United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 9

SEQ ID NO: 356785 - RNA, 21 nt, Human
ugcaggaaagugcugcgaccc

SEQ ID NO: 356786 - RNA, 22 nt, Human
ggucagccuuggauuugguagc

SEQ ID NO: 356787 - RNA, 22 nt, Human
cuuccugguuugaagcucgccg

SEQ ID NO: 356788 - RNA, 22 nt, Human
cgcagggauuucaaggggccuu

SEQ ID NO: 356789 - RNA, 22 nt, Human
uauggcuugucuuuauaccagg

SEQ ID NO: 356790 - RNA, 22 nt, Human
auuacacuuguucaucaucacc

SEQ ID NO: 356791 - RNA, 22 nt, Human
cagcucugaggaacacuccuuu

SEQ ID NO: 356792 - RNA, 22 nt, Human
uauuccuauuucuaaacauaug

SEQ ID NO: 356793 - RNA, 22 nt, Human
aggcugcuucagcugcagggag

SEQ ID NO: 356794 - RNA, 22 nt, Human
cugggccugucagggcuuuuug

SEQ ID NO: 356795 - RNA, 22 nt, Human
cgcugggggaacagcgagggug

SEQ ID NO: 356796 - RNA, 22 nt, Human
gcugucugcaucucuagagcuu

SEQ ID NO: 356797 - RNA, 22 nt, Human
agggcagcauugccuuucucca

SEQ ID NO: 356798 - RNA, 22 nt, Human
accaaggaguuugguauuuuag

SEQ ID NO: 356799 - RNA, 22 nt, Human
aaugugaaaccgcacagaauaa

SEQ ID NO: 356800 - RNA, 21 nt, Human
agcaacucugacuagaugagg

SEQ ID NO: 356801 - RNA, 22 nt, Human
gggcuggcgggaaaggcaauuc

SEQ ID NO: 356802 - RNA, 19 nt, Human
uuuggcacucugaaguguu

SEQ ID NO: 356803 - RNA, 22 nt, Human
gaggcaucugggcacagaagug

SEQ ID NO: 356804 - RNA, 22 nt, Human
agaauguagucuuggagauuua

SEQ ID NO: 356805 - RNA, 22 nt, Human
uuugaagaccuuaucucuaaau

SEQ ID NO: 356806 - RNA, 22 nt, Human
ucuccucaccaccagcagcaga

SEQ ID NO: 356807 - RNA, 22 nt, Human
cagugaaguuuaaaguguagau

SEQ ID NO: 356808 - RNA, 22 nt, Human
ugccaggcgauugcuaucagca

SEQ ID NO: 356809 - RNA, 22 nt, Human
aagacuuucaaaccuauguuug

SEQ ID NO: 356810 - RNA, 22 nt, Human
ugggcagacugagcccuguccc

SEQ ID NO: 356811 - RNA, 22 nt, Human
agguggaacguucaggugcuag

SEQ ID NO: 356812 - RNA, 22 nt, Human
ucagccucucugaguccagacc

SEQ ID NO: 356813 - RNA, 22 nt, Human
uggcugagaaguucugguggga

SEQ ID NO: 356814 - RNA, 20 nt, Human
ugaggcucagagagguugag

SEQ ID NO: 356815 - RNA, 22 nt, Human
aagguacaaaguauuauuuaaa

SEQ ID NO: 356816 - RNA, 22 nt, Human
aaggugugaagagaugggaaga

SEQ ID NO: 356817 - RNA, 22 nt, Human
uagcaggguaaauguagaugga

SEQ ID NO: 356818 - RNA, 22 nt, Human
ucuggagauaagacagacagau

SEQ ID NO: 356819 - RNA, 22 nt, Human
gcaaacaaggacauacauccug

SEQ ID NO: 356820 - RNA, 22 nt, Human
uggaguucucaggugagggcuu

SEQ ID NO: 356821 - RNA, 22 nt, Human
auuuccagugcacugaauagaa

SEQ ID NO: 356822 - RNA, 22 nt, Human
gagauuuaauuggauuaacuua

SEQ ID NO: 356823 - RNA, 22 nt, Human
ggucccaggcucccucuugucc

SEQ ID NO: 356824 - RNA, 22 nt, Human
ucugggcacugcugagccugua

SEQ ID NO: 356825 - RNA, 22 nt, Human
aaaugcauugguuucuacuugu

SEQ ID NO: 356826 - RNA, 22 nt, Human
augaggcaucuaacauugcaaa

SEQ ID NO: 356827 - RNA, 22 nt, Human
ugcugcacucaccaacagauaa

SEQ ID NO: 356828 - RNA, 22 nt, Human
aguggcagagccaaguagagcc

SEQ ID NO: 356829 - RNA, 22 nt, Human
cguuggagacacuugaggacuu

SEQ ID NO: 356830 - RNA, 22 nt, Human
agggucccgaaggagacagcaa

SEQ ID NO: 356831 - RNA, 22 nt, Human
cuggcaggaaguuagaugguaa

SEQ ID NO: 356832 - RNA, 22 nt, Human
agauuucagguuggggcagaag

SEQ ID NO: 356833 - RNA, 23 nt, Human
agccagggcacugguggagauug

SEQ ID NO: 356834 - RNA, 22 nt, Human
acugcccuguaacugccaggua

SEQ ID NO: 356835 - RNA, 22 nt, Human
uuugaaaguucuucugacacua

SEQ ID NO: 356836 - RNA, 22 nt, Human
uggccuguggcuuaaggucugu

SEQ ID NO: 356837 - RNA, 22 nt, Human
ccacucugcugugcuccaugau

SEQ ID NO: 356838 - RNA, 21 nt, Human
gggcagaggggccuccugggu

SEQ ID NO: 356839 - RNA, 22 nt, Human
gcugcagcucgccuuccggccu

SEQ ID NO: 356840 - RNA, 22 nt, Human
ggagccugcgggagcucccauu

SEQ ID NO: 356841 - RNA, 22 nt, Human
ugaaugaguuuggcugcuguuc

SEQ ID NO: 356842 - RNA, 22 nt, Human
gaguuauuuguagggauuauau

SEQ ID NO: 356843 - RNA, 18 nt, Human
uaaauauauuucccccuu

SEQ ID NO: 356844 - RNA, 22 nt, Human
ggcugccugccuccaagccggg

SEQ ID NO: 356845 - RNA, 22 nt, Human
auguuacauaguccuuauuugu

SEQ ID NO: 356846 - RNA, 22 nt, Human
cuggggcccaucgagggcugag

SEQ ID NO: 356847 - RNA, 23 nt, Human
aggcccugccugucccucuuuuu

SEQ ID NO: 356848 - RNA, 20 nt, Human
gcauccagacacccagcugc

SEQ ID NO: 356849 - RNA, 22 nt, Human
cccugcagaaccacagacaaac

SEQ ID NO: 356850 - RNA, 22 nt, Human
aaagccagagcaagcugucaca

SEQ ID NO: 356851 - RNA, 22 nt, Human
agccucuggcccuagacugcuu

SEQ ID NO: 356852 - RNA, 21 nt, Human
ugcagagauaucugaagcaga

SEQ ID NO: 356853 - RNA, 22 nt, Human
aguucuucauaaccuuacugug

SEQ ID NO: 356854 - RNA, 22 nt, Human
ugcucuggaguggcuugugcac

SEQ ID NO: 356855 - RNA, 22 nt, Human
ccaggcagagggauccccaucc

SEQ ID NO: 356856 - RNA, 22 nt, Human
ggcagauggaagaggcuggguc

SEQ ID NO: 356857 - RNA, 22 nt, Human
gcagagcaccaaagugaaagau

SEQ ID NO: 356858 - RNA, 22 nt, Human
agggcagcuagcuguagaaaga

SEQ ID NO: 356859 - RNA, 22 nt, Human
acagauuuuaaaugacacuccc

SEQ ID NO: 356860 - RNA, 22 nt, Human
ucucacagugcaggucugucuc

SEQ ID NO: 356861 - RNA, 22 nt, Human
gcaccugggcaaggauucagag

SEQ ID NO: 356862 - RNA, 22 nt, Human
uucuuuccucccagccuuugga

SEQ ID NO: 356863 - RNA, 22 nt, Human
cuaguucuagaucccugaggaa

SEQ ID NO: 356864 - RNA, 22 nt, Human
cagcagagacgguaagcagaac

SEQ ID NO: 356865 - RNA, 21 nt, Human
uugaaaguaaauucagcagcu

SEQ ID NO: 356866 - RNA, 22 nt, Human
ggucaggguuccagguaucuuc

SEQ ID NO: 356867 - RNA, 22 nt, Human
gaggccagcgcgcagcacuuuu

SEQ ID NO: 356868 - RNA, 22 nt, Human
ccugcagggugcugccacagau

SEQ ID NO: 356869 - RNA, 23 nt, Human
aguuuguaaagaaauauuugcac

SEQ ID NO: 356870 - RNA, 22 nt, Human
uucucuuuucaccaguugcuaa

SEQ ID NO: 356871 - RNA, 22 nt, Human
uuugcauuuauaaguuggugga

SEQ ID NO: 356872 - RNA, 22 nt, Human
guggagccaggaucuccgcaca

SEQ ID NO: 356873 - RNA, 20 nt, Human
ggcugccuccuuccuuuccu

SEQ ID NO: 356874 - RNA, 22 nt, Human
agggagccuuccuggcuguggu

SEQ ID NO: 356875 - RNA, 22 nt, Human
ccaguggguaggccauggugag

SEQ ID NO: 356876 - RNA, 22 nt, Human
gagccagguuggaggcugcagu

SEQ ID NO: 356877 - RNA, 22 nt, Human
ucuucucccaucuccaggcagg

SEQ ID NO: 356878 - RNA, 22 nt, Human
ucagggaccccucugaguggag

SEQ ID NO: 356879 - RNA, 22 nt, Human
ugaaaugacagucuuaagcucu

SEQ ID NO: 356880 - RNA, 22 nt, Human
ccaggcaggcgauggugcagug

SEQ ID NO: 356881 - RNA, 22 nt, Human
uuagugucuucuucauccucug

SEQ ID NO: 356882 - RNA, 22 nt, Human
ccaggccugcaucugcugcgca

SEQ ID NO: 356883 - RNA, 22 nt, Human
ugaucagucccaugaucuucca

SEQ ID NO: 356884 - RNA, 22 nt, Human
agagaacaaauuaaaggugguu

SEQ ID NO: 356885 - RNA, 21 nt, Human
aguguccuugaucuugccuug

SEQ ID NO: 356886 - RNA, 22 nt, Human
aaaccaucagauaauucauacu

SEQ ID NO: 356887 - RNA, 22 nt, Human
acaggugauucaggcucuggga

SEQ ID NO: 356888 - RNA, 22 nt, Human
cuuuacauaaggauaaaccugg

SEQ ID NO: 356889 - RNA, 22 nt, Human
acuggaucagaaucugauuuuu

SEQ ID NO: 356890 - RNA, 22 nt, Human
uuauucugcacuuuuaaaauau

SEQ ID NO: 356891 - RNA, 22 nt, Human
ggggauggaauguaguagugau

SEQ ID NO: 356892 - RNA, 22 nt, Human
gcuggcagggacagcugcgugu

SEQ ID NO: 356893 - RNA, 21 nt, Human
gggcgaggccugauguggcuc

SEQ ID NO: 356894 - RNA, 22 nt, Human
ggaguucacugugcaggcucug

SEQ ID NO: 356895 - RNA, 20 nt, Human
aguaggggaaugcaagagca

SEQ ID NO: 356896 - RNA, 22 nt, Human
aggagcagcccacuccuguccu

SEQ ID NO: 356897 - RNA, 22 nt, Human
uucagagagaaaccagugggaa

SEQ ID NO: 356898 - RNA, 21 nt, Human
ugucagcaacaauacuuucuc

SEQ ID NO: 356899 - RNA, 22 nt, Human
agcugcccccagggcugugcuu

SEQ ID NO: 356900 - RNA, 22 nt, Human
ugggccaggauuucaagacccu

SEQ ID NO: 356901 - RNA, 22 nt, Human
cacagcuucccaaaguggaccu

SEQ ID NO: 356902 - RNA, 22 nt, Human
cugugcuucgcaacuccaaggu

SEQ ID NO: 356903 - RNA, 22 nt, Human
aaugaacauauaaagagaucuu

SEQ ID NO: 356904 - RNA, 22 nt, Human
uuuguuuacucauucauugaug

SEQ ID NO: 356905 - RNA, 22 nt, Human
ccugcugggccugagcaaugag

SEQ ID NO: 356906 - RNA, 22 nt, Human
ucaguggagcuaagcaugagau

SEQ ID NO: 356907 - RNA, 22 nt, Human
aaguuucauuguucauguaaca

SEQ ID NO: 356908 - RNA, 22 nt, Human
agccuggcacugaggcagggcg

SEQ ID NO: 356909 - RNA, 22 nt, Human
agggcagcugugagccacugug

SEQ ID NO: 356910 - RNA, 22 nt, Human
aacagcuuugcuucuggagaca

SEQ ID NO: 356911 - RNA, 22 nt, Human
uuuccuaugauauucuaugugu

SEQ ID NO: 356912 - RNA, 22 nt, Human
ccuguccuccaagagcacaucu

SEQ ID NO: 356913 - RNA, 22 nt, Human
aaagccaguucuuagagaaagc

SEQ ID NO: 356914 - RNA, 22 nt, Human
cagcacugcuucgcagccaggg

SEQ ID NO: 356915 - RNA, 22 nt, Human
auagaaaacagauguccuuaaa

SEQ ID NO: 356916 - RNA, 22 nt, Human
cuuguccuuuacuugagacuca

SEQ ID NO: 356917 - RNA, 22 nt, Human
acauaaguuauggauaaaaugu

SEQ ID NO: 356918 - RNA, 22 nt, Human
ucucuccuuaucauuguguuua

SEQ ID NO: 356919 - RNA, 22 nt, Human
uuuaucuuuaggacuuugcaga

SEQ ID NO: 356920 - RNA, 22 nt, Human
agccaggcgcaguggcuuaugc

SEQ ID NO: 356921 - RNA, 22 nt, Human
gauuuacagaucuaagggucac

SEQ ID NO: 356922 - RNA, 22 nt, Human
caaauauuccagguacaucccu

SEQ ID NO: 356923 - RNA, 17 nt, Human
cagacagauauccuggg

SEQ ID NO: 356924 - RNA, 19 nt, Human
uagaggagaagggaagugg

SEQ ID NO: 356925 - RNA, 22 nt, Human
cccuggaguagcacugggucgc

SEQ ID NO: 356926 - RNA, 22 nt, Human
agccucugcuuaugcaaaggua

SEQ ID NO: 356927 - RNA, 18 nt, Human
cucucuggucuggauccc

SEQ ID NO: 356928 - RNA, 22 nt, Human
ccugggucacucaggcaggcgg

SEQ ID NO: 356929 - RNA, 22 nt, Human
ccugugugcacacgaggccaug

SEQ ID NO: 356930 - RNA, 22 nt, Human
ucuggagaacuugcaagaggau

SEQ ID NO: 356931 - RNA, 22 nt, Human
cuucugcaauaaguuuuggucc

SEQ ID NO: 356932 - RNA, 20 nt, Human
cugcugugauucccuccucc

SEQ ID NO: 356933 - RNA, 22 nt, Human
uugaauaauauguucaggagga

SEQ ID NO: 356934 - RNA, 22 nt, Human
ugcugucugcaacaguacuaca

SEQ ID NO: 356935 - RNA, 22 nt, Human
acugggccggugcagaguaguu

SEQ ID NO: 356936 - RNA, 21 nt, Human
agaggccuuacaggauagacc

SEQ ID NO: 356937 - RNA, 22 nt, Human
uuacaguaugaucaacuuuuca

SEQ ID NO: 356938 - RNA, 20 nt, Human
ucugaggcugagcucuacuu

SEQ ID NO: 356939 - RNA, 22 nt, Human
aaagcagauucugaugcaguag

SEQ ID NO: 356940 - RNA, 22 nt, Human
ugggcugcuucuauuggugguc

SEQ ID NO: 356941 - RNA, 22 nt, Human
ccagcuccaggacugggagcug

SEQ ID NO: 356942 - RNA, 22 nt, Human
cagugcaggcugggggcccugc

SEQ ID NO: 356943 - RNA, 22 nt, Human
ugggcuggcccaccacaccucg

SEQ ID NO: 356944 - RNA, 22 nt, Human
gagggggagaugugcacacacu

SEQ ID NO: 356945 - RNA, 22 nt, Human
uaucaacauuaauauuuucugg

SEQ ID NO: 356946 - RNA, 22 nt, Human
ccagagggccuuuggaguuauc

SEQ ID NO: 356947 - RNA, 22 nt, Human
ugggccacgugacccuuacccu

SEQ ID NO: 356948 - RNA, 22 nt, Human
caauuucacuaaugaugugggg

SEQ ID NO: 356949 - RNA, 22 nt, Human
cuuauuuuaagucaguuugggu

SEQ ID NO: 356950 - RNA, 22 nt, Human
ccagccacugggccacugccag

SEQ ID NO: 356951 - RNA, 22 nt, Human
ggaagccagaaagugagaauau

SEQ ID NO: 356952 - RNA, 22 nt, Human
uaaaugcaguuaguacuugcca

SEQ ID NO: 356953 - RNA, 22 nt, Human
ccucuguccuggggaguggagc

SEQ ID NO: 356954 - RNA, 22 nt, Human
ugccuguccugaggaugagggu

SEQ ID NO: 356955 - RNA, 22 nt, Human
aagaaaucauaucauuucuugg

SEQ ID NO: 356956 - RNA, 22 nt, Human
cuauuacauuucuggacauuca

SEQ ID NO: 356957 - RNA, 20 nt, Human
cagcaguggaugagaguuuu

SEQ ID NO: 356958 - RNA, 22 nt, Human
aaacaugagcaucucuucaagc

SEQ ID NO: 356959 - RNA, 22 nt, Human
aggcuggcuggcaggggacaca

SEQ ID NO: 356960 - RNA, 23 nt, Human
gagcugggauacaggcuuacugc

SEQ ID NO: 356961 - RNA, 22 nt, Human
ugccaggcagugucagauugag

SEQ ID NO: 356962 - RNA, 22 nt, Human
cagagccugcucacgucucugu

SEQ ID NO: 356963 - RNA, 22 nt, Human
ggcauuuagauugaauuucugu

SEQ ID NO: 356964 - RNA, 22 nt, Human
gccagagguucaacaacugucu

SEQ ID NO: 356965 - RNA, 22 nt, Human
ucuuugcaugugcuucuuggcc

SEQ ID NO: 356966 - RNA, 22 nt, Human
cugugcauugucuugucuguag

SEQ ID NO: 356967 - RNA, 19 nt, Human
augauacaggugaaaauug

SEQ ID NO: 356968 - RNA, 22 nt, Human
acacagccgugaaucugcuucu

SEQ ID NO: 356969 - RNA, 22 nt, Human
aucaggaaauacuuauuuauaa

SEQ ID NO: 356970 - RNA, 19 nt, Human
uuagccauccacagugaaa

SEQ ID NO: 356971 - RNA, 22 nt, Human
uuucccaguucccugcucuaua

SEQ ID NO: 356972 - RNA, 22 nt, Human
gccagcagguggagagaucaag

SEQ ID NO: 356973 - RNA, 22 nt, Human
gcagagaaaguuuuguccucag

SEQ ID NO: 356974 - RNA, 22 nt, Human
uuugucagucaugucugcuuuu

SEQ ID NO: 356975 - RNA, 20 nt, Human
agagccuggaaaaagacauc

SEQ ID NO: 356976 - RNA, 22 nt, Human
gcaggaugggagcuucacucug

SEQ ID NO: 356977 - RNA, 21 nt, Human
cugaggcagcacagcuaguca

SEQ ID NO: 356978 - RNA, 22 nt, Human
gcugcagcuuuaggauccagug

SEQ ID NO: 356979 - RNA, 22 nt, Human
cccuggagcuagucugagcaga

SEQ ID NO: 356980 - RNA, 22 nt, Human
ccucagagaaagguauggcuga

SEQ ID NO: 356981 - RNA, 22 nt, Human
acuuugaaagccuuggccccgg

SEQ ID NO: 356982 - RNA, 22 nt, Human
acagguggcauaggcaguuuga

SEQ ID NO: 356983 - RNA, 22 nt, Human
ucuguaucuaauuuuacaguag

SEQ ID NO: 356984 - RNA, 21 nt, Human
aggcaucuaaagagaguagac

SEQ ID NO: 356985 - RNA, 22 nt, Human
ugccuguguccccuucuuggca

SEQ ID NO: 356986 - RNA, 17 nt, Human
cucagaguugcuuuguc

SEQ ID NO: 356987 - RNA, 22 nt, Human
uuugcauugcagugguuuacag

SEQ ID NO: 356988 - RNA, 22 nt, Human
ccucuuccacugggccccaucc

SEQ ID NO: 356989 - RNA, 22 nt, Human
uccuuuggagcuugacugguag

SEQ ID NO: 356990 - RNA, 22 nt, Human
uggggcuggcuauugucucccu

SEQ ID NO: 356991 - RNA, 22 nt, Human
acccaggacaugggcacccgug

SEQ ID NO: 356992 - RNA, 22 nt, Human
cuuccaaacccaggguaugggc

SEQ ID NO: 356993 - RNA, 22 nt, Human
ccaggcugcuuagccuuaucuu

SEQ ID NO: 356994 - RNA, 22 nt, Human
caaauguguaaggaaguguuag

SEQ ID NO: 356995 - RNA, 22 nt, Human
aagugagauuauauguacggga

SEQ ID NO: 356996 - RNA, 22 nt, Human
ugggcagacgggagcuugccuu

SEQ ID NO: 356997 - RNA, 22 nt, Human
cagcaggguagguuguaucagu

SEQ ID NO: 356998 - RNA, 22 nt, Human
cagccugggcuccagagucccu

SEQ ID NO: 356999 - RNA, 22 nt, Human
accauccugaaaccuucaugcu

SEQ ID NO: 357000 - RNA, 23 nt, Human
cagcaggagggugccugggcugc

SEQ ID NO: 357001 - RNA, 22 nt, Human
cauuuacacuucuaaccacaag

SEQ ID NO: 357002 - RNA, 20 nt, Human
cccugagacaaaggaggggc

SEQ ID NO: 357003 - RNA, 22 nt, Human
aaagacugguguguuacauaua

SEQ ID NO: 357004 - RNA, 22 nt, Human
ugcagggaaucuguggcuggac

SEQ ID NO: 357005 - RNA, 22 nt, Human
ccucuccuugcacccgucccgc

SEQ ID NO: 357006 - RNA, 22 nt, Human
uuuaauauucugcauucuccuu

SEQ ID NO: 357007 - RNA, 22 nt, Human
gagacagcagggccagggccug

SEQ ID NO: 357008 - RNA, 22 nt, Human
auacagaagaccccuccgucau

SEQ ID NO: 357009 - RNA, 22 nt, Human
uuccagaagccuccauauuacu

SEQ ID NO: 357010 - RNA, 17 nt, Human
cccaugagcccacuccc

SEQ ID NO: 357011 - RNA, 22 nt, Human
cuccagaagacccauccucaug

SEQ ID NO: 357012 - RNA, 17 nt, Human
uuagcaaaauagcacuu

SEQ ID NO: 357013 - RNA, 22 nt, Human
acagaauuuacacaucucuaaa

SEQ ID NO: 357014 - RNA, 22 nt, Human
augauggugagguugagcacag

SEQ ID NO: 357015 - RNA, 21 nt, Human
gagacagcccagugccagggc

SEQ ID NO: 357016 - RNA, 22 nt, Human
uuaaaaugaauauugauuagca

SEQ ID NO: 357017 - RNA, 22 nt, Human
cuuaggcagacugcugaugcag

SEQ ID NO: 357018 - RNA, 22 nt, Human
cagagcugagaauguugaugcu

SEQ ID NO: 357019 - RNA, 22 nt, Human
auuuucaucauggguuuaacau

SEQ ID NO: 357020 - RNA, 22 nt, Human
agaaagcaucuccauuguaggu

SEQ ID NO: 357021 - RNA, 22 nt, Human
uugaauucauuucucauugagu

SEQ ID NO: 357022 - RNA, 22 nt, Human
ugcauacacaagcauacaugua

SEQ ID NO: 357023 - RNA, 22 nt, Human
ggccugagcagacagcaugaug

SEQ ID NO: 357024 - RNA, 22 nt, Human
gcccaggagguggaggugcagu

SEQ ID NO: 357025 - RNA, 22 nt, Human
cagcccuggugccaagguuccc

SEQ ID NO: 357026 - RNA, 21 nt, Human
ucaguaaaccuaaagauugua

SEQ ID NO: 357027 - RNA, 22 nt, Human
uagaauucaagauucaacaggc

SEQ ID NO: 357028 - RNA, 22 nt, Human
auccaugauuaguaggauaaag

SEQ ID NO: 357029 - RNA, 22 nt, Human
aaagaauuuguacacccuacua

SEQ ID NO: 357030 - RNA, 22 nt, Human
cagggcugucuccaaaggcccc

SEQ ID NO: 357031 - RNA, 22 nt, Human
ugcuagugcaggguuuucaguu

SEQ ID NO: 357032 - RNA, 22 nt, Human
guacccagaggcaugaucccag

SEQ ID NO: 357033 - RNA, 22 nt, Human
auauucuuccaaaacaucauuu

SEQ ID NO: 357034 - RNA, 22 nt, Human
uccagagccuauauguucaacu

SEQ ID NO: 357035 - RNA, 22 nt, Human
gugccugguuuggggaguguuc

SEQ ID NO: 357036 - RNA, 22 nt, Human
gguuucaacuuuugugaggaau

SEQ ID NO: 357037 - RNA, 22 nt, Human
ucacuccucauugcugcccauu

SEQ ID NO: 357038 - RNA, 22 nt, Human
uggcacugaccccaggccugug

SEQ ID NO: 357039 - RNA, 22 nt, Human
cacaggcugcccgcagcuggga

SEQ ID NO: 357040 - RNA, 22 nt, Human
ggaggggccggcugccugccac

SEQ ID NO: 357041 - RNA, 22 nt, Human
ccagggcaugggaagaacugaa

SEQ ID NO: 357042 - RNA, 22 nt, Human
augaaggcuguguggagccccc

SEQ ID NO: 357043 - RNA, 20 nt, Human
ccagcugagccaaggggaga

SEQ ID NO: 357044 - RNA, 22 nt, Human
ucccugggccacagcugugagc

SEQ ID NO: 357045 - RNA, 22 nt, Human
uccaggagucagacagauggug

SEQ ID NO: 357046 - RNA, 22 nt, Human
auagaaauggcagcuggugcua

SEQ ID NO: 357047 - RNA, 22 nt, Human
gaauuucaggacaacuggaagg

SEQ ID NO: 357048 - RNA, 22 nt, Human
cagucaccuugaggacucagac

SEQ ID NO: 357049 - RNA, 22 nt, Human
ccuggcaggcuggggacagugc

SEQ ID NO: 357050 - RNA, 22 nt, Human
uuaacacuugaacucuacaugu

SEQ ID NO: 357051 - RNA, 22 nt, Human
uccauccauguaggaagauggu

SEQ ID NO: 357052 - RNA, 22 nt, Human
auccaguuuaugucauauucuu

SEQ ID NO: 357053 - RNA, 22 nt, Human
aggucaaaccacagcucuaggc

SEQ ID NO: 357054 - RNA, 22 nt, Human
ccagaggaugcuggucagccuc

SEQ ID NO: 357055 - RNA, 22 nt, Human
aggcagcuuucuggugcaccau

SEQ ID NO: 357056 - RNA, 22 nt, Human
cacguuuuaugacagaagaagc

SEQ ID NO: 357057 - RNA, 22 nt, Human
gacaggggucccucugggcugu

SEQ ID NO: 357058 - RNA, 22 nt, Human
uuugacaggacuaacauauggc

SEQ ID NO: 357059 - RNA, 22 nt, Human
aaaauugagagucuugugcaag

SEQ ID NO: 357060 - RNA, 22 nt, Human
ccucccucuguuagagcugucu

SEQ ID NO: 357061 - RNA, 22 nt, Human
gcaggaugggagcuucacuuug

SEQ ID NO: 357062 - RNA, 22 nt, Human
ucuuuccuacuuuauugugaac

SEQ ID NO: 357063 - RNA, 19 nt, Human
caguggccuggaggucucu

SEQ ID NO: 357064 - RNA, 22 nt, Human
gaguggagcaaaagagguagau

SEQ ID NO: 357065 - RNA, 22 nt, Human
ccccuuccuuccucagacagcc

SEQ ID NO: 357066 - RNA, 19 nt, Human
acuguaaggcauuuuuuuc

SEQ ID NO: 357067 - RNA, 22 nt, Human
guggccugccgugugguauggg

SEQ ID NO: 357068 - RNA, 22 nt, Human
uagauuucgcugcaucucaauc

SEQ ID NO: 357069 - RNA, 22 nt, Human
uuccucagacccucauugugag

SEQ ID NO: 357070 - RNA, 22 nt, Human
gagauggggaauaggagcaagc

SEQ ID NO: 357071 - RNA, 22 nt, Human
caccaggcugcccaggacaggg

SEQ ID NO: 357072 - RNA, 22 nt, Human
gagcucuguguagccugagggu

SEQ ID NO: 357073 - RNA, 17 nt, Human
uccuucagugccucugc

SEQ ID NO: 357074 - RNA, 22 nt, Human
agggcccaggacagcaucaggg

SEQ ID NO: 357075 - RNA, 22 nt, Human
gggaaggagguggcuugaagug

SEQ ID NO: 357076 - RNA, 22 nt, Human
uggagcaggacggggaguggua

SEQ ID NO: 357077 - RNA, 22 nt, Human
gggcagcagcaggaggucucug

SEQ ID NO: 357078 - RNA, 22 nt, Human
cagcuccccaugguuccugaag

SEQ ID NO: 357079 - RNA, 22 nt, Human
uccaggagggggagccgugccg

SEQ ID NO: 357080 - RNA, 22 nt, Human
gauagaaagagugguucuuuuu

SEQ ID NO: 357081 - RNA, 22 nt, Human
gaugauaacagcauuucaacug

SEQ ID NO: 357082 - RNA, 22 nt, Human
gcaggagagccagcaggcuucc

SEQ ID NO: 357083 - RNA, 22 nt, Human
ggcuguggggccggguacagug

SEQ ID NO: 357084 - RNA, 22 nt, Human
gguuugaacagcuuuggagaag

SEQ ID NO: 357085 - RNA, 23 nt, Human
gagauuuagcagacaaagcucuu

SEQ ID NO: 357086 - RNA, 22 nt, Human
uuguuaaaaugcauauucuggu

SEQ ID NO: 357087 - RNA, 22 nt, Human
aggcuuuaaguggccuacagcu

SEQ ID NO: 357088 - RNA, 19 nt, Human
gccaggagggcucuggcug

SEQ ID NO: 357089 - RNA, 22 nt, Human
uggcugagggggcaguucagga

SEQ ID NO: 357090 - RNA, 22 nt, Human
agcgggugcugugucagcccuc

SEQ ID NO: 357091 - RNA, 22 nt, Human
auaaggcagugacuucaucuau

SEQ ID NO: 357092 - RNA, 22 nt, Human
gcagccacagaggagggaugca

SEQ ID NO: 357093 - RNA, 22 nt, Human
gcucaggaaacagcagggcuug

SEQ ID NO: 357094 - RNA, 23 nt, Human
gcauugucuccccacuucugggc

SEQ ID NO: 357095 - RNA, 22 nt, Human
gaguccuuuucucuguccacug

SEQ ID NO: 357096 - RNA, 22 nt, Human
ccaaaugugccuguuucaacaa

SEQ ID NO: 357097 - RNA, 22 nt, Human
acauaauagguaccugaauaau

SEQ ID NO: 357098 - RNA, 16 nt, Human
gggagggaguuggugg

SEQ ID NO: 357099 - RNA, 22 nt, Human
agcaggguuuggggauuggcac

SEQ ID NO: 357100 - RNA, 22 nt, Human
agaggacagguuuuccaugggc

SEQ ID NO: 357101 - RNA, 22 nt, Human
gcagagugauggaaugugggug

SEQ ID NO: 357102 - RNA, 22 nt, Human
accuggcaugaagcaugccuua

SEQ ID NO: 357103 - RNA, 22 nt, Human
agcaccaucagaugcaauaucu

SEQ ID NO: 357104 - RNA, 20 nt, Human
ugggcugaggaucaggugcc

SEQ ID NO: 357105 - RNA, 22 nt, Human
uauuucugaauccaaaagguca

SEQ ID NO: 357106 - RNA, 23 nt, Human
agaguccacaagauuuuccagug

SEQ ID NO: 357107 - RNA, 22 nt, Human
ucuuuacaguccucugucaauc

SEQ ID NO: 357108 - RNA, 22 nt, Human
agggagccagaguugggagcuc

SEQ ID NO: 357109 - RNA, 22 nt, Human
aaaagucagucucuccuagcuc

SEQ ID NO: 357110 - RNA, 22 nt, Human
uccugcaggcuugaguccucag

SEQ ID NO: 357111 - RNA, 22 nt, Human
ccaaguacagauuccuccacug

SEQ ID NO: 357112 - RNA, 22 nt, Human
ggcagccaugcacgcugccugg

SEQ ID NO: 357113 - RNA, 23 nt, Human
gggcagcuuaagcuuguuuuucu

SEQ ID NO: 357114 - RNA, 22 nt, Human
uccuguggcguuaucaugugau

SEQ ID NO: 357115 - RNA, 22 nt, Human
uguauguaaaguuuguaauaga

SEQ ID NO: 357116 - RNA, 22 nt, Human
ccagcuggcaggagagucaggg

SEQ ID NO: 357117 - RNA, 22 nt, Human
aguauugugacucaaguauucu

SEQ ID NO: 357118 - RNA, 22 nt, Human
gagcugcugguugcuggugccu

SEQ ID NO: 357119 - RNA, 22 nt, Human
acaggcagguaauuuacauauu

SEQ ID NO: 357120 - RNA, 22 nt, Human
agcuuuauuugucauucacggc

SEQ ID NO: 357121 - RNA, 22 nt, Human
augguuuguaacccaauacucc

SEQ ID NO: 357122 - RNA, 22 nt, Human
ucccuguccugggcaaucccag

SEQ ID NO: 357123 - RNA, 22 nt, Human
guggcagugugaggauccugcu

SEQ ID NO: 357124 - RNA, 22 nt, Human
aagauguaucaguuaagucuuc

SEQ ID NO: 357125 - RNA, 22 nt, Human
agggccagaaucccucagucua

SEQ ID NO: 357126 - RNA, 22 nt, Human
gagagcugggcuuugggugaag

SEQ ID NO: 357127 - RNA, 22 nt, Human
ggccagaggccauccuccugcu

SEQ ID NO: 357128 - RNA, 22 nt, Human
acucugaggagugacuagaggu

SEQ ID NO: 357129 - RNA, 22 nt, Human
cuuuaacaaaugacucuugucu

SEQ ID NO: 357130 - RNA, 22 nt, Human
ugucuucaucucagacacaguu

SEQ ID NO: 357131 - RNA, 22 nt, Human
ugggccaggcaugugaucagca

SEQ ID NO: 357132 - RNA, 22 nt, Human
uuuacuuugugucaagucaaga

SEQ ID NO: 357133 - RNA, 22 nt, Human
ucccuggcugggggcugccuug

SEQ ID NO: 357134 - RNA, 22 nt, Human
uucaaacaguguagaauauaug

SEQ ID NO: 357135 - RNA, 22 nt, Human
ccucacuuuccuuucuccuggg

SEQ ID NO: 357136 - RNA, 22 nt, Human
auggcuuaugaauaacaguagg

SEQ ID NO: 357137 - RNA, 22 nt, Human
aagcugcagacccccugucuca

SEQ ID NO: 357138 - RNA, 22 nt, Human
aggcugcuucaauggauaagau

SEQ ID NO: 357139 - RNA, 22 nt, Human
aaucuucacagagaaaauuagg

SEQ ID NO: 357140 - RNA, 22 nt, Human
uccucagaugcucuuggacgcc

SEQ ID NO: 357141 - RNA, 22 nt, Human
ucagagaacacagaggugaugu

SEQ ID NO: 357142 - RNA, 21 nt, Human
gccacugcacuccagccuggg

SEQ ID NO: 357143 - RNA, 22 nt, Human
agucccagccuaggcugugcug

SEQ ID NO: 357144 - RNA, 22 nt, Human
uccaggaguccugggagugauu

SEQ ID NO: 357145 - RNA, 22 nt, Human
ucagcugccuuucccaugcuag

SEQ ID NO: 357146 - RNA, 22 nt, Human
agagcuggggccagagucaagg

SEQ ID NO: 357147 - RNA, 22 nt, Human
auuuauuaagcaucugcuaugu

SEQ ID NO: 357148 - RNA, 22 nt, Human
uaggaaaaauacagaauuauau

SEQ ID NO: 357149 - RNA, 22 nt, Human
ugcuuuaucugacuuggcgcug

SEQ ID NO: 357150 - RNA, 22 nt, Human
uugauaaaaugauaucuucuuu

SEQ ID NO: 357151 - RNA, 22 nt, Human
gccaggcaguucaaguacacca

SEQ ID NO: 357152 - RNA, 22 nt, Human
uaucuguuaggaucagagcugg

SEQ ID NO: 357153 - RNA, 22 nt, Human
cugcuguggccagccaggucaa

SEQ ID NO: 357154 - RNA, 22 nt, Human
uuuccaagacuccaguucuccc

SEQ ID NO: 357155 - RNA, 18 nt, Human
ucaggagacacagacgca

SEQ ID NO: 357156 - RNA, 22 nt, Human
aagucauuaucucuucuaaucu

SEQ ID NO: 357157 - RNA, 22 nt, Human
cacugaaggaaggacuacugca

SEQ ID NO: 357158 - RNA, 22 nt, Human
ugaaguccuagaacuccuggua

SEQ ID NO: 357159 - RNA, 22 nt, Human
caggagccgccaggcacguugg

SEQ ID NO: 357160 - RNA, 22 nt, Human
uuggaucacucugaagccuuac

SEQ ID NO: 357161 - RNA, 22 nt, Human
uuucacauaucaacucuauccu

SEQ ID NO: 357162 - RNA, 22 nt, Human
cagaaauggaauuuuccaucac

SEQ ID NO: 357163 - RNA, 22 nt, Human
ggaggagggguuuacauuggaa

SEQ ID NO: 357164 - RNA, 22 nt, Human
uucuucaauuuuccauauacug

SEQ ID NO: 357165 - RNA, 22 nt, Human
gaagagcugcucagaacaugau

SEQ ID NO: 357166 - RNA, 22 nt, Human
augcuguguccuagugaaagaa

SEQ ID NO: 357167 - RNA, 22 nt, Human
aagggagacaguugugugagga

SEQ ID NO: 357168 - RNA, 22 nt, Human
auuguuaugaaaauaagauguu

SEQ ID NO: 357169 - RNA, 17 nt, Human
aggcuggcucacaggga

SEQ ID NO: 357170 - RNA, 22 nt, Human
ucuucacaggagccugccugcc

SEQ ID NO: 357171 - RNA, 22 nt, Human
guccucuggaagaugaguucuu

SEQ ID NO: 357172 - RNA, 22 nt, Human
gcucacagccggcuggcagggg

SEQ ID NO: 357173 - RNA, 22 nt, Human
uuuccaaaggaggaaccaguuu

SEQ ID NO: 357174 - RNA, 22 nt, Human
uaucuuuaacuugcaguauuua

SEQ ID NO: 357175 - RNA, 22 nt, Human
uggcagagucugggcuugggca

SEQ ID NO: 357176 - RNA, 22 nt, Human
aggugcaguggcucaugccugu

SEQ ID NO: 357177 - RNA, 22 nt, Human
ucagcuuucucagaggccuaac

SEQ ID NO: 357178 - RNA, 22 nt, Human
agggcccuagggaaugagacau

SEQ ID NO: 357179 - RNA, 21 nt, Human
ggcagccucuguggaagggga

SEQ ID NO: 357180 - RNA, 19 nt, Human
gaucagagugucagcuugu

SEQ ID NO: 357181 - RNA, 22 nt, Human
aagaggucauaccagauaaggg

SEQ ID NO: 357182 - RNA, 22 nt, Human
cagaggcuaagaugagugggug

SEQ ID NO: 357183 - RNA, 22 nt, Human
uucugugauugacauguggcuu

SEQ ID NO: 357184 - RNA, 22 nt, Human
aggcccagggcugcucucugaa

SEQ ID NO: 357185 - RNA, 22 nt, Human
acccaggacucucuuccaguag

SEQ ID NO: 357186 - RNA, 17 nt, Human
ugcuuaauuuugacugg

SEQ ID NO: 357187 - RNA, 22 nt, Human
ggcaaggccuugcccagcauuc

SEQ ID NO: 357188 - RNA, 22 nt, Human
uuacagaagagaaagaauucag

SEQ ID NO: 357189 - RNA, 22 nt, Human
ugucaugccaggaaauaguccc

SEQ ID NO: 357190 - RNA, 22 nt, Human
aaguuugagagccuuuaguaua

SEQ ID NO: 357191 - RNA, 22 nt, Human
agggaagaagcugguaguaggu

SEQ ID NO: 357192 - RNA, 22 nt, Human
uggcucagcugucacagccugg

SEQ ID NO: 357193 - RNA, 22 nt, Human
cagcuugggaguuugguuuuau

SEQ ID NO: 357194 - RNA, 22 nt, Human
aggucauuccagccauuccccu

SEQ ID NO: 357195 - RNA, 22 nt, Human
ucaggagacuggcagugcccac

SEQ ID NO: 357196 - RNA, 18 nt, Human
agcagagcccaugcauuc

SEQ ID NO: 357197 - RNA, 19 nt, Human
cugugcaggccgggcugag

SEQ ID NO: 357198 - RNA, 22 nt, Human
uauguacaaucagcaguucaua

SEQ ID NO: 357199 - RNA, 22 nt, Human
uuacuuugcuuucucauuacag

SEQ ID NO: 357200 - RNA, 23 nt, Human
uccuuccuuugagaggcuccauc

SEQ ID NO: 357201 - RNA, 22 nt, Human
aagggcugaaugaaggguugaa

SEQ ID NO: 357202 - RNA, 22 nt, Human
aggcucagggacggggccccuu

SEQ ID NO: 357203 - RNA, 22 nt, Human
agggggcaucagguccuggcuc

SEQ ID NO: 357204 - RNA, 22 nt, Human
aauuuccaaauuucugucacac

SEQ ID NO: 357205 - RNA, 22 nt, Human
gcacagggccuggcacauaaga

SEQ ID NO: 357206 - RNA, 22 nt, Human
uaugcuguggaaaauacaaaga

SEQ ID NO: 357207 - RNA, 19 nt, Human
uacuaaacaugcauauugg

SEQ ID NO: 357208 - RNA, 22 nt, Human
uggcagguuuccuccucauagu

SEQ ID NO: 357209 - RNA, 22 nt, Human
uauguagaagcugcucaaagaa

SEQ ID NO: 357210 - RNA, 22 nt, Human
uaugauuuguagacauuugauu

SEQ ID NO: 357211 - RNA, 22 nt, Human
ucaggggacuuaggagagaagu

SEQ ID NO: 357212 - RNA, 22 nt, Human
cggagaggaccugcaacucgcu

SEQ ID NO: 357213 - RNA, 22 nt, Human
ggcagcuggguuggccagaaac

SEQ ID NO: 357214 - RNA, 22 nt, Human
agcugccauccuguucagcacc

SEQ ID NO: 357215 - RNA, 18 nt, Human
gcugccugcauuccucac

SEQ ID NO: 357216 - RNA, 22 nt, Human
uaugaguacaaggacucugucu

SEQ ID NO: 357217 - RNA, 22 nt, Human
ucugugcaggaagucauuauga

SEQ ID NO: 357218 - RNA, 22 nt, Human
agggccugacacccuugccagc

SEQ ID NO: 357219 - RNA, 22 nt, Human
uggcagcugcguuguguuucug

SEQ ID NO: 357220 - RNA, 22 nt, Human
gcaaaugaguuguaacauaaaa

SEQ ID NO: 357221 - RNA, 22 nt, Human
cucuuucugauucgcugggacc

SEQ ID NO: 357222 - RNA, 22 nt, Human
agguaggggguuugggaacugc

SEQ ID NO: 357223 - RNA, 22 nt, Human
accagcugcugauugcuaaaug

SEQ ID NO: 357224 - RNA, 22 nt, Human
uccaggaguccuggguggcccc

SEQ ID NO: 357225 - RNA, 22 nt, Human
cuacagaaaaucagccacaggc

SEQ ID NO: 357226 - RNA, 22 nt, Human
aggcuucuacguggucccaggg

SEQ ID NO: 357227 - RNA, 22 nt, Human
uucagaaagguuaaucuggauu

SEQ ID NO: 357228 - RNA, 22 nt, Human
agcuuuaucuucaccugggaau

SEQ ID NO: 357229 - RNA, 21 nt, Human
ucugucugguuuuagaguggc

SEQ ID NO: 357230 - RNA, 18 nt, Human
agccuggaggguugaagu

SEQ ID NO: 357231 - RNA, 22 nt, Human
ugucaccaugcgaggcuaauuu

SEQ ID NO: 357232 - RNA, 19 nt, Human
agccuggagggcuggucac

SEQ ID NO: 357233 - RNA, 22 nt, Human
gugucauggaaaauugcaaugg

SEQ ID NO: 357234 - RNA, 22 nt, Human
aacaaaugauaccaguucucaa

SEQ ID NO: 357235 - RNA, 22 nt, Human
gccagcucagugccaggccccu

SEQ ID NO: 357236 - RNA, 22 nt, Human
gcaggcuggucugaccaucccu

SEQ ID NO: 357237 - RNA, 22 nt, Human
aaagcuaugaggcaugcauuuc

SEQ ID NO: 357238 - RNA, 22 nt, Human
agccuccaguagcugaagagac

SEQ ID NO: 357239 - RNA, 22 nt, Human
acagggccauuaucuguucuag

SEQ ID NO: 357240 - RNA, 22 nt, Human
acucagaaccauuuacucugag

SEQ ID NO: 357241 - RNA, 22 nt, Human
agggucagagucaggugcagua

SEQ ID NO: 357242 - RNA, 22 nt, Human
ggcagacuguaauaggagaauu

SEQ ID NO: 357243 - RNA, 22 nt, Human
uuucuacauucaaaaacuacca

SEQ ID NO: 357244 - RNA, 22 nt, Human
ucucccacagucucccauggcu

SEQ ID NO: 357245 - RNA, 22 nt, Human
gggacugggagauccuccuggc

SEQ ID NO: 357246 - RNA, 22 nt, Human
agccacagcauguguguaugua

SEQ ID NO: 357247 - RNA, 22 nt, Human
agccagcaggugagugcagccu

SEQ ID NO: 357248 - RNA, 22 nt, Human
uauuccaacugucauagucaua

SEQ ID NO: 357249 - RNA, 22 nt, Human
ugugaagguaaggaggggcaag

SEQ ID NO: 357250 - RNA, 22 nt, Human
uuuccucuuugugacacagcug

SEQ ID NO: 357251 - RNA, 22 nt, Human
gcugccugauguccagcaggac

SEQ ID NO: 357252 - RNA, 22 nt, Human
uggcugggccgggccuugugcc

SEQ ID NO: 357253 - RNA, 22 nt, Human
acagauguacacucauauauaa

SEQ ID NO: 357254 - RNA, 22 nt, Human
gcuauacaaguguagaauagag

SEQ ID NO: 357255 - RNA, 22 nt, Human
ucuguaucacccguucccagaa

SEQ ID NO: 357256 - RNA, 22 nt, Human
aggucacccguuugacuaucca

SEQ ID NO: 357257 - RNA, 19 nt, Human
ggucagcugggcuagaggc

SEQ ID NO: 357258 - RNA, 22 nt, Human
guuuaaucagaggaauuauaga

SEQ ID NO: 357259 - RNA, 22 nt, Human
auuccaaagguuaaugcccauu

SEQ ID NO: 357260 - RNA, 22 nt, Human
ucuuuccuaggugauaugcaau

SEQ ID NO: 357261 - RNA, 19 nt, Human
acaagggcaggcaagguga

SEQ ID NO: 357262 - RNA, 22 nt, Human
gccacugcacuccagcccaggc

SEQ ID NO: 357263 - RNA, 22 nt, Human
ccaugcacaccagcaggcagac

SEQ ID NO: 357264 - RNA, 22 nt, Human
uucuucaguuugguaaauguaa

SEQ ID NO: 357265 - RNA, 22 nt, Human
aaauauaauuucugccucaaua

SEQ ID NO: 357266 - RNA, 22 nt, Human
augaguaagaccauaauuuuug

SEQ ID NO: 357267 - RNA, 22 nt, Human
ccaaagugcugggguuacaggc

SEQ ID NO: 357268 - RNA, 22 nt, Human
aagcuuucagagcagaauguga

SEQ ID NO: 357269 - RNA, 22 nt, Human
agcugcaguaaagcucuccagg

SEQ ID NO: 357270 - RNA, 22 nt, Human
aaagccuuugucucaggcucug

SEQ ID NO: 357271 - RNA, 22 nt, Human
uuucucaaguucagauauuuga

SEQ ID NO: 357272 - RNA, 22 nt, Human
augcuuaauacacuguuaaagg

SEQ ID NO: 357273 - RNA, 22 nt, Human
uggagcagcuaagccucugaga

SEQ ID NO: 357274 - RNA, 21 nt, Human
uggcugagccaggugugugga

SEQ ID NO: 357275 - RNA, 22 nt, Human
agggugccugcugcagguucag

SEQ ID NO: 357276 - RNA, 22 nt, Human
auugcuguacacuucuagaucu

SEQ ID NO: 357277 - RNA, 22 nt, Human
gaagucugcugcucaggaguuu

SEQ ID NO: 357278 - RNA, 22 nt, Human
gaaggccauuagagccugugcc

SEQ ID NO: 357279 - RNA, 22 nt, Human
gggggaagacugggcuagugau

SEQ ID NO: 357280 - RNA, 22 nt, Human
uagcugccagaccauucuuacu

SEQ ID NO: 357281 - RNA, 22 nt, Human
agguguguauaaacauacauau

SEQ ID NO: 357282 - RNA, 22 nt, Human
agauuucucuuucccuggcuga

SEQ ID NO: 357283 - RNA, 22 nt, Human
ccagggcaggagaaagacucac

SEQ ID NO: 357284 - RNA, 22 nt, Human
ugcugcacaauuggaaaguauc

SEQ ID NO: 357285 - RNA, 22 nt, Human
gcugccaugguccaggcuccag

SEQ ID NO: 357286 - RNA, 22 nt, Human
acagaacugcaggaggaaaagc

SEQ ID NO: 357287 - RNA, 19 nt, Human
ggcagcuugggaagguagc

SEQ ID NO: 357288 - RNA, 22 nt, Human
ugcuucuggaaacaguggcugu

SEQ ID NO: 357289 - RNA, 22 nt, Human
aagugguagacaaagauaauug

SEQ ID NO: 357290 - RNA, 22 nt, Human
guauuuauaggggaaugagagu

SEQ ID NO: 357291 - RNA, 22 nt, Human
cauuugaauuguucugugggaa

SEQ ID NO: 357292 - RNA, 22 nt, Human
uaggcagcauggauucugaaua

SEQ ID NO: 357293 - RNA, 22 nt, Human
cugaggcucccucgggucugcu

SEQ ID NO: 357294 - RNA, 22 nt, Human
cacccagcuuuugcauccuccg

SEQ ID NO: 357295 - RNA, 22 nt, Human
ggcagcucugugucugggaagc

SEQ ID NO: 357296 - RNA, 22 nt, Human
cuccucacacccacugcaacca

SEQ ID NO: 357297 - RNA, 20 nt, Human
acaggggcagcacaauaaug

SEQ ID NO: 357298 - RNA, 22 nt, Human
gcauggcauuaacaagauggaa

SEQ ID NO: 357299 - RNA, 22 nt, Human
gcugcucuuuucagagaugaga

SEQ ID NO: 357300 - RNA, 22 nt, Human
gcuggcagccaagugaagaggg

SEQ ID NO: 357301 - RNA, 22 nt, Human
ugaguccacuuuaaaaugucag

SEQ ID NO: 357302 - RNA, 22 nt, Human
acugcagccuagggaccacagu

SEQ ID NO: 357303 - RNA, 22 nt, Human
gccuuugccugcgacguggcug

SEQ ID NO: 357304 - RNA, 20 nt, Human
aggcagacaaggagucuguu

SEQ ID NO: 357305 - RNA, 22 nt, Human
uaaaauugcggugaauauuucc

SEQ ID NO: 357306 - RNA, 22 nt, Human
aggcgcagaaggccaggggccu

SEQ ID NO: 357307 - RNA, 22 nt, Human
uugaccauaccuccaggcaguu

SEQ ID NO: 357308 - RNA, 22 nt, Human
auauacaggugguauguguaaa

SEQ ID NO: 357309 - RNA, 22 nt, Human
aagggaggggauguaagccugg

SEQ ID NO: 357310 - RNA, 22 nt, Human
ccuuucagaugggcauggaccg

SEQ ID NO: 357311 - RNA, 22 nt, Human
aggcuucuuagauuggcuggag

SEQ ID NO: 357312 - RNA, 22 nt, Human
auucuucacauggauaggaucu

SEQ ID NO: 357313 - RNA, 22 nt, Human
ggccucagugggccgcugcagg

SEQ ID NO: 357314 - RNA, 22 nt, Human
caauguaucaaccagaaaguuc

SEQ ID NO: 357315 - RNA, 22 nt, Human
agagaugucgccuugcccaggg

SEQ ID NO: 357316 - RNA, 22 nt, Human
agaggcaggagguugacuugag

SEQ ID NO: 357317 - RNA, 22 nt, Human
gcaggcuggaggcuguucuggg

SEQ ID NO: 357318 - RNA, 22 nt, Human
ucagcccugaggacagaggcag

SEQ ID NO: 357319 - RNA, 15 nt, Human
uggcagcuuguuaag

SEQ ID NO: 357320 - RNA, 22 nt, Human
ggcgcaggccuuggauccuggu

SEQ ID NO: 357321 - RNA, 22 nt, Human
cauaauuucuguaucagcacca

SEQ ID NO: 357322 - RNA, 16 nt, Human
uguuagcugugcauua

SEQ ID NO: 357323 - RNA, 22 nt, Human
uuugaagauuaugccagaguga

SEQ ID NO: 357324 - RNA, 22 nt, Human
gccagggaggcuguaggguccu

SEQ ID NO: 357325 - RNA, 18 nt, Human
cccagcuuagcgccccuc

SEQ ID NO: 357326 - RNA, 22 nt, Human
ugucauaaaacacaagcuguug

SEQ ID NO: 357327 - RNA, 22 nt, Human
gggcucuggaaggugcaccaug

SEQ ID NO: 357328 - RNA, 22 nt, Human
aggugagugugacugcaagaga

SEQ ID NO: 357329 - RNA, 22 nt, Human
uguccacaucacucacuuguca

SEQ ID NO: 357330 - RNA, 22 nt, Human
ugggcuccguugccuggggcag

SEQ ID NO: 357331 - RNA, 22 nt, Human
augaggcucucaggggagcugu

SEQ ID NO: 357332 - RNA, 19 nt, Human
uggcaucuguaaaauggug

SEQ ID NO: 357333 - RNA, 22 nt, Human
uaaaugugucuuuuuaaggccu

SEQ ID NO: 357334 - RNA, 22 nt, Human
ggccagaggccacagcuguguc

SEQ ID NO: 357335 - RNA, 22 nt, Human
acaaauauuuacugaauccacu

SEQ ID NO: 357336 - RNA, 22 nt, Human
ggcucuggguucugcaaugcgu

SEQ ID NO: 357337 - RNA, 22 nt, Human
gcagugccuugcuucucugucu

SEQ ID NO: 357338 - RNA, 22 nt, Human
caaagcucaugcucuuagccau

SEQ ID NO: 357339 - RNA, 22 nt, Human
ucaaagucuaucuguaauuacu

SEQ ID NO: 357340 - RNA, 22 nt, Human
uccuuuuugguccaaggugacc

SEQ ID NO: 357341 - RNA, 20 nt, Human
cuucaggacccauccucccc

SEQ ID NO: 357342 - RNA, 22 nt, Human
ucuggauggucagcucuuccug

SEQ ID NO: 357343 - RNA, 22 nt, Human
uacagggguaacaguggggaau

SEQ ID NO: 357344 - RNA, 22 nt, Human
uggcaguccccugugccuggaa

SEQ ID NO: 357345 - RNA, 22 nt, Human
aguaauaauuuauauuagggag

SEQ ID NO: 357346 - RNA, 20 nt, Human
ggggcugcaugcagagaaga

SEQ ID NO: 357347 - RNA, 22 nt, Human
uuuggaaugguaccuucaguug

SEQ ID NO: 357348 - RNA, 22 nt, Human
caaaggcaacauauacuuguuu

SEQ ID NO: 357349 - RNA, 22 nt, Human
uccugagauucugcauuucuaa

SEQ ID NO: 357350 - RNA, 22 nt, Human
gccugagagucugcauuucuaa

SEQ ID NO: 357351 - RNA, 21 nt, Human
agaagccaugugguggagaac

SEQ ID NO: 357352 - RNA, 22 nt, Human
agcucuccacacauaggacuag

SEQ ID NO: 357353 - RNA, 22 nt, Human
gagcuggcaggaggcuccccga

SEQ ID NO: 357354 - RNA, 22 nt, Human
cacaggaggaggccagagcgua

SEQ ID NO: 357355 - RNA, 22 nt, Human
ugccagucucacccuggguccu

SEQ ID NO: 357356 - RNA, 22 nt, Human
uaaaugcaaugugcuuuaccag

SEQ ID NO: 357357 - RNA, 22 nt, Human
caguuucuguuuuaaauagcag

SEQ ID NO: 357358 - RNA, 22 nt, Human
uaaggccaauuaacaaccaggg

SEQ ID NO: 357359 - RNA, 22 nt, Human
cuuccagguccuucuugagaag

SEQ ID NO: 357360 - RNA, 22 nt, Human
aagcagcacaguaauauuggug

SEQ ID NO: 357361 - RNA, 22 nt, Human
caauacuuccuuguuagaggca

SEQ ID NO: 357362 - RNA, 21 nt, Human
uggcucuggguaggagagugc

SEQ ID NO: 357363 - RNA, 21 nt, Human
acagcauguuuguguguuugc

SEQ ID NO: 357364 - RNA, 20 nt, Human
gccagcccugacacaggagc

SEQ ID NO: 357365 - RNA, 22 nt, Human
acuccugguuuguguccuggcu

SEQ ID NO: 357366 - RNA, 22 nt, Human
ucugucacccaggcuggagugc

SEQ ID NO: 357367 - RNA, 22 nt, Human
ugcuggaggccugacuguguuu

SEQ ID NO: 357368 - RNA, 22 nt, Human
agccagggagguggagguugca

SEQ ID NO: 357369 - RNA, 22 nt, Human
gggaguggagagcaauggauga

SEQ ID NO: 357370 - RNA, 22 nt, Human
ccugccaggcuuugggcuucug

SEQ ID NO: 357371 - RNA, 22 nt, Human
uaaggguucagaaugcaguggu

SEQ ID NO: 357372 - RNA, 22 nt, Human
aaauuucuaagcagccacuucc

SEQ ID NO: 357373 - RNA, 22 nt, Human
acuuagaacaggcagaauucca

SEQ ID NO: 357374 - RNA, 22 nt, Human
cuguggcauugccgaggcuggc

SEQ ID NO: 357375 - RNA, 22 nt, Human
acaaaaagggagaugagguaga

SEQ ID NO: 357376 - RNA, 22 nt, Human
ucauugcacuccagccugggca

SEQ ID NO: 357377 - RNA, 22 nt, Human
gggggcuggaauauccaucaac

SEQ ID NO: 357378 - RNA, 22 nt, Human
acccaggauaaucuguguaucu

SEQ ID NO: 357379 - RNA, 22 nt, Human
agagccugaggaugucccagcu

SEQ ID NO: 357380 - RNA, 22 nt, Human
gugaaaucugaggcccaugaug

SEQ ID NO: 357381 - RNA, 22 nt, Human
ugaagcaggaucguuugcuuca

SEQ ID NO: 357382 - RNA, 22 nt, Human
gcccucagaugggaaaggaggg

SEQ ID NO: 357383 - RNA, 22 nt, Human
gaagagcuuagacagaaucaaa

SEQ ID NO: 357384 - RNA, 22 nt, Human
ucacaacuugaagcugauuuaa

SEQ ID NO: 357385 - RNA, 23 nt, Human
ccugcucaggcgugugcccugcu

SEQ ID NO: 357386 - RNA, 22 nt, Human
acuguguggaccacucugaggc

SEQ ID NO: 357387 - RNA, 22 nt, Human
uauuacugagguuuuauggagu

SEQ ID NO: 357388 - RNA, 22 nt, Human
cugcagagcaaguaacauccuc

SEQ ID NO: 357389 - RNA, 22 nt, Human
augaacaaguauuugcaugagc

SEQ ID NO: 357390 - RNA, 19 nt, Human
guugaaaguaggugagggu

SEQ ID NO: 357391 - RNA, 22 nt, Human
augcaguggcagcuccuggugu

SEQ ID NO: 357392 - RNA, 19 nt, Human
ugagaaggcaguggggagc

SEQ ID NO: 357393 - RNA, 22 nt, Human
ugggaggaucgcuugagcccag

SEQ ID NO: 357394 - RNA, 20 nt, Human
ggcagggcaucaacagcucu

SEQ ID NO: 357395 - RNA, 22 nt, Human
gcugccaguaguuggagcucca

SEQ ID NO: 357396 - RNA, 22 nt, Human
aucaguuuggaacauucaggcc

SEQ ID NO: 357397 - RNA, 22 nt, Human
acacagggucuagaguuaggcc

SEQ ID NO: 357398 - RNA, 22 nt, Human
auccuugagccaaugacugauu

SEQ ID NO: 357399 - RNA, 17 nt, Human
cuggagccaagagggcc

SEQ ID NO: 357400 - RNA, 22 nt, Human
agggcuccgggcaggcgaugga

SEQ ID NO: 357401 - RNA, 22 nt, Human
aggcacuguggguguggccgga

SEQ ID NO: 357402 - RNA, 22 nt, Human
acagaguagcucaagaagauug

SEQ ID NO: 357403 - RNA, 22 nt, Human
agagcagaggcauggccguggg

SEQ ID NO: 357404 - RNA, 22 nt, Human
acaucucaugaaugauaaauca

SEQ ID NO: 357405 - RNA, 22 nt, Human
acagcagagacacucaggaggc

SEQ ID NO: 357406 - RNA, 22 nt, Human
ucaguagcagaaagcaaugagu

SEQ ID NO: 357407 - RNA, 22 nt, Human
cugggagauugcuagagaugca

SEQ ID NO: 357408 - RNA, 19 nt, Human
aggucauugauagugcagg

SEQ ID NO: 357409 - RNA, 22 nt, Human
aaauccuaccaagaaauucccu

SEQ ID NO: 357410 - RNA, 22 nt, Human
auggcagagaaagcgagccaca

SEQ ID NO: 357411 - RNA, 22 nt, Human
ucagaaauguaagcugaugacu

SEQ ID NO: 357412 - RNA, 22 nt, Human
agcagagcccuuccauggccuu

SEQ ID NO: 357413 - RNA, 22 nt, Human
auaacagauacucucugugagg

SEQ ID NO: 357414 - RNA, 22 nt, Human
ucacacauucuagguauguuga

SEQ ID NO: 357415 - RNA, 22 nt, Human
ccuggaagauucaccacuacca

SEQ ID NO: 357416 - RNA, 22 nt, Human
uucuucuucuggcugcaccugg

SEQ ID NO: 357417 - RNA, 22 nt, Human
gaugccucuuuuggcugaauua

SEQ ID NO: 357418 - RNA, 22 nt, Human
ucccaggaugaagacaguguug

SEQ ID NO: 357419 - RNA, 19 nt, Human
ccaguagagacagcugcag

SEQ ID NO: 357420 - RNA, 22 nt, Human
acucaggaaauugagauaaugg

SEQ ID NO: 357421 - RNA, 22 nt, Human
gucccagggagguucagggcuu

SEQ ID NO: 357422 - RNA, 22 nt, Human
uauuuguugaguuguuaugucu

SEQ ID NO: 357423 - RNA, 21 nt, Human
uauuucuuugacucucucccu

SEQ ID NO: 357424 - RNA, 22 nt, Human
uuaacacuaucugucauaauua

SEQ ID NO: 357425 - RNA, 22 nt, Human
ucaggagagaaagaauacaauu

SEQ ID NO: 357426 - RNA, 22 nt, Human
caggaacaauguaagucucauu

SEQ ID NO: 357427 - RNA, 22 nt, Human
guccucuggugaaagcauuccc

SEQ ID NO: 357428 - RNA, 22 nt, Human
uagcagugccaggauuuugcug

SEQ ID NO: 357429 - RNA, 21 nt, Human
ugcaugcuauguuuuuauuuc

SEQ ID NO: 357430 - RNA, 22 nt, Human
agcagcauuaagggaacugcag

SEQ ID NO: 357431 - RNA, 22 nt, Human
agugcugacucugggcacagug

SEQ ID NO: 357432 - RNA, 22 nt, Human
gucugcccucacgccagcuggg

SEQ ID NO: 357433 - RNA, 22 nt, Human
gacccagccugguuuuuauagg

SEQ ID NO: 357434 - RNA, 22 nt, Human
cucagccccaauucuccccauu

SEQ ID NO: 357435 - RNA, 22 nt, Human
gcugucugcugugcacugagca

SEQ ID NO: 357436 - RNA, 22 nt, Human
caaauaguuuuucauguauuau

SEQ ID NO: 357437 - RNA, 22 nt, Human
aauaauuacccaucuuuuugua

SEQ ID NO: 357438 - RNA, 22 nt, Human
ccagcccuccuccaucagagga

SEQ ID NO: 357439 - RNA, 22 nt, Human
gccuuggcugaugugcgaauga

SEQ ID NO: 357440 - RNA, 22 nt, Human
ccuccuggugggcgcuucuggc

SEQ ID NO: 357441 - RNA, 22 nt, Human
gaauuagguaauagaacuagua

SEQ ID NO: 357442 - RNA, 22 nt, Human
ccagcuggucugugcucauguu

SEQ ID NO: 357443 - RNA, 22 nt, Human
uggaggcauuuuagguugucac

SEQ ID NO: 357444 - RNA, 21 nt, Human
gauaaaaugggccuugguccu

SEQ ID NO: 357445 - RNA, 22 nt, Human
cuccaggaaaauagggaaugag

SEQ ID NO: 357446 - RNA, 22 nt, Human
cagcuuguuuuauuuggggacc

SEQ ID NO: 357447 - RNA, 22 nt, Human
gaguucaguguuucuaguagug

SEQ ID NO: 357448 - RNA, 23 nt, Human
ugcagagggacugaagccagcuu

SEQ ID NO: 357449 - RNA, 22 nt, Human
cucacugugaccucagcagaca

SEQ ID NO: 357450 - RNA, 22 nt, Human
ugccucagaguugucccuacca

SEQ ID NO: 357451 - RNA, 22 nt, Human
cccugcaggggaccugcagccu

SEQ ID NO: 357452 - RNA, 22 nt, Human
ggaucugauuaauaagguggac

SEQ ID NO: 357453 - RNA, 22 nt, Human
agcugggagcagagccacagcc

SEQ ID NO: 357454 - RNA, 22 nt, Human
ucacuugccuagcccaguucag

SEQ ID NO: 357455 - RNA, 22 nt, Human
uuucauaaacaguagaagacua

SEQ ID NO: 357456 - RNA, 22 nt, Human
ucagaauugucuggggaauguu

SEQ ID NO: 357457 - RNA, 22 nt, Human
aauaaacugcucaauugcauca

SEQ ID NO: 357458 - RNA, 22 nt, Human
ggcucaggcuggagugcagugg

SEQ ID NO: 357459 - RNA, 22 nt, Human
agaagccauugaagcagaccuc

SEQ ID NO: 357460 - RNA, 22 nt, Human
gugcugcucacaucuggaggua

SEQ ID NO: 357461 - RNA, 22 nt, Human
ugagaaccaugaaaagcuguca

SEQ ID NO: 357462 - RNA, 22 nt, Human
guccucaggaaagcagauaaca

SEQ ID NO: 357463 - RNA, 20 nt, Human
uacaauacacaugcauauga

SEQ ID NO: 357464 - RNA, 22 nt, Human
uggaaugacagagagucugaau

SEQ ID NO: 357465 - RNA, 22 nt, Human
gaggaaccaaucugugauauuc

SEQ ID NO: 357466 - RNA, 21 nt, Human
auuuccaaggguaccuaagau

SEQ ID NO: 357467 - RNA, 17 nt, Human
aagauuucauuagcuga

SEQ ID NO: 357468 - RNA, 22 nt, Human
agggacacacuccaguguuauu

SEQ ID NO: 357469 - RNA, 22 nt, Human
ugcuggagaggaaggugggguc

SEQ ID NO: 357470 - RNA, 22 nt, Human
ucagaaauuuucucaguaguuc

SEQ ID NO: 357471 - RNA, 20 nt, Human
ggcacuggaagcacacagga

SEQ ID NO: 357472 - RNA, 21 nt, Human
uuuagggaggauauuuaacuu

SEQ ID NO: 357473 - RNA, 22 nt, Human
caagaaggcuauaugggccagg

SEQ ID NO: 357474 - RNA, 23 nt, Human
cccagggacacgaugacaccucc

SEQ ID NO: 357475 - RNA, 22 nt, Human
uccaggcaaaaggaacugcuug

SEQ ID NO: 357476 - RNA, 22 nt, Human
gcucccagauuucagccuugug

SEQ ID NO: 357477 - RNA, 22 nt, Human
ugaggcucagaaauguaaguuu

SEQ ID NO: 357478 - RNA, 22 nt, Human
cugaauaauuuucuguuguaug

SEQ ID NO: 357479 - RNA, 22 nt, Human
cagaaauguacugacaugcagu

SEQ ID NO: 357480 - RNA, 22 nt, Human
gugccugugcggacucagggaa

SEQ ID NO: 357481 - RNA, 22 nt, Human
cauugcucaggcccagcaggaa

SEQ ID NO: 357482 - RNA, 22 nt, Human
caggccucuauggucagcugag

SEQ ID NO: 357483 - RNA, 22 nt, Human
gggagggaaggaccuuaugaau

SEQ ID NO: 357484 - RNA, 22 nt, Human
gcugucaguuuuacccacagac

SEQ ID NO: 357485 - RNA, 22 nt, Human
gcugccugcucggcuccuggga

SEQ ID NO: 357486 - RNA, 22 nt, Human
uuaaagaguaaucauaggucaa

SEQ ID NO: 357487 - RNA, 18 nt, Human
uccugccugugccccagg

SEQ ID NO: 357488 - RNA, 22 nt, Human
gccuucugugcuccuggccuuu

SEQ ID NO: 357489 - RNA, 22 nt, Human
uccaggagaggccugaccaggu

SEQ ID NO: 357490 - RNA, 21 nt, Human
cugcaucucauagaacauguc

SEQ ID NO: 357491 - RNA, 22 nt, Human
cacagggcaggccccaggccuc

SEQ ID NO: 357492 - RNA, 22 nt, Human
caccaggcugaaccagagggga

SEQ ID NO: 357493 - RNA, 22 nt, Human
uuucaaaauuuugcagugguaa

SEQ ID NO: 357494 - RNA, 22 nt, Human
cuuuggaagugaccacaauccu

SEQ ID NO: 357495 - RNA, 22 nt, Human
cauuggaaugcauuugaagaga

SEQ ID NO: 357496 - RNA, 22 nt, Human
cuuagaugaagucacagaaccc

SEQ ID NO: 357497 - RNA, 22 nt, Human
cagggcugcuggccgugcccuc

SEQ ID NO: 357498 - RNA, 22 nt, Human
uacauguaauuuucauaguaag

SEQ ID NO: 357499 - RNA, 22 nt, Human
ugguuuaccccuguccuauauc

SEQ ID NO: 357500 - RNA, 22 nt, Human
ugaugaauaaacuugagaguca

SEQ ID NO: 357501 - RNA, 22 nt, Human
cacagcuuaugccacugauugg

SEQ ID NO: 357502 - RNA, 22 nt, Human
cacuguaucuuuuccaaagucu

SEQ ID NO: 357503 - RNA, 21 nt, Human
gcagccagccgagaccaugcc

SEQ ID NO: 357504 - RNA, 22 nt, Human
acuugcauuauauuuaucacaa

SEQ ID NO: 357505 - RNA, 22 nt, Human
aaaugucuguuagucauaucau

SEQ ID NO: 357506 - RNA, 22 nt, Human
gaaaucugaaucuucuguuggu

SEQ ID NO: 357507 - RNA, 22 nt, Human
gcacagggagacagccguggcc

SEQ ID NO: 357508 - RNA, 22 nt, Human
ucccagggacucucugccuucc

SEQ ID NO: 357509 - RNA, 22 nt, Human
uuuccaaagcugaguugagcaa

SEQ ID NO: 357510 - RNA, 22 nt, Human
cuuauuauaaaauccuguuuga

SEQ ID NO: 357511 - RNA, 22 nt, Human
ugaguccauguggaggggaggu

SEQ ID NO: 357512 - RNA, 22 nt, Human
acagugucuccugguacccagu

SEQ ID NO: 357513 - RNA, 22 nt, Human
accccagcucugagccacacca

SEQ ID NO: 357514 - RNA, 22 nt, Human
ugcaucuguucagagcugucga

SEQ ID NO: 357515 - RNA, 22 nt, Human
ugucuucaguaaaauacacuau

SEQ ID NO: 357516 - RNA, 22 nt, Human
ugaaaugaaacagaacauauca

SEQ ID NO: 357517 - RNA, 22 nt, Human
uggcagucuggguuggcaguua

SEQ ID NO: 357518 - RNA, 22 nt, Human
ucacugcucucuaagcaucgcc

SEQ ID NO: 357519 - RNA, 22 nt, Human
caguucaggccggcugacucag

SEQ ID NO: 357520 - RNA, 22 nt, Human
cucuuaguaaugccaugaagca

SEQ ID NO: 357521 - RNA, 22 nt, Human
agggagugguuaagaaggugca

SEQ ID NO: 357522 - RNA, 22 nt, Human
gagauuucuuuugaugccuguc

SEQ ID NO: 357523 - RNA, 22 nt, Human
ucucccaggucauacacagaga

SEQ ID NO: 357524 - RNA, 23 nt, Human
ggguccagagacaggcaugggug

SEQ ID NO: 357525 - RNA, 20 nt, Human
gagagcuggggaugaggcug

SEQ ID NO: 357526 - RNA, 22 nt, Human
ccaggccuucugaggacacucu

SEQ ID NO: 357527 - RNA, 19 nt, Human
uuucccagcccuugcugug

SEQ ID NO: 357528 - RNA, 22 nt, Human
uaaauguguuguggaugaaguu

SEQ ID NO: 357529 - RNA, 22 nt, Human
auaguguuacccuucuuaaagu

SEQ ID NO: 357530 - RNA, 22 nt, Human
aaggagaaaugguagaugugca

SEQ ID NO: 357531 - RNA, 22 nt, Human
uggcucaggauaauuuucccaa

SEQ ID NO: 357532 - RNA, 22 nt, Human
cuagaaauucugauucaguagg

SEQ ID NO: 357533 - RNA, 22 nt, Human
aggccacaguacuuugcagacc

SEQ ID NO: 357534 - RNA, 22 nt, Human
gcagcccagagcgcaggacccc

SEQ ID NO: 357535 - RNA, 22 nt, Human
ggcaccugcucaucuggacuca

SEQ ID NO: 357536 - RNA, 22 nt, Human
gcagccacugggagugcuuaua

SEQ ID NO: 357537 - RNA, 22 nt, Human
caggacagcucaacaccuccuc

SEQ ID NO: 357538 - RNA, 22 nt, Human
ggcacugacacuagcauggcac

SEQ ID NO: 357539 - RNA, 22 nt, Human
cuggcagcccaaccuagagucu

SEQ ID NO: 357540 - RNA, 22 nt, Human
augaagcugguuuuggcuuggg

SEQ ID NO: 357541 - RNA, 23 nt, Human
agggagcuaaaaggcuggagcag

SEQ ID NO: 357542 - RNA, 22 nt, Human
caugaaaaugucaaguucugcu

SEQ ID NO: 357543 - RNA, 22 nt, Human
uggcucagagccuugagagcug

SEQ ID NO: 357544 - RNA, 18 nt, Human
cucucugggugaggacaa

SEQ ID NO: 357545 - RNA, 18 nt, Human
ucagaggagauaccuaaa

SEQ ID NO: 357546 - RNA, 21 nt, Human
agugaaauugcaucagaggga

SEQ ID NO: 357547 - RNA, 22 nt, Human
agcugccagcaaguuucaaaca

SEQ ID NO: 357548 - RNA, 22 nt, Human
ugcagccaggaaauauuugcug

SEQ ID NO: 357549 - RNA, 22 nt, Human
uccuuagagauacugucuugaa

SEQ ID NO: 357550 - RNA, 22 nt, Human
agaagccaaucagcucucugcu

SEQ ID NO: 357551 - RNA, 22 nt, Human
cccaggucccgccccagcucua

SEQ ID NO: 357552 - RNA, 22 nt, Human
accauguuggccaagcuggucu

SEQ ID NO: 357553 - RNA, 22 nt, Human
uggcagaguaggauggcccugu

SEQ ID NO: 357554 - RNA, 22 nt, Human
gacggcagaaacucaugagguc

SEQ ID NO: 357555 - RNA, 22 nt, Human
caguggagagacuuuuacucuu

SEQ ID NO: 357556 - RNA, 22 nt, Human
caaagcaccacaaaccagguga

SEQ ID NO: 357557 - RNA, 22 nt, Human
acuguguccuauuuccuugaca

SEQ ID NO: 357558 - RNA, 22 nt, Human
gcagcugggccccagccucucc

SEQ ID NO: 357559 - RNA, 22 nt, Human
uuugaaagcuacuuucggguca

SEQ ID NO: 357560 - RNA, 22 nt, Human
uauguuauuuucauacaacaga

SEQ ID NO: 357561 - RNA, 22 nt, Human
uggagcccagacacuggcauug

SEQ ID NO: 357562 - RNA, 22 nt, Human
aggcagcaaagaaaugaugcug

SEQ ID NO: 357563 - RNA, 22 nt, Human
gugggcuucuguuagggaggcu

SEQ ID NO: 357564 - RNA, 22 nt, Human
gaacaguaaauuuaugcagcac

SEQ ID NO: 357565 - RNA, 22 nt, Human
cucuccucugaaguggugaccc

SEQ ID NO: 357566 - RNA, 22 nt, Human
ucaggagucugugcaguuccac

SEQ ID NO: 357567 - RNA, 22 nt, Human
ggggaccugggcuucaaggguu

SEQ ID NO: 357568 - RNA, 22 nt, Human
uggcucaguuuagcagcucagu

SEQ ID NO: 357569 - RNA, 22 nt, Human
uggggcagcuccaucuauucca

SEQ ID NO: 357570 - RNA, 22 nt, Human
gaucugaagagcaaugaaauau

SEQ ID NO: 357571 - RNA, 22 nt, Human
ucagugcagaauagugaugcau

SEQ ID NO: 357572 - RNA, 17 nt, Human
ggcugcugugcuggugc

SEQ ID NO: 357573 - RNA, 20 nt, Human
acaaaauagguacuggguag

SEQ ID NO: 357574 - RNA, 22 nt, Human
agaggcucugccgccucaggua

SEQ ID NO: 357575 - RNA, 22 nt, Human
agagccagguguagucucggag

SEQ ID NO: 357576 - RNA, 22 nt, Human
gccuuaggggucagacagagcu

SEQ ID NO: 357577 - RNA, 22 nt, Human
auuucaggagcaguuucagugg

SEQ ID NO: 357578 - RNA, 17 nt, Human
ucaggcugugccuggua

SEQ ID NO: 357579 - RNA, 22 nt, Human
ggugauuuucgaguuucauguu

SEQ ID NO: 357580 - RNA, 18 nt, Human
gugagcagagagcaucac

SEQ ID NO: 357581 - RNA, 22 nt, Human
cugugugugucugcagcauacu

SEQ ID NO: 357582 - RNA, 22 nt, Human
uccagcagguccgagacaaguu

SEQ ID NO: 357583 - RNA, 22 nt, Human
ucaggaguaaagacagaguucc

SEQ ID NO: 357584 - RNA, 22 nt, Human
ugcucucucaggccuggcccac

SEQ ID NO: 357585 - RNA, 22 nt, Human
uaucuguuugcucacagguguu

SEQ ID NO: 357586 - RNA, 22 nt, Human
accaaggaagaaucuauuugag

SEQ ID NO: 357587 - RNA, 22 nt, Human
uaacagaaauauuuccagguga

SEQ ID NO: 357588 - RNA, 22 nt, Human
uccagcagcccgaaggcccauc

SEQ ID NO: 357589 - RNA, 21 nt, Human
ugaaagaaggugcagucugaa

SEQ ID NO: 357590 - RNA, 18 nt, Human
uccagagcuacuguggug

SEQ ID NO: 357591 - RNA, 22 nt, Human
agaaaucauugaauuauuugcu

SEQ ID NO: 357592 - RNA, 22 nt, Human
ucccccacucuaaaggagccuu

SEQ ID NO: 357593 - RNA, 22 nt, Human
gaagaacaccugcugcccagug

SEQ ID NO: 357594 - RNA, 22 nt, Human
gccaggaguguguggcuauguu

SEQ ID NO: 357595 - RNA, 22 nt, Human
agcagcucuggcacuguagcau

SEQ ID NO: 357596 - RNA, 22 nt, Human
ccacccagccagaugcaggaag

SEQ ID NO: 357597 - RNA, 22 nt, Human
gucccaggaguugcugggccuu

SEQ ID NO: 357598 - RNA, 22 nt, Human
uccagccuaauguucuucccac

SEQ ID NO: 357599 - RNA, 22 nt, Human
uggagcaggacugcugcccuca

SEQ ID NO: 357600 - RNA, 20 nt, Human
cccaggcagagcuagcggca

SEQ ID NO: 357601 - RNA, 22 nt, Human
uggcagagaauaaaucuugacu

SEQ ID NO: 357602 - RNA, 22 nt, Human
uccagggaugguaaugagcagu

SEQ ID NO: 357603 - RNA, 21 nt, Human
gcagcuggucucagagcuugc

SEQ ID NO: 357604 - RNA, 22 nt, Human
ucugggggcgaccagggacugc

SEQ ID NO: 357605 - RNA, 22 nt, Human
aggcugcagaacagucaggugc

SEQ ID NO: 357606 - RNA, 22 nt, Human
uucauagaucucaauuuugagg

SEQ ID NO: 357607 - RNA, 22 nt, Human
caggaggcagagguugcaguga

SEQ ID NO: 357608 - RNA, 19 nt, Human
accugcaguaauaauuccu

SEQ ID NO: 357609 - RNA, 23 nt, Human
gaggcacucaggaaaugugagug

SEQ ID NO: 357610 - RNA, 22 nt, Human
gcuggucacucugggagcugcu

SEQ ID NO: 357611 - RNA, 22 nt, Human
auuagggaaacugacuugucuc

SEQ ID NO: 357612 - RNA, 22 nt, Human
caguauuuauggcuugaguauu

SEQ ID NO: 357613 - RNA, 22 nt, Human
ccuggcucuguccucgcgcaaa

SEQ ID NO: 357614 - RNA, 22 nt, Human
auuucccuccagggaaagcuua

SEQ ID NO: 357615 - RNA, 22 nt, Human
ccaguggccaugcacgagcagc

SEQ ID NO: 357616 - RNA, 22 nt, Human
ugugaggagaggcccagcuccc

SEQ ID NO: 357617 - RNA, 22 nt, Human
aagaaucauccugcaagagucu

SEQ ID NO: 357618 - RNA, 22 nt, Human
uuuaagaugguauuuuauaaag

SEQ ID NO: 357619 - RNA, 22 nt, Human
cagcaggaaguacuagcuuuga

SEQ ID NO: 357620 - RNA, 22 nt, Human
ggggcugguggugguuucucca

SEQ ID NO: 357621 - RNA, 22 nt, Human
cuacagaagccguggucaggaa

SEQ ID NO: 357622 - RNA, 23 nt, Human
cuuuucauugccuuagcgcagag

SEQ ID NO: 357623 - RNA, 22 nt, Human
aagggcuguaagccaaguaaag

SEQ ID NO: 357624 - RNA, 22 nt, Human
gaaaccagcuagaggcagaggg

SEQ ID NO: 357625 - RNA, 22 nt, Human
gcaggcucuucuuucugcccag

SEQ ID NO: 357626 - RNA, 19 nt, Human
cucuggccucuggaugcug

SEQ ID NO: 357627 - RNA, 21 nt, Human
cauuuacaugacagauugguu

SEQ ID NO: 357628 - RNA, 22 nt, Human
uccugcagucugcacucugccu

SEQ ID NO: 357629 - RNA, 22 nt, Human
uucucauggugucuuuauacau

SEQ ID NO: 357630 - RNA, 22 nt, Human
acaugauuuuuaaagagauaau

SEQ ID NO: 357631 - RNA, 22 nt, Human
cacugcuucuggaggaauuugg

SEQ ID NO: 357632 - RNA, 19 nt, Human
ugaagcagcaaacucucag

SEQ ID NO: 357633 - RNA, 22 nt, Human
uaggcaacaugucgaauacugu

SEQ ID NO: 357634 - RNA, 22 nt, Human
gccuguguggaugcgccggugc

SEQ ID NO: 357635 - RNA, 22 nt, Human
uuuccucacuucaugagaguuu

SEQ ID NO: 357636 - RNA, 22 nt, Human
uguagaaagcucuucugaaauc

SEQ ID NO: 357637 - RNA, 22 nt, Human
gagggaggcaucaugaauccag

SEQ ID NO: 357638 - RNA, 22 nt, Human
uuuaguagaaugauacagggca

SEQ ID NO: 357639 - RNA, 22 nt, Human
aacaugaagguaggaugguuuu

SEQ ID NO: 357640 - RNA, 22 nt, Human
agagucagcuuaugacacaguc

SEQ ID NO: 357641 - RNA, 22 nt, Human
gaggacagcuuagggcuuccug

SEQ ID NO: 357642 - RNA, 22 nt, Human
agggguggagaguguugccagu

SEQ ID NO: 357643 - RNA, 20 nt, Human
cagggcacacugcagccucg

SEQ ID NO: 357644 - RNA, 22 nt, Human
auuuccaggagaaaggauuuua

SEQ ID NO: 357645 - RNA, 22 nt, Human
cccagcagauggcuaugugcua

SEQ ID NO: 357646 - RNA, 22 nt, Human
cugccugggccggccacccucu

SEQ ID NO: 357647 - RNA, 22 nt, Human
agcagggccugagugaccuaac

SEQ ID NO: 357648 - RNA, 22 nt, Human
ccucugcucccuggugucugag

SEQ ID NO: 357649 - RNA, 22 nt, Human
ucccagagcagaugugcuaaag

SEQ ID NO: 357650 - RNA, 22 nt, Human
aacaaauguaaaaugcagaugc

SEQ ID NO: 357651 - RNA, 22 nt, Human
uaugcauacaaugagauauucc

SEQ ID NO: 357652 - RNA, 22 nt, Human
uucagaaaggauaauuggaagg

SEQ ID NO: 357653 - RNA, 22 nt, Human
ugcccuguuaucuuggaagagu

SEQ ID NO: 357654 - RNA, 22 nt, Human
caggcagaugcugacaagaguu

SEQ ID NO: 357655 - RNA, 22 nt, Human
uccuucuuugacaaguggcaga

SEQ ID NO: 357656 - RNA, 22 nt, Human
cuguuaaucugcuugcaugaug

SEQ ID NO: 357657 - RNA, 22 nt, Human
uggcuuccugcacagugucugc

SEQ ID NO: 357658 - RNA, 22 nt, Human
ggagccugugcccaagcccaga

SEQ ID NO: 357659 - RNA, 22 nt, Human
uguuuaauaauucuaugauagu

SEQ ID NO: 357660 - RNA, 22 nt, Human
gagagcaggaggcagcgggacg

SEQ ID NO: 357661 - RNA, 22 nt, Human
gaaacccaaacuaagacaguag

SEQ ID NO: 357662 - RNA, 22 nt, Human
gccugccuggagcuugagguga

SEQ ID NO: 357663 - RNA, 22 nt, Human
guuauguaugagggaaugauua

SEQ ID NO: 357664 - RNA, 22 nt, Human
uucugcaucugaauuuaaguac

SEQ ID NO: 357665 - RNA, 22 nt, Human
gguggccuccagggcauaggug

SEQ ID NO: 357666 - RNA, 22 nt, Human
gcauuuagcuuuaaaauauuuc

SEQ ID NO: 357667 - RNA, 22 nt, Human
gaugaggcucaugcacccugcg

SEQ ID NO: 357668 - RNA, 22 nt, Human
uugcucagcacuggagccagcu

SEQ ID NO: 357669 - RNA, 22 nt, Human
guccaaauuuuucacauguaga

SEQ ID NO: 357670 - RNA, 22 nt, Human
gggcagugacaaaggggaugaa

SEQ ID NO: 357671 - RNA, 22 nt, Human
gccuccugagaagccacaggcu

SEQ ID NO: 357672 - RNA, 22 nt, Human
aaaugcacaggagaaccaauuc

SEQ ID NO: 357673 - RNA, 22 nt, Human
gcagugggaagguuggcacaug

SEQ ID NO: 357674 - RNA, 22 nt, Human
aggcucaguauagcuggcaagu

SEQ ID NO: 357675 - RNA, 18 nt, Human
acagaaauagcugugccu

SEQ ID NO: 357676 - RNA, 22 nt, Human
cuuaggaacgcucugccuagug

SEQ ID NO: 357677 - RNA, 22 nt, Human
uucucugaaggccaugcucacu

SEQ ID NO: 357678 - RNA, 22 nt, Human
ggcagagcuuguuccuucuguu

SEQ ID NO: 357679 - RNA, 22 nt, Human
acuggcaggcugcuggccggcg

SEQ ID NO: 357680 - RNA, 22 nt, Human
uaugacaagguggaguaugagu

SEQ ID NO: 357681 - RNA, 22 nt, Human
aaauccuaaugacaaguuuagu

SEQ ID NO: 357682 - RNA, 22 nt, Human
cugagccuguguuucucuggca

SEQ ID NO: 357683 - RNA, 22 nt, Human
cagaagagaugaaauaguauua

SEQ ID NO: 357684 - RNA, 21 nt, Human
ccaaaggcuauguaucuucug

SEQ ID NO: 357685 - RNA, 19 nt, Human
uugguggugguuuugguuc

SEQ ID NO: 357686 - RNA, 22 nt, Human
gggcugccuuucuucugggagc

SEQ ID NO: 357687 - RNA, 22 nt, Human
aacauuucagcaaauaagaaca

SEQ ID NO: 357688 - RNA, 22 nt, Human
uucaggagcuggcugcgaagga

SEQ ID NO: 357689 - RNA, 22 nt, Human
gccugcagccucagagaauuuu

SEQ ID NO: 357690 - RNA, 22 nt, Human
cuuauuagaaagaaaagacaug

SEQ ID NO: 357691 - RNA, 22 nt, Human
agaggaggcucugggaucgucc

SEQ ID NO: 357692 - RNA, 22 nt, Human
cucagagaaaaggagcaagggu

SEQ ID NO: 357693 - RNA, 22 nt, Human
aagaauguuaguuucugauaca

SEQ ID NO: 357694 - RNA, 22 nt, Human
gccacacugcuucuuugagccu

SEQ ID NO: 357695 - RNA, 22 nt, Human
ggaggugggauuaggaccuaaa

SEQ ID NO: 357696 - RNA, 22 nt, Human
uaagccacuagucuguuaugaa

SEQ ID NO: 357697 - RNA, 19 nt, Human
gcgaggaagucacuguggc

SEQ ID NO: 357698 - RNA, 22 nt, Human
acacagggcugcgccugacccc

SEQ ID NO: 357699 - RNA, 22 nt, Human
uccaugagagguaacuuuacaa

SEQ ID NO: 357700 - RNA, 21 nt, Human
agaaaaguagaguuuucagag

SEQ ID NO: 357701 - RNA, 22 nt, Human
aauuaguaaccuaauuccaucu

SEQ ID NO: 357702 - RNA, 22 nt, Human
caugggcucuucuggacugcac

SEQ ID NO: 357703 - RNA, 22 nt, Human
uacagauacagaucuagauaca

SEQ ID NO: 357704 - RNA, 22 nt, Human
caaugauggcuaggcagcugcu

SEQ ID NO: 357705 - RNA, 22 nt, Human
agggccugggucuguacuccuc

SEQ ID NO: 357706 - RNA, 22 nt, Human
aaaucaguucacguucugaggu

SEQ ID NO: 357707 - RNA, 22 nt, Human
uucagaauauuuguuuuacaug

SEQ ID NO: 357708 - RNA, 22 nt, Human
cugcagagaauuguggggcuuc

SEQ ID NO: 357709 - RNA, 22 nt, Human
uccucaggcugccuggaagacu

SEQ ID NO: 357710 - RNA, 22 nt, Human
ucuggcucggauuugucuagca

SEQ ID NO: 357711 - RNA, 22 nt, Human
uggcagcaguggagguagaaag

SEQ ID NO: 357712 - RNA, 22 nt, Human
ccauuuguucgcccagcuccaa

SEQ ID NO: 357713 - RNA, 22 nt, Human
uacaaagcuguauagccugguc

SEQ ID NO: 357714 - RNA, 22 nt, Human
gcuggcucuucaguggagauag

SEQ ID NO: 357715 - RNA, 22 nt, Human
cccagacucaucccugggagcu

SEQ ID NO: 357716 - RNA, 22 nt, Human
cuggccuuggugcuugcagaca

SEQ ID NO: 357717 - RNA, 22 nt, Human
cauaugaaauaugaguugaaca

SEQ ID NO: 357718 - RNA, 22 nt, Human
aguaccaugcuuccugacuggu

SEQ ID NO: 357719 - RNA, 22 nt, Human
uuuaaauuuagaagaaacacug

SEQ ID NO: 357720 - RNA, 22 nt, Human
gcugugugcucacguaguggaa

SEQ ID NO: 357721 - RNA, 22 nt, Human
agcauuuagucuuuauugcagc

SEQ ID NO: 357722 - RNA, 19 nt, Human
ugucucagugucccuuccu

SEQ ID NO: 357723 - RNA, 22 nt, Human
cuggagagauccuccugaaaaa

SEQ ID NO: 357724 - RNA, 22 nt, Human
cugcuggccuagcccauccucu

SEQ ID NO: 357725 - RNA, 22 nt, Human
gugaauaauuuuuuaguauaag

SEQ ID NO: 357726 - RNA, 20 nt, Human
gcccaagguccagaaggggg

SEQ ID NO: 357727 - RNA, 22 nt, Human
agcagcauucucugguaugggg

SEQ ID NO: 357728 - RNA, 22 nt, Human
gcugggcaccggagagacccca

SEQ ID NO: 357729 - RNA, 22 nt, Human
cucuggagguugagcccagcaa

SEQ ID NO: 357730 - RNA, 22 nt, Human
caccugggcuaaacuaugcagg

SEQ ID NO: 357731 - RNA, 22 nt, Human
uacauauuugucuuuguacugu

SEQ ID NO: 357732 - RNA, 22 nt, Human
agccacagagcaggagaccuuu

SEQ ID NO: 357733 - RNA, 22 nt, Human
ugcaggugaaaauuaugaggau

SEQ ID NO: 357734 - RNA, 22 nt, Human
cugagucucccggcaguggagg

SEQ ID NO: 357735 - RNA, 22 nt, Human
agaagugcuccagugaguuggg

SEQ ID NO: 357736 - RNA, 22 nt, Human
gagagaagggggauaugagccu

SEQ ID NO: 357737 - RNA, 22 nt, Human
ugucacauaggcaaaauguuuu

SEQ ID NO: 357738 - RNA, 18 nt, Human
aggagccuuugcacugga

SEQ ID NO: 357739 - RNA, 19 nt, Human
ggcucagggcgcugccgcc

SEQ ID NO: 357740 - RNA, 22 nt, Human
caaggccaguccauuuuggaag

SEQ ID NO: 357741 - RNA, 22 nt, Human
agagccaggcaggcaauguuga

SEQ ID NO: 357742 - RNA, 22 nt, Human
gcuauacacauuucuugguagu

SEQ ID NO: 357743 - RNA, 22 nt, Human
cagucuucuaaccuagcagccu

SEQ ID NO: 357744 - RNA, 22 nt, Human
caauaugcaagcuauuaaguau

SEQ ID NO: 357745 - RNA, 22 nt, Human
cauuuauucaugaucuguagcu

SEQ ID NO: 357746 - RNA, 22 nt, Human
auacaacuuuacaugcaauucc

SEQ ID NO: 357747 - RNA, 22 nt, Human
aaacuucagugaaugacuuaug

SEQ ID NO: 357748 - RNA, 23 nt, Human
cagaagcaccuguugacugcugc

SEQ ID NO: 357749 - RNA, 22 nt, Human
uuuaggcauugggugcucaagu

SEQ ID NO: 357750 - RNA, 22 nt, Human
gaggccagaaugagcugaaugc

SEQ ID NO: 357751 - RNA, 22 nt, Human
ugccuggaaggcccaugggaag

SEQ ID NO: 357752 - RNA, 22 nt, Human
uggcucugugucucccagcagc

SEQ ID NO: 357753 - RNA, 22 nt, Human
ucucucagggggaaggcugaag

SEQ ID NO: 357754 - RNA, 22 nt, Human
ucagcugccccaguggccccag

SEQ ID NO: 357755 - RNA, 22 nt, Human
ucccagagccaagcuauggaug

SEQ ID NO: 357756 - RNA, 22 nt, Human
uuauagugggcccaacauggcg

SEQ ID NO: 357757 - RNA, 22 nt, Human
agcaguggccuggggcucugug

SEQ ID NO: 357758 - RNA, 16 nt, Human
gagccaggugccuuga

SEQ ID NO: 357759 - RNA, 22 nt, Human
agcaggcuaagggaccuguuua

SEQ ID NO: 357760 - RNA, 22 nt, Human
uuacagauggaucuagcaaaau

SEQ ID NO: 357761 - RNA, 22 nt, Human
acagcuguggucuccuuagugu

SEQ ID NO: 357762 - RNA, 22 nt, Human
uuuauuagugcuuguaucacug

SEQ ID NO: 357763 - RNA, 22 nt, Human
cucaggauuaaggaaucuaaau

SEQ ID NO: 357764 - RNA, 22 nt, Human
aaguuuaagguggaaguggugg

SEQ ID NO: 357765 - RNA, 19 nt, Human
gagaggccugugcuugaag

SEQ ID NO: 357766 - RNA, 22 nt, Human
agcccucugcaaacaccugaua

SEQ ID NO: 357767 - RNA, 22 nt, Human
ugcuggagaucauuaauguuca

SEQ ID NO: 357768 - RNA, 22 nt, Human
ucaggcagcauuaaacuucagc

SEQ ID NO: 357769 - RNA, 22 nt, Human
agugggcaugaucuggugucug

SEQ ID NO: 357770 - RNA, 22 nt, Human
auuauauugaguauaaccagag

SEQ ID NO: 357771 - RNA, 22 nt, Human
ucugcugugggucuauauuuua

SEQ ID NO: 357772 - RNA, 22 nt, Human
cagcuugaaauauuaggagaug

SEQ ID NO: 357773 - RNA, 22 nt, Human
aaaguccuagcgauccacagaa

SEQ ID NO: 357774 - RNA, 22 nt, Human
cugggacuuuacccuguggccc

SEQ ID NO: 357775 - RNA, 22 nt, Human
aaaaucuaaguagcgaguaagg

SEQ ID NO: 357776 - RNA, 22 nt, Human
auauaaaguguuuagaaagcug

SEQ ID NO: 357777 - RNA, 22 nt, Human
ugaggcagaaauuccuguuuuc

SEQ ID NO: 357778 - RNA, 22 nt, Human
ccagggcagccaacccagaugc

SEQ ID NO: 357779 - RNA, 22 nt, Human
gaaaagagaacaucugaggauc

SEQ ID NO: 357780 - RNA, 22 nt, Human
auuguucaaagugcuuugcaug

SEQ ID NO: 357781 - RNA, 22 nt, Human
uagacacaagagaaggguauaa

SEQ ID NO: 357782 - RNA, 22 nt, Human
aggcugaggggcgagggacccu

SEQ ID NO: 357783 - RNA, 22 nt, Human
ccauaaggagccagacauucca

SEQ ID NO: 357784 - RNA, 22 nt, Human
ggcuucugagugcucugcuguu

SEQ ID NO: 357785 - RNA, 22 nt, Human
acaggacaggcugggcuagacu

SEQ ID NO: 357786 - RNA, 22 nt, Human
uuuccuaguucuaagaaaugua

SEQ ID NO: 357787 - RNA, 22 nt, Human
ccaggaggcagagguuacagug

SEQ ID NO: 357788 - RNA, 22 nt, Human
ggcuggagugggcuccagaguu

SEQ ID NO: 357789 - RNA, 22 nt, Human
cuggccacuggagguggcaccc

SEQ ID NO: 357790 - RNA, 22 nt, Human
ucaguucugcuagaaaaacagu

SEQ ID NO: 357791 - RNA, 20 nt, Human
ucauugcacauaauggaagc

SEQ ID NO: 357792 - RNA, 21 nt, Human
accagcaggagaucagaagga

SEQ ID NO: 357793 - RNA, 22 nt, Human
gcaggcaguuauuuaguagaau

SEQ ID NO: 357794 - RNA, 22 nt, Human
ugggcagagaguagaggcaacg

SEQ ID NO: 357795 - RNA, 22 nt, Human
ggcagcugaccuagcaccaucc

SEQ ID NO: 357796 - RNA, 22 nt, Human
ugggccuguggcuuggcucuag

SEQ ID NO: 357797 - RNA, 22 nt, Human
uuuuucaugagacuagaaguca

SEQ ID NO: 357798 - RNA, 22 nt, Human
cauuucaauacaguuuguaaau

SEQ ID NO: 357799 - RNA, 22 nt, Human
gcuggccauagaagccaaagag

SEQ ID NO: 357800 - RNA, 22 nt, Human
ucccugggcuucuccagacuug

SEQ ID NO: 357801 - RNA, 22 nt, Human
gaggccuguagucauggaugua

SEQ ID NO: 357802 - RNA, 22 nt, Human
gcagggccagggcucaggcugu

SEQ ID NO: 357803 - RNA, 22 nt, Human
uucuucuccuaaggagaguccu

SEQ ID NO: 357804 - RNA, 22 nt, Human
uagaaacagauguuuuugaaga

SEQ ID NO: 357805 - RNA, 22 nt, Human
ccugggagagccaucuguggcc

SEQ ID NO: 357806 - RNA, 22 nt, Human
cucacugacgaggaagcugaga

SEQ ID NO: 357807 - RNA, 22 nt, Human
auguaaggcugccuaugacacu

SEQ ID NO: 357808 - RNA, 22 nt, Human
uaacacugauuuguucucaggg

SEQ ID NO: 357809 - RNA, 22 nt, Human
uuccaugaaggagacugagaag

SEQ ID NO: 357810 - RNA, 22 nt, Human
caggguacagaguuuucuaaac

SEQ ID NO: 357811 - RNA, 22 nt, Human
uggcugaggcuuuucuuaaaga

SEQ ID NO: 357812 - RNA, 22 nt, Human
ccuccugggcuccugucugcac

SEQ ID NO: 357813 - RNA, 22 nt, Human
ggcugccucuggaagcuggaga

SEQ ID NO: 357814 - RNA, 22 nt, Human
gcaagcugcuuaagcucauugu

SEQ ID NO: 357815 - RNA, 22 nt, Human
ccagcucuuuuggcugagugag

SEQ ID NO: 357816 - RNA, 22 nt, Human
ccagcacugcucucagacugag

SEQ ID NO: 357817 - RNA, 22 nt, Human
ccaggcuggauuuugcaguuca

SEQ ID NO: 357818 - RNA, 22 nt, Human
gacccugccaugagugacaggg

SEQ ID NO: 357819 - RNA, 19 nt, Human
aggcagcacccaguccuug

SEQ ID NO: 357820 - RNA, 22 nt, Human
uccuggcccuguggccugcagu

SEQ ID NO: 357821 - RNA, 20 nt, Human
ggcagcuugggcagcaguua

SEQ ID NO: 357822 - RNA, 22 nt, Human
ugucuagggagcugcucaggcu

SEQ ID NO: 357823 - RNA, 22 nt, Human
uuucccaaguguaaacauggca

SEQ ID NO: 357824 - RNA, 22 nt, Human
aaaagucugcucucauuucaga

SEQ ID NO: 357825 - RNA, 22 nt, Human
gacacagagauaggccuguguu

SEQ ID NO: 357826 - RNA, 22 nt, Human
gcagcugcuguggcaucaagcu

SEQ ID NO: 357827 - RNA, 22 nt, Human
aagcccaguuucacacugagac

SEQ ID NO: 357828 - RNA, 22 nt, Human
gcugcucugugacagccuccgg

SEQ ID NO: 357829 - RNA, 22 nt, Human
aaguuauuuccucgugacugaa

SEQ ID NO: 357830 - RNA, 22 nt, Human
cuggagccccaggcugugcaga

SEQ ID NO: 357831 - RNA, 22 nt, Human
cagcugccuaugaccuagccuc

SEQ ID NO: 357832 - RNA, 22 nt, Human
gugcugagcugcagaugcgcuc

SEQ ID NO: 357833 - RNA, 18 nt, Human
cuuucagauggauaugcu

SEQ ID NO: 357834 - RNA, 22 nt, Human
ucugcugcugagcacacuccua

SEQ ID NO: 357835 - RNA, 22 nt, Human
agccaggacguugcucagcucc

SEQ ID NO: 357836 - RNA, 22 nt, Human
gcugagcuagaaaaggaccaca

SEQ ID NO: 357837 - RNA, 22 nt, Human
uuuuccucugcagagcaguuag

SEQ ID NO: 357838 - RNA, 22 nt, Human
auguccagagccggccugcuga

SEQ ID NO: 357839 - RNA, 22 nt, Human
ucugaggcccugcaggcagugu

SEQ ID NO: 357840 - RNA, 22 nt, Human
cuugugcauuucauuccucagg

SEQ ID NO: 357841 - RNA, 22 nt, Human
ccuggagcacauggcaggaggc

SEQ ID NO: 357842 - RNA, 20 nt, Human
ccugaggguuuguguucuuu

SEQ ID NO: 357843 - RNA, 22 nt, Human
acccagccuacaaagcucaccu

SEQ ID NO: 357844 - RNA, 22 nt, Human
accaggcaugauguggagcaca

SEQ ID NO: 357845 - RNA, 22 nt, Human
uccugaaaaauuacauguucag

SEQ ID NO: 357846 - RNA, 22 nt, Human
ggucccaggcugcgggcuggug

SEQ ID NO: 357847 - RNA, 20 nt, Human
cuguggcucaugcaucugcc

SEQ ID NO: 357848 - RNA, 17 nt, Human
gcugccaccuuuggagc

SEQ ID NO: 357849 - RNA, 22 nt, Human
cugagccuuauucaccagcccu

SEQ ID NO: 357850 - RNA, 20 nt, Human
acagaauaugcugguugugg

SEQ ID NO: 357851 - RNA, 22 nt, Human
ucucagagaaaugugucaccau

SEQ ID NO: 357852 - RNA, 22 nt, Human
agucuucacucuucacuacuau

SEQ ID NO: 357853 - RNA, 22 nt, Human
guuucuuagguaaauucuuuga

SEQ ID NO: 357854 - RNA, 22 nt, Human
uugcagggcaggaccauggaca

SEQ ID NO: 357855 - RNA, 22 nt, Human
uuuguacauauauaaaaucugu

SEQ ID NO: 357856 - RNA, 18 nt, Human
accugccuguucuucucu

SEQ ID NO: 357857 - RNA, 22 nt, Human
gugcauuuggugacucucaccc

SEQ ID NO: 357858 - RNA, 22 nt, Human
ucaguuaagaggccacggcagu

SEQ ID NO: 357859 - RNA, 22 nt, Human
cuugaaagcacuccuuugacug

SEQ ID NO: 357860 - RNA, 22 nt, Human
uacaaaugaaccaacuuugaug

SEQ ID NO: 357861 - RNA, 17 nt, Human
gguggccugcaguggcu

SEQ ID NO: 357862 - RNA, 22 nt, Human
ugggcuccagcaccugugcucu

SEQ ID NO: 357863 - RNA, 22 nt, Human
auguccaggaucuauccccaga

SEQ ID NO: 357864 - RNA, 22 nt, Human
ggaagggcaauaaaaucucagg

SEQ ID NO: 357865 - RNA, 22 nt, Human
agggccugggguagcuuacugc

SEQ ID NO: 357866 - RNA, 22 nt, Human
ggagugaaucacuagaugcaga

SEQ ID NO: 357867 - RNA, 22 nt, Human
cagugcagccaaggacaggcac

SEQ ID NO: 357868 - RNA, 22 nt, Human
gccaggagccagcuucuuagca

SEQ ID NO: 357869 - RNA, 22 nt, Human
ugucucugugacuccuuccgcc

SEQ ID NO: 357870 - RNA, 22 nt, Human
cugugcugauucagcacaggcc

SEQ ID NO: 357871 - RNA, 22 nt, Human
ugucucagauacgccaucaagg

SEQ ID NO: 357872 - RNA, 22 nt, Human
agaguguuucagucuuccuaga

SEQ ID NO: 357873 - RNA, 22 nt, Human
acagucuacuugagcuuguaua

SEQ ID NO: 357874 - RNA, 22 nt, Human
ucugcgcugccuugauccuugg

SEQ ID NO: 357875 - RNA, 22 nt, Human
gagggcagaaaauuaugcggug

SEQ ID NO: 357876 - RNA, 22 nt, Human
cagcagagcugggcuuugaauu

SEQ ID NO: 357877 - RNA, 22 nt, Human
agguggccggugccagccgggc

SEQ ID NO: 357878 - RNA, 22 nt, Human
ugaaugaugcaguauaaugaua

SEQ ID NO: 357879 - RNA, 22 nt, Human
uuuuccucugcaauaaaagcag

SEQ ID NO: 357880 - RNA, 22 nt, Human
cagggcuguggaaaacuggugc

SEQ ID NO: 357881 - RNA, 22 nt, Human
cauuuguaggaugcuucuuguu

SEQ ID NO: 357882 - RNA, 22 nt, Human
uugugucugggggagugacauc

SEQ ID NO: 357883 - RNA, 22 nt, Human
cuggccuagcucucugcuugaa

SEQ ID NO: 357884 - RNA, 22 nt, Human
uuggaugaagucuagcuuuagu

SEQ ID NO: 357885 - RNA, 22 nt, Human
agccucuguagaaagcagugug

SEQ ID NO: 357886 - RNA, 22 nt, Human
uagcccagaagagggaagcaac

SEQ ID NO: 357887 - RNA, 22 nt, Human
aucaggaaugaauacuuuugga

SEQ ID NO: 357888 - RNA, 22 nt, Human
acaggggaauuuacugucauua

SEQ ID NO: 357889 - RNA, 19 nt, Human
agcagagcccugaagaucc

SEQ ID NO: 357890 - RNA, 22 nt, Human
uucuagaugauaaaccagcagc

SEQ ID NO: 357891 - RNA, 22 nt, Human
uguuccauaaguggugcuuugu

SEQ ID NO: 357892 - RNA, 22 nt, Human
agaggggaggcgaaccagaguc

SEQ ID NO: 357893 - RNA, 22 nt, Human
acuuaaaaccagacagcgucau

SEQ ID NO: 357894 - RNA, 22 nt, Human
ugggcugcacccucagccucug

SEQ ID NO: 357895 - RNA, 22 nt, Human
cccucugccucugaguaggaca

SEQ ID NO: 357896 - RNA, 22 nt, Human
cauuuauucucagauccuuguc

SEQ ID NO: 357897 - RNA, 22 nt, Human
acuccugggugcugaccagcgu

SEQ ID NO: 357898 - RNA, 22 nt, Human
caggagugagaugcgaucacuu

SEQ ID NO: 357899 - RNA, 22 nt, Human
cauuagaagaacaguuauauua

SEQ ID NO: 357900 - RNA, 22 nt, Human
gcagaggcuguagggaagguug

SEQ ID NO: 357901 - RNA, 22 nt, Human
aaauuccagaaacucaguauau

SEQ ID NO: 357902 - RNA, 22 nt, Human
aucaggauguuuggcugucaua

SEQ ID NO: 357903 - RNA, 22 nt, Human
ccugcagagccacgugccagcg

SEQ ID NO: 357904 - RNA, 22 nt, Human
uuuauuauguacaggcacuaua

SEQ ID NO: 357905 - RNA, 22 nt, Human
auaaggcaagcugucaguuugu

SEQ ID NO: 357906 - RNA, 22 nt, Human
aguuaaagucugaaauagagaa

SEQ ID NO: 357907 - RNA, 19 nt, Human
acagggcagcaauaggaua

SEQ ID NO: 357908 - RNA, 21 nt, Human
uccaggagcacgggacuagga

SEQ ID NO: 357909 - RNA, 22 nt, Human
gaaaugcaggcuuggauucagc

SEQ ID NO: 357910 - RNA, 22 nt, Human
gccugaaguuucaugccucuau

SEQ ID NO: 357911 - RNA, 22 nt, Human
gcagaagcccggucagcgcacg

SEQ ID NO: 357912 - RNA, 22 nt, Human
ugaaggcuguuggauggggaag

SEQ ID NO: 357913 - RNA, 22 nt, Human
cuuguggcccauggcuuccugc

SEQ ID NO: 357914 - RNA, 20 nt, Human
ggggcccaagcccucuugcc

SEQ ID NO: 357915 - RNA, 22 nt, Human
ucugggaaccagugcggcuggg

SEQ ID NO: 357916 - RNA, 22 nt, Human
agcagcuuacauguggccuauc

SEQ ID NO: 357917 - RNA, 20 nt, Human
cucaguguggccugaguguu

SEQ ID NO: 357918 - RNA, 22 nt, Human
ucuuuaaucauaaccaagaugg

SEQ ID NO: 357919 - RNA, 22 nt, Human
cuacauuucccagcugccuucc

SEQ ID NO: 357920 - RNA, 22 nt, Human
acaaaauuaugaagaggccuug

SEQ ID NO: 357921 - RNA, 21 nt, Human
acuguucauuugaugaacugg

SEQ ID NO: 357922 - RNA, 23 nt, Human
aggcagcuggguagcaucuuucu

SEQ ID NO: 357923 - RNA, 22 nt, Human
ugcuauacauguacauauuagu

SEQ ID NO: 357924 - RNA, 22 nt, Human
cacuggggaaaacaggcuucuu

SEQ ID NO: 357925 - RNA, 22 nt, Human
aaagcagaggugauaugacuua

SEQ ID NO: 357926 - RNA, 22 nt, Human
cugccugcaugcugccauagcu

SEQ ID NO: 357927 - RNA, 22 nt, Human
aaggccauuauucugauauauu

SEQ ID NO: 357928 - RNA, 22 nt, Human
ugccagggugucaggagagcua

SEQ ID NO: 357929 - RNA, 22 nt, Human
aagaaugagcucaaagaucuua

SEQ ID NO: 357930 - RNA, 23 nt, Human
uauuagggccaggacuggcaaau

SEQ ID NO: 357931 - RNA, 17 nt, Human
auccccagcaucuagaa

SEQ ID NO: 357932 - RNA, 22 nt, Human
cagcaggcagccauuucacugu

SEQ ID NO: 357933 - RNA, 22 nt, Human
cccuggaggagcuuagagcuug

SEQ ID NO: 357934 - RNA, 23 nt, Human
cugucuccugggcuagguggaau

SEQ ID NO: 357935 - RNA, 22 nt, Human
auuauguagcuaaaaauugugu

SEQ ID NO: 357936 - RNA, 22 nt, Human
caggcagcuagauuuauaacaa

SEQ ID NO: 357937 - RNA, 22 nt, Human
uucucagaugauucagauaaac

SEQ ID NO: 357938 - RNA, 22 nt, Human
cuguuuauuacacuggauagca

SEQ ID NO: 357939 - RNA, 20 nt, Human
aguggggagucaggagugcc

SEQ ID NO: 357940 - RNA, 22 nt, Human
ccaggguggcguagaugcuggg

SEQ ID NO: 357941 - RNA, 22 nt, Human
ucaaggaggugcuuggcuucac

SEQ ID NO: 357942 - RNA, 21 nt, Human
ccuccaggagcagagcccuga

SEQ ID NO: 357943 - RNA, 22 nt, Human
augcaguacagauaauucuaca

SEQ ID NO: 357944 - RNA, 22 nt, Human
aggucacacuuggaucauagaa

SEQ ID NO: 357945 - RNA, 22 nt, Human
auaguggugagcugcauuuaug

SEQ ID NO: 357946 - RNA, 22 nt, Human
ccaggagcauuaagagaacaua

SEQ ID NO: 357947 - RNA, 20 nt, Human
gaggaaaagcugccaggccu

SEQ ID NO: 357948 - RNA, 22 nt, Human
ccaugagacagcaacugaaagu

SEQ ID NO: 357949 - RNA, 22 nt, Human
gcuuggccagcagccgggaugc

SEQ ID NO: 357950 - RNA, 22 nt, Human
uuguuuucacagcuuugcccgg

SEQ ID NO: 357951 - RNA, 22 nt, Human
acaggccacaguggagucucug

SEQ ID NO: 357952 - RNA, 22 nt, Human
cauuuacagugagaguuuuuac

SEQ ID NO: 357953 - RNA, 22 nt, Human
ugugcuucaucacuucucaguu

SEQ ID NO: 357954 - RNA, 22 nt, Human
ucuuugaacuuggcugaucucu

SEQ ID NO: 357955 - RNA, 22 nt, Human
caggggcagucugugugcgugg

SEQ ID NO: 357956 - RNA, 22 nt, Human
auacagaacaagccucaccucc

SEQ ID NO: 357957 - RNA, 22 nt, Human
gcagugguccaguucacaccca

SEQ ID NO: 357958 - RNA, 22 nt, Human
cccagccucuguuugcuccucu

SEQ ID NO: 357959 - RNA, 22 nt, Human
gucaggauuauuuuauuaaaag

SEQ ID NO: 357960 - RNA, 21 nt, Human
uucaagauauuuaaaaggugg

SEQ ID NO: 357961 - RNA, 22 nt, Human
gaggagcuggcagcgucuccgc

SEQ ID NO: 357962 - RNA, 22 nt, Human
cccaggagguguagcugcgugg

SEQ ID NO: 357963 - RNA, 22 nt, Human
uuagaaaugauuucaccucuuu

SEQ ID NO: 357964 - RNA, 22 nt, Human
ucaaaguagggguaagccaggc

SEQ ID NO: 357965 - RNA, 22 nt, Human
aaaggccaagcaugagguggac

SEQ ID NO: 357966 - RNA, 22 nt, Human
uguacaaucuuggucccuuuau

SEQ ID NO: 357967 - RNA, 22 nt, Human
cccugcagagggaugggggcag

SEQ ID NO: 357968 - RNA, 22 nt, Human
agcagcugcagggagggucugc

SEQ ID NO: 357969 - RNA, 23 nt, Human
auaaggcauaaagguacauugga

SEQ ID NO: 357970 - RNA, 22 nt, Human
gaccucagugaauggucaugua

SEQ ID NO: 357971 - RNA, 22 nt, Human
uugaacaguccuaagagacccu

SEQ ID NO: 357972 - RNA, 22 nt, Human
agaugggcgcccuggacugagg

SEQ ID NO: 357973 - RNA, 22 nt, Human
gcagcagaugcuuucauggaca

SEQ ID NO: 357974 - RNA, 22 nt, Human
uccagaccauggauggcugcaa

SEQ ID NO: 357975 - RNA, 22 nt, Human
ucagauggguuuugaaggaugu

SEQ ID NO: 357976 - RNA, 22 nt, Human
ucugagagguuaagcaauuuga

SEQ ID NO: 357977 - RNA, 22 nt, Human
guuauguaugggggccuuauga

SEQ ID NO: 357978 - RNA, 17 nt, Human
ccagagaguaguuagga

SEQ ID NO: 357979 - RNA, 17 nt, Human
accaggcaacacgccca

SEQ ID NO: 357980 - RNA, 21 nt, Human
acaggagaccgccuggcaguc

SEQ ID NO: 357981 - RNA, 22 nt, Human
auaaaacuuggguaugaucccu

SEQ ID NO: 357982 - RNA, 22 nt, Human
cuccucacuuuccagacugggc

SEQ ID NO: 357983 - RNA, 22 nt, Human
caguaucugucaguaaucaggu

SEQ ID NO: 357984 - RNA, 22 nt, Human
aggcucagacaggaaaaguaac

SEQ ID NO: 357985 - RNA, 22 nt, Human
cccccaggcucugacacaggag

SEQ ID NO: 357986 - RNA, 22 nt, Human
aaguguagauuauggagugucu

SEQ ID NO: 357987 - RNA, 22 nt, Human
aggcagcuuaagcccuggccca

SEQ ID NO: 357988 - RNA, 22 nt, Human
uauaucaccaaaaacaguucug

SEQ ID NO: 357989 - RNA, 22 nt, Human
gggaagccaugcucagagguac

SEQ ID NO: 357990 - RNA, 22 nt, Human
gaguccagacaccauaccugau

SEQ ID NO: 357991 - RNA, 22 nt, Human
uggaggaaaaaaccaggcagag

SEQ ID NO: 357992 - RNA, 21 nt, Human
gcugccaccgcgugcuccagg

SEQ ID NO: 357993 - RNA, 22 nt, Human
aucagcugaaaaacaggcagca

SEQ ID NO: 357994 - RNA, 22 nt, Human
auguacacaugcaugcaugugc

SEQ ID NO: 357995 - RNA, 22 nt, Human
cagcugacccgugggaggcggg

SEQ ID NO: 357996 - RNA, 19 nt, Human
ugaggggcucacagucuca

SEQ ID NO: 357997 - RNA, 22 nt, Human
ccacagggacuguuaaaacccu

SEQ ID NO: 357998 - RNA, 22 nt, Human
acacaguauuacaauaggugcu

SEQ ID NO: 357999 - RNA, 22 nt, Human
gagaaccucuccacaagucugg

SEQ ID NO: 358000 - RNA, 22 nt, Human
uccuucagccaugggcucucca

SEQ ID NO: 358001 - RNA, 22 nt, Human
caugcuuugggucagaaaugcc

SEQ ID NO: 358002 - RNA, 22 nt, Human
aagccagcauuuucccauuccu

SEQ ID NO: 358003 - RNA, 22 nt, Human
ccuggccugcucggcucuuaag

SEQ ID NO: 358004 - RNA, 22 nt, Human
uggcuggcaguaggcuaguggc

SEQ ID NO: 358005 - RNA, 19 nt, Human
ccagagcccgccagauggg

SEQ ID NO: 358006 - RNA, 22 nt, Human
gguuugcaugugauguugggca

SEQ ID NO: 358007 - RNA, 19 nt, Human
agcagagcagggccguggg

SEQ ID NO: 358008 - RNA, 22 nt, Human
aaggcaggaugcggacccaucu

SEQ ID NO: 358009 - RNA, 22 nt, Human
cagagcugggaucccaugggcg

SEQ ID NO: 358010 - RNA, 22 nt, Human
gccugggugaauuugauccuaa

SEQ ID NO: 358011 - RNA, 22 nt, Human
cccaggcagagagcuggugagc

SEQ ID NO: 358012 - RNA, 22 nt, Human
aggcucagccccugggaggaga

SEQ ID NO: 358013 - RNA, 22 nt, Human
caggaaccuaaagagacauuac

SEQ ID NO: 358014 - RNA, 22 nt, Human
agggccagcugcagaauuagca

SEQ ID NO: 358015 - RNA, 22 nt, Human
ccuggagcaggagcugcagagg

SEQ ID NO: 358016 - RNA, 22 nt, Human
ucagaggucacacagcaaguuu

SEQ ID NO: 358017 - RNA, 22 nt, Human
gcucuugucaaaaauuaguuga

SEQ ID NO: 358018 - RNA, 22 nt, Human
acuuccugggcaugcagagucc

SEQ ID NO: 358019 - RNA, 22 nt, Human
uguuuauaccuugguauaacca

SEQ ID NO: 358020 - RNA, 22 nt, Human
auuuccuagccucucuugcagu

SEQ ID NO: 358021 - RNA, 22 nt, Human
ccugccugaaggucagccaccc

SEQ ID NO: 358022 - RNA, 22 nt, Human
ugggccugccccaggcuucagc

SEQ ID NO: 358023 - RNA, 19 nt, Human
uuccaaaaucaggauuuga

SEQ ID NO: 358024 - RNA, 22 nt, Human
gcuuggcauugaccauuaucau

SEQ ID NO: 358025 - RNA, 22 nt, Human
ggcucaggacacagugguuuag

SEQ ID NO: 358026 - RNA, 22 nt, Human
ggacuggccggcgcugaggccc

SEQ ID NO: 358027 - RNA, 22 nt, Human
cuuugaaaacuuaaauaacagc

SEQ ID NO: 358028 - RNA, 22 nt, Human
aaagcaaugaugguagacacgu

SEQ ID NO: 358029 - RNA, 22 nt, Human
caagagcuagacuuugucagga

SEQ ID NO: 358030 - RNA, 22 nt, Human
ggggaccuaggcucugucucuu

SEQ ID NO: 358031 - RNA, 22 nt, Human
caguuuuucaaaauuacaugau

SEQ ID NO: 358032 - RNA, 22 nt, Human
cugggaguugacgaggcuugua

SEQ ID NO: 358033 - RNA, 22 nt, Human
uaccucaugcuguacagcacgu

SEQ ID NO: 358034 - RNA, 22 nt, Human
uccauuuucuaaguaucacuua

SEQ ID NO: 358035 - RNA, 22 nt, Human
uuauuucauguaaaauuuaugu

SEQ ID NO: 358036 - RNA, 22 nt, Human
uuccagugaugggcaauuuggu

SEQ ID NO: 358037 - RNA, 22 nt, Human
uaaaugugucuauggacccgcc

SEQ ID NO: 358038 - RNA, 20 nt, Human
aaggcacuaugucugcuagc

SEQ ID NO: 358039 - RNA, 20 nt, Human
cuaucuccuggcgugccuuc

SEQ ID NO: 358040 - RNA, 22 nt, Human
ccuggugccacuagagaauguc

SEQ ID NO: 358041 - RNA, 23 nt, Human
acaugggagggacauggaggcug

SEQ ID NO: 358042 - RNA, 17 nt, Human
uugggagagaaagguau

SEQ ID NO: 358043 - RNA, 22 nt, Human
gaggaggcacuaguuagugaca

SEQ ID NO: 358044 - RNA, 22 nt, Human
caggcagagucagauuagacuu

SEQ ID NO: 358045 - RNA, 22 nt, Human
gcaggagaaaugaagauugggu

SEQ ID NO: 358046 - RNA, 20 nt, Human
ucagugauuaucucugagug

SEQ ID NO: 358047 - RNA, 22 nt, Human
caccugagugucaguauucuca

SEQ ID NO: 358048 - RNA, 19 nt, Human
uaucuguuuccugcuuguc

SEQ ID NO: 358049 - RNA, 22 nt, Human
gcaggagcugcucuccugacga

SEQ ID NO: 358050 - RNA, 22 nt, Human
augaggcuaugaauggggagau

SEQ ID NO: 358051 - RNA, 22 nt, Human
gcuggcugaggucuagcucuuu

SEQ ID NO: 358052 - RNA, 20 nt, Human
uagauuucauacuucucuuu

SEQ ID NO: 358053 - RNA, 22 nt, Human
ugccucugguuaucugguaccu

SEQ ID NO: 358054 - RNA, 19 nt, Human
cuucuucuuggcagccaag

SEQ ID NO: 358055 - RNA, 22 nt, Human
caggagaggcuguacguuucuc

SEQ ID NO: 358056 - RNA, 22 nt, Human
uuuaaaauuuagaccucuccac

SEQ ID NO: 358057 - RNA, 22 nt, Human
aaagaacaaaugauauaugguu

SEQ ID NO: 358058 - RNA, 22 nt, Human
ugcagggccuucuagaccaugg

SEQ ID NO: 358059 - RNA, 22 nt, Human
gcucugcugaagccccuugcau

SEQ ID NO: 358060 - RNA, 22 nt, Human
uucuuaacuggaaaaugucaga

SEQ ID NO: 358061 - RNA, 22 nt, Human
ugcuggcucaguuugcagacuc

SEQ ID NO: 358062 - RNA, 18 nt, Human
uccuccuuuggccuuuuc

SEQ ID NO: 358063 - RNA, 22 nt, Human
cugaagaugucugagaugcuca

SEQ ID NO: 358064 - RNA, 22 nt, Human
cacugaaggcugcagcucagcc

SEQ ID NO: 358065 - RNA, 22 nt, Human
agcucccaggcagucaugagga

SEQ ID NO: 358066 - RNA, 22 nt, Human
acaagaauuuacauguagugga

SEQ ID NO: 358067 - RNA, 22 nt, Human
aggagccaggaaaccugcucug

SEQ ID NO: 358068 - RNA, 22 nt, Human
gcugaaggaggcucugguacua

SEQ ID NO: 358069 - RNA, 22 nt, Human
ucacugaauacuugucucaucc

SEQ ID NO: 358070 - RNA, 20 nt, Human
aguuuauuccaggagaacug

SEQ ID NO: 358071 - RNA, 22 nt, Human
agucuucccugugccagagugu

SEQ ID NO: 358072 - RNA, 22 nt, Human
acaguggaaagaacauggauuu

SEQ ID NO: 358073 - RNA, 22 nt, Human
uuuccucugggcccugccaccc

SEQ ID NO: 358074 - RNA, 22 nt, Human
ggaggaagcacacggcuuguau

SEQ ID NO: 358075 - RNA, 22 nt, Human
gcaagcugaugugauagugaaa

SEQ ID NO: 358076 - RNA, 22 nt, Human
gcugccagcucacucuccugag

SEQ ID NO: 358077 - RNA, 21 nt, Human
ugggaugggucugggaccagc

SEQ ID NO: 358078 - RNA, 20 nt, Human
gccugagcuauugccaggau

SEQ ID NO: 358079 - RNA, 20 nt, Human
auacacauauucuugcaacu

SEQ ID NO: 358080 - RNA, 17 nt, Human
ugauaguucauuuuaag

SEQ ID NO: 358081 - RNA, 22 nt, Human
cuggcucuucagugcuugguuc

SEQ ID NO: 358082 - RNA, 22 nt, Human
agggcuccaggggaccaucagu

SEQ ID NO: 358083 - RNA, 22 nt, Human
aaaucugggucaagguggagug

SEQ ID NO: 358084 - RNA, 22 nt, Human
accuuaaaacugacacauggag

SEQ ID NO: 358085 - RNA, 22 nt, Human
aggcugagguaggaggaucgcu

SEQ ID NO: 358086 - RNA, 22 nt, Human
gcaggugggggucggugcaucu

SEQ ID NO: 358087 - RNA, 22 nt, Human
cuguccucuguccucagcagga

SEQ ID NO: 358088 - RNA, 22 nt, Human
uuucagcugguaaaggaguagc

SEQ ID NO: 358089 - RNA, 22 nt, Human
uggcucugugcuucuaguaucu

SEQ ID NO: 358090 - RNA, 22 nt, Human
caguccuugcucaaagucuaca

SEQ ID NO: 358091 - RNA, 22 nt, Human
acagugucugacacauuguagc

SEQ ID NO: 358092 - RNA, 22 nt, Human
uccaggagguugagacugcagu

SEQ ID NO: 358093 - RNA, 21 nt, Human
agcuggcagauauggugucug

SEQ ID NO: 358094 - RNA, 22 nt, Human
auagauauuugaguuguuucca

SEQ ID NO: 358095 - RNA, 17 nt, Human
aggugcagaggcagagc

SEQ ID NO: 358096 - RNA, 22 nt, Human
acugcaucugaaacauggguca

SEQ ID NO: 358097 - RNA, 22 nt, Human
ucaguuuuaagguuugagaauu

SEQ ID NO: 358098 - RNA, 22 nt, Human
gagagugaaggcuucccagcaa

SEQ ID NO: 358099 - RNA, 22 nt, Human
ccugccagcauggcuuaucucc

SEQ ID NO: 358100 - RNA, 22 nt, Human
ugggaggcagguaggugaugau

SEQ ID NO: 358101 - RNA, 22 nt, Human
acagcagcauaaacugacuaag

SEQ ID NO: 358102 - RNA, 22 nt, Human
gcuggccaggugcuuugguucu

SEQ ID NO: 358103 - RNA, 20 nt, Human
gcagcuacucugucucgcuc

SEQ ID NO: 358104 - RNA, 21 nt, Human
auccuugaucagaagagugcu

SEQ ID NO: 358105 - RNA, 22 nt, Human
cagcuggccaaucagggcgccc

SEQ ID NO: 358106 - RNA, 22 nt, Human
ccucccacuucuugcugagguc

SEQ ID NO: 358107 - RNA, 22 nt, Human
uuucaguuuuugcucgauguau

SEQ ID NO: 358108 - RNA, 22 nt, Human
cauguugaauggccuugauuuu

SEQ ID NO: 358109 - RNA, 22 nt, Human
ccagaggagggcucugaugagg

SEQ ID NO: 358110 - RNA, 22 nt, Human
caggucccgccccgggcugacc

SEQ ID NO: 358111 - RNA, 19 nt, Human
ccuggcccugcugcgcggg

SEQ ID NO: 358112 - RNA, 22 nt, Human
gugggcaaggucccugccagcu

SEQ ID NO: 358113 - RNA, 22 nt, Human
uuuccucugucaugacagcuga

SEQ ID NO: 358114 - RNA, 22 nt, Human
gucaggcugccagucuuuauug

SEQ ID NO: 358115 - RNA, 22 nt, Human
ugaagcaguucucagaaguggg

SEQ ID NO: 358116 - RNA, 22 nt, Human
cccagcucucugcucuuagccu

SEQ ID NO: 358117 - RNA, 22 nt, Human
guccugggcccaggggcugccu

SEQ ID NO: 358118 - RNA, 22 nt, Human
gaguggggcguggauccagcgu

SEQ ID NO: 358119 - RNA, 22 nt, Human
ugagccugaguucaaggcugca

SEQ ID NO: 358120 - RNA, 17 nt, Human
uuaaaggaugcucucuc

SEQ ID NO: 358121 - RNA, 22 nt, Human
cccugcagacgucuugaugccu

SEQ ID NO: 358122 - RNA, 19 nt, Human
agcuguggggccuagcacc

SEQ ID NO: 358123 - RNA, 22 nt, Human
cauuucaaacaguuacagcugc

SEQ ID NO: 358124 - RNA, 22 nt, Human
ucuggaguccagauccauuugg

SEQ ID NO: 358125 - RNA, 22 nt, Human
ccaggccucaccugcccaccua

SEQ ID NO: 358126 - RNA, 22 nt, Human
gaaaucugcuucuugcauagua

SEQ ID NO: 358127 - RNA, 22 nt, Human
cuuuucaugagucuguuauggg

SEQ ID NO: 358128 - RNA, 22 nt, Human
acauuuuuuagagucccacauu

SEQ ID NO: 358129 - RNA, 22 nt, Human
aggugaaguugaggaggcagaa

SEQ ID NO: 358130 - RNA, 22 nt, Human
gcugaggccccagggugauggg

SEQ ID NO: 358131 - RNA, 22 nt, Human
gcuguucauagaaauggucuca

SEQ ID NO: 358132 - RNA, 22 nt, Human
aauaaauguuaagauugucuca

SEQ ID NO: 358133 - RNA, 22 nt, Human
uagucaccucuuuaaauguccu

SEQ ID NO: 358134 - RNA, 22 nt, Human
ccagggcucaggcucccagugg

SEQ ID NO: 358135 - RNA, 22 nt, Human
uggcagcagacaaaaggccauu

SEQ ID NO: 358136 - RNA, 22 nt, Human
gccugagacagugugguccaau

SEQ ID NO: 358137 - RNA, 22 nt, Human
aguccuuagaacacuguaucug

SEQ ID NO: 358138 - RNA, 22 nt, Human
uagugaaauuuaugcacagcua

SEQ ID NO: 358139 - RNA, 20 nt, Human
accagguggcugaugacacc

SEQ ID NO: 358140 - RNA, 22 nt, Human
guccucaguaagagggccucug

SEQ ID NO: 358141 - RNA, 22 nt, Human
ucagccagguaauguggagaug

SEQ ID NO: 358142 - RNA, 22 nt, Human
ggccuggccuccagaugugggc

SEQ ID NO: 358143 - RNA, 22 nt, Human
gagaggcugacuggcuguccug

SEQ ID NO: 358144 - RNA, 22 nt, Human
ggcagcacugcagcuuguuggg

SEQ ID NO: 358145 - RNA, 22 nt, Human
cccaagcagggugcagaggcau

SEQ ID NO: 358146 - RNA, 22 nt, Human
auuuaugacuggugaauagaac

SEQ ID NO: 358147 - RNA, 22 nt, Human
agaaauacuuuguaaaucucac

SEQ ID NO: 358148 - RNA, 22 nt, Human
aagcugccaccagcccagggca

SEQ ID NO: 358149 - RNA, 18 nt, Human
gagcagaggcucaacugg

SEQ ID NO: 358150 - RNA, 22 nt, Human
ugacauuucgguguaugugaug

SEQ ID NO: 358151 - RNA, 22 nt, Human
ggaagccagagugcugggcagg

SEQ ID NO: 358152 - RNA, 22 nt, Human
guucuaauauuuuaaaagccaa

SEQ ID NO: 358153 - RNA, 22 nt, Human
guguguuuagcauuagcagggg

SEQ ID NO: 358154 - RNA, 22 nt, Human
acuggcaguagagggagcgcau

SEQ ID NO: 358155 - RNA, 22 nt, Human
uuuuagauaguuuaacugcacu

SEQ ID NO: 358156 - RNA, 22 nt, Human
agcagggggaguuagacuagau

SEQ ID NO: 358157 - RNA, 22 nt, Human
gugcagcugcaggagucagguc

SEQ ID NO: 358158 - RNA, 22 nt, Human
cuccuguauguugggcuucaca

SEQ ID NO: 358159 - RNA, 19 nt, Human
gaaggcugaaaugaagcac

SEQ ID NO: 358160 - RNA, 22 nt, Human
uuuugucuaagaacuuugcaaa

SEQ ID NO: 358161 - RNA, 22 nt, Human
ucauugcagaaauaaaggugaa

SEQ ID NO: 358162 - RNA, 22 nt, Human
aaaagacaucuauuucaggcag

SEQ ID NO: 358163 - RNA, 22 nt, Human
ugguaauuaauuugauagguuc

SEQ ID NO: 358164 - RNA, 22 nt, Human
uaucuguugucuuuuacaugua

SEQ ID NO: 358165 - RNA, 22 nt, Human
uucauacuguguuuccaaguuu

SEQ ID NO: 358166 - RNA, 22 nt, Human
ucaugcuuauugcauauuugga

SEQ ID NO: 358167 - RNA, 23 nt, Human
cagaggguuccauggagcauggu

SEQ ID NO: 358168 - RNA, 22 nt, Human
ugagaagcagcuuacagguguc

SEQ ID NO: 358169 - RNA, 22 nt, Human
caaggagaaaacggcuucugaa

SEQ ID NO: 358170 - RNA, 22 nt, Human
ccaguacugucuccaauauucc

SEQ ID NO: 358171 - RNA, 22 nt, Human
uuagagaaauucugguaaugua

SEQ ID NO: 358172 - RNA, 22 nt, Human
gaggccacgguuuuccuugggg

SEQ ID NO: 358173 - RNA, 21 nt, Human
aggggacagaguagcuccagg

SEQ ID NO: 358174 - RNA, 23 nt, Human
ugucccagagggagggauaggcu

SEQ ID NO: 358175 - RNA, 22 nt, Human
aagacugucuuuucugagugac

SEQ ID NO: 358176 - RNA, 22 nt, Human
ucuccuuugaaaguuaggacug

SEQ ID NO: 358177 - RNA, 22 nt, Human
aguuaacaaguuggcaaucaac

SEQ ID NO: 358178 - RNA, 22 nt, Human
acaaaauuguguuaaacuuuau

SEQ ID NO: 358179 - RNA, 22 nt, Human
aggcagcagucaugaggaaaga

SEQ ID NO: 358180 - RNA, 22 nt, Human
uuucccaagaaaaauaauugga

SEQ ID NO: 358181 - RNA, 22 nt, Human
cgccugggaguccacaccugcu

SEQ ID NO: 358182 - RNA, 22 nt, Human
cucuggaguggguggccgggag

SEQ ID NO: 358183 - RNA, 22 nt, Human
uuuaaucaggcaaagcauaaua

SEQ ID NO: 358184 - RNA, 22 nt, Human
uggccucuggcugaggacuaac

SEQ ID NO: 358185 - RNA, 22 nt, Human
ugaaacuaggccaaucaaauua

SEQ ID NO: 358186 - RNA, 22 nt, Human
gcuguggcugaagaugcaggga

SEQ ID NO: 358187 - RNA, 22 nt, Human
caguggcacccacgggcugggc

SEQ ID NO: 358188 - RNA, 22 nt, Human
cauauaaauacaacauguguua

SEQ ID NO: 358189 - RNA, 22 nt, Human
cagaaguaagauuacugugaga

SEQ ID NO: 358190 - RNA, 22 nt, Human
acuuuaauuaaugaacuguggc

SEQ ID NO: 358191 - RNA, 22 nt, Human
ggagaugcuuuccaguggggau

SEQ ID NO: 358192 - RNA, 22 nt, Human
gggcugagcuguucugaguuua

SEQ ID NO: 358193 - RNA, 22 nt, Human
ucuccucugcgcggcagugccc

SEQ ID NO: 358194 - RNA, 22 nt, Human
ucugucacaauuugcuuacucu

SEQ ID NO: 358195 - RNA, 17 nt, Human
aggcauggucuggggug

SEQ ID NO: 358196 - RNA, 22 nt, Human
ugcucacagcccagaacauaau

SEQ ID NO: 358197 - RNA, 22 nt, Human
cuucuucaguugcauguauugg

SEQ ID NO: 358198 - RNA, 22 nt, Human
aucuggcuuggguguggguagc

SEQ ID NO: 358199 - RNA, 22 nt, Human
cagcugccacuugcucucggcu

SEQ ID NO: 358200 - RNA, 22 nt, Human
caggccugggcuucggggcuga

SEQ ID NO: 358201 - RNA, 22 nt, Human
uccuuggcaugccgucuucucc

SEQ ID NO: 358202 - RNA, 22 nt, Human
acauuucucauaggagagccac

SEQ ID NO: 358203 - RNA, 22 nt, Human
caucacagggggcuagaagucu

SEQ ID NO: 358204 - RNA, 22 nt, Human
ggcaggaggugaguggcgggug

SEQ ID NO: 358205 - RNA, 23 nt, Human
agcauggaauaggaaagaggcag

SEQ ID NO: 358206 - RNA, 22 nt, Human
aggcagauauuggggugaugug

SEQ ID NO: 358207 - RNA, 19 nt, Human
ggcugccuggagcgagggc

SEQ ID NO: 358208 - RNA, 22 nt, Human
gcacccagaauaaggacaggac

SEQ ID NO: 358209 - RNA, 22 nt, Human
cuggagcagcagguggccaggg

SEQ ID NO: 358210 - RNA, 23 nt, Human
cauaaaauauuaguaugguagca

SEQ ID NO: 358211 - RNA, 22 nt, Human
uugucccaggacuugcauagau

SEQ ID NO: 358212 - RNA, 22 nt, Human
augcuuuagugucaaguuuggg

SEQ ID NO: 358213 - RNA, 22 nt, Human
ggcuucucucuucacauggcuu

SEQ ID NO: 358214 - RNA, 22 nt, Human
cagaggcagugggguugcuccu

SEQ ID NO: 358215 - RNA, 22 nt, Human
aguucacauaucuguuuuauuu

SEQ ID NO: 358216 - RNA, 22 nt, Human
ugucucugauaaguaguucagu

SEQ ID NO: 358217 - RNA, 22 nt, Human
uggcaggaaaguaacagagcac

SEQ ID NO: 358218 - RNA, 22 nt, Human
cagcuuuaccaauauuuggaaa

SEQ ID NO: 358219 - RNA, 22 nt, Human
auguaagguucagaguauguga

SEQ ID NO: 358220 - RNA, 22 nt, Human
cacaggccugucucuuucuaac

SEQ ID NO: 358221 - RNA, 22 nt, Human
uaaugcaguacugauauaaaca

SEQ ID NO: 358222 - RNA, 22 nt, Human
uggcagggugggcuucagcccc

SEQ ID NO: 358223 - RNA, 18 nt, Human
caagaaucucuaaagaag

SEQ ID NO: 358224 - RNA, 18 nt, Human
gcacuucacccagcuagu

SEQ ID NO: 358225 - RNA, 22 nt, Human
aggaccugcuaaugugccaagu

SEQ ID NO: 358226 - RNA, 21 nt, Human
ucagaguguguuacagcaagc

SEQ ID NO: 358227 - RNA, 22 nt, Human
aggagccaugagugacaucaca

SEQ ID NO: 358228 - RNA, 22 nt, Human
cucucugggcccaguuggcacc

SEQ ID NO: 358229 - RNA, 22 nt, Human
gggaaggagccugcuugcuaga

SEQ ID NO: 358230 - RNA, 22 nt, Human
agcugcaggcccaugcucaguc

SEQ ID NO: 358231 - RNA, 20 nt, Human
cucuuaaauguaaaguaggc

SEQ ID NO: 358232 - RNA, 22 nt, Human
uuccuuagcugucccuggaaau

SEQ ID NO: 358233 - RNA, 22 nt, Human
auuuaaauuuucugauggagag

SEQ ID NO: 358234 - RNA, 22 nt, Human
aaugcugcaagaggugaaaaga

SEQ ID NO: 358235 - RNA, 22 nt, Human
ggcagccuccagggcacuggug

SEQ ID NO: 358236 - RNA, 22 nt, Human
aaaauuauagaucuagugccug

SEQ ID NO: 358237 - RNA, 22 nt, Human
ucagaggguggcugggagcauc

SEQ ID NO: 358238 - RNA, 22 nt, Human
accaggaggaaguguuaaugau

SEQ ID NO: 358239 - RNA, 22 nt, Human
acuguugucaggcugcuuugga

SEQ ID NO: 358240 - RNA, 22 nt, Human
caugaagcuugaagcaguccac

SEQ ID NO: 358241 - RNA, 19 nt, Human
caggccagugucagggggc

SEQ ID NO: 358242 - RNA, 22 nt, Human
ccugcuguaaugugucuuuauu

SEQ ID NO: 358243 - RNA, 22 nt, Human
uuagaaaugucacagaucugau

SEQ ID NO: 358244 - RNA, 22 nt, Human
aaacagcuggucucaaauguuc

SEQ ID NO: 358245 - RNA, 22 nt, Human
caguauguuugggagacaugac

SEQ ID NO: 358246 - RNA, 22 nt, Human
caguguggugagauuccaggug

SEQ ID NO: 358247 - RNA, 18 nt, Human
ugagaggcuauuuuuugc

SEQ ID NO: 358248 - RNA, 22 nt, Human
gccugguguccagaggcgagug

SEQ ID NO: 358249 - RNA, 22 nt, Human
auguuuccgugagcauccuuga

SEQ ID NO: 358250 - RNA, 22 nt, Human
gggcagcuggcuuauagguuug

SEQ ID NO: 358251 - RNA, 21 nt, Human
aggcucagcagguguauaaag

SEQ ID NO: 358252 - RNA, 22 nt, Human
uuuccaaaaguuuguucugugc

SEQ ID NO: 358253 - RNA, 22 nt, Human
uuuucucuacaaaauaaccagc

SEQ ID NO: 358254 - RNA, 22 nt, Human
ugaaugaauccuaacaaagaca

SEQ ID NO: 358255 - RNA, 22 nt, Human
agcagcugagaugguaagauuc

SEQ ID NO: 358256 - RNA, 23 nt, Human
ggcuggcccggggcugcuccuga

SEQ ID NO: 358257 - RNA, 22 nt, Human
aaguccuuaggaagcagucguu

SEQ ID NO: 358258 - RNA, 22 nt, Human
uaacagaaaggggacagaaaua

SEQ ID NO: 358259 - RNA, 22 nt, Human
cagagaaacucagauagcugau

SEQ ID NO: 358260 - RNA, 22 nt, Human
aguggcagagccaagauaugau

SEQ ID NO: 358261 - RNA, 21 nt, Human
aguucauacugaguaacaaaa

SEQ ID NO: 358262 - RNA, 23 nt, Human
augguuuaugucacacuuuugau

SEQ ID NO: 358263 - RNA, 22 nt, Human
gggcugagcacauacugacagc

SEQ ID NO: 358264 - RNA, 22 nt, Human
aagucaccccacacucuuggga

SEQ ID NO: 358265 - RNA, 22 nt, Human
caaguccucaaagggcucugcu

SEQ ID NO: 358266 - RNA, 22 nt, Human
acaucugaccauuacaagacau

SEQ ID NO: 358267 - RNA, 20 nt, Human
gagauuuccaaucaugccca

SEQ ID NO: 358268 - RNA, 22 nt, Human
gccugcagccucaagggcugag

SEQ ID NO: 358269 - RNA, 22 nt, Human
agggccugucagcgguguccug

SEQ ID NO: 358270 - RNA, 22 nt, Human
ggcacagagcccagcuuccuag

SEQ ID NO: 358271 - RNA, 22 nt, Human
aaacuucauggauaauauaaag

SEQ ID NO: 358272 - RNA, 22 nt, Human
uagggcucagcucuagcuccug

SEQ ID NO: 358273 - RNA, 20 nt, Human
ucuaauuaaaauugucuagu

SEQ ID NO: 358274 - RNA, 22 nt, Human
aucuacaggcugaggugggagg

SEQ ID NO: 358275 - RNA, 22 nt, Human
cuacuucugugaugaaacuaca

SEQ ID NO: 358276 - RNA, 22 nt, Human
aucaaguuuucuuaguugacug

SEQ ID NO: 358277 - RNA, 22 nt, Human
gcagaggcauuucugacgcugc

SEQ ID NO: 358278 - RNA, 22 nt, Human
agagcugagaauguggcuuccu

SEQ ID NO: 358279 - RNA, 22 nt, Human
uguacaaugccgagacuaacuc

SEQ ID NO: 358280 - RNA, 23 nt, Human
uucaaaacuggaaaaucagaugc

SEQ ID NO: 358281 - RNA, 20 nt, Human
auuccauaguuggcacuuuu

SEQ ID NO: 358282 - RNA, 22 nt, Human
aaugggauaggucuucaggaau

SEQ ID NO: 358283 - RNA, 19 nt, Human
ucgagucaagacacuaggc

SEQ ID NO: 358284 - RNA, 22 nt, Human
uauaauccugcuucacauugaa

SEQ ID NO: 358285 - RNA, 22 nt, Human
gcagcuuggauuucuguaguuu

SEQ ID NO: 358286 - RNA, 22 nt, Human
ccccaggagauuugggagcaca

SEQ ID NO: 358287 - RNA, 22 nt, Human
agggggcccuugcaggugagcg

SEQ ID NO: 358288 - RNA, 22 nt, Human
cacaggggcaaacuguagggga

SEQ ID NO: 358289 - RNA, 22 nt, Human
ggguccaggucuucaggcagag

SEQ ID NO: 358290 - RNA, 18 nt, Human
cgaggcaggcggaucacg

SEQ ID NO: 358291 - RNA, 23 nt, Human
acacauuuuucccguucugaggu

SEQ ID NO: 358292 - RNA, 22 nt, Human
ccacccuggacaggccucugag

SEQ ID NO: 358293 - RNA, 22 nt, Human
gcugccucccccauggcuggaa

SEQ ID NO: 358294 - RNA, 22 nt, Human
ggcgcucaguguugccccagag

SEQ ID NO: 358295 - RNA, 22 nt, Human
aaauggauggaauugacauuua

SEQ ID NO: 358296 - RNA, 22 nt, Human
cagcccaggccgacaguuccuc

SEQ ID NO: 358297 - RNA, 22 nt, Human
ccuggcugcuuucacuauggag

SEQ ID NO: 358298 - RNA, 22 nt, Human
acuuucuccagaaaaccaagga

SEQ ID NO: 358299 - RNA, 22 nt, Human
cuggacucugcagagaaaagua

SEQ ID NO: 358300 - RNA, 22 nt, Human
ccagggccaagagaccucgagg

SEQ ID NO: 358301 - RNA, 21 nt, Human
guggcucugccaggacugaaa

SEQ ID NO: 358302 - RNA, 22 nt, Human
cuggcugggagcgagcugcuca

SEQ ID NO: 358303 - RNA, 22 nt, Human
uggagaaggccggccaggagug

SEQ ID NO: 358304 - RNA, 22 nt, Human
uucaccacagucucaucuacgc

SEQ ID NO: 358305 - RNA, 22 nt, Human
uguuccuaaauaugaauggaga

SEQ ID NO: 358306 - RNA, 22 nt, Human
cccaggaggaggaaaaagcucg

SEQ ID NO: 358307 - RNA, 22 nt, Human
caggagauguaagacuucuguu

SEQ ID NO: 358308 - RNA, 22 nt, Human
uccugcagaccucagucagguc

SEQ ID NO: 358309 - RNA, 22 nt, Human
aacauguugcuuuaauaauauu

SEQ ID NO: 358310 - RNA, 22 nt, Human
ucucgacagccuggcacagugg

SEQ ID NO: 358311 - RNA, 20 nt, Human
ucaaaggcaaaggugggugu

SEQ ID NO: 358312 - RNA, 22 nt, Human
ggcccagccggcgagucucgcg

SEQ ID NO: 358313 - RNA, 22 nt, Human
gggaggaaagagaaguggucca

SEQ ID NO: 358314 - RNA, 19 nt, Human
cugccuguuauggagagaa

SEQ ID NO: 358315 - RNA, 20 nt, Human
ugggcagcacugcuggcugg

SEQ ID NO: 358316 - RNA, 22 nt, Human
uggcagagacaaggccgggccu

SEQ ID NO: 358317 - RNA, 22 nt, Human
cccagcaggucggugcugccug

SEQ ID NO: 358318 - RNA, 20 nt, Human
aguacaauguaugauucaga

SEQ ID NO: 358319 - RNA, 21 nt, Human
auggcuuuuuuaaagcuugug

SEQ ID NO: 358320 - RNA, 22 nt, Human
gaggucagucagaccaggguuu

SEQ ID NO: 358321 - RNA, 22 nt, Human
uuaagucacuuaucuaaagaca

SEQ ID NO: 358322 - RNA, 22 nt, Human
cugcugugccucuuuucacgug

SEQ ID NO: 358323 - RNA, 22 nt, Human
gggugggguucaggaaucuuca

SEQ ID NO: 358324 - RNA, 22 nt, Human
uggcugccuuucaccucaucuc

SEQ ID NO: 358325 - RNA, 22 nt, Human
gagggcauaguuaaauaggagg

SEQ ID NO: 358326 - RNA, 17 nt, Human
ucuguccagggagugug

SEQ ID NO: 358327 - RNA, 22 nt, Human
aaauagcagccuuuaguuaaca

SEQ ID NO: 358328 - RNA, 22 nt, Human
uuugcauuuugauaagaucacu

SEQ ID NO: 358329 - RNA, 22 nt, Human
uuuacagaugaggauacugagg

SEQ ID NO: 358330 - RNA, 22 nt, Human
aggcucagccugggccuagagc

SEQ ID NO: 358331 - RNA, 22 nt, Human
cagcuguguaugagagcaugcu

SEQ ID NO: 358332 - RNA, 22 nt, Human
gggcuccaccuagggacacugg

SEQ ID NO: 358333 - RNA, 22 nt, Human
acuauacauugaauguuaaggu

SEQ ID NO: 358334 - RNA, 22 nt, Human
gaaugugugacucuauugagca

SEQ ID NO: 358335 - RNA, 22 nt, Human
agccacgucccugucaggguca

SEQ ID NO: 358336 - RNA, 22 nt, Human
cacugcuuuaaggcugaguaac

SEQ ID NO: 358337 - RNA, 22 nt, Human
aaacaaacaauuaguugugugg

SEQ ID NO: 358338 - RNA, 22 nt, Human
ggucagguuuuuaggagugacc

SEQ ID NO: 358339 - RNA, 23 nt, Human
uuuuaauuuggacauaagaagau

SEQ ID NO: 358340 - RNA, 22 nt, Human
ucuucagauugcacugagcaag

SEQ ID NO: 358341 - RNA, 18 nt, Human
cucagagaugcccuuauu

SEQ ID NO: 358342 - RNA, 22 nt, Human
caggaugaagggcaaaggcaag

SEQ ID NO: 358343 - RNA, 22 nt, Human
aggagucauugagagggguccu

SEQ ID NO: 358344 - RNA, 22 nt, Human
uccuuguugcugcagucaccug

SEQ ID NO: 358345 - RNA, 22 nt, Human
cagcuccugcagcugcugccgu

SEQ ID NO: 358346 - RNA, 22 nt, Human
agggaggucuuugaggggcuua

SEQ ID NO: 358347 - RNA, 18 nt, Human
cagcugccagcucaugga

SEQ ID NO: 358348 - RNA, 22 nt, Human
ggacuucuaagugccagacacu

SEQ ID NO: 358349 - RNA, 22 nt, Human
gcagagaggaaugaagccaucc

SEQ ID NO: 358350 - RNA, 22 nt, Human
gccagggcucgcggucccucgu

SEQ ID NO: 358351 - RNA, 22 nt, Human
agcuggcagucauccuagugag

SEQ ID NO: 358352 - RNA, 22 nt, Human
uccagugguaguaaagaggucu

SEQ ID NO: 358353 - RNA, 22 nt, Human
ggcaguggugggaggcucgcuc

SEQ ID NO: 358354 - RNA, 22 nt, Human
aaguucaaggaagccuccaguu

SEQ ID NO: 358355 - RNA, 22 nt, Human
gugaauaaagggaguuuucaaa

SEQ ID NO: 358356 - RNA, 22 nt, Human
aguacaacauuagaguaucuua

SEQ ID NO: 358357 - RNA, 22 nt, Human
cagcaggcguugggagaaagac

SEQ ID NO: 358358 - RNA, 22 nt, Human
gaggagguuccggguggagaag

SEQ ID NO: 358359 - RNA, 22 nt, Human
auggaagguccuacagagcgca

SEQ ID NO: 358360 - RNA, 22 nt, Human
gccuggcccagggcucuuguug

SEQ ID NO: 358361 - RNA, 22 nt, Human
aauuuuaaucaguggugcugag

SEQ ID NO: 358362 - RNA, 22 nt, Human
ucaaggugcugugcugugcuag

SEQ ID NO: 358363 - RNA, 22 nt, Human
ugugaaagucaaauuaauugaa

SEQ ID NO: 358364 - RNA, 22 nt, Human
gcacccagccagcaucucagag

SEQ ID NO: 358365 - RNA, 22 nt, Human
ccaggcuggagugcaauggugc

SEQ ID NO: 358366 - RNA, 21 nt, Human
auugaaagucaacaaucaguu

SEQ ID NO: 358367 - RNA, 22 nt, Human
agcuuuaucagaggagucucua

SEQ ID NO: 358368 - RNA, 22 nt, Human
ugcaagaggaauucuagaagca

SEQ ID NO: 358369 - RNA, 22 nt, Human
aggcagaaaauagucauccaaa

SEQ ID NO: 358370 - RNA, 22 nt, Human
uguagcucuccagccagcaagg

SEQ ID NO: 358371 - RNA, 22 nt, Human
gaggaaggcuaaggggcuuaga

SEQ ID NO: 358372 - RNA, 22 nt, Human
aggugagggugccagugcaugg

SEQ ID NO: 358373 - RNA, 22 nt, Human
cccacacauuuuucacuuaccg

SEQ ID NO: 358374 - RNA, 22 nt, Human
agaagugagugugacucagcag

SEQ ID NO: 358375 - RNA, 22 nt, Human
uggucucuucuuccaagauggc

SEQ ID NO: 358376 - RNA, 22 nt, Human
aauuugauuuucuuaaaccaua

SEQ ID NO: 358377 - RNA, 21 nt, Human
gcaggguccuuuccauuccua

SEQ ID NO: 358378 - RNA, 19 nt, Human
ugcugaaguugucagucug

SEQ ID NO: 358379 - RNA, 22 nt, Human
guuuuccuucucagccauugcc

SEQ ID NO: 358380 - RNA, 22 nt, Human
cagagguacaagcuaaguuggg

SEQ ID NO: 358381 - RNA, 18 nt, Human
gagaggcccggcugugcc

SEQ ID NO: 358382 - RNA, 22 nt, Human
ggcacugaaccaggacacaagc

SEQ ID NO: 358383 - RNA, 22 nt, Human
ggaggaagagguuguucucuca

SEQ ID NO: 358384 - RNA, 22 nt, Human
aaguccaucucugccccacaca

SEQ ID NO: 358385 - RNA, 22 nt, Human
aauauaauuuuauuccuagagu

SEQ ID NO: 358386 - RNA, 19 nt, Human
gcuuuggagggagguucua

SEQ ID NO: 358387 - RNA, 22 nt, Human
aaagaacaauguggaaucuccu

SEQ ID NO: 358388 - RNA, 23 nt, Human
uuauuuugucagaagggacuuuu

SEQ ID NO: 358389 - RNA, 22 nt, Human
uuugacaucaauacccuagaau

SEQ ID NO: 358390 - RNA, 23 nt, Human
uuacaguaggaguuggaaaacca

SEQ ID NO: 358391 - RNA, 22 nt, Human
cugccuggucucaggcaugggg

SEQ ID NO: 358392 - RNA, 22 nt, Human
uaacaguguggacuugagaucu

SEQ ID NO: 358393 - RNA, 21 nt, Human
guuuucaugauagagucugua

SEQ ID NO: 358394 - RNA, 22 nt, Human
gcaggauggugcccuuucugcc

SEQ ID NO: 358395 - RNA, 22 nt, Human
cugugacuagaccugcaggaga

SEQ ID NO: 358396 - RNA, 22 nt, Human
auggaguucugccagcgcugcu

SEQ ID NO: 358397 - RNA, 22 nt, Human
ugucacagggauaccauggggc

SEQ ID NO: 358398 - RNA, 22 nt, Human
ucuucagagacucugagccccu

SEQ ID NO: 358399 - RNA, 22 nt, Human
cagggcucgcucgcucgcucgc

SEQ ID NO: 358400 - RNA, 22 nt, Human
ccuggccucagacagagggugg

SEQ ID NO: 358401 - RNA, 22 nt, Human
uggagccaaggccaguucucag

SEQ ID NO: 358402 - RNA, 22 nt, Human
ccaagggcugcugaggugucca

SEQ ID NO: 358403 - RNA, 22 nt, Human
ccaggagguggagauugcagug

SEQ ID NO: 358404 - RNA, 22 nt, Human
cauugcugugggcauuugcugc

SEQ ID NO: 358405 - RNA, 22 nt, Human
agcuguccuggcucaggcugug

SEQ ID NO: 358406 - RNA, 22 nt, Human
gcucccugaaaagaacaaaguc

SEQ ID NO: 358407 - RNA, 22 nt, Human
ggcuccacugcugaccacucca

SEQ ID NO: 358408 - RNA, 22 nt, Human
cauuuguacagaacagcuuuau

SEQ ID NO: 358409 - RNA, 22 nt, Human
cagagccaggucuaggagucuc

SEQ ID NO: 358410 - RNA, 22 nt, Human
acaacuuuaauggguuucagcu

SEQ ID NO: 358411 - RNA, 22 nt, Human
caggaccccauauucacugaac

SEQ ID NO: 358412 - RNA, 22 nt, Human
cggagccugcuuguugcagcug

SEQ ID NO: 358413 - RNA, 20 nt, Human
acaauauguagaugaauagc

SEQ ID NO: 358414 - RNA, 18 nt, Human
ugucucugaauuccagug

SEQ ID NO: 358415 - RNA, 22 nt, Human
cuggaagaggaagccagcugga

SEQ ID NO: 358416 - RNA, 22 nt, Human
ggcuuuauuaagcaggguaagu

SEQ ID NO: 358417 - RNA, 22 nt, Human
ucaguguauggagugcuggauu

SEQ ID NO: 358418 - RNA, 22 nt, Human
agccugugugcuuuggacaggg

SEQ ID NO: 358419 - RNA, 22 nt, Human
agcaguggcugaagauguuccu

SEQ ID NO: 358420 - RNA, 22 nt, Human
uuauuuucagcuaggaaagcca

SEQ ID NO: 358421 - RNA, 22 nt, Human
ugccugggagugaccaagacuc

SEQ ID NO: 358422 - RNA, 18 nt, Human
aguaaagcuuauuacaug

SEQ ID NO: 358423 - RNA, 22 nt, Human
uguuucuuuguagauauucuuu

SEQ ID NO: 358424 - RNA, 22 nt, Human
uccugcagcugcagaccugggg

SEQ ID NO: 358425 - RNA, 23 nt, Human
acagggcauugcuggccucgagg

SEQ ID NO: 358426 - RNA, 22 nt, Human
gcucucuugguggcuguccugg

SEQ ID NO: 358427 - RNA, 22 nt, Human
ugaggugaagaguggagcucag

SEQ ID NO: 358428 - RNA, 22 nt, Human
guuuuccacuggauuguuugga

SEQ ID NO: 358429 - RNA, 22 nt, Human
gaacagcuucuugggagcuggg

SEQ ID NO: 358430 - RNA, 22 nt, Human
uuccucucaacaugccugccgg

SEQ ID NO: 358431 - RNA, 22 nt, Human
ucccagcagucagagcuaugug

SEQ ID NO: 358432 - RNA, 22 nt, Human
gccaugccugugucuccaggcc

SEQ ID NO: 358433 - RNA, 20 nt, Human
uagggcucauuaugaucucc

SEQ ID NO: 358434 - RNA, 22 nt, Human
cauuucaaugccuucaacauag

SEQ ID NO: 358435 - RNA, 22 nt, Human
cagggcuggcuguggcaaucuc

SEQ ID NO: 358436 - RNA, 22 nt, Human
auuauaaagaacaugugugugg

SEQ ID NO: 358437 - RNA, 22 nt, Human
gaagagcuaaaggcacaggcuu

SEQ ID NO: 358438 - RNA, 22 nt, Human
aggggccauuguucugcccgcu

SEQ ID NO: 358439 - RNA, 22 nt, Human
auucuguauuucuaauaagauc

SEQ ID NO: 358440 - RNA, 22 nt, Human
uagcugcccaucuuuccuuuag

SEQ ID NO: 358441 - RNA, 22 nt, Human
gucugcugcagagcauggcuuu

SEQ ID NO: 358442 - RNA, 21 nt, Human
ucccugcuuucuggcccaguc

SEQ ID NO: 358443 - RNA, 22 nt, Human
ucucaggccccugaguuucucu

SEQ ID NO: 358444 - RNA, 22 nt, Human
ucuggcucagggcucugaggga

SEQ ID NO: 358445 - RNA, 22 nt, Human
caaaguuaugaaugauaagauu

SEQ ID NO: 358446 - RNA, 22 nt, Human
ugaugaaaauaugauucugagg

SEQ ID NO: 358447 - RNA, 22 nt, Human
aaauagauugcugaggcauuac

SEQ ID NO: 358448 - RNA, 22 nt, Human
uuaagacaguguauuuguuuuc

SEQ ID NO: 358449 - RNA, 22 nt, Human
ucacgagaggcacagaauagag

SEQ ID NO: 358450 - RNA, 22 nt, Human
cugcugugcagacagacucucu

SEQ ID NO: 358451 - RNA, 22 nt, Human
ggcaugggagugagcaaccuua

SEQ ID NO: 358452 - RNA, 22 nt, Human
cggcugagacggccauagacac

SEQ ID NO: 358453 - RNA, 22 nt, Human
gcagggucgcucuaggagauca

SEQ ID NO: 358454 - RNA, 22 nt, Human
uugggcucaggaguuugagacc

SEQ ID NO: 358455 - RNA, 22 nt, Human
gccagcucccaagugagccccu

SEQ ID NO: 358456 - RNA, 22 nt, Human
cuacagaauucaacaaaugguu

SEQ ID NO: 358457 - RNA, 22 nt, Human
cucaggaugucggugacuauug

SEQ ID NO: 358458 - RNA, 22 nt, Human
ggggccagcacugugccuuugu

SEQ ID NO: 358459 - RNA, 18 nt, Human
ggcucaggcuauccuaac

SEQ ID NO: 358460 - RNA, 22 nt, Human
gcagagccugggggucugcgga

SEQ ID NO: 358461 - RNA, 22 nt, Human
uggcgugcccuccagacuuggc

SEQ ID NO: 358462 - RNA, 22 nt, Human
cugcuguggugucaagcaucuc

SEQ ID NO: 358463 - RNA, 22 nt, Human
agggccagaggcaccuugcagc

SEQ ID NO: 358464 - RNA, 22 nt, Human
ugcucagacaagcugaacagua

SEQ ID NO: 358465 - RNA, 22 nt, Human
aaagcagggaugaggcuagagg

SEQ ID NO: 358466 - RNA, 22 nt, Human
ucuucucuacaccagcagcccc

SEQ ID NO: 358467 - RNA, 22 nt, Human
ucaggcagcuccaggaauggua

SEQ ID NO: 358468 - RNA, 22 nt, Human
uggauuuauuagguuggugaaa

SEQ ID NO: 358469 - RNA, 22 nt, Human
cacacaggaugaagcagcagaa

SEQ ID NO: 358470 - RNA, 22 nt, Human
uagcuuuagugaaaaauaucag

SEQ ID NO: 358471 - RNA, 22 nt, Human
aaggcugccucugccagaggag

SEQ ID NO: 358472 - RNA, 23 nt, Human
aacaauagguuuuggcagaauag

SEQ ID NO: 358473 - RNA, 22 nt, Human
acagauuuauugaagcugcugc

SEQ ID NO: 358474 - RNA, 22 nt, Human
uuaaacagguuuuugaauggcc

SEQ ID NO: 358475 - RNA, 19 nt, Human
guagggacagugguucuga

SEQ ID NO: 358476 - RNA, 22 nt, Human
ggccaccucugcccuacugagu

SEQ ID NO: 358477 - RNA, 22 nt, Human
caucaucaaaagugacagagaa

SEQ ID NO: 358478 - RNA, 22 nt, Human
uuaaugcagaaaucaaacugac

SEQ ID NO: 358479 - RNA, 22 nt, Human
ugggagcccaagggagcugccg

SEQ ID NO: 358480 - RNA, 22 nt, Human
agggaccuugauggguuuggga

SEQ ID NO: 358481 - RNA, 22 nt, Human
gccugagcaggcguggaccaug

SEQ ID NO: 358482 - RNA, 22 nt, Human
uauuccagaugaaaucauucag

SEQ ID NO: 358483 - RNA, 22 nt, Human
uuuccucuuccgagggggaggc

SEQ ID NO: 358484 - RNA, 22 nt, Human
ugagcccaggaguuggagaccg

SEQ ID NO: 358485 - RNA, 22 nt, Human
uuugcagcaaggagagagcauu

SEQ ID NO: 358486 - RNA, 22 nt, Human
uuuuauuaucuuugaaugggac

SEQ ID NO: 358487 - RNA, 20 nt, Human
uugcagcagugaggugaagg

SEQ ID NO: 358488 - RNA, 22 nt, Human
agcugugguucugggcagcgac

SEQ ID NO: 358489 - RNA, 22 nt, Human
gcagugauuggaucagagaugg

SEQ ID NO: 358490 - RNA, 22 nt, Human
aaagcuuuucaguauguucaug

SEQ ID NO: 358491 - RNA, 22 nt, Human
acagaggccccgugggagagcc

SEQ ID NO: 358492 - RNA, 22 nt, Human
cagaggcugaugugggaugggc

SEQ ID NO: 358493 - RNA, 18 nt, Human
ugcucuggucucacuugg

SEQ ID NO: 358494 - RNA, 22 nt, Human
uaucuguuggcuccuaguugua

SEQ ID NO: 358495 - RNA, 22 nt, Human
uuuuaucugcuucauuaguuga

SEQ ID NO: 358496 - RNA, 22 nt, Human
uggcugggugcuauccaguacu

SEQ ID NO: 358497 - RNA, 22 nt, Human
cacucccuucaggagccuagga

SEQ ID NO: 358498 - RNA, 22 nt, Human
gauaugaaguggcauugugaag

SEQ ID NO: 358499 - RNA, 22 nt, Human
ucaggggcccuucccucagcag

SEQ ID NO: 358500 - RNA, 22 nt, Human
cugcuggagguuggagcaugca

SEQ ID NO: 358501 - RNA, 22 nt, Human
aucaguuuuguucacuacuaua

SEQ ID NO: 358502 - RNA, 22 nt, Human
caguugccuacuacauggcagg

SEQ ID NO: 358503 - RNA, 18 nt, Human
gggcucacacaggucauc

SEQ ID NO: 358504 - RNA, 23 nt, Human
aggugcagcccuggaccugcccc

SEQ ID NO: 358505 - RNA, 22 nt, Human
ugaggcagaaaauagcaguuca

SEQ ID NO: 358506 - RNA, 22 nt, Human
ugaaagcagcaccaauaccauu

SEQ ID NO: 358507 - RNA, 22 nt, Human
cugccugcuucugagccagagg

SEQ ID NO: 358508 - RNA, 22 nt, Human
gaggcaugucuggccuguccca

SEQ ID NO: 358509 - RNA, 21 nt, Human
uggcugcuggcccucucucca

SEQ ID NO: 358510 - RNA, 22 nt, Human
aggagagagcugagcuuugcug

SEQ ID NO: 358511 - RNA, 19 nt, Human
aauacaguguuauagaauu

SEQ ID NO: 358512 - RNA, 23 nt, Human
guggccuccccggaaugccucgc

SEQ ID NO: 358513 - RNA, 22 nt, Human
ccagcccuugcugaaggguggc

SEQ ID NO: 358514 - RNA, 22 nt, Human
gaugccuccaaaugagggcaga

SEQ ID NO: 358515 - RNA, 21 nt, Human
aauuagggugccucuuauaau

SEQ ID NO: 358516 - RNA, 22 nt, Human
ugucccagacauaaguggacau

SEQ ID NO: 358517 - RNA, 22 nt, Human
cugagcuuggccaggaaugaau

SEQ ID NO: 358518 - RNA, 22 nt, Human
aggcucugugacaaucaagcug

SEQ ID NO: 358519 - RNA, 22 nt, Human
cggcuggguucggcugcaggcc

SEQ ID NO: 358520 - RNA, 22 nt, Human
auguacaguggaaacuaacaaa

SEQ ID NO: 358521 - RNA, 22 nt, Human
ugaaggccagcucuuuaucagc

SEQ ID NO: 358522 - RNA, 22 nt, Human
aaugagcuagaccugcuuccuc

SEQ ID NO: 358523 - RNA, 22 nt, Human
acagaguauuggaaaggcagug

SEQ ID NO: 358524 - RNA, 17 nt, Human
uccaugagacaugaaga

SEQ ID NO: 358525 - RNA, 22 nt, Human
auggccuggggagcaugggaag

SEQ ID NO: 358526 - RNA, 22 nt, Human
ccuguucacccuccaugcacag

SEQ ID NO: 358527 - RNA, 22 nt, Human
ccugccugguguaagucuaagg

SEQ ID NO: 358528 - RNA, 22 nt, Human
cagcaguguacaaggugucaga

SEQ ID NO: 358529 - RNA, 22 nt, Human
cuucuucaaccugaaaguuuca

SEQ ID NO: 358530 - RNA, 22 nt, Human
guggcgcagaggguggcagaga

SEQ ID NO: 358531 - RNA, 22 nt, Human
augagcugugggauuccagagg

SEQ ID NO: 358532 - RNA, 22 nt, Human
uccugucagugaggcagaugaa

SEQ ID NO: 358533 - RNA, 22 nt, Human
agguauauauucugguccuuau

SEQ ID NO: 358534 - RNA, 22 nt, Human
cuggccugaggccgccuucaga

SEQ ID NO: 358535 - RNA, 22 nt, Human
ucccacuggacgucugugcugg

SEQ ID NO: 358536 - RNA, 22 nt, Human
uguguugugacauucuuggaug

SEQ ID NO: 358537 - RNA, 22 nt, Human
uauuugaagauucuucugaugu

SEQ ID NO: 358538 - RNA, 22 nt, Human
cacagccuugagcgaggacaag

SEQ ID NO: 358539 - RNA, 22 nt, Human
ucacucagguucaugucuuugu

SEQ ID NO: 358540 - RNA, 22 nt, Human
guauuaggaggaacacaggccu

SEQ ID NO: 358541 - RNA, 19 nt, Human
ccauggagagagaugcauu

SEQ ID NO: 358542 - RNA, 22 nt, Human
aauguaaacagcaagagaaggg

SEQ ID NO: 358543 - RNA, 22 nt, Human
ccagcucuggcuucuugcuggg

SEQ ID NO: 358544 - RNA, 22 nt, Human
aaucaaaaccuacagagguaau

SEQ ID NO: 358545 - RNA, 22 nt, Human
aaaauuuugcccuauccuucau

SEQ ID NO: 358546 - RNA, 22 nt, Human
gucaugccuggcuucuuagaca

SEQ ID NO: 358547 - RNA, 22 nt, Human
ccugccagauccccugagcuga

SEQ ID NO: 358548 - RNA, 22 nt, Human
ccucaggcuuacgggcaaugga

SEQ ID NO: 358549 - RNA, 18 nt, Human
ggaaaaggagugucuagc

SEQ ID NO: 358550 - RNA, 22 nt, Human
ucacugaagacugggcucuaaa

SEQ ID NO: 358551 - RNA, 22 nt, Human
gaggguccccaugcagagcuca

SEQ ID NO: 358552 - RNA, 22 nt, Human
aacuuucaggcaaugaauauuu

SEQ ID NO: 358553 - RNA, 22 nt, Human
uuugugaaaugaagucacaacu

SEQ ID NO: 358554 - RNA, 22 nt, Human
cauucuuacacaauauuuuaau

SEQ ID NO: 358555 - RNA, 22 nt, Human
ggucagcagugcagggcagagc

SEQ ID NO: 358556 - RNA, 22 nt, Human
agggagagguugaaaccucagu

SEQ ID NO: 358557 - RNA, 22 nt, Human
aaacaucauaggcaugcaugau

SEQ ID NO: 358558 - RNA, 16 nt, Human
ucccaggaggcggaac

SEQ ID NO: 358559 - RNA, 16 nt, Human
cuacccagugagaagg

SEQ ID NO: 358560 - RNA, 22 nt, Human
acccaggagacagguugcagug

SEQ ID NO: 358561 - RNA, 23 nt, Human
aauaucaaggugauguucccaga

SEQ ID NO: 358562 - RNA, 22 nt, Human
ggcagggcuugucucugugaug

SEQ ID NO: 358563 - RNA, 22 nt, Human
ugcauaauacguuuccuauaac

SEQ ID NO: 358564 - RNA, 22 nt, Human
auaccuuuuagacauguaguug

SEQ ID NO: 358565 - RNA, 22 nt, Human
aggcaacuuuuggggaugaugg

SEQ ID NO: 358566 - RNA, 22 nt, Human
gauggcagcagcagccagggau

SEQ ID NO: 358567 - RNA, 22 nt, Human
gcuuccuagaucugugguacuc

SEQ ID NO: 358568 - RNA, 22 nt, Human
uguggccucaaggcugcccuca

SEQ ID NO: 358569 - RNA, 22 nt, Human
agugacugacaccuguaauccc

SEQ ID NO: 358570 - RNA, 22 nt, Human
aaggguugaagauaaauaaggu

SEQ ID NO: 358571 - RNA, 22 nt, Human
ugaaaucuuagccauucugccu

SEQ ID NO: 358572 - RNA, 22 nt, Human
aaagggcugucaaauaagcaac

SEQ ID NO: 358573 - RNA, 21 nt, Human
acaugucuggucauuuuuagc

SEQ ID NO: 358574 - RNA, 22 nt, Human
aggaccauccuaagguaggcaa

SEQ ID NO: 358575 - RNA, 22 nt, Human
uuuaauuuucugggcccagcag

SEQ ID NO: 358576 - RNA, 18 nt, Human
agggucagugucacuggc

SEQ ID NO: 358577 - RNA, 22 nt, Human
cauuaucucuucuauaugcuag

SEQ ID NO: 358578 - RNA, 22 nt, Human
auuucuguaacuuaugaaaguu

SEQ ID NO: 358579 - RNA, 22 nt, Human
agccuguccagaggacagggcu

SEQ ID NO: 358580 - RNA, 22 nt, Human
cuagccugggauuugaacuuau

SEQ ID NO: 358581 - RNA, 20 nt, Human
uacuugaauguugcagcagu

SEQ ID NO: 358582 - RNA, 22 nt, Human
cucaggaggaggaaguucauug

SEQ ID NO: 358583 - RNA, 22 nt, Human
ucuuugcaggagcccuuugaac

SEQ ID NO: 358584 - RNA, 22 nt, Human
augggcagcagcugccauucau

SEQ ID NO: 358585 - RNA, 22 nt, Human
guuugcauguguacuuaauugg

SEQ ID NO: 358586 - RNA, 21 nt, Human
ccagcagcucaaggaucucuu

SEQ ID NO: 358587 - RNA, 22 nt, Human
ggcuccuguccccucagcugcu

SEQ ID NO: 358588 - RNA, 22 nt, Human
cugcugucuuuauuucacugcu

SEQ ID NO: 358589 - RNA, 22 nt, Human
cggcuggggcuguccccaugac

SEQ ID NO: 358590 - RNA, 22 nt, Human
uccaaaguguugggauuauagg

SEQ ID NO: 358591 - RNA, 23 nt, Human
ugaguucucaucuuggcuucuau

SEQ ID NO: 358592 - RNA, 22 nt, Human
cuucaucaacucuaacaaaugu

SEQ ID NO: 358593 - RNA, 22 nt, Human
gaagccucaacaucucugcguc

SEQ ID NO: 358594 - RNA, 23 nt, Human
aggaaggagguccuaacaguauc

SEQ ID NO: 358595 - RNA, 22 nt, Human
caguuauuaugaggucauuagg

SEQ ID NO: 358596 - RNA, 22 nt, Human
uguguauuaccauuuuacagcu

SEQ ID NO: 358597 - RNA, 22 nt, Human
cuccugguucagagagcugaga

SEQ ID NO: 358598 - RNA, 22 nt, Human
accugagggcccaaacuuggua

SEQ ID NO: 358599 - RNA, 22 nt, Human
cucuuaaagaauguuccagcug

SEQ ID NO: 358600 - RNA, 22 nt, Human
aaaggcuccuucucccaugacc

SEQ ID NO: 358601 - RNA, 22 nt, Human
gcagggccuuagcagcggcugc

SEQ ID NO: 358602 - RNA, 22 nt, Human
cagcaguggcugcaggcagcug

SEQ ID NO: 358603 - RNA, 22 nt, Human
cugcuguguuucugcuagaaaa

SEQ ID NO: 358604 - RNA, 22 nt, Human
aaaugucuuuaucucauguaac

SEQ ID NO: 358605 - RNA, 22 nt, Human
ggagccaggggaccuucacaga

SEQ ID NO: 358606 - RNA, 20 nt, Human
ggagagcagggaagacagua

SEQ ID NO: 358607 - RNA, 19 nt, Human
agcauccagucaugggauc

SEQ ID NO: 358608 - RNA, 22 nt, Human
gagggguguggagccaucaguu

SEQ ID NO: 358609 - RNA, 22 nt, Human
ccagcaggggaauauuuuuagg

SEQ ID NO: 358610 - RNA, 22 nt, Human
guauuaggaaauaugaagaaag

SEQ ID NO: 358611 - RNA, 22 nt, Human
gcugugcuauaucucugagugu

SEQ ID NO: 358612 - RNA, 21 nt, Human
gggccuggcugcgcaggacgg

SEQ ID NO: 358613 - RNA, 22 nt, Human
ugcagagaaaccaguggaggac

SEQ ID NO: 358614 - RNA, 23 nt, Human
ugucacauuuaguuggcauuguu

SEQ ID NO: 358615 - RNA, 19 nt, Human
ucaggcaguuauucacaaa

SEQ ID NO: 358616 - RNA, 22 nt, Human
ucugagccguauggcuuggcua

SEQ ID NO: 358617 - RNA, 22 nt, Human
ugugaaaagcaggcuacuuucu

SEQ ID NO: 358618 - RNA, 22 nt, Human
acagaauacuacagacugguua

SEQ ID NO: 358619 - RNA, 22 nt, Human
acagcuuuaguguggguggugc

SEQ ID NO: 358620 - RNA, 22 nt, Human
cuggcuccaucacugggugaug

SEQ ID NO: 358621 - RNA, 22 nt, Human
uggcucagagcagggacucugg

SEQ ID NO: 358622 - RNA, 22 nt, Human
aaucucuugggaggaaugaauu

SEQ ID NO: 358623 - RNA, 22 nt, Human
ugaauaauuaugggaguccuaa

SEQ ID NO: 358624 - RNA, 22 nt, Human
aggcagcauuugaauccagguc

SEQ ID NO: 358625 - RNA, 22 nt, Human
ugucagggcaugcgguccagcc

SEQ ID NO: 358626 - RNA, 22 nt, Human
cccaaggccuucaagccagcuc

SEQ ID NO: 358627 - RNA, 22 nt, Human
ggaaaugacuuggugcuucguu

SEQ ID NO: 358628 - RNA, 22 nt, Human
gcaggaggaucacuugagccca

SEQ ID NO: 358629 - RNA, 22 nt, Human
uaaggcauucucaugcugugaa

SEQ ID NO: 358630 - RNA, 22 nt, Human
uagaaauccccagucucauagu

SEQ ID NO: 358631 - RNA, 22 nt, Human
gagacugcauuguccaaggguu

SEQ ID NO: 358632 - RNA, 22 nt, Human
ggcauguuucaucacaucaaga

SEQ ID NO: 358633 - RNA, 22 nt, Human
cacagagagcuacgugcagcgu

SEQ ID NO: 358634 - RNA, 22 nt, Human
gccaggcugcuccagggaggcc

SEQ ID NO: 358635 - RNA, 22 nt, Human
gcugggagugggcaagaugaga

SEQ ID NO: 358636 - RNA, 22 nt, Human
gagggccaauggauuucaacug

SEQ ID NO: 358637 - RNA, 22 nt, Human
gcucccugccuacacggaccuu

SEQ ID NO: 358638 - RNA, 22 nt, Human
ggaaaguggugguggaaagagg

SEQ ID NO: 358639 - RNA, 22 nt, Human
ugagccagauaagggcucacgc

SEQ ID NO: 358640 - RNA, 22 nt, Human
ucuggagagucacagugccaga

SEQ ID NO: 358641 - RNA, 22 nt, Human
ugcauuguugaauauuucauag

SEQ ID NO: 358642 - RNA, 22 nt, Human
caggagaagucucuagggggug

SEQ ID NO: 358643 - RNA, 22 nt, Human
uggguaaacugggucuggagag

SEQ ID NO: 358644 - RNA, 22 nt, Human
gcaggcuccaggccggccccuu

SEQ ID NO: 358645 - RNA, 22 nt, Human
cccagcuccuuacagggccgaa

SEQ ID NO: 358646 - RNA, 18 nt, Human
uccagagguguuggagcc

SEQ ID NO: 358647 - RNA, 22 nt, Human
ccuggcagacagcacugaagcu

SEQ ID NO: 358648 - RNA, 18 nt, Human
uccugcagcuucuaugua

SEQ ID NO: 358649 - RNA, 22 nt, Human
cauugcaccacauugcaucccu

SEQ ID NO: 358650 - RNA, 22 nt, Human
ucugggaaugaauaagaccugu

SEQ ID NO: 358651 - RNA, 22 nt, Human
acccugggucauauacagugug

SEQ ID NO: 358652 - RNA, 22 nt, Human
ugggcuguggagcaccuuugca

SEQ ID NO: 358653 - RNA, 22 nt, Human
ucaagaaagggcuucaccagga

SEQ ID NO: 358654 - RNA, 22 nt, Human
uccugcagcucugagaagcauc

SEQ ID NO: 358655 - RNA, 22 nt, Human
gaggcucagagacuuuaaguuu

SEQ ID NO: 358656 - RNA, 22 nt, Human
auuugcagagcucugaauuuug

SEQ ID NO: 358657 - RNA, 22 nt, Human
caagggcagcagccucaagcgg

SEQ ID NO: 358658 - RNA, 22 nt, Human
ggagcacuauaauagagauuuu

SEQ ID NO: 358659 - RNA, 22 nt, Human
gccagggagucugggccacaga

SEQ ID NO: 358660 - RNA, 22 nt, Human
agggccagggaagcuguauuuu

SEQ ID NO: 358661 - RNA, 22 nt, Human
gccaggcuguggggaacuugaa

SEQ ID NO: 358662 - RNA, 22 nt, Human
ugcagcuguaacagaggccuca

SEQ ID NO: 358663 - RNA, 22 nt, Human
gcuggggagggcgucaaggcca

SEQ ID NO: 358664 - RNA, 22 nt, Human
aaguucaagaucaagguuccag

SEQ ID NO: 358665 - RNA, 18 nt, Human
uguggcaggggugggaga

SEQ ID NO: 358666 - RNA, 17 nt, Human
agcagaagucagaggga

SEQ ID NO: 358667 - RNA, 17 nt, Human
ccagagcuacugagacu

SEQ ID NO: 358668 - RNA, 22 nt, Human
cgcuggggcuuuuugcuugaga

SEQ ID NO: 358669 - RNA, 17 nt, Human
gcaagggaugggagauu

SEQ ID NO: 358670 - RNA, 22 nt, Human
gcagggcagaccuccagccuau

SEQ ID NO: 358671 - RNA, 22 nt, Human
cugcuuuggacaacuauucuug

SEQ ID NO: 358672 - RNA, 22 nt, Human
caugaagcacagcucucuuuuu

SEQ ID NO: 358673 - RNA, 22 nt, Human
accugcagcuaaagauguaggg

SEQ ID NO: 358674 - RNA, 22 nt, Human
cuggcuggcaaguagaacacaa

SEQ ID NO: 358675 - RNA, 22 nt, Human
agcugaggcucugagagggaag

SEQ ID NO: 358676 - RNA, 22 nt, Human
cagaaagaccugggcucaagag

SEQ ID NO: 358677 - RNA, 22 nt, Human
cacauugaaaugacccaauaau

SEQ ID NO: 358678 - RNA, 22 nt, Human
gccugugcauagcagcggacuc

SEQ ID NO: 358679 - RNA, 17 nt, Human
uucaaugauuaaugcau

SEQ ID NO: 358680 - RNA, 22 nt, Human
caggccugacccugagcuucac

SEQ ID NO: 358681 - RNA, 18 nt, Human
uggugaaggguggaggag

SEQ ID NO: 358682 - RNA, 22 nt, Human
aucuggcugacuuugugggaca

SEQ ID NO: 358683 - RNA, 22 nt, Human
ggaaggaggaugcucuggccuu

SEQ ID NO: 358684 - RNA, 22 nt, Human
ccugggcaacauagugagaccc

SEQ ID NO: 358685 - RNA, 22 nt, Human
cucaggauagauuguccucuca

SEQ ID NO: 358686 - RNA, 22 nt, Human
uccucaggauguggaguagaau

SEQ ID NO: 358687 - RNA, 22 nt, Human
ucucuggaagcgcagaucuguu

SEQ ID NO: 358688 - RNA, 22 nt, Human
aaagaggaaccaagagcacgug

SEQ ID NO: 358689 - RNA, 22 nt, Human
uggagcaggccggaaguggcuu

SEQ ID NO: 358690 - RNA, 22 nt, Human
uggcugaggcuggagugcagug

SEQ ID NO: 358691 - RNA, 22 nt, Human
uucccaguauuaccuucaggaa

SEQ ID NO: 358692 - RNA, 22 nt, Human
aauugcaauuuucuuaaggucu

SEQ ID NO: 358693 - RNA, 22 nt, Human
auggcauuugaaucugucuuuu

SEQ ID NO: 358694 - RNA, 22 nt, Human
guugaguggguuaggaugcuga

SEQ ID NO: 358695 - RNA, 22 nt, Human
uuccuuagauccuucaaucacg

SEQ ID NO: 358696 - RNA, 22 nt, Human
uagggcagcugcaucaggcacu

SEQ ID NO: 358697 - RNA, 22 nt, Human
cagaggccuuucuacagugaua

SEQ ID NO: 358698 - RNA, 22 nt, Human
uggcuggcgccgggcuagccac

SEQ ID NO: 358699 - RNA, 22 nt, Human
aguguacauguuuacagcaucu

SEQ ID NO: 358700 - RNA, 22 nt, Human
uguuuucagucauauagcaggu

SEQ ID NO: 358701 - RNA, 22 nt, Human
cuggagcuggcuuccuuccacu

SEQ ID NO: 358702 - RNA, 22 nt, Human
ggcaggcaggagcgugcuuggg

SEQ ID NO: 358703 - RNA, 22 nt, Human
auccucagaccucagcaaagcc

SEQ ID NO: 358704 - RNA, 22 nt, Human
ucccagcagggccgaccagccu

SEQ ID NO: 358705 - RNA, 22 nt, Human
aguuuuucugggaggcacugcu

SEQ ID NO: 358706 - RNA, 22 nt, Human
ucuggcucacuucaggcuucac

SEQ ID NO: 358707 - RNA, 22 nt, Human
uaguuaaaauaauggagauguu

SEQ ID NO: 358708 - RNA, 22 nt, Human
cugggcagugguggcaucuuug

SEQ ID NO: 358709 - RNA, 22 nt, Human
uagcagcuuccagagagggcag

SEQ ID NO: 358710 - RNA, 22 nt, Human
ggaggaccccagcagcucccca

SEQ ID NO: 358711 - RNA, 22 nt, Human
uaguccagccuuggguguagcc

SEQ ID NO: 358712 - RNA, 22 nt, Human
agccuggaggccaggagacagu

SEQ ID NO: 358713 - RNA, 21 nt, Human
uccagaccucccucuccuagc

SEQ ID NO: 358714 - RNA, 22 nt, Human
agagugaucagauaucaggugu

SEQ ID NO: 358715 - RNA, 22 nt, Human
gcugcccuaauaucacauguua

SEQ ID NO: 358716 - RNA, 22 nt, Human
ugcauuccuccaccuccugcac

SEQ ID NO: 358717 - RNA, 22 nt, Human
auaguaacuggcauguuuauga

SEQ ID NO: 358718 - RNA, 17 nt, Human
aggccucccuccaggcc

SEQ ID NO: 358719 - RNA, 22 nt, Human
ccugccaggacauugcuugaag

SEQ ID NO: 358720 - RNA, 22 nt, Human
cugggcugagccugggcugugu

SEQ ID NO: 358721 - RNA, 22 nt, Human
guggcaggagagacacagccau

SEQ ID NO: 358722 - RNA, 22 nt, Human
ggccucucauguccugggcuuc

SEQ ID NO: 358723 - RNA, 22 nt, Human
cagcugaguguuggcauguuca

SEQ ID NO: 358724 - RNA, 22 nt, Human
ggccugcuucucagugagcuug

SEQ ID NO: 358725 - RNA, 22 nt, Human
uuuccagagcaugucugcucag

SEQ ID NO: 358726 - RNA, 22 nt, Human
ccaggagcaccaggccugugcc

SEQ ID NO: 358727 - RNA, 22 nt, Human
uccugcagcugaagcucaugug

SEQ ID NO: 358728 - RNA, 19 nt, Human
gaguuauugccagggcaug

SEQ ID NO: 358729 - RNA, 22 nt, Human
ggcaauuucaugugguuuaaac

SEQ ID NO: 358730 - RNA, 22 nt, Human
gcacagguugcaaaaguucaca

SEQ ID NO: 358731 - RNA, 22 nt, Human
gagggcucugaaaggaggucac

SEQ ID NO: 358732 - RNA, 22 nt, Human
aucaggaugacaacugcugggu

SEQ ID NO: 358733 - RNA, 22 nt, Human
ugagggcugcuuccagagcuag

SEQ ID NO: 358734 - RNA, 22 nt, Human
agggguggccugccuuacuccc

SEQ ID NO: 358735 - RNA, 22 nt, Human
ccucuggguaucuguggaagua

SEQ ID NO: 358736 - RNA, 22 nt, Human
ucucugaguauccugaacugcc

SEQ ID NO: 358737 - RNA, 23 nt, Human
gugagcagcccacuaggaaugcc

SEQ ID NO: 358738 - RNA, 22 nt, Human
cugugggcugaaagugcucccg

SEQ ID NO: 358739 - RNA, 22 nt, Human
cugcucugaagccaggauucug

SEQ ID NO: 358740 - RNA, 20 nt, Human
uguucacaguaguugcugcu

SEQ ID NO: 358741 - RNA, 23 nt, Human
uuacuuuugcaccaaccuaauau

SEQ ID NO: 358742 - RNA, 22 nt, Human
ugcguugcgcuccugcagcagg

SEQ ID NO: 358743 - RNA, 22 nt, Human
gcuguggcuugcagcuggggcu

SEQ ID NO: 358744 - RNA, 22 nt, Human
aguacauauaguaauuuagcca

SEQ ID NO: 358745 - RNA, 22 nt, Human
caggcccauucuaggcuugcua

SEQ ID NO: 358746 - RNA, 22 nt, Human
uuuauccaguguuggaauuuuu

SEQ ID NO: 358747 - RNA, 22 nt, Human
ccaaggcuucccagagaugcuc

SEQ ID NO: 358748 - RNA, 22 nt, Human
augugaggcagcacggagauua

SEQ ID NO: 358749 - RNA, 23 nt, Human
agggcaugaagcagaggacgugg

SEQ ID NO: 358750 - RNA, 22 nt, Human
auucacaaaaugauauagauac

SEQ ID NO: 358751 - RNA, 22 nt, Human
auugcaccuuggguuuugaaag

SEQ ID NO: 358752 - RNA, 22 nt, Human
ugggccacaagccaugggacca

SEQ ID NO: 358753 - RNA, 23 nt, Human
agugagcagcuguagggcaagga

SEQ ID NO: 358754 - RNA, 22 nt, Human
aucaaaguggaaguuuacuagg

SEQ ID NO: 358755 - RNA, 22 nt, Human
uagauaaauuagaaaguuuacu

SEQ ID NO: 358756 - RNA, 21 nt, Human
aucccagcacccaggagugca

SEQ ID NO: 358757 - RNA, 22 nt, Human
gggccagagcuuggcagcuggg

SEQ ID NO: 358758 - RNA, 22 nt, Human
ccugggcaucucaugcaccugc

SEQ ID NO: 358759 - RNA, 22 nt, Human
ucaaggagcccacagucuaaug

SEQ ID NO: 358760 - RNA, 22 nt, Human
cauguaaaacacucagaacagu

SEQ ID NO: 358761 - RNA, 19 nt, Human
agcuggggcgguguguguu

SEQ ID NO: 358762 - RNA, 22 nt, Human
agaauuuuugauuaucuacucg

SEQ ID NO: 358763 - RNA, 22 nt, Human
guuugcauggaagacagugagu

SEQ ID NO: 358764 - RNA, 22 nt, Human
ucuggagccuuggaugggaaag

SEQ ID NO: 358765 - RNA, 22 nt, Human
uaugugcaguuugcucuuaaca

SEQ ID NO: 358766 - RNA, 22 nt, Human
cugcagcuccccugagaucaag

SEQ ID NO: 358767 - RNA, 20 nt, Human
acugccuugguucaguaggu

SEQ ID NO: 358768 - RNA, 22 nt, Human
uccucugcuccaggcuggacuu

SEQ ID NO: 358769 - RNA, 22 nt, Human
aaugcacauguuguaauaaaua

SEQ ID NO: 358770 - RNA, 22 nt, Human
auguaaaucaagcagugcuggu

SEQ ID NO: 358771 - RNA, 23 nt, Human
agaugaaagcuucccaucacagu

SEQ ID NO: 358772 - RNA, 22 nt, Human
ccaggcucugagccucacucuu

SEQ ID NO: 358773 - RNA, 22 nt, Human
ucagcuuuugucagaaauugua

SEQ ID NO: 358774 - RNA, 22 nt, Human
ugcccuuggguaacuugcugau

SEQ ID NO: 358775 - RNA, 22 nt, Human
aucagaagcuuguagucucucu

SEQ ID NO: 358776 - RNA, 22 nt, Human
aaugggaggauuuucucucuug

SEQ ID NO: 358777 - RNA, 22 nt, Human
uagcugccauugcuccaggaag

SEQ ID NO: 358778 - RNA, 18 nt, Human
aguccuuacgaggcuaua

SEQ ID NO: 358779 - RNA, 22 nt, Human
uaauuacagguccaaaacaauc

SEQ ID NO: 358780 - RNA, 22 nt, Human
aaaaugaacagaacaaugggga

SEQ ID NO: 358781 - RNA, 22 nt, Human
acagagcacauagauuggaguu

SEQ ID NO: 358782 - RNA, 18 nt, Human
ggucuuuaggucaguguc

SEQ ID NO: 358783 - RNA, 22 nt, Human
aggcagagcuaggaagaauugu

SEQ ID NO: 358784 - RNA, 22 nt, Human
guuuaauaauguugaauuacua

SEQ ID NO: 358785 - RNA, 22 nt, Human
acagccuguuugaucuggugcu

SEQ ID NO: 358786 - RNA, 22 nt, Human
agagauucauguuuacuguagg

SEQ ID NO: 358787 - RNA, 22 nt, Human
cuggcuuccaugcuguaguggc

SEQ ID NO: 358788 - RNA, 22 nt, Human
gggcaguggguggcugcagccu

SEQ ID NO: 358789 - RNA, 20 nt, Human
ccucaggaugagggugagca

SEQ ID NO: 358790 - RNA, 22 nt, Human
cugcugcauuacucuucucaag

SEQ ID NO: 358791 - RNA, 22 nt, Human
agagggagcccagucauagcug

SEQ ID NO: 358792 - RNA, 22 nt, Human
gcucccuguucucagccaugau

SEQ ID NO: 358793 - RNA, 22 nt, Human
gcagaagucagaccaucugaau

SEQ ID NO: 358794 - RNA, 22 nt, Human
ccagugcauaaucaauacagcc

SEQ ID NO: 358795 - RNA, 22 nt, Human
ucuacccagagcuaugaccuga

SEQ ID NO: 358796 - RNA, 22 nt, Human
aggcagcguagcaaggcuagua

SEQ ID NO: 358797 - RNA, 22 nt, Human
agccaccaccacugaaagguua

SEQ ID NO: 358798 - RNA, 21 nt, Human
caugaagccgguucccuguuu

SEQ ID NO: 358799 - RNA, 22 nt, Human
gacccuggaguuaguccugugu

SEQ ID NO: 358800 - RNA, 19 nt, Human
cuuauuagagugagagcuu

SEQ ID NO: 358801 - RNA, 21 nt, Human
aagagcugucaggaaggcugc

SEQ ID NO: 358802 - RNA, 22 nt, Human
ggugaggaauuggggacugacc

SEQ ID NO: 358803 - RNA, 22 nt, Human
acugcuuuaucugagaaguccu

SEQ ID NO: 358804 - RNA, 22 nt, Human
agcagaacauuuucagggcugu

SEQ ID NO: 358805 - RNA, 22 nt, Human
ugcagcccuuccuuccucuggg

SEQ ID NO: 358806 - RNA, 22 nt, Human
cugggaggcaccgcgucgugcu

SEQ ID NO: 358807 - RNA, 23 nt, Human
ugggccuggccucccaguccagc

SEQ ID NO: 358808 - RNA, 22 nt, Human
cugggaggcggagguuguagug

SEQ ID NO: 358809 - RNA, 22 nt, Human
acagagguguuccagaccuagg

SEQ ID NO: 358810 - RNA, 22 nt, Human
ugggggugacuaucucgggaau

SEQ ID NO: 358811 - RNA, 22 nt, Human
ugugccugaguuggcugaguac

SEQ ID NO: 358812 - RNA, 22 nt, Human
aaagccacugcauguguaguau

SEQ ID NO: 358813 - RNA, 22 nt, Human
cagcaguggccaucuguguggu

SEQ ID NO: 358814 - RNA, 22 nt, Human
uaaaguucagugcaugaaugug

SEQ ID NO: 358815 - RNA, 22 nt, Human
uggugguuaugcgcuuuguggg

SEQ ID NO: 358816 - RNA, 22 nt, Human
ucagagccaaucauggugcauu

SEQ ID NO: 358817 - RNA, 22 nt, Human
cagggccaggcugauggccugg

SEQ ID NO: 358818 - RNA, 22 nt, Human
uaauguguugaauauuuguaca

SEQ ID NO: 358819 - RNA, 22 nt, Human
uaggcagaaaggaaggcaaguu

SEQ ID NO: 358820 - RNA, 22 nt, Human
aagggcuggccacauucugggu

SEQ ID NO: 358821 - RNA, 22 nt, Human
cagcauugaucccaggcugugg

SEQ ID NO: 358822 - RNA, 22 nt, Human
aaggccagcuuguagggcuggu

SEQ ID NO: 358823 - RNA, 22 nt, Human
acugucuccucaucaugccugg

SEQ ID NO: 358824 - RNA, 21 nt, Human
uugaagcaaggguggcucuga

SEQ ID NO: 358825 - RNA, 22 nt, Human
ucucauguauugcccuggugug

SEQ ID NO: 358826 - RNA, 22 nt, Human
acaaaugccauauauaaauucu

SEQ ID NO: 358827 - RNA, 22 nt, Human
gcagcauugugagguccugccc

SEQ ID NO: 358828 - RNA, 22 nt, Human
ccaaagagcuagaauuauaggc

SEQ ID NO: 358829 - RNA, 22 nt, Human
gauccuugcacuugacuuggca

SEQ ID NO: 358830 - RNA, 22 nt, Human
ugaaggagggaagaaggcucug

SEQ ID NO: 358831 - RNA, 21 nt, Human
gcaggggauagaaauggucug

SEQ ID NO: 358832 - RNA, 22 nt, Human
cagcagcaggcgcacggccguc

SEQ ID NO: 358833 - RNA, 22 nt, Human
acuugguuggucucacccuguu

SEQ ID NO: 358834 - RNA, 22 nt, Human
gccaguggcaugcggcagggac

SEQ ID NO: 358835 - RNA, 22 nt, Human
uggaggcaguaacugagcaaca

SEQ ID NO: 358836 - RNA, 21 nt, Human
ugcuucucuagaucaacuacu

SEQ ID NO: 358837 - RNA, 22 nt, Human
gaaggccaguuuugagauaggu

SEQ ID NO: 358838 - RNA, 22 nt, Human
acagagguguguguaggacagu

SEQ ID NO: 358839 - RNA, 22 nt, Human
gcuucuauuauuuggagcugag

SEQ ID NO: 358840 - RNA, 22 nt, Human
cccagcaguuguuggugcacau

SEQ ID NO: 358841 - RNA, 22 nt, Human
acauuuaggauguuuugagaga

SEQ ID NO: 358842 - RNA, 22 nt, Human
guaaaauugcaauuacuuuugc

SEQ ID NO: 358843 - RNA, 22 nt, Human
auaauuaauuucaguaaucucc

SEQ ID NO: 358844 - RNA, 22 nt, Human
agcagggccaacaguaaacacc

SEQ ID NO: 358845 - RNA, 22 nt, Human
gcuguccaugucuggccucagu

SEQ ID NO: 358846 - RNA, 22 nt, Human
ugucagugguagacccagaggu

SEQ ID NO: 358847 - RNA, 19 nt, Human
agggucaggacaaggacuu

SEQ ID NO: 358848 - RNA, 22 nt, Human
uuucacaacguuguggugagag

SEQ ID NO: 358849 - RNA, 22 nt, Human
agaacagaagggaggaaggccu

SEQ ID NO: 358850 - RNA, 23 nt, Human
augcucugggcugugggaccugc

SEQ ID NO: 358851 - RNA, 22 nt, Human
ucuuuguaaaugccuagcauaa

SEQ ID NO: 358852 - RNA, 22 nt, Human
gcaggaugccagggcagcagcg

SEQ ID NO: 358853 - RNA, 22 nt, Human
gacucagugauuugacaugccu

SEQ ID NO: 358854 - RNA, 22 nt, Human
agaaaacauuacauaggugugu

SEQ ID NO: 358855 - RNA, 22 nt, Human
gagcagugacuggagcaugaga

SEQ ID NO: 358856 - RNA, 22 nt, Human
gggcugagaaguugaucccaag

SEQ ID NO: 358857 - RNA, 22 nt, Human
gcucccagguucuugggccuug

SEQ ID NO: 358858 - RNA, 22 nt, Human
uuauuuugguaaauguuugccu

SEQ ID NO: 358859 - RNA, 22 nt, Human
aagauuucugcuccugagagaa

SEQ ID NO: 358860 - RNA, 22 nt, Human
ggaagagggaaccacgacugua

SEQ ID NO: 358861 - RNA, 23 nt, Human
agcagccauagggaagcaauaca

SEQ ID NO: 358862 - RNA, 22 nt, Human
ucucugggaaugggccugggua

SEQ ID NO: 358863 - RNA, 22 nt, Human
cugcccaguuugggagccuuuc

SEQ ID NO: 358864 - RNA, 22 nt, Human
caggugggagcgaggagcuacu

SEQ ID NO: 358865 - RNA, 19 nt, Human
agugcagggagcacccuca

SEQ ID NO: 358866 - RNA, 22 nt, Human
auggaaagugcauggaagucau

SEQ ID NO: 358867 - RNA, 20 nt, Human
ccagguggugccuggagagg

SEQ ID NO: 358868 - RNA, 22 nt, Human
ggcucaagcagucugccugccu

SEQ ID NO: 358869 - RNA, 21 nt, Human
uggcucugaaagagugcugca

SEQ ID NO: 358870 - RNA, 22 nt, Human
uacaugcuccacuuucuccugu

SEQ ID NO: 358871 - RNA, 16 nt, Human
uggcagagguucagcc

SEQ ID NO: 358872 - RNA, 22 nt, Human
gcagccacacuguuacagaaug

SEQ ID NO: 358873 - RNA, 22 nt, Human
cagaggaagcuggguguggagu

SEQ ID NO: 358874 - RNA, 22 nt, Human
auaacaugagccagauugaaag

SEQ ID NO: 358875 - RNA, 22 nt, Human
ugcuuuauaucucucuucuuag

SEQ ID NO: 358876 - RNA, 22 nt, Human
agaggcaacauggggaacagau

SEQ ID NO: 358877 - RNA, 22 nt, Human
gccuggagcuacuggacacuga

SEQ ID NO: 358878 - RNA, 22 nt, Human
ucugugaacaucacauugacag

SEQ ID NO: 358879 - RNA, 22 nt, Human
gcuccacuugcagcuaggcuug

SEQ ID NO: 358880 - RNA, 22 nt, Human
aucacauuguuagcauagacug

SEQ ID NO: 358881 - RNA, 22 nt, Human
uuuggacaaguuacugguuucc

SEQ ID NO: 358882 - RNA, 22 nt, Human
uagcugccuuugggcuccugcu

SEQ ID NO: 358883 - RNA, 22 nt, Human
acuuccuggcguagcugacauu

SEQ ID NO: 358884 - RNA, 22 nt, Human
ucccacugugccuguuguaauc

SEQ ID NO: 358885 - RNA, 22 nt, Human
cauuagggacugaggaauaagg

SEQ ID NO: 358886 - RNA, 22 nt, Human
agcaauauuuaaagguuugcaa

SEQ ID NO: 358887 - RNA, 21 nt, Human
cagagguggccugaccucuga

SEQ ID NO: 358888 - RNA, 22 nt, Human
ugaaaucuccucuuuauauauc

SEQ ID NO: 358889 - RNA, 21 nt, Human
uuagcaaagcaaacacaugcu

SEQ ID NO: 358890 - RNA, 22 nt, Human
uccuuuuuaagucguuguggua

SEQ ID NO: 358891 - RNA, 22 nt, Human
ugaggcucagagaagugcuguu

SEQ ID NO: 358892 - RNA, 22 nt, Human
augcuguggaaguuccugaagc

SEQ ID NO: 358893 - RNA, 22 nt, Human
gagcagugguugaacagaggca

SEQ ID NO: 358894 - RNA, 22 nt, Human
augaggcagucuggccugaggg

SEQ ID NO: 358895 - RNA, 22 nt, Human
gcugucacacaugggaucucag

SEQ ID NO: 358896 - RNA, 22 nt, Human
agcagggcuggauuuggcaaga

SEQ ID NO: 358897 - RNA, 22 nt, Human
caggcaggugcagauuccucuu

SEQ ID NO: 358898 - RNA, 22 nt, Human
cugugcaagcccaagauaaaac

SEQ ID NO: 358899 - RNA, 22 nt, Human
ucagcaauaugauaggcuuugu

SEQ ID NO: 358900 - RNA, 22 nt, Human
ucaugucaguuucuucuauaaa

SEQ ID NO: 358901 - RNA, 22 nt, Human
uggcccuguguccugcugccag

SEQ ID NO: 358902 - RNA, 22 nt, Human
cagugagggcccccuuccaggu

SEQ ID NO: 358903 - RNA, 22 nt, Human
uaauacuuaccuugcagagucu

SEQ ID NO: 358904 - RNA, 22 nt, Human
aauucugugcaggcagagcuau

SEQ ID NO: 358905 - RNA, 22 nt, Human
ucagaccauccugcuguuagug

SEQ ID NO: 358906 - RNA, 22 nt, Human
gcucaggaaauaguuuaguguu

SEQ ID NO: 358907 - RNA, 20 nt, Human
agagccuugaggaagaugau

SEQ ID NO: 358908 - RNA, 22 nt, Human
auuuauguaucuguguagauca

SEQ ID NO: 358909 - RNA, 22 nt, Human
cguguggucccggcaaggcaag

SEQ ID NO: 358910 - RNA, 21 nt, Human
gugguucuagagaaacagaau

SEQ ID NO: 358911 - RNA, 22 nt, Human
gugugggcugcagaggcacagc

SEQ ID NO: 358912 - RNA, 22 nt, Human
cccuggagggauuucucaauca

SEQ ID NO: 358913 - RNA, 22 nt, Human
ugcaggugguuuggacacugcu

SEQ ID NO: 358914 - RNA, 18 nt, Human
ugcuuuaugcuuauauaa

SEQ ID NO: 358915 - RNA, 22 nt, Human
ugaagccaucccucagauggcc

SEQ ID NO: 358916 - RNA, 22 nt, Human
ugggccugggagggcagacgcu

SEQ ID NO: 358917 - RNA, 22 nt, Human
gagcgggaggaacggcucgggc

SEQ ID NO: 358918 - RNA, 22 nt, Human
cuuggcagauccaaaaaugaca

SEQ ID NO: 358919 - RNA, 22 nt, Human
ccugccugucaucgccugcgcc

SEQ ID NO: 358920 - RNA, 22 nt, Human
ccuggcagacugugagggcagg

SEQ ID NO: 358921 - RNA, 22 nt, Human
gcaguggcaugaugugggcuca

SEQ ID NO: 358922 - RNA, 22 nt, Human
augcagcuucaggauuaugaug

SEQ ID NO: 358923 - RNA, 22 nt, Human
agcucauggugcuaucucaggg

SEQ ID NO: 358924 - RNA, 22 nt, Human
cuguggcaggaagggacuagca

SEQ ID NO: 358925 - RNA, 21 nt, Human
uucaaaaugguguguuugucu

SEQ ID NO: 358926 - RNA, 22 nt, Human
ugggagcaccuugagggcagaa

SEQ ID NO: 358927 - RNA, 22 nt, Human
ugguggcuguugcagaacugag

SEQ ID NO: 358928 - RNA, 22 nt, Human
ucaggagacaaagggugcggag

SEQ ID NO: 358929 - RNA, 22 nt, Human
cagugagguggauggauggccu

SEQ ID NO: 358930 - RNA, 22 nt, Human
ggucccaggauugguugcgcag

SEQ ID NO: 358931 - RNA, 22 nt, Human
ugaaguaacuguccaggaucca

SEQ ID NO: 358932 - RNA, 22 nt, Human
gccaccucggcuuucucugcuc

SEQ ID NO: 358933 - RNA, 22 nt, Human
ucugggaaaugcuguuccuugu

SEQ ID NO: 358934 - RNA, 22 nt, Human
agcuucuggaagccuggcagca

SEQ ID NO: 358935 - RNA, 20 nt, Human
ugcagaagaacguucugguu

SEQ ID NO: 358936 - RNA, 22 nt, Human
gguuauauaauucagugcuuuc

SEQ ID NO: 358937 - RNA, 22 nt, Human
aauucuagcauugugaaaauau

SEQ ID NO: 358938 - RNA, 22 nt, Human
ucaguauccacaaaugcucaaa

SEQ ID NO: 358939 - RNA, 22 nt, Human
ggguggggcccaggaaaucuau

SEQ ID NO: 358940 - RNA, 18 nt, Human
acagacaaaauggaaaug

SEQ ID NO: 358941 - RNA, 22 nt, Human
gcuuuauuuugugagggauuac

SEQ ID NO: 358942 - RNA, 22 nt, Human
gagaaggcuggucuuaagucga

SEQ ID NO: 358943 - RNA, 22 nt, Human
caacuuucuguuaaauguuagu

SEQ ID NO: 358944 - RNA, 22 nt, Human
ggacucuguuuuccugaucacu

SEQ ID NO: 358945 - RNA, 22 nt, Human
gucccuggggaaucagcuggag

SEQ ID NO: 358946 - RNA, 22 nt, Human
gggagccaugcuggucuucuuu

SEQ ID NO: 358947 - RNA, 22 nt, Human
caugcugugcaucuugaugacc

SEQ ID NO: 358948 - RNA, 22 nt, Human
aggugcuggagucugggcagga

SEQ ID NO: 358949 - RNA, 17 nt, Human
cagucgaggaggaccug

SEQ ID NO: 358950 - RNA, 21 nt, Human
auggagggaccagggaagcag

SEQ ID NO: 358951 - RNA, 22 nt, Human
gccuggagacaaggacaaaggg

SEQ ID NO: 358952 - RNA, 22 nt, Human
uuugaaagcaccauuugaguag

SEQ ID NO: 358953 - RNA, 22 nt, Human
ccugagccugaguggugcaggg

SEQ ID NO: 358954 - RNA, 22 nt, Human
ggccuugggcuggcugcaguau

SEQ ID NO: 358955 - RNA, 22 nt, Human
caauuucaagauucuguucuuu

SEQ ID NO: 358956 - RNA, 22 nt, Human
ugaaugauguauaauauugaga

SEQ ID NO: 358957 - RNA, 22 nt, Human
ggcuuuauguuuuucauguggu

SEQ ID NO: 358958 - RNA, 22 nt, Human
ucuguggcacgauugcacugca

SEQ ID NO: 358959 - RNA, 22 nt, Human
ugaaaugagagcacagaauaaa

SEQ ID NO: 358960 - RNA, 22 nt, Human
uauuucagcacaugggauaggu

SEQ ID NO: 358961 - RNA, 22 nt, Human
aaauccuaaggagaauaugauu

SEQ ID NO: 358962 - RNA, 22 nt, Human
uaauauguguuacugacuuuuu

SEQ ID NO: 358963 - RNA, 22 nt, Human
cucugaagggagggccaagccc

SEQ ID NO: 358964 - RNA, 22 nt, Human
cuauuucaaggcccagauauga

SEQ ID NO: 358965 - RNA, 22 nt, Human
ucuuugcaggccaaauuguuaa

SEQ ID NO: 358966 - RNA, 22 nt, Human
acagaaauaacuuuuuauguuu

SEQ ID NO: 358967 - RNA, 21 nt, Human
ucacacacguuuccaagggca

SEQ ID NO: 358968 - RNA, 22 nt, Human
gcugggagccccgagccagcgc

SEQ ID NO: 358969 - RNA, 22 nt, Human
uuuccucugaugcugacuugga

SEQ ID NO: 358970 - RNA, 22 nt, Human
aacaaaugaccugauuucuucc

SEQ ID NO: 358971 - RNA, 21 nt, Human
gaaggagaaagcaagugcugc

SEQ ID NO: 358972 - RNA, 22 nt, Human
ccaugagcuuccuauauagggu

SEQ ID NO: 358973 - RNA, 22 nt, Human
uguccuuagggauauaaaauau

SEQ ID NO: 358974 - RNA, 22 nt, Human
gcauguuuugcaacaagugacc

SEQ ID NO: 358975 - RNA, 22 nt, Human
cugggccugggaggccaggucu

SEQ ID NO: 358976 - RNA, 22 nt, Human
guccuggggaauacagaagccg

SEQ ID NO: 358977 - RNA, 22 nt, Human
augauugaccaucugcugggcu

SEQ ID NO: 358978 - RNA, 22 nt, Human
gaagcagcuaggaucuucauuu

SEQ ID NO: 358979 - RNA, 22 nt, Human
uuuuccuaguaggccuauuaga

SEQ ID NO: 358980 - RNA, 22 nt, Human
agaaaagaggcuuucuaagcau

SEQ ID NO: 358981 - RNA, 20 nt, Human
uucugcuugcaaauaucaag

SEQ ID NO: 358982 - RNA, 22 nt, Human
uuuaugagcaaugcugagggga

SEQ ID NO: 358983 - RNA, 22 nt, Human
aaauaauuauagcgagucuauc

SEQ ID NO: 358984 - RNA, 22 nt, Human
cucacugcaaguuccaccuacc

SEQ ID NO: 358985 - RNA, 21 nt, Human
gggugcuguggucaugcagga

SEQ ID NO: 358986 - RNA, 20 nt, Human
agauggugaaggccagggag

SEQ ID NO: 358987 - RNA, 22 nt, Human
acaaaggcauagugaauguuuu

SEQ ID NO: 358988 - RNA, 20 nt, Human
gggcagccucgggagugggu

SEQ ID NO: 358989 - RNA, 22 nt, Human
uauuuucuggacagucuugcuu

SEQ ID NO: 358990 - RNA, 22 nt, Human
cuccuuccugguuagcaccuua

SEQ ID NO: 358991 - RNA, 20 nt, Human
gcugaccccugcugucaugc

SEQ ID NO: 358992 - RNA, 22 nt, Human
ugguccuggggaucugcaguga

SEQ ID NO: 358993 - RNA, 22 nt, Human
gagcgauguggguauguagaag

SEQ ID NO: 358994 - RNA, 22 nt, Human
agggcaaguugagugugcgugg

SEQ ID NO: 358995 - RNA, 18 nt, Human
auagaaaccuuuaaucag

SEQ ID NO: 358996 - RNA, 22 nt, Human
ucacccuugauaauguucuucu

SEQ ID NO: 358997 - RNA, 22 nt, Human
cuugcuucauuagugucuuagu

SEQ ID NO: 358998 - RNA, 22 nt, Human
uugauacagcagccugugaucc

SEQ ID NO: 358999 - RNA, 22 nt, Human
ugggcugcuuccucagcugaga

SEQ ID NO: 359000 - RNA, 22 nt, Human
gcugaaggcccggaggacaggg

SEQ ID NO: 359001 - RNA, 22 nt, Human
gccugugacucgucuugggcca

SEQ ID NO: 359002 - RNA, 22 nt, Human
cugggcugcagcgggagcgacg

SEQ ID NO: 359003 - RNA, 22 nt, Human
aaucagaacuucucaggguggg

SEQ ID NO: 359004 - RNA, 22 nt, Human
gggcugcacagaucuucaaggg

SEQ ID NO: 359005 - RNA, 19 nt, Human
gcauaaaaugucaaugugu

SEQ ID NO: 359006 - RNA, 22 nt, Human
gccuucagcggccgcucgcugc

SEQ ID NO: 359007 - RNA, 22 nt, Human
ccagcugcccaagaggcauccu

SEQ ID NO: 359008 - RNA, 19 nt, Human
gaagaagcuugagaaguag

SEQ ID NO: 359009 - RNA, 22 nt, Human
uacaaaguuugagaaugcuuuc

SEQ ID NO: 359010 - RNA, 22 nt, Human
aggcagcagacuguuaaucaga

SEQ ID NO: 359011 - RNA, 22 nt, Human
agaagccaauucugugugaguc

SEQ ID NO: 359012 - RNA, 22 nt, Human
uaucagaagacuuacaguaucg

SEQ ID NO: 359013 - RNA, 22 nt, Human
aagggcugcaauccaaaacacu

SEQ ID NO: 359014 - RNA, 22 nt, Human
aguccagucucacucuuggcag

SEQ ID NO: 359015 - RNA, 22 nt, Human
uaauuuuaugacaguguauuuu

SEQ ID NO: 359016 - RNA, 19 nt, Human
ccucugcgcuguccugcuc

SEQ ID NO: 359017 - RNA, 22 nt, Human
aaguccuuucucauggaggaau

SEQ ID NO: 359018 - RNA, 22 nt, Human
aguggcagggcuggcugcugca

SEQ ID NO: 359019 - RNA, 22 nt, Human
uucucuuuugugaugugagaug

SEQ ID NO: 359020 - RNA, 22 nt, Human
uaagacaauucuucagucacaa

SEQ ID NO: 359021 - RNA, 22 nt, Human
uuuuagaaauacugauuuagug

SEQ ID NO: 359022 - RNA, 22 nt, Human
cagcuuggaggaggaucuaaga

SEQ ID NO: 359023 - RNA, 22 nt, Human
ggaggggauuuaguagaugcua

SEQ ID NO: 359024 - RNA, 22 nt, Human
ucucccacugcaagcccaggcu

SEQ ID NO: 359025 - RNA, 22 nt, Human
cauagagugauguaagguaugu

SEQ ID NO: 359026 - RNA, 22 nt, Human
cuucagaggggacucaaaguca

SEQ ID NO: 359027 - RNA, 21 nt, Human
agaguaauuccugcuggaaag

SEQ ID NO: 359028 - RNA, 22 nt, Human
gccaguggucacugaggaagaa

SEQ ID NO: 359029 - RNA, 22 nt, Human
uagccaggucacacuguguguu

SEQ ID NO: 359030 - RNA, 22 nt, Human
auuguguaauuuucagcucaua

SEQ ID NO: 359031 - RNA, 22 nt, Human
cugcugugggcaggguagcugg

SEQ ID NO: 359032 - RNA, 22 nt, Human
cauuuuauccucugggaagcua

SEQ ID NO: 359033 - RNA, 22 nt, Human
ugcuuuaacauaagauaucuuu

SEQ ID NO: 359034 - RNA, 18 nt, Human
ccagagcuggcuccucgc

SEQ ID NO: 359035 - RNA, 21 nt, Human
cagcuucuucugugaccuggu

SEQ ID NO: 359036 - RNA, 22 nt, Human
agggcaugcuggaggagagaca

SEQ ID NO: 359037 - RNA, 23 nt, Human
gcugggcuuacucuuucagugag

SEQ ID NO: 359038 - RNA, 22 nt, Human
aggcaggucacaugcuuggcga

SEQ ID NO: 359039 - RNA, 22 nt, Human
agcaggagagcagugcgugguc

SEQ ID NO: 359040 - RNA, 22 nt, Human
ugucaugccaccguuucccaga

SEQ ID NO: 359041 - RNA, 22 nt, Human
uggcucagugacauuccuccca

SEQ ID NO: 359042 - RNA, 18 nt, Human
caggagcaggaguugaac

SEQ ID NO: 359043 - RNA, 22 nt, Human
ugagggaggcccuuugagcaga

SEQ ID NO: 359044 - RNA, 22 nt, Human
agcaccugcuaugugucaggga

SEQ ID NO: 359045 - RNA, 22 nt, Human
uauuccaagcacagcaacccag

SEQ ID NO: 359046 - RNA, 22 nt, Human
gcagggcugcugaaacuuguuu

SEQ ID NO: 359047 - RNA, 22 nt, Human
cagaguaaggagcugucaaacg

SEQ ID NO: 359048 - RNA, 22 nt, Human
gggucuggcaugcugagaugga

SEQ ID NO: 359049 - RNA, 22 nt, Human
ucaucuaagagucuuacauuua

SEQ ID NO: 359050 - RNA, 22 nt, Human
cccaggcagucuggcucuaaag

SEQ ID NO: 359051 - RNA, 22 nt, Human
uuauccaagcagaagcugcaca

SEQ ID NO: 359052 - RNA, 22 nt, Human
agccuggaauuaaggaaaugca

SEQ ID NO: 359053 - RNA, 22 nt, Human
aggcaggagugacccugacagg

SEQ ID NO: 359054 - RNA, 22 nt, Human
aagcaaaggcaggagcuuguga

SEQ ID NO: 359055 - RNA, 17 nt, Human
gagauggguggaucacc

SEQ ID NO: 359056 - RNA, 22 nt, Human
auccccagaaaauaggugccua

SEQ ID NO: 359057 - RNA, 22 nt, Human
aggcaguggagcuggaauaggc

SEQ ID NO: 359058 - RNA, 22 nt, Human
ugccugcugcuaagcucuuugu

SEQ ID NO: 359059 - RNA, 22 nt, Human
uagucaccuuuggcaccugcaa

SEQ ID NO: 359060 - RNA, 22 nt, Human
uaguccuuuaauaguuaaugug

SEQ ID NO: 359061 - RNA, 22 nt, Human
agaagccaaaugccagugaccu

SEQ ID NO: 359062 - RNA, 22 nt, Human
gguggcaggcccugagcauccc

SEQ ID NO: 359063 - RNA, 22 nt, Human
uguauauucugccuaaaagcuu

SEQ ID NO: 359064 - RNA, 22 nt, Human
caguggcugugaccagggaccu

SEQ ID NO: 359065 - RNA, 22 nt, Human
ucugcaggcucuagaugagguu

SEQ ID NO: 359066 - RNA, 22 nt, Human
aggcuagcuuuggcucaguaaa

SEQ ID NO: 359067 - RNA, 22 nt, Human
ggguaccaagcugcuugggggc

SEQ ID NO: 359068 - RNA, 22 nt, Human
ccugcagacacuuguccagcaa

SEQ ID NO: 359069 - RNA, 22 nt, Human
gugcuuucugcaugguuccuac

SEQ ID NO: 359070 - RNA, 22 nt, Human
gccugagagacccauggggcaa

SEQ ID NO: 359071 - RNA, 22 nt, Human
uuagccaugcccuagaagagga

SEQ ID NO: 359072 - RNA, 22 nt, Human
uccugaaaauaauuucacaaga

SEQ ID NO: 359073 - RNA, 21 nt, Human
uaaaugugagcagggcugggc

SEQ ID NO: 359074 - RNA, 22 nt, Human
gcugagucuugagcacugagca

SEQ ID NO: 359075 - RNA, 22 nt, Human
caggagcucuuaaggaugugau

SEQ ID NO: 359076 - RNA, 22 nt, Human
ucauugcagugauguuguaugu

SEQ ID NO: 359077 - RNA, 21 nt, Human
cagaggcagguccugggacgg

SEQ ID NO: 359078 - RNA, 22 nt, Human
ucugcugcacaaauucaucucu

SEQ ID NO: 359079 - RNA, 21 nt, Human
gcuccuggugcugcguggcgc

SEQ ID NO: 359080 - RNA, 22 nt, Human
agucccagcucugccacuuacu

SEQ ID NO: 359081 - RNA, 22 nt, Human
cuguguuugaugagaagccacc

SEQ ID NO: 359082 - RNA, 22 nt, Human
ccuggggagaagagcuuccccc

SEQ ID NO: 359083 - RNA, 22 nt, Human
gaaugcuaagcaugugggaguu

SEQ ID NO: 359084 - RNA, 22 nt, Human
uaaguccuauuccaggucucuc

SEQ ID NO: 359085 - RNA, 22 nt, Human
ugcccuguuccugccuccagcu

SEQ ID NO: 359086 - RNA, 22 nt, Human
agucucuuuugcgaagaguguu

SEQ ID NO: 359087 - RNA, 17 nt, Human
ucuggccuuccugaacu

SEQ ID NO: 359088 - RNA, 23 nt, Human
uacagaaggaguagucacuaaga

SEQ ID NO: 359089 - RNA, 22 nt, Human
aaucaguuagaaggaagagaau

SEQ ID NO: 359090 - RNA, 20 nt, Human
uacagaaugcaauaaaaugg

SEQ ID NO: 359091 - RNA, 22 nt, Human
cccaggaaacccgaaggcgacc

SEQ ID NO: 359092 - RNA, 23 nt, Human
ccucccaccuauuucacuuucuu

SEQ ID NO: 359093 - RNA, 22 nt, Human
cauuuauucauuugcuagggcu

SEQ ID NO: 359094 - RNA, 22 nt, Human
aggcacugaaggaagcuugcgc

SEQ ID NO: 359095 - RNA, 20 nt, Human
ugucauuguuucuaggaccu

SEQ ID NO: 359096 - RNA, 22 nt, Human
ucuggcucaggagcuguguuca

SEQ ID NO: 359097 - RNA, 22 nt, Human
uggccuggugcucaggcaguag

SEQ ID NO: 359098 - RNA, 22 nt, Human
agagggaucacccuguuucugg

SEQ ID NO: 359099 - RNA, 22 nt, Human
ucuuuggauaucgcuagaccgu

SEQ ID NO: 359100 - RNA, 22 nt, Human
agggcugguauguccaugaaag

SEQ ID NO: 359101 - RNA, 22 nt, Human
aggaggaggcuggaguacaccc

SEQ ID NO: 359102 - RNA, 20 nt, Human
ccagcuuucccugcagcauc

SEQ ID NO: 359103 - RNA, 22 nt, Human
cucuuaaagcuuccaguuucaa

SEQ ID NO: 359104 - RNA, 22 nt, Human
cacaggcuugucagcaugaggc

SEQ ID NO: 359105 - RNA, 23 nt, Human
auaauaacgucugucuugucucu

SEQ ID NO: 359106 - RNA, 22 nt, Human
ucugccuggauuccauucucca

SEQ ID NO: 359107 - RNA, 22 nt, Human
cagggcuccaugcagggacucc

SEQ ID NO: 359108 - RNA, 22 nt, Human
cucaaguaagaaacagaauugg

SEQ ID NO: 359109 - RNA, 22 nt, Human
cugucaguaggcucccaucauu

SEQ ID NO: 359110 - RNA, 20 nt, Human
aagggcagagggaacagacu

SEQ ID NO: 359111 - RNA, 20 nt, Human
cuuguacaugauaaagauuu

SEQ ID NO: 359112 - RNA, 17 nt, Human
gcuguaguuugauaaga

SEQ ID NO: 359113 - RNA, 22 nt, Human
agauaucaccaguuuuacauac

SEQ ID NO: 359114 - RNA, 22 nt, Human
uccagaauauuugggaaagaug

SEQ ID NO: 359115 - RNA, 22 nt, Human
cacaguggauugggugaugccc

SEQ ID NO: 359116 - RNA, 22 nt, Human
cacucacuuauuucuaacagaa

SEQ ID NO: 359117 - RNA, 22 nt, Human
agaggacaaaaugagaagugcu

SEQ ID NO: 359118 - RNA, 22 nt, Human
ccugaagaugcuguggccuggu

SEQ ID NO: 359119 - RNA, 22 nt, Human
ccuaggccuuacuuuccugugc

SEQ ID NO: 359120 - RNA, 22 nt, Human
agcugccacagagccuggccag

SEQ ID NO: 359121 - RNA, 22 nt, Human
ucaaaguccuugcuuuuucugu

SEQ ID NO: 359122 - RNA, 22 nt, Human
auagcuguuagauuggggucga

SEQ ID NO: 359123 - RNA, 17 nt, Human
agccccucagcgucacc

SEQ ID NO: 359124 - RNA, 22 nt, Human
cugcagaggccucgccuccucu

SEQ ID NO: 359125 - RNA, 22 nt, Human
acaguggagaaggcaugaggcu

SEQ ID NO: 359126 - RNA, 22 nt, Human
gcagagugagauaugaacccag

SEQ ID NO: 359127 - RNA, 22 nt, Human
ugcccugucuaagcugucagua

SEQ ID NO: 359128 - RNA, 22 nt, Human
aaggcccuggcaggaagcagga

SEQ ID NO: 359129 - RNA, 22 nt, Human
gguacaauucugggguaugcuc

SEQ ID NO: 359130 - RNA, 22 nt, Human
ucugucaggagauuggcagcug

SEQ ID NO: 359131 - RNA, 22 nt, Human
gcugccaauccagcugugggag

SEQ ID NO: 359132 - RNA, 22 nt, Human
aggccuccugcagggaugagug

SEQ ID NO: 359133 - RNA, 22 nt, Human
ugucccagcacuuugggagucu

SEQ ID NO: 359134 - RNA, 22 nt, Human
agagggcugcugcacagugcuc

SEQ ID NO: 359135 - RNA, 22 nt, Human
aauaaugucuuuggcuugacca

SEQ ID NO: 359136 - RNA, 22 nt, Human
guggagcccugguagggacccc

SEQ ID NO: 359137 - RNA, 22 nt, Human
uaaauguaccuucugccuuacu

SEQ ID NO: 359138 - RNA, 22 nt, Human
cuuucacagcacaagccugccu

SEQ ID NO: 359139 - RNA, 22 nt, Human
uaaaguuuguagcaauugauau

SEQ ID NO: 359140 - RNA, 22 nt, Human
gcauguguugguuuaugcaugu

SEQ ID NO: 359141 - RNA, 22 nt, Human
uauucacaaaaugagguccuca

SEQ ID NO: 359142 - RNA, 23 nt, Human
agggccacugggaaggauuacug

SEQ ID NO: 359143 - RNA, 22 nt, Human
ucuguucagguuucagagaacu

SEQ ID NO: 359144 - RNA, 22 nt, Human
caggaggcaguuucagaaguca

SEQ ID NO: 359145 - RNA, 22 nt, Human
cagcagcuucuguugaucagaa

SEQ ID NO: 359146 - RNA, 22 nt, Human
gaaggagaggauugugaggcug

SEQ ID NO: 359147 - RNA, 22 nt, Human
ucaggaauccagacagggcaca

SEQ ID NO: 359148 - RNA, 22 nt, Human
ugaaggaauggaggaucagagc

SEQ ID NO: 359149 - RNA, 22 nt, Human
aaggcucccucuucucgagugu

SEQ ID NO: 359150 - RNA, 22 nt, Human
aauuuagauugauaaacaugga

SEQ ID NO: 359151 - RNA, 22 nt, Human
caggauggugugagugugagga

SEQ ID NO: 359152 - RNA, 22 nt, Human
uuuguucaugccuauauucuca

SEQ ID NO: 359153 - RNA, 22 nt, Human
gcuccuggucuggagcuucaag

SEQ ID NO: 359154 - RNA, 22 nt, Human
ucuugggauugcccugcaguuc

SEQ ID NO: 359155 - RNA, 22 nt, Human
gacugucauucuagugcccaug

SEQ ID NO: 359156 - RNA, 17 nt, Human
cugaggcccagggccca

SEQ ID NO: 359157 - RNA, 22 nt, Human
gcccaggauggagaauaguggu

SEQ ID NO: 359158 - RNA, 22 nt, Human
cugccucuauucacugaggcag

SEQ ID NO: 359159 - RNA, 22 nt, Human
cacagggcagugauuguccaca

SEQ ID NO: 359160 - RNA, 22 nt, Human
ggcugcuggggacgugggagag

SEQ ID NO: 359161 - RNA, 22 nt, Human
cugggagcugucaggagcgugu

SEQ ID NO: 359162 - RNA, 22 nt, Human
uuuaggcaaauuucagaugugc

SEQ ID NO: 359163 - RNA, 22 nt, Human
ugggcuccucgucacucgcugu

SEQ ID NO: 359164 - RNA, 22 nt, Human
cucucuguuaugcuuucaugaa

SEQ ID NO: 359165 - RNA, 22 nt, Human
uaaagguaguuuuaaaggugcu

SEQ ID NO: 359166 - RNA, 22 nt, Human
agcagcuggugagcaagcucag

SEQ ID NO: 359167 - RNA, 22 nt, Human
agaauaaaucaaauguccugag

SEQ ID NO: 359168 - RNA, 22 nt, Human
aagcaccugcaguugacaaaaa

SEQ ID NO: 359169 - RNA, 18 nt, Human
gcucugcccaggcugccc

SEQ ID NO: 359170 - RNA, 22 nt, Human
agccuggauccauguggcuacc

SEQ ID NO: 359171 - RNA, 22 nt, Human
gucccagagagcacuaguccau

SEQ ID NO: 359172 - RNA, 22 nt, Human
cagugcaguggcugagcuggag

SEQ ID NO: 359173 - RNA, 20 nt, Human
cguaaggcaagugcugcauc

SEQ ID NO: 359174 - RNA, 22 nt, Human
cagauuuagaguggggcuugga

SEQ ID NO: 359175 - RNA, 22 nt, Human
ucauuuaauagcuuuugucuuu

SEQ ID NO: 359176 - RNA, 22 nt, Human
ggcuugcuucuuguccaggaau

SEQ ID NO: 359177 - RNA, 22 nt, Human
gcucaaggcaggcagacaugag

SEQ ID NO: 359178 - RNA, 22 nt, Human
uagauuuuacuucugucauuac

SEQ ID NO: 359179 - RNA, 22 nt, Human
aggccucuucagggagcaugga

SEQ ID NO: 359180 - RNA, 20 nt, Human
aggaacuggaagggaggaaa

SEQ ID NO: 359181 - RNA, 22 nt, Human
uuauuagggugguuuauguucu

SEQ ID NO: 359182 - RNA, 22 nt, Human
gggggaagaaagaacauggcau

SEQ ID NO: 359183 - RNA, 22 nt, Human
uauccaauucaccauugauggg

SEQ ID NO: 359184 - RNA, 22 nt, Human
agcugcagugaacuguuuuguc

SEQ ID NO: 359185 - RNA, 22 nt, Human
guuuucugauuagcaaaucuga

SEQ ID NO: 359186 - RNA, 23 nt, Human
ccucagggucuagcagagagaag

SEQ ID NO: 359187 - RNA, 17 nt, Human
uccuggcucugccacug

SEQ ID NO: 359188 - RNA, 22 nt, Human
ugggcagaggcagcagaaaccu

SEQ ID NO: 359189 - RNA, 22 nt, Human
ggccucugguucguggugaccu

SEQ ID NO: 359190 - RNA, 22 nt, Human
ucuggccaggauggcaagacca

SEQ ID NO: 359191 - RNA, 22 nt, Human
cagaaucagcccuugcuauuaa

SEQ ID NO: 359192 - RNA, 23 nt, Human
gcagacagagcagacuaagacaa

SEQ ID NO: 359193 - RNA, 22 nt, Human
cuguccagucuuuagcaagcug

SEQ ID NO: 359194 - RNA, 22 nt, Human
agcaggaaggggaugaugggca

SEQ ID NO: 359195 - RNA, 22 nt, Human
uuagccauuaauguccugugca

SEQ ID NO: 359196 - RNA, 22 nt, Human
uggcucagagagggagugugga

SEQ ID NO: 359197 - RNA, 21 nt, Human
ccagcuccaggaccuuggauc

SEQ ID NO: 359198 - RNA, 22 nt, Human
augaaggcuguguagauggaug

SEQ ID NO: 359199 - RNA, 23 nt, Human
uugcacauuggagcuggucuucu

SEQ ID NO: 359200 - RNA, 22 nt, Human
ucaggcagagggagaagccaag

SEQ ID NO: 359201 - RNA, 22 nt, Human
gcagggacaucuucagaucacu

SEQ ID NO: 359202 - RNA, 22 nt, Human
aaggcugagacagcacaggucc

SEQ ID NO: 359203 - RNA, 22 nt, Human
ugccucugugggccuuccuggc

SEQ ID NO: 359204 - RNA, 22 nt, Human
agggcagagggugccucaccug

SEQ ID NO: 359205 - RNA, 22 nt, Human
auaauucagguuuucuggcaca

SEQ ID NO: 359206 - RNA, 22 nt, Human
aauuucaaagcucacuggcaua

SEQ ID NO: 359207 - RNA, 22 nt, Human
gcucccucugcucaggcacuug

SEQ ID NO: 359208 - RNA, 19 nt, Human
uagaaugcccacuuaaaaa

SEQ ID NO: 359209 - RNA, 22 nt, Human
ggccucuguucugcauuccucc

SEQ ID NO: 359210 - RNA, 22 nt, Human
ugaagccaaucugccaggcaga

SEQ ID NO: 359211 - RNA, 22 nt, Human
ugucccaguuuugcagguuaga

SEQ ID NO: 359212 - RNA, 22 nt, Human
cagugauguuucugcaucagag

SEQ ID NO: 359213 - RNA, 22 nt, Human
uacauguaagacaugagacucu

SEQ ID NO: 359214 - RNA, 22 nt, Human
agugcagaguacauuuguggca

SEQ ID NO: 359215 - RNA, 22 nt, Human
aagggcagaauagagaagaugg

SEQ ID NO: 359216 - RNA, 22 nt, Human
ggcugcugaguuggccaggaga

SEQ ID NO: 359217 - RNA, 22 nt, Human
ucuacuuuucccuauacaguuu

SEQ ID NO: 359218 - RNA, 22 nt, Human
acuuccuguuaugugugccucu

SEQ ID NO: 359219 - RNA, 22 nt, Human
agcucccagcuccuuugagaga

SEQ ID NO: 359220 - RNA, 22 nt, Human
ugugaauaccuugaauucauca

SEQ ID NO: 359221 - RNA, 22 nt, Human
cugaggugagcuucccugggcu

SEQ ID NO: 359222 - RNA, 22 nt, Human
gcuguucucuguaacaugcauu

SEQ ID NO: 359223 - RNA, 22 nt, Human
agacaggcagaggcugcagagg

SEQ ID NO: 359224 - RNA, 22 nt, Human
cacagacccagaagggaugaag

SEQ ID NO: 359225 - RNA, 22 nt, Human
ccagggcugagcugugaccaug

SEQ ID NO: 359226 - RNA, 22 nt, Human
caaaguccauaguuuacaauag

SEQ ID NO: 359227 - RNA, 22 nt, Human
ugagccaggcucaagugauccu

SEQ ID NO: 359228 - RNA, 22 nt, Human
gccagggcugugcagguuuguu

SEQ ID NO: 359229 - RNA, 22 nt, Human
uuguggaaauacagacuccaag

SEQ ID NO: 359230 - RNA, 22 nt, Human
ccagacccugcucuggggcucu

SEQ ID NO: 359231 - RNA, 22 nt, Human
uugcaccauuucacuuccauua

SEQ ID NO: 359232 - RNA, 22 nt, Human
agacaaauggaguaugagcaac

SEQ ID NO: 359233 - RNA, 22 nt, Human
agauuaugcuggcugcuacaag

SEQ ID NO: 359234 - RNA, 22 nt, Human
cugugaccuccaggaaggggug

SEQ ID NO: 359235 - RNA, 21 nt, Human
agcugccacccuagcuucuga

SEQ ID NO: 359236 - RNA, 22 nt, Human
cccuggcagaaugucucugggc

SEQ ID NO: 359237 - RNA, 22 nt, Human
cuuaaagaugucaaggcuguuu

SEQ ID NO: 359238 - RNA, 22 nt, Human
agggaugguggagguugcaagu

SEQ ID NO: 359239 - RNA, 22 nt, Human
uaaaaguuuuaguuguacauaa

SEQ ID NO: 359240 - RNA, 22 nt, Human
ucaguuuugauuccugguucuc

SEQ ID NO: 359241 - RNA, 22 nt, Human
acagccagaggugguccugggu

SEQ ID NO: 359242 - RNA, 22 nt, Human
aggucauuacaauuaucauuuu

SEQ ID NO: 359243 - RNA, 22 nt, Human
uggguggcggccugguucugag

SEQ ID NO: 359244 - RNA, 22 nt, Human
auugacaagcaguaugucuuag

SEQ ID NO: 359245 - RNA, 20 nt, Human
uugcauuggaugugcaggug

SEQ ID NO: 359246 - RNA, 22 nt, Human
ucaccugggagggcugugguag

SEQ ID NO: 359247 - RNA, 22 nt, Human
ugggcagauuaaugcaguggcu

SEQ ID NO: 359248 - RNA, 22 nt, Human
uaauaaaugaaagugcuggcau

SEQ ID NO: 359249 - RNA, 22 nt, Human
uaugcauauagaugcacacaca

SEQ ID NO: 359250 - RNA, 22 nt, Human
gggcugcuguagagaacauguu

SEQ ID NO: 359251 - RNA, 22 nt, Human
aucuggcuauugacauguuaua

SEQ ID NO: 359252 - RNA, 18 nt, Human
cggcagagugcuucuagc

SEQ ID NO: 359253 - RNA, 22 nt, Human
gggcugagucugcugccuguca

SEQ ID NO: 359254 - RNA, 22 nt, Human
ccugugaggucaucugugguaa

SEQ ID NO: 359255 - RNA, 22 nt, Human
agcagcugaucaaagcacuuau

SEQ ID NO: 359256 - RNA, 22 nt, Human
gaaugaauagguguccagaugg

SEQ ID NO: 359257 - RNA, 22 nt, Human
ugcauuguugaccaguugugca

SEQ ID NO: 359258 - RNA, 18 nt, Human
gagcugggagaaggaagg

SEQ ID NO: 359259 - RNA, 22 nt, Human
ugucaccaaguugaugaaugca

SEQ ID NO: 359260 - RNA, 22 nt, Human
uagaacacuugaccacugcucc

SEQ ID NO: 359261 - RNA, 22 nt, Human
gcaggggaguggaugauggauu

SEQ ID NO: 359262 - RNA, 22 nt, Human
uuaaaauagccagugccccucu

SEQ ID NO: 359263 - RNA, 18 nt, Human
gucacuguguuucugagc

SEQ ID NO: 359264 - RNA, 22 nt, Human
gcucaggauuucauccaugugu

SEQ ID NO: 359265 - RNA, 17 nt, Human
uccauacaauucucucu

SEQ ID NO: 359266 - RNA, 22 nt, Human
agaaagaacguugguuaucuua

SEQ ID NO: 359267 - RNA, 22 nt, Human
uugcauguuauuuaaucuguau

SEQ ID NO: 359268 - RNA, 21 nt, Human
uugaaggaucacuucuguacc

SEQ ID NO: 359269 - RNA, 19 nt, Human
ccuuccuccccagggccau

SEQ ID NO: 359270 - RNA, 22 nt, Human
gggcagguuauuggaguaggga

SEQ ID NO: 359271 - RNA, 22 nt, Human
gcuggcuguaucaccuggccag

SEQ ID NO: 359272 - RNA, 22 nt, Human
aauguguauacuggcaauuaag

SEQ ID NO: 359273 - RNA, 22 nt, Human
aggcagcagugauaagauagga

SEQ ID NO: 359274 - RNA, 22 nt, Human
agggggugucucugauuggguu

SEQ ID NO: 359275 - RNA, 22 nt, Human
acagaguacauucagagacuau

SEQ ID NO: 359276 - RNA, 22 nt, Human
cagagccaugguaugggcuugu

SEQ ID NO: 359277 - RNA, 22 nt, Human
ccacuugugaaauaaucaaaua

SEQ ID NO: 359278 - RNA, 22 nt, Human
cagguggcaugacugccuacaa

SEQ ID NO: 359279 - RNA, 22 nt, Human
gccugccugcugugugcaaguu

SEQ ID NO: 359280 - RNA, 22 nt, Human
uagcccagcaugagcagagcug

SEQ ID NO: 359281 - RNA, 22 nt, Human
uaagagaacuggauagauagga

SEQ ID NO: 359282 - RNA, 22 nt, Human
ucagaggauagaaauacuuauu

SEQ ID NO: 359283 - RNA, 22 nt, Human
ccugucaggguuugccucagaa

SEQ ID NO: 359284 - RNA, 22 nt, Human
cagcacugcugcuguacacaca

SEQ ID NO: 359285 - RNA, 23 nt, Human
agggcccaagccuggacagcagg

SEQ ID NO: 359286 - RNA, 22 nt, Human
ggaggacacuggcucugccuuc

SEQ ID NO: 359287 - RNA, 22 nt, Human
ccacuguuuuucaguuaacuuu

SEQ ID NO: 359288 - RNA, 22 nt, Human
aagcagccagccaucaugcccg

SEQ ID NO: 359289 - RNA, 22 nt, Human
uuguaaaugaccuuuucuaauu

SEQ ID NO: 359290 - RNA, 22 nt, Human
uggcuuuauaaauccacugguu

SEQ ID NO: 359291 - RNA, 22 nt, Human
aguccuuugggaaaaaugacua

SEQ ID NO: 359292 - RNA, 22 nt, Human
cuggcucacaggugagaugcau

SEQ ID NO: 359293 - RNA, 22 nt, Human
gcucccagacugaccagaggug

SEQ ID NO: 359294 - RNA, 22 nt, Human
agagccagcaagugaauaguga

SEQ ID NO: 359295 - RNA, 22 nt, Human
gcagagcucuguucuuaucucc

SEQ ID NO: 359296 - RNA, 22 nt, Human
gcagggcucaacaggacacccc

SEQ ID NO: 359297 - RNA, 17 nt, Human
uguuccauuugaccacc

SEQ ID NO: 359298 - RNA, 22 nt, Human
acagcagcaauagcagugacau

SEQ ID NO: 359299 - RNA, 22 nt, Human
gcaggcaguugcaguuuucuag

SEQ ID NO: 359300 - RNA, 22 nt, Human
gaugcacaugugaguauagaag

SEQ ID NO: 359301 - RNA, 22 nt, Human
uccucucagugugguuguggga

SEQ ID NO: 359302 - RNA, 22 nt, Human
augcuguguggccaccuccaug

SEQ ID NO: 359303 - RNA, 22 nt, Human
uaggcuggaacuuaggcagagg

SEQ ID NO: 359304 - RNA, 22 nt, Human
uggcagucggacuucuaucuca

SEQ ID NO: 359305 - RNA, 22 nt, Human
gugucccaaagauuagaaauca

SEQ ID NO: 359306 - RNA, 22 nt, Human
guggccucugugcuccugccua

SEQ ID NO: 359307 - RNA, 22 nt, Human
cuacauuuggagaguauaggaa

SEQ ID NO: 359308 - RNA, 22 nt, Human
uccucugcuguucugguucuuu

SEQ ID NO: 359309 - RNA, 22 nt, Human
gggauggggucaacauguaccu

SEQ ID NO: 359310 - RNA, 22 nt, Human
cccaggaggugugcccaacucg

SEQ ID NO: 359311 - RNA, 22 nt, Human
acaggugugagaacaugccuug

SEQ ID NO: 359312 - RNA, 23 nt, Human
gccaggcuccggucuguggccac

SEQ ID NO: 359313 - RNA, 22 nt, Human
auuauguaacugugguucagca

SEQ ID NO: 359314 - RNA, 22 nt, Human
uacaaaugaguuguaugaacca

SEQ ID NO: 359315 - RNA, 22 nt, Human
gcugagggcauguguggcgacu

SEQ ID NO: 359316 - RNA, 22 nt, Human
ugcagcauuauucacaguagcc

SEQ ID NO: 359317 - RNA, 22 nt, Human
aauucuauguucuugaguaaga

SEQ ID NO: 359318 - RNA, 22 nt, Human
gucucccaucguuugugaggaa

SEQ ID NO: 359319 - RNA, 22 nt, Human
cugcuuuguggaaucacacugg

SEQ ID NO: 359320 - RNA, 22 nt, Human
accucuggccuucaggcaucau

SEQ ID NO: 359321 - RNA, 22 nt, Human
gugaauaaaacaccugccaaga

SEQ ID NO: 359322 - RNA, 22 nt, Human
gggauuuaguaggauaguauac

SEQ ID NO: 359323 - RNA, 22 nt, Human
agcugucuaccugcagaguccu

SEQ ID NO: 359324 - RNA, 22 nt, Human
acauguguauagccuguauaga

SEQ ID NO: 359325 - RNA, 22 nt, Human
uggagccuguguuucugcccag

SEQ ID NO: 359326 - RNA, 22 nt, Human
cagcaauaagccagguuagaca

SEQ ID NO: 359327 - RNA, 22 nt, Human
cagcagggcccccgggugcgcc

SEQ ID NO: 359328 - RNA, 22 nt, Human
auuuucugguugagguuuaaca

SEQ ID NO: 359329 - RNA, 22 nt, Human
uccaggagggguaggcaguaug

SEQ ID NO: 359330 - RNA, 22 nt, Human
uuguuucaggaugguuuguuac

SEQ ID NO: 359331 - RNA, 22 nt, Human
gcuggccauggggagugaggag

SEQ ID NO: 359332 - RNA, 19 nt, Human
ccugggagucagcugaagg

SEQ ID NO: 359333 - RNA, 22 nt, Human
agcucccagaaggcccugcgcc

SEQ ID NO: 359334 - RNA, 22 nt, Human
uuauuccauagaagucaaggaa

SEQ ID NO: 359335 - RNA, 22 nt, Human
aaaggccacugcaagggaaggu

SEQ ID NO: 359336 - RNA, 22 nt, Human
caucagaaccaguggggacauu

SEQ ID NO: 359337 - RNA, 22 nt, Human
cuucucagaggccagaagcuau

SEQ ID NO: 359338 - RNA, 22 nt, Human
uccuugaagcuuguaucuaaua

SEQ ID NO: 359339 - RNA, 22 nt, Human
gcucugagccgggggccugucc

SEQ ID NO: 359340 - RNA, 20 nt, Human
agugucugggccucaggccc

SEQ ID NO: 359341 - RNA, 22 nt, Human
ccagggcugcugugggacucca

SEQ ID NO: 359342 - RNA, 22 nt, Human
cucagaguccccaguggguuug

SEQ ID NO: 359343 - RNA, 22 nt, Human
uaucuguuccaggcacucagcu

SEQ ID NO: 359344 - RNA, 22 nt, Human
gaagcccagcaaacugugauca

SEQ ID NO: 359345 - RNA, 22 nt, Human
uugaaaggugacauuguuagag

SEQ ID NO: 359346 - RNA, 22 nt, Human
cacacagaugguaagggaggga

SEQ ID NO: 359347 - RNA, 22 nt, Human
cugggagcccgcguccuggugg

SEQ ID NO: 359348 - RNA, 22 nt, Human
aauuagggaggacaaagguaca

SEQ ID NO: 359349 - RNA, 22 nt, Human
uucccucuccuacucaggaaag

SEQ ID NO: 359350 - RNA, 22 nt, Human
gugugcagcagagacaggacuc

SEQ ID NO: 359351 - RNA, 22 nt, Human
cugagaaggaagccuccacucu

SEQ ID NO: 359352 - RNA, 22 nt, Human
auucuucauuguugauucaugu

SEQ ID NO: 359353 - RNA, 19 nt, Human
cucuccagcuccaguagcu

SEQ ID NO: 359354 - RNA, 22 nt, Human
uccagggaugccagccauguug

SEQ ID NO: 359355 - RNA, 22 nt, Human
aaggaguuuggguagucauaca

SEQ ID NO: 359356 - RNA, 22 nt, Human
acauuugaggauguuaagaaug

SEQ ID NO: 359357 - RNA, 19 nt, Human
uucaggauugacccuacug

SEQ ID NO: 359358 - RNA, 22 nt, Human
uugaggagucaggggcacggaa

SEQ ID NO: 359359 - RNA, 22 nt, Human
agaauuguugggguaauaaaag

SEQ ID NO: 359360 - RNA, 22 nt, Human
caugggagguuggcuuggcaug

SEQ ID NO: 359361 - RNA, 22 nt, Human
ccagagagaaauggauuugagu

SEQ ID NO: 359362 - RNA, 22 nt, Human
cuggcucauagagcagcuccaa

SEQ ID NO: 359363 - RNA, 22 nt, Human
aaugagacacgugaagcagaug

SEQ ID NO: 359364 - RNA, 22 nt, Human
ucagcuuuccuugcuuuagauu

SEQ ID NO: 359365 - RNA, 22 nt, Human
uugcauugggagugaggagacc

SEQ ID NO: 359366 - RNA, 22 nt, Human
uuucacaaaugucuuuaacuug

SEQ ID NO: 359367 - RNA, 22 nt, Human
gucagaggaggcugaguaggaa

SEQ ID NO: 359368 - RNA, 22 nt, Human
uuuugagauggugucucgcucc

SEQ ID NO: 359369 - RNA, 22 nt, Human
agcagcauccccggccuccacc

SEQ ID NO: 359370 - RNA, 23 nt, Human
uugcuuucaucaugagaugcucc

SEQ ID NO: 359371 - RNA, 22 nt, Human
agagcccugaagcagagcuaaa

SEQ ID NO: 359372 - RNA, 22 nt, Human
gcauggaauucccuuaugggcc

SEQ ID NO: 359373 - RNA, 22 nt, Human
ugccuggguguaaagggccaac

SEQ ID NO: 359374 - RNA, 22 nt, Human
uuagccauauagaaaaagagcu

SEQ ID NO: 359375 - RNA, 22 nt, Human
cuggcagcgugagcagcaucca

SEQ ID NO: 359376 - RNA, 22 nt, Human
uuucaguuuaugucuugaauua

SEQ ID NO: 359377 - RNA, 22 nt, Human
augaaacaugcuuuguggauga

SEQ ID NO: 359378 - RNA, 22 nt, Human
cugcuucuccaaaguaggacuu

SEQ ID NO: 359379 - RNA, 22 nt, Human
ggagagugggagcaacuguugc

SEQ ID NO: 359380 - RNA, 22 nt, Human
acacaugcauaagccuucccuu

SEQ ID NO: 359381 - RNA, 22 nt, Human
cugugagcuggguggccaggac

SEQ ID NO: 359382 - RNA, 22 nt, Human
ugcuggcuggccuggccuggac

SEQ ID NO: 359383 - RNA, 22 nt, Human
ggagccuggccuggcucugugu

SEQ ID NO: 359384 - RNA, 22 nt, Human
cuucuccucugaguccugggag

SEQ ID NO: 359385 - RNA, 22 nt, Human
uuccauuguuucugucuucacu

SEQ ID NO: 359386 - RNA, 22 nt, Human
gccuggagaaaggaagguggga

SEQ ID NO: 359387 - RNA, 22 nt, Human
gucuggggaagucagggcauca

SEQ ID NO: 359388 - RNA, 22 nt, Human
aaucagaaagaucuugaugaga

SEQ ID NO: 359389 - RNA, 15 nt, Human
aggcacugugggacc

SEQ ID NO: 359390 - RNA, 22 nt, Human
gcauucaucuuccuccaugcag

SEQ ID NO: 359391 - RNA, 22 nt, Human
ugaauaaucauguccauagugu

SEQ ID NO: 359392 - RNA, 22 nt, Human
gcugcaggggggucuggacuug

SEQ ID NO: 359393 - RNA, 22 nt, Human
ccuggcagguggagguugcagu

SEQ ID NO: 359394 - RNA, 22 nt, Human
gagcagaacaggccggguggga

SEQ ID NO: 359395 - RNA, 22 nt, Human
ucccaguguggcaggccaugga

SEQ ID NO: 359396 - RNA, 22 nt, Human
gcucuggguagccacugccugg

SEQ ID NO: 359397 - RNA, 22 nt, Human
ccucugagagaaggccuucagc

SEQ ID NO: 359398 - RNA, 22 nt, Human
aauuagggaaguauuuaguagu

SEQ ID NO: 359399 - RNA, 22 nt, Human
aggaaggguucuuugugaaaga

SEQ ID NO: 359400 - RNA, 22 nt, Human
uuuaggcaaacucauugucaga

SEQ ID NO: 359401 - RNA, 22 nt, Human
gcaggaugaaggcagaggcuga

SEQ ID NO: 359402 - RNA, 20 nt, Human
gcacugaagguuccagggga

SEQ ID NO: 359403 - RNA, 22 nt, Human
ggcugaggcucaugccaucuug

SEQ ID NO: 359404 - RNA, 22 nt, Human
ugcugccuugaccuccugggcu

SEQ ID NO: 359405 - RNA, 22 nt, Human
caguacuuguccucagguguua

SEQ ID NO: 359406 - RNA, 20 nt, Human
ucuggcucuuugcuccuccc

SEQ ID NO: 359407 - RNA, 22 nt, Human
aagucacacuagacaacugagg

SEQ ID NO: 359408 - RNA, 22 nt, Human
caguuucugggcguucacaggu

SEQ ID NO: 359409 - RNA, 22 nt, Human
aagcaauagcaacaacuuuaca

SEQ ID NO: 359410 - RNA, 22 nt, Human
ggagagaaauugagguagcaag

SEQ ID NO: 359411 - RNA, 22 nt, Human
augaacaauaaaauagaucaca

SEQ ID NO: 359412 - RNA, 22 nt, Human
agcccaggugagggguucgaaa

SEQ ID NO: 359413 - RNA, 22 nt, Human
cagugcauagauccugaggccu

SEQ ID NO: 359414 - RNA, 22 nt, Human
ucucuucuagcuucuugugguu

SEQ ID NO: 359415 - RNA, 22 nt, Human
auguuacagaaagcaaagauga

SEQ ID NO: 359416 - RNA, 22 nt, Human
augccaggaacaaacaguggug

SEQ ID NO: 359417 - RNA, 22 nt, Human
ggccucugguucacagggagga

SEQ ID NO: 359418 - RNA, 22 nt, Human
aagggcaggaaaagauggaugu

SEQ ID NO: 359419 - RNA, 22 nt, Human
ugucaccacuggcugaaacacc

SEQ ID NO: 359420 - RNA, 22 nt, Human
uagcuuuaaaaaucaucaaagc

SEQ ID NO: 359421 - RNA, 22 nt, Human
gcagggcugggugggagacaga

SEQ ID NO: 359422 - RNA, 17 nt, Human
ggcuggagcagcucccc

SEQ ID NO: 359423 - RNA, 22 nt, Human
cccagcucuuuuagcggcaucu

SEQ ID NO: 359424 - RNA, 21 nt, Human
gcugugcacauaguagaagug

SEQ ID NO: 359425 - RNA, 22 nt, Human
gagccuguguuuccuguagcca

SEQ ID NO: 359426 - RNA, 22 nt, Human
guggcugcucgggcuccggccc

SEQ ID NO: 359427 - RNA, 22 nt, Human
cagauacuguaaaauuucagua

SEQ ID NO: 359428 - RNA, 22 nt, Human
aggauuuaggagcuggcuaacg

SEQ ID NO: 359429 - RNA, 22 nt, Human
acaugaaaaauguuugcaguuu

SEQ ID NO: 359430 - RNA, 22 nt, Human
ucaguguagcagacuuguagcc

SEQ ID NO: 359431 - RNA, 22 nt, Human
agcccuggcccggcugugcuuu

SEQ ID NO: 359432 - RNA, 22 nt, Human
gcucugugggugaguagaaucu

SEQ ID NO: 359433 - RNA, 22 nt, Human
auuucccaugugaaucaauugg

SEQ ID NO: 359434 - RNA, 22 nt, Human
aaaguccuguuaacuguuaaca

SEQ ID NO: 359435 - RNA, 22 nt, Human
uuugaaaauuuaagugcuacac

SEQ ID NO: 359436 - RNA, 22 nt, Human
cagcaauaguguguuuguuuca

SEQ ID NO: 359437 - RNA, 22 nt, Human
gcaguccucucauuggccuccu

SEQ ID NO: 359438 - RNA, 22 nt, Human
ggcugccuggaccuccucuuuc

SEQ ID NO: 359439 - RNA, 22 nt, Human
uaagcauaacuaaaaaugauuu

SEQ ID NO: 359440 - RNA, 22 nt, Human
cuggcagcgcagcaugaagucg

SEQ ID NO: 359441 - RNA, 22 nt, Human
agugaccaacaaugcugagaag

SEQ ID NO: 359442 - RNA, 17 nt, Human
aaggccauuuccaccca

SEQ ID NO: 359443 - RNA, 22 nt, Human
ugccaggcaggacccuagaacc

SEQ ID NO: 359444 - RNA, 15 nt, Human
aaucagaaguguggc

SEQ ID NO: 359445 - RNA, 22 nt, Human
accagugcuuccugcuggagcu

SEQ ID NO: 359446 - RNA, 22 nt, Human
auuauuuuaugugcggccugau

SEQ ID NO: 359447 - RNA, 22 nt, Human
uuaagcaacacacauuaauuau

SEQ ID NO: 359448 - RNA, 22 nt, Human
aucaguuucacuugcuugcaaa

SEQ ID NO: 359449 - RNA, 22 nt, Human
gcaggaguguggugggacaucc

SEQ ID NO: 359450 - RNA, 22 nt, Human
cccaggaaaugggcucuugccu

SEQ ID NO: 359451 - RNA, 22 nt, Human
agggccagcacuccuggcagga

SEQ ID NO: 359452 - RNA, 22 nt, Human
cucuggagaacuccuugugucu

SEQ ID NO: 359453 - RNA, 22 nt, Human
auugaaagaguuuucugcugca

SEQ ID NO: 359454 - RNA, 22 nt, Human
gucccugcaucaccacgggacu

SEQ ID NO: 359455 - RNA, 19 nt, Human
cuggcagccugucuguguc

SEQ ID NO: 359456 - RNA, 22 nt, Human
ugcuggaggauuaaacaaguca

SEQ ID NO: 359457 - RNA, 22 nt, Human
gggcaggagagaacagucaugg

SEQ ID NO: 359458 - RNA, 22 nt, Human
agagccaggcggcugggcaccu

SEQ ID NO: 359459 - RNA, 22 nt, Human
gcagauggugccaugucuugug

SEQ ID NO: 359460 - RNA, 22 nt, Human
cugcagggcagaagggcauaga

SEQ ID NO: 359461 - RNA, 22 nt, Human
cccugcagugugaccucaccua

SEQ ID NO: 359462 - RNA, 22 nt, Human
ugcugccuccaacuccugggcu

SEQ ID NO: 359463 - RNA, 22 nt, Human
cugggaggacaacuuggagcuc

SEQ ID NO: 359464 - RNA, 22 nt, Human
uggcuggggccacaguuuuccu

SEQ ID NO: 359465 - RNA, 22 nt, Human
cagggcugugcccaucuucccc

SEQ ID NO: 359466 - RNA, 22 nt, Human
uucacauaaugauacaaagcuu

SEQ ID NO: 359467 - RNA, 22 nt, Human
cagucacauggaugauggauag

SEQ ID NO: 359468 - RNA, 22 nt, Human
cacaauacuauuuuuaggucuu

SEQ ID NO: 359469 - RNA, 22 nt, Human
ucauucuuuaccaaguugucac

SEQ ID NO: 359470 - RNA, 22 nt, Human
agagugcaaccgaaacaagcag

SEQ ID NO: 359471 - RNA, 22 nt, Human
cccuguccuggaugggagcacu

SEQ ID NO: 359472 - RNA, 22 nt, Human
agggagcuaggauccugaaggu

SEQ ID NO: 359473 - RNA, 22 nt, Human
aucuggguucaccaugcuccug

SEQ ID NO: 359474 - RNA, 22 nt, Human
ucucaggaagauuagggcuaag

SEQ ID NO: 359475 - RNA, 22 nt, Human
auguguaaaaagugcuuaauau

SEQ ID NO: 359476 - RNA, 22 nt, Human
ggagcaggagucucuugaauuu

SEQ ID NO: 359477 - RNA, 22 nt, Human
ugaggcucagagcaccugcucc

SEQ ID NO: 359478 - RNA, 19 nt, Human
uggcucugucgaaggcaca

SEQ ID NO: 359479 - RNA, 22 nt, Human
ggccagaggugguacauagcuu

SEQ ID NO: 359480 - RNA, 21 nt, Human
caguguggugaccagggucuc

SEQ ID NO: 359481 - RNA, 22 nt, Human
aggggccucgcaggaccgcucc

SEQ ID NO: 359482 - RNA, 22 nt, Human
ugggcugcccugaugguccuca

SEQ ID NO: 359483 - RNA, 22 nt, Human
gaggcugggaaguccaagauca

SEQ ID NO: 359484 - RNA, 22 nt, Human
ugggcagaguugugaugaacug

SEQ ID NO: 359485 - RNA, 22 nt, Human
auggcagcaaaugucuggcugg

SEQ ID NO: 359486 - RNA, 22 nt, Human
auagaauuauggaaagcaucuu

SEQ ID NO: 359487 - RNA, 20 nt, Human
agaauucuuacccuuugaug

SEQ ID NO: 359488 - RNA, 22 nt, Human
cucagcuggcaauucuggcucc

SEQ ID NO: 359489 - RNA, 22 nt, Human
ccaagaugaucuuuacaguguu

SEQ ID NO: 359490 - RNA, 18 nt, Human
cuuuaugugcagagcuuu

SEQ ID NO: 359491 - RNA, 22 nt, Human
uguccaggucagcagcagggac

SEQ ID NO: 359492 - RNA, 22 nt, Human
aucacaaaggcugcuucaugau

SEQ ID NO: 359493 - RNA, 22 nt, Human
uggcaguguauagguggcuccu

SEQ ID NO: 359494 - RNA, 22 nt, Human
ugauuaacugucuauuaaucau

SEQ ID NO: 359495 - RNA, 23 nt, Human
ggcaccaggccauggagcgggag

SEQ ID NO: 359496 - RNA, 22 nt, Human
auggacagugugucuguuucca

SEQ ID NO: 359497 - RNA, 22 nt, Human
caaaagucuuccuauucucuua

SEQ ID NO: 359498 - RNA, 22 nt, Human
aaguccaguuuuuccagguggu

SEQ ID NO: 359499 - RNA, 22 nt, Human
gccuucugauaucucuuggcau

SEQ ID NO: 359500 - RNA, 22 nt, Human
acagguuugucugauguaauga

SEQ ID NO: 359501 - RNA, 22 nt, Human
gagaaggacuacacaucuggcc

SEQ ID NO: 359502 - RNA, 22 nt, Human
uauaaaguuucgaaagauguau

SEQ ID NO: 359503 - RNA, 22 nt, Human
caguccuuaaggaaacauuugu

SEQ ID NO: 359504 - RNA, 22 nt, Human
acaggcagggaccuuggcuaag

SEQ ID NO: 359505 - RNA, 22 nt, Human
uuuucauuguuacuaugagcua

SEQ ID NO: 359506 - RNA, 22 nt, Human
cagaauuugaaguaauauucca

SEQ ID NO: 359507 - RNA, 19 nt, Human
ucagggcaguccggucccc

SEQ ID NO: 359508 - RNA, 22 nt, Human
cugauuccugauucaugcucuu

SEQ ID NO: 359509 - RNA, 22 nt, Human
uugcuguguaacuccuggccug

SEQ ID NO: 359510 - RNA, 22 nt, Human
ugcacagugaccccuggugacu

SEQ ID NO: 359511 - RNA, 22 nt, Human
cagggcuggguuaaaagcaggg

SEQ ID NO: 359512 - RNA, 22 nt, Human
guguacaugagaaaucaacuuu

SEQ ID NO: 359513 - RNA, 22 nt, Human
cucacuguccaacaggcuuuac

SEQ ID NO: 359514 - RNA, 22 nt, Human
gggcugaggaacauauuuuguu

SEQ ID NO: 359515 - RNA, 22 nt, Human
ucuucaaacugaaaauuuagaa

SEQ ID NO: 359516 - RNA, 22 nt, Human
cucagagaaccuaagcggagga

SEQ ID NO: 359517 - RNA, 22 nt, Human
uacuuugucauucuaaccuucc

SEQ ID NO: 359518 - RNA, 22 nt, Human
ugggacagugugccuugcuccu

SEQ ID NO: 359519 - RNA, 22 nt, Human
gcaggccagcugugcagauggg

SEQ ID NO: 359520 - RNA, 18 nt, Human
gcccagaggucugggccc

SEQ ID NO: 359521 - RNA, 22 nt, Human
caugaguuuuuuaguucaugca

SEQ ID NO: 359522 - RNA, 22 nt, Human
uucaggauuauacucucuuccc

SEQ ID NO: 359523 - RNA, 22 nt, Human
gagccuggauagccuuguucca

SEQ ID NO: 359524 - RNA, 22 nt, Human
cuacagaaacacuggacaugug

SEQ ID NO: 359525 - RNA, 22 nt, Human
uuccuuagacagagguggucau

SEQ ID NO: 359526 - RNA, 22 nt, Human
gcaccaggcagcugagcaggcc

SEQ ID NO: 359527 - RNA, 22 nt, Human
gcuucucucucagacugcaagc

SEQ ID NO: 359528 - RNA, 22 nt, Human
uccuggaggcaaaugaagacuc

SEQ ID NO: 359529 - RNA, 22 nt, Human
cggggcuguagcacagcugagc

SEQ ID NO: 359530 - RNA, 23 nt, Human
uguaacaauuucauauacaugca

SEQ ID NO: 359531 - RNA, 22 nt, Human
ucacaggcuccagggccuggau

SEQ ID NO: 359532 - RNA, 22 nt, Human
ucuggcucaaaauacguacucu

SEQ ID NO: 359533 - RNA, 21 nt, Human
aacugguucaauucaacuaga

SEQ ID NO: 359534 - RNA, 20 nt, Human
aggcugccaggucucacauc

SEQ ID NO: 359535 - RNA, 22 nt, Human
aaagccuucaaguagauguaag

SEQ ID NO: 359536 - RNA, 22 nt, Human
aauaucaguauauuguaucagu

SEQ ID NO: 359537 - RNA, 22 nt, Human
uuccuuccauagcaaaacaugc

SEQ ID NO: 359538 - RNA, 22 nt, Human
gaggccagaagucugagaucag

SEQ ID NO: 359539 - RNA, 22 nt, Human
aggcucaggugccucauucaca

SEQ ID NO: 359540 - RNA, 22 nt, Human
gagucaguaauggauaugucau

SEQ ID NO: 359541 - RNA, 22 nt, Human
agcucugacauugauucucagc

SEQ ID NO: 359542 - RNA, 22 nt, Human
uacaugcucaguaacuuucagu

SEQ ID NO: 359543 - RNA, 22 nt, Human
ucagggcauccauugccuguug

SEQ ID NO: 359544 - RNA, 20 nt, Human
uuucugugcccaggucuguu

SEQ ID NO: 359545 - RNA, 22 nt, Human
ucucuggccgagagucccuggg

SEQ ID NO: 359546 - RNA, 22 nt, Human
gagcuucccucugcagucccug

SEQ ID NO: 359547 - RNA, 23 nt, Human
aggcacugaaugugucagugagu

SEQ ID NO: 359548 - RNA, 17 nt, Human
gcuggcugacccaugcc

SEQ ID NO: 359549 - RNA, 21 nt, Human
ucacuagugccuucugucauu

SEQ ID NO: 359550 - RNA, 22 nt, Human
uucaacuuuggagauuuaauaa

SEQ ID NO: 359551 - RNA, 18 nt, Human
ggcugccuguuccugaag

SEQ ID NO: 359552 - RNA, 22 nt, Human
cucagaauuuagggcucugagg

SEQ ID NO: 359553 - RNA, 22 nt, Human
ucaggggcuugaggugcauguc

SEQ ID NO: 359554 - RNA, 22 nt, Human
cugaaugucgaucagcuugggu

SEQ ID NO: 359555 - RNA, 22 nt, Human
uaaagccacgcuggaaaucagg

SEQ ID NO: 359556 - RNA, 22 nt, Human
uucagagcaucucuaaagccag

SEQ ID NO: 359557 - RNA, 22 nt, Human
caaaugugacuuuugggcuucu

SEQ ID NO: 359558 - RNA, 22 nt, Human
uauuucaugugcaccauaauuc

SEQ ID NO: 359559 - RNA, 22 nt, Human
cauuuacacacagaggugugcu

SEQ ID NO: 359560 - RNA, 22 nt, Human
aauuucagagguagagauucua

SEQ ID NO: 359561 - RNA, 22 nt, Human
aggcagaucacuugaggccagg

SEQ ID NO: 359562 - RNA, 22 nt, Human
ccuucucuacuccugaugcaug

SEQ ID NO: 359563 - RNA, 22 nt, Human
uggcugagagaagacggggaag

SEQ ID NO: 359564 - RNA, 20 nt, Human
uuugagaccagucugcccaa

SEQ ID NO: 359565 - RNA, 22 nt, Human
uggcagagcuggcugcggauga

SEQ ID NO: 359566 - RNA, 22 nt, Human
ggggccagcaauguugaggaau

SEQ ID NO: 359567 - RNA, 22 nt, Human
uucuugcaggucacucacugag

SEQ ID NO: 359568 - RNA, 18 nt, Human
gagcugccauauuuaguu

SEQ ID NO: 359569 - RNA, 23 nt, Human
ugugaagguggguccaagggcug

SEQ ID NO: 359570 - RNA, 22 nt, Human
ugcuuccuucccguucuucucc

SEQ ID NO: 359571 - RNA, 22 nt, Human
cuggggcucacuuuggucaggc

SEQ ID NO: 359572 - RNA, 22 nt, Human
gaggccuggaccagccacagag

SEQ ID NO: 359573 - RNA, 18 nt, Human
uacaugcauaaaugaagc

SEQ ID NO: 359574 - RNA, 22 nt, Human
aagugaguggccuggagaggug

SEQ ID NO: 359575 - RNA, 22 nt, Human
ggcgcacaaugugcagguuugu

SEQ ID NO: 359576 - RNA, 22 nt, Human
ccugggcaauauagugaggccc

SEQ ID NO: 359577 - RNA, 22 nt, Human
uucaaugagcccggggccauag

SEQ ID NO: 359578 - RNA, 22 nt, Human
aucuaagauguauugagcacuu

SEQ ID NO: 359579 - RNA, 22 nt, Human
uuuucuuacugucugugauccu

SEQ ID NO: 359580 - RNA, 22 nt, Human
augaagauaagaccaggcugga

SEQ ID NO: 359581 - RNA, 22 nt, Human
ccagagccggauugugaagugc

SEQ ID NO: 359582 - RNA, 22 nt, Human
auggcuuucagauggugaaaga

SEQ ID NO: 359583 - RNA, 22 nt, Human
gacaucauagggugggaggaaa

SEQ ID NO: 359584 - RNA, 18 nt, Human
uggaggcagaguucuggc

SEQ ID NO: 359585 - RNA, 22 nt, Human
augcccgauaccuaguuaacuc

SEQ ID NO: 359586 - RNA, 22 nt, Human
uaaauguggagacucaggaguc

SEQ ID NO: 359587 - RNA, 22 nt, Human
gcuucuaucccuccacugcacu

SEQ ID NO: 359588 - RNA, 22 nt, Human
agcuggcagcucucagggguac

SEQ ID NO: 359589 - RNA, 22 nt, Human
agcugccagggacugggcaugg

SEQ ID NO: 359590 - RNA, 22 nt, Human
uccugcagugugucuccugcac

SEQ ID NO: 359591 - RNA, 22 nt, Human
cauuccuuaacguggggagucu

SEQ ID NO: 359592 - RNA, 22 nt, Human
agccuggccacucagggccuga

SEQ ID NO: 359593 - RNA, 22 nt, Human
ggccuggaagaggacagagaaa

SEQ ID NO: 359594 - RNA, 19 nt, Human
cuggcucuuggguggagga

SEQ ID NO: 359595 - RNA, 22 nt, Human
agaauucuuggugguuagaaua

SEQ ID NO: 359596 - RNA, 22 nt, Human
caagacaagaucuaagcaugcu

SEQ ID NO: 359597 - RNA, 17 nt, Human
aaucuguuuacagucag

SEQ ID NO: 359598 - RNA, 22 nt, Human
uaaggccaaguucauauacaac

SEQ ID NO: 359599 - RNA, 22 nt, Human
ggccaggccaagaggguuggaa

SEQ ID NO: 359600 - RNA, 22 nt, Human
agcugcagauucuaucuagaag

SEQ ID NO: 359601 - RNA, 22 nt, Human
aaucuucacagaaaaaugucug

SEQ ID NO: 359602 - RNA, 22 nt, Human
ugggugggagcgcccugucugg

SEQ ID NO: 359603 - RNA, 22 nt, Human
cccaggcacucuuggucauuuu

SEQ ID NO: 359604 - RNA, 22 nt, Human
gaaggagggugcggaucugagc

SEQ ID NO: 359605 - RNA, 22 nt, Human
gcacaauuauuuaugcaguaug

SEQ ID NO: 359606 - RNA, 22 nt, Human
ccucugcugcuguugagcaccg

SEQ ID NO: 359607 - RNA, 22 nt, Human
auguacauuuguaguaauauca

SEQ ID NO: 359608 - RNA, 22 nt, Human
gcaggugguccccguggagugg

SEQ ID NO: 359609 - RNA, 22 nt, Human
cuggcugugcugcaggcuuugg

SEQ ID NO: 359610 - RNA, 22 nt, Human
gacaguuuuuaauccuuucaug

SEQ ID NO: 359611 - RNA, 22 nt, Human
ucccuggcuguguucaggugcg

SEQ ID NO: 359612 - RNA, 23 nt, Human
aacaccaaggcucagagagauaa

SEQ ID NO: 359613 - RNA, 22 nt, Human
gguggguuuggaagagcaggcu

SEQ ID NO: 359614 - RNA, 22 nt, Human
gugucauuaaccaccaugcaaa

SEQ ID NO: 359615 - RNA, 22 nt, Human
aaguuguauauaccgcuuuaag

SEQ ID NO: 359616 - RNA, 22 nt, Human
acacugugcagauucccuguga

SEQ ID NO: 359617 - RNA, 22 nt, Human
accucugcaguagggcugugcc

SEQ ID NO: 359618 - RNA, 22 nt, Human
ugcauggacucaucagacaaga

SEQ ID NO: 359619 - RNA, 22 nt, Human
gauacauuuuaucuccuaacag

SEQ ID NO: 359620 - RNA, 22 nt, Human
ccgggccucgggacaccgggua

SEQ ID NO: 359621 - RNA, 20 nt, Human
ugcagggccuaaaaagggaa

SEQ ID NO: 359622 - RNA, 22 nt, Human
aaauaguucagcuuguaaaccc

SEQ ID NO: 359623 - RNA, 22 nt, Human
ucagcugccucucccuggaaga

SEQ ID NO: 359624 - RNA, 22 nt, Human
ggaggccauaguuugggaguca

SEQ ID NO: 359625 - RNA, 22 nt, Human
uuuauucaucaucuguucauau

SEQ ID NO: 359626 - RNA, 22 nt, Human
cggggcaggagucccuguagag

SEQ ID NO: 359627 - RNA, 22 nt, Human
gugugccagacaugaugcuaug

SEQ ID NO: 359628 - RNA, 22 nt, Human
acaauguguuuuuauacauuug

SEQ ID NO: 359629 - RNA, 22 nt, Human
caugcuccaaaaacaagagaau

SEQ ID NO: 359630 - RNA, 22 nt, Human
uucuucuucaagugcugcauuc

SEQ ID NO: 359631 - RNA, 22 nt, Human
cucccagggucuaggcugcugg

SEQ ID NO: 359632 - RNA, 22 nt, Human
gggaucagaaacauagcccuga

SEQ ID NO: 359633 - RNA, 18 nt, Human
gccagagggaagcaggug

SEQ ID NO: 359634 - RNA, 21 nt, Human
uggagacucugguucuuugug

SEQ ID NO: 359635 - RNA, 22 nt, Human
gcugcugucagugguggcaguu

SEQ ID NO: 359636 - RNA, 22 nt, Human
agccauugaauuuagugccuuu

SEQ ID NO: 359637 - RNA, 22 nt, Human
ccacagggugucaucagcuuga

SEQ ID NO: 359638 - RNA, 22 nt, Human
cccaggagguggagguugcggu

SEQ ID NO: 359639 - RNA, 22 nt, Human
agagcuuagaauuucagaugau

SEQ ID NO: 359640 - RNA, 22 nt, Human
ugcagggaaaacccaggaugcu

SEQ ID NO: 359641 - RNA, 22 nt, Human
uggagaaggggcagggucucca

SEQ ID NO: 359642 - RNA, 21 nt, Human
aggcucagagaucaaacagua

SEQ ID NO: 359643 - RNA, 22 nt, Human
ccagguggcuucugcccgaugu

SEQ ID NO: 359644 - RNA, 22 nt, Human
ggagaggugaauggcugcucua

SEQ ID NO: 359645 - RNA, 22 nt, Human
acaaaggcagagaauucaacau

SEQ ID NO: 359646 - RNA, 22 nt, Human
ugaaaugauaucugauaacaaa

SEQ ID NO: 359647 - RNA, 22 nt, Human
gcugccucugcgacucugggcg

SEQ ID NO: 359648 - RNA, 22 nt, Human
guggccuggauagacuccaucu

SEQ ID NO: 359649 - RNA, 22 nt, Human
aaagacacacagugcuucaguu

SEQ ID NO: 359650 - RNA, 22 nt, Human
aguggcaguagaugagcugguu

SEQ ID NO: 359651 - RNA, 22 nt, Human
aguggccagugcugcucugggg

SEQ ID NO: 359652 - RNA, 22 nt, Human
agggagcucaguuggaagcggu

SEQ ID NO: 359653 - RNA, 22 nt, Human
caguuucuuaucuucaaaauug

SEQ ID NO: 359654 - RNA, 21 nt, Human
uccuguaagcuuggguggcuc

SEQ ID NO: 359655 - RNA, 22 nt, Human
ggagguggcagagggacauucu

SEQ ID NO: 359656 - RNA, 22 nt, Human
cucaggauuuaaaggggcacuc

SEQ ID NO: 359657 - RNA, 22 nt, Human
aaaauaacuucuacuauuugca

SEQ ID NO: 359658 - RNA, 22 nt, Human
uuaaugauaccuauguuaauuu

SEQ ID NO: 359659 - RNA, 22 nt, Human
agcugccagaugacagugcuau

SEQ ID NO: 359660 - RNA, 22 nt, Human
auaauuuacaacugcuuuuaau

SEQ ID NO: 359661 - RNA, 22 nt, Human
acagcagcgucaacuuaaaauu

SEQ ID NO: 359662 - RNA, 22 nt, Human
acacagggcggaaagcaugaga

SEQ ID NO: 359663 - RNA, 22 nt, Human
cauuauggcagccaggauauug

SEQ ID NO: 359664 - RNA, 22 nt, Human
caguuuauaugucagagcugua

SEQ ID NO: 359665 - RNA, 22 nt, Human
uggaugcuguaggacacgcucu

SEQ ID NO: 359666 - RNA, 22 nt, Human
cuccagugagugagcaggcgac

SEQ ID NO: 359667 - RNA, 22 nt, Human
cuguucauggaaaaauaguugg

SEQ ID NO: 359668 - RNA, 22 nt, Human
cagcuguggagggaggaaaugc

SEQ ID NO: 359669 - RNA, 22 nt, Human
cagaugagaguggccaggguuc

SEQ ID NO: 359670 - RNA, 22 nt, Human
cccaggacucggcacucuccuu

SEQ ID NO: 359671 - RNA, 22 nt, Human
cagggcuggcucaugaaaaguu

SEQ ID NO: 359672 - RNA, 19 nt, Human
ccagcagcuuugauucucu

SEQ ID NO: 359673 - RNA, 22 nt, Human
uuccucuagcuucucacuaaca

SEQ ID NO: 359674 - RNA, 22 nt, Human
uuucuaguaaucaauauaaagu

SEQ ID NO: 359675 - RNA, 22 nt, Human
accaugaucugcucugguguuu

SEQ ID NO: 359676 - RNA, 22 nt, Human
cagaauuuagcacaauguaugg

SEQ ID NO: 359677 - RNA, 22 nt, Human
ugcauaaacuucucugguguga

SEQ ID NO: 359678 - RNA, 22 nt, Human
caguugcuggaugugcagcucu

SEQ ID NO: 359679 - RNA, 22 nt, Human
ggcaggguggcccuccagugag

SEQ ID NO: 359680 - RNA, 22 nt, Human
uuuagggaauagaagaucugaa

SEQ ID NO: 359681 - RNA, 22 nt, Human
ucauggauggccgggaggugau

SEQ ID NO: 359682 - RNA, 22 nt, Human
augcagguugggcaaguguggg

SEQ ID NO: 359683 - RNA, 22 nt, Human
cuauuucugccuaaugaccugu

SEQ ID NO: 359684 - RNA, 22 nt, Human
ugcugucugauucagggugauu

SEQ ID NO: 359685 - RNA, 22 nt, Human
cuggccugcugggugagguccu

SEQ ID NO: 359686 - RNA, 22 nt, Human
cccaggccccagggcuugucag

SEQ ID NO: 359687 - RNA, 20 nt, Human
ggccugagcauggcuggcag

SEQ ID NO: 359688 - RNA, 22 nt, Human
gugcaggagguaacauagcaaa

SEQ ID NO: 359689 - RNA, 22 nt, Human
ggagagcaggguccugagauac

SEQ ID NO: 359690 - RNA, 22 nt, Human
ucauuuguugaacuuuagugcg

SEQ ID NO: 359691 - RNA, 22 nt, Human
caguccuuucugaaauccuaua

SEQ ID NO: 359692 - RNA, 22 nt, Human
cuacuuuaauuuucugcagaga

SEQ ID NO: 359693 - RNA, 20 nt, Human
gugcauuucaccuguacugu

SEQ ID NO: 359694 - RNA, 22 nt, Human
aaggcucuuggagugaaugcag

SEQ ID NO: 359695 - RNA, 20 nt, Human
ugugugcacacaugacauuc

SEQ ID NO: 359696 - RNA, 22 nt, Human
uuuuuccuagcgauuugucagc

SEQ ID NO: 359697 - RNA, 22 nt, Human
guuuucaauuauaagauggcuu

SEQ ID NO: 359698 - RNA, 22 nt, Human
uggaggcauaggccugggcccu

SEQ ID NO: 359699 - RNA, 22 nt, Human
gccucugcacuguggcacacca

SEQ ID NO: 359700 - RNA, 22 nt, Human
uaauuucaaguuuagggcucua

SEQ ID NO: 359701 - RNA, 23 nt, Human
ccaggcaguagcuauugaaguga

SEQ ID NO: 359702 - RNA, 22 nt, Human
gagaaagauguaggcugggagg

SEQ ID NO: 359703 - RNA, 22 nt, Human
gaggcuggugguuaguuccauu

SEQ ID NO: 359704 - RNA, 22 nt, Human
aaaugcacucugcuucugugac

SEQ ID NO: 359705 - RNA, 22 nt, Human
uuccuauuuccaugaaacacaa

SEQ ID NO: 359706 - RNA, 22 nt, Human
caaguccuuagaugguucuuug

SEQ ID NO: 359707 - RNA, 22 nt, Human
uugcauaaaagaguauaucuua

SEQ ID NO: 359708 - RNA, 22 nt, Human
aaggcacuagcaagcugccugg

SEQ ID NO: 359709 - RNA, 22 nt, Human
guguugaugacauuuuagaaac

SEQ ID NO: 359710 - RNA, 22 nt, Human
cagcugggugaucuugggcagg

SEQ ID NO: 359711 - RNA, 23 nt, Human
auauggcuguuguguguuaacau

SEQ ID NO: 359712 - RNA, 22 nt, Human
agagccugugauugucaucacc

SEQ ID NO: 359713 - RNA, 22 nt, Human
cugggcuucucccccuggcaga

SEQ ID NO: 359714 - RNA, 22 nt, Human
cauuucugugacacuuccaucu

SEQ ID NO: 359715 - RNA, 22 nt, Human
ccacagagacagagcccagggu

SEQ ID NO: 359716 - RNA, 20 nt, Human
aggaaaaggguggugguaga

SEQ ID NO: 359717 - RNA, 22 nt, Human
cucugggcaaguaugauagaaa

SEQ ID NO: 359718 - RNA, 17 nt, Human
uggagcugcguguguuc

SEQ ID NO: 359719 - RNA, 22 nt, Human
uuucuucagagagagcuuuccc

SEQ ID NO: 359720 - RNA, 22 nt, Human
gugcuaggauuacaggcauggg

SEQ ID NO: 359721 - RNA, 22 nt, Human
ggccugagucacaucaggagag

SEQ ID NO: 359722 - RNA, 22 nt, Human
caaaugaagggagcugaagucu

SEQ ID NO: 359723 - RNA, 22 nt, Human
uuccaggaagauucaacaaaag

SEQ ID NO: 359724 - RNA, 22 nt, Human
agagcugagcaccaagcauggu

SEQ ID NO: 359725 - RNA, 22 nt, Human
agaaggcagaugggacggagca

SEQ ID NO: 359726 - RNA, 22 nt, Human
aggaagcccaagucucaucuuc

SEQ ID NO: 359727 - RNA, 22 nt, Human
acauugaucagccucccaugca

SEQ ID NO: 359728 - RNA, 18 nt, Human
agaguguucucagugaaa

SEQ ID NO: 359729 - RNA, 22 nt, Human
uggagcagccaugaugacagag

SEQ ID NO: 359730 - RNA, 22 nt, Human
aacaggcaggagaauucugccu

SEQ ID NO: 359731 - RNA, 22 nt, Human
aucaauucuuaggaaaauagcu

SEQ ID NO: 359732 - RNA, 22 nt, Human
cucagggacguuagaggacagg

SEQ ID NO: 359733 - RNA, 21 nt, Human
aaaugaaugugguagugcaag

SEQ ID NO: 359734 - RNA, 22 nt, Human
uuugacaguaauaaagcacaag

SEQ ID NO: 359735 - RNA, 22 nt, Human
auuuccaccggcucaggaaguu

SEQ ID NO: 359736 - RNA, 22 nt, Human
cugggaugucuauagaacacuu

SEQ ID NO: 359737 - RNA, 22 nt, Human
auucacaaagaagggaaguaca

SEQ ID NO: 359738 - RNA, 18 nt, Human
cugaaggauccaggugua

SEQ ID NO: 359739 - RNA, 22 nt, Human
ucugagcuggagcccaucaccu

SEQ ID NO: 359740 - RNA, 22 nt, Human
ugguccaggguguaguacagag

SEQ ID NO: 359741 - RNA, 22 nt, Human
auagucuuagucuauaguuuug

SEQ ID NO: 359742 - RNA, 22 nt, Human
ccucacugcuauguguuugcuc

SEQ ID NO: 359743 - RNA, 22 nt, Human
cuuacaaaggagaggagauagg

SEQ ID NO: 359744 - RNA, 22 nt, Human
uuugaaguggaaaaggauuuaa

SEQ ID NO: 359745 - RNA, 22 nt, Human
gcugccacgaucucugcuguag

SEQ ID NO: 359746 - RNA, 22 nt, Human
uugggaaggcguggaagcagaa

SEQ ID NO: 359747 - RNA, 22 nt, Human
ugagccaguggaagauggcagu

SEQ ID NO: 359748 - RNA, 22 nt, Human
uugucuguccaggcaccccaag

SEQ ID NO: 359749 - RNA, 22 nt, Human
gcagggcacacaagaaugauaa

SEQ ID NO: 359750 - RNA, 22 nt, Human
ugccacacagcuguaugaggga

SEQ ID NO: 359751 - RNA, 22 nt, Human
ugguaaauauguccauucucuu

SEQ ID NO: 359752 - RNA, 22 nt, Human
acacauaagccuaaucaucucc

SEQ ID NO: 359753 - RNA, 22 nt, Human
caagagcuggguggcaagcuag

SEQ ID NO: 359754 - RNA, 22 nt, Human
accaggaguugggggugggacc

SEQ ID NO: 359755 - RNA, 22 nt, Human
ggcugcagaaguacuuccggau

SEQ ID NO: 359756 - RNA, 22 nt, Human
auagaauucguguuuguaauuc

SEQ ID NO: 359757 - RNA, 22 nt, Human
uugcuucaguagcucuuuaaag

SEQ ID NO: 359758 - RNA, 22 nt, Human
ugggcagacgcuguuggaaggc

SEQ ID NO: 359759 - RNA, 22 nt, Human
ucaaagucauggcaggcucaga

SEQ ID NO: 359760 - RNA, 22 nt, Human
ucucaggggauucacuggcacc

SEQ ID NO: 359761 - RNA, 22 nt, Human
ugcaccugagaggucucugagg

SEQ ID NO: 359762 - RNA, 22 nt, Human
ucucagggccccaaaggcuagu

SEQ ID NO: 359763 - RNA, 21 nt, Human
aaggccugcuuacugcuaguu

SEQ ID NO: 359764 - RNA, 22 nt, Human
aaaagccaugcauaccuaagag

SEQ ID NO: 359765 - RNA, 22 nt, Human
augcuguguauuuuacucuuuc

SEQ ID NO: 359766 - RNA, 22 nt, Human
uuaugauuugccacagauuggu

SEQ ID NO: 359767 - RNA, 22 nt, Human
gggagggacacaaagaguuccc

SEQ ID NO: 359768 - RNA, 22 nt, Human
cagguaagagacggauuggccc

SEQ ID NO: 359769 - RNA, 22 nt, Human
aggccugaggaccagauaaaug

SEQ ID NO: 359770 - RNA, 22 nt, Human
auggaaagggaagcaaggaaca

SEQ ID NO: 359771 - RNA, 22 nt, Human
uuuccucuccaccaggaggucu

SEQ ID NO: 359772 - RNA, 22 nt, Human
aggaagcuagagccaccggacu

SEQ ID NO: 359773 - RNA, 22 nt, Human
ggguggcuccuaugggcauagc

SEQ ID NO: 359774 - RNA, 22 nt, Human
ggcgaggccgggacaggcugga

SEQ ID NO: 359775 - RNA, 22 nt, Human
uucaaauacauucuuugccacu

SEQ ID NO: 359776 - RNA, 22 nt, Human
agggcuccaaggaaguguagcu

SEQ ID NO: 359777 - RNA, 19 nt, Human
acagagcucucugcuucug

SEQ ID NO: 359778 - RNA, 20 nt, Human
ucagagagagggugccacuu

SEQ ID NO: 359779 - RNA, 21 nt, Human
gggagcuggaaacugggugac

SEQ ID NO: 359780 - RNA, 22 nt, Human
ggagacagugguagggccuaag

SEQ ID NO: 359781 - RNA, 22 nt, Human
uaguaaaaguuuaguugaaagu

SEQ ID NO: 359782 - RNA, 22 nt, Human
ugcagagguuuccaggcaaguu

SEQ ID NO: 359783 - RNA, 22 nt, Human
agggucaguucugugagguguu

SEQ ID NO: 359784 - RNA, 22 nt, Human
ugaagacagaccaaggagaaug

SEQ ID NO: 359785 - RNA, 22 nt, Human
gagggcaguagccucguacccu

SEQ ID NO: 359786 - RNA, 22 nt, Human
guccuggcuuaguucgcuguaa

SEQ ID NO: 359787 - RNA, 22 nt, Human
caagcagacaguaggccuagaa

SEQ ID NO: 359788 - RNA, 22 nt, Human
guuuuauaggcuguugcuauau

SEQ ID NO: 359789 - RNA, 22 nt, Human
aaaugcacagguuuuaaauccu

SEQ ID NO: 359790 - RNA, 22 nt, Human
cagcuccugccugggcagcugu

SEQ ID NO: 359791 - RNA, 22 nt, Human
uccugucugcucacagagcugg

SEQ ID NO: 359792 - RNA, 21 nt, Human
uuugaaagcccuauguuuuca

SEQ ID NO: 359793 - RNA, 22 nt, Human
ccaggugguucaggucaccaua

SEQ ID NO: 359794 - RNA, 22 nt, Human
auuaggcacuagaaugucaauu

SEQ ID NO: 359795 - RNA, 21 nt, Human
uucaauacuauuucaauaguc

SEQ ID NO: 359796 - RNA, 22 nt, Human
uaaugaauaaacuugagaguca

SEQ ID NO: 359797 - RNA, 22 nt, Human
ugcagggccuugggaugugucc

SEQ ID NO: 359798 - RNA, 22 nt, Human
gccucugcaucaucacuccagc

SEQ ID NO: 359799 - RNA, 22 nt, Human
ucuauacugaugggauacuauu

SEQ ID NO: 359800 - RNA, 22 nt, Human
ggcuuuauaggguagaggauca

SEQ ID NO: 359801 - RNA, 22 nt, Human
augacagaggagugcaggugau

SEQ ID NO: 359802 - RNA, 22 nt, Human
ucuuccucuagaucugaggccc

SEQ ID NO: 359803 - RNA, 22 nt, Human
gguagcacauugcauuaggaga

SEQ ID NO: 359804 - RNA, 22 nt, Human
uagcuuuaagacauggugaaug

SEQ ID NO: 359805 - RNA, 22 nt, Human
cccagcaggaggagguugcagu

SEQ ID NO: 359806 - RNA, 22 nt, Human
gagucgagcagaaagccgucgg

SEQ ID NO: 359807 - RNA, 22 nt, Human
aggacagugguguucuggagug

SEQ ID NO: 359808 - RNA, 20 nt, Human
uuccagagaucugcauuuua

SEQ ID NO: 359809 - RNA, 22 nt, Human
ggggaugguagaccggugacgu

SEQ ID NO: 359810 - RNA, 22 nt, Human
ccagcuuucauaucaugaggua

SEQ ID NO: 359811 - RNA, 22 nt, Human
ccucagggccaucucugucccu

SEQ ID NO: 359812 - RNA, 23 nt, Human
cccagcuuucccacugccgagag

SEQ ID NO: 359813 - RNA, 23 nt, Human
acagcaagaggaccagaugugag

SEQ ID NO: 359814 - RNA, 22 nt, Human
ccugcugugaagccaggccugu

SEQ ID NO: 359815 - RNA, 22 nt, Human
uaucaagugacuaucacagaac

SEQ ID NO: 359816 - RNA, 22 nt, Human
cucaggauauugggcuggagca

SEQ ID NO: 359817 - RNA, 22 nt, Human
aggccagcucuacccuuggacu

SEQ ID NO: 359818 - RNA, 22 nt, Human
gccauccucugagcacuaggca

SEQ ID NO: 359819 - RNA, 22 nt, Human
cagggcagaacauauagauagu

SEQ ID NO: 359820 - RNA, 22 nt, Human
aguuuucuguucuacaauuuga

SEQ ID NO: 359821 - RNA, 22 nt, Human
acuuucugcaguguuggaaaug

SEQ ID NO: 359822 - RNA, 22 nt, Human
uguuuguucccucucuuuccug

SEQ ID NO: 359823 - RNA, 22 nt, Human
cugaggccucuguucaccagaa

SEQ ID NO: 359824 - RNA, 22 nt, Human
guagggacuguucucaccugag

SEQ ID NO: 359825 - RNA, 22 nt, Human
guucagggagggacagaugaag

SEQ ID NO: 359826 - RNA, 22 nt, Human
ugcuuuauguuaucagaagggu

SEQ ID NO: 359827 - RNA, 22 nt, Human
ucacaguaucacacaaggauua

SEQ ID NO: 359828 - RNA, 22 nt, Human
auugacaagugagcugggcugc

SEQ ID NO: 359829 - RNA, 22 nt, Human
ucuggccacccgaggccccugc

SEQ ID NO: 359830 - RNA, 22 nt, Human
ucaaagucucugcuucuguaac

SEQ ID NO: 359831 - RNA, 22 nt, Human
cugaagcaaaggaucgagcuaa

SEQ ID NO: 359832 - RNA, 22 nt, Human
ucauuuguacuugugugcuugu

SEQ ID NO: 359833 - RNA, 22 nt, Human
gccagagguaucaaagauagua

SEQ ID NO: 359834 - RNA, 22 nt, Human
gccaccagggggcuccagugag

SEQ ID NO: 359835 - RNA, 22 nt, Human
ucucuucuauuugagacuauuu

SEQ ID NO: 359836 - RNA, 22 nt, Human
aagaggaacugggggcugaguc

SEQ ID NO: 359837 - RNA, 22 nt, Human
uccagggaagagcagaggcuac

SEQ ID NO: 359838 - RNA, 22 nt, Human
caaaggcugccacuguggcugu

SEQ ID NO: 359839 - RNA, 23 nt, Human
ucuugaaaagccuacagcaguuc

SEQ ID NO: 359840 - RNA, 22 nt, Human
ugggcagggagcuggaaccaca

SEQ ID NO: 359841 - RNA, 22 nt, Human
auaguuugugaaacacagcagu

SEQ ID NO: 359842 - RNA, 22 nt, Human
gucucccaaccccugugcccag

SEQ ID NO: 359843 - RNA, 22 nt, Human
gugcaggggccuccccuugcug

SEQ ID NO: 359844 - RNA, 22 nt, Human
uuuuaaguuaauauaauugagg

SEQ ID NO: 359845 - RNA, 22 nt, Human
caggcauggugagaacucagcc

SEQ ID NO: 359846 - RNA, 22 nt, Human
aggauuuacuagcaaggauucu

SEQ ID NO: 359847 - RNA, 22 nt, Human
ccugucucuuucaaucugagag

SEQ ID NO: 359848 - RNA, 22 nt, Human
ucagaacagaagaaggaacacg

SEQ ID NO: 359849 - RNA, 17 nt, Human
cuuuuaauuuacuuccc

SEQ ID NO: 359850 - RNA, 19 nt, Human
guggccucggagcgcgcgg

SEQ ID NO: 359851 - RNA, 20 nt, Human
aggcacuggauuucuuauau

SEQ ID NO: 359852 - RNA, 22 nt, Human
agaagccaauccuugucucucu

SEQ ID NO: 359853 - RNA, 22 nt, Human
uacagaagcugagacacugaga

SEQ ID NO: 359854 - RNA, 22 nt, Human
cagcuggccccacaguagaggc

SEQ ID NO: 359855 - RNA, 22 nt, Human
ggagccagggaagcugcuuccu

SEQ ID NO: 359856 - RNA, 22 nt, Human
aaagcucacaguaauacaaggc

SEQ ID NO: 359857 - RNA, 22 nt, Human
uccagagcagguggucagaagg

SEQ ID NO: 359858 - RNA, 22 nt, Human
gggcucuguccauuccuucaua

SEQ ID NO: 359859 - RNA, 22 nt, Human
auaugaaaauguuuuagcugua

SEQ ID NO: 359860 - RNA, 22 nt, Human
caggcagcugaggacuuugcua

SEQ ID NO: 359861 - RNA, 22 nt, Human
uaccugcagcgggaauccauua

SEQ ID NO: 359862 - RNA, 22 nt, Human
ggcagcugcaaaucugcucugu

SEQ ID NO: 359863 - RNA, 22 nt, Human
cuggguaaguuccuaaggcuca

SEQ ID NO: 359864 - RNA, 21 nt, Human
aggugccaaggagaagcaggc

SEQ ID NO: 359865 - RNA, 22 nt, Human
ggccugugagcccuugcaugua

SEQ ID NO: 359866 - RNA, 22 nt, Human
uucaagucaaggaaagaggucu

SEQ ID NO: 359867 - RNA, 22 nt, Human
cagccaggagcucccccugcuc

SEQ ID NO: 359868 - RNA, 22 nt, Human
agggagaaaauuggaugcacaa

SEQ ID NO: 359869 - RNA, 22 nt, Human
ucuggcuccaggaccgggcaca

SEQ ID NO: 359870 - RNA, 22 nt, Human
cauggcuuguaauaaauuuaua

SEQ ID NO: 359871 - RNA, 22 nt, Human
cccaggucugccagccuguggg

SEQ ID NO: 359872 - RNA, 22 nt, Human
uccuccucuaucagacagugcc

SEQ ID NO: 359873 - RNA, 22 nt, Human
uucuuucccuuccagcagcucc

SEQ ID NO: 359874 - RNA, 22 nt, Human
agcuguggaguaggggguugga

SEQ ID NO: 359875 - RNA, 22 nt, Human
uccagcuuugagauuuuaugga

SEQ ID NO: 359876 - RNA, 22 nt, Human
acagaugauuuuuaugaaaaca

SEQ ID NO: 359877 - RNA, 20 nt, Human
gcugccagugccugaugcuu

SEQ ID NO: 359878 - RNA, 22 nt, Human
ugcugcucaaugagaugccauc

SEQ ID NO: 359879 - RNA, 20 nt, Human
agaggaggauuauuuuauuc

SEQ ID NO: 359880 - RNA, 22 nt, Human
agaaaugggccuugggacacaa

SEQ ID NO: 359881 - RNA, 22 nt, Human
uguuuucauuugauguaacaaa

SEQ ID NO: 359882 - RNA, 22 nt, Human
ggucuuccgagaggccugugcu

SEQ ID NO: 359883 - RNA, 21 nt, Human
uccuuccuugagguccuuucc

SEQ ID NO: 359884 - RNA, 22 nt, Human
caggcacuggccagucagcaca

SEQ ID NO: 359885 - RNA, 19 nt, Human
ucucagagcccuagaggcc

SEQ ID NO: 359886 - RNA, 22 nt, Human
ucuucuuccuccacagggccca

SEQ ID NO: 359887 - RNA, 22 nt, Human
uuuucaguuccaucucugcucu

SEQ ID NO: 359888 - RNA, 22 nt, Human
auaucagaaauaguaagcagag

SEQ ID NO: 359889 - RNA, 22 nt, Human
augcacaagaggcuagaaaaga

SEQ ID NO: 359890 - RNA, 22 nt, Human
cauuucacaaauggccacauca

SEQ ID NO: 359891 - RNA, 22 nt, Human
gcaggaguguauuugcauguaa

SEQ ID NO: 359892 - RNA, 23 nt, Human
cauuucugggagauuuauaaaau

SEQ ID NO: 359893 - RNA, 22 nt, Human
ucugcaggaaaaaagugccugg

SEQ ID NO: 359894 - RNA, 22 nt, Human
caguguuccaggcggcagugaa

SEQ ID NO: 359895 - RNA, 22 nt, Human
gaggccuggcugggaggaggug

SEQ ID NO: 359896 - RNA, 22 nt, Human
ugccagugggugugcagagacu

SEQ ID NO: 359897 - RNA, 22 nt, Human
ucuguccucuuugaagcugcuc

SEQ ID NO: 359898 - RNA, 22 nt, Human
gggugcugacuggggccugaaa

SEQ ID NO: 359899 - RNA, 22 nt, Human
aagacaauuugauacuaguugc

SEQ ID NO: 359900 - RNA, 22 nt, Human
cuucuucacacuggucugaagc

SEQ ID NO: 359901 - RNA, 22 nt, Human
gccuaggagacaagcgugaaag

SEQ ID NO: 359902 - RNA, 22 nt, Human
uauggcuuuucauuccuaugug

SEQ ID NO: 359903 - RNA, 22 nt, Human
ugcagggaaagggcacugggcu

SEQ ID NO: 359904 - RNA, 22 nt, Human
ucagagaguccuggucauuugc

SEQ ID NO: 359905 - RNA, 22 nt, Human
auuugucuagugguauucacgu

SEQ ID NO: 359906 - RNA, 22 nt, Human
ggcugcugguagggguaggaag

SEQ ID NO: 359907 - RNA, 22 nt, Human
cuggugagacgguugacaggag

SEQ ID NO: 359908 - RNA, 22 nt, Human
ugggcagacauugaguuuguuc

SEQ ID NO: 359909 - RNA, 22 nt, Human
auaaggcagaaauagggaaagu

SEQ ID NO: 359910 - RNA, 22 nt, Human
uccaagggcagccauagaacuu

SEQ ID NO: 359911 - RNA, 22 nt, Human
gagccagcgccuugccucuggg

SEQ ID NO: 359912 - RNA, 22 nt, Human
auuauucaacacuugagaaauu

SEQ ID NO: 359913 - RNA, 21 nt, Human
agguggggcugcaccucugcu

SEQ ID NO: 359914 - RNA, 22 nt, Human
auguguuuguaccuuuaaauau

SEQ ID NO: 359915 - RNA, 22 nt, Human
ccagcuggugggucuuucucug

SEQ ID NO: 359916 - RNA, 22 nt, Human
cccagcucaucaggagccgccc

SEQ ID NO: 359917 - RNA, 22 nt, Human
uagaagcaguaauagaaauagg

SEQ ID NO: 359918 - RNA, 22 nt, Human
ugucccauggauaccaggcuau

SEQ ID NO: 359919 - RNA, 22 nt, Human
gucaggauuauaauccccaugg

SEQ ID NO: 359920 - RNA, 22 nt, Human
uuucagacaggacuucauaugu

SEQ ID NO: 359921 - RNA, 22 nt, Human
gugagcagaacagguggcuucu

SEQ ID NO: 359922 - RNA, 22 nt, Human
uucauugucucuguuugccuuc

SEQ ID NO: 359923 - RNA, 22 nt, Human
gcccggcagucacacacccagg

SEQ ID NO: 359924 - RNA, 22 nt, Human
uccaggaggaggaaggcugcca

SEQ ID NO: 359925 - RNA, 22 nt, Human
ugcugccaaaugcgagcucugu

SEQ ID NO: 359926 - RNA, 22 nt, Human
uaaagguaugucuuaaucaaac

SEQ ID NO: 359927 - RNA, 22 nt, Human
acagaacuuccugcuggagugg

SEQ ID NO: 359928 - RNA, 22 nt, Human
acaauuccacauggcaugcagg

SEQ ID NO: 359929 - RNA, 19 nt, Human
uggaccugugcccauggcu

SEQ ID NO: 359930 - RNA, 22 nt, Human
acauuuaaugauccuacuguga

SEQ ID NO: 359931 - RNA, 22 nt, Human
agguauagaauugaaaggguuu

SEQ ID NO: 359932 - RNA, 22 nt, Human
gcagagcugggucuguauccaa

SEQ ID NO: 359933 - RNA, 22 nt, Human
cccagccuuugcuuccugguuc

SEQ ID NO: 359934 - RNA, 22 nt, Human
aaaguucagugccuucuauaca

SEQ ID NO: 359935 - RNA, 19 nt, Human
agaaucaggucaggugaca

SEQ ID NO: 359936 - RNA, 17 nt, Human
agugacuuggaaagagc

SEQ ID NO: 359937 - RNA, 22 nt, Human
agucuucagagaaauuaacucu

SEQ ID NO: 359938 - RNA, 22 nt, Human
agaguggggaagguguugagaa

SEQ ID NO: 359939 - RNA, 22 nt, Human
aaaguguugggauuacaggugu

SEQ ID NO: 359940 - RNA, 22 nt, Human
uuucugcugugcuuucuugcgu

SEQ ID NO: 359941 - RNA, 22 nt, Human
caacaguguugcaaucugaaaa

SEQ ID NO: 359942 - RNA, 23 nt, Human
guaaaauacgcagugcaguguga

SEQ ID NO: 359943 - RNA, 22 nt, Human
gcuggccaguguggugaccacc

SEQ ID NO: 359944 - RNA, 22 nt, Human
ugacccugcuucuuggugcagg

SEQ ID NO: 359945 - RNA, 22 nt, Human
gcuggccauucucuuugagaug

SEQ ID NO: 359946 - RNA, 22 nt, Human
cagcugggagcuccauuagaua

SEQ ID NO: 359947 - RNA, 22 nt, Human
gcuggagauaguaggauccaua

SEQ ID NO: 359948 - RNA, 22 nt, Human
agcagcuggggccugugacgau

SEQ ID NO: 359949 - RNA, 22 nt, Human
aagagggaggugcgggugcaga

SEQ ID NO: 359950 - RNA, 22 nt, Human
gcaaaugcuaaaguguagagac

SEQ ID NO: 359951 - RNA, 20 nt, Human
aaaaucucccagaaacuuau

SEQ ID NO: 359952 - RNA, 22 nt, Human
guggccugccagcagauggcgc

SEQ ID NO: 359953 - RNA, 22 nt, Human
aaauguguuugauaggaauauu

SEQ ID NO: 359954 - RNA, 22 nt, Human
acagauuuuauuauucagguau

SEQ ID NO: 359955 - RNA, 22 nt, Human
gagaagcagguuuagcagacaa

SEQ ID NO: 359956 - RNA, 22 nt, Human
ugcuauaagaauuauauuacuc

SEQ ID NO: 359957 - RNA, 22 nt, Human
cuggcuccauccuugagcucug

SEQ ID NO: 359958 - RNA, 22 nt, Human
uccuucagaaaaccucagucuu

SEQ ID NO: 359959 - RNA, 22 nt, Human
aggagcugacuuguaaagcauu

SEQ ID NO: 359960 - RNA, 22 nt, Human
ggcuuuauuugcagccauuguu

SEQ ID NO: 359961 - RNA, 22 nt, Human
gugauuucaaauauagagugag

SEQ ID NO: 359962 - RNA, 22 nt, Human
agauuucagaugcucggcaguu

SEQ ID NO: 359963 - RNA, 22 nt, Human
augccagucaaagaagaugaca

SEQ ID NO: 359964 - RNA, 22 nt, Human
cagacacagcaauucuguguug

SEQ ID NO: 359965 - RNA, 22 nt, Human
aggagaaggaggccccucacac

SEQ ID NO: 359966 - RNA, 22 nt, Human
aguaaacauagaauguucuucc

SEQ ID NO: 359967 - RNA, 18 nt, Human
acaggccucaguccugca

SEQ ID NO: 359968 - RNA, 22 nt, Human
ggcagcacgacaggaguggaag

SEQ ID NO: 359969 - RNA, 19 nt, Human
ugucuuaauuaacucagag

SEQ ID NO: 359970 - RNA, 22 nt, Human
augcuuuaaacuauaaauccac

SEQ ID NO: 359971 - RNA, 20 nt, Human
gcccuggagccuuguccugg

SEQ ID NO: 359972 - RNA, 22 nt, Human
agggcagagaaauguaguugag

SEQ ID NO: 359973 - RNA, 22 nt, Human
uguguuccugccuggcucuggu

SEQ ID NO: 359974 - RNA, 22 nt, Human
cugagggccuuggcuccugccc

SEQ ID NO: 359975 - RNA, 22 nt, Human
gccugggagggcagcagugugg

SEQ ID NO: 359976 - RNA, 22 nt, Human
caaguccaucagauaagcaaga

SEQ ID NO: 359977 - RNA, 22 nt, Human
gaaauauuacaguggaggggau

SEQ ID NO: 359978 - RNA, 19 nt, Human
aauguaguguuaugucaac

SEQ ID NO: 359979 - RNA, 22 nt, Human
guacuucccugggaggcaagca

SEQ ID NO: 359980 - RNA, 22 nt, Human
caaugaaagcaacugccuauaa

SEQ ID NO: 359981 - RNA, 22 nt, Human
accugcagguguuuccacacuu

SEQ ID NO: 359982 - RNA, 22 nt, Human
ucuucucucauguaggagggaa

SEQ ID NO: 359983 - RNA, 18 nt, Human
guucaaggucaagagaga

SEQ ID NO: 359984 - RNA, 22 nt, Human
ccuucccuaaagcgucgcuuag

SEQ ID NO: 359985 - RNA, 22 nt, Human
uagcagaaacuguuacagaagg

SEQ ID NO: 359986 - RNA, 22 nt, Human
ggaggccacgguuuagcaccga

SEQ ID NO: 359987 - RNA, 22 nt, Human
aggcaaaauuacaaaguuauua

SEQ ID NO: 359988 - RNA, 22 nt, Human
ucacagaacaauguuuaguucu

SEQ ID NO: 359989 - RNA, 22 nt, Human
agggccaccagagcagggcagu

SEQ ID NO: 359990 - RNA, 22 nt, Human
uaaauguguaaaccuccauuac

SEQ ID NO: 359991 - RNA, 22 nt, Human
gaggagaggggcucccaagagc

SEQ ID NO: 359992 - RNA, 22 nt, Human
gcucugaggcugggagcacucu

SEQ ID NO: 359993 - RNA, 18 nt, Human
ggcagcaagaagggaggg

SEQ ID NO: 359994 - RNA, 22 nt, Human
aaacugcugguugcuggccagc

SEQ ID NO: 359995 - RNA, 22 nt, Human
auaucaguaucuauguauuugu

SEQ ID NO: 359996 - RNA, 22 nt, Human
aaauuguugaucuacaguaagg

SEQ ID NO: 359997 - RNA, 22 nt, Human
ccugcccuagagaugacacaau

SEQ ID NO: 359998 - RNA, 22 nt, Human
acuguguggaaauuugugaggg

SEQ ID NO: 359999 - RNA, 22 nt, Human
gcugcccaggagagguggggcu

SEQ ID NO: 360000 - RNA, 21 nt, Human
cagaggcaggcucugugugug

SEQ ID NO: 360001 - RNA, 19 nt, Human
ugggaguggggaagguccu

SEQ ID NO: 360002 - RNA, 22 nt, Human
aagccagggauuccugagggag

SEQ ID NO: 360003 - RNA, 22 nt, Human
uugugaaauguuucaaaauagu

SEQ ID NO: 360004 - RNA, 22 nt, Human
ucagugcuucggcgagcaccua

SEQ ID NO: 360005 - RNA, 22 nt, Human
caggcuugggagcagagccacu

SEQ ID NO: 360006 - RNA, 22 nt, Human
ugcuggggucauggggcgcccg

SEQ ID NO: 360007 - RNA, 22 nt, Human
cagagcugcucaugguggccag

SEQ ID NO: 360008 - RNA, 22 nt, Human
acugcuuuucagagucugccug

SEQ ID NO: 360009 - RNA, 22 nt, Human
acagagcuuaauucaggagcuu

SEQ ID NO: 360010 - RNA, 22 nt, Human
aauuccagcuaggaaaagcuuc

SEQ ID NO: 360011 - RNA, 18 nt, Human
ggagagugacagagucgu

SEQ ID NO: 360012 - RNA, 22 nt, Human
ucaguaaaguucuuucuugcug

SEQ ID NO: 360013 - RNA, 22 nt, Human
gccuuuuuuguugcucugucac

SEQ ID NO: 360014 - RNA, 22 nt, Human
cagggcugaaaucaagguguag

SEQ ID NO: 360015 - RNA, 22 nt, Human
ugaccuauuagauuuccuugcc

SEQ ID NO: 360016 - RNA, 22 nt, Human
uugcaggaaacugagugugagc

SEQ ID NO: 360017 - RNA, 22 nt, Human
ugggcugcggauaggccucgga

SEQ ID NO: 360018 - RNA, 22 nt, Human
ugguccugccccgugcacagag

SEQ ID NO: 360019 - RNA, 22 nt, Human
ccucugaggucauggacuuggc

SEQ ID NO: 360020 - RNA, 22 nt, Human
uuugaaaggagcuuuauccaga

SEQ ID NO: 360021 - RNA, 22 nt, Human
acaaaugucuccucuuuuguua

SEQ ID NO: 360022 - RNA, 22 nt, Human
ucacaggaaccaucagagaaau

SEQ ID NO: 360023 - RNA, 22 nt, Human
cagcagcuuugccaagucagcc

SEQ ID NO: 360024 - RNA, 22 nt, Human
cugggacacccaaggaaagagc

SEQ ID NO: 360025 - RNA, 22 nt, Human
aucagcaaggcaaucacugcag

SEQ ID NO: 360026 - RNA, 22 nt, Human
agagccaggaugucuucugggg

SEQ ID NO: 360027 - RNA, 22 nt, Human
aagaacagguucuagaaccauu

SEQ ID NO: 360028 - RNA, 22 nt, Human
gacaauaaaaugaucuuacagu

SEQ ID NO: 360029 - RNA, 22 nt, Human
cagagccuaaaacgacuccacu

SEQ ID NO: 360030 - RNA, 22 nt, Human
uugacagcaaagauugugccua

SEQ ID NO: 360031 - RNA, 22 nt, Human
uaauacuuuugccuuguauuca

SEQ ID NO: 360032 - RNA, 22 nt, Human
caaguccucgcuucuagcugug

SEQ ID NO: 360033 - RNA, 22 nt, Human
ucacagaaggcaucacagaaga

SEQ ID NO: 360034 - RNA, 22 nt, Human
agcuggagcuucaagcagguaa

SEQ ID NO: 360035 - RNA, 22 nt, Human
gagggaugguaguugacacuga

SEQ ID NO: 360036 - RNA, 22 nt, Human
gaggcacaguguuuggucagug

SEQ ID NO: 360037 - RNA, 22 nt, Human
uggcugcugcuuggucuucuuc

SEQ ID NO: 360038 - RNA, 21 nt, Human
augucaaaugcuuuauuuuau

SEQ ID NO: 360039 - RNA, 22 nt, Human
aggcagagcugauguucuguga

SEQ ID NO: 360040 - RNA, 22 nt, Human
auucuucacuguuucagaauga

SEQ ID NO: 360041 - RNA, 22 nt, Human
acgagagguccuuagaaucugu

SEQ ID NO: 360042 - RNA, 22 nt, Human
gggagggaaagcuugaucuguc

SEQ ID NO: 360043 - RNA, 22 nt, Human
cagagcugguguuacaagucca

SEQ ID NO: 360044 - RNA, 22 nt, Human
uucauguguauggaacauuuuu

SEQ ID NO: 360045 - RNA, 22 nt, Human
uuugacagauccuuaacucagc

SEQ ID NO: 360046 - RNA, 22 nt, Human
auaugauuccacuauuguaugg

SEQ ID NO: 360047 - RNA, 22 nt, Human
uaugaagacaaugauagcauga

SEQ ID NO: 360048 - RNA, 21 nt, Human
uuucuucacuuugccccaugu

SEQ ID NO: 360049 - RNA, 22 nt, Human
auacagaagaacuauagccacu

SEQ ID NO: 360050 - RNA, 22 nt, Human
uggcaaggccacaggugcaguu

SEQ ID NO: 360051 - RNA, 22 nt, Human
ugaagaagccaauugguaggcu

SEQ ID NO: 360052 - RNA, 22 nt, Human
auguggaggaaaugaguguaca

SEQ ID NO: 360053 - RNA, 22 nt, Human
agggccugggauguccuccuag

SEQ ID NO: 360054 - RNA, 22 nt, Human
aaguccauucuuccagccagcu

SEQ ID NO: 360055 - RNA, 22 nt, Human
agcgagggaggucugaggacag

SEQ ID NO: 360056 - RNA, 22 nt, Human
ccuggccacucagguguggggc

SEQ ID NO: 360057 - RNA, 22 nt, Human
cagcuacuccucccaugacuuc

SEQ ID NO: 360058 - RNA, 22 nt, Human
uucuacagacuauaacugugau

SEQ ID NO: 360059 - RNA, 22 nt, Human
gguuggaggugggaauagcuag

SEQ ID NO: 360060 - RNA, 22 nt, Human
ggcucccaggagggccuggagg

SEQ ID NO: 360061 - RNA, 22 nt, Human
acccaggagcucugggguccuc

SEQ ID NO: 360062 - RNA, 22 nt, Human
acuacuuugggccauuuguuua

SEQ ID NO: 360063 - RNA, 22 nt, Human
uucuucuuuaucucaguauccu

SEQ ID NO: 360064 - RNA, 22 nt, Human
ggcucuggaaaguguccuugau

SEQ ID NO: 360065 - RNA, 22 nt, Human
aaaucucacuguagucaaagug

SEQ ID NO: 360066 - RNA, 22 nt, Human
ucacaaauauuuuaacaguagg

SEQ ID NO: 360067 - RNA, 22 nt, Human
uaauccaggguauucuaguuuc

SEQ ID NO: 360068 - RNA, 22 nt, Human
ccuguguggaaaccgcaugacg

SEQ ID NO: 360069 - RNA, 22 nt, Human
agccagcaugaagacagaggcc

SEQ ID NO: 360070 - RNA, 22 nt, Human
aagggcucugggcuacgcacug

SEQ ID NO: 360071 - RNA, 22 nt, Human
gggcugaaaggccgccucagau

SEQ ID NO: 360072 - RNA, 22 nt, Human
aggcacuggguaauuaguagcu

SEQ ID NO: 360073 - RNA, 22 nt, Human
ucucagaguuuacggggcugaa

SEQ ID NO: 360074 - RNA, 22 nt, Human
agacaggacacaagcugcauaa

SEQ ID NO: 360075 - RNA, 22 nt, Human
ccuuccaggagucucugcaggu

SEQ ID NO: 360076 - RNA, 22 nt, Human
ucuguucacugagcaauggcaa

SEQ ID NO: 360077 - RNA, 22 nt, Human
agacucaagcagauaggaauua

SEQ ID NO: 360078 - RNA, 22 nt, Human
ucaaaugcacguagagaaaaua

SEQ ID NO: 360079 - RNA, 22 nt, Human
uggcugagaaugggaugaugcc

SEQ ID NO: 360080 - RNA, 22 nt, Human
guuuggggucugcagagcggcg

SEQ ID NO: 360081 - RNA, 22 nt, Human
agucaguuaaccucacagcauc

SEQ ID NO: 360082 - RNA, 22 nt, Human
ugcugccacauuuaaagagggg

SEQ ID NO: 360083 - RNA, 22 nt, Human
uggguagagcaggcuggggcuu

SEQ ID NO: 360084 - RNA, 22 nt, Human
aagauuuagggccaguuuacau

SEQ ID NO: 360085 - RNA, 22 nt, Human
ggcauuuauuugucucauucuu

SEQ ID NO: 360086 - RNA, 22 nt, Human
auccuugagaaaauaaaugacc

SEQ ID NO: 360087 - RNA, 22 nt, Human
auggagggugguaagacagaga

SEQ ID NO: 360088 - RNA, 22 nt, Human
ccagggugggguccaggaacca

SEQ ID NO: 360089 - RNA, 22 nt, Human
uccaugccaggcagucgaugca

SEQ ID NO: 360090 - RNA, 22 nt, Human
gaccagagaaaggcacuggaag

SEQ ID NO: 360091 - RNA, 22 nt, Human
cugucccagauguucucagcac

SEQ ID NO: 360092 - RNA, 22 nt, Human
gaggaagccccauugaagccag

SEQ ID NO: 360093 - RNA, 22 nt, Human
gaggaguguauuccacaccacu

SEQ ID NO: 360094 - RNA, 22 nt, Human
guacaauagucccuguuuggau

SEQ ID NO: 360095 - RNA, 18 nt, Human
cagggcuguggggucacu

SEQ ID NO: 360096 - RNA, 21 nt, Human
agacagaacaacugcucucca

SEQ ID NO: 360097 - RNA, 22 nt, Human
uucuuuccccauggaguucgga

SEQ ID NO: 360098 - RNA, 22 nt, Human
cuacacaguucugccuaauggc

SEQ ID NO: 360099 - RNA, 22 nt, Human
gcugcccauuccacuggauggu

SEQ ID NO: 360100 - RNA, 22 nt, Human
cugagagucagcuucuccuccu

SEQ ID NO: 360101 - RNA, 21 nt, Human
cauuucuauugaugagaaaag

SEQ ID NO: 360102 - RNA, 22 nt, Human
guggggcaugcacgcugcuccu

SEQ ID NO: 360103 - RNA, 22 nt, Human
cgaggcagggaagcugcaaaag

SEQ ID NO: 360104 - RNA, 22 nt, Human
uuccaggaggcacugacagagg

SEQ ID NO: 360105 - RNA, 22 nt, Human
gcucugagauugagccuuuggu

SEQ ID NO: 360106 - RNA, 22 nt, Human
caggcagaguuagagcaacugg

SEQ ID NO: 360107 - RNA, 22 nt, Human
uccagaaacuuuuccagucuca

SEQ ID NO: 360108 - RNA, 22 nt, Human
cugcugcaggaugggcacucug

SEQ ID NO: 360109 - RNA, 17 nt, Human
gcacugaacaauccugu

SEQ ID NO: 360110 - RNA, 22 nt, Human
aucauucuauuguugagcugcc

SEQ ID NO: 360111 - RNA, 22 nt, Human
caauuuuuaaacuaugaaguug

SEQ ID NO: 360112 - RNA, 22 nt, Human
gcagagcaguacucucuugacu

SEQ ID NO: 360113 - RNA, 22 nt, Human
gaagcagcgaaguggaagggac

SEQ ID NO: 360114 - RNA, 22 nt, Human
ccuugcugaccaucaccuuuga

SEQ ID NO: 360115 - RNA, 22 nt, Human
cccauuuaaacacaagcuuuca

SEQ ID NO: 360116 - RNA, 22 nt, Human
agugaaauaugcccauugcugu

SEQ ID NO: 360117 - RNA, 22 nt, Human
acuagaaauuacucagaauaaa

SEQ ID NO: 360118 - RNA, 22 nt, Human
aaggcaggaugggaaaagauuu

SEQ ID NO: 360119 - RNA, 22 nt, Human
uccaugagggacacuggaugcu

SEQ ID NO: 360120 - RNA, 22 nt, Human
cacccagcacagagggaggcga

SEQ ID NO: 360121 - RNA, 18 nt, Human
uuuuacucauagcaggcc

SEQ ID NO: 360122 - RNA, 22 nt, Human
cagggcucaccacugggauccu

SEQ ID NO: 360123 - RNA, 22 nt, Human
gcuggaucccugugggaguggu

SEQ ID NO: 360124 - RNA, 22 nt, Human
caugcuuauucauucugcuaac

SEQ ID NO: 360125 - RNA, 21 nt, Human
cagggcacacagaggauggua

SEQ ID NO: 360126 - RNA, 22 nt, Human
cucuucuugaaagaggaauuca

SEQ ID NO: 360127 - RNA, 22 nt, Human
augugcaaauccaaugugaaug

SEQ ID NO: 360128 - RNA, 22 nt, Human
ggcacugaauuucuuggcaucu

SEQ ID NO: 360129 - RNA, 22 nt, Human
cccuuucccuucuggcucaggg

SEQ ID NO: 360130 - RNA, 22 nt, Human
cauguacaguuuuucuguccug

SEQ ID NO: 360131 - RNA, 22 nt, Human
ugccucugugugcaggugagca

SEQ ID NO: 360132 - RNA, 22 nt, Human
auuuuccagccuuucuagaacu

SEQ ID NO: 360133 - RNA, 20 nt, Human
caucagugccugacaggucc

SEQ ID NO: 360134 - RNA, 22 nt, Human
ccagggucuuggagaggagugc

SEQ ID NO: 360135 - RNA, 22 nt, Human
uucaggauucugugucugacaa

SEQ ID NO: 360136 - RNA, 22 nt, Human
ugucuguacaaauuuucugugu

SEQ ID NO: 360137 - RNA, 22 nt, Human
aggcugagcuggcccuugaaau

SEQ ID NO: 360138 - RNA, 22 nt, Human
gcagggugugucucauacaguu

SEQ ID NO: 360139 - RNA, 22 nt, Human
caggggcucccugggugccagu

SEQ ID NO: 360140 - RNA, 22 nt, Human
acagaggccgccucucucacgg

SEQ ID NO: 360141 - RNA, 22 nt, Human
gggagcuguaguccagauaccg

SEQ ID NO: 360142 - RNA, 21 nt, Human
gccauuguuuucuaccuggag

SEQ ID NO: 360143 - RNA, 20 nt, Human
uccagcugucuuucagagac

SEQ ID NO: 360144 - RNA, 22 nt, Human
cagcugcuuuaguuuuccaucc

SEQ ID NO: 360145 - RNA, 22 nt, Human
guccucuguagggcugggccac

SEQ ID NO: 360146 - RNA, 22 nt, Human
cagcaguggaacuacccaggga

SEQ ID NO: 360147 - RNA, 22 nt, Human
ugcagggcuacaggacuacaac

SEQ ID NO: 360148 - RNA, 22 nt, Human
agcagcaucuucuguucuccgc

SEQ ID NO: 360149 - RNA, 22 nt, Human
gccagcagggcccaaaugcugg

SEQ ID NO: 360150 - RNA, 19 nt, Human
aucugccuuagugcugcug

SEQ ID NO: 360151 - RNA, 20 nt, Human
cccucugcuacacugggagc

SEQ ID NO: 360152 - RNA, 22 nt, Human
uuauacaguuuauacuuagaau

SEQ ID NO: 360153 - RNA, 22 nt, Human
aaauacugggcucaaaaggguu

SEQ ID NO: 360154 - RNA, 22 nt, Human
guuuauuauacaacaaaagcua

SEQ ID NO: 360155 - RNA, 22 nt, Human
ggcagcucugcuccacaugagu

SEQ ID NO: 360156 - RNA, 22 nt, Human
cagagcggccacuagagggcgc

SEQ ID NO: 360157 - RNA, 22 nt, Human
uuaucguacgcuucagaaauuu

SEQ ID NO: 360158 - RNA, 22 nt, Human
ucuucuccagugcuucugcaca

SEQ ID NO: 360159 - RNA, 22 nt, Human
ggagaagcaggugcuuuggguc

SEQ ID NO: 360160 - RNA, 17 nt, Human
uugaacugcugagucag

SEQ ID NO: 360161 - RNA, 21 nt, Human
ggcagcguguggacaggaagg

SEQ ID NO: 360162 - RNA, 22 nt, Human
ugugcccauuacacagaggcau

SEQ ID NO: 360163 - RNA, 22 nt, Human
uggcagcagggaggccaguguu

SEQ ID NO: 360164 - RNA, 22 nt, Human
gaugcacuuucuuuucaacagu

SEQ ID NO: 360165 - RNA, 18 nt, Human
ggcaucugcacagcagcc

SEQ ID NO: 360166 - RNA, 22 nt, Human
gcuccuggcuccaggcagccaa

SEQ ID NO: 360167 - RNA, 22 nt, Human
ugcuuauugcuuucaagacugu

SEQ ID NO: 360168 - RNA, 22 nt, Human
cagcagcugcgugcccaggccg

SEQ ID NO: 360169 - RNA, 22 nt, Human
gucucagauaacauguauucua

SEQ ID NO: 360170 - RNA, 22 nt, Human
auucuuaauugccaugcuguau

SEQ ID NO: 360171 - RNA, 22 nt, Human
cugggcagcuguaucagggagu

SEQ ID NO: 360172 - RNA, 22 nt, Human
ucauuuaauaauuuuugaguag

SEQ ID NO: 360173 - RNA, 22 nt, Human
uugaagagugccuuccagacau

SEQ ID NO: 360174 - RNA, 22 nt, Human
uaucuguuaugggcugaauugc

SEQ ID NO: 360175 - RNA, 22 nt, Human
caggggcugagaaggaacgucc

SEQ ID NO: 360176 - RNA, 22 nt, Human
auaaagucuaccguauuaaaga

SEQ ID NO: 360177 - RNA, 22 nt, Human
acugcaggagacacagcugcug

SEQ ID NO: 360178 - RNA, 22 nt, Human
uugaagcaaauucugugcagua

SEQ ID NO: 360179 - RNA, 19 nt, Human
gguguccuagagauaagag

SEQ ID NO: 360180 - RNA, 22 nt, Human
ccagcugcagguguuccagaug

SEQ ID NO: 360181 - RNA, 22 nt, Human
ugcauuuccagauuucuggagu

SEQ ID NO: 360182 - RNA, 22 nt, Human
cugcagcuuuggaaaccuguuu

SEQ ID NO: 360183 - RNA, 22 nt, Human
uagcugccuaugugauaagaga

SEQ ID NO: 360184 - RNA, 22 nt, Human
ugcagucuuccagcugcacaaa

SEQ ID NO: 360185 - RNA, 18 nt, Human
gggcauggaugcagcauc

SEQ ID NO: 360186 - RNA, 22 nt, Human
gcugucucggggcuuucuccug

SEQ ID NO: 360187 - RNA, 22 nt, Human
uggggcuggcacagucucuauu

SEQ ID NO: 360188 - RNA, 22 nt, Human
aaagccagcucugagcugcacc

SEQ ID NO: 360189 - RNA, 22 nt, Human
uugaaauaucaaguuauuagug

SEQ ID NO: 360190 - RNA, 22 nt, Human
cuggagggggaaauguucauug

SEQ ID NO: 360191 - RNA, 22 nt, Human
gcugcccagcaggccccagggg

SEQ ID NO: 360192 - RNA, 22 nt, Human
cucuggacacuggcaugggguc

SEQ ID NO: 360193 - RNA, 22 nt, Human
auggccugggcccgcuucagau

SEQ ID NO: 360194 - RNA, 22 nt, Human
caagaaauguuuacugagcauc

SEQ ID NO: 360195 - RNA, 22 nt, Human
aggcagacaaggucccuggucu

SEQ ID NO: 360196 - RNA, 22 nt, Human
gccagaaagaggaggaccuggg

SEQ ID NO: 360197 - RNA, 22 nt, Human
ugaggggaacugaugcccauug

SEQ ID NO: 360198 - RNA, 22 nt, Human
aaugaucuggcucaggauauca

SEQ ID NO: 360199 - RNA, 22 nt, Human
ccagguguaggacaccaaggga

SEQ ID NO: 360200 - RNA, 22 nt, Human
acauucacuauguccaaacucu

SEQ ID NO: 360201 - RNA, 22 nt, Human
guaggcagucucucaggugauc

SEQ ID NO: 360202 - RNA, 22 nt, Human
gaggcuggaggucaaagaugaa

SEQ ID NO: 360203 - RNA, 21 nt, Human
caagccagaccaauagcagcc

SEQ ID NO: 360204 - RNA, 22 nt, Human
agcugcucuugggugacuucaa

SEQ ID NO: 360205 - RNA, 22 nt, Human
cuggagcuaggaaguccaagau

SEQ ID NO: 360206 - RNA, 22 nt, Human
gguuucaacuucaaccucucca

SEQ ID NO: 360207 - RNA, 22 nt, Human
gcagacagacugcagugauuuu

SEQ ID NO: 360208 - RNA, 22 nt, Human
ugaaauaauaucuggaucaauc

SEQ ID NO: 360209 - RNA, 22 nt, Human
gugaauaagaccuaaggaugaa

SEQ ID NO: 360210 - RNA, 22 nt, Human
uugauacuauuaagcacugggc

SEQ ID NO: 360211 - RNA, 22 nt, Human
agcagugggggaguguuaguuu

SEQ ID NO: 360212 - RNA, 22 nt, Human
uggcucaggagggaucuuugcu

SEQ ID NO: 360213 - RNA, 22 nt, Human
cagccuccugggacacucaccg

SEQ ID NO: 360214 - RNA, 21 nt, Human
guauucuuuaugaagugaaaa

SEQ ID NO: 360215 - RNA, 22 nt, Human
ugucaacacaccuaucucaauu

SEQ ID NO: 360216 - RNA, 22 nt, Human
cagagccacuuggagaugagaa

SEQ ID NO: 360217 - RNA, 22 nt, Human
ucugaggcauaaccuguucugc

SEQ ID NO: 360218 - RNA, 22 nt, Human
aggccagcacgacagccgcagg

SEQ ID NO: 360219 - RNA, 22 nt, Human
agaugcugcuccacaggccagg

SEQ ID NO: 360220 - RNA, 22 nt, Human
cuggccucaccucagacuuacu

SEQ ID NO: 360221 - RNA, 22 nt, Human
agccucugauggcucccaagga

SEQ ID NO: 360222 - RNA, 22 nt, Human
ggcugccauaacugauaccaua

SEQ ID NO: 360223 - RNA, 22 nt, Human
acauguuagaaaugcagaaucu

SEQ ID NO: 360224 - RNA, 22 nt, Human
aagccaggaagagagccuucac

SEQ ID NO: 360225 - RNA, 22 nt, Human
ggcagggaguggagacucccua

SEQ ID NO: 360226 - RNA, 22 nt, Human
cugcuuuagacaacugcuggga

SEQ ID NO: 360227 - RNA, 22 nt, Human
ucucugagacaguagccucugc

SEQ ID NO: 360228 - RNA, 22 nt, Human
cucccaggacucagaggagaag

SEQ ID NO: 360229 - RNA, 22 nt, Human
acugucugcccugagaugccag

SEQ ID NO: 360230 - RNA, 22 nt, Human
uggcucagccuggcccuuucau

SEQ ID NO: 360231 - RNA, 22 nt, Human
ucugccuuggcaaccacagcuu

SEQ ID NO: 360232 - RNA, 22 nt, Human
caggagcaaggagcagugggau

SEQ ID NO: 360233 - RNA, 22 nt, Human
aaaguccuguuugaaggaccug

SEQ ID NO: 360234 - RNA, 22 nt, Human
cugccaggcgauggauuggcug

SEQ ID NO: 360235 - RNA, 22 nt, Human
uuucacauuuguuuuaagaagu

SEQ ID NO: 360236 - RNA, 22 nt, Human
gcaggagagucugugccagguu

SEQ ID NO: 360237 - RNA, 22 nt, Human
agagccaggugcugcuguuuga

SEQ ID NO: 360238 - RNA, 22 nt, Human
agggacuugaugucagggagau

SEQ ID NO: 360239 - RNA, 22 nt, Human
aaauuuucagagcacuagagaa

SEQ ID NO: 360240 - RNA, 22 nt, Human
agcucugggccaggaacccuaa

SEQ ID NO: 360241 - RNA, 22 nt, Human
ucuuuaauauaaaggaaugaau

SEQ ID NO: 360242 - RNA, 17 nt, Human
uuauuuuuugggcugag

SEQ ID NO: 360243 - RNA, 22 nt, Human
cuccugggcucaagugauccuc

SEQ ID NO: 360244 - RNA, 22 nt, Human
uuucuucucacccaggacagag

SEQ ID NO: 360245 - RNA, 22 nt, Human
gggcacuguggggcccaugcug

SEQ ID NO: 360246 - RNA, 23 nt, Human
ugagcccaggaggucaaggcugc

SEQ ID NO: 360247 - RNA, 22 nt, Human
uggcuucaucugcagcacugcc

SEQ ID NO: 360248 - RNA, 22 nt, Human
augggcagcugcagcaguggug

SEQ ID NO: 360249 - RNA, 22 nt, Human
cacaauuuccaagucauguuau

SEQ ID NO: 360250 - RNA, 22 nt, Human
ccucauggaccucagacugucc

SEQ ID NO: 360251 - RNA, 22 nt, Human
cuagccaugggcauuaaaggua

SEQ ID NO: 360252 - RNA, 22 nt, Human
acaagagauuaucuacagauga

SEQ ID NO: 360253 - RNA, 21 nt, Human
uucagcaguccucuagagaua

SEQ ID NO: 360254 - RNA, 20 nt, Human
gccaggagggugugaugagc

SEQ ID NO: 360255 - RNA, 22 nt, Human
gcuuuuucaaaugaaagcuggu

SEQ ID NO: 360256 - RNA, 22 nt, Human
agucaaagcuacaggcauuuga

SEQ ID NO: 360257 - RNA, 22 nt, Human
gaaucauuuagcucugcaugga

SEQ ID NO: 360258 - RNA, 22 nt, Human
gaggccuggagccgccuaggcg

SEQ ID NO: 360259 - RNA, 22 nt, Human
gggaggagugaagauucaccug

SEQ ID NO: 360260 - RNA, 22 nt, Human
aaaguucugggggagaagaacg

SEQ ID NO: 360261 - RNA, 22 nt, Human
acucugccccgaguucugggaa

SEQ ID NO: 360262 - RNA, 22 nt, Human
ugacuuccugcacucaggugau

SEQ ID NO: 360263 - RNA, 22 nt, Human
agugcuguccaguuucacaggu

SEQ ID NO: 360264 - RNA, 22 nt, Human
agguaaggcuguaagcuaagcc

SEQ ID NO: 360265 - RNA, 18 nt, Human
ggcagcuugacuagcaac

SEQ ID NO: 360266 - RNA, 22 nt, Human
aaucaguguggugacuugucug

SEQ ID NO: 360267 - RNA, 22 nt, Human
uggagcugggguuugaaucugg

SEQ ID NO: 360268 - RNA, 22 nt, Human
accuuuuuguucuguucucagc

SEQ ID NO: 360269 - RNA, 22 nt, Human
uccauguggccagacacuggca

SEQ ID NO: 360270 - RNA, 21 nt, Human
cagugcucaaucugacagugg

SEQ ID NO: 360271 - RNA, 22 nt, Human
cugagcucuaaugucagccuug

SEQ ID NO: 360272 - RNA, 23 nt, Human
cucccuggaguuucuggaagaug

SEQ ID NO: 360273 - RNA, 22 nt, Human
gcuggcucagggacuagaguuu

SEQ ID NO: 360274 - RNA, 19 nt, Human
uccccagcaccucugaguc

SEQ ID NO: 360275 - RNA, 22 nt, Human
agaagaaaugaggccguucugc

SEQ ID NO: 360276 - RNA, 22 nt, Human
ugcaagcacucaaugcaaacag

SEQ ID NO: 360277 - RNA, 22 nt, Human
gaggcaguuugccaugccagga

SEQ ID NO: 360278 - RNA, 22 nt, Human
aagcugcccaagacugaagcau

SEQ ID NO: 360279 - RNA, 23 nt, Human
ugcaugugaauucauacuuguuu

SEQ ID NO: 360280 - RNA, 22 nt, Human
gcugucacucuccggccuuccc

SEQ ID NO: 360281 - RNA, 22 nt, Human
agcagcauguugggaugugaaa

SEQ ID NO: 360282 - RNA, 22 nt, Human
cauuguuaauugguaucuuaca

SEQ ID NO: 360283 - RNA, 22 nt, Human
aaaugcagguucuugagccaag

SEQ ID NO: 360284 - RNA, 22 nt, Human
gggcugagacgauggggucuuc

SEQ ID NO: 360285 - RNA, 22 nt, Human
uacaaacuuguuuuaaguaagu

SEQ ID NO: 360286 - RNA, 22 nt, Human
agaaagaacgcacuugugcugc

SEQ ID NO: 360287 - RNA, 22 nt, Human
gugggugauguacuggaggcca

SEQ ID NO: 360288 - RNA, 22 nt, Human
auacauguucguguacauguuc

SEQ ID NO: 360289 - RNA, 22 nt, Human
ugggccugacucaccugccucc

SEQ ID NO: 360290 - RNA, 19 nt, Human
ggagaagcaucuagaaaua

SEQ ID NO: 360291 - RNA, 22 nt, Human
ggagcggagggagggccacugu

SEQ ID NO: 360292 - RNA, 22 nt, Human
aagggcuccaagagguagcugg

SEQ ID NO: 360293 - RNA, 22 nt, Human
cagaggguugaugugaggcuua

SEQ ID NO: 360294 - RNA, 22 nt, Human
cauuuguaucauauguaucuua

SEQ ID NO: 360295 - RNA, 22 nt, Human
ucaaaguuuuugagaauuacau

SEQ ID NO: 360296 - RNA, 22 nt, Human
ucaacugcaaguuugcuuaguu

SEQ ID NO: 360297 - RNA, 22 nt, Human
gcccugugccagucacgcugug

SEQ ID NO: 360298 - RNA, 22 nt, Human
cagcugccaugacauguccugc

SEQ ID NO: 360299 - RNA, 22 nt, Human
ggagggacccacucuagaggug

SEQ ID NO: 360300 - RNA, 22 nt, Human
acagaaugcguagugcauguug

SEQ ID NO: 360301 - RNA, 22 nt, Human
guuaggcaauaccucuuacacc

SEQ ID NO: 360302 - RNA, 22 nt, Human
gcagggcagccacaggcccccu

SEQ ID NO: 360303 - RNA, 22 nt, Human
augaauaaacaggugccucuuc

SEQ ID NO: 360304 - RNA, 21 nt, Human
auuauuauuucuguguccagc

SEQ ID NO: 360305 - RNA, 22 nt, Human
agagcccucucauuggcuuauu

SEQ ID NO: 360306 - RNA, 22 nt, Human
uugaacugguaguuggaaaucu

SEQ ID NO: 360307 - RNA, 22 nt, Human
ucugucacuauuggccagaaca

SEQ ID NO: 360308 - RNA, 22 nt, Human
gaaaggcaguacagcugagccu

SEQ ID NO: 360309 - RNA, 22 nt, Human
cagagcaguaaaucuggggcac

SEQ ID NO: 360310 - RNA, 22 nt, Human
cccagggauuauaaaggugaaa

SEQ ID NO: 360311 - RNA, 22 nt, Human
aggaagagcuggaccagaggac

SEQ ID NO: 360312 - RNA, 22 nt, Human
aggcagcuggaaaacuccaggc

SEQ ID NO: 360313 - RNA, 22 nt, Human
aaggcaggagcuguaucuuauu

SEQ ID NO: 360314 - RNA, 22 nt, Human
uauaguaaaauuuucauuuaug

SEQ ID NO: 360315 - RNA, 22 nt, Human
uccuucagauuccugcuucugg

SEQ ID NO: 360316 - RNA, 23 nt, Human
cuuucauugugguuucacagagc

SEQ ID NO: 360317 - RNA, 22 nt, Human
agaggccuccgaaaggugggcu

SEQ ID NO: 360318 - RNA, 22 nt, Human
agcagggcagcuuuuuucagaa

SEQ ID NO: 360319 - RNA, 19 nt, Human
uggccagguacugucugcu

SEQ ID NO: 360320 - RNA, 22 nt, Human
uacaguaagaugaaauagcaau

SEQ ID NO: 360321 - RNA, 22 nt, Human
acugaguguaggacuuugaguu

SEQ ID NO: 360322 - RNA, 22 nt, Human
cagacccugggccacagaggag

SEQ ID NO: 360323 - RNA, 22 nt, Human
uaccuugggcuauuaucuuuga

SEQ ID NO: 360324 - RNA, 22 nt, Human
uaaauuuacccaaggaacaugu

SEQ ID NO: 360325 - RNA, 22 nt, Human
aagagcauauuaauaguggaga

SEQ ID NO: 360326 - RNA, 22 nt, Human
accugccucuaagcagcaggug

SEQ ID NO: 360327 - RNA, 19 nt, Human
uuugaaagaguuuuauugg

SEQ ID NO: 360328 - RNA, 22 nt, Human
agccuggagguaaugaggaaac

SEQ ID NO: 360329 - RNA, 22 nt, Human
guggagaccuccuaggaugugu

SEQ ID NO: 360330 - RNA, 22 nt, Human
aaucuguucuacucuauucaga

SEQ ID NO: 360331 - RNA, 22 nt, Human
ugcuugaaagggguuucccagu

SEQ ID NO: 360332 - RNA, 22 nt, Human
cagcaucccucaggggccucug

SEQ ID NO: 360333 - RNA, 22 nt, Human
cugccgagugggucaugaggca

SEQ ID NO: 360334 - RNA, 22 nt, Human
caaagaugcugauguuggauca

SEQ ID NO: 360335 - RNA, 22 nt, Human
uggagacugugcuaagggaguu

SEQ ID NO: 360336 - RNA, 22 nt, Human
agucucugucguagaucagcgu

SEQ ID NO: 360337 - RNA, 22 nt, Human
uccuggccugucuggaguagcu

SEQ ID NO: 360338 - RNA, 21 nt, Human
ccacauucucauucugacugc

SEQ ID NO: 360339 - RNA, 22 nt, Human
ccacagccauuccagggaggcu

SEQ ID NO: 360340 - RNA, 22 nt, Human
uuuucaucucugcuuuguaccu

SEQ ID NO: 360341 - RNA, 22 nt, Human
gcauucuuuuuaggagguuccu

SEQ ID NO: 360342 - RNA, 22 nt, Human
acuucucuucauagguggcaau

SEQ ID NO: 360343 - RNA, 22 nt, Human
gccaggcauuauuccgaucccu

SEQ ID NO: 360344 - RNA, 17 nt, Human
cgagggcuugcuggcuc

SEQ ID NO: 360345 - RNA, 20 nt, Human
gggcaguggcgcuaucucag

SEQ ID NO: 360346 - RNA, 21 nt, Human
gcuauacagaauggccagagg

SEQ ID NO: 360347 - RNA, 22 nt, Human
uugugaguagugccgcaauaaa

SEQ ID NO: 360348 - RNA, 22 nt, Human
uugauccaguugaaagugauga

SEQ ID NO: 360349 - RNA, 22 nt, Human
uuacagaaggaacacuacucag

SEQ ID NO: 360350 - RNA, 22 nt, Human
agggaaggagguuagaacccac

SEQ ID NO: 360351 - RNA, 22 nt, Human
ccagcaggagaugccugugucu

SEQ ID NO: 360352 - RNA, 22 nt, Human
cuuccagagauagggccucaag

SEQ ID NO: 360353 - RNA, 22 nt, Human
agugacucacuagcucucagug

SEQ ID NO: 360354 - RNA, 22 nt, Human
uuccuuagcuccucauggccug

SEQ ID NO: 360355 - RNA, 22 nt, Human
agcagggcagcugaugcgcacg

SEQ ID NO: 360356 - RNA, 22 nt, Human
auaauaaaccaggaugggucug

SEQ ID NO: 360357 - RNA, 22 nt, Human
gggcucugguacuuccuggcuc

SEQ ID NO: 360358 - RNA, 19 nt, Human
ggcucucuuaaagcuguuu

SEQ ID NO: 360359 - RNA, 22 nt, Human
ucuuuaaugugauuguaauuau

SEQ ID NO: 360360 - RNA, 22 nt, Human
uucaggauggaguaccuuuuau

SEQ ID NO: 360361 - RNA, 21 nt, Human
ugggcagauggcaguguggcu

SEQ ID NO: 360362 - RNA, 22 nt, Human
aggguccugggugcaguugcuu

SEQ ID NO: 360363 - RNA, 22 nt, Human
cugcccaggaaccagaggggca

SEQ ID NO: 360364 - RNA, 22 nt, Human
ccugagacaugaaccaggcucc

SEQ ID NO: 360365 - RNA, 21 nt, Human
ccauaauuuuguuucagaagu

SEQ ID NO: 360366 - RNA, 22 nt, Human
ucuucacagaugcauauacuuc

SEQ ID NO: 360367 - RNA, 22 nt, Human
gacacagggggauguguggacg

SEQ ID NO: 360368 - RNA, 22 nt, Human
ucugaagaacugaguaaacaug

SEQ ID NO: 360369 - RNA, 22 nt, Human
gaagcagcuuucuggugaggag

SEQ ID NO: 360370 - RNA, 22 nt, Human
acagggcagguggcuacugguc

SEQ ID NO: 360371 - RNA, 22 nt, Human
augcuuuuaugucacaugguca

SEQ ID NO: 360372 - RNA, 22 nt, Human
ucccagagucagagguggggcc

SEQ ID NO: 360373 - RNA, 22 nt, Human
gacagcagggacauguaggaag

SEQ ID NO: 360374 - RNA, 22 nt, Human
gcagaauuuucuguuuucuaga

SEQ ID NO: 360375 - RNA, 22 nt, Human
cugaaggauucaaaauggcagg

SEQ ID NO: 360376 - RNA, 22 nt, Human
cagccagcugaauguaccauga

SEQ ID NO: 360377 - RNA, 22 nt, Human
aguaacaagugccaacguuaga

SEQ ID NO: 360378 - RNA, 22 nt, Human
gggccucugugcagaggggccu

SEQ ID NO: 360379 - RNA, 22 nt, Human
uccaggcuggccucgcgugaca

SEQ ID NO: 360380 - RNA, 22 nt, Human
cagagcagcagagcuuccaugg

SEQ ID NO: 360381 - RNA, 22 nt, Human
gccuucccacccugcgaggcug

SEQ ID NO: 360382 - RNA, 22 nt, Human
aaagccauugaacuguacuuua

SEQ ID NO: 360383 - RNA, 22 nt, Human
uacauguuugguaaaugauggc

SEQ ID NO: 360384 - RNA, 22 nt, Human
uuuaaaaaacuagucugagucu

SEQ ID NO: 360385 - RNA, 22 nt, Human
ugacauaauaauccaaacauac

SEQ ID NO: 360386 - RNA, 22 nt, Human
auggaguucuuuaaauucacag

SEQ ID NO: 360387 - RNA, 22 nt, Human
acugucuguccugcucuccgug

SEQ ID NO: 360388 - RNA, 22 nt, Human
uggaaggggagcuggaaagggg

SEQ ID NO: 360389 - RNA, 22 nt, Human
ugucucaggggcauugaaauaa

SEQ ID NO: 360390 - RNA, 22 nt, Human
ugucaugcagguuuguuauaga

SEQ ID NO: 360391 - RNA, 22 nt, Human
aagagaaggauucugagccugg

SEQ ID NO: 360392 - RNA, 22 nt, Human
uggcucagcuuuccccaucugg

SEQ ID NO: 360393 - RNA, 22 nt, Human
augauugcagcccuacagcugu

SEQ ID NO: 360394 - RNA, 22 nt, Human
ugcugucccuaagucucuucaa

SEQ ID NO: 360395 - RNA, 22 nt, Human
uuuacuuuugguaaggucauuu

SEQ ID NO: 360396 - RNA, 22 nt, Human
uauuucagggagaauaaauuug

SEQ ID NO: 360397 - RNA, 22 nt, Human
uuagggacaaauuugcagaacc

SEQ ID NO: 360398 - RNA, 22 nt, Human
agaggccaucugcucugugggg

SEQ ID NO: 360399 - RNA, 21 nt, Human
uggaaagauucaaagaccagg

SEQ ID NO: 360400 - RNA, 22 nt, Human
ggacagcccauacacaugucug

SEQ ID NO: 360401 - RNA, 22 nt, Human
gcagcuaccacccaggaaggac

SEQ ID NO: 360402 - RNA, 22 nt, Human
gggcagcugccccucucugggc

SEQ ID NO: 360403 - RNA, 22 nt, Human
cucuccagccacagaagcugcu

SEQ ID NO: 360404 - RNA, 22 nt, Human
cggcagggcuccaugcauuucu

SEQ ID NO: 360405 - RNA, 22 nt, Human
uggcucaggggucuggcucugu

SEQ ID NO: 360406 - RNA, 22 nt, Human
ggccugcugcuaugacuuccug

SEQ ID NO: 360407 - RNA, 22 nt, Human
agacccucuccaugcccacugc

SEQ ID NO: 360408 - RNA, 22 nt, Human
ugcacacaguucucaggaaaga

SEQ ID NO: 360409 - RNA, 22 nt, Human
acauuucuugaugccucuguga

SEQ ID NO: 360410 - RNA, 20 nt, Human
agguggcuccugcugggggu

SEQ ID NO: 360411 - RNA, 22 nt, Human
gggugggagucuggcccucaaa

SEQ ID NO: 360412 - RNA, 22 nt, Human
gaggagaggcuggacgcgguga

SEQ ID NO: 360413 - RNA, 22 nt, Human
cugcccuggucccauggcugau

SEQ ID NO: 360414 - RNA, 22 nt, Human
gcugagcugaggcagggcuggg

SEQ ID NO: 360415 - RNA, 22 nt, Human
gauaccagacagggagggagaa

SEQ ID NO: 360416 - RNA, 22 nt, Human
acuuaaaaacagauccagcagg

SEQ ID NO: 360417 - RNA, 21 nt, Human
acagcagggcuggcaugacag

SEQ ID NO: 360418 - RNA, 22 nt, Human
ucagaagcaggagugugcacaa

SEQ ID NO: 360419 - RNA, 22 nt, Human
gacauucacagguaaacauucc

SEQ ID NO: 360420 - RNA, 22 nt, Human
uucaaaacagcuagauauugga

SEQ ID NO: 360421 - RNA, 22 nt, Human
caggccugugacaccgugucug

SEQ ID NO: 360422 - RNA, 22 nt, Human
agcagguguagggcucuuugua

SEQ ID NO: 360423 - RNA, 22 nt, Human
agguagagcuccaguagaaaau

SEQ ID NO: 360424 - RNA, 22 nt, Human
ucagcagucacauguuguccca

SEQ ID NO: 360425 - RNA, 22 nt, Human
cagguccccuccccuaccaggc

SEQ ID NO: 360426 - RNA, 22 nt, Human
uaaagaacacagggaauagcac

SEQ ID NO: 360427 - RNA, 22 nt, Human
cauuucugauuacagaauacua

SEQ ID NO: 360428 - RNA, 22 nt, Human
ucucucagucagaugcuaaaga

SEQ ID NO: 360429 - RNA, 22 nt, Human
agagcuguuuggacaucugagu

SEQ ID NO: 360430 - RNA, 22 nt, Human
uuugucaucccuuuugaaacug

SEQ ID NO: 360431 - RNA, 22 nt, Human
ggagcacccugcucagccaagc

SEQ ID NO: 360432 - RNA, 22 nt, Human
agcaggugaauuccuggaugug

SEQ ID NO: 360433 - RNA, 22 nt, Human
gggcuggcaucaguugccgaga

SEQ ID NO: 360434 - RNA, 22 nt, Human
guuaauuuaguagaguccagau

SEQ ID NO: 360435 - RNA, 22 nt, Human
gugaggggaguaaagccauguu

SEQ ID NO: 360436 - RNA, 22 nt, Human
uuacagaaguuucagcguuuua

SEQ ID NO: 360437 - RNA, 22 nt, Human
uguagcacagagcuuugacacu

SEQ ID NO: 360438 - RNA, 22 nt, Human
gagagcacaugaacauggagga

SEQ ID NO: 360439 - RNA, 22 nt, Human
agggccaguaccaggugggugg

SEQ ID NO: 360440 - RNA, 22 nt, Human
agcagaggaggauuuaguuagg

SEQ ID NO: 360441 - RNA, 22 nt, Human
gagggggcgugcaaggcuccgc

SEQ ID NO: 360442 - RNA, 19 nt, Human
cauuuuaagcauccccagu

SEQ ID NO: 360443 - RNA, 22 nt, Human
aggcagguguuaccucugguuu

SEQ ID NO: 360444 - RNA, 22 nt, Human
cagcugcaggaacaaaaaugug

SEQ ID NO: 360445 - RNA, 22 nt, Human
cacccaggcuagagugcagugg

SEQ ID NO: 360446 - RNA, 22 nt, Human
augggggccugaacaggcaaaa

SEQ ID NO: 360447 - RNA, 22 nt, Human
acaagccaauuacugugccagg

SEQ ID NO: 360448 - RNA, 22 nt, Human
ggggcagggagguuaucgccga

SEQ ID NO: 360449 - RNA, 18 nt, Human
ggcugagguugacuagaa

SEQ ID NO: 360450 - RNA, 21 nt, Human
gaguccuuccaauguccucag

SEQ ID NO: 360451 - RNA, 22 nt, Human
cacagggcagagaccugggugc

SEQ ID NO: 360452 - RNA, 22 nt, Human
uccaggcuggaaaugucaaacu

SEQ ID NO: 360453 - RNA, 22 nt, Human
aaauaugaaugauaagaguuau

SEQ ID NO: 360454 - RNA, 22 nt, Human
aaucagaaauucuacaucacaa

SEQ ID NO: 360455 - RNA, 22 nt, Human
cuuuggcaugguccucacuaua

SEQ ID NO: 360456 - RNA, 22 nt, Human
uugaagcacaaugucuuuuauc

SEQ ID NO: 360457 - RNA, 22 nt, Human
aaagcagagcagggcacuuaug

SEQ ID NO: 360458 - RNA, 22 nt, Human
agaacagaggccuuauguuuca

SEQ ID NO: 360459 - RNA, 22 nt, Human
uauugaguuacagaaaauacuu

SEQ ID NO: 360460 - RNA, 22 nt, Human
uacaauacuuaaccuauuuugc

SEQ ID NO: 360461 - RNA, 22 nt, Human
aggcugaggaucccuguguucu

SEQ ID NO: 360462 - RNA, 22 nt, Human
cggucaggugcagcguuggcac

SEQ ID NO: 360463 - RNA, 22 nt, Human
aacagaacccgagugugaaucu

SEQ ID NO: 360464 - RNA, 22 nt, Human
cuggcucaguucuugguuuuca

SEQ ID NO: 360465 - RNA, 22 nt, Human
auugcuguggaaauauaagaug

SEQ ID NO: 360466 - RNA, 22 nt, Human
cugccucuguugggcauggucu

SEQ ID NO: 360467 - RNA, 22 nt, Human
uuacuucuuacaaaagaaauau

SEQ ID NO: 360468 - RNA, 22 nt, Human
gccuggagggauagaaugcaag

SEQ ID NO: 360469 - RNA, 22 nt, Human
acaaguggguccuacauaaagc

SEQ ID NO: 360470 - RNA, 22 nt, Human
aaaaucaguacacuuuauuuug

SEQ ID NO: 360471 - RNA, 20 nt, Human
aagcacauuucuacaauaau

SEQ ID NO: 360472 - RNA, 22 nt, Human
gccucucucuacccaguaugau

SEQ ID NO: 360473 - RNA, 22 nt, Human
auucugucuuuuuaaaauaaua

SEQ ID NO: 360474 - RNA, 22 nt, Human
auccaaagcccuaaguuaacug

SEQ ID NO: 360475 - RNA, 22 nt, Human
gcaggcagaucaccugucagga

SEQ ID NO: 360476 - RNA, 22 nt, Human
ucaccaggcuggaaugcagugg

SEQ ID NO: 360477 - RNA, 22 nt, Human
gcccugagacugagcauggguu

SEQ ID NO: 360478 - RNA, 22 nt, Human
acaacaggguaaggcaggccau

SEQ ID NO: 360479 - RNA, 22 nt, Human
uaaaugugcacagguuagaagg

SEQ ID NO: 360480 - RNA, 22 nt, Human
gcuggccugcugggcaccaccg

SEQ ID NO: 360481 - RNA, 22 nt, Human
aagugauuucugccugcauguu

SEQ ID NO: 360482 - RNA, 22 nt, Human
ugcuguguucuccugacucacc

SEQ ID NO: 360483 - RNA, 22 nt, Human
uaguggagaaguggagucugug

SEQ ID NO: 360484 - RNA, 22 nt, Human
gcagcaugagcuauacaaagua

SEQ ID NO: 360485 - RNA, 22 nt, Human
gccagcaguccugcugugugcc

SEQ ID NO: 360486 - RNA, 22 nt, Human
gagcaugguuccauagguuggu

SEQ ID NO: 360487 - RNA, 22 nt, Human
caggguggcacaucacagcauu

SEQ ID NO: 360488 - RNA, 22 nt, Human
ggcugaaguguaguggcucacu

SEQ ID NO: 360489 - RNA, 22 nt, Human
caucagaaggaaggacgauuau

SEQ ID NO: 360490 - RNA, 22 nt, Human
uggccugcagaggcuguggggc

SEQ ID NO: 360491 - RNA, 22 nt, Human
cugggugguucuaacuguugau

SEQ ID NO: 360492 - RNA, 22 nt, Human
ugagagggcccagagcacacca

SEQ ID NO: 360493 - RNA, 22 nt, Human
uagacacaucaaguauaguuaa

SEQ ID NO: 360494 - RNA, 22 nt, Human
ucugagagccucuagccuaagu

SEQ ID NO: 360495 - RNA, 22 nt, Human
cccaggaggcagagguuggagc

SEQ ID NO: 360496 - RNA, 18 nt, Human
acagaacucaggggcacc

SEQ ID NO: 360497 - RNA, 22 nt, Human
augaaacacacacgcgcauacu

SEQ ID NO: 360498 - RNA, 22 nt, Human
cagggcaguuuuacuucucucu

SEQ ID NO: 360499 - RNA, 18 nt, Human
cccagccucuccuuucua

SEQ ID NO: 360500 - RNA, 20 nt, Human
uguuucuuuuaaugagcggc

SEQ ID NO: 360501 - RNA, 22 nt, Human
aagauucuacaguagguacauu

SEQ ID NO: 360502 - RNA, 22 nt, Human
auaauuuaauuuucacaguggu

SEQ ID NO: 360503 - RNA, 22 nt, Human
gccagagcacaggcugguagua

SEQ ID NO: 360504 - RNA, 22 nt, Human
gcugccuggaauaacggcuggc

SEQ ID NO: 360505 - RNA, 22 nt, Human
uuagccaugugggaaaaacagc

SEQ ID NO: 360506 - RNA, 22 nt, Human
aucacaaaggucucagagcaca

SEQ ID NO: 360507 - RNA, 22 nt, Human
uuuaggcacaacuacucagcua

SEQ ID NO: 360508 - RNA, 22 nt, Human
ucagagaugcagugccaccuac

SEQ ID NO: 360509 - RNA, 22 nt, Human
aggcaggaacccugugugcgcc

SEQ ID NO: 360510 - RNA, 22 nt, Human
gaugguuuggaaugaaguagcu

SEQ ID NO: 360511 - RNA, 22 nt, Human
uguccuuauauuguggaagggg

SEQ ID NO: 360512 - RNA, 22 nt, Human
uuaacagagaacauagaaguag

SEQ ID NO: 360513 - RNA, 22 nt, Human
ccagcuuguuugaagcucguca

SEQ ID NO: 360514 - RNA, 22 nt, Human
cacaagucuguggucuccaaca

SEQ ID NO: 360515 - RNA, 22 nt, Human
uggcugccuagucccucagccu

SEQ ID NO: 360516 - RNA, 22 nt, Human
ccagucugaggccuggugaggg

SEQ ID NO: 360517 - RNA, 22 nt, Human
agccccaguccgcugcgggcgg

SEQ ID NO: 360518 - RNA, 22 nt, Human
gcaaauauucaagacuuuucca

SEQ ID NO: 360519 - RNA, 22 nt, Human
gaaggccaagaggcuccaagau

SEQ ID NO: 360520 - RNA, 22 nt, Human
uggccugguccuugucaaggca

SEQ ID NO: 360521 - RNA, 23 nt, Human
uuugaaaguaucaacucgccuga

SEQ ID NO: 360522 - RNA, 22 nt, Human
uuaagauagaacccaguagucu

SEQ ID NO: 360523 - RNA, 22 nt, Human
acuguucacagauuagucgaug

SEQ ID NO: 360524 - RNA, 22 nt, Human
agggaagagcuugcaagaaacc

SEQ ID NO: 360525 - RNA, 22 nt, Human
gaggagcugggcugagaggguc

SEQ ID NO: 360526 - RNA, 22 nt, Human
caugcuuuucaaucuaucuuaa

SEQ ID NO: 360527 - RNA, 22 nt, Human
ugaauagauuuuuaacauauaa

SEQ ID NO: 360528 - RNA, 22 nt, Human
cagaaguggccucagagggagu

SEQ ID NO: 360529 - RNA, 22 nt, Human
agucaccaggguuugcuggguu

SEQ ID NO: 360530 - RNA, 22 nt, Human
uggagaauuuugucaccagaca

SEQ ID NO: 360531 - RNA, 22 nt, Human
ugagguaggugguaagagauac

SEQ ID NO: 360532 - RNA, 22 nt, Human
caucuggcuagcuaucauugug

SEQ ID NO: 360533 - RNA, 21 nt, Human
auuucagagcacacaaguaaa

SEQ ID NO: 360534 - RNA, 22 nt, Human
uugcacagaugagggugaugcu

SEQ ID NO: 360535 - RNA, 22 nt, Human
gaauuucauuuguuuccuacca

SEQ ID NO: 360536 - RNA, 22 nt, Human
cugcuguggaugcaggaccuca

SEQ ID NO: 360537 - RNA, 22 nt, Human
ugugggaggaauuagaauggga

SEQ ID NO: 360538 - RNA, 22 nt, Human
aaaaaucacuuuuauaggcagc

SEQ ID NO: 360539 - RNA, 22 nt, Human
uauuuaguuaucuuucauaaaa

SEQ ID NO: 360540 - RNA, 22 nt, Human
gaguuauuucagaaggaaagau

SEQ ID NO: 360541 - RNA, 22 nt, Human
cacccacauggaaauucacagu

SEQ ID NO: 360542 - RNA, 22 nt, Human
uagcugcugcagcacagggagg

SEQ ID NO: 360543 - RNA, 22 nt, Human
ugaagaauaaaugguugagacu

SEQ ID NO: 360544 - RNA, 22 nt, Human
ugcagcucauugcuggggucug

SEQ ID NO: 360545 - RNA, 22 nt, Human
uccuuccuggggucucugcugc

SEQ ID NO: 360546 - RNA, 22 nt, Human
uaaugcacauagaaguacuuag

SEQ ID NO: 360547 - RNA, 22 nt, Human
ugcagaguaaaagcagaugcua

SEQ ID NO: 360548 - RNA, 22 nt, Human
cauccugcggggagcagagggc

SEQ ID NO: 360549 - RNA, 22 nt, Human
uguauuuuuaggaaugcgcuau

SEQ ID NO: 360550 - RNA, 22 nt, Human
cagaguguggcaucuuccaacu

SEQ ID NO: 360551 - RNA, 22 nt, Human
ccagaagaggacacagugugga

SEQ ID NO: 360552 - RNA, 22 nt, Human
aggcagagcuggguuuugaaau

SEQ ID NO: 360553 - RNA, 22 nt, Human
uagggcuauaagagaauaagac

SEQ ID NO: 360554 - RNA, 22 nt, Human
cugcccugaccugccucagagu

SEQ ID NO: 360555 - RNA, 22 nt, Human
ucuugcacuucaugaauauguu

SEQ ID NO: 360556 - RNA, 22 nt, Human
agaaaacuugucacagcucuca

SEQ ID NO: 360557 - RNA, 21 nt, Human
ggucuuccaaauaaggagaaa

SEQ ID NO: 360558 - RNA, 22 nt, Human
gccuaauaugcaaaauugauac

SEQ ID NO: 360559 - RNA, 22 nt, Human
cccugagaugccucacccuagu

SEQ ID NO: 360560 - RNA, 22 nt, Human
uuuaaauucugucugccgcuua

SEQ ID NO: 360561 - RNA, 22 nt, Human
agcuuccugaugcaagagggcu

SEQ ID NO: 360562 - RNA, 22 nt, Human
ucuggcuccacuuucuucauuu

SEQ ID NO: 360563 - RNA, 22 nt, Human
ccugagugcuuccagagucaug

SEQ ID NO: 360564 - RNA, 22 nt, Human
uuagagucaaaauggcauguua

SEQ ID NO: 360565 - RNA, 21 nt, Human
uuucacaaaaguaugugacaa

SEQ ID NO: 360566 - RNA, 22 nt, Human
gaugcugagagguggagggaac

SEQ ID NO: 360567 - RNA, 22 nt, Human
auauuauucuaguaacagugau

SEQ ID NO: 360568 - RNA, 22 nt, Human
caggaaggcgcggcugugccug

SEQ ID NO: 360569 - RNA, 22 nt, Human
ucagggacuaggugcugccuga

SEQ ID NO: 360570 - RNA, 22 nt, Human
uuuaggcaagaacucacugaga

SEQ ID NO: 360571 - RNA, 22 nt, Human
uuugauuuacuggauauucuca

SEQ ID NO: 360572 - RNA, 22 nt, Human
aggagggagaugcccauccugg

SEQ ID NO: 360573 - RNA, 23 nt, Human
gcucugagggcuuaucccuccca

SEQ ID NO: 360574 - RNA, 18 nt, Human
uaggagagaauuuauuua

SEQ ID NO: 360575 - RNA, 22 nt, Human
agaaaugacacacaugagacau

SEQ ID NO: 360576 - RNA, 22 nt, Human
agagcagagggcucugggacaa

SEQ ID NO: 360577 - RNA, 22 nt, Human
ucuuuacacaagacaagaauaa

SEQ ID NO: 360578 - RNA, 22 nt, Human
cugugcuugacagugggaagca

SEQ ID NO: 360579 - RNA, 22 nt, Human
gaagcagcuagcccacuaguca

SEQ ID NO: 360580 - RNA, 22 nt, Human
aaacuguauauuuauggcaugu

SEQ ID NO: 360581 - RNA, 23 nt, Human
aguguuccaguugguugagagug

SEQ ID NO: 360582 - RNA, 17 nt, Human
gagagcugcugcuuccg

SEQ ID NO: 360583 - RNA, 22 nt, Human
guuccaaagucucugagcugag

SEQ ID NO: 360584 - RNA, 22 nt, Human
cacccaggcagguggcugagaa

SEQ ID NO: 360585 - RNA, 22 nt, Human
agaggcagaaguguucaaaccc

SEQ ID NO: 360586 - RNA, 22 nt, Human
ccagucacagguguguuuauau

SEQ ID NO: 360587 - RNA, 22 nt, Human
ggagacaguauggcuuguagcu

SEQ ID NO: 360588 - RNA, 22 nt, Human
uucaaagugcauguuccucaga

SEQ ID NO: 360589 - RNA, 22 nt, Human
ucucagagcuucaguuauuuuc

SEQ ID NO: 360590 - RNA, 22 nt, Human
ucucagagcuucagaaagcacc

SEQ ID NO: 360591 - RNA, 22 nt, Human
ugaccugcagucaagaggggaa

SEQ ID NO: 360592 - RNA, 22 nt, Human
cccugaggggaguggugaggug

SEQ ID NO: 360593 - RNA, 22 nt, Human
accaggcaguauggugcugcaa

SEQ ID NO: 360594 - RNA, 22 nt, Human
gugugcagggcugccugugccg

SEQ ID NO: 360595 - RNA, 22 nt, Human
agcugggucuugggccaggaga

SEQ ID NO: 360596 - RNA, 21 nt, Human
uuucugucucugccacuaguu

SEQ ID NO: 360597 - RNA, 22 nt, Human
caggaacauuuaaccacagggu

SEQ ID NO: 360598 - RNA, 22 nt, Human
agagcugaaaaagcugacccgg

SEQ ID NO: 360599 - RNA, 22 nt, Human
gucugagaaucuugcauaucau

SEQ ID NO: 360600 - RNA, 22 nt, Human
augcacagcagugaguucagug

SEQ ID NO: 360601 - RNA, 22 nt, Human
augugaggaagaaagagguaag

SEQ ID NO: 360602 - RNA, 22 nt, Human
aaaaagguugauccagauuagg

SEQ ID NO: 360603 - RNA, 22 nt, Human
aucugcaggaaugugugcagag

SEQ ID NO: 360604 - RNA, 22 nt, Human
acaguguguucugggaccucca

SEQ ID NO: 360605 - RNA, 22 nt, Human
uuauuaggaacucaggauuuuu

SEQ ID NO: 360606 - RNA, 22 nt, Human
gaucaaaagcuggguucuaaaa

SEQ ID NO: 360607 - RNA, 22 nt, Human
aucacgucaugguuugaucugg

SEQ ID NO: 360608 - RNA, 22 nt, Human
uuuugaaagaguccugcuacag

SEQ ID NO: 360609 - RNA, 22 nt, Human
ugugaaggagaugaagggagug

SEQ ID NO: 360610 - RNA, 22 nt, Human
agagauaugaguaguugugaca

SEQ ID NO: 360611 - RNA, 22 nt, Human
aguaaagcagaguugcaguaca

SEQ ID NO: 360612 - RNA, 22 nt, Human
uucaaugagcccaagaacguga

SEQ ID NO: 360613 - RNA, 22 nt, Human
agucucuuuguggacucugccu

SEQ ID NO: 360614 - RNA, 22 nt, Human
guggcuugaccaucccugcuac

SEQ ID NO: 360615 - RNA, 22 nt, Human
gaggcagcggcucacagagaaa

SEQ ID NO: 360616 - RNA, 22 nt, Human
ugucucaguauacgaaacacuu

SEQ ID NO: 360617 - RNA, 22 nt, Human
acagauauaaacuauaguagug

SEQ ID NO: 360618 - RNA, 22 nt, Human
auaaggcagucccuuaacaagg

SEQ ID NO: 360619 - RNA, 22 nt, Human
uuuauucuugagagugagaaga

SEQ ID NO: 360620 - RNA, 22 nt, Human
cugcagggcccgccugagcccu

SEQ ID NO: 360621 - RNA, 22 nt, Human
uugaauaguguuuucaguauac

SEQ ID NO: 360622 - RNA, 22 nt, Human
acaguggaauggugggccugca

SEQ ID NO: 360623 - RNA, 22 nt, Human
ggcagcuccucucagcaaaaga

SEQ ID NO: 360624 - RNA, 22 nt, Human
cugugcuggagaugggccagag

SEQ ID NO: 360625 - RNA, 22 nt, Human
uugcuuugccaccagaagucua

SEQ ID NO: 360626 - RNA, 22 nt, Human
ggcuucuccccuuugagucuuc

SEQ ID NO: 360627 - RNA, 22 nt, Human
uuauauuaguuagacuugcugu

SEQ ID NO: 360628 - RNA, 22 nt, Human
uuccuuagggaaagggauaagg

SEQ ID NO: 360629 - RNA, 22 nt, Human
caaaguuuaaaguagauuucag

SEQ ID NO: 360630 - RNA, 22 nt, Human
ccaggugugccagcagggacug

SEQ ID NO: 360631 - RNA, 22 nt, Human
cauuaugugggaaaauguucuu

SEQ ID NO: 360632 - RNA, 22 nt, Human
ggagcuggucagccuugagcau

SEQ ID NO: 360633 - RNA, 22 nt, Human
uuugaguugcuuauuuaauagg

SEQ ID NO: 360634 - RNA, 22 nt, Human
cagggcacggagaagucacccc

SEQ ID NO: 360635 - RNA, 22 nt, Human
caucagaaggccagaggguagc

SEQ ID NO: 360636 - RNA, 22 nt, Human
caggggcuguggcacauggugu

SEQ ID NO: 360637 - RNA, 22 nt, Human
cucucuggaagggggagcugau

SEQ ID NO: 360638 - RNA, 22 nt, Human
ucauuuguaccauuuuuuaaga

SEQ ID NO: 360639 - RNA, 22 nt, Human
cuggggccacaacggcgcacgc

SEQ ID NO: 360640 - RNA, 22 nt, Human
cggagcugccugccaagccugc

SEQ ID NO: 360641 - RNA, 22 nt, Human
ccagugcccagcugcccaggca

SEQ ID NO: 360642 - RNA, 22 nt, Human
cucccagagagcaggugggccg

SEQ ID NO: 360643 - RNA, 22 nt, Human
caaagccauagaguagauaaga

SEQ ID NO: 360644 - RNA, 22 nt, Human
uuccauaaaggugauaguauac

SEQ ID NO: 360645 - RNA, 22 nt, Human
agagccugugggagaugcagcu

SEQ ID NO: 360646 - RNA, 20 nt, Human
auauguguacguguauacau

SEQ ID NO: 360647 - RNA, 22 nt, Human
gagaggcuaugagguucugugu

SEQ ID NO: 360648 - RNA, 22 nt, Human
ggccugcugacccaaguccugu

SEQ ID NO: 360649 - RNA, 22 nt, Human
aggcuucagaugaccuuagcau

SEQ ID NO: 360650 - RNA, 22 nt, Human
gaugaaaaauugcugugucaua

SEQ ID NO: 360651 - RNA, 22 nt, Human
uagcugugagcacccaggcugu

SEQ ID NO: 360652 - RNA, 22 nt, Human
guggccagcaagugcugccucu

SEQ ID NO: 360653 - RNA, 22 nt, Human
agagacaggauaucugcucaug

SEQ ID NO: 360654 - RNA, 22 nt, Human
ugcuugugagaguuuuuucaga

SEQ ID NO: 360655 - RNA, 22 nt, Human
gccuggugugcgccgcgcagcu

SEQ ID NO: 360656 - RNA, 23 nt, Human
uggcucagggucucuuaugaagu

SEQ ID NO: 360657 - RNA, 22 nt, Human
ucacauuuguucuugaaucuaa

SEQ ID NO: 360658 - RNA, 19 nt, Human
uuucuuaggccuuuggccu

SEQ ID NO: 360659 - RNA, 19 nt, Human
gacucacaccuuccgcugu

SEQ ID NO: 360660 - RNA, 22 nt, Human
aaggguggauuucugagcucua

SEQ ID NO: 360661 - RNA, 22 nt, Human
ugcucuguugugcaugugggau

SEQ ID NO: 360662 - RNA, 17 nt, Human
gggcagggacuccuggg

SEQ ID NO: 360663 - RNA, 22 nt, Human
gcugucacacauggccccagcu

SEQ ID NO: 360664 - RNA, 22 nt, Human
uucucugaguacguuucagugu

SEQ ID NO: 360665 - RNA, 22 nt, Human
aaggcuuuugggaauuuucaac

SEQ ID NO: 360666 - RNA, 22 nt, Human
uggcaggguuggccaccuuacc

SEQ ID NO: 360667 - RNA, 22 nt, Human
ccaggcuuucccagccucucca

SEQ ID NO: 360668 - RNA, 22 nt, Human
agcugcagagguuugugcaaca

SEQ ID NO: 360669 - RNA, 22 nt, Human
ucagggcagaauccaaagaauu

SEQ ID NO: 360670 - RNA, 22 nt, Human
aucagaauaauuagauuucaga

SEQ ID NO: 360671 - RNA, 22 nt, Human
uugcauaaaugcuuaaaauuug

SEQ ID NO: 360672 - RNA, 22 nt, Human
ugcaauaaagugcuauaaaucc

SEQ ID NO: 360673 - RNA, 22 nt, Human
ugugccagaaaauaugcugagg

SEQ ID NO: 360674 - RNA, 22 nt, Human
uaagaaacccaggaauuucuua

SEQ ID NO: 360675 - RNA, 22 nt, Human
gagggcagugaauuuugaagcu

SEQ ID NO: 360676 - RNA, 22 nt, Human
agaggccagggacacugcucaa

SEQ ID NO: 360677 - RNA, 22 nt, Human
acagaauauugguuacuguugc

SEQ ID NO: 360678 - RNA, 22 nt, Human
cagaguguuagcgcugguuggg

SEQ ID NO: 360679 - RNA, 22 nt, Human
agccaggcagggcucucgcucu

SEQ ID NO: 360680 - RNA, 22 nt, Human
aacaaacaaacauuuugucauc

SEQ ID NO: 360681 - RNA, 22 nt, Human
ugugacaugugucaucuuuucu

SEQ ID NO: 360682 - RNA, 22 nt, Human
cagccucuuuccacaucaggca

SEQ ID NO: 360683 - RNA, 22 nt, Human
aaaugcaccuugcugugagacu

SEQ ID NO: 360684 - RNA, 19 nt, Human
cagucccaaauucuuguca

SEQ ID NO: 360685 - RNA, 22 nt, Human
caguccuuucaauggugaccuu

SEQ ID NO: 360686 - RNA, 18 nt, Human
uggcagcaggaagccauu

SEQ ID NO: 360687 - RNA, 22 nt, Human
gcagcuuuggagguggaacucu

SEQ ID NO: 360688 - RNA, 22 nt, Human
cagugggaagggcagaggcuuu

SEQ ID NO: 360689 - RNA, 22 nt, Human
ggagugacucacagcugggaca

SEQ ID NO: 360690 - RNA, 22 nt, Human
agcuuuauuaacucuccaggug

SEQ ID NO: 360691 - RNA, 22 nt, Human
gccaggccugcaagugcuggug

SEQ ID NO: 360692 - RNA, 22 nt, Human
agugggcaggcagggugcgcag

SEQ ID NO: 360693 - RNA, 22 nt, Human
ccuucuucuguguggcccaaga

SEQ ID NO: 360694 - RNA, 22 nt, Human
gccugcaguucugugcuaggca

SEQ ID NO: 360695 - RNA, 22 nt, Human
cccuggaggcaaagguugcagu

SEQ ID NO: 360696 - RNA, 22 nt, Human
aaaaauaggucaaccguguaug

SEQ ID NO: 360697 - RNA, 22 nt, Human
ucacaugcuacugagccagacc

SEQ ID NO: 360698 - RNA, 22 nt, Human
cuuagaaauaaugguuucaguu

SEQ ID NO: 360699 - RNA, 22 nt, Human
ucugaggcauacccaggccccc

SEQ ID NO: 360700 - RNA, 22 nt, Human
gagacaggauuuaaccaaagcu

SEQ ID NO: 360701 - RNA, 22 nt, Human
uccugucugucuuuggucccuu

SEQ ID NO: 360702 - RNA, 22 nt, Human
cagcuggccugaucccuguggc

SEQ ID NO: 360703 - RNA, 22 nt, Human
acuguucaaguuuuaugcugga

SEQ ID NO: 360704 - RNA, 22 nt, Human
gaggcucagagugguuaaauaa

SEQ ID NO: 360705 - RNA, 22 nt, Human
uaaacaucugucauguguuuau

SEQ ID NO: 360706 - RNA, 22 nt, Human
uuugcauugcauacaaggaacu

SEQ ID NO: 360707 - RNA, 22 nt, Human
uauuccaguccuauccucuuuu

SEQ ID NO: 360708 - RNA, 22 nt, Human
cgcugggcgccgaccugcuggc

SEQ ID NO: 360709 - RNA, 22 nt, Human
gcugccugauuuacauagugaa

SEQ ID NO: 360710 - RNA, 20 nt, Human
aaagucuuaugguuaauuuu

SEQ ID NO: 360711 - RNA, 20 nt, Human
uucuggaggcuacaagucug

SEQ ID NO: 360712 - RNA, 22 nt, Human
gaagucuggcugacgagaguua

SEQ ID NO: 360713 - RNA, 22 nt, Human
ucucagggugaggaaagaauuu

SEQ ID NO: 360714 - RNA, 22 nt, Human
uggcagcaaaaccagaaucaga

SEQ ID NO: 360715 - RNA, 22 nt, Human
cccaggucuaugccagcucuga

SEQ ID NO: 360716 - RNA, 22 nt, Human
ggcucagaccucccagcuccag

SEQ ID NO: 360717 - RNA, 22 nt, Human
aaaugcacaaaguaaguguaau

SEQ ID NO: 360718 - RNA, 22 nt, Human
agcuggcauacuuugcuaggaa

SEQ ID NO: 360719 - RNA, 22 nt, Human
gcugccuuuuaaagccucgcuu

SEQ ID NO: 360720 - RNA, 22 nt, Human
uuuuaacuuaaaauacauagau

SEQ ID NO: 360721 - RNA, 22 nt, Human
uaagaacauuuucggaaagaua

SEQ ID NO: 360722 - RNA, 22 nt, Human
cauuugaaauucuuagaacaaa

SEQ ID NO: 360723 - RNA, 22 nt, Human
uauuucaagaacuucuauccau

SEQ ID NO: 360724 - RNA, 22 nt, Human
ugucccucugaggcuucccugg

SEQ ID NO: 360725 - RNA, 22 nt, Human
agaggacagacggaaagugcca

SEQ ID NO: 360726 - RNA, 22 nt, Human
cagaaggcuggcagauugagau

SEQ ID NO: 360727 - RNA, 22 nt, Human
uaucagaaaucaacacacagug

SEQ ID NO: 360728 - RNA, 22 nt, Human
uccuguuuaucugugugacucg

SEQ ID NO: 360729 - RNA, 22 nt, Human
cagaggaaggcucugggaaugu

SEQ ID NO: 360730 - RNA, 18 nt, Human
agaaggagcuaugggcag

SEQ ID NO: 360731 - RNA, 22 nt, Human
ggcaggugugagaucgaggcca

SEQ ID NO: 360732 - RNA, 22 nt, Human
acagugacguuuauuugagacg

SEQ ID NO: 360733 - RNA, 22 nt, Human
ccaguuuuuccagugcuuucug

SEQ ID NO: 360734 - RNA, 22 nt, Human
agcaggguauguuagagcugua

SEQ ID NO: 360735 - RNA, 22 nt, Human
agcccugggaggccagcuugua

SEQ ID NO: 360736 - RNA, 22 nt, Human
cagagggcucaguccugcugga

SEQ ID NO: 360737 - RNA, 23 nt, Human
ucuguacacaucagcaucuccca

SEQ ID NO: 360738 - RNA, 22 nt, Human
gacuacucaaacuuucucuaua

SEQ ID NO: 360739 - RNA, 22 nt, Human
uacccagcuucaagucaggacu

SEQ ID NO: 360740 - RNA, 22 nt, Human
cuugaauccaaaugggagauga

SEQ ID NO: 360741 - RNA, 22 nt, Human
uaagaaucgauguuuauuuaga

SEQ ID NO: 360742 - RNA, 22 nt, Human
cagguacacucccuugugcuga

SEQ ID NO: 360743 - RNA, 22 nt, Human
ccuccuuuccuguuuuccugag

SEQ ID NO: 360744 - RNA, 22 nt, Human
uuguuacacauaauaacauuuu

SEQ ID NO: 360745 - RNA, 22 nt, Human
auucaguaggucuagaauaaga

SEQ ID NO: 360746 - RNA, 22 nt, Human
acuggcagcuguaggaugcaug

SEQ ID NO: 360747 - RNA, 22 nt, Human
uagaggugucacuuugggaagu

SEQ ID NO: 360748 - RNA, 22 nt, Human
aaggcacuagcagaauuaguga

SEQ ID NO: 360749 - RNA, 22 nt, Human
gugcagggagcccagaaggucc

SEQ ID NO: 360750 - RNA, 22 nt, Human
auuucaacguuagauguaauag

SEQ ID NO: 360751 - RNA, 22 nt, Human
aucuggcuuuuacugaauugcu

SEQ ID NO: 360752 - RNA, 22 nt, Human
auugaaagcauggauuuggauu

SEQ ID NO: 360753 - RNA, 22 nt, Human
aaagaacagauguguggugcau

SEQ ID NO: 360754 - RNA, 22 nt, Human
gccagguguaguggccacaccu

SEQ ID NO: 360755 - RNA, 22 nt, Human
ccagagaguaaacauuuuccgg

SEQ ID NO: 360756 - RNA, 22 nt, Human
uggggccugagguggagcugca

SEQ ID NO: 360757 - RNA, 22 nt, Human
uucuucaaugugcccuguuuuc

SEQ ID NO: 360758 - RNA, 22 nt, Human
uuagcaucugcuguaagcuuau

SEQ ID NO: 360759 - RNA, 22 nt, Human
gugcucuccuggcugcccugac

SEQ ID NO: 360760 - RNA, 22 nt, Human
gcguuaauaacauuaauaaugc

SEQ ID NO: 360761 - RNA, 22 nt, Human
agggcugcugaggaagccuugc

SEQ ID NO: 360762 - RNA, 22 nt, Human
cuuccaaaauuuauauguugaa

SEQ ID NO: 360763 - RNA, 22 nt, Human
ucuuuauuucugaaucccccau

SEQ ID NO: 360764 - RNA, 22 nt, Human
cccaaggcugcagugagcauga

SEQ ID NO: 360765 - RNA, 22 nt, Human
gucccaggcagagucaggaggg

SEQ ID NO: 360766 - RNA, 22 nt, Human
ucagaauucagagggagugggg

SEQ ID NO: 360767 - RNA, 22 nt, Human
gccaggcugcuggcugcugucc

SEQ ID NO: 360768 - RNA, 22 nt, Human
aagcugccugggaggaagggcu

SEQ ID NO: 360769 - RNA, 22 nt, Human
auuauuagugauguuguuacug

SEQ ID NO: 360770 - RNA, 22 nt, Human
ccuggguggcagagguugcagu

SEQ ID NO: 360771 - RNA, 22 nt, Human
uagucaccuguugugugaugcc

SEQ ID NO: 360772 - RNA, 22 nt, Human
agcuggagaaaccugggagggu

SEQ ID NO: 360773 - RNA, 19 nt, Human
cugaggcccauguaccaug

SEQ ID NO: 360774 - RNA, 22 nt, Human
ugaagguggcauaggagagaug

SEQ ID NO: 360775 - RNA, 22 nt, Human
caggcccugggcaggaucagcc

SEQ ID NO: 360776 - RNA, 22 nt, Human
aaaugcacagagccuuagagau

SEQ ID NO: 360777 - RNA, 22 nt, Human
agcccucauggaacagcuccua

SEQ ID NO: 360778 - RNA, 22 nt, Human
gaggggcuugaggcccugaugg

SEQ ID NO: 360779 - RNA, 22 nt, Human
caagagcucaccggagagcauu

SEQ ID NO: 360780 - RNA, 22 nt, Human
auuagcugaccucuaaggagcc

SEQ ID NO: 360781 - RNA, 22 nt, Human
ucccagcgcggggggaggaucc

SEQ ID NO: 360782 - RNA, 22 nt, Human
caaucaguuucuguuguauaau

SEQ ID NO: 360783 - RNA, 22 nt, Human
guccugggccugcugaggcuga

SEQ ID NO: 360784 - RNA, 22 nt, Human
aauuucuccaagaaugcuuaga

SEQ ID NO: 360785 - RNA, 22 nt, Human
gccugaugagcuuccagcugag

SEQ ID NO: 360786 - RNA, 22 nt, Human
uaagaaucugcauuuuaacaag

SEQ ID NO: 360787 - RNA, 22 nt, Human
uuccaugaagggcagccucuca

SEQ ID NO: 360788 - RNA, 23 nt, Human
uggccucuccccaccuggcagaa

SEQ ID NO: 360789 - RNA, 22 nt, Human
ccaggacagugaacauguaaga

SEQ ID NO: 360790 - RNA, 20 nt, Human
cuggcaggagcgagucuacc

SEQ ID NO: 360791 - RNA, 22 nt, Human
gguggcagucuuaagagaucuu

SEQ ID NO: 360792 - RNA, 22 nt, Human
uucaaauuaccacauuugcuua

SEQ ID NO: 360793 - RNA, 22 nt, Human
ggaggcgauccugggaaacacc

SEQ ID NO: 360794 - RNA, 22 nt, Human
ucuggcucauacaagccugcaa

SEQ ID NO: 360795 - RNA, 23 nt, Human
ucaugcccaggcuccagauguca

SEQ ID NO: 360796 - RNA, 22 nt, Human
ccacagggcacaagggagguug

SEQ ID NO: 360797 - RNA, 22 nt, Human
aaaguuugcaauuuauguuaau

SEQ ID NO: 360798 - RNA, 22 nt, Human
uauauacuuucuuccuggguag

SEQ ID NO: 360799 - RNA, 22 nt, Human
ucucagggccucccucuguuuc

SEQ ID NO: 360800 - RNA, 22 nt, Human
caaauguauucucacuucaggg

SEQ ID NO: 360801 - RNA, 22 nt, Human
ucugagagucucugaggcagau

SEQ ID NO: 360802 - RNA, 22 nt, Human
gcagagugccgagauggaagcg

SEQ ID NO: 360803 - RNA, 22 nt, Human
gcccaggccggagagcagugcu

SEQ ID NO: 360804 - RNA, 22 nt, Human
uaagaacagauaaaguuucccc

SEQ ID NO: 360805 - RNA, 22 nt, Human
acacugugagcugaagggcugc

SEQ ID NO: 360806 - RNA, 22 nt, Human
cuacccagauccaggauggcua

SEQ ID NO: 360807 - RNA, 19 nt, Human
aggguccagggagcggcuc

SEQ ID NO: 360808 - RNA, 22 nt, Human
agugggguccucaguaugguuc

SEQ ID NO: 360809 - RNA, 22 nt, Human
aggggcugccuggcuuggcacu

SEQ ID NO: 360810 - RNA, 22 nt, Human
aggcacaggccucagcacccag

SEQ ID NO: 360811 - RNA, 22 nt, Human
aauauguuccacuuaaagcugg

SEQ ID NO: 360812 - RNA, 22 nt, Human
cugccuggagcauucugaaggu

SEQ ID NO: 360813 - RNA, 22 nt, Human
uucacagggcagcagcugagcc

SEQ ID NO: 360814 - RNA, 22 nt, Human
cacccaggacaggccagaugug

SEQ ID NO: 360815 - RNA, 22 nt, Human
ccacccugagccgcaagagcag

SEQ ID NO: 360816 - RNA, 22 nt, Human
guuucauucggcagcucauaag

SEQ ID NO: 360817 - RNA, 22 nt, Human
agccugcaggaugggcagcacc

SEQ ID NO: 360818 - RNA, 22 nt, Human
aguuuauguaaaauuaguaaug

SEQ ID NO: 360819 - RNA, 22 nt, Human
uuuuuccuuagggguuacucac

SEQ ID NO: 360820 - RNA, 22 nt, Human
aggcugaggcagguggaucauu

SEQ ID NO: 360821 - RNA, 22 nt, Human
cugagcgcaugguugcugggga

SEQ ID NO: 360822 - RNA, 18 nt, Human
agaagccacgaggagucc

SEQ ID NO: 360823 - RNA, 22 nt, Human
caggagcuacucagguuggguu

SEQ ID NO: 360824 - RNA, 22 nt, Human
ucaagcaggguagcaagcuggu

SEQ ID NO: 360825 - RNA, 22 nt, Human
ccccaggacacauggaccaagu

SEQ ID NO: 360826 - RNA, 22 nt, Human
gucauugcaguggcaaaucaca

SEQ ID NO: 360827 - RNA, 22 nt, Human
ggugcagaucuuucucuucagg

SEQ ID NO: 360828 - RNA, 22 nt, Human
aaaugccucugcuguacacaau

SEQ ID NO: 360829 - RNA, 22 nt, Human
uguauacauuuaacuagauaga

SEQ ID NO: 360830 - RNA, 19 nt, Human
agggcugcucuggccuggg

SEQ ID NO: 360831 - RNA, 22 nt, Human
gccugcagccagggaguucucu

SEQ ID NO: 360832 - RNA, 22 nt, Human
cucagggcuggaaagccaggaa

SEQ ID NO: 360833 - RNA, 22 nt, Human
uucaaaauuguucuaagcucug

SEQ ID NO: 360834 - RNA, 22 nt, Human
ccagguggacggcgaguacagg

SEQ ID NO: 360835 - RNA, 22 nt, Human
cccaagaucuuucgugcacuaa

SEQ ID NO: 360836 - RNA, 22 nt, Human
agcugcugcgccucacccuggc

SEQ ID NO: 360837 - RNA, 22 nt, Human
cuggcucccagcuuucagggag

SEQ ID NO: 360838 - RNA, 22 nt, Human
gccucugcaggugcgguuaucc

SEQ ID NO: 360839 - RNA, 22 nt, Human
agccagggacgcugcaggcuac

SEQ ID NO: 360840 - RNA, 22 nt, Human
auugcagcuggucaggguaauu

SEQ ID NO: 360841 - RNA, 22 nt, Human
uuccaaagucauguugcugaua

SEQ ID NO: 360842 - RNA, 22 nt, Human
ucucccaggcugcccuguggac

SEQ ID NO: 360843 - RNA, 22 nt, Human
gcagagcccuggggguauggug

SEQ ID NO: 360844 - RNA, 22 nt, Human
auaacagaguugggaagugaaa

SEQ ID NO: 360845 - RNA, 22 nt, Human
uggcucagcgguggcagcagac

SEQ ID NO: 360846 - RNA, 22 nt, Human
uugcauuugacaaauuauuuaa

SEQ ID NO: 360847 - RNA, 22 nt, Human
agagcuggauggucaagauggc

SEQ ID NO: 360848 - RNA, 22 nt, Human
caucagaaugaauguucuggag

SEQ ID NO: 360849 - RNA, 22 nt, Human
cagauggccagaggcagcugca

SEQ ID NO: 360850 - RNA, 22 nt, Human
gcugucuguucgagcguguguu

SEQ ID NO: 360851 - RNA, 21 nt, Human
ggagcugcaggagccgaaggc

SEQ ID NO: 360852 - RNA, 22 nt, Human
cagguggggcagcugugggagc

SEQ ID NO: 360853 - RNA, 22 nt, Human
aaguuauaucaucucauugacg

SEQ ID NO: 360854 - RNA, 22 nt, Human
uuuaugaacuacagauauaacu

SEQ ID NO: 360855 - RNA, 22 nt, Human
ggcagcucacgggcauggggug

SEQ ID NO: 360856 - RNA, 22 nt, Human
gcagagccccucaagccagccu

SEQ ID NO: 360857 - RNA, 22 nt, Human
uuugcaguagacaucuuauuuu

SEQ ID NO: 360858 - RNA, 22 nt, Human
uccagccaagggagguuacuag

SEQ ID NO: 360859 - RNA, 22 nt, Human
agggcagcccuucugggagggc

SEQ ID NO: 360860 - RNA, 22 nt, Human
ggcaagcucaggccucaggugu

SEQ ID NO: 360861 - RNA, 22 nt, Human
aggcuggagggcaauggcaaga

SEQ ID NO: 360862 - RNA, 22 nt, Human
guguguuucagaagccaggugu

SEQ ID NO: 360863 - RNA, 22 nt, Human
cccaggagacauauagaaggac

SEQ ID NO: 360864 - RNA, 22 nt, Human
acaguggaguugggguagcccu

SEQ ID NO: 360865 - RNA, 22 nt, Human
aggucauuggggacuaucuccg

SEQ ID NO: 360866 - RNA, 22 nt, Human
aauacauguuuucuacuauucu

SEQ ID NO: 360867 - RNA, 22 nt, Human
uccuucuuucccccuagucauu

SEQ ID NO: 360868 - RNA, 22 nt, Human
cauguuaaugaauuuuugcagu

SEQ ID NO: 360869 - RNA, 22 nt, Human
gcuggccuugugucugaggaag

SEQ ID NO: 360870 - RNA, 22 nt, Human
acaguggaugacauccuuuugc

SEQ ID NO: 360871 - RNA, 22 nt, Human
cagucaccaccagguggcagua

SEQ ID NO: 360872 - RNA, 22 nt, Human
aucucccagccacagcauucuu

SEQ ID NO: 360873 - RNA, 22 nt, Human
cagguaggauggaagggcucaa

SEQ ID NO: 360874 - RNA, 22 nt, Human
aggcugaggcgggaggaucacu

SEQ ID NO: 360875 - RNA, 22 nt, Human
cugggagaugacucagagcagg

SEQ ID NO: 360876 - RNA, 22 nt, Human
uccugccucacaguugaaguuu

SEQ ID NO: 360877 - RNA, 22 nt, Human
uuuuuauaacucuuuugugaca

SEQ ID NO: 360878 - RNA, 22 nt, Human
auccagcuuugucuggucuucg

SEQ ID NO: 360879 - RNA, 22 nt, Human
guaagggauuugaacauagguu

SEQ ID NO: 360880 - RNA, 22 nt, Human
uuucuaggcacagugucuuccc

SEQ ID NO: 360881 - RNA, 22 nt, Human
cuugaaucuucugaguauuugc

SEQ ID NO: 360882 - RNA, 21 nt, Human
gccacguuucagucuucucag

SEQ ID NO: 360883 - RNA, 22 nt, Human
agaguuaagacguacaugagug

SEQ ID NO: 360884 - RNA, 22 nt, Human
guuuuaguggguggccacugau

SEQ ID NO: 360885 - RNA, 22 nt, Human
gggcaggaggcuaauucugcau

SEQ ID NO: 360886 - RNA, 20 nt, Human
ccagcauguacacaugugga

SEQ ID NO: 360887 - RNA, 22 nt, Human
ugcauugcauuugucaugaaga

SEQ ID NO: 360888 - RNA, 22 nt, Human
auugaaagauuuugggcucaug

SEQ ID NO: 360889 - RNA, 22 nt, Human
ucagaagcauguggggagccug

SEQ ID NO: 360890 - RNA, 22 nt, Human
agcagaggacaguucuuaggaa

SEQ ID NO: 360891 - RNA, 22 nt, Human
cccaggaagagugaguggcauu

SEQ ID NO: 360892 - RNA, 19 nt, Human
ucauucaggaccaguggau

SEQ ID NO: 360893 - RNA, 22 nt, Human
ucucugucugagccuggcagac

SEQ ID NO: 360894 - RNA, 22 nt, Human
gauguagagggaagauuuuaaa

SEQ ID NO: 360895 - RNA, 22 nt, Human
cuucucuucccagggacacagg

SEQ ID NO: 360896 - RNA, 22 nt, Human
ccucuggcuguaccacuggcac

SEQ ID NO: 360897 - RNA, 22 nt, Human
cccuggagucagguuggccugg

SEQ ID NO: 360898 - RNA, 22 nt, Human
uuauccuggauuauauauguga

SEQ ID NO: 360899 - RNA, 22 nt, Human
aggcagguccccuggaaggcac

SEQ ID NO: 360900 - RNA, 22 nt, Human
ugcugcacgauaaauaauuucu

SEQ ID NO: 360901 - RNA, 22 nt, Human
caggacauugauccauuggcac

SEQ ID NO: 360902 - RNA, 22 nt, Human
uccuuggcuuucuggagcuucu

SEQ ID NO: 360903 - RNA, 22 nt, Human
cucaggagaugacagaagguau

SEQ ID NO: 360904 - RNA, 22 nt, Human
gggcuggggcucaauaauuugu

SEQ ID NO: 360905 - RNA, 21 nt, Human
aggcagccagucaugcucccu

SEQ ID NO: 360906 - RNA, 22 nt, Human
ugaagcagcaaaugaugggaga

SEQ ID NO: 360907 - RNA, 22 nt, Human
ccuccagcgcgauccacuccgg

SEQ ID NO: 360908 - RNA, 20 nt, Human
gcagggcaucuuggccccca

SEQ ID NO: 360909 - RNA, 22 nt, Human
cugggcagugguggcccuuccc

SEQ ID NO: 360910 - RNA, 22 nt, Human
ucucaccauggugcuugcuuau

SEQ ID NO: 360911 - RNA, 22 nt, Human
ucucugagaaguuccuuuguga

SEQ ID NO: 360912 - RNA, 22 nt, Human
uaacauuagguagacauaagcc

SEQ ID NO: 360913 - RNA, 23 nt, Human
agccucuuuucuccugcccugca

SEQ ID NO: 360914 - RNA, 22 nt, Human
uggauuuaguucuucacaggcc

SEQ ID NO: 360915 - RNA, 22 nt, Human
aguguguccagaaaucuguauu

SEQ ID NO: 360916 - RNA, 22 nt, Human
aaggacuccaauucuuucaucu

SEQ ID NO: 360917 - RNA, 22 nt, Human
uuuuccucuguauuugaaaugc

SEQ ID NO: 360918 - RNA, 22 nt, Human
gcugcagcagcugcaggguugu

SEQ ID NO: 360919 - RNA, 21 nt, Human
ugacauuuccaauauaaagcc

SEQ ID NO: 360920 - RNA, 22 nt, Human
guggagcccugccuugcucaug

SEQ ID NO: 360921 - RNA, 21 nt, Human
acagaugggaugagcacacug

SEQ ID NO: 360922 - RNA, 22 nt, Human
uacaaagucagaauaacaggug

SEQ ID NO: 360923 - RNA, 22 nt, Human
aaaaacugcaauuacuuuuguc

SEQ ID NO: 360924 - RNA, 22 nt, Human
gcagggacgcagcacucuccgu

SEQ ID NO: 360925 - RNA, 22 nt, Human
ggcagagacuggguuggcagag

SEQ ID NO: 360926 - RNA, 22 nt, Human
uuacaaaguucugaguucaaac

SEQ ID NO: 360927 - RNA, 22 nt, Human
ggagauaguccaggugaaggga

SEQ ID NO: 360928 - RNA, 22 nt, Human
cugagaggaugcugcaguggag

SEQ ID NO: 360929 - RNA, 22 nt, Human
gcucaggaucagccaccucuuu

SEQ ID NO: 360930 - RNA, 22 nt, Human
ucaacagaagugauagcuauua

SEQ ID NO: 360931 - RNA, 22 nt, Human
acuguucauauucuuagaaauu

SEQ ID NO: 360932 - RNA, 22 nt, Human
gaagaaucaagcaguaauuugu

SEQ ID NO: 360933 - RNA, 22 nt, Human
agagggcaaguguaguccagua

SEQ ID NO: 360934 - RNA, 22 nt, Human
cccugcagagaccacugaccuu

SEQ ID NO: 360935 - RNA, 22 nt, Human
aggguccaucaaggacugcaca

SEQ ID NO: 360936 - RNA, 22 nt, Human
uauugaggaucuccugcuaauu

SEQ ID NO: 360937 - RNA, 22 nt, Human
gccugggagugcacagugaggu

SEQ ID NO: 360938 - RNA, 22 nt, Human
augaacaagagagggaagauuc

SEQ ID NO: 360939 - RNA, 23 nt, Human
agcuuugugaaagcagacauggg

SEQ ID NO: 360940 - RNA, 22 nt, Human
ggagaugccagaauugcaaauu

SEQ ID NO: 360941 - RNA, 22 nt, Human
agugauggugagugagaagcuc

SEQ ID NO: 360942 - RNA, 22 nt, Human
acaguggaaagaaacgaauuag

SEQ ID NO: 360943 - RNA, 22 nt, Human
aggcugcucugcgaagucagcu

SEQ ID NO: 360944 - RNA, 22 nt, Human
cagugaggcucugcugagcggu

SEQ ID NO: 360945 - RNA, 22 nt, Human
uggauuagugcugaaaugaugg

SEQ ID NO: 360946 - RNA, 22 nt, Human
auugaggcagcauaguucaggg

SEQ ID NO: 360947 - RNA, 22 nt, Human
caggcuugcugcuagagcacuu

SEQ ID NO: 360948 - RNA, 22 nt, Human
aagggcagaaagggacgcuuug

SEQ ID NO: 360949 - RNA, 22 nt, Human
uggcagcugagugcacccccuc

SEQ ID NO: 360950 - RNA, 22 nt, Human
uggagcuggaauuucugggccu

SEQ ID NO: 360951 - RNA, 22 nt, Human
uaagauguuuugguuugauaag

SEQ ID NO: 360952 - RNA, 22 nt, Human
aggagcugcauggauaccuggu

SEQ ID NO: 360953 - RNA, 22 nt, Human
accaggagacaugaccaaugag

SEQ ID NO: 360954 - RNA, 22 nt, Human
uuuaggaaugugguuuuugagc

SEQ ID NO: 360955 - RNA, 22 nt, Human
uggguggaauaaaucaguucug

SEQ ID NO: 360956 - RNA, 17 nt, Human
agccgggcauggaccag

SEQ ID NO: 360957 - RNA, 22 nt, Human
gcaccugauugauuucacugcu

SEQ ID NO: 360958 - RNA, 22 nt, Human
gauuucuugauaaguaguguga

SEQ ID NO: 360959 - RNA, 22 nt, Human
ucauacaucuguccuggagcuc

SEQ ID NO: 360960 - RNA, 22 nt, Human
ucagcugcucuguugagcugaa

SEQ ID NO: 360961 - RNA, 22 nt, Human
agccucugugacucacagguca

SEQ ID NO: 360962 - RNA, 22 nt, Human
uuuaauuuuccugguaggccug

SEQ ID NO: 360963 - RNA, 22 nt, Human
ugccugagugauguggcagcca

SEQ ID NO: 360964 - RNA, 22 nt, Human
gcaaaggcuagagacacaggga

SEQ ID NO: 360965 - RNA, 22 nt, Human
agugcacaccuuaguacaaagu

SEQ ID NO: 360966 - RNA, 22 nt, Human
gccuuccuuuuaccaccagcca

SEQ ID NO: 360967 - RNA, 22 nt, Human
uuugggaagaggaaucucugga

SEQ ID NO: 360968 - RNA, 22 nt, Human
gacacauagaucuaucucacuc

SEQ ID NO: 360969 - RNA, 22 nt, Human
cgggcagaucacacagggcuug

SEQ ID NO: 360970 - RNA, 22 nt, Human
acacacuguugcucauccaggc

SEQ ID NO: 360971 - RNA, 22 nt, Human
cuggcaggucucgcugacgugu

SEQ ID NO: 360972 - RNA, 22 nt, Human
ucaaaauuaaaccaacguccag

SEQ ID NO: 360973 - RNA, 22 nt, Human
caggaaaggugugucaugaugg

SEQ ID NO: 360974 - RNA, 22 nt, Human
uaauuucuagggacuaaggugc

SEQ ID NO: 360975 - RNA, 22 nt, Human
gagguacaugaggauacacagg

SEQ ID NO: 360976 - RNA, 22 nt, Human
aaaaugugaucuacaaaugcaa

SEQ ID NO: 360977 - RNA, 22 nt, Human
gcccaggagaggccagggcuga

SEQ ID NO: 360978 - RNA, 22 nt, Human
cuggccuuuagccccagugucu

SEQ ID NO: 360979 - RNA, 21 nt, Human
aggcugcuggcucaggguccu

SEQ ID NO: 360980 - RNA, 22 nt, Human
gcuggggcugggcugaggaaga

SEQ ID NO: 360981 - RNA, 22 nt, Human
cauacauaugcauguguguaua

SEQ ID NO: 360982 - RNA, 22 nt, Human
aucagagauggcuccagugcuc

SEQ ID NO: 360983 - RNA, 22 nt, Human
ugaggaagccaaacagcuacac

SEQ ID NO: 360984 - RNA, 18 nt, Human
cagaaguccuucaaggcc

SEQ ID NO: 360985 - RNA, 22 nt, Human
auggcuuugcucaaguuuagcc

SEQ ID NO: 360986 - RNA, 22 nt, Human
cugucaggggcggguggagcgg

SEQ ID NO: 360987 - RNA, 22 nt, Human
acucuugucucaacuuuuguau

SEQ ID NO: 360988 - RNA, 22 nt, Human
gggggcaguaaggauauggaaa

SEQ ID NO: 360989 - RNA, 23 nt, Human
uggggccaagugaggaagggucu

SEQ ID NO: 360990 - RNA, 22 nt, Human
gagggcucacugagaaagcagu

SEQ ID NO: 360991 - RNA, 22 nt, Human
uaaauuguuuucuagaaguugu

SEQ ID NO: 360992 - RNA, 22 nt, Human
gggccuggggacaccaccauga

SEQ ID NO: 360993 - RNA, 22 nt, Human
ugccuugguucucuacuuggag

SEQ ID NO: 360994 - RNA, 20 nt, Human
cagaaggucuaagcuuuaga

SEQ ID NO: 360995 - RNA, 22 nt, Human
ucagcuuucucuucuaucgaua

SEQ ID NO: 360996 - RNA, 22 nt, Human
agguggggaaaccagcgauccc

SEQ ID NO: 360997 - RNA, 20 nt, Human
agaagcugauacugauggaa

SEQ ID NO: 360998 - RNA, 22 nt, Human
gaaacuguauguaguuuuuggg

SEQ ID NO: 360999 - RNA, 22 nt, Human
accaggcuugaugauuugcuua

SEQ ID NO: 361000 - RNA, 22 nt, Human
uccuguguuacugccuggagcg

SEQ ID NO: 361001 - RNA, 22 nt, Human
ccagcugaggcagccacacagg

SEQ ID NO: 361002 - RNA, 22 nt, Human
aagagcugcccaaggugaacag

SEQ ID NO: 361003 - RNA, 22 nt, Human
gauuucuugauaauucaaaucc

SEQ ID NO: 361004 - RNA, 22 nt, Human
gugcaguggcagauccuagcuc

SEQ ID NO: 361005 - RNA, 22 nt, Human
cuccagggaugagacagaguag

SEQ ID NO: 361006 - RNA, 22 nt, Human
uauuuugacuauuaaaccaaca

SEQ ID NO: 361007 - RNA, 22 nt, Human
ccagcccuguaaggaugaggca

SEQ ID NO: 361008 - RNA, 22 nt, Human
gagcagcuggacaggccucccu

SEQ ID NO: 361009 - RNA, 22 nt, Human
agugccaggagcaaggagcucc

SEQ ID NO: 361010 - RNA, 22 nt, Human
ucugcagcuugcacaggcaggc

SEQ ID NO: 361011 - RNA, 22 nt, Human
ugaacagaucaauagaacugac

SEQ ID NO: 361012 - RNA, 22 nt, Human
ucaggcugguccccacagugga

SEQ ID NO: 361013 - RNA, 22 nt, Human
ucccagagguugagucacuuau

SEQ ID NO: 361014 - RNA, 22 nt, Human
aaacauuguaauuuuagcaugg

SEQ ID NO: 361015 - RNA, 20 nt, Human
cgcccaggagggcccaugug

SEQ ID NO: 361016 - RNA, 22 nt, Human
gucccauaaguagugcaacuug

SEQ ID NO: 361017 - RNA, 22 nt, Human
uaugcacaccuggguccuuguc

SEQ ID NO: 361018 - RNA, 22 nt, Human
acacugugucuagcauuuuaca

SEQ ID NO: 361019 - RNA, 22 nt, Human
gcguccagggaaggcccagcug

SEQ ID NO: 361020 - RNA, 22 nt, Human
cugagccaaggggacagugaca

SEQ ID NO: 361021 - RNA, 22 nt, Human
auacaucuugucagauucaugu

SEQ ID NO: 361022 - RNA, 22 nt, Human
aaacuguaagagaauaaacuac

SEQ ID NO: 361023 - RNA, 22 nt, Human
gcagaugguggggcaggaaaau

SEQ ID NO: 361024 - RNA, 21 nt, Human
ucuguacaucauugagucccc

SEQ ID NO: 361025 - RNA, 21 nt, Human
uuugcauuuuacaugugggga

SEQ ID NO: 361026 - RNA, 22 nt, Human
aggguauaaagagcaagcagaa

SEQ ID NO: 361027 - RNA, 22 nt, Human
aggcucagauccuuguguccug

SEQ ID NO: 361028 - RNA, 22 nt, Human
cucccuggcuuuguccugaggc

SEQ ID NO: 361029 - RNA, 19 nt, Human
gagcgcagagggcagggga

SEQ ID NO: 361030 - RNA, 22 nt, Human
gaggagcuggcugucgggaggc

SEQ ID NO: 361031 - RNA, 22 nt, Human
uugaaagggauauaucuuucug

SEQ ID NO: 361032 - RNA, 22 nt, Human
ucaugaaucguggaaugauuua

SEQ ID NO: 361033 - RNA, 22 nt, Human
guacagaaugcuugguaaggca

SEQ ID NO: 361034 - RNA, 22 nt, Human
uucuuguauauaaaaaucauuu

SEQ ID NO: 361035 - RNA, 22 nt, Human
ccuguucaaugcccuggcuuca

SEQ ID NO: 361036 - RNA, 22 nt, Human
cuccucccucuuugccacacau

SEQ ID NO: 361037 - RNA, 22 nt, Human
cccagcuaccucugcuaggaga

SEQ ID NO: 361038 - RNA, 22 nt, Human
ugagcuuccucccugcauccau

SEQ ID NO: 361039 - RNA, 22 nt, Human
acaaaugcagcauaaagugaac

SEQ ID NO: 361040 - RNA, 22 nt, Human
gcaucuaaauaaacgugggagu

SEQ ID NO: 361041 - RNA, 22 nt, Human
ucuguucaugaaauaucuuuuu

SEQ ID NO: 361042 - RNA, 22 nt, Human
gagcuggugaucagcuggagga

SEQ ID NO: 361043 - RNA, 21 nt, Human
gccaggaguagauuacauuua

SEQ ID NO: 361044 - RNA, 22 nt, Human
ucuuucucucuaaucaagcaca

SEQ ID NO: 361045 - RNA, 22 nt, Human
aggcacugggaauaugcugagg

SEQ ID NO: 361046 - RNA, 22 nt, Human
gcugcucucagagcucaugcug

SEQ ID NO: 361047 - RNA, 20 nt, Human
uuucacaucugucccuuuaa

SEQ ID NO: 361048 - RNA, 22 nt, Human
aaucaguuucuuggcaaguuua

SEQ ID NO: 361049 - RNA, 22 nt, Human
gccccagccaaggugacacgaa

SEQ ID NO: 361050 - RNA, 17 nt, Human
gcuuuggaaggguagac

SEQ ID NO: 361051 - RNA, 22 nt, Human
gcacugcagccucagauggugg

SEQ ID NO: 361052 - RNA, 22 nt, Human
ccaggugcucuugccagggcug

SEQ ID NO: 361053 - RNA, 22 nt, Human
ugaaaucugcaugcaaaguccu

SEQ ID NO: 361054 - RNA, 22 nt, Human
ucuuuccucugagcuccuguag

SEQ ID NO: 361055 - RNA, 22 nt, Human
guugggaagcagauggaugagc

SEQ ID NO: 361056 - RNA, 19 nt, Human
uggcauuuggaggcaaccu

SEQ ID NO: 361057 - RNA, 22 nt, Human
accaugaugcauccuuaaggaa

SEQ ID NO: 361058 - RNA, 18 nt, Human
aggcuucuuggcucaguc

SEQ ID NO: 361059 - RNA, 22 nt, Human
ucugagcauugaauuuucuucc

SEQ ID NO: 361060 - RNA, 22 nt, Human
acugggaggcaucuggagcuga

SEQ ID NO: 361061 - RNA, 22 nt, Human
cccaggagagggaaccaaaugu

SEQ ID NO: 361062 - RNA, 22 nt, Human
agcugagcugcagaugacugua

SEQ ID NO: 361063 - RNA, 22 nt, Human
aucuagaaaguguugaagauca

SEQ ID NO: 361064 - RNA, 22 nt, Human
uuaauuuauguccaaaccagau

SEQ ID NO: 361065 - RNA, 22 nt, Human
gucauauacacugcauguaauc

SEQ ID NO: 361066 - RNA, 22 nt, Human
aaaaugcaugagaaugugcucg

SEQ ID NO: 361067 - RNA, 22 nt, Human
agaugguuuugucuuuaugauu

SEQ ID NO: 361068 - RNA, 23 nt, Human
cauggcagcaagagcucauggcc

SEQ ID NO: 361069 - RNA, 23 nt, Human
uagagcagggaaaucugucagag

SEQ ID NO: 361070 - RNA, 18 nt, Human
auggucucauacugggag

SEQ ID NO: 361071 - RNA, 22 nt, Human
aggcaagcauugggaacagggc

SEQ ID NO: 361072 - RNA, 22 nt, Human
ccauccugcauugcuauucaga

SEQ ID NO: 361073 - RNA, 22 nt, Human
aaagguuugcauggaauuuacc

SEQ ID NO: 361074 - RNA, 22 nt, Human
uugaagcagcucaggaggcuua

SEQ ID NO: 361075 - RNA, 22 nt, Human
gaaaucugaacucuguauccuu

SEQ ID NO: 361076 - RNA, 22 nt, Human
gccaggcucagcagucaaccug

SEQ ID NO: 361077 - RNA, 22 nt, Human
gaguccaggcucagaaacccgu

SEQ ID NO: 361078 - RNA, 22 nt, Human
aaguaaauaucuguuuauagca

SEQ ID NO: 361079 - RNA, 22 nt, Human
acccuggacuggggcugaggcu

SEQ ID NO: 361080 - RNA, 22 nt, Human
uaugcugugcuagauacaauau

SEQ ID NO: 361081 - RNA, 22 nt, Human
cugcuuugcauagcugccagag

SEQ ID NO: 361082 - RNA, 22 nt, Human
cacaauuuccuugcuucacuuu

SEQ ID NO: 361083 - RNA, 22 nt, Human
ccugggugucaugggcagcugg

SEQ ID NO: 361084 - RNA, 22 nt, Human
cauuuagagucuugcaauuuua

SEQ ID NO: 361085 - RNA, 22 nt, Human
ggcagaggaaggaugaauucac

SEQ ID NO: 361086 - RNA, 22 nt, Human
gcuaccugagcaagagcuucaa

SEQ ID NO: 361087 - RNA, 22 nt, Human
uuuauuguuuagaagggggcug

SEQ ID NO: 361088 - RNA, 22 nt, Human
agcugccauggccugaauuuac

SEQ ID NO: 361089 - RNA, 22 nt, Human
uggcaggguggcaacuuuuggu

SEQ ID NO: 361090 - RNA, 22 nt, Human
ggggcuccagucuucacauuuu

SEQ ID NO: 361091 - RNA, 22 nt, Human
agcaugcacaugacuggcuuaa

SEQ ID NO: 361092 - RNA, 22 nt, Human
ugagcccuaagggucaagcagg

SEQ ID NO: 361093 - RNA, 22 nt, Human
ugccagggcugcuacuggcuga

SEQ ID NO: 361094 - RNA, 22 nt, Human
cuguggugagcaacugacugaa

SEQ ID NO: 361095 - RNA, 22 nt, Human
aaaaaaucagaucuuugguuaa

SEQ ID NO: 361096 - RNA, 22 nt, Human
aguggaccagaagacugaagcu

SEQ ID NO: 361097 - RNA, 22 nt, Human
uauuuccaaaagccuauuauga

SEQ ID NO: 361098 - RNA, 22 nt, Human
gggcccuggacguggcggcaga

SEQ ID NO: 361099 - RNA, 22 nt, Human
uccaggaggguuuucugccuuc

SEQ ID NO: 361100 - RNA, 22 nt, Human
ugcuuuaaauaugaauuagcau

SEQ ID NO: 361101 - RNA, 22 nt, Human
caaaugcaggucauaaccugag

SEQ ID NO: 361102 - RNA, 22 nt, Human
cuccaggagcugugucuuucuu

SEQ ID NO: 361103 - RNA, 22 nt, Human
guacaugucaaaaaaugcauaa

SEQ ID NO: 361104 - RNA, 22 nt, Human
uugaauaauguguauguuguua

SEQ ID NO: 361105 - RNA, 22 nt, Human
uucagauguggcuuugucaggc

SEQ ID NO: 361106 - RNA, 22 nt, Human
ucacugcagacaaccucaguca

SEQ ID NO: 361107 - RNA, 19 nt, Human
agguggucuaggcuggaga

SEQ ID NO: 361108 - RNA, 22 nt, Human
uuggaaggagucaaccagcuga

SEQ ID NO: 361109 - RNA, 22 nt, Human
cccaggcuggagugcaauggug

SEQ ID NO: 361110 - RNA, 22 nt, Human
acauaauaaaaauaacagcuca

SEQ ID NO: 361111 - RNA, 22 nt, Human
auauacugaggagacuuuauau

SEQ ID NO: 361112 - RNA, 22 nt, Human
cagagcugguaagugguagagg

SEQ ID NO: 361113 - RNA, 21 nt, Human
cucaggauggcggccuggugg

SEQ ID NO: 361114 - RNA, 20 nt, Human
cgugcugugaccuugagcau

SEQ ID NO: 361115 - RNA, 22 nt, Human
agugacagcugggaaggugaaa

SEQ ID NO: 361116 - RNA, 17 nt, Human
caaggccagcaucuuca

SEQ ID NO: 361117 - RNA, 22 nt, Human
ucucagaguuccucuggagucc

SEQ ID NO: 361118 - RNA, 22 nt, Human
ucauuucuccgaccugcugucc

SEQ ID NO: 361119 - RNA, 22 nt, Human
agggccagcuagagcccucgcc

SEQ ID NO: 361120 - RNA, 22 nt, Human
gagaaagggaacuuacagagug

SEQ ID NO: 361121 - RNA, 22 nt, Human
uguaugcagcaaaacaauuagu

SEQ ID NO: 361122 - RNA, 22 nt, Human
guauuuucaugauuucagacca

SEQ ID NO: 361123 - RNA, 22 nt, Human
caugaguucaucugcuucucuu

SEQ ID NO: 361124 - RNA, 22 nt, Human
gagcucaggagcaucagaagaa

SEQ ID NO: 361125 - RNA, 22 nt, Human
cugccuggcauggagaagagaa

SEQ ID NO: 361126 - RNA, 22 nt, Human
uccaggcauaaugcccaguggu

SEQ ID NO: 361127 - RNA, 22 nt, Human
ggagucccagcaaagccuuccc

SEQ ID NO: 361128 - RNA, 22 nt, Human
aaacaccagucccaguauacac

SEQ ID NO: 361129 - RNA, 22 nt, Human
acagucuugagcaucagccaga

SEQ ID NO: 361130 - RNA, 22 nt, Human
caaggcaggaagccugucuuau

SEQ ID NO: 361131 - RNA, 22 nt, Human
uccaggcuggacaugaggcggg

SEQ ID NO: 361132 - RNA, 22 nt, Human
aggaagugcuaagagaacauca

SEQ ID NO: 361133 - RNA, 22 nt, Human
aaguguuaaaagauuaaaugcu

SEQ ID NO: 361134 - RNA, 22 nt, Human
aguaggaggcgggagcaugaag

SEQ ID NO: 361135 - RNA, 20 nt, Human
uccaugaguuagagacuaua

SEQ ID NO: 361136 - RNA, 19 nt, Human
gcagcugugggaagagcca

SEQ ID NO: 361137 - RNA, 22 nt, Human
agaaguaggcagggcuguauca

SEQ ID NO: 361138 - RNA, 22 nt, Human
ugcagaagaauguaggcauaag

SEQ ID NO: 361139 - RNA, 22 nt, Human
accaggaggccuggagcacaaa

SEQ ID NO: 361140 - RNA, 22 nt, Human
uuggccuuguuaaggaggcccu

SEQ ID NO: 361141 - RNA, 22 nt, Human
uuuucagugggcaaugauguga

SEQ ID NO: 361142 - RNA, 22 nt, Human
uugcugugaaaccaugggaagu

SEQ ID NO: 361143 - RNA, 22 nt, Human
guuauugcaguauagaggucua

SEQ ID NO: 361144 - RNA, 22 nt, Human
uuuucucaggugcuuaucuaag

SEQ ID NO: 361145 - RNA, 22 nt, Human
uaaaugcagauuccugagccua

SEQ ID NO: 361146 - RNA, 22 nt, Human
augccaaagcccaaguucauca

SEQ ID NO: 361147 - RNA, 19 nt, Human
ggcucucccuugagagagc

SEQ ID NO: 361148 - RNA, 20 nt, Human
uuucuugucggcuguugcug

SEQ ID NO: 361149 - RNA, 19 nt, Human
ccagcagguucauuucagg

SEQ ID NO: 361150 - RNA, 21 nt, Human
aagagcuggaucaaggauaag

SEQ ID NO: 361151 - RNA, 22 nt, Human
ugcugccagggcucugcccaca

SEQ ID NO: 361152 - RNA, 22 nt, Human
guuuauuaacugucaagugauu

SEQ ID NO: 361153 - RNA, 22 nt, Human
aggcuucccaagcagcugcaaa

SEQ ID NO: 361154 - RNA, 22 nt, Human
aauaauaagauacuaagggagu

SEQ ID NO: 361155 - RNA, 22 nt, Human
gccaggcaaauuaaggaaugca

SEQ ID NO: 361156 - RNA, 22 nt, Human
ggggcagauggaacagagcaca

SEQ ID NO: 361157 - RNA, 22 nt, Human
cucucuggcuuggcacggagau

SEQ ID NO: 361158 - RNA, 22 nt, Human
acuguguccucauguggcagaa

SEQ ID NO: 361159 - RNA, 22 nt, Human
agauuuccaucuuuuucaugug

SEQ ID NO: 361160 - RNA, 22 nt, Human
cccaggagacugagcuguaacc

SEQ ID NO: 361161 - RNA, 22 nt, Human
gcuggugccuuguuguuguuac

SEQ ID NO: 361162 - RNA, 19 nt, Human
aauuagggagucgguuaag

SEQ ID NO: 361163 - RNA, 22 nt, Human
ucacuuauugcucaucucaugc

SEQ ID NO: 361164 - RNA, 22 nt, Human
uuacauuuggcuauguccucua

SEQ ID NO: 361165 - RNA, 22 nt, Human
aguacaauuauauuuagauggu

SEQ ID NO: 361166 - RNA, 22 nt, Human
cuggcugcuggccugaggaugc

SEQ ID NO: 361167 - RNA, 22 nt, Human
ucucagucuuugcaaggaugcu

SEQ ID NO: 361168 - RNA, 22 nt, Human
ugauuuccaaaaggcuucuaag

SEQ ID NO: 361169 - RNA, 22 nt, Human
uugcagcagggugaauucacuc

SEQ ID NO: 361170 - RNA, 22 nt, Human
aaggcacuacgcugcuggggcg

SEQ ID NO: 361171 - RNA, 22 nt, Human
gccaguuccuguggagucagag

SEQ ID NO: 361172 - RNA, 22 nt, Human
ucauaaaacacaccagguaguu

SEQ ID NO: 361173 - RNA, 22 nt, Human
gaaaggaaauauucuaagcacu

SEQ ID NO: 361174 - RNA, 22 nt, Human
ugagcaguaacagcucacaggg

SEQ ID NO: 361175 - RNA, 22 nt, Human
aaagaacaucggagugggcggg

SEQ ID NO: 361176 - RNA, 20 nt, Human
gccuguccugagugucaugg

SEQ ID NO: 361177 - RNA, 22 nt, Human
gguggggcccuggcacugguau

SEQ ID NO: 361178 - RNA, 22 nt, Human
agggaggagaauggacuccuuc

SEQ ID NO: 361179 - RNA, 22 nt, Human
gagggcugauguugccaccuca

SEQ ID NO: 361180 - RNA, 22 nt, Human
auuaaacugagcaaauuaacau

SEQ ID NO: 361181 - RNA, 22 nt, Human
aagugacaccucuucccuuucc

SEQ ID NO: 361182 - RNA, 22 nt, Human
gcagcccagguguagcucuuug

SEQ ID NO: 361183 - RNA, 22 nt, Human
ugccugggggacuaaggccaaa

SEQ ID NO: 361184 - RNA, 22 nt, Human
caucagagugguggccuggugu

SEQ ID NO: 361185 - RNA, 22 nt, Human
agggcagaccacgugcaaggau

SEQ ID NO: 361186 - RNA, 22 nt, Human
accgaaggaaacuggaaccguu

SEQ ID NO: 361187 - RNA, 22 nt, Human
gcagugacagggcugcugccuu

SEQ ID NO: 361188 - RNA, 21 nt, Human
aaauggauagggcaauggaag

SEQ ID NO: 361189 - RNA, 22 nt, Human
cuggauuugccuauggugcuuu

SEQ ID NO: 361190 - RNA, 22 nt, Human
caagauggacauaaggagagaa

SEQ ID NO: 361191 - RNA, 20 nt, Human
cccagugaagcauggaagag

SEQ ID NO: 361192 - RNA, 22 nt, Human
gggcucagacaucccuccugga

SEQ ID NO: 361193 - RNA, 22 nt, Human
ugggcuccaauuuguccuuuca

SEQ ID NO: 361194 - RNA, 22 nt, Human
ccagaagagaucacaguucuug

SEQ ID NO: 361195 - RNA, 22 nt, Human
acaaaugcuuaguucaccaaaa

SEQ ID NO: 361196 - RNA, 22 nt, Human
aggaggcccuagagcucuagag

SEQ ID NO: 361197 - RNA, 22 nt, Human
agccucugacugucagcaaggu

SEQ ID NO: 361198 - RNA, 22 nt, Human
aaaggccauuacuugcuuuuag

SEQ ID NO: 361199 - RNA, 22 nt, Human
cacagcagaaauaugaaggcag

SEQ ID NO: 361200 - RNA, 22 nt, Human
gagaagcaaucgugacaucucc

SEQ ID NO: 361201 - RNA, 22 nt, Human
uaucuguuguaguacagaugau

SEQ ID NO: 361202 - RNA, 22 nt, Human
auguccuucuccucuuaccugc

SEQ ID NO: 361203 - RNA, 22 nt, Human
ccaggcugcucacaagcugccc

SEQ ID NO: 361204 - RNA, 22 nt, Human
agggcacagccuaaagccuaug

SEQ ID NO: 361205 - RNA, 22 nt, Human
aggaagcugccugggaugggaa

SEQ ID NO: 361206 - RNA, 22 nt, Human
caaaugcuggcccugcuacuua

SEQ ID NO: 361207 - RNA, 22 nt, Human
agcuuccuacaaccaucucaga

SEQ ID NO: 361208 - RNA, 22 nt, Human
aggcugccaaagcuucugucuc

SEQ ID NO: 361209 - RNA, 22 nt, Human
agaauaaucacugaaguucaaa

SEQ ID NO: 361210 - RNA, 22 nt, Human
ugugcucuggaguugccuucac

SEQ ID NO: 361211 - RNA, 22 nt, Human
uugcauugaucccagcuugggc

SEQ ID NO: 361212 - RNA, 22 nt, Human
ucacauuuauuucaaaguuacu

SEQ ID NO: 361213 - RNA, 18 nt, Human
cuguccaguagacucugc

SEQ ID NO: 361214 - RNA, 22 nt, Human
cagaaaauaaaguuucuacgca

SEQ ID NO: 361215 - RNA, 22 nt, Human
agagacaccgcgcaucauggcu

SEQ ID NO: 361216 - RNA, 22 nt, Human
uuccuuagugccucuuccgcug

SEQ ID NO: 361217 - RNA, 22 nt, Human
uggcccugccacucacugcuga

SEQ ID NO: 361218 - RNA, 23 nt, Human
agcaauaagaagggauacaugug

SEQ ID NO: 361219 - RNA, 16 nt, Human
agaggccuugaggaag

SEQ ID NO: 361220 - RNA, 22 nt, Human
ccagggcaucacauccaguguu

SEQ ID NO: 361221 - RNA, 22 nt, Human
ucagagagugcaaaauauagcu

SEQ ID NO: 361222 - RNA, 22 nt, Human
cagcccugccauggagccuccu

SEQ ID NO: 361223 - RNA, 22 nt, Human
gcugagggcuguaacagcagag

SEQ ID NO: 361224 - RNA, 22 nt, Human
ggggcagaaguagugccccuga

SEQ ID NO: 361225 - RNA, 22 nt, Human
aggcagcuuucagugucucuca

SEQ ID NO: 361226 - RNA, 22 nt, Human
ucagaauugcagggagggcagg

SEQ ID NO: 361227 - RNA, 22 nt, Human
ggagccuugggcgcucucccau

SEQ ID NO: 361228 - RNA, 22 nt, Human
ugcaggggcuugucugggccug

SEQ ID NO: 361229 - RNA, 21 nt, Human
aggucccagguuugggcagca

SEQ ID NO: 361230 - RNA, 22 nt, Human
ucccagaguucaaugggaaggu

SEQ ID NO: 361231 - RNA, 22 nt, Human
uccugccuucauacugcuguau

SEQ ID NO: 361232 - RNA, 22 nt, Human
caaggcugcugcgggucgcacc

SEQ ID NO: 361233 - RNA, 22 nt, Human
uggggacauagccagucuggcu

SEQ ID NO: 361234 - RNA, 22 nt, Human
cauugaaaaacguugacugagu

SEQ ID NO: 361235 - RNA, 22 nt, Human
aggggccugguuggccucuguu

SEQ ID NO: 361236 - RNA, 22 nt, Human
cccagcuugcaaauggguugcu

SEQ ID NO: 361237 - RNA, 22 nt, Human
acagcagcuaaccccugggcca

SEQ ID NO: 361238 - RNA, 22 nt, Human
cagggcagagggaaacuccuuu

SEQ ID NO: 361239 - RNA, 22 nt, Human
ugaucugagagcagaucaccau

SEQ ID NO: 361240 - RNA, 22 nt, Human
gggacgggcaguccaagggguc

SEQ ID NO: 361241 - RNA, 22 nt, Human
guguaaggugaaaucaacaaau

SEQ ID NO: 361242 - RNA, 22 nt, Human
aagguuaaauagguauuuucca

SEQ ID NO: 361243 - RNA, 22 nt, Human
cuguccagaaagggggcaacaa

SEQ ID NO: 361244 - RNA, 22 nt, Human
auguaacaggugaagcucugag

SEQ ID NO: 361245 - RNA, 23 nt, Human
aagucaccaagaggaaggcggag

SEQ ID NO: 361246 - RNA, 22 nt, Human
acagugcuaaacacuucuugaa

SEQ ID NO: 361247 - RNA, 22 nt, Human
aagggcugcuguagaagcagag

SEQ ID NO: 361248 - RNA, 22 nt, Human
gucccagaggacagggucacau

SEQ ID NO: 361249 - RNA, 22 nt, Human
uccucacagucaacacuuugag

SEQ ID NO: 361250 - RNA, 22 nt, Human
uacaguaaagcugcuaugaauu

SEQ ID NO: 361251 - RNA, 22 nt, Human
uaagaaucggucgcaacagagg

SEQ ID NO: 361252 - RNA, 22 nt, Human
uuuccauauuuggucuuuggga

SEQ ID NO: 361253 - RNA, 22 nt, Human
gugcuuccaucuagagggucac

SEQ ID NO: 361254 - RNA, 22 nt, Human
caggcccagcccagcccuucga

SEQ ID NO: 361255 - RNA, 22 nt, Human
gcauacagagaggauguggcau

SEQ ID NO: 361256 - RNA, 22 nt, Human
aacauaauguggccaaagucac

SEQ ID NO: 361257 - RNA, 22 nt, Human
uuguuauaaagacuaaauaugu

SEQ ID NO: 361258 - RNA, 22 nt, Human
acaugucuguaauuauuuuagg

SEQ ID NO: 361259 - RNA, 22 nt, Human
aguccggggucuggacaccugg

SEQ ID NO: 361260 - RNA, 21 nt, Human
aaggcagaagcauggaaugag

SEQ ID NO: 361261 - RNA, 23 nt, Human
auucuucauuaucuucuagaaaa

SEQ ID NO: 361262 - RNA, 22 nt, Human
guggcccucugauagggucagg

SEQ ID NO: 361263 - RNA, 22 nt, Human
uauuugaaaguguacaaaaacu

SEQ ID NO: 361264 - RNA, 22 nt, Human
auaugucgcuacaucauuagau

SEQ ID NO: 361265 - RNA, 22 nt, Human
uggcuuuacaucaaauugagua

SEQ ID NO: 361266 - RNA, 22 nt, Human
caguauguacucuuaucaugua

SEQ ID NO: 361267 - RNA, 22 nt, Human
uucccaggcugugcuaccagag

SEQ ID NO: 361268 - RNA, 22 nt, Human
ucaggugggaccugcuaggaca

SEQ ID NO: 361269 - RNA, 23 nt, Human
ucccagccucuucucuugcauac

SEQ ID NO: 361270 - RNA, 22 nt, Human
gagguacagaguguuccaaugu

SEQ ID NO: 361271 - RNA, 22 nt, Human
ugagguguguccccagggaggu

SEQ ID NO: 361272 - RNA, 22 nt, Human
aaagaugucauacacauuaaga

SEQ ID NO: 361273 - RNA, 22 nt, Human
gugauuucagguuuuucauacu

SEQ ID NO: 361274 - RNA, 22 nt, Human
uggcagggucuugcuguguugc

SEQ ID NO: 361275 - RNA, 22 nt, Human
aacagaaaucauuuagggcucu

SEQ ID NO: 361276 - RNA, 22 nt, Human
ugccaggauauaagagugcgau

SEQ ID NO: 361277 - RNA, 22 nt, Human
gggaccugccaaggccacccag

SEQ ID NO: 361278 - RNA, 22 nt, Human
uaaguucaagucuuggauauaa

SEQ ID NO: 361279 - RNA, 18 nt, Human
ugggcugccuggccucug

SEQ ID NO: 361280 - RNA, 22 nt, Human
auaaacacuucuagggcacaca

SEQ ID NO: 361281 - RNA, 22 nt, Human
aagggcagcuuaaauugguagc

SEQ ID NO: 361282 - RNA, 22 nt, Human
uguauuuugugaggaucacucu

SEQ ID NO: 361283 - RNA, 22 nt, Human
cagcugagcucccaggccauca

SEQ ID NO: 361284 - RNA, 22 nt, Human
ugcugaaggcaggggagguggc

SEQ ID NO: 361285 - RNA, 21 nt, Human
auacauucuauuaagcauuua

SEQ ID NO: 361286 - RNA, 22 nt, Human
cccauugugguuguugaggaua

SEQ ID NO: 361287 - RNA, 22 nt, Human
ccaggaagccucagaugcugag

SEQ ID NO: 361288 - RNA, 22 nt, Human
ugcauggaggaagaugaaugca

SEQ ID NO: 361289 - RNA, 22 nt, Human
aggcugaggugugcugugaucg

SEQ ID NO: 361290 - RNA, 21 nt, Human
guuuuaagggagaaaaccuag

SEQ ID NO: 361291 - RNA, 22 nt, Human
uccagucaucucccuucacauu

SEQ ID NO: 361292 - RNA, 18 nt, Human
gcagagugcgucucugug

SEQ ID NO: 361293 - RNA, 22 nt, Human
uuuccuaggagauugaucacau

SEQ ID NO: 361294 - RNA, 22 nt, Human
aaaguuugaaugauauauuagu

SEQ ID NO: 361295 - RNA, 22 nt, Human
cacaggugcuccucggggagcu

SEQ ID NO: 361296 - RNA, 22 nt, Human
uggcaggagacacauggcauag

SEQ ID NO: 361297 - RNA, 23 nt, Human
ugagaagccaggggagcgugagg

SEQ ID NO: 361298 - RNA, 22 nt, Human
guauuaggagguggagccuuug

SEQ ID NO: 361299 - RNA, 22 nt, Human
cugccagucuaugcugcucggc

SEQ ID NO: 361300 - RNA, 22 nt, Human
caaggccaaagggccacuguca

SEQ ID NO: 361301 - RNA, 22 nt, Human
uucuaacaaguggcuuguuagu

SEQ ID NO: 361302 - RNA, 22 nt, Human
cccucagcuccacccucagcag

SEQ ID NO: 361303 - RNA, 22 nt, Human
uugauuccuugaaauauccuug

SEQ ID NO: 361304 - RNA, 22 nt, Human
ccuggcacgaagggcugagguu

SEQ ID NO: 361305 - RNA, 22 nt, Human
cuuaacagcaagaucuguguca

SEQ ID NO: 361306 - RNA, 22 nt, Human
cugcauuagucaugcuuugcag

SEQ ID NO: 361307 - RNA, 22 nt, Human
caguagacacauuaauauggaa

SEQ ID NO: 361308 - RNA, 23 nt, Human
uuaggcacuuaguagggccagag

SEQ ID NO: 361309 - RNA, 22 nt, Human
ucagagagaaauaguuuuugac

SEQ ID NO: 361310 - RNA, 22 nt, Human
cuuuauguucaguacaaugcuu

SEQ ID NO: 361311 - RNA, 22 nt, Human
uagcugccuagacagcuauagc

SEQ ID NO: 361312 - RNA, 22 nt, Human
aaggccagccugagagcuaaca

SEQ ID NO: 361313 - RNA, 20 nt, Human
agcaggaaaagugccagucu

SEQ ID NO: 361314 - RNA, 22 nt, Human
ugccucugcugcuguggcauca

SEQ ID NO: 361315 - RNA, 22 nt, Human
uuauacauguguuuugagauga

SEQ ID NO: 361316 - RNA, 22 nt, Human
ugaggcaggagaaucacaugaa

SEQ ID NO: 361317 - RNA, 22 nt, Human
ggcugggcugcugggucagagc

SEQ ID NO: 361318 - RNA, 22 nt, Human
accaggcagcugggggugaugu

SEQ ID NO: 361319 - RNA, 22 nt, Human
agcuguguagggaaucagagaa

SEQ ID NO: 361320 - RNA, 22 nt, Human
uuucaaagaguuguaaauuacu

SEQ ID NO: 361321 - RNA, 21 nt, Human
uuuaaagaauaggaagggagg

SEQ ID NO: 361322 - RNA, 22 nt, Human
ccaccagcuucagcagccgcgg

SEQ ID NO: 361323 - RNA, 22 nt, Human
ggagccugugggaugagaugug

SEQ ID NO: 361324 - RNA, 22 nt, Human
gagggugguggcuuaaggugcu

SEQ ID NO: 361325 - RNA, 22 nt, Human
aaggcugagagucacaguccua

SEQ ID NO: 361326 - RNA, 22 nt, Human
gcaggagcagucaggggcagcu

SEQ ID NO: 361327 - RNA, 22 nt, Human
auaaauaucacuguugucccuc

SEQ ID NO: 361328 - RNA, 19 nt, Human
uggcagaggacaaggacuu

SEQ ID NO: 361329 - RNA, 22 nt, Human
aaguguguauuguuuaugcugc

SEQ ID NO: 361330 - RNA, 22 nt, Human
uuugcaaagugacuauuauaug

SEQ ID NO: 361331 - RNA, 22 nt, Human
ugggcuggcugaacuucaaccu

SEQ ID NO: 361332 - RNA, 22 nt, Human
uacauuaucuuguuaucuuuca

SEQ ID NO: 361333 - RNA, 22 nt, Human
gagccagccgcaagagcuguga

SEQ ID NO: 361334 - RNA, 22 nt, Human
uggggcuguccuuagucugaga

SEQ ID NO: 361335 - RNA, 20 nt, Human
cugcugugugugccucagcc

SEQ ID NO: 361336 - RNA, 22 nt, Human
augaaauauuucagagcagagu

SEQ ID NO: 361337 - RNA, 22 nt, Human
ugccaggcccagcuccagagcu

SEQ ID NO: 361338 - RNA, 22 nt, Human
cugaagccacgauagcuuccua

SEQ ID NO: 361339 - RNA, 22 nt, Human
acagggccucagccagggcaga

SEQ ID NO: 361340 - RNA, 22 nt, Human
agcagaaccacagcacuguuga

SEQ ID NO: 361341 - RNA, 22 nt, Human
gaggauggaggugugagcuaug

SEQ ID NO: 361342 - RNA, 22 nt, Human
gaggagaggccaucguuguuau

SEQ ID NO: 361343 - RNA, 22 nt, Human
uagaaucuaguucauucauuug

SEQ ID NO: 361344 - RNA, 22 nt, Human
auucagcaguuccugcuucagu

SEQ ID NO: 361345 - RNA, 22 nt, Human
ccugccugcggcccgcggggag

SEQ ID NO: 361346 - RNA, 22 nt, Human
agggcccauagaucgucagcuu

SEQ ID NO: 361347 - RNA, 22 nt, Human
agggcugacagugaggagucaa

SEQ ID NO: 361348 - RNA, 22 nt, Human
agcugcccuguggggaggguug

SEQ ID NO: 361349 - RNA, 18 nt, Human
gguggcucagucaugggg

SEQ ID NO: 361350 - RNA, 22 nt, Human
ugaaaaaccucaguccgcuuua

SEQ ID NO: 361351 - RNA, 22 nt, Human
cagggcucacucggcuggcguc

SEQ ID NO: 361352 - RNA, 22 nt, Human
gggcacuguguucagagugcag

SEQ ID NO: 361353 - RNA, 22 nt, Human
aagauuuccauuucuagcucau

SEQ ID NO: 361354 - RNA, 22 nt, Human
ugcugccagagagacagggacu

SEQ ID NO: 361355 - RNA, 22 nt, Human
aggagaggcucuaacucugugu

SEQ ID NO: 361356 - RNA, 18 nt, Human
agggaguuuuagggaagg

SEQ ID NO: 361357 - RNA, 23 nt, Human
ugggucagcugccuccaggacaa

SEQ ID NO: 361358 - RNA, 22 nt, Human
aacaaaugauuguugguuggag

SEQ ID NO: 361359 - RNA, 22 nt, Human
ucagaggagaaguugggaaaau

SEQ ID NO: 361360 - RNA, 22 nt, Human
aagaacugugcuccaggcucca

SEQ ID NO: 361361 - RNA, 23 nt, Human
aggaggccugaaacugaggcuga

SEQ ID NO: 361362 - RNA, 22 nt, Human
cccaaggacacgggcagggaca

SEQ ID NO: 361363 - RNA, 22 nt, Human
aaagcagguugcaauuacagug

SEQ ID NO: 361364 - RNA, 17 nt, Human
aggaaacauuuucuuuc

SEQ ID NO: 361365 - RNA, 22 nt, Human
uuggcugaagguuaagugcugg

SEQ ID NO: 361366 - RNA, 18 nt, Human
aggcacagagcauacaua

SEQ ID NO: 361367 - RNA, 22 nt, Human
aggccagggucccacacucgca

SEQ ID NO: 361368 - RNA, 22 nt, Human
agcugaggaggaaugaugggua

SEQ ID NO: 361369 - RNA, 21 nt, Human
uccugcagaaugccuuccuac

SEQ ID NO: 361370 - RNA, 22 nt, Human
gcaaaauuuacacuccuucuuc

SEQ ID NO: 361371 - RNA, 22 nt, Human
aaaaauugcugagaacggaauu

SEQ ID NO: 361372 - RNA, 22 nt, Human
caggaacagcaccaggagcuag

SEQ ID NO: 361373 - RNA, 22 nt, Human
aaaugucuuucuucugcuacgu

SEQ ID NO: 361374 - RNA, 22 nt, Human
gccacccugagcugggccaggg

SEQ ID NO: 361375 - RNA, 22 nt, Human
cauuaggguaauugaacacuua

SEQ ID NO: 361376 - RNA, 22 nt, Human
uccgccaggacugagggcccau

SEQ ID NO: 361377 - RNA, 22 nt, Human
gccacacuuauucucaugcaca

SEQ ID NO: 361378 - RNA, 22 nt, Human
gcagcuggauuucaagagggag

SEQ ID NO: 361379 - RNA, 22 nt, Human
aguuauuacucuuuaacauauu

SEQ ID NO: 361380 - RNA, 22 nt, Human
aagucuguuugagugucacacu

SEQ ID NO: 361381 - RNA, 17 nt, Human
ccucccacaccgcccug

SEQ ID NO: 361382 - RNA, 22 nt, Human
gggaggugauuaggaccaugua

SEQ ID NO: 361383 - RNA, 22 nt, Human
ucuuucaaugagcauucuuucc

SEQ ID NO: 361384 - RNA, 22 nt, Human
cacagcuucuccuugauaucgc

SEQ ID NO: 361385 - RNA, 22 nt, Human
uguacuugaacuugacuguaga

SEQ ID NO: 361386 - RNA, 16 nt, Human
aaggagggaagagaau

SEQ ID NO: 361387 - RNA, 20 nt, Human
caggccucugggggcccugg

SEQ ID NO: 361388 - RNA, 22 nt, Human
aaggcccuaauagagcacauau

SEQ ID NO: 361389 - RNA, 22 nt, Human
aggcccuguuaugagccacugu

SEQ ID NO: 361390 - RNA, 22 nt, Human
cagcagcaaaucuagaagagga

SEQ ID NO: 361391 - RNA, 22 nt, Human
aaggccaugaccacuugcugug

SEQ ID NO: 361392 - RNA, 22 nt, Human
auuguauuagcacaauacaauu

SEQ ID NO: 361393 - RNA, 22 nt, Human
aacuagaaccacuuguauuucc

SEQ ID NO: 361394 - RNA, 22 nt, Human
agugcuuuagagaaauggugcu

SEQ ID NO: 361395 - RNA, 22 nt, Human
aaagguaguacuucuagaaggg

SEQ ID NO: 361396 - RNA, 18 nt, Human
gcaggugccacugcuguu

SEQ ID NO: 361397 - RNA, 22 nt, Human
acauuucucuugaugucucuau

SEQ ID NO: 361398 - RNA, 22 nt, Human
uaaggccaggcuguggucggca

SEQ ID NO: 361399 - RNA, 22 nt, Human
accugaggccuccccagcagac

SEQ ID NO: 361400 - RNA, 22 nt, Human
gcagagcauguccucaggacag

SEQ ID NO: 361401 - RNA, 22 nt, Human
ggcuccuguggcaagacagcuu

SEQ ID NO: 361402 - RNA, 22 nt, Human
ggcagaggagcuggaaacaugg

SEQ ID NO: 361403 - RNA, 22 nt, Human
uggucagacaaaggagaauguu

SEQ ID NO: 361404 - RNA, 22 nt, Human
ccugccaggagcuggugcugca

SEQ ID NO: 361405 - RNA, 22 nt, Human
ccuuggaggacugcugcuucuu

SEQ ID NO: 361406 - RNA, 22 nt, Human
cagacuugacggcagcugcuuu

SEQ ID NO: 361407 - RNA, 22 nt, Human
uccugggcuugcuccuccagcu

SEQ ID NO: 361408 - RNA, 22 nt, Human
agaggcggagcuugcagugagc

SEQ ID NO: 361409 - RNA, 22 nt, Human
cccccaaggccaggcugagacc

SEQ ID NO: 361410 - RNA, 22 nt, Human
cugugaauuaaguauuguuauc

SEQ ID NO: 361411 - RNA, 22 nt, Human
uggaccugagccuggcccugcc

SEQ ID NO: 361412 - RNA, 22 nt, Human
ccagaggaguugaggcuuuggg

SEQ ID NO: 361413 - RNA, 22 nt, Human
gagggcagagucuaaugaugca

SEQ ID NO: 361414 - RNA, 22 nt, Human
acuguucacuagugaggguuga

SEQ ID NO: 361415 - RNA, 20 nt, Human
gucucaaguaucucacaguc

SEQ ID NO: 361416 - RNA, 22 nt, Human
auuuuuaugacaaaccauccuc

SEQ ID NO: 361417 - RNA, 19 nt, Human
aacuguaauuaauacccua

SEQ ID NO: 361418 - RNA, 22 nt, Human
cagagccauccaggugccuguu

SEQ ID NO: 361419 - RNA, 22 nt, Human
aggucaggguauucacgucugu

SEQ ID NO: 361420 - RNA, 22 nt, Human
ccuggcuccugccucugcaggg

SEQ ID NO: 361421 - RNA, 22 nt, Human
cccugcagagccagcccugacc

SEQ ID NO: 361422 - RNA, 22 nt, Human
gccuggugaaaggcagagagcg

SEQ ID NO: 361423 - RNA, 22 nt, Human
agucucagcaagcauggcuagu

SEQ ID NO: 361424 - RNA, 22 nt, Human
ucagagaggcaauacuguuuaa

SEQ ID NO: 361425 - RNA, 22 nt, Human
ucuuugcagaauuuaacuuugc

SEQ ID NO: 361426 - RNA, 22 nt, Human
cauauucuuuaagcaaugcucu

SEQ ID NO: 361427 - RNA, 22 nt, Human
caggcugcagaggccuuucaug

SEQ ID NO: 361428 - RNA, 22 nt, Human
auggacaggaacucccuuggca

SEQ ID NO: 361429 - RNA, 22 nt, Human
aagcaggauggaucuaguguuc

SEQ ID NO: 361430 - RNA, 22 nt, Human
ucuggcuccacaccucacugca

SEQ ID NO: 361431 - RNA, 22 nt, Human
uggagcugauacagcuggcuuu

SEQ ID NO: 361432 - RNA, 22 nt, Human
uccugccucuugccuucuucac

SEQ ID NO: 361433 - RNA, 22 nt, Human
uagcaucuguucuuucauuaaa

SEQ ID NO: 361434 - RNA, 22 nt, Human
cgcagagggcaggcagugcugg

SEQ ID NO: 361435 - RNA, 22 nt, Human
cagagcugugauaaauagauau

SEQ ID NO: 361436 - RNA, 22 nt, Human
uuucaaaguugggaauuguaau

SEQ ID NO: 361437 - RNA, 22 nt, Human
agcugggaggugggcagugaga

SEQ ID NO: 361438 - RNA, 22 nt, Human
ugaacgcagguccacauggcuc

SEQ ID NO: 361439 - RNA, 20 nt, Human
ucugcccaccccggcuccca

SEQ ID NO: 361440 - RNA, 22 nt, Human
ugaacccaggagguugcaguga

SEQ ID NO: 361441 - RNA, 22 nt, Human
agaaauguggaucguuuuaaaa

SEQ ID NO: 361442 - RNA, 22 nt, Human
auacaaagcuaaauaugguuuc

SEQ ID NO: 361443 - RNA, 18 nt, Human
uuucacaaccuccagagg

SEQ ID NO: 361444 - RNA, 22 nt, Human
agagccagccuucucagcuuac

SEQ ID NO: 361445 - RNA, 22 nt, Human
aggagagucuugagucacuggu

SEQ ID NO: 361446 - RNA, 22 nt, Human
uuucuguaauuaaaagggcagg

SEQ ID NO: 361447 - RNA, 22 nt, Human
gugggggcaggcagugcuagga

SEQ ID NO: 361448 - RNA, 22 nt, Human
aggcugcuggcaggcguggacg

SEQ ID NO: 361449 - RNA, 22 nt, Human
cuggaggcugaguugggucucc

SEQ ID NO: 361450 - RNA, 22 nt, Human
agcugccagcaucccggaaggg

SEQ ID NO: 361451 - RNA, 22 nt, Human
auuauccagcaccaaugucaga

SEQ ID NO: 361452 - RNA, 22 nt, Human
ugucuuuauauauuuggaaaau

SEQ ID NO: 361453 - RNA, 22 nt, Human
ucaggcugcuggccagcaggcu

SEQ ID NO: 361454 - RNA, 22 nt, Human
aauguauaaaguguuaauaacu

SEQ ID NO: 361455 - RNA, 22 nt, Human
agacucaagacugcagaagacg

SEQ ID NO: 361456 - RNA, 22 nt, Human
gagacaaaaguuggagugcaag

SEQ ID NO: 361457 - RNA, 22 nt, Human
uauuuuaaagugaagggucuug

SEQ ID NO: 361458 - RNA, 22 nt, Human
gaggcagugcauugucuagggg

SEQ ID NO: 361459 - RNA, 22 nt, Human
caggcagcucugcuuuuccuaa

SEQ ID NO: 361460 - RNA, 22 nt, Human
caggccugaguguggaagucuu

SEQ ID NO: 361461 - RNA, 22 nt, Human
acaggcaggcgggacagcccga

SEQ ID NO: 361462 - RNA, 22 nt, Human
gacagggcauggugcagaguuc

SEQ ID NO: 361463 - RNA, 22 nt, Human
ugcugugagguugagaaggaag

SEQ ID NO: 361464 - RNA, 22 nt, Human
ugaaacaagauccacagacuug

SEQ ID NO: 361465 - RNA, 22 nt, Human
ccucccacauccuagcucugcu

SEQ ID NO: 361466 - RNA, 22 nt, Human
uccacugcagcuucugauggaa

SEQ ID NO: 361467 - RNA, 22 nt, Human
cacagugcaugaugggcagaag

SEQ ID NO: 361468 - RNA, 21 nt, Human
agaauucuuaaguauucuaau

SEQ ID NO: 361469 - RNA, 18 nt, Human
ccucacagacuuccaugu

SEQ ID NO: 361470 - RNA, 22 nt, Human
agauaaaaugguucaaaggcua

SEQ ID NO: 361471 - RNA, 22 nt, Human
uugcauugcuuggucuucaaga

SEQ ID NO: 361472 - RNA, 22 nt, Human
aauaacaggcucaucagaugcu

SEQ ID NO: 361473 - RNA, 22 nt, Human
ugcuuauucuuuccacaauuca

SEQ ID NO: 361474 - RNA, 22 nt, Human
gcuguucccauguggggcucag

SEQ ID NO: 361475 - RNA, 22 nt, Human
cagcaggaagguuuccccugca

SEQ ID NO: 361476 - RNA, 22 nt, Human
ccagggcuggguuugucggugu

SEQ ID NO: 361477 - RNA, 22 nt, Human
gcauaauauacaugcuugaucc

SEQ ID NO: 361478 - RNA, 22 nt, Human
uucaggauccccuugaugggcu

SEQ ID NO: 361479 - RNA, 22 nt, Human
gaggaaaagagacagguuauug

SEQ ID NO: 361480 - RNA, 22 nt, Human
cacacauugaauucauucuugu

SEQ ID NO: 361481 - RNA, 22 nt, Human
aggucacauggauaaugaucag

SEQ ID NO: 361482 - RNA, 20 nt, Human
ucugcucagcccucaguggc

SEQ ID NO: 361483 - RNA, 22 nt, Human
gauucuuacuucuaagcaagcu

SEQ ID NO: 361484 - RNA, 22 nt, Human
gaugaggggucauuggcuggga

SEQ ID NO: 361485 - RNA, 22 nt, Human
ugcuuuauaaccauuucugugg

SEQ ID NO: 361486 - RNA, 22 nt, Human
gaaaguuucuucauuaagaugu

SEQ ID NO: 361487 - RNA, 22 nt, Human
uuuauuuaaagucguguguuaa

SEQ ID NO: 361488 - RNA, 22 nt, Human
gcuugaaaauucauagguauuu

SEQ ID NO: 361489 - RNA, 22 nt, Human
cugggccucaaucucagaguuu

SEQ ID NO: 361490 - RNA, 23 nt, Human
uguaacaauucccagccuuugcc

SEQ ID NO: 361491 - RNA, 22 nt, Human
gggaggaaaugugcagcgaauu

SEQ ID NO: 361492 - RNA, 17 nt, Human
ugagacagggcaggccc

SEQ ID NO: 361493 - RNA, 22 nt, Human
ccauggcauuuuaugugucuua

SEQ ID NO: 361494 - RNA, 22 nt, Human
cuggcagcugcccgagaugccc

SEQ ID NO: 361495 - RNA, 18 nt, Human
acagaggcagacauguau

SEQ ID NO: 361496 - RNA, 22 nt, Human
uccaggagagguagaggguucc

SEQ ID NO: 361497 - RNA, 22 nt, Human
aaugcaguuucauuuguagaau

SEQ ID NO: 361498 - RNA, 22 nt, Human
gcagaggcucuuuaaugcuuag

SEQ ID NO: 361499 - RNA, 22 nt, Human
cccaggcagugugugcaugcgu

SEQ ID NO: 361500 - RNA, 22 nt, Human
acuauacaagauuagggauuug

SEQ ID NO: 361501 - RNA, 22 nt, Human
uugguuuaggaacuggcuugga

SEQ ID NO: 361502 - RNA, 22 nt, Human
caagagcuuuagaaaugcucau

SEQ ID NO: 361503 - RNA, 22 nt, Human
ggaucugagagcaagcaggacc

SEQ ID NO: 361504 - RNA, 22 nt, Human
acuuccuguguuggucuugcug

SEQ ID NO: 361505 - RNA, 22 nt, Human
ucagcuccucaugcaggggaua

SEQ ID NO: 361506 - RNA, 22 nt, Human
gcaaauacauguugagcaccua

SEQ ID NO: 361507 - RNA, 22 nt, Human
caagagcucccagaccugggca

SEQ ID NO: 361508 - RNA, 22 nt, Human
aauuaggggaggacguaucaua

SEQ ID NO: 361509 - RNA, 22 nt, Human
ccagaggaggggggucuuucug

SEQ ID NO: 361510 - RNA, 22 nt, Human
uuuuucaucugauugauaacuc

SEQ ID NO: 361511 - RNA, 22 nt, Human
uaacagaaaggcucaggugcuc

SEQ ID NO: 361512 - RNA, 22 nt, Human
guacccaggcacgccuugcuga

SEQ ID NO: 361513 - RNA, 22 nt, Human
ugguccagacauuucugaggua

SEQ ID NO: 361514 - RNA, 22 nt, Human
cuggccgguauuugccucuggg

SEQ ID NO: 361515 - RNA, 22 nt, Human
ugugaacuggcagguggacggg

SEQ ID NO: 361516 - RNA, 22 nt, Human
aggcgugggaggaucugaggcc

SEQ ID NO: 361517 - RNA, 22 nt, Human
ccuggcaguggugaagaagagg

SEQ ID NO: 361518 - RNA, 22 nt, Human
cauggucuacaauuucauuuua

SEQ ID NO: 361519 - RNA, 22 nt, Human
uagggcucacugagaugaauau

SEQ ID NO: 361520 - RNA, 22 nt, Human
uccauuuuucaugacuccucaa

SEQ ID NO: 361521 - RNA, 22 nt, Human
uuaugcaaaggggccucuuccu

SEQ ID NO: 361522 - RNA, 20 nt, Human
agagaauucccuuuggagau

SEQ ID NO: 361523 - RNA, 22 nt, Human
augcugcacaagccacauguag

SEQ ID NO: 361524 - RNA, 22 nt, Human
uucaggaucaaguugccaguag

SEQ ID NO: 361525 - RNA, 22 nt, Human
agaauuucaaauggaaguuuua

SEQ ID NO: 361526 - RNA, 22 nt, Human
acaaaaauuagcugggcauggu

SEQ ID NO: 361527 - RNA, 22 nt, Human
agccaggaaugcaugcucugcu

SEQ ID NO: 361528 - RNA, 22 nt, Human
cccaggugggcaccucgaggaa

SEQ ID NO: 361529 - RNA, 22 nt, Human
acagaguaggugcugucgacug

SEQ ID NO: 361530 - RNA, 22 nt, Human
ugaggaaacugaggcacagaug

SEQ ID NO: 361531 - RNA, 22 nt, Human
ucuggaucgccggcgccugggc

SEQ ID NO: 361532 - RNA, 19 nt, Human
gcuuuuuguugucaaaggu

SEQ ID NO: 361533 - RNA, 22 nt, Human
cccuccccacaaagcuucacac

SEQ ID NO: 361534 - RNA, 22 nt, Human
uauugacaauaggcaacugagg

SEQ ID NO: 361535 - RNA, 22 nt, Human
cuggagccauguauagccuaug

SEQ ID NO: 361536 - RNA, 22 nt, Human
ccuuucucauuuuaagcauuag

SEQ ID NO: 361537 - RNA, 22 nt, Human
cagacaugauguaagcagaggc

SEQ ID NO: 361538 - RNA, 22 nt, Human
gugaggcagagaugccaaaacu

SEQ ID NO: 361539 - RNA, 22 nt, Human
uucuuacagcccuauuacuaaa

SEQ ID NO: 361540 - RNA, 22 nt, Human
caugggcuacagaagcaugcug

SEQ ID NO: 361541 - RNA, 22 nt, Human
gacaggaggcagagcucaggug

SEQ ID NO: 361542 - RNA, 22 nt, Human
cugucuguucagauucauuacu

SEQ ID NO: 361543 - RNA, 22 nt, Human
cugggguggaggagcuccccug

SEQ ID NO: 361544 - RNA, 22 nt, Human
agccauuuuccugaaauauaac

SEQ ID NO: 361545 - RNA, 20 nt, Human
agggcagagggauuacaggc

SEQ ID NO: 361546 - RNA, 20 nt, Human
uggagcuccagcguccaugu

SEQ ID NO: 361547 - RNA, 21 nt, Human
uggccucccacacuuccaugg

SEQ ID NO: 361548 - RNA, 22 nt, Human
caucagaaccagcugggugagg

SEQ ID NO: 361549 - RNA, 20 nt, Human
ucucugcuguccacauuugc

SEQ ID NO: 361550 - RNA, 22 nt, Human
auacaacuuuaucuguaaugag

SEQ ID NO: 361551 - RNA, 22 nt, Human
ccaggcagccaagugugugugu

SEQ ID NO: 361552 - RNA, 18 nt, Human
aucuuuccauagcauguu

SEQ ID NO: 361553 - RNA, 22 nt, Human
gcccaggaguuggaggcugcag

SEQ ID NO: 361554 - RNA, 22 nt, Human
agauacauagcugugagcacac

SEQ ID NO: 361555 - RNA, 22 nt, Human
aguuuguaucaauuugcuuuau

SEQ ID NO: 361556 - RNA, 22 nt, Human
gggcagccucggugccugcugc

SEQ ID NO: 361557 - RNA, 22 nt, Human
caaaggcuuccacugcauccuu

SEQ ID NO: 361558 - RNA, 22 nt, Human
cucagagagggcaccagggcca

SEQ ID NO: 361559 - RNA, 22 nt, Human
gggagguucuguucgcacuuga

SEQ ID NO: 361560 - RNA, 22 nt, Human
cacagcagagggagccauugaa

SEQ ID NO: 361561 - RNA, 22 nt, Human
gaaggccacaagagaaguuaag

SEQ ID NO: 361562 - RNA, 22 nt, Human
caggagccagcugucccaacca

SEQ ID NO: 361563 - RNA, 22 nt, Human
agagguagagguugcagugagc

SEQ ID NO: 361564 - RNA, 22 nt, Human
gcagugaaucuggcaagaauuu

SEQ ID NO: 361565 - RNA, 22 nt, Human
agggacccugaugacugaggag

SEQ ID NO: 361566 - RNA, 22 nt, Human
ucagaagagcuggugcugccug

SEQ ID NO: 361567 - RNA, 22 nt, Human
uagucucuggagacucuagggg

SEQ ID NO: 361568 - RNA, 22 nt, Human
ucucuggaauuggcugaggcaa

SEQ ID NO: 361569 - RNA, 22 nt, Human
caggcugggcuccggagauaaa

SEQ ID NO: 361570 - RNA, 22 nt, Human
agcuuuauauaaaagaguacau

SEQ ID NO: 361571 - RNA, 22 nt, Human
uuagaaacccagacucuuaggu

SEQ ID NO: 361572 - RNA, 22 nt, Human
uuuaggcagcacgggcagcccu

SEQ ID NO: 361573 - RNA, 22 nt, Human
gcagaauugauggagaacuuaa

SEQ ID NO: 361574 - RNA, 22 nt, Human
caggaaagagcugccaggcagg

SEQ ID NO: 361575 - RNA, 22 nt, Human
agcagagcgccugcucagaggg

SEQ ID NO: 361576 - RNA, 22 nt, Human
gaucugaaucaauagaauaacu

SEQ ID NO: 361577 - RNA, 22 nt, Human
ugggaggcuuccagaccuugcu

SEQ ID NO: 361578 - RNA, 22 nt, Human
ugcuucaaguugaaauauucuu

SEQ ID NO: 361579 - RNA, 22 nt, Human
auuuucauggcuucugcucagu

SEQ ID NO: 361580 - RNA, 22 nt, Human
gcucccacugcagcccugagcc

SEQ ID NO: 361581 - RNA, 22 nt, Human
gcucccaggaugaggagccagg

SEQ ID NO: 361582 - RNA, 22 nt, Human
cggcagcuccgcgccguaggac

SEQ ID NO: 361583 - RNA, 22 nt, Human
guaagagcacugucuccugcug

SEQ ID NO: 361584 - RNA, 22 nt, Human
uuagaaaggagcuuauuucuuu

SEQ ID NO: 361585 - RNA, 22 nt, Human
caggcagagcaacugguccaga

SEQ ID NO: 361586 - RNA, 22 nt, Human
uauguacagggauagaacuuga

SEQ ID NO: 361587 - RNA, 22 nt, Human
uacauucuacuuuuucacuccc

SEQ ID NO: 361588 - RNA, 22 nt, Human
cuccaggggccagaagccuggc

SEQ ID NO: 361589 - RNA, 19 nt, Human
ccaggccaucccaguuccc

SEQ ID NO: 361590 - RNA, 22 nt, Human
agcccagguucuaaagccaaac

SEQ ID NO: 361591 - RNA, 22 nt, Human
aucagaaaauacccaguguuua

SEQ ID NO: 361592 - RNA, 22 nt, Human
auguucuuucagccagugcauc

SEQ ID NO: 361593 - RNA, 22 nt, Human
aagcccagaugggagcauuuca

SEQ ID NO: 361594 - RNA, 22 nt, Human
cuucccacagaauucaaucagu

SEQ ID NO: 361595 - RNA, 22 nt, Human
ccauaagguuuggggccaugca

SEQ ID NO: 361596 - RNA, 20 nt, Human
uccagcugggaacagcugau

SEQ ID NO: 361597 - RNA, 22 nt, Human
auggaucacagugccgugggug

SEQ ID NO: 361598 - RNA, 22 nt, Human
cuuauguauauuuggaacguac

SEQ ID NO: 361599 - RNA, 22 nt, Human
cccuguacagucucuguggcac

SEQ ID NO: 361600 - RNA, 22 nt, Human
uacugaaaguggucaacagugg

SEQ ID NO: 361601 - RNA, 22 nt, Human
uuucaaauaccauaaaccuaau

SEQ ID NO: 361602 - RNA, 22 nt, Human
gagccauacaaccuauaaagug

SEQ ID NO: 361603 - RNA, 22 nt, Human
agccuggaguucccaggagaag

SEQ ID NO: 361604 - RNA, 23 nt, Human
uggcuucugccccauucucucca

SEQ ID NO: 361605 - RNA, 22 nt, Human
caggcagagaggagcauuuaau

SEQ ID NO: 361606 - RNA, 22 nt, Human
aaagccacguggccuggggagc

SEQ ID NO: 361607 - RNA, 22 nt, Human
ucuguucaguugauguaguuuu

SEQ ID NO: 361608 - RNA, 22 nt, Human
cugagagguaagcagcgcagug

SEQ ID NO: 361609 - RNA, 22 nt, Human
uccaggagacacccuugugugu

SEQ ID NO: 361610 - RNA, 22 nt, Human
aauuaguauugcgauucauuag

SEQ ID NO: 361611 - RNA, 21 nt, Human
agaagccuggguggagguggg

SEQ ID NO: 361612 - RNA, 18 nt, Human
ggcaugugagugcugagg

SEQ ID NO: 361613 - RNA, 22 nt, Human
caaggaaaacagaugaucaaca

SEQ ID NO: 361614 - RNA, 22 nt, Human
ucccagcauaacaaacugcccg

SEQ ID NO: 361615 - RNA, 22 nt, Human
uaggcucagggcugggugacgg

SEQ ID NO: 361616 - RNA, 22 nt, Human
uucaggaugcagagguuguagu

SEQ ID NO: 361617 - RNA, 22 nt, Human
uaguuaggguucugcagagaca

SEQ ID NO: 361618 - RNA, 22 nt, Human
cagaagcagugagagaugugca

SEQ ID NO: 361619 - RNA, 22 nt, Human
ggcugcaggcagaggcugucug

SEQ ID NO: 361620 - RNA, 22 nt, Human
cagggccuccccggcagucuuu

SEQ ID NO: 361621 - RNA, 22 nt, Human
acugaaggaaacuuuuguguuu

SEQ ID NO: 361622 - RNA, 22 nt, Human
ucccaggacaugggcucugcuc

SEQ ID NO: 361623 - RNA, 22 nt, Human
acagagcugggugcccccugga

SEQ ID NO: 361624 - RNA, 22 nt, Human
aggcaggcuggucugaagagug

SEQ ID NO: 361625 - RNA, 22 nt, Human
uucuucucucauagauuaaggu

SEQ ID NO: 361626 - RNA, 22 nt, Human
ucaggggagguugaaucgucuc

SEQ ID NO: 361627 - RNA, 22 nt, Human
gcagagccgugaauggauuuca

SEQ ID NO: 361628 - RNA, 22 nt, Human
gauuucaaagguucugcaugcc

SEQ ID NO: 361629 - RNA, 22 nt, Human
cauugaaauauggaaacugaug

SEQ ID NO: 361630 - RNA, 22 nt, Human
cugcccugcuugaugacagcga

SEQ ID NO: 361631 - RNA, 22 nt, Human
uccaguggcaccuuggcccuca

SEQ ID NO: 361632 - RNA, 22 nt, Human
ggccugugucugugccuguccu

SEQ ID NO: 361633 - RNA, 22 nt, Human
gcagcuggcccugacacgcaga

SEQ ID NO: 361634 - RNA, 22 nt, Human
ccugucugcagauaucucaggu

SEQ ID NO: 361635 - RNA, 21 nt, Human
cagagcuguccaaacccugac

SEQ ID NO: 361636 - RNA, 21 nt, Human
ccagcuuucccaagucccuuu

SEQ ID NO: 361637 - RNA, 22 nt, Human
gcugccugggcaggaggcgcug

SEQ ID NO: 361638 - RNA, 22 nt, Human
aucugcagaggacaggcgagga

SEQ ID NO: 361639 - RNA, 22 nt, Human
aguccaaggagagacagcauuu

SEQ ID NO: 361640 - RNA, 22 nt, Human
agccaggcugcaguuggcuggc

SEQ ID NO: 361641 - RNA, 22 nt, Human
uuucaaagaccauuaacuauca

SEQ ID NO: 361642 - RNA, 22 nt, Human
cugcuccacaccuccauuuccu

SEQ ID NO: 361643 - RNA, 18 nt, Human
ggcuguggacaagauuag

SEQ ID NO: 361644 - RNA, 22 nt, Human
gccugagccgccugagcggcgg

SEQ ID NO: 361645 - RNA, 22 nt, Human
agggcugagcccaggcauguag

SEQ ID NO: 361646 - RNA, 22 nt, Human
gggcuccagcccgggaccaggu

SEQ ID NO: 361647 - RNA, 22 nt, Human
caguuuuuagauuaguuggugg

SEQ ID NO: 361648 - RNA, 22 nt, Human
ucucaggggccuggaguccugg

SEQ ID NO: 361649 - RNA, 22 nt, Human
gaauuucacaaggugaggauaa

SEQ ID NO: 361650 - RNA, 22 nt, Human
gcgucugaguugcgggggcuca

SEQ ID NO: 361651 - RNA, 22 nt, Human
aaagaaauagauggcauuuaaa

SEQ ID NO: 361652 - RNA, 22 nt, Human
agggucugacuccucuggcaag

SEQ ID NO: 361653 - RNA, 22 nt, Human
ccacccagcagaggaggcaaga

SEQ ID NO: 361654 - RNA, 22 nt, Human
ugaggcuccagccaggccagca

SEQ ID NO: 361655 - RNA, 22 nt, Human
auucuggauuaucaguccacca

SEQ ID NO: 361656 - RNA, 22 nt, Human
cagggugccuguccucagcaaa

SEQ ID NO: 361657 - RNA, 22 nt, Human
agaaagcuuaugaaugggcaag

SEQ ID NO: 361658 - RNA, 22 nt, Human
cucaggauagcugcgcagccug

SEQ ID NO: 361659 - RNA, 22 nt, Human
uuucugaagggcagcagacucu

SEQ ID NO: 361660 - RNA, 22 nt, Human
acugugcacaauucuaaguccu

SEQ ID NO: 361661 - RNA, 18 nt, Human
agaggggagguaagucug

SEQ ID NO: 361662 - RNA, 22 nt, Human
ggaggccagggacccagucagc

SEQ ID NO: 361663 - RNA, 22 nt, Human
acagaggcagugugagauacug

SEQ ID NO: 361664 - RNA, 22 nt, Human
ccugggaguggcacucacagca

SEQ ID NO: 361665 - RNA, 19 nt, Human
gcaucagagcagaaggggu

SEQ ID NO: 361666 - RNA, 21 nt, Human
uggcacugcuuagcagguucc

SEQ ID NO: 361667 - RNA, 22 nt, Human
uggguagagacacagucugggg

SEQ ID NO: 361668 - RNA, 23 nt, Human
ugccucugccucccuagucugca

SEQ ID NO: 361669 - RNA, 22 nt, Human
ugagaaaagguugagaugauaa

SEQ ID NO: 361670 - RNA, 22 nt, Human
uggguagaggaauugggcuacc

SEQ ID NO: 361671 - RNA, 22 nt, Human
cgggcagcggcguggccauggu

SEQ ID NO: 361672 - RNA, 22 nt, Human
uaaaucccuacaucuguguuuu

SEQ ID NO: 361673 - RNA, 22 nt, Human
ccugcagguugcagaggcggaa

SEQ ID NO: 361674 - RNA, 22 nt, Human
caggauccuggcugcauggacg

SEQ ID NO: 361675 - RNA, 22 nt, Human
uggcuuccugcauggauccucu

SEQ ID NO: 361676 - RNA, 22 nt, Human
augcuuaagcucaguuauauau

SEQ ID NO: 361677 - RNA, 20 nt, Human
aggcagagcgcacuuuuaga

SEQ ID NO: 361678 - RNA, 22 nt, Human
auuuugaaaccaaguuauuucc

SEQ ID NO: 361679 - RNA, 22 nt, Human
ccacagaguuacaaaacaguca

SEQ ID NO: 361680 - RNA, 22 nt, Human
aggcagcagggccacuggcuga

SEQ ID NO: 361681 - RNA, 22 nt, Human
gucugucaucugagauggagug

SEQ ID NO: 361682 - RNA, 22 nt, Human
ucagaggacaagcucccuggug

SEQ ID NO: 361683 - RNA, 22 nt, Human
ggcuccugauaggagaaugcgg

SEQ ID NO: 361684 - RNA, 22 nt, Human
gaaaggugccccauaggcagga

SEQ ID NO: 361685 - RNA, 22 nt, Human
caauuucagugcuguggagagg

SEQ ID NO: 361686 - RNA, 19 nt, Human
cccaggagucuggcugguu

SEQ ID NO: 361687 - RNA, 19 nt, Human
ggagaagcccaggaauccu

SEQ ID NO: 361688 - RNA, 22 nt, Human
ucagucucaucaacucuauucc

SEQ ID NO: 361689 - RNA, 22 nt, Human
ggccaugguuggggaagacaug

SEQ ID NO: 361690 - RNA, 22 nt, Human
ucucuuaauuuuggaauagugu

SEQ ID NO: 361691 - RNA, 22 nt, Human
auuccaaacgccucgcggacuu

SEQ ID NO: 361692 - RNA, 22 nt, Human
cagagugaaaacugagcucaaa

SEQ ID NO: 361693 - RNA, 22 nt, Human
ucacagacauggugagguaaca

SEQ ID NO: 361694 - RNA, 22 nt, Human
guaaacauuacugugcuguaua

SEQ ID NO: 361695 - RNA, 18 nt, Human
aagaggaggagcagguug

SEQ ID NO: 361696 - RNA, 17 nt, Human
uuuucucucuuggauuc

SEQ ID NO: 361697 - RNA, 22 nt, Human
cccagcaucccagugggcagca

SEQ ID NO: 361698 - RNA, 23 nt, Human
caauuucauaugauucuaccuaa

SEQ ID NO: 361699 - RNA, 23 nt, Human
aaucuggcugauguuuuuucucu

SEQ ID NO: 361700 - RNA, 22 nt, Human
acccugggcuuggccugcucag

SEQ ID NO: 361701 - RNA, 22 nt, Human
gagaggccauggcugugcagug

SEQ ID NO: 361702 - RNA, 22 nt, Human
agcugguguccuccuggagcug

SEQ ID NO: 361703 - RNA, 22 nt, Human
cccagcagaaucugaugagggc

SEQ ID NO: 361704 - RNA, 22 nt, Human
uauuucagcccuacuacuuggc

SEQ ID NO: 361705 - RNA, 22 nt, Human
uuucacauguggaaugccaggu

SEQ ID NO: 361706 - RNA, 22 nt, Human
cagaauaaagguacaauugagu

SEQ ID NO: 361707 - RNA, 22 nt, Human
gaccauuuuuacagagcauuca

SEQ ID NO: 361708 - RNA, 22 nt, Human
ggccauggaccccgagcugacc

SEQ ID NO: 361709 - RNA, 22 nt, Human
ccagggccaguaagauuggcau

SEQ ID NO: 361710 - RNA, 22 nt, Human
cauagaaaucaggugagaaucu

SEQ ID NO: 361711 - RNA, 19 nt, Human
cuggaaugagaacaugccc

SEQ ID NO: 361712 - RNA, 18 nt, Human
ucugucucuguccuugcu

SEQ ID NO: 361713 - RNA, 22 nt, Human
gcucuggcuacuguggcuaccg

SEQ ID NO: 361714 - RNA, 20 nt, Human
ggcugugcccuuccguggcc

SEQ ID NO: 361715 - RNA, 22 nt, Human
acaguuugcccugacauucucc

SEQ ID NO: 361716 - RNA, 22 nt, Human
ucagagagguuggugauaagaa

SEQ ID NO: 361717 - RNA, 20 nt, Human
agaggcuuccuugggaggag

SEQ ID NO: 361718 - RNA, 22 nt, Human
aaguucaauggaaaagcuuuag

SEQ ID NO: 361719 - RNA, 20 nt, Human
ccuggcugcauucaggacgg

SEQ ID NO: 361720 - RNA, 22 nt, Human
gcucuggagauggagccuugag

SEQ ID NO: 361721 - RNA, 18 nt, Human
gggaagccgggaagccgg

SEQ ID NO: 361722 - RNA, 18 nt, Human
uuaagagcugaaagggga

SEQ ID NO: 361723 - RNA, 22 nt, Human
cucaggcuugggaggaggccca

SEQ ID NO: 361724 - RNA, 22 nt, Human
accaugaugggaagcucagggc

SEQ ID NO: 361725 - RNA, 22 nt, Human
ucagggugaaccaggcaggaau

SEQ ID NO: 361726 - RNA, 22 nt, Human
agccuccaaaugucaggucccg

SEQ ID NO: 361727 - RNA, 20 nt, Human
ugcccagcaagagugcaguu

SEQ ID NO: 361728 - RNA, 22 nt, Human
uccagccaccaccuugauugcc

SEQ ID NO: 361729 - RNA, 22 nt, Human
ugggagaagcagcagccaagug

SEQ ID NO: 361730 - RNA, 22 nt, Human
uucuggagcuaaaguccacucu

SEQ ID NO: 361731 - RNA, 22 nt, Human
ccagggugagugucauggguua

SEQ ID NO: 361732 - RNA, 22 nt, Human
uaaggcacacaguugcugcaug

SEQ ID NO: 361733 - RNA, 22 nt, Human
ccccagcucagugcagggacau

SEQ ID NO: 361734 - RNA, 23 nt, Human
ggagccuggcauaugagacgcau

SEQ ID NO: 361735 - RNA, 22 nt, Human
ggcucugguugaccaugauggc

SEQ ID NO: 361736 - RNA, 19 nt, Human
uacauacuuauucuaaaag

SEQ ID NO: 361737 - RNA, 22 nt, Human
uugauuaaacaggcauauucaa

SEQ ID NO: 361738 - RNA, 22 nt, Human
uuucuuaguccuagagugauuu

SEQ ID NO: 361739 - RNA, 22 nt, Human
uccucuucugcccaucagaggc

SEQ ID NO: 361740 - RNA, 22 nt, Human
ccaggcagagggaauagcaagu

SEQ ID NO: 361741 - RNA, 23 nt, Human
uggcaccaggcauucuaggggua

SEQ ID NO: 361742 - RNA, 22 nt, Human
cuauuaggcuuccauuucaugc

SEQ ID NO: 361743 - RNA, 23 nt, Human
uccaggagaauuccagggcccgg

SEQ ID NO: 361744 - RNA, 19 nt, Human
agauuuaccucauauaguu

SEQ ID NO: 361745 - RNA, 20 nt, Human
gcagcugcccccagucccug

SEQ ID NO: 361746 - RNA, 22 nt, Human
cagggcucuucaucacacagua

SEQ ID NO: 361747 - RNA, 22 nt, Human
uggcagggccugcucaucaucc

SEQ ID NO: 361748 - RNA, 19 nt, Human
cagauguuuucaguucauu

SEQ ID NO: 361749 - RNA, 19 nt, Human
ugucacugucauggcccag

SEQ ID NO: 361750 - RNA, 22 nt, Human
guccuggggauacagaagugaa

SEQ ID NO: 361751 - RNA, 22 nt, Human
cuuagaaaugcagauucucagg

SEQ ID NO: 361752 - RNA, 22 nt, Human
gcuguggccaacaaaccacuuu

SEQ ID NO: 361753 - RNA, 23 nt, Human
uuacagaaaguaugcuuuuguuu

SEQ ID NO: 361754 - RNA, 22 nt, Human
cccaggagacagaaacagaggu

SEQ ID NO: 361755 - RNA, 22 nt, Human
uggugccuugggccuacagcgc

SEQ ID NO: 361756 - RNA, 22 nt, Human
cagcuucucagaaagcugaggu

SEQ ID NO: 361757 - RNA, 22 nt, Human
agaaaugcucaggucaacuuaa

SEQ ID NO: 361758 - RNA, 22 nt, Human
gagaaguuucugguuugcauag

SEQ ID NO: 361759 - RNA, 22 nt, Human
uaauuauagccgcuauuuugcu

SEQ ID NO: 361760 - RNA, 22 nt, Human
gagggauggugugagaggcuca

SEQ ID NO: 361761 - RNA, 22 nt, Human
cagggcccauggcucagguagg

SEQ ID NO: 361762 - RNA, 20 nt, Human
aggccaggaaauguaguucu

SEQ ID NO: 361763 - RNA, 17 nt, Human
ggagagugggaauggcc

SEQ ID NO: 361764 - RNA, 22 nt, Human
cggcugagcagugcugauggaa

SEQ ID NO: 361765 - RNA, 22 nt, Human
ucccagauuguugauggcuuaa

SEQ ID NO: 361766 - RNA, 22 nt, Human
cagcucucuaaggucuugcuuu

SEQ ID NO: 361767 - RNA, 22 nt, Human
aaaucauguuggcacaauaaaa

SEQ ID NO: 361768 - RNA, 22 nt, Human
aacacuuugggcauggccuucc

SEQ ID NO: 361769 - RNA, 22 nt, Human
ucugaaaugcaaauuugacuga

SEQ ID NO: 361770 - RNA, 22 nt, Human
cuuccuguugucacagucugcg

SEQ ID NO: 361771 - RNA, 22 nt, Human
cuuaauuuaagccuagaaugca

SEQ ID NO: 361772 - RNA, 22 nt, Human
ggccaccuuccaguugccugca

SEQ ID NO: 361773 - RNA, 22 nt, Human
agcugcuguccuaggcacugua

SEQ ID NO: 361774 - RNA, 22 nt, Human
gaauacaugauacaugaacugc

SEQ ID NO: 361775 - RNA, 22 nt, Human
cucuucuugcuagacugagugc

SEQ ID NO: 361776 - RNA, 22 nt, Human
uccuggcccggccgggccugcu

SEQ ID NO: 361777 - RNA, 17 nt, Human
uucucuuccuggauagu

SEQ ID NO: 361778 - RNA, 22 nt, Human
cugcugagcccuggcacaggug

SEQ ID NO: 361779 - RNA, 22 nt, Human
gggacuucauagcuaggcacuu

SEQ ID NO: 361780 - RNA, 22 nt, Human
cagagacauucaguaaauuauc

SEQ ID NO: 361781 - RNA, 22 nt, Human
gcacacaguauaugcucauuaa

SEQ ID NO: 361782 - RNA, 19 nt, Human
uaaaaugucuguggucagu

SEQ ID NO: 361783 - RNA, 22 nt, Human
cucccagguuccgacgccucuu

SEQ ID NO: 361784 - RNA, 22 nt, Human
ugccaggcuaaguggaggacuu

SEQ ID NO: 361785 - RNA, 22 nt, Human
agaugcuucaguguuuaauuua

SEQ ID NO: 361786 - RNA, 22 nt, Human
guucauuuaugauguaacaugu

SEQ ID NO: 361787 - RNA, 18 nt, Human
caauuucaauggucugaa

SEQ ID NO: 361788 - RNA, 22 nt, Human
uggugcaagucucugaggaggg

SEQ ID NO: 361789 - RNA, 18 nt, Human
agaugaaagcaaaugaca

SEQ ID NO: 361790 - RNA, 22 nt, Human
ucuggcucugacacuacuguua

SEQ ID NO: 361791 - RNA, 22 nt, Human
aaucagcuaaauaaacuaguca

SEQ ID NO: 361792 - RNA, 22 nt, Human
ggcacugagaacaggcugacuu

SEQ ID NO: 361793 - RNA, 22 nt, Human
ucucccaguggugcagaaagca

SEQ ID NO: 361794 - RNA, 22 nt, Human
auaagagcuagucuuuuccuug

SEQ ID NO: 361795 - RNA, 22 nt, Human
aggaggggcauagaaauguaau

SEQ ID NO: 361796 - RNA, 22 nt, Human
uucuguguggguagcuccuguu

SEQ ID NO: 361797 - RNA, 20 nt, Human
ugcucugucuaaaacuuccc

SEQ ID NO: 361798 - RNA, 22 nt, Human
ucaggauccauagacucccaaa

SEQ ID NO: 361799 - RNA, 22 nt, Human
gagucaccuugggucagcgaua

SEQ ID NO: 361800 - RNA, 22 nt, Human
aaguccuuuccaguccugugau

SEQ ID NO: 361801 - RNA, 23 nt, Human
auuucuaggggauuuucuggugc

SEQ ID NO: 361802 - RNA, 22 nt, Human
auuucaacacuuuuggaauuag

SEQ ID NO: 361803 - RNA, 22 nt, Human
ucccagagacagagccuccucc

SEQ ID NO: 361804 - RNA, 22 nt, Human
gaggccugguagccgagcccca

SEQ ID NO: 361805 - RNA, 20 nt, Human
uucuauacauaucacugaaa

SEQ ID NO: 361806 - RNA, 22 nt, Human
agauguuccagccaaugggaau

SEQ ID NO: 361807 - RNA, 22 nt, Human
uagaauaaguugaugauauaug

SEQ ID NO: 361808 - RNA, 22 nt, Human
ugggcucugcugcguaccaguu

SEQ ID NO: 361809 - RNA, 22 nt, Human
ucucagagcucacaccuccugg

SEQ ID NO: 361810 - RNA, 22 nt, Human
ugcucugguccucccucggcgc

SEQ ID NO: 361811 - RNA, 22 nt, Human
agagacaggguuuugucguguu

SEQ ID NO: 361812 - RNA, 22 nt, Human
cugugcagcuggcuuccuggaa

SEQ ID NO: 361813 - RNA, 22 nt, Human
ggcaccuggauguagcagugaa

SEQ ID NO: 361814 - RNA, 23 nt, Human
agcccagcagagaaccuaggucc

SEQ ID NO: 361815 - RNA, 22 nt, Human
uuguauuagcuguaaauuuucu

SEQ ID NO: 361816 - RNA, 22 nt, Human
acagcuuuuaugggaccagcca

SEQ ID NO: 361817 - RNA, 20 nt, Human
acauccuggugacuagaacu

SEQ ID NO: 361818 - RNA, 22 nt, Human
cagcuauuuucucauuaaggau

SEQ ID NO: 361819 - RNA, 22 nt, Human
cucagagaggcaguggaaguca

SEQ ID NO: 361820 - RNA, 22 nt, Human
gcuuagucaauuauaaauaggc

SEQ ID NO: 361821 - RNA, 22 nt, Human
ggcagcaguccauggcccaagg

SEQ ID NO: 361822 - RNA, 21 nt, Human
auucagaaagggaauaaacuc

SEQ ID NO: 361823 - RNA, 22 nt, Human
acacaaguucuaaagauugcgc

SEQ ID NO: 361824 - RNA, 22 nt, Human
ggcaggugcaccugagccaucu

SEQ ID NO: 361825 - RNA, 22 nt, Human
ugaagcccugugucagcuucca

SEQ ID NO: 361826 - RNA, 22 nt, Human
ccugggaggcugugggucugcu

SEQ ID NO: 361827 - RNA, 22 nt, Human
uaaguucagaguucucauuugu

SEQ ID NO: 361828 - RNA, 22 nt, Human
ugccauuuugagauguuaauga

SEQ ID NO: 361829 - RNA, 22 nt, Human
ucuucucuccugcuuggcagaa

SEQ ID NO: 361830 - RNA, 23 nt, Human
ucagagaaguuguaggcugggga

SEQ ID NO: 361831 - RNA, 22 nt, Human
cagggcaggaugcugugauuau

SEQ ID NO: 361832 - RNA, 22 nt, Human
gaggcagagguuguugcaguga

SEQ ID NO: 361833 - RNA, 22 nt, Human
agagaauuuuaaaagccuugaa

SEQ ID NO: 361834 - RNA, 23 nt, Human
uugucugugcuuuuccaguugcu

SEQ ID NO: 361835 - RNA, 22 nt, Human
uaggcagccagcaucaguuggg

SEQ ID NO: 361836 - RNA, 22 nt, Human
aacaguaaugugguguuggguu

SEQ ID NO: 361837 - RNA, 22 nt, Human
ggcaggcaagucugcucuguga

SEQ ID NO: 361838 - RNA, 22 nt, Human
ugccugucuuggaguccuggcc

SEQ ID NO: 361839 - RNA, 22 nt, Human
uaaaugugggggccacgggcuu

SEQ ID NO: 361840 - RNA, 21 nt, Human
uuucagaccuaucuuugaagg

SEQ ID NO: 361841 - RNA, 22 nt, Human
gucauuguguggacauggagaa

SEQ ID NO: 361842 - RNA, 22 nt, Human
gcagcugcaggcaggcuugcug

SEQ ID NO: 361843 - RNA, 22 nt, Human
cagagcagagugauuguucugg

SEQ ID NO: 361844 - RNA, 22 nt, Human
ucucagggcagcaaggaagcau

SEQ ID NO: 361845 - RNA, 20 nt, Human
gccugagcuccgccuccugu

SEQ ID NO: 361846 - RNA, 22 nt, Human
uuaaaugaggcugauguagauu

SEQ ID NO: 361847 - RNA, 22 nt, Human
ugggcucugcaucagugcccau

SEQ ID NO: 361848 - RNA, 22 nt, Human
agggccaggaucacagccaaga

SEQ ID NO: 361849 - RNA, 22 nt, Human
cccuggcauaaaacuucuccag

SEQ ID NO: 361850 - RNA, 22 nt, Human
ggccucugcccucacuccuguc

SEQ ID NO: 361851 - RNA, 22 nt, Human
guccagagauggacgagcagau

SEQ ID NO: 361852 - RNA, 22 nt, Human
agacagcaugauacaugaugcu

SEQ ID NO: 361853 - RNA, 22 nt, Human
guaaacauuuucaucugugccc

SEQ ID NO: 361854 - RNA, 22 nt, Human
agcuguggaagacugucagggu

SEQ ID NO: 361855 - RNA, 22 nt, Human
gcucaggaucccaggggugugc

SEQ ID NO: 361856 - RNA, 22 nt, Human
caaggaaacaugaaaugcauug

SEQ ID NO: 361857 - RNA, 22 nt, Human
gaggggcuggguagggcaaccc

SEQ ID NO: 361858 - RNA, 22 nt, Human
agugcugucccgacaacugagg

SEQ ID NO: 361859 - RNA, 22 nt, Human
cauagaaacuugcagcaagcac

SEQ ID NO: 361860 - RNA, 22 nt, Human
acagaacugggggcacagauag

SEQ ID NO: 361861 - RNA, 22 nt, Human
uauagccauuuccaguggcauc

SEQ ID NO: 361862 - RNA, 22 nt, Human
ccacagagcauuagauuucaga

SEQ ID NO: 361863 - RNA, 22 nt, Human
agagcuggaaucagaccucagg

SEQ ID NO: 361864 - RNA, 22 nt, Human
agagccagagaccuggguucac

SEQ ID NO: 361865 - RNA, 22 nt, Human
gguguccaucaggcugugcuuc

SEQ ID NO: 361866 - RNA, 17 nt, Human
agagagagcaugccacc

SEQ ID NO: 361867 - RNA, 22 nt, Human
uuuccucuaaacgcauuugcuu

SEQ ID NO: 361868 - RNA, 22 nt, Human
auuuacagaagcauguaauagc

SEQ ID NO: 361869 - RNA, 19 nt, Human
cucuuaaauugucucuugc

SEQ ID NO: 361870 - RNA, 22 nt, Human
acaacaaagacacuugaaauga

SEQ ID NO: 361871 - RNA, 22 nt, Human
cccaggcagcggggucuccuug

SEQ ID NO: 361872 - RNA, 22 nt, Human
gaggcagcaauaaaaagaauuu

SEQ ID NO: 361873 - RNA, 22 nt, Human
ggggauggauuccgggucccug

SEQ ID NO: 361874 - RNA, 22 nt, Human
gccuggcaaggcccuguugacu

SEQ ID NO: 361875 - RNA, 21 nt, Human
aggcccagagucuugggggga

SEQ ID NO: 361876 - RNA, 22 nt, Human
cagaaguaagauuacugugagu

SEQ ID NO: 361877 - RNA, 22 nt, Human
agggaggaucugcuccuugucu

SEQ ID NO: 361878 - RNA, 19 nt, Human
agcagccaucgaccaugga

SEQ ID NO: 361879 - RNA, 20 nt, Human
caggagggacauuucagcau

SEQ ID NO: 361880 - RNA, 22 nt, Human
cucuaauccuuugucccugggu

SEQ ID NO: 361881 - RNA, 22 nt, Human
ugcagggauuguuggcauccau

SEQ ID NO: 361882 - RNA, 22 nt, Human
auuagagguacaaaccuucacu

SEQ ID NO: 361883 - RNA, 22 nt, Human
uaugaacuuuugaugugacaug

SEQ ID NO: 361884 - RNA, 22 nt, Human
aggggcucaaagugugcaggga

SEQ ID NO: 361885 - RNA, 22 nt, Human
auaucacaguaguuguuuaguu

SEQ ID NO: 361886 - RNA, 22 nt, Human
caggccucccggugcacacuga

SEQ ID NO: 361887 - RNA, 22 nt, Human
ggaaggucgagcugcaucuggc

SEQ ID NO: 361888 - RNA, 22 nt, Human
uagcagggguagauagagugug

SEQ ID NO: 361889 - RNA, 20 nt, Human
cacaagagaauacacacugg

SEQ ID NO: 361890 - RNA, 23 nt, Human
uuuggacuugugacucuucuccu

SEQ ID NO: 361891 - RNA, 22 nt, Human
uggcagcuggaucccaaggcag

SEQ ID NO: 361892 - RNA, 22 nt, Human
gugucccaggccucuggaauua

SEQ ID NO: 361893 - RNA, 22 nt, Human
gaggaagggcugccugccgggc

SEQ ID NO: 361894 - RNA, 22 nt, Human
gcacuaaaccaacauguaauaa

SEQ ID NO: 361895 - RNA, 22 nt, Human
agcaauaugacauugcuacauc

SEQ ID NO: 361896 - RNA, 22 nt, Human
gguucacauauugagaguauuc

SEQ ID NO: 361897 - RNA, 22 nt, Human
ggacacagcugcagccacaccc

SEQ ID NO: 361898 - RNA, 22 nt, Human
cccaggaagaaauucugauuug

SEQ ID NO: 361899 - RNA, 22 nt, Human
ccuuucucuuggauaccgauug

SEQ ID NO: 361900 - RNA, 22 nt, Human
gccaaaucuugcacacucuugu

SEQ ID NO: 361901 - RNA, 22 nt, Human
cagggacagccuugggguggcg

SEQ ID NO: 361902 - RNA, 22 nt, Human
auacacauauguguguauaugu

SEQ ID NO: 361903 - RNA, 22 nt, Human
auuaagggccaauccuccagcc

SEQ ID NO: 361904 - RNA, 22 nt, Human
cucaagacugaucgcaguggaa

SEQ ID NO: 361905 - RNA, 22 nt, Human
ugggauggagccugaguauagu

SEQ ID NO: 361906 - RNA, 22 nt, Human
cauagcuuagggguuaaacuca

SEQ ID NO: 361907 - RNA, 22 nt, Human
acagcugugagggucacuugua

SEQ ID NO: 361908 - RNA, 22 nt, Human
aaggcacucauucaaggagaua

SEQ ID NO: 361909 - RNA, 22 nt, Human
agggucagggagugaguauuua

SEQ ID NO: 361910 - RNA, 23 nt, Human
gugcucugcggucugcuagucug

SEQ ID NO: 361911 - RNA, 22 nt, Human
ggccuguccagccugccuggcu

SEQ ID NO: 361912 - RNA, 22 nt, Human
uaaacauguugacaucuuaccu

SEQ ID NO: 361913 - RNA, 22 nt, Human
gccagccugugcuuggccaggc

SEQ ID NO: 361914 - RNA, 22 nt, Human
ccauaauauuaaaugcuuuugu

SEQ ID NO: 361915 - RNA, 22 nt, Human
cagggagcuggcuggcugugcc

SEQ ID NO: 361916 - RNA, 22 nt, Human
aagggcuccauccuuauaaaug

SEQ ID NO: 361917 - RNA, 22 nt, Human
ugccaaggagcuggaucagggc

SEQ ID NO: 361918 - RNA, 22 nt, Human
cccagcagccuggauguucuuu

SEQ ID NO: 361919 - RNA, 22 nt, Human
guauuagguuggugcaaaagua

SEQ ID NO: 361920 - RNA, 22 nt, Human
auaucuuuguuuuugccaagau

SEQ ID NO: 361921 - RNA, 22 nt, Human
ugccucuguggaaauggugguc

SEQ ID NO: 361922 - RNA, 22 nt, Human
ucagaacagaagcuggcuauaa

SEQ ID NO: 361923 - RNA, 22 nt, Human
caguggccaugguggcaggggu

SEQ ID NO: 361924 - RNA, 22 nt, Human
ggaagagagggcugggccucaa

SEQ ID NO: 361925 - RNA, 22 nt, Human
uauauguaagcuauguaagagu

SEQ ID NO: 361926 - RNA, 22 nt, Human
gaauguaauagucaguagaaca

SEQ ID NO: 361927 - RNA, 23 nt, Human
cagagcuggcucagagcugccug

SEQ ID NO: 361928 - RNA, 22 nt, Human
accaucaguacuggaugcugac

SEQ ID NO: 361929 - RNA, 22 nt, Human
uuuaggcagucauugaacaagu

SEQ ID NO: 361930 - RNA, 22 nt, Human
uacuuccagcaaucugcauauu

SEQ ID NO: 361931 - RNA, 22 nt, Human
gguacaaggagugaagguuugg

SEQ ID NO: 361932 - RNA, 20 nt, Human
auuucaguguuugcaauuuc

SEQ ID NO: 361933 - RNA, 22 nt, Human
cccucccaagcacucugacaua

SEQ ID NO: 361934 - RNA, 22 nt, Human
cagcuuuauuaaugauugucuu

SEQ ID NO: 361935 - RNA, 22 nt, Human
acccuggguucccgcagcacca

SEQ ID NO: 361936 - RNA, 22 nt, Human
ggucagagggugggcugccugu

SEQ ID NO: 361937 - RNA, 22 nt, Human
gcaggugaaugauggacuagga

SEQ ID NO: 361938 - RNA, 18 nt, Human
aaaugcuaggcuacauga

SEQ ID NO: 361939 - RNA, 22 nt, Human
uuguuuucuccacugcaucuua

SEQ ID NO: 361940 - RNA, 22 nt, Human
cuucagaagccugcagccuuug

SEQ ID NO: 361941 - RNA, 22 nt, Human
ggcugcuuuaucggcugcugaa

SEQ ID NO: 361942 - RNA, 22 nt, Human
aaaugcacagaaaggaugugga

SEQ ID NO: 361943 - RNA, 22 nt, Human
ucaggaucaggggccuuuccuu

SEQ ID NO: 361944 - RNA, 22 nt, Human
cagcuuuauuucacguguuugu

SEQ ID NO: 361945 - RNA, 22 nt, Human
ggcagaggugacagugucuuuu

SEQ ID NO: 361946 - RNA, 22 nt, Human
auguaacuucugugaaucugac

SEQ ID NO: 361947 - RNA, 22 nt, Human
cuguagccaguuuggccucacc

SEQ ID NO: 361948 - RNA, 22 nt, Human
ccucugcucugguccaugugcu

SEQ ID NO: 361949 - RNA, 22 nt, Human
ggcuuaaugguucuuuuucuca

SEQ ID NO: 361950 - RNA, 22 nt, Human
uauccuuguacuauaguauuua

SEQ ID NO: 361951 - RNA, 22 nt, Human
aaacuuuaagacaguccucaag

SEQ ID NO: 361952 - RNA, 22 nt, Human
gagcuggcuccgccaugcugcu

SEQ ID NO: 361953 - RNA, 22 nt, Human
auucuucacaaauauauagaag

SEQ ID NO: 361954 - RNA, 16 nt, Human
gagggcagaggcggaa

SEQ ID NO: 361955 - RNA, 22 nt, Human
ggugaaggaggaagcugaugga

SEQ ID NO: 361956 - RNA, 22 nt, Human
uuguuugaggucacugauauuu

SEQ ID NO: 361957 - RNA, 23 nt, Human
gccuggagaaaagcugcaguuca

SEQ ID NO: 361958 - RNA, 22 nt, Human
ucaaagcaucagucaauuuagg

SEQ ID NO: 361959 - RNA, 22 nt, Human
uggcagcaguagccaccccagc

SEQ ID NO: 361960 - RNA, 22 nt, Human
acaaaugcaaguuuuaugucaa

SEQ ID NO: 361961 - RNA, 22 nt, Human
uggcugagagucauccugugug

SEQ ID NO: 361962 - RNA, 22 nt, Human
ugcugugcuggcggcagaggcc

SEQ ID NO: 361963 - RNA, 22 nt, Human
aggcagguguuaacccucugag

SEQ ID NO: 361964 - RNA, 19 nt, Human
agcagcuggagguggagug

SEQ ID NO: 361965 - RNA, 21 nt, Human
agcagcugcaguuucuaucug

SEQ ID NO: 361966 - RNA, 22 nt, Human
ccucaugguacuuacuguagcu

SEQ ID NO: 361967 - RNA, 22 nt, Human
agugcuccuauggaucaguugu

SEQ ID NO: 361968 - RNA, 22 nt, Human
uccaggagauacacugcaccag

SEQ ID NO: 361969 - RNA, 23 nt, Human
cccugcagucagggugagauggu

SEQ ID NO: 361970 - RNA, 22 nt, Human
aggcagcaugggcccagagucc

SEQ ID NO: 361971 - RNA, 22 nt, Human
uucaugaauggaaucaaugcuc

SEQ ID NO: 361972 - RNA, 21 nt, Human
auacacauacacauaaaugug

SEQ ID NO: 361973 - RNA, 22 nt, Human
acacuuuacagcuuccuuugca

SEQ ID NO: 361974 - RNA, 22 nt, Human
uuugcauuauauuuauagaaga

SEQ ID NO: 361975 - RNA, 22 nt, Human
agccagcugugggcucaggcgg

SEQ ID NO: 361976 - RNA, 22 nt, Human
caggagggcccgagacucuucc

SEQ ID NO: 361977 - RNA, 22 nt, Human
gccacaggcacuuaagggcugg

SEQ ID NO: 361978 - RNA, 22 nt, Human
auuucacucuuaauugcuuccu

SEQ ID NO: 361979 - RNA, 22 nt, Human
uuucagaucauuuuuuaaguac

SEQ ID NO: 361980 - RNA, 22 nt, Human
augaagcuaaacccugcagcca

SEQ ID NO: 361981 - RNA, 22 nt, Human
uggcucagaaggcugccuucac

SEQ ID NO: 361982 - RNA, 22 nt, Human
caggcagcagccacucugguau

SEQ ID NO: 361983 - RNA, 18 nt, Human
agcagcugucagaaugcc

SEQ ID NO: 361984 - RNA, 21 nt, Human
uccugcaggaggccugagagg

SEQ ID NO: 361985 - RNA, 22 nt, Human
cccagggacagcuagguggggc

SEQ ID NO: 361986 - RNA, 22 nt, Human
ccagaggugccacagaaagagc

SEQ ID NO: 361987 - RNA, 22 nt, Human
ucaaguuucucucagauuaugg

SEQ ID NO: 361988 - RNA, 22 nt, Human
gaaaucugcccagugcacuggu

SEQ ID NO: 361989 - RNA, 22 nt, Human
ucucagagggaggauuacugcc

SEQ ID NO: 361990 - RNA, 22 nt, Human
aaggaaagacauauaaaugacu

SEQ ID NO: 361991 - RNA, 22 nt, Human
gagagaagaaagccaugguccu

SEQ ID NO: 361992 - RNA, 22 nt, Human
ugucucagaguaucccugaacu

SEQ ID NO: 361993 - RNA, 22 nt, Human
ccagccuucugagcugccugga

SEQ ID NO: 361994 - RNA, 22 nt, Human
agggaccugcucacugccuggc

SEQ ID NO: 361995 - RNA, 22 nt, Human
ucauugcaagcucauuuaucug

SEQ ID NO: 361996 - RNA, 22 nt, Human
caaaguuaucaacugcaacauu

SEQ ID NO: 361997 - RNA, 22 nt, Human
caguggguggcuaaguggcuga

SEQ ID NO: 361998 - RNA, 22 nt, Human
agggcugaaacauaauccuucu

SEQ ID NO: 361999 - RNA, 19 nt, Human
aggugaugugacucuagaa

SEQ ID NO: 362000 - RNA, 22 nt, Human
acccugagggguauagcagaag

SEQ ID NO: 362001 - RNA, 22 nt, Human
ggaggccaucagggagggcauu

SEQ ID NO: 362002 - RNA, 22 nt, Human
acagcacaaucugagucccaga

SEQ ID NO: 362003 - RNA, 23 nt, Human
uggcccugugcaugcugcuuccc

SEQ ID NO: 362004 - RNA, 22 nt, Human
auggcauuauagcaaugguuug

SEQ ID NO: 362005 - RNA, 22 nt, Human
aaagccaaaugaaagaugguuc

SEQ ID NO: 362006 - RNA, 22 nt, Human
cuggcagguccagcuggacuca

SEQ ID NO: 362007 - RNA, 22 nt, Human
aguuucuaccgguacauucagg

SEQ ID NO: 362008 - RNA, 22 nt, Human
uguaaauaauuccuaggcuuuu

SEQ ID NO: 362009 - RNA, 22 nt, Human
cagcaggguauacagggaauuu

SEQ ID NO: 362010 - RNA, 22 nt, Human
gggcugaggcuaccacuggucu

SEQ ID NO: 362011 - RNA, 22 nt, Human
ccuggccuggcacucccucugc

SEQ ID NO: 362012 - RNA, 22 nt, Human
ccugcuguucuguuuagugaac

SEQ ID NO: 362013 - RNA, 22 nt, Human
cauuaauauuguucuucuuuag

SEQ ID NO: 362014 - RNA, 22 nt, Human
gcccagcacuaaaagcuuugcu

SEQ ID NO: 362015 - RNA, 22 nt, Human
cccagcauccucagggagcggg

SEQ ID NO: 362016 - RNA, 22 nt, Human
cagagagagugggguguggauu

SEQ ID NO: 362017 - RNA, 22 nt, Human
guagaagugaugucauguuaua

SEQ ID NO: 362018 - RNA, 22 nt, Human
uuuaagaaguuauguuauaaau

SEQ ID NO: 362019 - RNA, 22 nt, Human
agccauggcgccacuagaggga

SEQ ID NO: 362020 - RNA, 22 nt, Human
ggacucagcagccaggaguggc

SEQ ID NO: 362021 - RNA, 22 nt, Human
augucccagcugagagacaacu

SEQ ID NO: 362022 - RNA, 22 nt, Human
cccagguggguuggccucuguc

SEQ ID NO: 362023 - RNA, 22 nt, Human
cagcuuuagagaaaacauauuu

SEQ ID NO: 362024 - RNA, 22 nt, Human
cucugugcccuacugcucagcu

SEQ ID NO: 362025 - RNA, 22 nt, Human
gaugcacugcaguauauacugu

SEQ ID NO: 362026 - RNA, 22 nt, Human
ugucagugaguuaguugcaagu

SEQ ID NO: 362027 - RNA, 22 nt, Human
accaaggaagagauucucaguu

SEQ ID NO: 362028 - RNA, 22 nt, Human
cgagaguggacagggcgcagcu

SEQ ID NO: 362029 - RNA, 22 nt, Human
uuugaacugauaaucuucuguu

SEQ ID NO: 362030 - RNA, 21 nt, Human
acagagccgggcacaaagcug

SEQ ID NO: 362031 - RNA, 22 nt, Human
acagggccagccugggaccugg

SEQ ID NO: 362032 - RNA, 22 nt, Human
uuaaauuauuucuagugaggug

SEQ ID NO: 362033 - RNA, 22 nt, Human
ggguguguuccuaaggaaacca

SEQ ID NO: 362034 - RNA, 22 nt, Human
aggagccccucuucaguccugg

SEQ ID NO: 362035 - RNA, 22 nt, Human
ugaaaucaauugcaauguuuau

SEQ ID NO: 362036 - RNA, 22 nt, Human
ucacaaaagcuuuugaauuugg

SEQ ID NO: 362037 - RNA, 22 nt, Human
aaauacagaguugcuuaaaagc

SEQ ID NO: 362038 - RNA, 22 nt, Human
caauuucacuaauaauauuuac

SEQ ID NO: 362039 - RNA, 22 nt, Human
ggucccagcugcucaagaggcu

SEQ ID NO: 362040 - RNA, 22 nt, Human
gugacaguggucacuuguaguu

SEQ ID NO: 362041 - RNA, 22 nt, Human
auuucaacagaguuugaaggca

SEQ ID NO: 362042 - RNA, 22 nt, Human
gcugagacuggcagcaggaagu

SEQ ID NO: 362043 - RNA, 22 nt, Human
ugcuuauuuauagucaauagag

SEQ ID NO: 362044 - RNA, 22 nt, Human
gcugccugccuaguuccacagu

SEQ ID NO: 362045 - RNA, 22 nt, Human
uguccucaaggagcuucagucu

SEQ ID NO: 362046 - RNA, 22 nt, Human
ccagagaccagaacauggggau

SEQ ID NO: 362047 - RNA, 22 nt, Human
gucccaggcuuauguggagcuu

SEQ ID NO: 362048 - RNA, 22 nt, Human
gcuacugauugaccuuggagag

SEQ ID NO: 362049 - RNA, 22 nt, Human
gcucucugucguuaugcuucau

SEQ ID NO: 362050 - RNA, 22 nt, Human
cccaugagauucugaauuuggc

SEQ ID NO: 362051 - RNA, 22 nt, Human
gcagcagaguuugggagauggu

SEQ ID NO: 362052 - RNA, 22 nt, Human
aaggcaguaggaucuuccacag

SEQ ID NO: 362053 - RNA, 22 nt, Human
aaguuugacagaaguuucuaau

SEQ ID NO: 362054 - RNA, 22 nt, Human
auuugcuucugugaaaucaagu

SEQ ID NO: 362055 - RNA, 22 nt, Human
ugaacucucucaagugacagaa

SEQ ID NO: 362056 - RNA, 19 nt, Human
cugaggugcaguaagaggc

SEQ ID NO: 362057 - RNA, 22 nt, Human
gcucagaggaugcuccuuuaug

SEQ ID NO: 362058 - RNA, 22 nt, Human
uuuggaauguaguuuaaucauc

SEQ ID NO: 362059 - RNA, 22 nt, Human
ccugccagcccgcguucaugcc

SEQ ID NO: 362060 - RNA, 22 nt, Human
uguaagaaucagucuuuaaugu

SEQ ID NO: 362061 - RNA, 22 nt, Human
cuggccagggugcgaucguggu

SEQ ID NO: 362062 - RNA, 22 nt, Human
aaaagguaguugccaaauaagg

SEQ ID NO: 362063 - RNA, 22 nt, Human
cugagcugaaacuugagaggcu

SEQ ID NO: 362064 - RNA, 22 nt, Human
aggcugcuuucauggccgcccc

SEQ ID NO: 362065 - RNA, 22 nt, Human
cagucacauugcccugcauuua

SEQ ID NO: 362066 - RNA, 22 nt, Human
uggcuuccacugugugcccccu

SEQ ID NO: 362067 - RNA, 22 nt, Human
uacuuugaagacaauaucugga

SEQ ID NO: 362068 - RNA, 18 nt, Human
gggcuguguucaugccca

SEQ ID NO: 362069 - RNA, 22 nt, Human
uuuccuuccuugcuagccugag

SEQ ID NO: 362070 - RNA, 22 nt, Human
uagugcuugagucucuccguac

SEQ ID NO: 362071 - RNA, 21 nt, Human
cucuggaggcaagggagagug

SEQ ID NO: 362072 - RNA, 17 nt, Human
ugcauuguuggaaauuu

SEQ ID NO: 362073 - RNA, 22 nt, Human
auguagcagaagauguuuuccu

SEQ ID NO: 362074 - RNA, 22 nt, Human
ggcagcuuguccuucaggagag

SEQ ID NO: 362075 - RNA, 20 nt, Human
cacguuuuuccacuagcaaa

SEQ ID NO: 362076 - RNA, 22 nt, Human
cagcagcugggaaggaggcuga

SEQ ID NO: 362077 - RNA, 22 nt, Human
uggagaggaaagugcaguuuug

SEQ ID NO: 362078 - RNA, 22 nt, Human
gcugccuuugugagccaagggg

SEQ ID NO: 362079 - RNA, 22 nt, Human
guguguccaggcgggagucaag

SEQ ID NO: 362080 - RNA, 22 nt, Human
ucagagagcagaacuuuuuuac

SEQ ID NO: 362081 - RNA, 20 nt, Human
gcaaggcacagugaggaggg

SEQ ID NO: 362082 - RNA, 22 nt, Human
gccuggcccagggcuccgcagg

SEQ ID NO: 362083 - RNA, 22 nt, Human
uccaaaaaacguuugaauaguu

SEQ ID NO: 362084 - RNA, 22 nt, Human
uauuucuaagagauaucuguac

SEQ ID NO: 362085 - RNA, 22 nt, Human
gaggcucugugaugugccaggc

SEQ ID NO: 362086 - RNA, 22 nt, Human
caggcugcagcagcaguggccc

SEQ ID NO: 362087 - RNA, 22 nt, Human
cuggggacuugcagacacaauu

SEQ ID NO: 362088 - RNA, 22 nt, Human
cugcccagaagccagaugggca

SEQ ID NO: 362089 - RNA, 22 nt, Human
cugcagaguggagccucggcug

SEQ ID NO: 362090 - RNA, 22 nt, Human
gaagccacaacuuuuucuuagc

SEQ ID NO: 362091 - RNA, 22 nt, Human
aggccagguuccucaaucuuga

SEQ ID NO: 362092 - RNA, 22 nt, Human
uaucuacaggugucagguaaga

SEQ ID NO: 362093 - RNA, 16 nt, Human
ccaccugcagcucuca

SEQ ID NO: 362094 - RNA, 22 nt, Human
acacugaauauacaaugaauau

SEQ ID NO: 362095 - RNA, 22 nt, Human
auguucuuguucaaaugucagu

SEQ ID NO: 362096 - RNA, 22 nt, Human
gcagagcagugcuugcccagcg

SEQ ID NO: 362097 - RNA, 22 nt, Human
guucuugccagcauccucaggu

SEQ ID NO: 362098 - RNA, 23 nt, Human
uccaagggcuacaaacacagacc

SEQ ID NO: 362099 - RNA, 21 nt, Human
ugcucacagaugugcucagug

SEQ ID NO: 362100 - RNA, 22 nt, Human
acaaugaacacacaaggaauuc

SEQ ID NO: 362101 - RNA, 22 nt, Human
ggaagggccucgggcgugggac

SEQ ID NO: 362102 - RNA, 22 nt, Human
uaaucacaucaggguaaauggg

SEQ ID NO: 362103 - RNA, 22 nt, Human
ggcagagaugugggucagaauc

SEQ ID NO: 362104 - RNA, 22 nt, Human
cagcuuuccagagaccugcccc

SEQ ID NO: 362105 - RNA, 22 nt, Human
ccugauggagcccugcugcaug

SEQ ID NO: 362106 - RNA, 22 nt, Human
agagggcuggacgcagguugga

SEQ ID NO: 362107 - RNA, 22 nt, Human
ucaggaugaccacgagccucua

SEQ ID NO: 362108 - RNA, 22 nt, Human
cugggcuguaauguggcacuga

SEQ ID NO: 362109 - RNA, 22 nt, Human
uucugggacaucuggacaguuu

SEQ ID NO: 362110 - RNA, 23 nt, Human
aucaagauaauccagaugaccua

SEQ ID NO: 362111 - RNA, 22 nt, Human
ccagcugucagugugaaaauaa

SEQ ID NO: 362112 - RNA, 22 nt, Human
ugagcuucuuuauuuggccaga

SEQ ID NO: 362113 - RNA, 22 nt, Human
gaaguucaaaagacagauuuga

SEQ ID NO: 362114 - RNA, 22 nt, Human
gagcaacaguuuaugguuuuuc

SEQ ID NO: 362115 - RNA, 22 nt, Human
gagcccuggcagucugggaugg

SEQ ID NO: 362116 - RNA, 22 nt, Human
gcagagcucaugccugcaccuc

SEQ ID NO: 362117 - RNA, 22 nt, Human
cagccuucugaaugaacguacu

SEQ ID NO: 362118 - RNA, 23 nt, Human
aaggucacagaacuuagcaagcc

SEQ ID NO: 362119 - RNA, 22 nt, Human
cuuaggcaguuuaggaaagaga

SEQ ID NO: 362120 - RNA, 22 nt, Human
gcagggcuaauggggcaaguag

SEQ ID NO: 362121 - RNA, 22 nt, Human
ccaggcagcucugauuuauguc

SEQ ID NO: 362122 - RNA, 22 nt, Human
agccagggauggcagugcccag

SEQ ID NO: 362123 - RNA, 22 nt, Human
ccuggcagcuaagugcuuugag

SEQ ID NO: 362124 - RNA, 22 nt, Human
ccugggcuggaguacagcagug

SEQ ID NO: 362125 - RNA, 22 nt, Human
agcugugggauuugggugugcc

SEQ ID NO: 362126 - RNA, 22 nt, Human
uaaaguuuggcagacaauaaca

SEQ ID NO: 362127 - RNA, 22 nt, Human
acaguuaucuuugaaauagaga

SEQ ID NO: 362128 - RNA, 22 nt, Human
aaaggucaagcuggacucaggu

SEQ ID NO: 362129 - RNA, 22 nt, Human
ugcuuuauuggaaccucauccu

SEQ ID NO: 362130 - RNA, 22 nt, Human
ugagcagaacacgggauccaug

SEQ ID NO: 362131 - RNA, 22 nt, Human
ucugggcccuaaaccagcucua

SEQ ID NO: 362132 - RNA, 22 nt, Human
ugcagcuucuccaucuccuugu

SEQ ID NO: 362133 - RNA, 22 nt, Human
cccugcagagagugcuuuugug

SEQ ID NO: 362134 - RNA, 22 nt, Human
aucugccugagucuagguuuuc

SEQ ID NO: 362135 - RNA, 22 nt, Human
uggcaggggaggugcuugcuua

SEQ ID NO: 362136 - RNA, 22 nt, Human
aggcagccuuuagacagucugc

SEQ ID NO: 362137 - RNA, 22 nt, Human
uggggaagggcacccuggagac

SEQ ID NO: 362138 - RNA, 22 nt, Human
gccaggaggcuuaacuggacag

SEQ ID NO: 362139 - RNA, 22 nt, Human
cuagucacucagcacugacaaa

SEQ ID NO: 362140 - RNA, 20 nt, Human
cugcugugguccuuuauuuu

SEQ ID NO: 362141 - RNA, 22 nt, Human
aaagauuucacaucccaagccu

SEQ ID NO: 362142 - RNA, 22 nt, Human
ucuuuccuagaggcugaugagu

SEQ ID NO: 362143 - RNA, 22 nt, Human
uccuugaagagugggcggucga

SEQ ID NO: 362144 - RNA, 23 nt, Human
cagaaaucugaaaucuagaaaug

SEQ ID NO: 362145 - RNA, 22 nt, Human
ugaggggagguuggggcacauc

SEQ ID NO: 362146 - RNA, 22 nt, Human
cuggugggaggcaagguggaag

SEQ ID NO: 362147 - RNA, 22 nt, Human
ggguacuuaauauuuacggggu

SEQ ID NO: 362148 - RNA, 22 nt, Human
ugcaguggaagagguggagauc

SEQ ID NO: 362149 - RNA, 22 nt, Human
ccugucuggccaccagggcgau

SEQ ID NO: 362150 - RNA, 22 nt, Human
ccaggccuagccccugagggua

SEQ ID NO: 362151 - RNA, 22 nt, Human
cacauguaguaagcaggcaaug

SEQ ID NO: 362152 - RNA, 22 nt, Human
ggggcucaguucggacagccug

SEQ ID NO: 362153 - RNA, 22 nt, Human
cagagccagcuguccuuggcau

SEQ ID NO: 362154 - RNA, 22 nt, Human
ugacuccaaacagaaaacgaau

SEQ ID NO: 362155 - RNA, 22 nt, Human
ugaagcagaggggucuugagcu

SEQ ID NO: 362156 - RNA, 22 nt, Human
aucugccuggcuccaggugagc

SEQ ID NO: 362157 - RNA, 19 nt, Human
aggcugcaagguggugggc

SEQ ID NO: 362158 - RNA, 22 nt, Human
gaggcaggguguugauuacaga

SEQ ID NO: 362159 - RNA, 22 nt, Human
cuauacaguaaccacagugauu

SEQ ID NO: 362160 - RNA, 22 nt, Human
caggguccggcugccuggcugu

SEQ ID NO: 362161 - RNA, 22 nt, Human
uuauuuuuaaaaguucacacag

SEQ ID NO: 362162 - RNA, 22 nt, Human
agugggaggcggcugacgggcg

SEQ ID NO: 362163 - RNA, 22 nt, Human
ucacaggacccugaggguggcg

SEQ ID NO: 362164 - RNA, 22 nt, Human
gccuuggccaacaccuugcaaa

SEQ ID NO: 362165 - RNA, 22 nt, Human
ccagagagucgaugggggacac

SEQ ID NO: 362166 - RNA, 22 nt, Human
gggcugaccccaccccucacuc

SEQ ID NO: 362167 - RNA, 22 nt, Human
acugccuugucucuugccuguu

SEQ ID NO: 362168 - RNA, 22 nt, Human
gauuucaccugaucuugucauc

SEQ ID NO: 362169 - RNA, 22 nt, Human
aaaugcuagggagaaacucucc

SEQ ID NO: 362170 - RNA, 22 nt, Human
ugugaaaggggucacagggaaa

SEQ ID NO: 362171 - RNA, 22 nt, Human
ccuggagagagaggccaacugc

SEQ ID NO: 362172 - RNA, 22 nt, Human
gagggagagugauggaccauug

SEQ ID NO: 362173 - RNA, 22 nt, Human
gguucacacuaagcuuaagugg

SEQ ID NO: 362174 - RNA, 22 nt, Human
ccaggccaaauucagucagcag

SEQ ID NO: 362175 - RNA, 22 nt, Human
cagcaguguggaagcugagggg

SEQ ID NO: 362176 - RNA, 22 nt, Human
cccuggaggaaaaucugaggcu

SEQ ID NO: 362177 - RNA, 22 nt, Human
ucaaauaccagcaauuucaugu

SEQ ID NO: 362178 - RNA, 22 nt, Human
cagcugacgccagaguggaauu

SEQ ID NO: 362179 - RNA, 22 nt, Human
caugucuuauauccugucuuca

SEQ ID NO: 362180 - RNA, 22 nt, Human
acaggcagcgucauugcugcuc

SEQ ID NO: 362181 - RNA, 22 nt, Human
guagggacuuguuuuacuagua

SEQ ID NO: 362182 - RNA, 18 nt, Human
cagggccccagaauuauc

SEQ ID NO: 362183 - RNA, 22 nt, Human
gaaggcugucagagaggagggc

SEQ ID NO: 362184 - RNA, 22 nt, Human
ggcugagcucaggggcagcagg

SEQ ID NO: 362185 - RNA, 22 nt, Human
aguuuucacacucaccaaaagg

SEQ ID NO: 362186 - RNA, 22 nt, Human
cagcuugugcaaagguccuggg

SEQ ID NO: 362187 - RNA, 22 nt, Human
aucugccucuucuucauugcga

SEQ ID NO: 362188 - RNA, 22 nt, Human
aagcagcugauuucacagcuca

SEQ ID NO: 362189 - RNA, 23 nt, Human
uccugcagauaagcugguugaca

SEQ ID NO: 362190 - RNA, 22 nt, Human
cuggagccagccagggcccucu

SEQ ID NO: 362191 - RNA, 22 nt, Human
gaccaaggaagaggggagccag

SEQ ID NO: 362192 - RNA, 22 nt, Human
ucuuuauuuaagucuguuguaa

SEQ ID NO: 362193 - RNA, 22 nt, Human
guuugucuuaauuaggcaucga

SEQ ID NO: 362194 - RNA, 22 nt, Human
ucagagugggagaaugugccaa

SEQ ID NO: 362195 - RNA, 22 nt, Human
aguuuccaaagcauguucacac

SEQ ID NO: 362196 - RNA, 22 nt, Human
caguagcagggauuauuuuagg

SEQ ID NO: 362197 - RNA, 22 nt, Human
uuucucaucuggaaacagugcu

SEQ ID NO: 362198 - RNA, 22 nt, Human
aguggcagccgagcaggagaug

SEQ ID NO: 362199 - RNA, 22 nt, Human
agguccagcuguugcagccucc

SEQ ID NO: 362200 - RNA, 22 nt, Human
acagauuuuugguaaauaauuu

SEQ ID NO: 362201 - RNA, 22 nt, Human
caguguggcugagacagaggcu

SEQ ID NO: 362202 - RNA, 22 nt, Human
augacacaauuuuagagcugaa

SEQ ID NO: 362203 - RNA, 22 nt, Human
aaacaucaauugcaucucccaa

SEQ ID NO: 362204 - RNA, 22 nt, Human
cuccuuccccuacucagcaucc

SEQ ID NO: 362205 - RNA, 22 nt, Human
ugaggcaggaauggggaaaagu

SEQ ID NO: 362206 - RNA, 18 nt, Human
ggcuuugcugggguuucu

SEQ ID NO: 362207 - RNA, 22 nt, Human
gaaguggaagccaucggcaguc

SEQ ID NO: 362208 - RNA, 22 nt, Human
ucccaggaauccguccucuaga

SEQ ID NO: 362209 - RNA, 22 nt, Human
cagcugccccauaaaucacagu

SEQ ID NO: 362210 - RNA, 22 nt, Human
uauugucuguccgggucaaagc

SEQ ID NO: 362211 - RNA, 22 nt, Human
gugccaggugcuaagcugugcu

SEQ ID NO: 362212 - RNA, 22 nt, Human
aggcagcuggcagcacccaggg

SEQ ID NO: 362213 - RNA, 22 nt, Human
caacuuuucugugaauuuaagu

SEQ ID NO: 362214 - RNA, 22 nt, Human
uucuucuccgaggagggcuggu

SEQ ID NO: 362215 - RNA, 22 nt, Human
cugaacuuauugagugcuugcu

SEQ ID NO: 362216 - RNA, 22 nt, Human
uggcagcauuuuuuccagaaca

SEQ ID NO: 362217 - RNA, 22 nt, Human
uacaguaaccuuauuugucauu

SEQ ID NO: 362218 - RNA, 22 nt, Human
uagugcuuaacacaaagugauu

SEQ ID NO: 362219 - RNA, 22 nt, Human
ugaggaaguugaucucaucagu

SEQ ID NO: 362220 - RNA, 22 nt, Human
ggcuggcacucuguccaguguc

SEQ ID NO: 362221 - RNA, 22 nt, Human
gauuucuuuaugaaguacagaa

SEQ ID NO: 362222 - RNA, 22 nt, Human
ucugccuggauuuuggaaagcu

SEQ ID NO: 362223 - RNA, 22 nt, Human
gaaauauacaugaagucggcug

SEQ ID NO: 362224 - RNA, 18 nt, Human
agcuggggccucuggucc

SEQ ID NO: 362225 - RNA, 22 nt, Human
acagcuuuugaaaaauuacugg

SEQ ID NO: 362226 - RNA, 22 nt, Human
ccagaggaaaaauaucucccua

SEQ ID NO: 362227 - RNA, 22 nt, Human
accaguccgcggagcuccgggg

SEQ ID NO: 362228 - RNA, 22 nt, Human
cccaggaggacauuccauaccc

SEQ ID NO: 362229 - RNA, 22 nt, Human
ggcuuuaugcacagcagauggu

SEQ ID NO: 362230 - RNA, 22 nt, Human
caggauggucucgaucuccuga

SEQ ID NO: 362231 - RNA, 22 nt, Human
gcagggaccuugcccacccucc

SEQ ID NO: 362232 - RNA, 22 nt, Human
ggaggcucccacgcagcucaca

SEQ ID NO: 362233 - RNA, 22 nt, Human
agugcagcaugcuggggaggcu

SEQ ID NO: 362234 - RNA, 22 nt, Human
cacaggagcuguggggcagugu

SEQ ID NO: 362235 - RNA, 22 nt, Human
gggacaggcugagacuugagcu

SEQ ID NO: 362236 - RNA, 17 nt, Human
ccugggaggaguuauga

SEQ ID NO: 362237 - RNA, 22 nt, Human
cugaggugcuagggucccugcu

SEQ ID NO: 362238 - RNA, 20 nt, Human
ggaagcagagaacuguuuuc

SEQ ID NO: 362239 - RNA, 22 nt, Human
aauacaaucaaauucacuagca

SEQ ID NO: 362240 - RNA, 22 nt, Human
accagagaaaacacagcaggcu

SEQ ID NO: 362241 - RNA, 22 nt, Human
uucucagguagugcugaugcug

SEQ ID NO: 362242 - RNA, 22 nt, Human
ucauugaacgaagagcuccauu

SEQ ID NO: 362243 - RNA, 22 nt, Human
guuuuuccuugcugaggacccg

SEQ ID NO: 362244 - RNA, 22 nt, Human
augcauugucugguuucauuuu

SEQ ID NO: 362245 - RNA, 22 nt, Human
gccuggucucuuucaugucagu

SEQ ID NO: 362246 - RNA, 22 nt, Human
agucccagaucuccauucgguc

SEQ ID NO: 362247 - RNA, 22 nt, Human
agugaggcuaauaggcaauggu

SEQ ID NO: 362248 - RNA, 17 nt, Human
gcagcagagagacccuc

SEQ ID NO: 362249 - RNA, 22 nt, Human
ccagcugucugguuccagagcc

SEQ ID NO: 362250 - RNA, 22 nt, Human
aaagcagucacuccagugugau

SEQ ID NO: 362251 - RNA, 22 nt, Human
uugcaacaucugaacauuuauc

SEQ ID NO: 362252 - RNA, 22 nt, Human
uggccagaaccugcaguaggcc

SEQ ID NO: 362253 - RNA, 22 nt, Human
cugggggcaagcagacagcugu

SEQ ID NO: 362254 - RNA, 22 nt, Human
auuugucugcuugcugccuucc

SEQ ID NO: 362255 - RNA, 22 nt, Human
cugagcugggcucucuugaggg

SEQ ID NO: 362256 - RNA, 22 nt, Human
cugaggagagaucacguggugu

SEQ ID NO: 362257 - RNA, 22 nt, Human
cucaggaugcaauuccaucaag

SEQ ID NO: 362258 - RNA, 19 nt, Human
ccuuugaaucaggacacuu

SEQ ID NO: 362259 - RNA, 22 nt, Human
aacaaagucguugccuagaaga

SEQ ID NO: 362260 - RNA, 22 nt, Human
ccucuccaguuuuaacgugacc

SEQ ID NO: 362261 - RNA, 22 nt, Human
uucuccgcuaaguucucugcag

SEQ ID NO: 362262 - RNA, 22 nt, Human
uucucuagguuuuagaugaaga

SEQ ID NO: 362263 - RNA, 22 nt, Human
caggggcuuaagugacagaagg

SEQ ID NO: 362264 - RNA, 22 nt, Human
cccaggaguucgaggcuguagu

SEQ ID NO: 362265 - RNA, 17 nt, Human
uauguaguacuuauaaa

SEQ ID NO: 362266 - RNA, 19 nt, Human
augucccaccgccccugag

SEQ ID NO: 362267 - RNA, 22 nt, Human
uaauuucuucaucucugcagcu

SEQ ID NO: 362268 - RNA, 20 nt, Human
cugugcuuuggaaccuggaa

SEQ ID NO: 362269 - RNA, 22 nt, Human
ucaggcaggcagagggcaaaug

SEQ ID NO: 362270 - RNA, 22 nt, Human
cugagaggcggagcuugcagug

SEQ ID NO: 362271 - RNA, 22 nt, Human
caguagcaggcaggugcuuuug

SEQ ID NO: 362272 - RNA, 22 nt, Human
auguuucaaugcacuuuagccu

SEQ ID NO: 362273 - RNA, 22 nt, Human
gcugggaggaauuuggggaaua

SEQ ID NO: 362274 - RNA, 22 nt, Human
uuuccaaacccagcgagcuaca

SEQ ID NO: 362275 - RNA, 22 nt, Human
cugaaggagcauagucaguuuu

SEQ ID NO: 362276 - RNA, 22 nt, Human
cccaugagaccugguuuaaggc

SEQ ID NO: 362277 - RNA, 22 nt, Human
gcucugcuugcaucaugacugc

SEQ ID NO: 362278 - RNA, 22 nt, Human
agaccgagaaguucuccaggcc

SEQ ID NO: 362279 - RNA, 22 nt, Human
acugcuuuuagaaaucuauaga

SEQ ID NO: 362280 - RNA, 22 nt, Human
aucuggcuauuucuggucgggg

SEQ ID NO: 362281 - RNA, 22 nt, Human
ggcugugcgggcagccguggga

SEQ ID NO: 362282 - RNA, 22 nt, Human
uguggcucucagauccuccaau

SEQ ID NO: 362283 - RNA, 22 nt, Human
cagggagaggcaucauagggaa

SEQ ID NO: 362284 - RNA, 22 nt, Human
acagggcagcaacuuugugccu

SEQ ID NO: 362285 - RNA, 22 nt, Human
auauacaguuuuacaggguuuc

SEQ ID NO: 362286 - RNA, 22 nt, Human
uugaaagaggcaaaguuugauc

SEQ ID NO: 362287 - RNA, 22 nt, Human
cggggcugcgcucuuccugccg

SEQ ID NO: 362288 - RNA, 22 nt, Human
gaauucugguccuguccaaggu

SEQ ID NO: 362289 - RNA, 22 nt, Human
gcagagcuaucuucuggauuug

SEQ ID NO: 362290 - RNA, 22 nt, Human
uggcagagccuugccaaacucc

SEQ ID NO: 362291 - RNA, 22 nt, Human
uuaguuaguggggcugucaguc

SEQ ID NO: 362292 - RNA, 19 nt, Human
uguggccaugguucagcug

SEQ ID NO: 362293 - RNA, 22 nt, Human
ucuuuccaaggacucuguagca

SEQ ID NO: 362294 - RNA, 22 nt, Human
agugaaaacacuaguucuugcc

SEQ ID NO: 362295 - RNA, 22 nt, Human
aggcacugaaagguggccagag

SEQ ID NO: 362296 - RNA, 22 nt, Human
cucucuucccgugaguguugca

SEQ ID NO: 362297 - RNA, 22 nt, Human
cugccuggaaugccagcuucuc

SEQ ID NO: 362298 - RNA, 22 nt, Human
uggccaggggaguuccccucca

SEQ ID NO: 362299 - RNA, 22 nt, Human
ggcugcagauagccagccacca

SEQ ID NO: 362300 - RNA, 22 nt, Human
uuccaugaaauguguuaugcuu

SEQ ID NO: 362301 - RNA, 22 nt, Human
auugucugaauccaaagcucug

SEQ ID NO: 362302 - RNA, 22 nt, Human
ccaaaguccauaguuuacuuua

SEQ ID NO: 362303 - RNA, 22 nt, Human
ggcuggucacaccacugcaggg

SEQ ID NO: 362304 - RNA, 22 nt, Human
uacauuaacuuacguccacaug

SEQ ID NO: 362305 - RNA, 22 nt, Human
ggcauuuaucuaauauaguuua

SEQ ID NO: 362306 - RNA, 22 nt, Human
aagaagagaaaugugcugcugg

SEQ ID NO: 362307 - RNA, 23 nt, Human
uuuuccagaaucgacucuguaga

SEQ ID NO: 362308 - RNA, 22 nt, Human
ugaaucauggauaaauagcuua

SEQ ID NO: 362309 - RNA, 22 nt, Human
ugcccaaguccuccaccgaggu

SEQ ID NO: 362310 - RNA, 22 nt, Human
gguggcuggaggagcugaugga

SEQ ID NO: 362311 - RNA, 22 nt, Human
gugccagcaguuauggugauuu

SEQ ID NO: 362312 - RNA, 19 nt, Human
ggcagucucaagcagcaca

SEQ ID NO: 362313 - RNA, 22 nt, Human
uuucaaagucaauaucauuacc

SEQ ID NO: 362314 - RNA, 22 nt, Human
agauacaugucaagagacuuau

SEQ ID NO: 362315 - RNA, 22 nt, Human
gcaggccugacuguagggggca

SEQ ID NO: 362316 - RNA, 22 nt, Human
ggcagauggagaagcagcaggu

SEQ ID NO: 362317 - RNA, 22 nt, Human
ucucuucucuagugagcaacug

SEQ ID NO: 362318 - RNA, 22 nt, Human
gcuccucuucucccacugaaug

SEQ ID NO: 362319 - RNA, 22 nt, Human
guggcugcuguccucucugguu

SEQ ID NO: 362320 - RNA, 22 nt, Human
ggugagaggcagaggacagcuu

SEQ ID NO: 362321 - RNA, 22 nt, Human
cuugaacucaaugugaggaaga

SEQ ID NO: 362322 - RNA, 22 nt, Human
cugcuguguugccagugucacc

SEQ ID NO: 362323 - RNA, 22 nt, Human
caggaagagaacauggaggcug

SEQ ID NO: 362324 - RNA, 22 nt, Human
aacaucuacuaagugccaggca

SEQ ID NO: 362325 - RNA, 19 nt, Human
ucaaaggcaaggaggaacu

SEQ ID NO: 362326 - RNA, 19 nt, Human
uccaggaggcugccauuga

SEQ ID NO: 362327 - RNA, 22 nt, Human
caccagcuuugcccacugccca

SEQ ID NO: 362328 - RNA, 22 nt, Human
ugguggcaauguccuggagaag

SEQ ID NO: 362329 - RNA, 22 nt, Human
gagagaagaauguuccgaggcc

SEQ ID NO: 362330 - RNA, 22 nt, Human
aggccagguggucaugcuugcu

SEQ ID NO: 362331 - RNA, 22 nt, Human
cuggggcugcagcgaucuucau

SEQ ID NO: 362332 - RNA, 22 nt, Human
ugcucccaggcauucucuguug

SEQ ID NO: 362333 - RNA, 22 nt, Human
gaaauauuguacuggagauguu

SEQ ID NO: 362334 - RNA, 22 nt, Human
ggcaggagggcggacaaugacc

SEQ ID NO: 362335 - RNA, 22 nt, Human
gcagauggaaagugcuugaggg

SEQ ID NO: 362336 - RNA, 22 nt, Human
agcuggguggagggcccacggu

SEQ ID NO: 362337 - RNA, 22 nt, Human
uggaaagaugaagauguuuaag

SEQ ID NO: 362338 - RNA, 22 nt, Human
uggcucagcgcggccuggucuu

SEQ ID NO: 362339 - RNA, 22 nt, Human
caaaugaagaaccuucucaccu

SEQ ID NO: 362340 - RNA, 22 nt, Human
augaggcagcugcuggagaacg

SEQ ID NO: 362341 - RNA, 22 nt, Human
augaaacagugaauuagucaag

SEQ ID NO: 362342 - RNA, 22 nt, Human
ugggcagggaucucuuuugcaa

SEQ ID NO: 362343 - RNA, 22 nt, Human
ugggccuggagcccuggagagu

SEQ ID NO: 362344 - RNA, 17 nt, Human
cugaagauaauggcaac

SEQ ID NO: 362345 - RNA, 22 nt, Human
caggagcccguugcuccggcgg

SEQ ID NO: 362346 - RNA, 22 nt, Human
ugccaggcccagcagggcggcc

SEQ ID NO: 362347 - RNA, 19 nt, Human
gcagccaggugcucuaccu

SEQ ID NO: 362348 - RNA, 22 nt, Human
agcugucuuucugccuccugau

SEQ ID NO: 362349 - RNA, 23 nt, Human
gggcaguuauguuguccuuggcu

SEQ ID NO: 362350 - RNA, 22 nt, Human
gcugaagggagugcugagucug

SEQ ID NO: 362351 - RNA, 22 nt, Human
uccauaagcagguucuuccuga

SEQ ID NO: 362352 - RNA, 22 nt, Human
gcagaggagaugaagauacuuu

SEQ ID NO: 362353 - RNA, 23 nt, Human
uggggcugauggagacggaccag

SEQ ID NO: 362354 - RNA, 22 nt, Human
gcugagaguccaggaaaacauc

SEQ ID NO: 362355 - RNA, 22 nt, Human
aggcugggcuccgcccaacucc

SEQ ID NO: 362356 - RNA, 22 nt, Human
gaguggagaucgugccacugca

SEQ ID NO: 362357 - RNA, 22 nt, Human
aggcugcuuccuuacguggcug

SEQ ID NO: 362358 - RNA, 22 nt, Human
ugucccagucaaggcugucauc

SEQ ID NO: 362359 - RNA, 22 nt, Human
uacacacagaggccaugggauu

SEQ ID NO: 362360 - RNA, 22 nt, Human
uauuuagaaugcguguacgugu

SEQ ID NO: 362361 - RNA, 20 nt, Human
aacauugcuucaauguaacc

SEQ ID NO: 362362 - RNA, 22 nt, Human
gcucugagucucagcuaccaca

SEQ ID NO: 362363 - RNA, 22 nt, Human
ucagcuuuccugcagcuaaggg

SEQ ID NO: 362364 - RNA, 22 nt, Human
agaagccaugguaugcaacuac

SEQ ID NO: 362365 - RNA, 22 nt, Human
gagcuggcuaauacugacuuau

SEQ ID NO: 362366 - RNA, 22 nt, Human
gugugcagaagacacaagacau

SEQ ID NO: 362367 - RNA, 22 nt, Human
uggcuuccgccgcgggccucgg

SEQ ID NO: 362368 - RNA, 22 nt, Human
ugggccacuugaaaguggaugu

SEQ ID NO: 362369 - RNA, 22 nt, Human
cagccacguagcccuuggccgu

SEQ ID NO: 362370 - RNA, 22 nt, Human
uccaggcaugguguaauuuugc

SEQ ID NO: 362371 - RNA, 20 nt, Human
uuucaguugguuaauggcau

SEQ ID NO: 362372 - RNA, 22 nt, Human
cuggacagaaaccaguccuggg

SEQ ID NO: 362373 - RNA, 22 nt, Human
gggcagggguagcauuccaagu

SEQ ID NO: 362374 - RNA, 22 nt, Human
caauagcagcuucugaaugcaa

SEQ ID NO: 362375 - RNA, 22 nt, Human
ggucagggggaucugugaggua

SEQ ID NO: 362376 - RNA, 22 nt, Human
acauuuuaauaugcuuagugug

SEQ ID NO: 362377 - RNA, 22 nt, Human
uuuaacuuaaucugcuugauga

SEQ ID NO: 362378 - RNA, 18 nt, Human
uggagcagguaggcauga

SEQ ID NO: 362379 - RNA, 22 nt, Human
gcucucuguuauuaagaucuuu

SEQ ID NO: 362380 - RNA, 22 nt, Human
uggccucuuacgacauagccuu

SEQ ID NO: 362381 - RNA, 22 nt, Human
acacugcagaugaaagcauaag

SEQ ID NO: 362382 - RNA, 22 nt, Human
auguuacacauaggcauaaaug

SEQ ID NO: 362383 - RNA, 22 nt, Human
uccugggagagugggacuguau

SEQ ID NO: 362384 - RNA, 22 nt, Human
ugcucccagggacucuggcugg

SEQ ID NO: 362385 - RNA, 22 nt, Human
gcagggacaacugugcaccuga

SEQ ID NO: 362386 - RNA, 22 nt, Human
ggcccagcugugcuuccagccc

SEQ ID NO: 362387 - RNA, 22 nt, Human
uagcagggucucaggagucagg

SEQ ID NO: 362388 - RNA, 22 nt, Human
uccucugcucagcauuccucac

SEQ ID NO: 362389 - RNA, 22 nt, Human
cuggccuuggaagggagcccgu

SEQ ID NO: 362390 - RNA, 18 nt, Human
ucagagguacagaaaagu

SEQ ID NO: 362391 - RNA, 22 nt, Human
ucaaguauaucuagucauuagg

SEQ ID NO: 362392 - RNA, 22 nt, Human
uagggcaguuucauguuaucuu

SEQ ID NO: 362393 - RNA, 22 nt, Human
ucuggcucaggucagacaggga

SEQ ID NO: 362394 - RNA, 22 nt, Human
aagcugaggcccauggcaaggu

SEQ ID NO: 362395 - RNA, 22 nt, Human
aucagaaauagucauguuacuu

SEQ ID NO: 362396 - RNA, 22 nt, Human
cacuggaauucaagauacugag

SEQ ID NO: 362397 - RNA, 22 nt, Human
cccaggcagggacgugcucugg

SEQ ID NO: 362398 - RNA, 22 nt, Human
cauguuuacuaccaggagaaug

SEQ ID NO: 362399 - RNA, 22 nt, Human
uggcauuucuggccauuugugu

SEQ ID NO: 362400 - RNA, 22 nt, Human
aaggaggagcggaggcuuguug

SEQ ID NO: 362401 - RNA, 22 nt, Human
ggcuuuaugcagggauagaaau

SEQ ID NO: 362402 - RNA, 22 nt, Human
ucauucuccucuggaaaaggca

SEQ ID NO: 362403 - RNA, 22 nt, Human
uucacauuagugguucuauaua

SEQ ID NO: 362404 - RNA, 22 nt, Human
gauuuauuuuuaaucagcaggg

SEQ ID NO: 362405 - RNA, 22 nt, Human
acaguguccuuguggucccugu

SEQ ID NO: 362406 - RNA, 18 nt, Human
ucucugaauauuuuaugu

SEQ ID NO: 362407 - RNA, 22 nt, Human
uucaugaaaguguaucuugugg

SEQ ID NO: 362408 - RNA, 22 nt, Human
acagaauugauggaaaucucag

SEQ ID NO: 362409 - RNA, 19 nt, Human
ugagcaugcgagcugagaa

SEQ ID NO: 362410 - RNA, 19 nt, Human
ugaaauggcaguugcuaaa

SEQ ID NO: 362411 - RNA, 22 nt, Human
aacagcaugcuggguaacauug

SEQ ID NO: 362412 - RNA, 22 nt, Human
gaucuguuauaaucucuuuuau

SEQ ID NO: 362413 - RNA, 22 nt, Human
augcaacaaaugcuacgaaucg

SEQ ID NO: 362414 - RNA, 22 nt, Human
cagcaggacccaggaauccugc

SEQ ID NO: 362415 - RNA, 22 nt, Human
auucuucaccauggauaauuug

SEQ ID NO: 362416 - RNA, 21 nt, Human
aggcagcucaggcccagagag

SEQ ID NO: 362417 - RNA, 22 nt, Human
gaacagaauuaccgaagaucug

SEQ ID NO: 362418 - RNA, 22 nt, Human
aucagcaaucaaauugcagagu

SEQ ID NO: 362419 - RNA, 22 nt, Human
acccaggacacagagaugaccc

SEQ ID NO: 362420 - RNA, 22 nt, Human
uccaaauucuagggccuugguu

SEQ ID NO: 362421 - RNA, 22 nt, Human
uguucuugggaaucuuacaguu

SEQ ID NO: 362422 - RNA, 22 nt, Human
caggugggaccaugauagggca

SEQ ID NO: 362423 - RNA, 22 nt, Human
ccagagucuaugaguccucauu

SEQ ID NO: 362424 - RNA, 22 nt, Human
aguuacaaccaugacacaagca

SEQ ID NO: 362425 - RNA, 22 nt, Human
agagccuugaagaucuggaaaa

SEQ ID NO: 362426 - RNA, 22 nt, Human
uguggcccagaugagugugcua

SEQ ID NO: 362427 - RNA, 22 nt, Human
gugagcaggauuucauggugua

SEQ ID NO: 362428 - RNA, 21 nt, Human
cccaggaggagcuccggcucc

SEQ ID NO: 362429 - RNA, 22 nt, Human
cugggcuggcgcauccgacacg

SEQ ID NO: 362430 - RNA, 22 nt, Human
gcaggggcugagcaccagcggg

SEQ ID NO: 362431 - RNA, 18 nt, Human
cagaaaucacaccagcac

SEQ ID NO: 362432 - RNA, 22 nt, Human
auacaaauuuauagaugcauuu

SEQ ID NO: 362433 - RNA, 22 nt, Human
cagagaaaaaauccugcucuca

SEQ ID NO: 362434 - RNA, 22 nt, Human
ucuucaaguuccaaagugcagg

SEQ ID NO: 362435 - RNA, 22 nt, Human
uuuaggcacagggaguugguuu

SEQ ID NO: 362436 - RNA, 22 nt, Human
cacccagccuucacacaggagu

SEQ ID NO: 362437 - RNA, 22 nt, Human
acagagcaauucuuggguguuu

SEQ ID NO: 362438 - RNA, 22 nt, Human
ucagcagaggggaaggcaucug

SEQ ID NO: 362439 - RNA, 23 nt, Human
uggcagagacccagaaucuacau

SEQ ID NO: 362440 - RNA, 22 nt, Human
cagugucuuauuuguagcucag

SEQ ID NO: 362441 - RNA, 22 nt, Human
aggaagcaaaaggcagggucua

SEQ ID NO: 362442 - RNA, 22 nt, Human
gaggaacccagcugggguugcc

SEQ ID NO: 362443 - RNA, 22 nt, Human
caaagauuuuagaauuugcaau

SEQ ID NO: 362444 - RNA, 22 nt, Human
aucaggauccaccuugagccug

SEQ ID NO: 362445 - RNA, 22 nt, Human
acauuuaaccaaacuguuuaau

SEQ ID NO: 362446 - RNA, 22 nt, Human
uuauguacucugcaauguuuga

SEQ ID NO: 362447 - RNA, 22 nt, Human
uuuuccucuguuauuaguguga

SEQ ID NO: 362448 - RNA, 22 nt, Human
ucucuggguuuuuguccuguac

SEQ ID NO: 362449 - RNA, 22 nt, Human
gccuggccugaacuaggaggug

SEQ ID NO: 362450 - RNA, 22 nt, Human
gcugcucugaaaaugacuguug

SEQ ID NO: 362451 - RNA, 22 nt, Human
acccuuucuuacucacacgcuc

SEQ ID NO: 362452 - RNA, 22 nt, Human
agggccuggugaccuggguccu

SEQ ID NO: 362453 - RNA, 22 nt, Human
guuuacauguacucauuauacu

SEQ ID NO: 362454 - RNA, 22 nt, Human
cagggcuguaaauuagugcuga

SEQ ID NO: 362455 - RNA, 22 nt, Human
aaauucuuucauggcuaauaag

SEQ ID NO: 362456 - RNA, 22 nt, Human
cagugcauaaucuaaauggggg

SEQ ID NO: 362457 - RNA, 22 nt, Human
acaggcuggugguccuggccau

SEQ ID NO: 362458 - RNA, 21 nt, Human
acuguucaucuguucagaagc

SEQ ID NO: 362459 - RNA, 23 nt, Human
uggaauaauaagguacauuaaca

SEQ ID NO: 362460 - RNA, 22 nt, Human
augggaggcaggcucagaaccg

SEQ ID NO: 362461 - RNA, 22 nt, Human
ucgagcucuggagccaaggaug

SEQ ID NO: 362462 - RNA, 22 nt, Human
aaaugcacaauaaaguaaaggc

SEQ ID NO: 362463 - RNA, 22 nt, Human
uccaggcaaggauaauaaacau

SEQ ID NO: 362464 - RNA, 22 nt, Human
agggugcauguuugcaagagug

SEQ ID NO: 362465 - RNA, 22 nt, Human
caaaugauaccuauuacuaggc

SEQ ID NO: 362466 - RNA, 22 nt, Human
ccuguucacuuugacuucucca

SEQ ID NO: 362467 - RNA, 22 nt, Human
ccaucagcuccaguaucuucug

SEQ ID NO: 362468 - RNA, 22 nt, Human
uccucagacuucccuuugugua

SEQ ID NO: 362469 - RNA, 22 nt, Human
cuggugcaggaaggagcuggca

SEQ ID NO: 362470 - RNA, 22 nt, Human
ucuuugcaugcauuuucccuua

SEQ ID NO: 362471 - RNA, 22 nt, Human
ccagcuuuucuuaucauuauaa

SEQ ID NO: 362472 - RNA, 22 nt, Human
cuggcagcuuagcacucugguu

SEQ ID NO: 362473 - RNA, 22 nt, Human
ugcugccuucuaggcgugcccu

SEQ ID NO: 362474 - RNA, 17 nt, Human
cccacggaggugugaaa

SEQ ID NO: 362475 - RNA, 22 nt, Human
gaagagcuccaaaaacagugag

SEQ ID NO: 362476 - RNA, 22 nt, Human
uauuuccagcaguaagaagaca

SEQ ID NO: 362477 - RNA, 21 nt, Human
ugggaccuauuucaacuggau

SEQ ID NO: 362478 - RNA, 22 nt, Human
ugucauaaucaguuuugcaugu

SEQ ID NO: 362479 - RNA, 21 nt, Human
ccuguucacagaucuguaacu

SEQ ID NO: 362480 - RNA, 22 nt, Human
uggaaagaaaaacaggccauga

SEQ ID NO: 362481 - RNA, 22 nt, Human
guuuaagaggguuucauuccca

SEQ ID NO: 362482 - RNA, 22 nt, Human
uuuguagaggguaauugacaga

SEQ ID NO: 362483 - RNA, 22 nt, Human
agcagcugggcucagagcuggg

SEQ ID NO: 362484 - RNA, 22 nt, Human
cugugucccuugucccagagcc

SEQ ID NO: 362485 - RNA, 22 nt, Human
ucagaggaacacuguuucaugc

SEQ ID NO: 362486 - RNA, 22 nt, Human
uaaggccaccguuauagaacca

SEQ ID NO: 362487 - RNA, 22 nt, Human
uugaagcaaggcgaaucuugug

SEQ ID NO: 362488 - RNA, 22 nt, Human
uggaggcaccacuggcugcccg

SEQ ID NO: 362489 - RNA, 22 nt, Human
ccagggcagcagaauuggggca

SEQ ID NO: 362490 - RNA, 22 nt, Human
augcuuaacucuguacauaguu

SEQ ID NO: 362491 - RNA, 22 nt, Human
gaggagaagcuauuggaaggac

SEQ ID NO: 362492 - RNA, 22 nt, Human
cccaggaguuggaggcuacggu

SEQ ID NO: 362493 - RNA, 22 nt, Human
acaggcagguugagaaacauuu

SEQ ID NO: 362494 - RNA, 22 nt, Human
cuggccugugggcugucuccgg

SEQ ID NO: 362495 - RNA, 22 nt, Human
aggauuuaccuccagcuaggcu

SEQ ID NO: 362496 - RNA, 22 nt, Human
uuacaagauaaccugaugcugu

SEQ ID NO: 362497 - RNA, 17 nt, Human
uggcucugaggcugaau

SEQ ID NO: 362498 - RNA, 22 nt, Human
ccuuucucuaucgacccaucgc

SEQ ID NO: 362499 - RNA, 22 nt, Human
gaggcaguguuuacugcccugu

SEQ ID NO: 362500 - RNA, 22 nt, Human
acuuuagaccaucuuccacagu

SEQ ID NO: 362501 - RNA, 22 nt, Human
uggauuuauggagaccgaaagu

SEQ ID NO: 362502 - RNA, 22 nt, Human
ggcagaggugaaguucacaagg

SEQ ID NO: 362503 - RNA, 22 nt, Human
cuaguggaaacuaacuggaauu

SEQ ID NO: 362504 - RNA, 22 nt, Human
agccuggagaagauguguauug

SEQ ID NO: 362505 - RNA, 22 nt, Human
aauuccagaggaggacaguccu

SEQ ID NO: 362506 - RNA, 22 nt, Human
cucugcagaauuugagcugcuc

SEQ ID NO: 362507 - RNA, 22 nt, Human
cccuucucuuucacucacuauu

SEQ ID NO: 362508 - RNA, 22 nt, Human
gaugcacuugccccuccucaga

SEQ ID NO: 362509 - RNA, 22 nt, Human
aaugcagugagccauuaaaugg

SEQ ID NO: 362510 - RNA, 22 nt, Human
gggaccuggcaccuuugcucug

SEQ ID NO: 362511 - RNA, 22 nt, Human
uuacaagcagcuacauaucaca

SEQ ID NO: 362512 - RNA, 22 nt, Human
caagcuccuuacauccacaggg

SEQ ID NO: 362513 - RNA, 22 nt, Human
ucucuggaguauaaccagggau

SEQ ID NO: 362514 - RNA, 22 nt, Human
gugcuuucugcugcauuccucu

SEQ ID NO: 362515 - RNA, 23 nt, Human
aggcagcagguuguccaggguga

SEQ ID NO: 362516 - RNA, 22 nt, Human
cugccuguuagucuagcaguua

SEQ ID NO: 362517 - RNA, 22 nt, Human
gcugaagcccacguggcuugua

SEQ ID NO: 362518 - RNA, 22 nt, Human
cugcagcuauauuuucccacag

SEQ ID NO: 362519 - RNA, 22 nt, Human
gagagcugauagaugagcuacu

SEQ ID NO: 362520 - RNA, 22 nt, Human
aucagcaagacuaggggaauac

SEQ ID NO: 362521 - RNA, 22 nt, Human
agcagggcuccauuucacugcc

SEQ ID NO: 362522 - RNA, 22 nt, Human
ugcaggcaggggaugagcagcc

SEQ ID NO: 362523 - RNA, 15 nt, Human
cagucccagggaccc

SEQ ID NO: 362524 - RNA, 22 nt, Human
ucaguggaguauggaugaaguc

SEQ ID NO: 362525 - RNA, 22 nt, Human
uuaaaguucauuaaaugagcca

SEQ ID NO: 362526 - RNA, 22 nt, Human
gaagcccagggcguggccgggc

SEQ ID NO: 362527 - RNA, 22 nt, Human
gcagggcaaauguggaaaggag

SEQ ID NO: 362528 - RNA, 22 nt, Human
ggcugggcaggucugcacaggg

SEQ ID NO: 362529 - RNA, 22 nt, Human
uuauacuuuauacuacaucauu

SEQ ID NO: 362530 - RNA, 22 nt, Human
caugucuuuguuaugcucacca

SEQ ID NO: 362531 - RNA, 19 nt, Human
aucugaaguaggugcagcu

SEQ ID NO: 362532 - RNA, 22 nt, Human
aagcagaggguauggccagguu

SEQ ID NO: 362533 - RNA, 22 nt, Human
gcagggcucugcuguaguccua

SEQ ID NO: 362534 - RNA, 22 nt, Human
ccugcucagagcgucuugugug

SEQ ID NO: 362535 - RNA, 22 nt, Human
gcugcaggcauuuuccugggca

SEQ ID NO: 362536 - RNA, 22 nt, Human
aucuauacuacaaauggcuggu

SEQ ID NO: 362537 - RNA, 22 nt, Human
caguaaaagauggaaauagaau

SEQ ID NO: 362538 - RNA, 22 nt, Human
uuaugcuaagugcaacaagcca

SEQ ID NO: 362539 - RNA, 22 nt, Human
ucugcugugauuugcuaccugu

SEQ ID NO: 362540 - RNA, 22 nt, Human
aagaugauaggacuugcuuaag

SEQ ID NO: 362541 - RNA, 22 nt, Human
caggcugggaacgccacccgcu

SEQ ID NO: 362542 - RNA, 22 nt, Human
aaugaaauguagcuuauccaua

SEQ ID NO: 362543 - RNA, 22 nt, Human
aagcagagccaccagcuuugga

SEQ ID NO: 362544 - RNA, 22 nt, Human
gcucagagcaucccagugaaug

SEQ ID NO: 362545 - RNA, 22 nt, Human
aagggaaaucauauggugcagu

SEQ ID NO: 362546 - RNA, 22 nt, Human
caagagcauuuaguuagcuggu

SEQ ID NO: 362547 - RNA, 22 nt, Human
uuaacagagugccuggcaugua

SEQ ID NO: 362548 - RNA, 22 nt, Human
aggguagggcccggagacagac

SEQ ID NO: 362549 - RNA, 22 nt, Human
ucucuucuuguguuuuccugcc

SEQ ID NO: 362550 - RNA, 22 nt, Human
aggcagucuaguccccaggcaa

SEQ ID NO: 362551 - RNA, 22 nt, Human
gcugccagucuaaugggaaaca

SEQ ID NO: 362552 - RNA, 22 nt, Human
gcucuccacugaccacggggca

SEQ ID NO: 362553 - RNA, 22 nt, Human
uacaggcauguagcauggugau

SEQ ID NO: 362554 - RNA, 22 nt, Human
ucuggccagugaaaugcagaau

SEQ ID NO: 362555 - RNA, 22 nt, Human
agggcagccugagugcuggccc

SEQ ID NO: 362556 - RNA, 22 nt, Human
caguggguccuaaguacaguuc

SEQ ID NO: 362557 - RNA, 21 nt, Human
cagcuuugucugucuucgggg

SEQ ID NO: 362558 - RNA, 22 nt, Human
acagcuuuucaauucugcugag

SEQ ID NO: 362559 - RNA, 22 nt, Human
gagcucccuggagguucagaua

SEQ ID NO: 362560 - RNA, 22 nt, Human
aaguccaguuucauuugagguc

SEQ ID NO: 362561 - RNA, 22 nt, Human
ccugagggcgccgagcucccag

SEQ ID NO: 362562 - RNA, 22 nt, Human
agcagcauuuaaggauccaagu

SEQ ID NO: 362563 - RNA, 21 nt, Human
gugcuuuuccuuaauguucuu

SEQ ID NO: 362564 - RNA, 22 nt, Human
cuuuuuccagcuucaggguggg

SEQ ID NO: 362565 - RNA, 22 nt, Human
cuuaagauuugagauaccuaau

SEQ ID NO: 362566 - RNA, 22 nt, Human
gagugcaguaugagaggcugcu

SEQ ID NO: 362567 - RNA, 21 nt, Human
auccuuagcacuuagaagagu

SEQ ID NO: 362568 - RNA, 22 nt, Human
uguggccuugcagccuggaggu

SEQ ID NO: 362569 - RNA, 19 nt, Human
acauuuaaauucagaucuc

SEQ ID NO: 362570 - RNA, 22 nt, Human
gcccucucggcauagcaggggc

SEQ ID NO: 362571 - RNA, 22 nt, Human
cuggagccggaccagggacggu

SEQ ID NO: 362572 - RNA, 22 nt, Human
caccagggacaaugcuaggggu

SEQ ID NO: 362573 - RNA, 22 nt, Human
ccagguguggggaggacucaca

SEQ ID NO: 362574 - RNA, 22 nt, Human
caugagcugcugggagccuguc

SEQ ID NO: 362575 - RNA, 23 nt, Human
caguacuuaguguagcguuaauu

SEQ ID NO: 362576 - RNA, 22 nt, Human
cuuaggcauccaggguucuucc

SEQ ID NO: 362577 - RNA, 22 nt, Human
aagccaggcugcacuugcuggg

SEQ ID NO: 362578 - RNA, 22 nt, Human
uucucagauccaucagaagucc

SEQ ID NO: 362579 - RNA, 22 nt, Human
caugucuugcccugauuaguag

SEQ ID NO: 362580 - RNA, 22 nt, Human
augguuuguguggcccagauga

SEQ ID NO: 362581 - RNA, 20 nt, Human
acaggagaucugaggaaagg

SEQ ID NO: 362582 - RNA, 18 nt, Human
aggcagacacuagagguc

SEQ ID NO: 362583 - RNA, 22 nt, Human
aggcagacucaauggcuagaua

SEQ ID NO: 362584 - RNA, 21 nt, Human
ugaggcuguuguaccagggag

SEQ ID NO: 362585 - RNA, 18 nt, Human
aagccagagaccacugcc

SEQ ID NO: 362586 - RNA, 22 nt, Human
auguggaaugaacaaaggaggc

SEQ ID NO: 362587 - RNA, 22 nt, Human
gucccugggaugcccuucuggg

SEQ ID NO: 362588 - RNA, 22 nt, Human
aauguguagauguugcauuccu

SEQ ID NO: 362589 - RNA, 22 nt, Human
aucagcaaguccuguuaauucu

SEQ ID NO: 362590 - RNA, 22 nt, Human
gagggcuguggggcaugaccag

SEQ ID NO: 362591 - RNA, 23 nt, Human
aggagacagggaagugccuggcu

SEQ ID NO: 362592 - RNA, 20 nt, Human
gcugucuggauuagaagccu

SEQ ID NO: 362593 - RNA, 22 nt, Human
aggagaggucucccuuccccag

SEQ ID NO: 362594 - RNA, 22 nt, Human
ucagaggaggcauuuaaacaga

SEQ ID NO: 362595 - RNA, 22 nt, Human
uauacuuuccugcaacuuugau

SEQ ID NO: 362596 - RNA, 22 nt, Human
aaaugucuuugaguauuucugc

SEQ ID NO: 362597 - RNA, 22 nt, Human
agggcugacaaauggcagugac

SEQ ID NO: 362598 - RNA, 22 nt, Human
gaaggccacggaauggagcugg

SEQ ID NO: 362599 - RNA, 22 nt, Human
gaggagcuugugagaagauguc

SEQ ID NO: 362600 - RNA, 22 nt, Human
ugaugauguuuaucuugguauu

SEQ ID NO: 362601 - RNA, 22 nt, Human
gcucugcuggagggaaagagaa

SEQ ID NO: 362602 - RNA, 21 nt, Human
agccuguugguuuacugcuca

SEQ ID NO: 362603 - RNA, 22 nt, Human
ccugccugcagaaaguaucucc

SEQ ID NO: 362604 - RNA, 22 nt, Human
ggccaggagaggagggcacuga

SEQ ID NO: 362605 - RNA, 22 nt, Human
guggccucuguuggcuccuagg

SEQ ID NO: 362606 - RNA, 22 nt, Human
gggcuggaggugagcaggacag

SEQ ID NO: 362607 - RNA, 22 nt, Human
aagcagaguccccuucccaugg

SEQ ID NO: 362608 - RNA, 22 nt, Human
uaguggaggccuguugugugca

SEQ ID NO: 362609 - RNA, 22 nt, Human
aggcaguggaugucaggaaugg

SEQ ID NO: 362610 - RNA, 19 nt, Human
aggcugugagggaggacuc

SEQ ID NO: 362611 - RNA, 22 nt, Human
agcagggcuuuggcuggcuuuc

SEQ ID NO: 362612 - RNA, 22 nt, Human
gaggcucaguuauuuuagccug

SEQ ID NO: 362613 - RNA, 22 nt, Human
uucaagauggcaccagugagug

SEQ ID NO: 362614 - RNA, 21 nt, Human
ccagacuggccuaugugguag

SEQ ID NO: 362615 - RNA, 22 nt, Human
ggcaggagcucagguugguucc

SEQ ID NO: 362616 - RNA, 22 nt, Human
uuuccuuccaaaugcccgggag

SEQ ID NO: 362617 - RNA, 22 nt, Human
auuucagguaccugugggaucc

SEQ ID NO: 362618 - RNA, 22 nt, Human
accucugccaagaugugcuccc

SEQ ID NO: 362619 - RNA, 22 nt, Human
gggauggacuuggggacuccag

SEQ ID NO: 362620 - RNA, 22 nt, Human
gguacaaugguucauuuuaugu

SEQ ID NO: 362621 - RNA, 22 nt, Human
uugcuuccaguccaagucuguu

SEQ ID NO: 362622 - RNA, 22 nt, Human
caugaauauacauccugauggc

SEQ ID NO: 362623 - RNA, 22 nt, Human
cugcaggauucucccaguugga

SEQ ID NO: 362624 - RNA, 22 nt, Human
ugucucaggcccaagccaguaa

SEQ ID NO: 362625 - RNA, 22 nt, Human
cauaagaaauaaugaugaugac

SEQ ID NO: 362626 - RNA, 22 nt, Human
uuggauccaucucaggcauagg

SEQ ID NO: 362627 - RNA, 22 nt, Human
ccuuaaauucuccauuugaaag

SEQ ID NO: 362628 - RNA, 22 nt, Human
uccugggcugugugccacucug

SEQ ID NO: 362629 - RNA, 22 nt, Human
cagccaucccagccugugguuc

SEQ ID NO: 362630 - RNA, 22 nt, Human
caauauauaggaacaacuuagg

SEQ ID NO: 362631 - RNA, 22 nt, Human
uuucaucuucccagagaccuug

SEQ ID NO: 362632 - RNA, 22 nt, Human
agaccagcugccucccagggcc

SEQ ID NO: 362633 - RNA, 22 nt, Human
ucuggcuccuggcuccacugcc

SEQ ID NO: 362634 - RNA, 22 nt, Human
ugcauacacaugugcacauacg

SEQ ID NO: 362635 - RNA, 22 nt, Human
aggagaguucacacuggucaga

SEQ ID NO: 362636 - RNA, 22 nt, Human
ucagccacuacccaccuuaaca

SEQ ID NO: 362637 - RNA, 22 nt, Human
cuggugccuccucccugugcuu

SEQ ID NO: 362638 - RNA, 22 nt, Human
uggcacugggacagaugcucuc

SEQ ID NO: 362639 - RNA, 22 nt, Human
uugguuuacuaggauucaaauu

SEQ ID NO: 362640 - RNA, 22 nt, Human
ggccugagcuugggcagcguau

SEQ ID NO: 362641 - RNA, 22 nt, Human
uucagcagugcagacacccagu

SEQ ID NO: 362642 - RNA, 22 nt, Human
gaaggccacuuuguguugagaa

SEQ ID NO: 362643 - RNA, 22 nt, Human
uccaagaucuacagcaguuuag

SEQ ID NO: 362644 - RNA, 22 nt, Human
gcucuaauugaaaaauacugca

SEQ ID NO: 362645 - RNA, 21 nt, Human
ccagagccugcugagcccccu

SEQ ID NO: 362646 - RNA, 22 nt, Human
ucagagguaguagcagaguuga

SEQ ID NO: 362647 - RNA, 15 nt, Human
cccaggaguucgaga

SEQ ID NO: 362648 - RNA, 22 nt, Human
uucauuccugagcccauauuua

SEQ ID NO: 362649 - RNA, 22 nt, Human
ccaggcugagcaugauuggagc

SEQ ID NO: 362650 - RNA, 22 nt, Human
cgcugccaggucaccaggggua

SEQ ID NO: 362651 - RNA, 22 nt, Human
uccugcagaucaaagccuuuga

SEQ ID NO: 362652 - RNA, 22 nt, Human
ucucccagaaguccucaguaca

SEQ ID NO: 362653 - RNA, 22 nt, Human
uugaaaguccuucuugaguuac

SEQ ID NO: 362654 - RNA, 22 nt, Human
ugcaggaaucagaggggaagcg

SEQ ID NO: 362655 - RNA, 22 nt, Human
ggcuuggaaaugguaaugagcu

SEQ ID NO: 362656 - RNA, 22 nt, Human
cauuucaagcauugacuucuau

SEQ ID NO: 362657 - RNA, 22 nt, Human
guacagaaaguacccauagaag

SEQ ID NO: 362658 - RNA, 19 nt, Human
ugccugucaguagaucuca

SEQ ID NO: 362659 - RNA, 22 nt, Human
gcccugucccuuggcuucuagg

SEQ ID NO: 362660 - RNA, 22 nt, Human
cuuaauuuaaaauaguucaggc

SEQ ID NO: 362661 - RNA, 22 nt, Human
cagagggcucuuggcugccugc

SEQ ID NO: 362662 - RNA, 22 nt, Human
ucagaguguggugagaugugca

SEQ ID NO: 362663 - RNA, 22 nt, Human
acugaaggcuuucccaagguca

SEQ ID NO: 362664 - RNA, 22 nt, Human
caggcacugugcuagauccuug

SEQ ID NO: 362665 - RNA, 22 nt, Human
gccuggccgcuccgagcuccgc

SEQ ID NO: 362666 - RNA, 22 nt, Human
cagcucuguaaauuccuucauc

SEQ ID NO: 362667 - RNA, 22 nt, Human
ugcagauucaaaugaaaugcaa

SEQ ID NO: 362668 - RNA, 22 nt, Human
gaaaacuaacggaaaaguuagg

SEQ ID NO: 362669 - RNA, 23 nt, Human
aaggccagaauuucaauggugcc

SEQ ID NO: 362670 - RNA, 22 nt, Human
uaaaugcagcaguuucuguucu

SEQ ID NO: 362671 - RNA, 22 nt, Human
aauuaaauugguuuagagagga

SEQ ID NO: 362672 - RNA, 22 nt, Human
agcagagcggggccuccggaag

SEQ ID NO: 362673 - RNA, 20 nt, Human
agccugccagcuggcccaga

SEQ ID NO: 362674 - RNA, 22 nt, Human
cagagccaacgccaccugccca

SEQ ID NO: 362675 - RNA, 22 nt, Human
gaauuguacgcuuuacauaggu

SEQ ID NO: 362676 - RNA, 22 nt, Human
cacagguguucuugcagugaaa

SEQ ID NO: 362677 - RNA, 20 nt, Human
cucaggauacugcaaaguug

SEQ ID NO: 362678 - RNA, 21 nt, Human
ucucacaauaugaugccagau

SEQ ID NO: 362679 - RNA, 22 nt, Human
aauacauauggaauuccauguu

SEQ ID NO: 362680 - RNA, 22 nt, Human
guuacacaggaaaacauuagca

SEQ ID NO: 362681 - RNA, 22 nt, Human
gugucaugggguuuguuauaca

SEQ ID NO: 362682 - RNA, 22 nt, Human
ggugaguugggguucacagguc

SEQ ID NO: 362683 - RNA, 22 nt, Human
aauguacaaaagucagccaacu

SEQ ID NO: 362684 - RNA, 18 nt, Human
acccucuggcuucugagc

SEQ ID NO: 362685 - RNA, 22 nt, Human
caaaugcauagaaagaugaaac

SEQ ID NO: 362686 - RNA, 22 nt, Human
ggcagcaguaggagcuaaucuu

SEQ ID NO: 362687 - RNA, 21 nt, Human
uccacaaguuagaaggaaauu

SEQ ID NO: 362688 - RNA, 21 nt, Human
uggcucuguucaauauaugga

SEQ ID NO: 362689 - RNA, 22 nt, Human
ggcagcuuucucacccaugacc

SEQ ID NO: 362690 - RNA, 22 nt, Human
ggucccaguccucucccugcua

SEQ ID NO: 362691 - RNA, 22 nt, Human
cucagagauauagucccugcuu

SEQ ID NO: 362692 - RNA, 22 nt, Human
ccuucauugcaucuuuaagaga

SEQ ID NO: 362693 - RNA, 22 nt, Human
agcagcauggaugggccucagc

SEQ ID NO: 362694 - RNA, 22 nt, Human
ggcugugagcaggcagaaugcu

SEQ ID NO: 362695 - RNA, 22 nt, Human
agaaauacuaggaauauucaua

SEQ ID NO: 362696 - RNA, 22 nt, Human
gcccagcuggcuuccagcacau

SEQ ID NO: 362697 - RNA, 22 nt, Human
cugcuuccauaaauaaugugcu

SEQ ID NO: 362698 - RNA, 22 nt, Human
cucaguuucuucauauuguagg

SEQ ID NO: 362699 - RNA, 22 nt, Human
guaucuuuccacaucuucagua

SEQ ID NO: 362700 - RNA, 22 nt, Human
gcccagaguucaaggcugcagu

SEQ ID NO: 362701 - RNA, 22 nt, Human
uugacaauguccuuugaauuuc

SEQ ID NO: 362702 - RNA, 22 nt, Human
gagaggaguagacacuuugguu

SEQ ID NO: 362703 - RNA, 22 nt, Human
uuuaucacagaauaagaaguca

SEQ ID NO: 362704 - RNA, 22 nt, Human
cagaggcauacucccagucuug

SEQ ID NO: 362705 - RNA, 20 nt, Human
ugggccugagccugugggcu

SEQ ID NO: 362706 - RNA, 22 nt, Human
auauucuucuuguucagacuau

SEQ ID NO: 362707 - RNA, 22 nt, Human
gaggcagcagggcugguuccuu

SEQ ID NO: 362708 - RNA, 22 nt, Human
ucaccagggcuccagccagccu

SEQ ID NO: 362709 - RNA, 22 nt, Human
gauacaaauucaugucugaauu

SEQ ID NO: 362710 - RNA, 22 nt, Human
auuuccaaaaccacuuauugcc

SEQ ID NO: 362711 - RNA, 22 nt, Human
auacuguuucucuucuacauga

SEQ ID NO: 362712 - RNA, 22 nt, Human
aaacauuugcaacucgguuugg

SEQ ID NO: 362713 - RNA, 22 nt, Human
gagagugagauccuccugggga

SEQ ID NO: 362714 - RNA, 22 nt, Human
uuauuccaguaaucucuguaau

SEQ ID NO: 362715 - RNA, 22 nt, Human
aacaggagaguaaauauaugau

SEQ ID NO: 362716 - RNA, 20 nt, Human
gaguccuuaugggcugaggu

SEQ ID NO: 362717 - RNA, 22 nt, Human
cagagagcaugggaggcccgag

SEQ ID NO: 362718 - RNA, 22 nt, Human
guggcagcggugugcaaggagg

SEQ ID NO: 362719 - RNA, 22 nt, Human
agaccaugggcucugaagagca

SEQ ID NO: 362720 - RNA, 22 nt, Human
aaggcagcccuggcucagccug

SEQ ID NO: 362721 - RNA, 22 nt, Human
ugcugccaccugguggcugaag

SEQ ID NO: 362722 - RNA, 21 nt, Human
acaugcauagagagauuucug

SEQ ID NO: 362723 - RNA, 19 nt, Human
aucuuacagagcagaguac

SEQ ID NO: 362724 - RNA, 22 nt, Human
uuucauaaccucaagcuacagu

SEQ ID NO: 362725 - RNA, 22 nt, Human
uguuucaugauugcugucauuu

SEQ ID NO: 362726 - RNA, 22 nt, Human
uaagaacaagcuggggguucca

SEQ ID NO: 362727 - RNA, 22 nt, Human
aagaggagacuucagcaacuug

SEQ ID NO: 362728 - RNA, 22 nt, Human
ucaggcaguagaauugcuugaa

SEQ ID NO: 362729 - RNA, 22 nt, Human
uauugaaaugaaugacagugau

SEQ ID NO: 362730 - RNA, 22 nt, Human
ccagagccuggcaucugcauaa

SEQ ID NO: 362731 - RNA, 22 nt, Human
uagagcuggccgggacagcugg

SEQ ID NO: 362732 - RNA, 21 nt, Human
gcagcagaggcuugacagaca

SEQ ID NO: 362733 - RNA, 22 nt, Human
ggggccagguccagcuuccaaa

SEQ ID NO: 362734 - RNA, 19 nt, Human
aguguguacugaaagcacu

SEQ ID NO: 362735 - RNA, 19 nt, Human
ucucaauguucagaaagcu

SEQ ID NO: 362736 - RNA, 22 nt, Human
auucuucacauaagugcuguac

SEQ ID NO: 362737 - RNA, 22 nt, Human
augugaaagagguguucagugg

SEQ ID NO: 362738 - RNA, 22 nt, Human
uuaaacagucccagaggcugac

SEQ ID NO: 362739 - RNA, 22 nt, Human
ggauaagaaaauuguaauaacu

SEQ ID NO: 362740 - RNA, 22 nt, Human
acauuguuugagaauacagaug

SEQ ID NO: 362741 - RNA, 22 nt, Human
uggcucagauaauucaaggggc

SEQ ID NO: 362742 - RNA, 22 nt, Human
cauugcccaguaggaucaccag

SEQ ID NO: 362743 - RNA, 22 nt, Human
cagugagggaagaucucagcac

SEQ ID NO: 362744 - RNA, 20 nt, Human
aggcugagggugauuguguc

SEQ ID NO: 362745 - RNA, 22 nt, Human
cagcuucuucaguccuggagcu

SEQ ID NO: 362746 - RNA, 22 nt, Human
aucaguuuguauaugaaacacu

SEQ ID NO: 362747 - RNA, 22 nt, Human
agaagauuuagguugacgcuau

SEQ ID NO: 362748 - RNA, 22 nt, Human
agggcacccucucugcaguacc

SEQ ID NO: 362749 - RNA, 22 nt, Human
cugagcugggacucaguagcaa

SEQ ID NO: 362750 - RNA, 22 nt, Human
agagucuuccaggcagccugag

SEQ ID NO: 362751 - RNA, 22 nt, Human
agccugagccccauccagcuga

SEQ ID NO: 362752 - RNA, 22 nt, Human
gcugugcagauguagggagugg

SEQ ID NO: 362753 - RNA, 22 nt, Human
ccagagagaguacugggcucug

SEQ ID NO: 362754 - RNA, 22 nt, Human
agaucugaggguccaagggagg

SEQ ID NO: 362755 - RNA, 22 nt, Human
guccucagggaauguggcgggu

SEQ ID NO: 362756 - RNA, 22 nt, Human
uaugcacacaucgcagcaggaa

SEQ ID NO: 362757 - RNA, 22 nt, Human
guacaguuuucaguguucacug

SEQ ID NO: 362758 - RNA, 18 nt, Human
agcugcagaccaggaggu

SEQ ID NO: 362759 - RNA, 22 nt, Human
cagcugacuucauaggaagaca

SEQ ID NO: 362760 - RNA, 22 nt, Human
cccaggaggguggccucugccc

SEQ ID NO: 362761 - RNA, 22 nt, Human
gugucccacucuggaggugaag

SEQ ID NO: 362762 - RNA, 22 nt, Human
cucuacucuuaacacagcuagg

SEQ ID NO: 362763 - RNA, 21 nt, Human
cuguggaagggaacuagaggg

SEQ ID NO: 362764 - RNA, 22 nt, Human
gccaggcuggugcaaggauauu

SEQ ID NO: 362765 - RNA, 22 nt, Human
aaaucucaauuugaauuguagc

SEQ ID NO: 362766 - RNA, 22 nt, Human
aagggacccuggaucaaaugga

SEQ ID NO: 362767 - RNA, 22 nt, Human
cucugggcuuguugaccugcac

SEQ ID NO: 362768 - RNA, 22 nt, Human
cagaagcacuaggaggaaacgu

SEQ ID NO: 362769 - RNA, 22 nt, Human
uuucuagugguuaagauuuaca

SEQ ID NO: 362770 - RNA, 22 nt, Human
aaaauccuuagccgagugaggu

SEQ ID NO: 362771 - RNA, 22 nt, Human
ccagcaggagacuagcaacaua

SEQ ID NO: 362772 - RNA, 22 nt, Human
ugcaggcugggaagagggacaa

SEQ ID NO: 362773 - RNA, 19 nt, Human
ccuggguccacucagacua

SEQ ID NO: 362774 - RNA, 22 nt, Human
agucauaugacccuucacaaac

SEQ ID NO: 362775 - RNA, 22 nt, Human
ucucacuuuccagacuuuucaa

SEQ ID NO: 362776 - RNA, 22 nt, Human
gaauucuuuucuuucugaaagu

SEQ ID NO: 362777 - RNA, 22 nt, Human
augauuuccaguuguugcuaag

SEQ ID NO: 362778 - RNA, 22 nt, Human
cucuaacacuguaaugcuuucu

SEQ ID NO: 362779 - RNA, 22 nt, Human
augcuuuacaguuuuccaaaca

SEQ ID NO: 362780 - RNA, 21 nt, Human
agcugcuccagggagcucagg

SEQ ID NO: 362781 - RNA, 22 nt, Human
cauuagggucucucagcugaau

SEQ ID NO: 362782 - RNA, 20 nt, Human
gguagcagcugcugucaucc

SEQ ID NO: 362783 - RNA, 22 nt, Human
ccuggccaggcauggagucaca

SEQ ID NO: 362784 - RNA, 22 nt, Human
cagggcccaagacacaaugagg

SEQ ID NO: 362785 - RNA, 22 nt, Human
ccccagccuuccaugggaauug

SEQ ID NO: 362786 - RNA, 22 nt, Human
cagcaggcccaggugcugguga

SEQ ID NO: 362787 - RNA, 22 nt, Human
uguuuuaugagccauauaaccu

SEQ ID NO: 362788 - RNA, 22 nt, Human
gccuugcuuugcuucuggacag

SEQ ID NO: 362789 - RNA, 21 nt, Human
agcaggaggcagucacagcuc

SEQ ID NO: 362790 - RNA, 22 nt, Human
ugagaggcagaauggugccugc

SEQ ID NO: 362791 - RNA, 22 nt, Human
ucuggaucucccucauccuggg

SEQ ID NO: 362792 - RNA, 22 nt, Human
acaaaauuaccuaguuauuuuc

SEQ ID NO: 362793 - RNA, 22 nt, Human
ugcaggugccucuugagcuugu

SEQ ID NO: 362794 - RNA, 22 nt, Human
uaaaaguggauaagcuguagga

SEQ ID NO: 362795 - RNA, 22 nt, Human
cuaaaugccuuuccuaccuaac

SEQ ID NO: 362796 - RNA, 22 nt, Human
cauugcuuccuaugucccuucu

SEQ ID NO: 362797 - RNA, 22 nt, Human
cagaaauggagcccaggaaucu

SEQ ID NO: 362798 - RNA, 22 nt, Human
agaauccugaugaaaaggagag

SEQ ID NO: 362799 - RNA, 22 nt, Human
cucuggagcaccgggcuaucca

SEQ ID NO: 362800 - RNA, 22 nt, Human
gagccuccuccuggugugccga

SEQ ID NO: 362801 - RNA, 22 nt, Human
aaauguguuuagaugguuuauu

SEQ ID NO: 362802 - RNA, 22 nt, Human
uggcaauuuuaggugguuuagu

SEQ ID NO: 362803 - RNA, 22 nt, Human
cugggccauggaagucucugcc

SEQ ID NO: 362804 - RNA, 22 nt, Human
ugaagccacagagcaucugccu

SEQ ID NO: 362805 - RNA, 22 nt, Human
uagaaaauagggccuguggagc

SEQ ID NO: 362806 - RNA, 22 nt, Human
uggucaggcugcucugcggcgu

SEQ ID NO: 362807 - RNA, 22 nt, Human
ccugccagucacuaugucaccu

SEQ ID NO: 362808 - RNA, 19 nt, Human
aggcaggugcagagguccc

SEQ ID NO: 362809 - RNA, 22 nt, Human
uaucaucuuguugucaugcagc

SEQ ID NO: 362810 - RNA, 22 nt, Human
uuucacaaacugaggagacaau

SEQ ID NO: 362811 - RNA, 22 nt, Human
caggcagcugggucaccguccc

SEQ ID NO: 362812 - RNA, 22 nt, Human
gcucagagcacucagacucagc

SEQ ID NO: 362813 - RNA, 22 nt, Human
ugcuuuaaaauggacuguuuug

SEQ ID NO: 362814 - RNA, 22 nt, Human
ccagguguagcacugcucacag

SEQ ID NO: 362815 - RNA, 22 nt, Human
uguguauuucuggaacagacua

SEQ ID NO: 362816 - RNA, 22 nt, Human
ggcucaggaccugggauugcca

SEQ ID NO: 362817 - RNA, 21 nt, Human
aggccucuucauggccaugau

SEQ ID NO: 362818 - RNA, 22 nt, Human
uggcuucuugggaugggucauu

SEQ ID NO: 362819 - RNA, 22 nt, Human
acacaggggaaaguggagcuga

SEQ ID NO: 362820 - RNA, 21 nt, Human
cauugucgacauuuuccccuc

SEQ ID NO: 362821 - RNA, 19 nt, Human
ugaagcaggcagagaagau

SEQ ID NO: 362822 - RNA, 22 nt, Human
gauuuucauuauagcuaguuuc

SEQ ID NO: 362823 - RNA, 22 nt, Human
agaaaaggauugauggaucaga

SEQ ID NO: 362824 - RNA, 22 nt, Human
agggcagagcacugaauuggga

SEQ ID NO: 362825 - RNA, 22 nt, Human
uuauuuugagagaaugugugcu

SEQ ID NO: 362826 - RNA, 22 nt, Human
caagggcauugcuugggaccuu

SEQ ID NO: 362827 - RNA, 22 nt, Human
uucuuuuacauuaagauuucag

SEQ ID NO: 362828 - RNA, 22 nt, Human
acuggauuccauugugcaaaga

SEQ ID NO: 362829 - RNA, 22 nt, Human
gaaugcacucacccaucacuca

SEQ ID NO: 362830 - RNA, 22 nt, Human
guucacaagaguuacagacaga

SEQ ID NO: 362831 - RNA, 22 nt, Human
agugcauugcaucucugcuuca

SEQ ID NO: 362832 - RNA, 22 nt, Human
ucugagagagggucagaugcua

SEQ ID NO: 362833 - RNA, 22 nt, Human
aaauucagcagugaaaugcccc

SEQ ID NO: 362834 - RNA, 22 nt, Human
cuaaucaucuuucucuuaaagc

SEQ ID NO: 362835 - RNA, 22 nt, Human
uacuuccuguuuccaugucugu

SEQ ID NO: 362836 - RNA, 22 nt, Human
augaaaacuuuagccucauuag

SEQ ID NO: 362837 - RNA, 21 nt, Human
ugauccuuucccccauguugc

SEQ ID NO: 362838 - RNA, 22 nt, Human
cacaauuuguuuuaucaguauu

SEQ ID NO: 362839 - RNA, 22 nt, Human
ugcugaggucaccuugcugcua

SEQ ID NO: 362840 - RNA, 22 nt, Human
uuccuguaguugugcaauguac

SEQ ID NO: 362841 - RNA, 22 nt, Human
ugcaagggcuuagggggcugug

SEQ ID NO: 362842 - RNA, 22 nt, Human
agggccugcucuaucacucuca

SEQ ID NO: 362843 - RNA, 22 nt, Human
cugcugggucuaugcaagugga

SEQ ID NO: 362844 - RNA, 21 nt, Human
uggcugccuacaugcugcagg

SEQ ID NO: 362845 - RNA, 22 nt, Human
ugaggggagaagcagcagccug

SEQ ID NO: 362846 - RNA, 22 nt, Human
ccugggcucaagugauccuccu

SEQ ID NO: 362847 - RNA, 20 nt, Human
gggagaagggcugaugagag

SEQ ID NO: 362848 - RNA, 22 nt, Human
ugucucugagaugacucccacc

SEQ ID NO: 362849 - RNA, 22 nt, Human
agcagugggugacagagcugag

SEQ ID NO: 362850 - RNA, 22 nt, Human
uugaaaaaauugguagaggaug

SEQ ID NO: 362851 - RNA, 22 nt, Human
agcagccaaccuuacauucauc

SEQ ID NO: 362852 - RNA, 22 nt, Human
uaauuuuacuuccugagcaccu

SEQ ID NO: 362853 - RNA, 22 nt, Human
cccagacugcagagcgggcaga

SEQ ID NO: 362854 - RNA, 22 nt, Human
uggcagcuguuaauguuuuguu

SEQ ID NO: 362855 - RNA, 22 nt, Human
acuugguugaugucauaagguu

SEQ ID NO: 362856 - RNA, 22 nt, Human
uguacauagaucuugaaaauua

SEQ ID NO: 362857 - RNA, 22 nt, Human
aacauuuaugauugagguaaau

SEQ ID NO: 362858 - RNA, 23 nt, Human
uacauuguggauggaguccuggg

SEQ ID NO: 362859 - RNA, 18 nt, Human
uuucacagauucaugacu

SEQ ID NO: 362860 - RNA, 22 nt, Human
gccaggcuggccagcaccuucu

SEQ ID NO: 362861 - RNA, 22 nt, Human
aguuugaaauguuggcaauauu

SEQ ID NO: 362862 - RNA, 22 nt, Human
acccagcaugacaccugcacau

SEQ ID NO: 362863 - RNA, 22 nt, Human
uuagauaauguuauuguaauuu

SEQ ID NO: 362864 - RNA, 22 nt, Human
aucuaagaguuaacaucaagaa

SEQ ID NO: 362865 - RNA, 22 nt, Human
agccagucggggccaugcuggg

SEQ ID NO: 362866 - RNA, 22 nt, Human
ugggggaagagcuuguuaaagu

SEQ ID NO: 362867 - RNA, 22 nt, Human
agaucaguuagauagcuugaug

SEQ ID NO: 362868 - RNA, 22 nt, Human
ggagcugaugacgucaccaugg

SEQ ID NO: 362869 - RNA, 22 nt, Human
gggcuggcaucgguugcugaga

SEQ ID NO: 362870 - RNA, 22 nt, Human
guaagcaucugucucuucugca

SEQ ID NO: 362871 - RNA, 22 nt, Human
gccaggcaggugucggagcccu

SEQ ID NO: 362872 - RNA, 22 nt, Human
acacacucaauugcauaagcac

SEQ ID NO: 362873 - RNA, 23 nt, Human
ccaaagucgaagucuaguccaga

SEQ ID NO: 362874 - RNA, 22 nt, Human
ggcagcuauuccaagcagcacu

SEQ ID NO: 362875 - RNA, 22 nt, Human
aauguuaaaaccuucagugcuu

SEQ ID NO: 362876 - RNA, 17 nt, Human
ugaaggccaugaccacg

SEQ ID NO: 362877 - RNA, 22 nt, Human
acacugaaugcuguuuagaaau

SEQ ID NO: 362878 - RNA, 22 nt, Human
ggcugcagcggauuggggauug

SEQ ID NO: 362879 - RNA, 22 nt, Human
aguggcaguuugggagcuacag

SEQ ID NO: 362880 - RNA, 22 nt, Human
ucuugauuacaaauaacaucau

SEQ ID NO: 362881 - RNA, 22 nt, Human
uuuucagaggccuaagagguuu

SEQ ID NO: 362882 - RNA, 22 nt, Human
uuuccuuccagguuccuaaggc

SEQ ID NO: 362883 - RNA, 22 nt, Human
ucaguuuuuacggucacaggga

SEQ ID NO: 362884 - RNA, 22 nt, Human
caggcacagaguuauucauuua

SEQ ID NO: 362885 - RNA, 22 nt, Human
uuacugaaaauucuucaggauu

SEQ ID NO: 362886 - RNA, 23 nt, Human
uccagcagccaagaaggguagaa

SEQ ID NO: 362887 - RNA, 22 nt, Human
ggcaggagaauggcgugaacuc

SEQ ID NO: 362888 - RNA, 22 nt, Human
auguuuuugagauacaaacaga

SEQ ID NO: 362889 - RNA, 22 nt, Human
ggucccaguugcccaggucagg

SEQ ID NO: 362890 - RNA, 22 nt, Human
uggagaagcuguagguggacuc

SEQ ID NO: 362891 - RNA, 22 nt, Human
agggcugagacuaaggccagau

SEQ ID NO: 362892 - RNA, 22 nt, Human
caguugaugggacucauguggg

SEQ ID NO: 362893 - RNA, 22 nt, Human
uggcuuucucccccagcuucuc

SEQ ID NO: 362894 - RNA, 22 nt, Human
ccagccagccuugaucugagua

SEQ ID NO: 362895 - RNA, 22 nt, Human
aagaaaagaaaccugaggcuuu

SEQ ID NO: 362896 - RNA, 22 nt, Human
gcaggcagagguggaggagaca

SEQ ID NO: 362897 - RNA, 22 nt, Human
uggcucaguuucaguccugguu

SEQ ID NO: 362898 - RNA, 22 nt, Human
ggcuccuggcaucuggugggua

SEQ ID NO: 362899 - RNA, 22 nt, Human
cuggcagcuucaggacacucgg

SEQ ID NO: 362900 - RNA, 22 nt, Human
ugcagcugcuggcccaggugcu

SEQ ID NO: 362901 - RNA, 22 nt, Human
cuuccugcaggacagccaucug

SEQ ID NO: 362902 - RNA, 22 nt, Human
ugggcucuccuggaggacaaca

SEQ ID NO: 362903 - RNA, 22 nt, Human
aggaggcacucacucucagggu

SEQ ID NO: 362904 - RNA, 21 nt, Human
agccuggcccagggggaggcu

SEQ ID NO: 362905 - RNA, 22 nt, Human
acaguggaaaugugggagggga

SEQ ID NO: 362906 - RNA, 22 nt, Human
uuucacagcuggguggcagagu

SEQ ID NO: 362907 - RNA, 22 nt, Human
uagaaaucagcaggcauaugua

SEQ ID NO: 362908 - RNA, 20 nt, Human
uacugggcaagcccacagac

SEQ ID NO: 362909 - RNA, 22 nt, Human
uaucauaaguuaauuaaacagu

SEQ ID NO: 362910 - RNA, 22 nt, Human
uggaagggagugacagucagag

SEQ ID NO: 362911 - RNA, 21 nt, Human
ucucuggaauuagaccauguu

SEQ ID NO: 362912 - RNA, 22 nt, Human
cuggccuguccugacccagccu

SEQ ID NO: 362913 - RNA, 22 nt, Human
ggaggugggcuaaggacucucu

SEQ ID NO: 362914 - RNA, 22 nt, Human
ggaagagccuggggugucaggc

SEQ ID NO: 362915 - RNA, 22 nt, Human
gugggacucuucuuuggcagug

SEQ ID NO: 362916 - RNA, 22 nt, Human
agcagcauaucagagaaaguca

SEQ ID NO: 362917 - RNA, 22 nt, Human
ucugggcugggagcguguggac

SEQ ID NO: 362918 - RNA, 22 nt, Human
ucucaagagggaggcaaucaug

SEQ ID NO: 362919 - RNA, 22 nt, Human
ccuggagcacucucccuggcug

SEQ ID NO: 362920 - RNA, 22 nt, Human
agggcagcacagcugugcuccu

SEQ ID NO: 362921 - RNA, 22 nt, Human
gcacacacuguuuuccucacau

SEQ ID NO: 362922 - RNA, 22 nt, Human
aggccagcaccagagucaagaa

SEQ ID NO: 362923 - RNA, 22 nt, Human
agggacccauagagagaccagu

SEQ ID NO: 362924 - RNA, 22 nt, Human
cauaauaucuccgauuacuugc

SEQ ID NO: 362925 - RNA, 20 nt, Human
uggcaggaggcagcagugga

SEQ ID NO: 362926 - RNA, 22 nt, Human
caaagaagagauuuacagagcu

SEQ ID NO: 362927 - RNA, 22 nt, Human
agggcuacugccugccuucagg

SEQ ID NO: 362928 - RNA, 22 nt, Human
gucccucugugucccugcaguc

SEQ ID NO: 362929 - RNA, 22 nt, Human
ggcugagcguggcugccguggg

SEQ ID NO: 362930 - RNA, 22 nt, Human
cuggagugaagucuggcagcuu

SEQ ID NO: 362931 - RNA, 22 nt, Human
uauguguaggaggaggacaggg

SEQ ID NO: 362932 - RNA, 22 nt, Human
cuucucucugcauaggcauggg

SEQ ID NO: 362933 - RNA, 22 nt, Human
agggccagaguacaucagggcu

SEQ ID NO: 362934 - RNA, 20 nt, Human
cucugcugcccgccggcugc

SEQ ID NO: 362935 - RNA, 22 nt, Human
gccaggcagcugggagggugcc

SEQ ID NO: 362936 - RNA, 22 nt, Human
gcuggcagagagcuggugagga

SEQ ID NO: 362937 - RNA, 22 nt, Human
gaagccaguguuugaagaauuu

SEQ ID NO: 362938 - RNA, 19 nt, Human
aauucuguuucagcagauc

SEQ ID NO: 362939 - RNA, 22 nt, Human
agcagccauagauagcaugcaa

SEQ ID NO: 362940 - RNA, 22 nt, Human
ugcauaaacagauacuucaugu

SEQ ID NO: 362941 - RNA, 22 nt, Human
ucugagggugggagaaggagcu

SEQ ID NO: 362942 - RNA, 17 nt, Human
ucauuuguugugacuag

SEQ ID NO: 362943 - RNA, 22 nt, Human
ucugcaggaggcuggcugcagg

SEQ ID NO: 362944 - RNA, 22 nt, Human
ucagggcaggacaguguaggcc

SEQ ID NO: 362945 - RNA, 22 nt, Human
cugcuguguuccuccugcaucu

SEQ ID NO: 362946 - RNA, 22 nt, Human
ucugggaacacacgucacuuca

SEQ ID NO: 362947 - RNA, 22 nt, Human
cuuuucauuguuuguacaugca

SEQ ID NO: 362948 - RNA, 22 nt, Human
uccugagauguggagcuccaug

SEQ ID NO: 362949 - RNA, 22 nt, Human
aggcugagggcuccugagggca

SEQ ID NO: 362950 - RNA, 20 nt, Human
ccugccuguguuugugauga

SEQ ID NO: 362951 - RNA, 22 nt, Human
uucagucagugacuaagcaguu

SEQ ID NO: 362952 - RNA, 22 nt, Human
aggcagugugggccaagcuucc

SEQ ID NO: 362953 - RNA, 22 nt, Human
cugaacucuuuaugacagcuug

SEQ ID NO: 362954 - RNA, 22 nt, Human
aacaaauguguggcaguguggg

SEQ ID NO: 362955 - RNA, 22 nt, Human
gucucuggguuaagcagugcau

SEQ ID NO: 362956 - RNA, 21 nt, Human
acagugugcuucucucccucc

SEQ ID NO: 362957 - RNA, 22 nt, Human
cuuccucacggugcaacaggaa

SEQ ID NO: 362958 - RNA, 22 nt, Human
ucuccuggucaccucagaaguc

SEQ ID NO: 362959 - RNA, 22 nt, Human
ccaaggagcaaggcucaacaag

SEQ ID NO: 362960 - RNA, 22 nt, Human
gaagugaagguuacucuagauu

SEQ ID NO: 362961 - RNA, 22 nt, Human
uggagagguugaauaacuuguc

SEQ ID NO: 362962 - RNA, 22 nt, Human
ccaucccuccuccaccagcuag

SEQ ID NO: 362963 - RNA, 22 nt, Human
uugcauugugauuacagaggug

SEQ ID NO: 362964 - RNA, 22 nt, Human
gagagcuggauucuggauaggu

SEQ ID NO: 362965 - RNA, 22 nt, Human
gagguagcgaguggacagugca

SEQ ID NO: 362966 - RNA, 22 nt, Human
ggucauugucagagccuguacu

SEQ ID NO: 362967 - RNA, 16 nt, Human
gagaagagcccggcag

SEQ ID NO: 362968 - RNA, 19 nt, Human
ccagagagcuagguacaga

SEQ ID NO: 362969 - RNA, 22 nt, Human
uaucagaacacagccacagcca

SEQ ID NO: 362970 - RNA, 22 nt, Human
agagagcccgggccagggcaca

SEQ ID NO: 362971 - RNA, 22 nt, Human
aggauccuuuuucugcuguuug

SEQ ID NO: 362972 - RNA, 23 nt, Human
auacauacagucuuacugacuuu

SEQ ID NO: 362973 - RNA, 22 nt, Human
ggaggccaguccuggccgggcu

SEQ ID NO: 362974 - RNA, 18 nt, Human
uggccuggagacaacucu

SEQ ID NO: 362975 - RNA, 22 nt, Human
augcuuuuccaggagaaauaua

SEQ ID NO: 362976 - RNA, 22 nt, Human
aaagccagugguaugagagaaa

SEQ ID NO: 362977 - RNA, 22 nt, Human
gcagugggagcuuaggcagugc

SEQ ID NO: 362978 - RNA, 22 nt, Human
caguccuuggcaaguucucagu

SEQ ID NO: 362979 - RNA, 22 nt, Human
uccaggcaugucugaguccuuc

SEQ ID NO: 362980 - RNA, 22 nt, Human
cuggcucaauuuguacugcugu

SEQ ID NO: 362981 - RNA, 22 nt, Human
uggauuuaccacagggccacag

SEQ ID NO: 362982 - RNA, 22 nt, Human
uggcagcuguguccagguagaa

SEQ ID NO: 362983 - RNA, 22 nt, Human
ucaguggauuguagaaggcuua

SEQ ID NO: 362984 - RNA, 22 nt, Human
auuugaauggcuuaacacaacg

SEQ ID NO: 362985 - RNA, 22 nt, Human
ccuggccuccuggccuucucau

SEQ ID NO: 362986 - RNA, 22 nt, Human
auaguuguguggggauucuggu

SEQ ID NO: 362987 - RNA, 22 nt, Human
auuuugaugcuaucuaaugaau

SEQ ID NO: 362988 - RNA, 22 nt, Human
cuccauugaacauccucucaga

SEQ ID NO: 362989 - RNA, 22 nt, Human
ugagccugguugcagugucugg

SEQ ID NO: 362990 - RNA, 22 nt, Human
gagguauguaugcuacauucuu

SEQ ID NO: 362991 - RNA, 21 nt, Human
uccugcagggcagcagagugg

SEQ ID NO: 362992 - RNA, 22 nt, Human
agcugagcuaguaguuccagug

SEQ ID NO: 362993 - RNA, 22 nt, Human
ucccagccuuccuuguggugaa

SEQ ID NO: 362994 - RNA, 22 nt, Human
cacuacuugaaagaauuacaga

SEQ ID NO: 362995 - RNA, 22 nt, Human
cauguacauucuguagauggag

SEQ ID NO: 362996 - RNA, 22 nt, Human
gcccaggaucugcucagaucau

SEQ ID NO: 362997 - RNA, 18 nt, Human
ugcccagaaaagcaggga

SEQ ID NO: 362998 - RNA, 23 nt, Human
acaacuuuacagauacauuuugu

SEQ ID NO: 362999 - RNA, 22 nt, Human
gcagggacaccuuugugaagcu

SEQ ID NO: 363000 - RNA, 21 nt, Human
cagaggggcuagccuggcugc

SEQ ID NO: 363001 - RNA, 22 nt, Human
guggaaugaauagauuugcauu

SEQ ID NO: 363002 - RNA, 22 nt, Human
ucagcagcagcucagcauguuu

SEQ ID NO: 363003 - RNA, 21 nt, Human
ccagagagagggaaguggguu

SEQ ID NO: 363004 - RNA, 22 nt, Human
aggccuggcuuugguuugcuga

SEQ ID NO: 363005 - RNA, 22 nt, Human
gcagcuuggugaaaggugaugg

SEQ ID NO: 363006 - RNA, 21 nt, Human
ccuggcagaagccugauaugc

SEQ ID NO: 363007 - RNA, 22 nt, Human
aagucacccuagggccuggacu

SEQ ID NO: 363008 - RNA, 22 nt, Human
cacagaggcaaccuucuggggu

SEQ ID NO: 363009 - RNA, 22 nt, Human
gggcagugguccaggcuacagc

SEQ ID NO: 363010 - RNA, 22 nt, Human
ugaaaugagauaauuuaagugc

SEQ ID NO: 363011 - RNA, 22 nt, Human
ccugucuggaacauggccuguu

SEQ ID NO: 363012 - RNA, 18 nt, Human
caggaugagugaugggga

SEQ ID NO: 363013 - RNA, 22 nt, Human
cugagagaaucaugcugcaggu

SEQ ID NO: 363014 - RNA, 22 nt, Human
aaggcacugcuuugcugcgccc

SEQ ID NO: 363015 - RNA, 22 nt, Human
cccagcccagcguucgaggggu

SEQ ID NO: 363016 - RNA, 22 nt, Human
ggcucaccauuuucacucucug

SEQ ID NO: 363017 - RNA, 22 nt, Human
uuucuucaauugcuaacaagga

SEQ ID NO: 363018 - RNA, 22 nt, Human
agugcuuugguauagaacuauu

SEQ ID NO: 363019 - RNA, 22 nt, Human
uguaaaaccaaaucaaucuagu

SEQ ID NO: 363020 - RNA, 22 nt, Human
agggcacaucugcugggaaugg

SEQ ID NO: 363021 - RNA, 22 nt, Human
ucugugacuugcgggaggagaa

SEQ ID NO: 363022 - RNA, 22 nt, Human
agcagaaccugcagaccugucu

SEQ ID NO: 363023 - RNA, 22 nt, Human
uuuacauuucccucugucaguu

SEQ ID NO: 363024 - RNA, 22 nt, Human
gaggcucacuuucauccucuuc

SEQ ID NO: 363025 - RNA, 22 nt, Human
cagggcagccaggccccguggg

SEQ ID NO: 363026 - RNA, 22 nt, Human
gugcuucucuucacacccaacu

SEQ ID NO: 363027 - RNA, 22 nt, Human
uggagagguuuaaacaaaaguu

SEQ ID NO: 363028 - RNA, 21 nt, Human
aaagaacaggcagauguucuu

SEQ ID NO: 363029 - RNA, 22 nt, Human
cucugggcaaguuucuucauga

SEQ ID NO: 363030 - RNA, 22 nt, Human
cugggcagccucacacaauguu

SEQ ID NO: 363031 - RNA, 22 nt, Human
ggcccucccugagccagguggg

SEQ ID NO: 363032 - RNA, 22 nt, Human
caucagaauguuauggggggcu

SEQ ID NO: 363033 - RNA, 22 nt, Human
ucugcagguguuggaaggguca

SEQ ID NO: 363034 - RNA, 22 nt, Human
uagggcuauucugaguaauaau

SEQ ID NO: 363035 - RNA, 22 nt, Human
uuccucagaaaauacuguccaa

SEQ ID NO: 363036 - RNA, 21 nt, Human
guggccugauuaugaaugggu

SEQ ID NO: 363037 - RNA, 22 nt, Human
cuggaggcacccuuagagaggc

SEQ ID NO: 363038 - RNA, 22 nt, Human
uagucuuuugagaaguauaucu

SEQ ID NO: 363039 - RNA, 22 nt, Human
cugagccauaagggaggcuggg

SEQ ID NO: 363040 - RNA, 22 nt, Human
gcuggccuccugcuagauggaa

SEQ ID NO: 363041 - RNA, 20 nt, Human
gagccugggaagucuaaggu

SEQ ID NO: 363042 - RNA, 22 nt, Human
uacaucauaauaauacuuagaa

SEQ ID NO: 363043 - RNA, 22 nt, Human
auguccuuccauuuugaucugu

SEQ ID NO: 363044 - RNA, 22 nt, Human
ugcagggaaaguguuggcagca

SEQ ID NO: 363045 - RNA, 22 nt, Human
uaagaacauaaauucauacggg

SEQ ID NO: 363046 - RNA, 22 nt, Human
uacaaaguauauuucuagcugu

SEQ ID NO: 363047 - RNA, 22 nt, Human
agcuucuguucaucuuccaggc

SEQ ID NO: 363048 - RNA, 21 nt, Human
aggcacuguuugugguuuggg

SEQ ID NO: 363049 - RNA, 22 nt, Human
aggccagcuguuacuagagcca

SEQ ID NO: 363050 - RNA, 22 nt, Human
cccagcauggagugaggacuca

SEQ ID NO: 363051 - RNA, 22 nt, Human
ugcagggauuauguagggguug

SEQ ID NO: 363052 - RNA, 22 nt, Human
gcagagcuucuguccuucagga

SEQ ID NO: 363053 - RNA, 22 nt, Human
ucaguggauauuucuguggcug

SEQ ID NO: 363054 - RNA, 22 nt, Human
aucuggcucccuuggaauccgu

SEQ ID NO: 363055 - RNA, 19 nt, Human
ggcagcuggacgcuguuca

SEQ ID NO: 363056 - RNA, 22 nt, Human
ucgcugugguuucuguacaugg

SEQ ID NO: 363057 - RNA, 23 nt, Human
gaaucaguggcuaacaaggaaac

SEQ ID NO: 363058 - RNA, 22 nt, Human
agcccagguugaggcugcagug

SEQ ID NO: 363059 - RNA, 22 nt, Human
gacccaggguauccagagcugc

SEQ ID NO: 363060 - RNA, 22 nt, Human
gggagccaaggagagaggccuu

SEQ ID NO: 363061 - RNA, 22 nt, Human
ccugcucagccccagcucaccc

SEQ ID NO: 363062 - RNA, 22 nt, Human
aucuugcauuugcuaaaaugca

SEQ ID NO: 363063 - RNA, 22 nt, Human
uauuacaauuuacauugcacuu

SEQ ID NO: 363064 - RNA, 22 nt, Human
uaaggccagcaugaaugcagca

SEQ ID NO: 363065 - RNA, 22 nt, Human
agcugaagaaaugggaagcauu

SEQ ID NO: 363066 - RNA, 22 nt, Human
ucacaugcccuguauuuaccag

SEQ ID NO: 363067 - RNA, 22 nt, Human
agaauucugacaauagaauugg

SEQ ID NO: 363068 - RNA, 22 nt, Human
acuuaguauuuuucagcuuuga

SEQ ID NO: 363069 - RNA, 22 nt, Human
aucaguuugauaauaaggcuug

SEQ ID NO: 363070 - RNA, 22 nt, Human
ggcugccaggagaagcucagug

SEQ ID NO: 363071 - RNA, 22 nt, Human
uggcagcugccauguccacgug

SEQ ID NO: 363072 - RNA, 22 nt, Human
auccuuggaugugucuuuuugu

SEQ ID NO: 363073 - RNA, 22 nt, Human
ggcuucuuccugugaacauguu

SEQ ID NO: 363074 - RNA, 22 nt, Human
aagaugcuuauugcuccugcag

SEQ ID NO: 363075 - RNA, 22 nt, Human
aggagaaagacuggacagccaa

SEQ ID NO: 363076 - RNA, 22 nt, Human
gggagagagagcucauguugaa

SEQ ID NO: 363077 - RNA, 22 nt, Human
guuaaagaguuuggcuuucuuc

SEQ ID NO: 363078 - RNA, 22 nt, Human
gcagggccagugcagagaggaa

SEQ ID NO: 363079 - RNA, 22 nt, Human
guguccacggcugagaaugauu

SEQ ID NO: 363080 - RNA, 19 nt, Human
auagucuuuccaauuauac

SEQ ID NO: 363081 - RNA, 23 nt, Human
aggauuuaaaggcaaugcauuuu

SEQ ID NO: 363082 - RNA, 22 nt, Human
caguucuuuguggggaguucuc

SEQ ID NO: 363083 - RNA, 22 nt, Human
gagugggcaccgugggcacacu

SEQ ID NO: 363084 - RNA, 22 nt, Human
ggcugagggccagggcuagucu

SEQ ID NO: 363085 - RNA, 22 nt, Human
uccuccuucgggacugcuugac

SEQ ID NO: 363086 - RNA, 23 nt, Human
ggcagcucucaucugaugacuga

SEQ ID NO: 363087 - RNA, 22 nt, Human
uagcagagaggggacaguggca

SEQ ID NO: 363088 - RNA, 22 nt, Human
ggccaggaagggaagaucagca

SEQ ID NO: 363089 - RNA, 22 nt, Human
ccuggagcaaaaaucuaaggag

SEQ ID NO: 363090 - RNA, 22 nt, Human
gaauuucagagguaacaucauc

SEQ ID NO: 363091 - RNA, 22 nt, Human
ucaggagaaggcaauguggaaa

SEQ ID NO: 363092 - RNA, 22 nt, Human
uuuuaauacugcuauuguagga

SEQ ID NO: 363093 - RNA, 22 nt, Human
ucuagaaacaugacauugaucu

SEQ ID NO: 363094 - RNA, 22 nt, Human
gcagaugaggaagcuaaugcug

SEQ ID NO: 363095 - RNA, 22 nt, Human
agaaaugaauauguagugguua

SEQ ID NO: 363096 - RNA, 22 nt, Human
aguaaacauuucagauuuauuu

SEQ ID NO: 363097 - RNA, 22 nt, Human
uugcucugacuggagugcagug

SEQ ID NO: 363098 - RNA, 22 nt, Human
gaaauauugggacucagagcuu

SEQ ID NO: 363099 - RNA, 22 nt, Human
gaacaauagugguaacaaagcc

SEQ ID NO: 363100 - RNA, 22 nt, Human
ugcuggggagugauugaccauc

SEQ ID NO: 363101 - RNA, 22 nt, Human
cagcuguggagauggggugcau

SEQ ID NO: 363102 - RNA, 22 nt, Human
uuucacagguacaaacacuccu

SEQ ID NO: 363103 - RNA, 22 nt, Human
ucagcuggauguggaagugcua

SEQ ID NO: 363104 - RNA, 22 nt, Human
uaggagggcccugaaaauggca

SEQ ID NO: 363105 - RNA, 22 nt, Human
aagaggaggacgguucccagaa

SEQ ID NO: 363106 - RNA, 22 nt, Human
ucccacugcuuugcucugcuca

SEQ ID NO: 363107 - RNA, 22 nt, Human
gcauggcauuugaagguagaag

SEQ ID NO: 363108 - RNA, 22 nt, Human
ugugaaggcagagccagugaaa

SEQ ID NO: 363109 - RNA, 23 nt, Human
acugagccagggccugggucagc

SEQ ID NO: 363110 - RNA, 22 nt, Human
uucuuuuccuacacagcgauuu

SEQ ID NO: 363111 - RNA, 22 nt, Human
auuaggcauuauggggauaagg

SEQ ID NO: 363112 - RNA, 22 nt, Human
gcugcucucucccuaaguuggg

SEQ ID NO: 363113 - RNA, 22 nt, Human
gaggaggaaguucucuguaggc

SEQ ID NO: 363114 - RNA, 22 nt, Human
ggcacugggagaggugagacgg

SEQ ID NO: 363115 - RNA, 22 nt, Human
ucagagagguuaaauaucuugu

SEQ ID NO: 363116 - RNA, 22 nt, Human
auacuaaaguauagaacuuagu

SEQ ID NO: 363117 - RNA, 22 nt, Human
ggugaagggccuuaggagacag

SEQ ID NO: 363118 - RNA, 20 nt, Human
ccagagcugauggcugcccg

SEQ ID NO: 363119 - RNA, 22 nt, Human
ucagagaggauuuuaauaagug

SEQ ID NO: 363120 - RNA, 22 nt, Human
ccuuagagaguacugggcugcc

SEQ ID NO: 363121 - RNA, 22 nt, Human
aguuuuaugcaguguucugaua

SEQ ID NO: 363122 - RNA, 22 nt, Human
uaagaacagugacagccaacau

SEQ ID NO: 363123 - RNA, 22 nt, Human
ucauuuccucaaauucaagguu

SEQ ID NO: 363124 - RNA, 22 nt, Human
caugggagcuaucuccaucacu

SEQ ID NO: 363125 - RNA, 22 nt, Human
uacaaaguuugggguccucaaa

SEQ ID NO: 363126 - RNA, 22 nt, Human
ucaaaugcucuuugcagagagg

SEQ ID NO: 363127 - RNA, 22 nt, Human
uggcuuaauauuucauauuuaa

SEQ ID NO: 363128 - RNA, 22 nt, Human
cugauuccaaagccaaagcuau

SEQ ID NO: 363129 - RNA, 22 nt, Human
uuuaggcauacuuuugggagaa

SEQ ID NO: 363130 - RNA, 22 nt, Human
uaaauucuacaacuucaaagau

SEQ ID NO: 363131 - RNA, 18 nt, Human
ucauagaagugaaucaga

SEQ ID NO: 363132 - RNA, 22 nt, Human
agggcagcagcuccuccuagcu

SEQ ID NO: 363133 - RNA, 22 nt, Human
ccugccuggaucagccauccug

SEQ ID NO: 363134 - RNA, 21 nt, Human
aaauacagaaacuuguuuuca

SEQ ID NO: 363135 - RNA, 22 nt, Human
ucauuauccuaguaucuugaau

SEQ ID NO: 363136 - RNA, 22 nt, Human
aggcaguguguagcuggaagag

SEQ ID NO: 363137 - RNA, 22 nt, Human
agggcagagcugucuaaauggc

SEQ ID NO: 363138 - RNA, 22 nt, Human
ggccuuggggaggauggugucc

SEQ ID NO: 363139 - RNA, 22 nt, Human
aggagccaagcagaacuaagga

SEQ ID NO: 363140 - RNA, 22 nt, Human
gugguaauuuaauccuacacug

SEQ ID NO: 363141 - RNA, 22 nt, Human
aguggcagagcugugucuugaa

SEQ ID NO: 363142 - RNA, 22 nt, Human
ucccagacaaucauuggccacc

SEQ ID NO: 363143 - RNA, 22 nt, Human
ucugggcuuuacacugugcuua

SEQ ID NO: 363144 - RNA, 22 nt, Human
aguuacuugagacguuuaugaa

SEQ ID NO: 363145 - RNA, 22 nt, Human
uuuauauuucccaggauuggcc

SEQ ID NO: 363146 - RNA, 22 nt, Human
agagcaauggcauccagcugau

SEQ ID NO: 363147 - RNA, 22 nt, Human
agauauaauaauuuacaagugu

SEQ ID NO: 363148 - RNA, 20 nt, Human
aaucagaaagugugagcucu

SEQ ID NO: 363149 - RNA, 22 nt, Human
ggcaggaggaagaguuagcacc

SEQ ID NO: 363150 - RNA, 23 nt, Human
ccuggaguacuaaggggauggaa

SEQ ID NO: 363151 - RNA, 22 nt, Human
uuugcauuguuucaaaagugaa

SEQ ID NO: 363152 - RNA, 22 nt, Human
ugaaaugcuguagagacuguau

SEQ ID NO: 363153 - RNA, 22 nt, Human
agcaggcuuguuaugucugaga

SEQ ID NO: 363154 - RNA, 19 nt, Human
ugggcagcucccucugucc

SEQ ID NO: 363155 - RNA, 22 nt, Human
aaaggccagguuggcugguauu

SEQ ID NO: 363156 - RNA, 22 nt, Human
gaguccuuaauacacuggugga

SEQ ID NO: 363157 - RNA, 22 nt, Human
caguccuucauuccuccuuuga

SEQ ID NO: 363158 - RNA, 22 nt, Human
ccaggccucuggcugcuuaguc

SEQ ID NO: 363159 - RNA, 22 nt, Human
guaucuuucccaccaaucacaa

SEQ ID NO: 363160 - RNA, 22 nt, Human
uugaagcauuucuuugagcuuc

SEQ ID NO: 363161 - RNA, 22 nt, Human
uaggccaggacagagcuuccag

SEQ ID NO: 363162 - RNA, 22 nt, Human
gaggccuggguuggaggugcau

SEQ ID NO: 363163 - RNA, 22 nt, Human
uagaauaugugguaggaucugg

SEQ ID NO: 363164 - RNA, 22 nt, Human
uuccugagggacuuuugagauu

SEQ ID NO: 363165 - RNA, 18 nt, Human
auccuugaugagaggucu

SEQ ID NO: 363166 - RNA, 19 nt, Human
aaagcagaggagcaucuga

SEQ ID NO: 363167 - RNA, 22 nt, Human
agcuggagaugcccagcaccgg

SEQ ID NO: 363168 - RNA, 22 nt, Human
aguggagaagaggauggucucc

SEQ ID NO: 363169 - RNA, 22 nt, Human
uacccaggaggaaacugaggcu

SEQ ID NO: 363170 - RNA, 22 nt, Human
uucuuacuaguauguuucagca

SEQ ID NO: 363171 - RNA, 18 nt, Human
uucacaggaaaugucuuu

SEQ ID NO: 363172 - RNA, 22 nt, Human
agaggagugggaagcagugcaa

SEQ ID NO: 363173 - RNA, 22 nt, Human
gugcugucguggaacugggcug

SEQ ID NO: 363174 - RNA, 22 nt, Human
ggggcagaaagcccacagagug

SEQ ID NO: 363175 - RNA, 22 nt, Human
aucaggaucacagaaacuuuua

SEQ ID NO: 363176 - RNA, 22 nt, Human
acuugaauuauauuucuagaga

SEQ ID NO: 363177 - RNA, 22 nt, Human
acugcagcaaagcccgugucuu

SEQ ID NO: 363178 - RNA, 22 nt, Human
ggcagcuucucccaggcuguuu

SEQ ID NO: 363179 - RNA, 22 nt, Human
gucucccacuuucuggccucuu

SEQ ID NO: 363180 - RNA, 22 nt, Human
caaaugugguuucucagcauuc

SEQ ID NO: 363181 - RNA, 22 nt, Human
acaggagaauuaucuggaacaa

SEQ ID NO: 363182 - RNA, 22 nt, Human
aggcaccuugagagcaggagcu

SEQ ID NO: 363183 - RNA, 22 nt, Human
gacagggcaagacucugucuaa

SEQ ID NO: 363184 - RNA, 23 nt, Human
acagagaucuugacuuguaugga

SEQ ID NO: 363185 - RNA, 22 nt, Human
cuggcaguguccagcucgugau

SEQ ID NO: 363186 - RNA, 22 nt, Human
ugaauaguccuuggaauaacug

SEQ ID NO: 363187 - RNA, 22 nt, Human
uaauuucaaauuucuuagcgug

SEQ ID NO: 363188 - RNA, 22 nt, Human
cacaagagagugcgcguugcaa

SEQ ID NO: 363189 - RNA, 22 nt, Human
uagggcagccacccaggcugcu

SEQ ID NO: 363190 - RNA, 22 nt, Human
gauggcagucaaccaggugagg

SEQ ID NO: 363191 - RNA, 22 nt, Human
auacauguuguaccauauguuu

SEQ ID NO: 363192 - RNA, 22 nt, Human
augcuguguuugagaaccuagg

SEQ ID NO: 363193 - RNA, 22 nt, Human
gagggugggccagauaugaggg

SEQ ID NO: 363194 - RNA, 22 nt, Human
gggcuacagacaugcucuaagc

SEQ ID NO: 363195 - RNA, 22 nt, Human
acagaaauauagaagguaggaa

SEQ ID NO: 363196 - RNA, 22 nt, Human
ucucuggaauuuugagagugac

SEQ ID NO: 363197 - RNA, 22 nt, Human
uaagaacaucuguccccagauu

SEQ ID NO: 363198 - RNA, 22 nt, Human
ugaggcaggaggauugcaggau

SEQ ID NO: 363199 - RNA, 22 nt, Human
aagacuuucucccaaauccuca

SEQ ID NO: 363200 - RNA, 22 nt, Human
guuauaaaugacugcaaaaguu

SEQ ID NO: 363201 - RNA, 20 nt, Human
cccagggaccugagcuccau

SEQ ID NO: 363202 - RNA, 22 nt, Human
agggagcucacaguccaguaga

SEQ ID NO: 363203 - RNA, 19 nt, Human
uucuaccuuacuguaggcu

SEQ ID NO: 363204 - RNA, 22 nt, Human
gguuucaacuaaaucaagaagg

SEQ ID NO: 363205 - RNA, 21 nt, Human
uuucaauguguucuuuguagu

SEQ ID NO: 363206 - RNA, 22 nt, Human
agguuuauguuuggugcaggag

SEQ ID NO: 363207 - RNA, 22 nt, Human
ggcuggaaguccaagaucaagg

SEQ ID NO: 363208 - RNA, 22 nt, Human
acccaggaugauaauguucaca

SEQ ID NO: 363209 - RNA, 19 nt, Human
uguuggugcggauguggag

SEQ ID NO: 363210 - RNA, 22 nt, Human
ugcuggguagaaguauuagucu

SEQ ID NO: 363211 - RNA, 22 nt, Human
gggacuggaacuacuggugcag

SEQ ID NO: 363212 - RNA, 22 nt, Human
gugccuggcacacagaaggcaa

SEQ ID NO: 363213 - RNA, 22 nt, Human
auuucauagauuguaaaucccu

SEQ ID NO: 363214 - RNA, 22 nt, Human
caggaugagaagggcucuuacg

SEQ ID NO: 363215 - RNA, 22 nt, Human
guuugcauuuauuagucuucug

SEQ ID NO: 363216 - RNA, 22 nt, Human
guugaaagcuuuucauuuaguu

SEQ ID NO: 363217 - RNA, 22 nt, Human
caaagucauggggaugcagguc

SEQ ID NO: 363218 - RNA, 22 nt, Human
aucagaaauugcuaccagugga

SEQ ID NO: 363219 - RNA, 22 nt, Human
ugcccaggaucuggcgaugcuc

SEQ ID NO: 363220 - RNA, 22 nt, Human
gccuuaauuuuuuauaaucucu

SEQ ID NO: 363221 - RNA, 19 nt, Human
ggucacagggguuacaagg

SEQ ID NO: 363222 - RNA, 22 nt, Human
aaacaugagcauuucuguuuaa

SEQ ID NO: 363223 - RNA, 22 nt, Human
aggcccuguccauggugcugaa

SEQ ID NO: 363224 - RNA, 22 nt, Human
uuucagggagccuagaagagcu

SEQ ID NO: 363225 - RNA, 22 nt, Human
acagcugugaaaauccacagga

SEQ ID NO: 363226 - RNA, 22 nt, Human
aaaugcauguagaauaauagag

SEQ ID NO: 363227 - RNA, 21 nt, Human
guggcccugguguggcugcac

SEQ ID NO: 363228 - RNA, 22 nt, Human
guccugggaaggaagccaggga

SEQ ID NO: 363229 - RNA, 22 nt, Human
aaguccagcucuaaauaucuga

SEQ ID NO: 363230 - RNA, 22 nt, Human
augaggcaguacacacaaagcc

SEQ ID NO: 363231 - RNA, 22 nt, Human
gucucagaguccuacuuauucc

SEQ ID NO: 363232 - RNA, 22 nt, Human
agagcuggcugguagcccugau

SEQ ID NO: 363233 - RNA, 22 nt, Human
gcuggagccuucugcucuguug

SEQ ID NO: 363234 - RNA, 22 nt, Human
auucaaauuaaguuaauucagc

SEQ ID NO: 363235 - RNA, 22 nt, Human
gcucccagggaccgcagggcag

SEQ ID NO: 363236 - RNA, 22 nt, Human
caggccugcaggaaaggcuccc

SEQ ID NO: 363237 - RNA, 22 nt, Human
cagggccagcgucucgggcuau

SEQ ID NO: 363238 - RNA, 22 nt, Human
ucugagcuuuuauuaucaaccu

SEQ ID NO: 363239 - RNA, 22 nt, Human
ugucuguaagguguuuauguua

SEQ ID NO: 363240 - RNA, 22 nt, Human
uccagaauacucugaaaucauu

SEQ ID NO: 363241 - RNA, 22 nt, Human
cagcccaaagccccaggcuaga

SEQ ID NO: 363242 - RNA, 22 nt, Human
ucaaaugcugccuuugugugcc

SEQ ID NO: 363243 - RNA, 22 nt, Human
caguacuuugaagauauuuuag

SEQ ID NO: 363244 - RNA, 22 nt, Human
uccugagagcagaguccaggug

SEQ ID NO: 363245 - RNA, 20 nt, Human
gcauugaguauagacagaug

SEQ ID NO: 363246 - RNA, 22 nt, Human
ugccacaccaacaucuuucagc

SEQ ID NO: 363247 - RNA, 22 nt, Human
uccaggagagguguggggacug

SEQ ID NO: 363248 - RNA, 22 nt, Human
ugaaauuccaggagaguuaaaa

SEQ ID NO: 363249 - RNA, 22 nt, Human
aguggcaguggcugggcagagc

SEQ ID NO: 363250 - RNA, 22 nt, Human
ugguuuaauuuccauuuccuug

SEQ ID NO: 363251 - RNA, 18 nt, Human
auauguuaauuagguagg

SEQ ID NO: 363252 - RNA, 22 nt, Human
uucaggauucucucccauuuac

SEQ ID NO: 363253 - RNA, 22 nt, Human
gaacccaguccaggugcagccu

SEQ ID NO: 363254 - RNA, 22 nt, Human
gcugggagcccuggucugcucc

SEQ ID NO: 363255 - RNA, 22 nt, Human
uagaauaugauuaauuuucuua

SEQ ID NO: 363256 - RNA, 22 nt, Human
ccuccaggauaagucagggccu

SEQ ID NO: 363257 - RNA, 22 nt, Human
ucuucaaagaauuuuaguaauu

SEQ ID NO: 363258 - RNA, 22 nt, Human
gaagcuucguggcucuucaaau

SEQ ID NO: 363259 - RNA, 22 nt, Human
guccucuggccuuucccaggac

SEQ ID NO: 363260 - RNA, 22 nt, Human
uuagcugcauuaucaaaguuau

SEQ ID NO: 363261 - RNA, 22 nt, Human
ucuaaacacuaagucuugaugc

SEQ ID NO: 363262 - RNA, 22 nt, Human
uggagaaggacagccugagaaa

SEQ ID NO: 363263 - RNA, 19 nt, Human
gggcuucugggaucaagag

SEQ ID NO: 363264 - RNA, 22 nt, Human
aaggaaccuggaguagagggag

SEQ ID NO: 363265 - RNA, 22 nt, Human
uccagugguacauggagacacu

SEQ ID NO: 363266 - RNA, 22 nt, Human
ugggauaguggccaggaccccc

SEQ ID NO: 363267 - RNA, 22 nt, Human
uccugggcugcagggaagagca

SEQ ID NO: 363268 - RNA, 22 nt, Human
agcugguucauucauucauggu

SEQ ID NO: 363269 - RNA, 22 nt, Human
cucugggcaaagaugccucauc

SEQ ID NO: 363270 - RNA, 22 nt, Human
caaaugcauaguuuauaagaag

SEQ ID NO: 363271 - RNA, 22 nt, Human
uuacuuuggguccugcuuauaa

SEQ ID NO: 363272 - RNA, 22 nt, Human
acauuucuauagugcaucuguu

SEQ ID NO: 363273 - RNA, 22 nt, Human
accucugccacuuucuaacucu

SEQ ID NO: 363274 - RNA, 22 nt, Human
cagaggcacagcuucuuuuaau

SEQ ID NO: 363275 - RNA, 22 nt, Human
cccaggcucccaggugggacaa

SEQ ID NO: 363276 - RNA, 22 nt, Human
aagcaccucuaugauugcuuuu

SEQ ID NO: 363277 - RNA, 23 nt, Human
ucugucacuuucugcuguggagu

SEQ ID NO: 363278 - RNA, 22 nt, Human
cuggggcugcggacgggagccc

SEQ ID NO: 363279 - RNA, 23 nt, Human
cuggccuccgacacuggccaaga

SEQ ID NO: 363280 - RNA, 22 nt, Human
aggugauguccacagcuugcag

SEQ ID NO: 363281 - RNA, 22 nt, Human
gcugucugagaacaugguggaa

SEQ ID NO: 363282 - RNA, 22 nt, Human
gcugcuguugauuuaguccaau

SEQ ID NO: 363283 - RNA, 22 nt, Human
ggaagccaggccaaugagaaca

SEQ ID NO: 363284 - RNA, 22 nt, Human
ugcagcagcagggaggaggcuc

SEQ ID NO: 363285 - RNA, 22 nt, Human
auuacaguaacagcuacaaugc

SEQ ID NO: 363286 - RNA, 22 nt, Human
uggcagaguucgcugugccuuu

SEQ ID NO: 363287 - RNA, 22 nt, Human
uguggcugucuguucuccuagg

SEQ ID NO: 363288 - RNA, 22 nt, Human
ugaggcaggaguucaggcugcg

SEQ ID NO: 363289 - RNA, 22 nt, Human
gacagcagacagaacuaccugc

SEQ ID NO: 363290 - RNA, 22 nt, Human
cugaaggauuagagagcacuua

SEQ ID NO: 363291 - RNA, 22 nt, Human
gagcacagaaucuucccaugca

SEQ ID NO: 363292 - RNA, 22 nt, Human
agcagcauggagaaaccguuca

SEQ ID NO: 363293 - RNA, 22 nt, Human
cuuucacagcugugcuuaugau

SEQ ID NO: 363294 - RNA, 22 nt, Human
aggaccaacauagcagcagugg

SEQ ID NO: 363295 - RNA, 22 nt, Human
aacccgggaggcagagguugug

SEQ ID NO: 363296 - RNA, 22 nt, Human
gcugccugcacagagcugcuuu

SEQ ID NO: 363297 - RNA, 22 nt, Human
acaggcugcccgcuccccaccu

SEQ ID NO: 363298 - RNA, 22 nt, Human
ccagccuuacugcccuucagug

SEQ ID NO: 363299 - RNA, 22 nt, Human
uggagaggagcaccauggccau

SEQ ID NO: 363300 - RNA, 22 nt, Human
uaggcaggugugcacugcccac

SEQ ID NO: 363301 - RNA, 22 nt, Human
ugcugcuguauccuuaguguca

SEQ ID NO: 363302 - RNA, 22 nt, Human
gccaggagaaugcuagcagagg

SEQ ID NO: 363303 - RNA, 19 nt, Human
gcccugcaggagguggggc

SEQ ID NO: 363304 - RNA, 22 nt, Human
ucucagagagcuguguuuuccu

SEQ ID NO: 363305 - RNA, 22 nt, Human
aauauaugugguauugaccagc

SEQ ID NO: 363306 - RNA, 22 nt, Human
cagucccacaagaucuccacaa

SEQ ID NO: 363307 - RNA, 22 nt, Human
uucuucuuaauguccugggaac

SEQ ID NO: 363308 - RNA, 17 nt, Human
aaguccagccugcagcu

SEQ ID NO: 363309 - RNA, 22 nt, Human
aacuuucagaauccuaugcauu

SEQ ID NO: 363310 - RNA, 22 nt, Human
agaagcuuccuacauuguucuu

SEQ ID NO: 363311 - RNA, 22 nt, Human
caggaacacaaugagucucaaa

SEQ ID NO: 363312 - RNA, 22 nt, Human
gcugagguaggagguugcagug

SEQ ID NO: 363313 - RNA, 22 nt, Human
cucaguuucugacauuaaaauc

SEQ ID NO: 363314 - RNA, 22 nt, Human
aggccuggugugccggaugcag

SEQ ID NO: 363315 - RNA, 22 nt, Human
cugcugggcuccucaugugacu

SEQ ID NO: 363316 - RNA, 22 nt, Human
cuggcuucugggccagggcaga

SEQ ID NO: 363317 - RNA, 23 nt, Human
uggaaagcggaccuggggcagag

SEQ ID NO: 363318 - RNA, 22 nt, Human
cucuuaaaaacuugauauauuu

SEQ ID NO: 363319 - RNA, 22 nt, Human
guccucugacucagccuuggga

SEQ ID NO: 363320 - RNA, 22 nt, Human
auaaggcagaaaugauucuagu

SEQ ID NO: 363321 - RNA, 22 nt, Human
gagagggccagggugagaacua

SEQ ID NO: 363322 - RNA, 22 nt, Human
gaaugaauucagcacauggaau

SEQ ID NO: 363323 - RNA, 17 nt, Human
ggcagcugccacuuuuu

SEQ ID NO: 363324 - RNA, 22 nt, Human
gagcuuccauggacgccaucug

SEQ ID NO: 363325 - RNA, 22 nt, Human
cuggcagcguguuuaugaacau

SEQ ID NO: 363326 - RNA, 22 nt, Human
augggcagacagggagcucacg

SEQ ID NO: 363327 - RNA, 22 nt, Human
cagagguagaaggcaugcagug

SEQ ID NO: 363328 - RNA, 22 nt, Human
agguagaggccuccaggcagca

SEQ ID NO: 363329 - RNA, 22 nt, Human
aggcaguggaaggagaaagcaa

SEQ ID NO: 363330 - RNA, 22 nt, Human
uaauuuacuugcaaauaacaau

SEQ ID NO: 363331 - RNA, 22 nt, Human
uucauacaguggcugcacucca

SEQ ID NO: 363332 - RNA, 22 nt, Human
acagggcccuugccagcacaag

SEQ ID NO: 363333 - RNA, 22 nt, Human
gagcagcugagcuggaaugaga

SEQ ID NO: 363334 - RNA, 22 nt, Human
acuucuucuucagcugggggau

SEQ ID NO: 363335 - RNA, 22 nt, Human
uuauuuacaacucuucucuucc

SEQ ID NO: 363336 - RNA, 22 nt, Human
acugcuuacaaaaggaaagaau

SEQ ID NO: 363337 - RNA, 22 nt, Human
cuguccuggagggcauaggacg

SEQ ID NO: 363338 - RNA, 22 nt, Human
aggcacagagaaugcccuccau

SEQ ID NO: 363339 - RNA, 22 nt, Human
aauaugcauuaacuguguacau

SEQ ID NO: 363340 - RNA, 22 nt, Human
uggagcugggaguccugggcug

SEQ ID NO: 363341 - RNA, 22 nt, Human
aagagcuggagcugcuacagga

SEQ ID NO: 363342 - RNA, 22 nt, Human
cccuguccuuggcugugaggcu

SEQ ID NO: 363343 - RNA, 22 nt, Human
uugcaggggaaggagcagagcu

SEQ ID NO: 363344 - RNA, 22 nt, Human
ucaguggauuggaugagaucug

SEQ ID NO: 363345 - RNA, 22 nt, Human
aauaauuuccagccaacuggaa

SEQ ID NO: 363346 - RNA, 22 nt, Human
cugucuguuucugauucaaccu

SEQ ID NO: 363347 - RNA, 22 nt, Human
cagcauggggcuuggagucagc

SEQ ID NO: 363348 - RNA, 22 nt, Human
uacuguauuugauaagugaagu

SEQ ID NO: 363349 - RNA, 23 nt, Human
ggccauggagacuuagaaugggc

SEQ ID NO: 363350 - RNA, 22 nt, Human
uuagauaaauuaagacuuuaca

SEQ ID NO: 363351 - RNA, 22 nt, Human
gcacagccagcaucugagggau

SEQ ID NO: 363352 - RNA, 23 nt, Human
agaggcaggaguggcuugcccgg

SEQ ID NO: 363353 - RNA, 22 nt, Human
agcagggcucugccaugggccc

SEQ ID NO: 363354 - RNA, 22 nt, Human
aagagcauggaauggagaucca

SEQ ID NO: 363355 - RNA, 22 nt, Human
uaacacacugaaggugagaugg

SEQ ID NO: 363356 - RNA, 22 nt, Human
aacugcuguggccuaguacuua

SEQ ID NO: 363357 - RNA, 22 nt, Human
ggcugccuccugcugggcugga

SEQ ID NO: 363358 - RNA, 20 nt, Human
auaaaauaacugccacaaga

SEQ ID NO: 363359 - RNA, 22 nt, Human
ugggcagaucuuugguggcuag

SEQ ID NO: 363360 - RNA, 22 nt, Human
uaugcacacauguaugcaugug

SEQ ID NO: 363361 - RNA, 22 nt, Human
ugcauccuuaaccagcaucacu

SEQ ID NO: 363362 - RNA, 22 nt, Human
uggagcagcacaagaaagggga

SEQ ID NO: 363363 - RNA, 22 nt, Human
ugcagaaggaggaggaaaucca

SEQ ID NO: 363364 - RNA, 22 nt, Human
aaaguucaugguguuauagaaa

SEQ ID NO: 363365 - RNA, 22 nt, Human
aaaguucagauuagacucaaga

SEQ ID NO: 363366 - RNA, 22 nt, Human
cuuuacagaauaagaauacugg

SEQ ID NO: 363367 - RNA, 22 nt, Human
ucugcuguaaagaauuucugcc

SEQ ID NO: 363368 - RNA, 22 nt, Human
aaauugcaaaaguacuuuuagg

SEQ ID NO: 363369 - RNA, 22 nt, Human
gcaaggagacuguagggccaag

SEQ ID NO: 363370 - RNA, 22 nt, Human
auaaaugccucagaaucauccc

SEQ ID NO: 363371 - RNA, 22 nt, Human
aucaggauucaccccagagcug

SEQ ID NO: 363372 - RNA, 22 nt, Human
augaggcaugugaggagaaggg

SEQ ID NO: 363373 - RNA, 20 nt, Human
ccugucucacguuccgcccc

SEQ ID NO: 363374 - RNA, 22 nt, Human
gcuucccagcagaggaaagacu

SEQ ID NO: 363375 - RNA, 22 nt, Human
gaagucugacucuuuguaagcu

SEQ ID NO: 363376 - RNA, 22 nt, Human
gggcucugcgcucagcuccagc

SEQ ID NO: 363377 - RNA, 19 nt, Human
ccauggcaaugaucugaug

SEQ ID NO: 363378 - RNA, 22 nt, Human
acaguggaagaagcacugaacu

SEQ ID NO: 363379 - RNA, 22 nt, Human
agccuucagcaguucaggugcc

SEQ ID NO: 363380 - RNA, 22 nt, Human
auuaaagaaacccagcauguga

SEQ ID NO: 363381 - RNA, 22 nt, Human
uuaaguccuugguaauuuucuu

SEQ ID NO: 363382 - RNA, 22 nt, Human
accaggggaugguuggcacugu

SEQ ID NO: 363383 - RNA, 22 nt, Human
ucccuccuggugagcaggggcu

SEQ ID NO: 363384 - RNA, 22 nt, Human
aggcacuggucuaccccuuagu

SEQ ID NO: 363385 - RNA, 22 nt, Human
ucaugcacaugugucaccauca

SEQ ID NO: 363386 - RNA, 23 nt, Human
uuuauccaacucuguaaucucuc

SEQ ID NO: 363387 - RNA, 22 nt, Human
aaaucaguaaauguucauuaac

SEQ ID NO: 363388 - RNA, 22 nt, Human
auuuccaagaaagcuuuaggau

SEQ ID NO: 363389 - RNA, 22 nt, Human
uggcugaaggaagauucuucua

SEQ ID NO: 363390 - RNA, 22 nt, Human
aggccaggcaacauucugaagu

SEQ ID NO: 363391 - RNA, 22 nt, Human
uggcagcugguacagugggucu

SEQ ID NO: 363392 - RNA, 22 nt, Human
agaggagguccuuuucugaugu

SEQ ID NO: 363393 - RNA, 22 nt, Human
gcucccaguucccaaagugacc

SEQ ID NO: 363394 - RNA, 23 nt, Human
aucaaaguggaaaucaauuaucu

SEQ ID NO: 363395 - RNA, 22 nt, Human
cacaggguuguucugaggauuc

SEQ ID NO: 363396 - RNA, 22 nt, Human
augaggcauucacagaaggcac

SEQ ID NO: 363397 - RNA, 22 nt, Human
ggguggaggagaacaggcccca

SEQ ID NO: 363398 - RNA, 22 nt, Human
gagccaggucgggccgcggcga

SEQ ID NO: 363399 - RNA, 22 nt, Human
uggcucagugcauucacaguaa

SEQ ID NO: 363400 - RNA, 21 nt, Human
auuuccaaauaaggucacauu

SEQ ID NO: 363401 - RNA, 22 nt, Human
caguguccucagccagcagcua

SEQ ID NO: 363402 - RNA, 22 nt, Human
aauuagggagagguagcuaggu

SEQ ID NO: 363403 - RNA, 22 nt, Human
ggcuuugccuggaauuuccuug

SEQ ID NO: 363404 - RNA, 22 nt, Human
acuguacuguguauuguagaau

SEQ ID NO: 363405 - RNA, 22 nt, Human
augcacuugcguguuugcaaau

SEQ ID NO: 363406 - RNA, 22 nt, Human
aacaaucaaguuucuaaaugac

SEQ ID NO: 363407 - RNA, 22 nt, Human
uugugguuaaccgcacauuuuu

SEQ ID NO: 363408 - RNA, 22 nt, Human
gacagggcgagacucagucuca

SEQ ID NO: 363409 - RNA, 23 nt, Human
cccagcagagaugaggagggguc

SEQ ID NO: 363410 - RNA, 22 nt, Human
gggcugagauuggugcccuguc

SEQ ID NO: 363411 - RNA, 20 nt, Human
ugucagugccugaggcacag

SEQ ID NO: 363412 - RNA, 22 nt, Human
ugaaagguuauuuaggucugcu

SEQ ID NO: 363413 - RNA, 22 nt, Human
cagaacugggcagggagcagag

SEQ ID NO: 363414 - RNA, 22 nt, Human
ugcaggccggcccuaggccuca

SEQ ID NO: 363415 - RNA, 22 nt, Human
ggggcagagagaaggaagcuug

SEQ ID NO: 363416 - RNA, 22 nt, Human
ccacacugaaccucagugucuu

SEQ ID NO: 363417 - RNA, 22 nt, Human
ccuggccugugaaucugagagc

SEQ ID NO: 363418 - RNA, 19 nt, Human
aggacucuggaggcaugag

SEQ ID NO: 363419 - RNA, 22 nt, Human
ccagcccugccucucagggccc

SEQ ID NO: 363420 - RNA, 22 nt, Human
cagagccaggccugcccucuuu

SEQ ID NO: 363421 - RNA, 22 nt, Human
uucuuaacucaaauauauaucc

SEQ ID NO: 363422 - RNA, 18 nt, Human
uccgaggcaccauaaaaa

SEQ ID NO: 363423 - RNA, 20 nt, Human
guaaugaauguaaacaguaa

SEQ ID NO: 363424 - RNA, 22 nt, Human
ugcaggagacauaauagggacu

SEQ ID NO: 363425 - RNA, 22 nt, Human
uguucuugagccuuuagaccua

SEQ ID NO: 363426 - RNA, 22 nt, Human
cccaggaacagggcucagaccc

SEQ ID NO: 363427 - RNA, 22 nt, Human
uuucaacuuguuugcuuccaua

SEQ ID NO: 363428 - RNA, 22 nt, Human
uacugaaaagccacaaggacca

SEQ ID NO: 363429 - RNA, 22 nt, Human
uucuuuucuuuaggcauugugu

SEQ ID NO: 363430 - RNA, 22 nt, Human
cgccaggcuugguagcucaugc

SEQ ID NO: 363431 - RNA, 22 nt, Human
uucaacuaauguuuauuuuaug

SEQ ID NO: 363432 - RNA, 22 nt, Human
uguggcuuaagaaugccuuuaa

SEQ ID NO: 363433 - RNA, 22 nt, Human
cauuugcagagggugacacucu

SEQ ID NO: 363434 - RNA, 22 nt, Human
guuagaaagugucugcuugggu

SEQ ID NO: 363435 - RNA, 22 nt, Human
uggcugaggagagggcggaagu

SEQ ID NO: 363436 - RNA, 22 nt, Human
uggcuggcuagugggcaggauu

SEQ ID NO: 363437 - RNA, 22 nt, Human
agagcugaauuuggguggugga

SEQ ID NO: 363438 - RNA, 22 nt, Human
ggcuucagugacuggugcccuc

SEQ ID NO: 363439 - RNA, 22 nt, Human
caggcagcugcuggguucagcc

SEQ ID NO: 363440 - RNA, 22 nt, Human
gcucugcugucuucuugcaggc

SEQ ID NO: 363441 - RNA, 22 nt, Human
uggaaggaagccaaggaagguu

SEQ ID NO: 363442 - RNA, 22 nt, Human
caggccugucugcacaugaggc

SEQ ID NO: 363443 - RNA, 22 nt, Human
agaagccauaguaucucagggu

SEQ ID NO: 363444 - RNA, 22 nt, Human
agagcuguucagcagccagguu

SEQ ID NO: 363445 - RNA, 22 nt, Human
aggcugcugccuuggagagugu

SEQ ID NO: 363446 - RNA, 22 nt, Human
aaacucuguagcuaaacauaau

SEQ ID NO: 363447 - RNA, 22 nt, Human
uggaagggggaagacagcucug

SEQ ID NO: 363448 - RNA, 22 nt, Human
aggugucugugaugggagcgau

SEQ ID NO: 363449 - RNA, 22 nt, Human
gagggucccgagcccugucaga

SEQ ID NO: 363450 - RNA, 22 nt, Human
auaaaaguuuccaaucaugccu

SEQ ID NO: 363451 - RNA, 22 nt, Human
gaguguucccacaccccaguug

SEQ ID NO: 363452 - RNA, 22 nt, Human
cuccagggcagcauggcagugg

SEQ ID NO: 363453 - RNA, 22 nt, Human
ucacauuugcaauugcauuguu

SEQ ID NO: 363454 - RNA, 22 nt, Human
ccagcucugcagggccuggggu

SEQ ID NO: 363455 - RNA, 22 nt, Human
aaggcgacacaggcagcaggcc

SEQ ID NO: 363456 - RNA, 20 nt, Human
agcauuugaaauaugacuau

SEQ ID NO: 363457 - RNA, 22 nt, Human
aaauguguuucgaaaacuggug

SEQ ID NO: 363458 - RNA, 22 nt, Human
cuguagccagaagcagaaggcc

SEQ ID NO: 363459 - RNA, 22 nt, Human
uacaguauguucuugaauuugg

SEQ ID NO: 363460 - RNA, 22 nt, Human
uauuccaguucaccuuuucauc

SEQ ID NO: 363461 - RNA, 23 nt, Human
uggcucugugucacauacaggau

SEQ ID NO: 363462 - RNA, 22 nt, Human
uggacaggugagugacucaggg

SEQ ID NO: 363463 - RNA, 18 nt, Human
cugcuugggagacgucag

SEQ ID NO: 363464 - RNA, 22 nt, Human
aggggaaggccagccuguagag

SEQ ID NO: 363465 - RNA, 22 nt, Human
uggcagcuagauaguguguuua

SEQ ID NO: 363466 - RNA, 22 nt, Human
aagagcugcacauauuuauauc

SEQ ID NO: 363467 - RNA, 22 nt, Human
acauaauagcauuucuaauuug

SEQ ID NO: 363468 - RNA, 23 nt, Human
gacacaggagcacccagcugagc

SEQ ID NO: 363469 - RNA, 21 nt, Human
gcaaggcuuuuguguuuccca

SEQ ID NO: 363470 - RNA, 22 nt, Human
caaaugcaugagaaauaagagg

SEQ ID NO: 363471 - RNA, 22 nt, Human
gcaggguauaauacuuagguga

SEQ ID NO: 363472 - RNA, 22 nt, Human
cccaggagaauauaauguucuu

SEQ ID NO: 363473 - RNA, 22 nt, Human
cauuauguucaguagcuuaaaa

SEQ ID NO: 363474 - RNA, 22 nt, Human
aacauugccaugguuaauuuua

SEQ ID NO: 363475 - RNA, 22 nt, Human
gcaacuuucaagcaccaugggg

SEQ ID NO: 363476 - RNA, 22 nt, Human
ucacagcaaaagugugcagagc

SEQ ID NO: 363477 - RNA, 22 nt, Human
acucccagguugccuggcaggc

SEQ ID NO: 363478 - RNA, 22 nt, Human
uuaauucuaguuuaacacuuag

SEQ ID NO: 363479 - RNA, 22 nt, Human
ucauguaaguauagaaagcagu

SEQ ID NO: 363480 - RNA, 22 nt, Human
cugugccuuuguagcugugccu

SEQ ID NO: 363481 - RNA, 22 nt, Human
uccauuggucucugugcccagg

SEQ ID NO: 363482 - RNA, 22 nt, Human
gaaagaggaaggagauguauua

SEQ ID NO: 363483 - RNA, 22 nt, Human
gucccuggaauggacucugcgc

SEQ ID NO: 363484 - RNA, 22 nt, Human
ccuggcagguggcgcccucggc

SEQ ID NO: 363485 - RNA, 22 nt, Human
agcugccaccucugccuuuggg

SEQ ID NO: 363486 - RNA, 22 nt, Human
gagaaagauggaaucuuacagg

SEQ ID NO: 363487 - RNA, 22 nt, Human
gcaggcagguggcaucuuguga

SEQ ID NO: 363488 - RNA, 23 nt, Human
cugcuguguuggucucgauggga

SEQ ID NO: 363489 - RNA, 22 nt, Human
aagauggagcacgagcagaagc

SEQ ID NO: 363490 - RNA, 22 nt, Human
uagucaaaccucagaauacccc

SEQ ID NO: 363491 - RNA, 17 nt, Human
aguggcaggcagauggg

SEQ ID NO: 363492 - RNA, 22 nt, Human
cagggcucaggcucugggauuc

SEQ ID NO: 363493 - RNA, 19 nt, Human
acuggcaguuucugcaugg

SEQ ID NO: 363494 - RNA, 22 nt, Human
gcagcuuuagaaacaagggcug

SEQ ID NO: 363495 - RNA, 22 nt, Human
agaagugccauacuguggucca

SEQ ID NO: 363496 - RNA, 22 nt, Human
uugauacaggcucuauuucauc

SEQ ID NO: 363497 - RNA, 22 nt, Human
ggcaggugaccuggccucccag

SEQ ID NO: 363498 - RNA, 18 nt, Human
acauuucuaugcuucugg

SEQ ID NO: 363499 - RNA, 22 nt, Human
caugggcaguuggcagggcuca

SEQ ID NO: 363500 - RNA, 22 nt, Human
uguuucaggaccuaucuuuuag

SEQ ID NO: 363501 - RNA, 22 nt, Human
uccaguggagugugggggugaa

SEQ ID NO: 363502 - RNA, 22 nt, Human
gcccucugcacagcucugagca

SEQ ID NO: 363503 - RNA, 22 nt, Human
ugauuucccucaucauaacaga

SEQ ID NO: 363504 - RNA, 22 nt, Human
cuggcucaugugaugagggcaa

SEQ ID NO: 363505 - RNA, 22 nt, Human
ucuggagcaacagagcaggaca

SEQ ID NO: 363506 - RNA, 22 nt, Human
aggcaggugggucacuugaguc

SEQ ID NO: 363507 - RNA, 22 nt, Human
uggcucagucauggaugaguaa

SEQ ID NO: 363508 - RNA, 22 nt, Human
gaauuucaaaagccagaacggg

SEQ ID NO: 363509 - RNA, 22 nt, Human
ucugucacuuuuauuuacugaa

SEQ ID NO: 363510 - RNA, 22 nt, Human
gagguuagaggucagugcaguc

SEQ ID NO: 363511 - RNA, 22 nt, Human
ugaaagguuaaaaguaguauug

SEQ ID NO: 363512 - RNA, 22 nt, Human
agccaacuaggagauuaaggua

SEQ ID NO: 363513 - RNA, 22 nt, Human
agagaaggucacuaaggaccca

SEQ ID NO: 363514 - RNA, 22 nt, Human
agccaaggagugcagguggcuu

SEQ ID NO: 363515 - RNA, 22 nt, Human
agcagcagauccaaaaaaugug

SEQ ID NO: 363516 - RNA, 22 nt, Human
cuggccuuuaaaaugaccuuau

SEQ ID NO: 363517 - RNA, 22 nt, Human
gcuguauuuaacaacuggcuca

SEQ ID NO: 363518 - RNA, 21 nt, Human
gcagcaguguucuagaauacu

SEQ ID NO: 363519 - RNA, 22 nt, Human
cccaggaaaucaggcuuucuag

SEQ ID NO: 363520 - RNA, 21 nt, Human
gcagccagacgggauucaguu

SEQ ID NO: 363521 - RNA, 22 nt, Human
aaaauguaaagcuugaguguag

SEQ ID NO: 363522 - RNA, 22 nt, Human
acccagggaccccgcugacgcc

SEQ ID NO: 363523 - RNA, 22 nt, Human
cacuucaauuaacuucagcauu

SEQ ID NO: 363524 - RNA, 19 nt, Human
ggugugaagugaggaguua

SEQ ID NO: 363525 - RNA, 22 nt, Human
cuggagccugcaguuuucacuu

SEQ ID NO: 363526 - RNA, 21 nt, Human
acucaggagacuaacuauguc

SEQ ID NO: 363527 - RNA, 22 nt, Human
aaagccaugaauguuauagagg

SEQ ID NO: 363528 - RNA, 22 nt, Human
ucuguggccuguguccaagugc

SEQ ID NO: 363529 - RNA, 22 nt, Human
aaaagagguuaaccaggugugu

SEQ ID NO: 363530 - RNA, 22 nt, Human
uccugccucaggcucuggagua

SEQ ID NO: 363531 - RNA, 19 nt, Human
caggaaggggcgaaucugg

SEQ ID NO: 363532 - RNA, 22 nt, Human
gggccuggugcuucugacuccu

SEQ ID NO: 363533 - RNA, 22 nt, Human
agaauucuggaguugggaggaa

SEQ ID NO: 363534 - RNA, 22 nt, Human
ucucucuucaacccuuaacuag

SEQ ID NO: 363535 - RNA, 22 nt, Human
aggcuucccagcugagcucagc

SEQ ID NO: 363536 - RNA, 22 nt, Human
aggauuuagcaugaaaugugaa

SEQ ID NO: 363537 - RNA, 22 nt, Human
gugauuuugagaccuauauagu

SEQ ID NO: 363538 - RNA, 22 nt, Human
guuauuuuaucucugagagguu

SEQ ID NO: 363539 - RNA, 22 nt, Human
aagaacaguugggaggugagcc

SEQ ID NO: 363540 - RNA, 22 nt, Human
ucacaucuuauuagaguaucuc

SEQ ID NO: 363541 - RNA, 22 nt, Human
cagagccaaaugcugugguuau

SEQ ID NO: 363542 - RNA, 22 nt, Human
ggucccugaagaggccuggggu

SEQ ID NO: 363543 - RNA, 22 nt, Human
uggcugcaguucacaggagcaa

SEQ ID NO: 363544 - RNA, 22 nt, Human
cagaggccaccuguggccacug

SEQ ID NO: 363545 - RNA, 22 nt, Human
caaaggcaggcccccugugcag

SEQ ID NO: 363546 - RNA, 22 nt, Human
uuucccaauugagagguucugu

SEQ ID NO: 363547 - RNA, 22 nt, Human
uuauagaaggagcauucacuua

SEQ ID NO: 363548 - RNA, 22 nt, Human
uuccaugacaccgagggaaguc

SEQ ID NO: 363549 - RNA, 22 nt, Human
ugaaggaaugaguauacuguuu

SEQ ID NO: 363550 - RNA, 22 nt, Human
agagagcauggcacagaggggu

SEQ ID NO: 363551 - RNA, 22 nt, Human
ugcagccauuuucugccaaugc

SEQ ID NO: 363552 - RNA, 19 nt, Human
gggaaauucacuugcuucc

SEQ ID NO: 363553 - RNA, 22 nt, Human
cagaggcucagauggcccuggc

SEQ ID NO: 363554 - RNA, 22 nt, Human
cugggcacauuuugacuagugu

SEQ ID NO: 363555 - RNA, 22 nt, Human
gugcccugguccccagcauaua

SEQ ID NO: 363556 - RNA, 22 nt, Human
uucaacuagauuuauacaauuc

SEQ ID NO: 363557 - RNA, 22 nt, Human
agggcugaugcaccauguagcc

SEQ ID NO: 363558 - RNA, 20 nt, Human
cucugcuuuaggagagucag

SEQ ID NO: 363559 - RNA, 20 nt, Human
aggcucaggguguuuaggaa

SEQ ID NO: 363560 - RNA, 22 nt, Human
ccagggcuccauugcucauccu

SEQ ID NO: 363561 - RNA, 22 nt, Human
aauucaugaguagaaucuauau

SEQ ID NO: 363562 - RNA, 22 nt, Human
auaacagaugugaagugcuaau

SEQ ID NO: 363563 - RNA, 21 nt, Human
uuugagaauuggucagagugc

SEQ ID NO: 363564 - RNA, 22 nt, Human
uuccuugguagagagaauauuu

SEQ ID NO: 363565 - RNA, 23 nt, Human
ucuguacaauugagaagagaaca

SEQ ID NO: 363566 - RNA, 22 nt, Human
uuuccaaaggaguaccacgcau

SEQ ID NO: 363567 - RNA, 18 nt, Human
ugugguggagcugccuuc

SEQ ID NO: 363568 - RNA, 22 nt, Human
cagagcuguuacuauucaugaa

SEQ ID NO: 363569 - RNA, 22 nt, Human
acccagccacagcauugaggga

SEQ ID NO: 363570 - RNA, 22 nt, Human
aagaguuuucuauaaucuuggc

SEQ ID NO: 363571 - RNA, 22 nt, Human
ucaugcaaggcugaaacauggu

SEQ ID NO: 363572 - RNA, 22 nt, Human
uguuuuguuuaugagagcacag

SEQ ID NO: 363573 - RNA, 21 nt, Human
ugaaaugagaaugcugagcac

SEQ ID NO: 363574 - RNA, 22 nt, Human
ucuguucauguugggcuuuucc

SEQ ID NO: 363575 - RNA, 23 nt, Human
gaagcagaugucugaguaggcag

SEQ ID NO: 363576 - RNA, 22 nt, Human
uauuauguagaguaaggguuaa

SEQ ID NO: 363577 - RNA, 22 nt, Human
aaggcagaaauucaacuacugg

SEQ ID NO: 363578 - RNA, 22 nt, Human
gagauuuagcugcuuaacuccu

SEQ ID NO: 363579 - RNA, 22 nt, Human
ggacacaguggaagacagcuug

SEQ ID NO: 363580 - RNA, 22 nt, Human
uauguacaucguugaauucaaa

SEQ ID NO: 363581 - RNA, 22 nt, Human
accagaguaauguguggaaauu

SEQ ID NO: 363582 - RNA, 22 nt, Human
aaagaagggacagacugccucu

SEQ ID NO: 363583 - RNA, 22 nt, Human
gcuuuggagccuguguucugcc

SEQ ID NO: 363584 - RNA, 22 nt, Human
gggcucagccccauugaaccag

SEQ ID NO: 363585 - RNA, 22 nt, Human
agaugaagauaucugcaggggc

SEQ ID NO: 363586 - RNA, 22 nt, Human
ucuggagcuuguuucagauggu

SEQ ID NO: 363587 - RNA, 22 nt, Human
gcagcauuaccaagacauggca

SEQ ID NO: 363588 - RNA, 22 nt, Human
cugcccugucuuuuucugauga

SEQ ID NO: 363589 - RNA, 22 nt, Human
ccagcugcgggcaucgagaguu

SEQ ID NO: 363590 - RNA, 22 nt, Human
gcugugcaguaguagguacagu

SEQ ID NO: 363591 - RNA, 22 nt, Human
acucugugugaguagagccugu

SEQ ID NO: 363592 - RNA, 17 nt, Human
agggacagcaguuuagg

SEQ ID NO: 363593 - RNA, 22 nt, Human
uguccucacaggaaugaacuuu

SEQ ID NO: 363594 - RNA, 22 nt, Human
ucaggggcugugcauuucccag

SEQ ID NO: 363595 - RNA, 20 nt, Human
gcccaggaucucugaggcau

SEQ ID NO: 363596 - RNA, 20 nt, Human
ucauuguguugccaauuccc

SEQ ID NO: 363597 - RNA, 22 nt, Human
gaggaagcagggcuuggcugag

SEQ ID NO: 363598 - RNA, 22 nt, Human
ugcuuaauacguauuugcugga

SEQ ID NO: 363599 - RNA, 22 nt, Human
agggugggcuagacucuucccc

SEQ ID NO: 363600 - RNA, 22 nt, Human
uccaggagguagugcuuaauuu

SEQ ID NO: 363601 - RNA, 23 nt, Human
uguaaaaugggguaguguuacca

SEQ ID NO: 363602 - RNA, 22 nt, Human
uucuucaaauagcagggaguca

SEQ ID NO: 363603 - RNA, 22 nt, Human
auuuccauagagcgucucacag

SEQ ID NO: 363604 - RNA, 22 nt, Human
uuuccuguugccaucaagaaug

SEQ ID NO: 363605 - RNA, 22 nt, Human
aucuagaaguggcaugaauuac

SEQ ID NO: 363606 - RNA, 22 nt, Human
cugcccugugaggguccuuggg

SEQ ID NO: 363607 - RNA, 22 nt, Human
aaguguuuacuuaaagucaugg

SEQ ID NO: 363608 - RNA, 22 nt, Human
caaugaaaauuuaaguugcagc

SEQ ID NO: 363609 - RNA, 17 nt, Human
uccuucagggccucaca

SEQ ID NO: 363610 - RNA, 22 nt, Human
guucccauacaguaucagugcu

SEQ ID NO: 363611 - RNA, 22 nt, Human
cagggagcuggugccagccgac

SEQ ID NO: 363612 - RNA, 22 nt, Human
gcuggccugucuagagccuuac

SEQ ID NO: 363613 - RNA, 22 nt, Human
aucaguuucugugaagaacaca

SEQ ID NO: 363614 - RNA, 20 nt, Human
gauuacaaaaugaaaugcau

SEQ ID NO: 363615 - RNA, 22 nt, Human
aggcugaggcuuuccuuggaga

SEQ ID NO: 363616 - RNA, 22 nt, Human
cugugacuguguuggaugcaca

SEQ ID NO: 363617 - RNA, 22 nt, Human
ugggggugugccagggaccucc

SEQ ID NO: 363618 - RNA, 22 nt, Human
gagcucugacugcugggugaca

SEQ ID NO: 363619 - RNA, 22 nt, Human
uugugaaacauucauggauuug

SEQ ID NO: 363620 - RNA, 22 nt, Human
ugaaggcauugaugaaggaauc

SEQ ID NO: 363621 - RNA, 22 nt, Human
auucuucagaauaucuggcacu

SEQ ID NO: 363622 - RNA, 22 nt, Human
gcagcugccuucagcuggaugg

SEQ ID NO: 363623 - RNA, 17 nt, Human
uuccucucacauuuuuu

SEQ ID NO: 363624 - RNA, 22 nt, Human
gggccuguguguucaggagccu

SEQ ID NO: 363625 - RNA, 20 nt, Human
agcugaggcaccugagguua

SEQ ID NO: 363626 - RNA, 22 nt, Human
uauucacauguacauaugcuca

SEQ ID NO: 363627 - RNA, 22 nt, Human
acaaggcugaacagugaagccg

SEQ ID NO: 363628 - RNA, 22 nt, Human
uacaaaguuuucuuggauugag

SEQ ID NO: 363629 - RNA, 22 nt, Human
ucuggcucccagccugcucuca

SEQ ID NO: 363630 - RNA, 22 nt, Human
ucaagagaaggggaaauagacu

SEQ ID NO: 363631 - RNA, 22 nt, Human
aaagaaucacauccuucagcaa

SEQ ID NO: 363632 - RNA, 22 nt, Human
agggagcuguggucagcucagu

SEQ ID NO: 363633 - RNA, 22 nt, Human
uuucuuucaauucuccuaaugc

SEQ ID NO: 363634 - RNA, 22 nt, Human
cacaggaaugaacagggaaaga

SEQ ID NO: 363635 - RNA, 22 nt, Human
auuaaauuagcaaacugugaaa

SEQ ID NO: 363636 - RNA, 22 nt, Human
uuguccaaggucccacaguuag

SEQ ID NO: 363637 - RNA, 22 nt, Human
gccaggcucucagugacugccc

SEQ ID NO: 363638 - RNA, 22 nt, Human
aaugcuagugugauauguaagg

SEQ ID NO: 363639 - RNA, 22 nt, Human
aaaguguugggaagaaagugca

SEQ ID NO: 363640 - RNA, 22 nt, Human
aacaugcugccuuucuacgagu

SEQ ID NO: 363641 - RNA, 21 nt, Human
acaugucucuaaucucaguga

SEQ ID NO: 363642 - RNA, 22 nt, Human
aaaugcuguguuuuaacauaga

SEQ ID NO: 363643 - RNA, 22 nt, Human
aggccugggucucgugccuacc

SEQ ID NO: 363644 - RNA, 22 nt, Human
uaagaagcuucugcuaaugccu

SEQ ID NO: 363645 - RNA, 22 nt, Human
cuggagguaauguuauuuuugu

SEQ ID NO: 363646 - RNA, 22 nt, Human
caguaugagaguugaaucaagg

SEQ ID NO: 363647 - RNA, 22 nt, Human
auaaugaggauuugcauauuag

SEQ ID NO: 363648 - RNA, 22 nt, Human
uuucacaugguacugccuguuu

SEQ ID NO: 363649 - RNA, 21 nt, Human
cagcagaguaaugcauucgua

SEQ ID NO: 363650 - RNA, 22 nt, Human
ucagagccccuccgcuguccca

SEQ ID NO: 363651 - RNA, 22 nt, Human
gcacugaaauuauaugcauuug

SEQ ID NO: 363652 - RNA, 22 nt, Human
aggcuagcaaugggagaugagu

SEQ ID NO: 363653 - RNA, 22 nt, Human
cugagguggaacagaggugaag

SEQ ID NO: 363654 - RNA, 22 nt, Human
gcaaggacucccugggucauuc

SEQ ID NO: 363655 - RNA, 22 nt, Human
gccuggcaggggccugggagug

SEQ ID NO: 363656 - RNA, 20 nt, Human
gacaucauguacacauugcc

SEQ ID NO: 363657 - RNA, 22 nt, Human
cagcuugggucaggugccugcu

SEQ ID NO: 363658 - RNA, 22 nt, Human
gcaggguaggugacagguaguc

SEQ ID NO: 363659 - RNA, 22 nt, Human
ugggcugaguggcagccagagu

SEQ ID NO: 363660 - RNA, 22 nt, Human
aucagagaaauggagggcgcuu

SEQ ID NO: 363661 - RNA, 22 nt, Human
cagcuuuggcccagucgggagg

SEQ ID NO: 363662 - RNA, 20 nt, Human
cccagccccuaccuguugcc

SEQ ID NO: 363663 - RNA, 23 nt, Human
uccaugagaugugggcuucuagu

SEQ ID NO: 363664 - RNA, 22 nt, Human
uccuucagucuucugagccaua

SEQ ID NO: 363665 - RNA, 22 nt, Human
agacagcauggagcugauaaca

SEQ ID NO: 363666 - RNA, 20 nt, Human
ugccagggccagcagaggcu

SEQ ID NO: 363667 - RNA, 22 nt, Human
gcuuccugucccucagccauga

SEQ ID NO: 363668 - RNA, 22 nt, Human
cccaggcaucccauuaaggagc

SEQ ID NO: 363669 - RNA, 22 nt, Human
acuguucauuuggauuucucug

SEQ ID NO: 363670 - RNA, 22 nt, Human
uuuucuuaggugcuccaaguag

SEQ ID NO: 363671 - RNA, 22 nt, Human
ugggcaggauaauaucucaugu

SEQ ID NO: 363672 - RNA, 22 nt, Human
uagcuuuccuuguugccugugc

SEQ ID NO: 363673 - RNA, 22 nt, Human
uuugaagugcaaugaggauucu

SEQ ID NO: 363674 - RNA, 22 nt, Human
cccaggagagaggggauaaagc

SEQ ID NO: 363675 - RNA, 22 nt, Human
ucuccucucuuaccugguacaa

SEQ ID NO: 363676 - RNA, 22 nt, Human
cuguggaguggggaguacuggu

SEQ ID NO: 363677 - RNA, 22 nt, Human
ucuccaagcagggcugcaaggc

SEQ ID NO: 363678 - RNA, 22 nt, Human
cugagcacugggcacauagcug

SEQ ID NO: 363679 - RNA, 22 nt, Human
cacagcuuguuuagugacucac

SEQ ID NO: 363680 - RNA, 22 nt, Human
uauggcuuuuaacugucguaug

SEQ ID NO: 363681 - RNA, 22 nt, Human
ucagugugaguaccaugcucag

SEQ ID NO: 363682 - RNA, 22 nt, Human
guucuucaucuuaaccaucugu

SEQ ID NO: 363683 - RNA, 22 nt, Human
acauaugcucaucugcauuccc

SEQ ID NO: 363684 - RNA, 22 nt, Human
ccagggugaccagcuggccuag

SEQ ID NO: 363685 - RNA, 22 nt, Human
gccugucugcgucacgcuuauu

SEQ ID NO: 363686 - RNA, 22 nt, Human
agcaauauaaauguuggguaga

SEQ ID NO: 363687 - RNA, 19 nt, Human
ugagcuggcugagccucuc

SEQ ID NO: 363688 - RNA, 22 nt, Human
caacauauaauauuugaguucu

SEQ ID NO: 363689 - RNA, 22 nt, Human
gagaaagggauaauuugaagag

SEQ ID NO: 363690 - RNA, 22 nt, Human
ucuguucaguugauuagacaga

SEQ ID NO: 363691 - RNA, 22 nt, Human
gcagagugaagcaguauggaaa

SEQ ID NO: 363692 - RNA, 22 nt, Human
ggugcagcugcagccugggagc

SEQ ID NO: 363693 - RNA, 22 nt, Human
uuauuauagauuaugcaagauu

SEQ ID NO: 363694 - RNA, 22 nt, Human
gugcugugugauccaugcuggc

SEQ ID NO: 363695 - RNA, 22 nt, Human
gauuucaaaaguagauccauca

SEQ ID NO: 363696 - RNA, 22 nt, Human
gagcugcccugagcuuugcaug

SEQ ID NO: 363697 - RNA, 22 nt, Human
cacccugggcugggccuguuaa

SEQ ID NO: 363698 - RNA, 22 nt, Human
augcuguggggagugaggguag

SEQ ID NO: 363699 - RNA, 20 nt, Human
agugcaagaaagcacagcug

SEQ ID NO: 363700 - RNA, 22 nt, Human
aggauccuccuuagaaaagacc

SEQ ID NO: 363701 - RNA, 22 nt, Human
aggcucaggcaggaauggcgga

SEQ ID NO: 363702 - RNA, 22 nt, Human
gccuaauaacuagcuguguaac

SEQ ID NO: 363703 - RNA, 22 nt, Human
guuuacauauuuuaauugguga

SEQ ID NO: 363704 - RNA, 22 nt, Human
ugagcccagagaucugagcuau

SEQ ID NO: 363705 - RNA, 22 nt, Human
aggaaacuguccccucauccua

SEQ ID NO: 363706 - RNA, 22 nt, Human
gggcugcugccaccagguggau

SEQ ID NO: 363707 - RNA, 22 nt, Human
gaaaagcuaggccaguucagcu

SEQ ID NO: 363708 - RNA, 22 nt, Human
uuucuucagccuucacaaccug

SEQ ID NO: 363709 - RNA, 22 nt, Human
uuagacaagggcuccuuaaaag

SEQ ID NO: 363710 - RNA, 22 nt, Human
aggcaguuguugcugagcagcu

SEQ ID NO: 363711 - RNA, 19 nt, Human
uucacauuggaagaaguag

SEQ ID NO: 363712 - RNA, 22 nt, Human
agcagagccaggucucucugua

SEQ ID NO: 363713 - RNA, 22 nt, Human
aucuggcucauucagggaacgg

SEQ ID NO: 363714 - RNA, 22 nt, Human
cagugcccuuccaggacugcag

SEQ ID NO: 363715 - RNA, 22 nt, Human
ugauuuccacagucaggggugc

SEQ ID NO: 363716 - RNA, 22 nt, Human
uuacaaagagaaguuguagaau

SEQ ID NO: 363717 - RNA, 22 nt, Human
agguuuucagcuguauccugag

SEQ ID NO: 363718 - RNA, 22 nt, Human
uugauacaggccuucuagauga

SEQ ID NO: 363719 - RNA, 21 nt, Human
ucccacucuaaauggacugaa

SEQ ID NO: 363720 - RNA, 22 nt, Human
cccaggaggccaagguugcagu

SEQ ID NO: 363721 - RNA, 22 nt, Human
cucaggaggugguagaggcccu

SEQ ID NO: 363722 - RNA, 22 nt, Human
agcucccagaagccagagucgg

SEQ ID NO: 363723 - RNA, 22 nt, Human
acucaggaaaaauguagugaua

SEQ ID NO: 363724 - RNA, 22 nt, Human
uaaagccauacugaaagccacu

SEQ ID NO: 363725 - RNA, 22 nt, Human
uaacagaaaagaacugaguuug

SEQ ID NO: 363726 - RNA, 22 nt, Human
gggcugagggguaucucauggg

SEQ ID NO: 363727 - RNA, 21 nt, Human
guuugcaugaacaagucagcc

SEQ ID NO: 363728 - RNA, 22 nt, Human
ccuggcagucaggggaguccuu

SEQ ID NO: 363729 - RNA, 22 nt, Human
caaaugcuacuaauaggcaagu

SEQ ID NO: 363730 - RNA, 18 nt, Human
cuguucuagaacuccugu

SEQ ID NO: 363731 - RNA, 22 nt, Human
ucucugagcccagugucccccu

SEQ ID NO: 363732 - RNA, 22 nt, Human
gcccagcuuuuugaggcaggca

SEQ ID NO: 363733 - RNA, 22 nt, Human
uaucagaaagauauuacugggg

SEQ ID NO: 363734 - RNA, 17 nt, Human
acucaggaucugggagu

SEQ ID NO: 363735 - RNA, 22 nt, Human
cuggagcugucuucacaggccu

SEQ ID NO: 363736 - RNA, 22 nt, Human
aguaaacauaauuuaccuguag

SEQ ID NO: 363737 - RNA, 22 nt, Human
gcuggcuguguuucaucucuga

SEQ ID NO: 363738 - RNA, 22 nt, Human
aagauaaacucuugauuucuga

SEQ ID NO: 363739 - RNA, 22 nt, Human
uucuguauauuguaaagacuca

SEQ ID NO: 363740 - RNA, 22 nt, Human
acaggauuagcaaguaaucagg

SEQ ID NO: 363741 - RNA, 22 nt, Human
ggccuugggauguggcugcagc

SEQ ID NO: 363742 - RNA, 22 nt, Human
ucuguucagaagaggugaaagu

SEQ ID NO: 363743 - RNA, 22 nt, Human
uguccuuuaugaaaugguguuu

SEQ ID NO: 363744 - RNA, 22 nt, Human
agucccuucucaaagugugcgg

SEQ ID NO: 363745 - RNA, 22 nt, Human
ccaggagcagggcuggcugcac

SEQ ID NO: 363746 - RNA, 22 nt, Human
uguccuuacaaggucccuuucg

SEQ ID NO: 363747 - RNA, 22 nt, Human
ugcuucugggcaaaugugugug

SEQ ID NO: 363748 - RNA, 22 nt, Human
uccagggagagccgcugcucca

SEQ ID NO: 363749 - RNA, 22 nt, Human
cagcagugaugugugaggguuc

SEQ ID NO: 363750 - RNA, 22 nt, Human
guaauugacucagcucuguuca

SEQ ID NO: 363751 - RNA, 22 nt, Human
agccucucuuucugguggcuaa

SEQ ID NO: 363752 - RNA, 22 nt, Human
gcuggaucaaguccuucaccca

SEQ ID NO: 363753 - RNA, 22 nt, Human
ggagcauguggggugagcaggg

SEQ ID NO: 363754 - RNA, 22 nt, Human
uucaggauggcggauguugggg

SEQ ID NO: 363755 - RNA, 22 nt, Human
uguguacuugaaagggcagguc

SEQ ID NO: 363756 - RNA, 22 nt, Human
cugggccagcaacugcaaugga

SEQ ID NO: 363757 - RNA, 22 nt, Human
ggaguuggugagcaccaggcuu

SEQ ID NO: 363758 - RNA, 22 nt, Human
gaccuggaggauccucuucuug

SEQ ID NO: 363759 - RNA, 22 nt, Human
uauucaaaguaccuucauugcc

SEQ ID NO: 363760 - RNA, 22 nt, Human
auguuauuuuggaaaauacaaa

SEQ ID NO: 363761 - RNA, 23 nt, Human
aaaguugauuugcaguuuaagag

SEQ ID NO: 363762 - RNA, 21 nt, Human
ccagcugucuguccuuaggca

SEQ ID NO: 363763 - RNA, 22 nt, Human
gcuccugggcucuaccuugcua

SEQ ID NO: 363764 - RNA, 22 nt, Human
uguaugcuuuccaaaaaugcug

SEQ ID NO: 363765 - RNA, 22 nt, Human
gcugucagugaggugagacaug

SEQ ID NO: 363766 - RNA, 22 nt, Human
aucuguaaaugcaaauguagcu

SEQ ID NO: 363767 - RNA, 22 nt, Human
acacuaauuaagcugcuuuacu

SEQ ID NO: 363768 - RNA, 22 nt, Human
uuuuaucaaucauuaagacauu

SEQ ID NO: 363769 - RNA, 22 nt, Human
caggugucaaaauacuaagugg

SEQ ID NO: 363770 - RNA, 22 nt, Human
caauuucucgaacucuaaucca

SEQ ID NO: 363771 - RNA, 22 nt, Human
auuugagaugguaaauaacuuu

SEQ ID NO: 363772 - RNA, 22 nt, Human
ugcugggcuagaagcugaggcc

SEQ ID NO: 363773 - RNA, 22 nt, Human
uacugaaauacuaagaaguuaa

SEQ ID NO: 363774 - RNA, 22 nt, Human
ggcagggaaacagcugauccca

SEQ ID NO: 363775 - RNA, 22 nt, Human
aggccuguuccuuccugggcac

SEQ ID NO: 363776 - RNA, 20 nt, Human
ucauuacagugcuaagaugu

SEQ ID NO: 363777 - RNA, 22 nt, Human
uggcaggaaaaagggccagagg

SEQ ID NO: 363778 - RNA, 22 nt, Human
ccugcuggccaguggagggcug

SEQ ID NO: 363779 - RNA, 23 nt, Human
caggcaggaugaggacuacacuc

SEQ ID NO: 363780 - RNA, 19 nt, Human
aguggcagaucuggaagua

SEQ ID NO: 363781 - RNA, 22 nt, Human
ucaguguccggagccugagugc

SEQ ID NO: 363782 - RNA, 22 nt, Human
caggggcucugagauugucuaa

SEQ ID NO: 363783 - RNA, 22 nt, Human
ucccaggacaggccacauggaa

SEQ ID NO: 363784 - RNA, 22 nt, Human
acagccaggaauucuggagaag

SEQ ID NO: 363785 - RNA, 22 nt, Human
uuuauuauucucuggagaaugu

SEQ ID NO: 363786 - RNA, 22 nt, Human
ugagaggccccagcucuuggcc

SEQ ID NO: 363787 - RNA, 22 nt, Human
cuucuugcaauuuucaucuuau

SEQ ID NO: 363788 - RNA, 22 nt, Human
aggcugggaaauguauuccagc

SEQ ID NO: 363789 - RNA, 22 nt, Human
cauucacucagcgaugccagua

SEQ ID NO: 363790 - RNA, 22 nt, Human
ggauuuccucuugacucuaaag

SEQ ID NO: 363791 - RNA, 22 nt, Human
aacagaauugcugcugccaaug

SEQ ID NO: 363792 - RNA, 22 nt, Human
ugcucugucaagaaaagaugcc

SEQ ID NO: 363793 - RNA, 22 nt, Human
cccagcucucucaguucugcuu

SEQ ID NO: 363794 - RNA, 22 nt, Human
aggcacugguccauuuucugca

SEQ ID NO: 363795 - RNA, 22 nt, Human
gcagcugccuauucagggcuug

SEQ ID NO: 363796 - RNA, 22 nt, Human
uggcugaacuaaugugcuguuu

SEQ ID NO: 363797 - RNA, 22 nt, Human
agcugguuagcaaucuaaguga

SEQ ID NO: 363798 - RNA, 21 nt, Human
ccaccaggucuucugcucggg

SEQ ID NO: 363799 - RNA, 22 nt, Human
uuuuguuguaauauaccuaucc

SEQ ID NO: 363800 - RNA, 22 nt, Human
uguaacaaaauaccuuggauug

SEQ ID NO: 363801 - RNA, 22 nt, Human
ccaggguuuaaauucugacuau

SEQ ID NO: 363802 - RNA, 22 nt, Human
ucuagggaacaugggucaagcu

SEQ ID NO: 363803 - RNA, 22 nt, Human
agcaggaaggcuuuggggguuc

SEQ ID NO: 363804 - RNA, 22 nt, Human
ccugaagcaaggguaggcaggu

SEQ ID NO: 363805 - RNA, 22 nt, Human
cccaggcaggagugugguggcu

SEQ ID NO: 363806 - RNA, 22 nt, Human
uggcagagugcggcauccccug

SEQ ID NO: 363807 - RNA, 22 nt, Human
agcaggcuuucaagagucuucu

SEQ ID NO: 363808 - RNA, 22 nt, Human
uaauuauuaugacaacaauugc

SEQ ID NO: 363809 - RNA, 20 nt, Human
ucacauccucucccaacaug

SEQ ID NO: 363810 - RNA, 22 nt, Human
cacaugggcguaauguccaugg

SEQ ID NO: 363811 - RNA, 22 nt, Human
accugagaccuaaucugacugu

SEQ ID NO: 363812 - RNA, 20 nt, Human
caccacagaauuggggacag

SEQ ID NO: 363813 - RNA, 22 nt, Human
uccagggagauacuggcugcca

SEQ ID NO: 363814 - RNA, 20 nt, Human
uuacucaguuccugccaugc

SEQ ID NO: 363815 - RNA, 22 nt, Human
uccucaggcggugaggaggggc

SEQ ID NO: 363816 - RNA, 16 nt, Human
uggcugagagaggguu

SEQ ID NO: 363817 - RNA, 22 nt, Human
cuuauacacccucuucccaggc

SEQ ID NO: 363818 - RNA, 22 nt, Human
ggaaagagcccagcagugcuug

SEQ ID NO: 363819 - RNA, 22 nt, Human
cccucugccugcgcccuggugu

SEQ ID NO: 363820 - RNA, 20 nt, Human
uuucuguaaggcauuaaucu

SEQ ID NO: 363821 - RNA, 22 nt, Human
agucaauucuuuucaacucaag

SEQ ID NO: 363822 - RNA, 22 nt, Human
gccugcagggcccuuguggguc

SEQ ID NO: 363823 - RNA, 22 nt, Human
augggaugcauggcuguggcca

SEQ ID NO: 363824 - RNA, 22 nt, Human
ccagggcauguccaagacuuag

SEQ ID NO: 363825 - RNA, 22 nt, Human
acagaggaagcauauagcacaa

SEQ ID NO: 363826 - RNA, 22 nt, Human
ucauccaguaccauggaaggca

SEQ ID NO: 363827 - RNA, 22 nt, Human
cugcugugccuuaaaaugcaag

SEQ ID NO: 363828 - RNA, 22 nt, Human
aaguggagcuauaggcucagau

SEQ ID NO: 363829 - RNA, 22 nt, Human
aagacaagcaucaaaucaggca

SEQ ID NO: 363830 - RNA, 22 nt, Human
ucaccgucgggggucgcugucu

SEQ ID NO: 363831 - RNA, 22 nt, Human
ggcugggcuccgggagcaugcg

SEQ ID NO: 363832 - RNA, 22 nt, Human
ucacaagacagaaaacauuuag

SEQ ID NO: 363833 - RNA, 22 nt, Human
ugggcucucuggcaggaaggcu

SEQ ID NO: 363834 - RNA, 19 nt, Human
caggagagcaugcacuuug

SEQ ID NO: 363835 - RNA, 22 nt, Human
ccccaggaagccucagauuugc

SEQ ID NO: 363836 - RNA, 22 nt, Human
agacagcugcucgcagagcuau

SEQ ID NO: 363837 - RNA, 21 nt, Human
agagccugagaucuuccagca

SEQ ID NO: 363838 - RNA, 22 nt, Human
gagagggcugccuggugugagg

SEQ ID NO: 363839 - RNA, 22 nt, Human
aucuccaggcauuucaagagac

SEQ ID NO: 363840 - RNA, 22 nt, Human
agcaccuucacaggcucucagg

SEQ ID NO: 363841 - RNA, 22 nt, Human
acuggagcccguggaggcgcag

SEQ ID NO: 363842 - RNA, 22 nt, Human
aggcuucugugagcucauacaa

SEQ ID NO: 363843 - RNA, 22 nt, Human
gagagucuaggaaccucauaua

SEQ ID NO: 363844 - RNA, 22 nt, Human
cugcucugagaggcucuuccua

SEQ ID NO: 363845 - RNA, 22 nt, Human
guauuuucaagagcaguaguau

SEQ ID NO: 363846 - RNA, 22 nt, Human
gaaggaggugucaguuggacug

SEQ ID NO: 363847 - RNA, 23 nt, Human
agaccugcaucugauaggcccug

SEQ ID NO: 363848 - RNA, 22 nt, Human
gagucccaugaugauagccaca

SEQ ID NO: 363849 - RNA, 22 nt, Human
gcagugcuaaguagcuggccca

SEQ ID NO: 363850 - RNA, 22 nt, Human
caaauacuaaacauaagauuuu

SEQ ID NO: 363851 - RNA, 22 nt, Human
auucugauaucuuauucuagcu

SEQ ID NO: 363852 - RNA, 17 nt, Human
ccagguggaaucgugga

SEQ ID NO: 363853 - RNA, 22 nt, Human
agaugaaagauuuuuauagaga

SEQ ID NO: 363854 - RNA, 22 nt, Human
aaaugucagaggaacauauuga

SEQ ID NO: 363855 - RNA, 22 nt, Human
ggagcugcauuuagggagccuu

SEQ ID NO: 363856 - RNA, 22 nt, Human
ggcacagggaggcccuggugug

SEQ ID NO: 363857 - RNA, 22 nt, Human
cccacucuggcucccuucuagu

SEQ ID NO: 363858 - RNA, 23 nt, Human
gccagccuugcucuccugcagcc

SEQ ID NO: 363859 - RNA, 22 nt, Human
gcagcuuuaaacauuggaaaua

SEQ ID NO: 363860 - RNA, 22 nt, Human
uuucugcucgcucucaaucagg

SEQ ID NO: 363861 - RNA, 22 nt, Human
uccuccagugucuggggccuug

SEQ ID NO: 363862 - RNA, 22 nt, Human
cagccugcagggcugccuguug

SEQ ID NO: 363863 - RNA, 22 nt, Human
uauaucuuauaugugcagguac

SEQ ID NO: 363864 - RNA, 22 nt, Human
ggucauugaaaucagaaggguu

SEQ ID NO: 363865 - RNA, 22 nt, Human
ggccuuggugcucuguguugca

SEQ ID NO: 363866 - RNA, 22 nt, Human
cuggcugcuuguagacucgacu

SEQ ID NO: 363867 - RNA, 22 nt, Human
cuggccucauagccaagcugug

SEQ ID NO: 363868 - RNA, 22 nt, Human
caaugugugcuuacaggccagu

SEQ ID NO: 363869 - RNA, 22 nt, Human
uuccaggaggagguacuagagg

SEQ ID NO: 363870 - RNA, 22 nt, Human
cugaauaauauuccauuaugag

SEQ ID NO: 363871 - RNA, 22 nt, Human
agcagggcacuggaaggcacug

SEQ ID NO: 363872 - RNA, 17 nt, Human
agcagcuggcacaggag

SEQ ID NO: 363873 - RNA, 22 nt, Human
ucugucugagggagugacauuu

SEQ ID NO: 363874 - RNA, 22 nt, Human
gcugccuucaguucugauucau

SEQ ID NO: 363875 - RNA, 22 nt, Human
agccagacauggcuccugcucc

SEQ ID NO: 363876 - RNA, 18 nt, Human
ugaccugcgcuucacggu

SEQ ID NO: 363877 - RNA, 22 nt, Human
caccagcuacagacuacugugu

SEQ ID NO: 363878 - RNA, 22 nt, Human
ucuuugaauuucugacugucuu

SEQ ID NO: 363879 - RNA, 22 nt, Human
cagccagugugaccgaggagga

SEQ ID NO: 363880 - RNA, 22 nt, Human
uggcagaguuauggguauuuau

SEQ ID NO: 363881 - RNA, 22 nt, Human
gaaaggagggaaacagagcggu

SEQ ID NO: 363882 - RNA, 22 nt, Human
ugacagaacagguugggagcaa

SEQ ID NO: 363883 - RNA, 20 nt, Human
cuucuucagccuaugcuuca

SEQ ID NO: 363884 - RNA, 22 nt, Human
gggcacuggaggccaaggagcu

SEQ ID NO: 363885 - RNA, 22 nt, Human
ucuucagauggccaguuguccc

SEQ ID NO: 363886 - RNA, 22 nt, Human
guuugaaaaaagcaguauguaa

SEQ ID NO: 363887 - RNA, 22 nt, Human
augagcugggccauccagugau

SEQ ID NO: 363888 - RNA, 22 nt, Human
uaguuaggaaaguccagggagc

SEQ ID NO: 363889 - RNA, 22 nt, Human
ucagagcuuuggagaccaggaa

SEQ ID NO: 363890 - RNA, 22 nt, Human
agagggcuuugauucucaguuc

SEQ ID NO: 363891 - RNA, 22 nt, Human
ucucccaggugggugccuggag

SEQ ID NO: 363892 - RNA, 22 nt, Human
aauuugauucccugcaccuguu

SEQ ID NO: 363893 - RNA, 22 nt, Human
uuaugcuaaaugaaucaaguca

SEQ ID NO: 363894 - RNA, 22 nt, Human
ucaguuuuguauguuguaaguc

SEQ ID NO: 363895 - RNA, 23 nt, Human
cagcugaagcagccugggcugga

SEQ ID NO: 363896 - RNA, 22 nt, Human
gagggcaggggucuugcacggu

SEQ ID NO: 363897 - RNA, 22 nt, Human
ugugccuggaucucugugacaa

SEQ ID NO: 363898 - RNA, 22 nt, Human
aggaaagcucccaguagggcuc

SEQ ID NO: 363899 - RNA, 22 nt, Human
uuuuucauauuccccucucugg

SEQ ID NO: 363900 - RNA, 20 nt, Human
aggcaccugucacaggugag

SEQ ID NO: 363901 - RNA, 22 nt, Human
ccaggcauccauugcuuccucu

SEQ ID NO: 363902 - RNA, 22 nt, Human
ugaggcucagaagugccaagug

SEQ ID NO: 363903 - RNA, 22 nt, Human
gugcauuuaggucacaugaugu

SEQ ID NO: 363904 - RNA, 22 nt, Human
agggcccuuacgcaggcccuuc

SEQ ID NO: 363905 - RNA, 22 nt, Human
ggauccuucuuugaccucacag

SEQ ID NO: 363906 - RNA, 22 nt, Human
gucaaguuuauccgcucauuca

SEQ ID NO: 363907 - RNA, 22 nt, Human
cagaggaugaucuggccucucu

SEQ ID NO: 363908 - RNA, 22 nt, Human
aggacaguguggaagagggugc

SEQ ID NO: 363909 - RNA, 22 nt, Human
auucuucaucagagaugcacua

SEQ ID NO: 363910 - RNA, 22 nt, Human
aaggaaaggaugagcaugcauu

SEQ ID NO: 363911 - RNA, 21 nt, Human
ugcagcugacacugguaugcc

SEQ ID NO: 363912 - RNA, 22 nt, Human
gcuggcugggucccugagaggc

SEQ ID NO: 363913 - RNA, 22 nt, Human
caccagguggaaaugucacagc

SEQ ID NO: 363914 - RNA, 22 nt, Human
uauacagauuaacagauuuaaa

SEQ ID NO: 363915 - RNA, 22 nt, Human
gugccagggggcacugaacaga

SEQ ID NO: 363916 - RNA, 22 nt, Human
caggcagcccugcaccaagugu

SEQ ID NO: 363917 - RNA, 22 nt, Human
ggucucagaucuuuauuaaggc

SEQ ID NO: 363918 - RNA, 22 nt, Human
ccucugccugcacaucauccug

SEQ ID NO: 363919 - RNA, 22 nt, Human
caagagcugcaaauagcgugac

SEQ ID NO: 363920 - RNA, 22 nt, Human
aggcagcuucugauuagcagcg

SEQ ID NO: 363921 - RNA, 22 nt, Human
uacagaaguaaauaccaaaagc

SEQ ID NO: 363922 - RNA, 22 nt, Human
ucagggcaucaucaugaauaua

SEQ ID NO: 363923 - RNA, 22 nt, Human
gcugaggccucagaaggcugag

SEQ ID NO: 363924 - RNA, 22 nt, Human
ccagcaggguugguuucuucug

SEQ ID NO: 363925 - RNA, 19 nt, Human
auuccucaaggacagaaau

SEQ ID NO: 363926 - RNA, 22 nt, Human
cugucagguuggucucagagcu

SEQ ID NO: 363927 - RNA, 22 nt, Human
cagugcagguggcagaggacag

SEQ ID NO: 363928 - RNA, 21 nt, Human
uucuucuuggacuguuuuggc

SEQ ID NO: 363929 - RNA, 22 nt, Human
ucugcaggcuuauaggaugggu

SEQ ID NO: 363930 - RNA, 22 nt, Human
ucccaggauguuuauggcuggu

SEQ ID NO: 363931 - RNA, 22 nt, Human
acuuggagagcauugcugggga

SEQ ID NO: 363932 - RNA, 22 nt, Human
cuuagaaauuguuacucauuca

SEQ ID NO: 363933 - RNA, 22 nt, Human
aauuucaaacuaauaggaacca

SEQ ID NO: 363934 - RNA, 22 nt, Human
gaggcagcugggauacaaggga

SEQ ID NO: 363935 - RNA, 18 nt, Human
uguuuauuuuucucuuac

SEQ ID NO: 363936 - RNA, 22 nt, Human
ugccugugucacagugauguuu

SEQ ID NO: 363937 - RNA, 18 nt, Human
gccaggcaggguggggaa

SEQ ID NO: 363938 - RNA, 22 nt, Human
ggcagucagugugguucauaaa

SEQ ID NO: 363939 - RNA, 22 nt, Human
cggagaggugggggcagcaucu

SEQ ID NO: 363940 - RNA, 22 nt, Human
uugcucaggcuuagagcuacua

SEQ ID NO: 363941 - RNA, 22 nt, Human
ggcugcuguacugaugucaguu

SEQ ID NO: 363942 - RNA, 22 nt, Human
auucagagcacuggguagaauu

SEQ ID NO: 363943 - RNA, 22 nt, Human
ccucccucuuucagucccacag

SEQ ID NO: 363944 - RNA, 22 nt, Human
aggagucagauaugggaaaguu

SEQ ID NO: 363945 - RNA, 22 nt, Human
gguugccggggcaggacuggaa

SEQ ID NO: 363946 - RNA, 22 nt, Human
uaagauaaguggguugagaugg

SEQ ID NO: 363947 - RNA, 22 nt, Human
caggacaguauaggcuuuagga

SEQ ID NO: 363948 - RNA, 22 nt, Human
auaugccauuagcuagaaauaa

SEQ ID NO: 363949 - RNA, 22 nt, Human
aggcaggagcaagcccuacaag

SEQ ID NO: 363950 - RNA, 22 nt, Human
ggcagcuaguuuaagaaagagg

SEQ ID NO: 363951 - RNA, 22 nt, Human
uuggaaggcccugccuagcagg

SEQ ID NO: 363952 - RNA, 22 nt, Human
uaucuauuccaaauaucagcgu

SEQ ID NO: 363953 - RNA, 22 nt, Human
uuggaucaaauuucaugcuguc

SEQ ID NO: 363954 - RNA, 22 nt, Human
augacaguucuacacuuaaucu

SEQ ID NO: 363955 - RNA, 22 nt, Human
caguggaaacuaugcugcugga

SEQ ID NO: 363956 - RNA, 22 nt, Human
aacugcauucagaaagcucacu

SEQ ID NO: 363957 - RNA, 22 nt, Human
accagguggccccagcgugguu

SEQ ID NO: 363958 - RNA, 22 nt, Human
ucagcaggcgguuccuuguggg

SEQ ID NO: 363959 - RNA, 20 nt, Human
gugcuucagaagccauugcu

SEQ ID NO: 363960 - RNA, 20 nt, Human
gacauucauaguuauuacca

SEQ ID NO: 363961 - RNA, 22 nt, Human
cagcugaagaaagagugguuag

SEQ ID NO: 363962 - RNA, 22 nt, Human
aaucuagucuccuuaagucuuu

SEQ ID NO: 363963 - RNA, 22 nt, Human
auuucagauucagaaauguagg

SEQ ID NO: 363964 - RNA, 22 nt, Human
ugcuuucaaaggcuuucuagau

SEQ ID NO: 363965 - RNA, 20 nt, Human
gggcuggcgcauggggaaag

SEQ ID NO: 363966 - RNA, 22 nt, Human
ugugcccauuccacuugaguac

SEQ ID NO: 363967 - RNA, 22 nt, Human
agcagggcuuugucucugugaa

SEQ ID NO: 363968 - RNA, 22 nt, Human
aaauacuagaauucagaguuga

SEQ ID NO: 363969 - RNA, 22 nt, Human
agauacaucauuuauaccuuca

SEQ ID NO: 363970 - RNA, 22 nt, Human
guaaacaacacaaaucauuuga

SEQ ID NO: 363971 - RNA, 22 nt, Human
uuguuacagcagugauuucaga

SEQ ID NO: 363972 - RNA, 22 nt, Human
guggcuucugcggugugcgcag

SEQ ID NO: 363973 - RNA, 22 nt, Human
auccuuaguuaagaacaggagu

SEQ ID NO: 363974 - RNA, 22 nt, Human
uggcugcagacaccuauggcag

SEQ ID NO: 363975 - RNA, 22 nt, Human
uugagggucuggaucugcugcu

SEQ ID NO: 363976 - RNA, 22 nt, Human
uuugacauuauccuguuacugg

SEQ ID NO: 363977 - RNA, 22 nt, Human
ggcagcuucuuaauauggagac

SEQ ID NO: 363978 - RNA, 22 nt, Human
cuggaaggucuguccccacugc

SEQ ID NO: 363979 - RNA, 22 nt, Human
aaugucugaaaaucagacugca

SEQ ID NO: 363980 - RNA, 22 nt, Human
agguacagggugaaaguuuaug

SEQ ID NO: 363981 - RNA, 22 nt, Human
uauaauccauucauugauuucu

SEQ ID NO: 363982 - RNA, 22 nt, Human
agggccacaguggggccugaga

SEQ ID NO: 363983 - RNA, 22 nt, Human
uggaguuccuuugaaaggcucu

SEQ ID NO: 363984 - RNA, 22 nt, Human
ccaaggcuccucagcuggucuu

SEQ ID NO: 363985 - RNA, 22 nt, Human
augaggcaggauuaagcuauca

SEQ ID NO: 363986 - RNA, 22 nt, Human
auuaaauuggacgcugggggaa

SEQ ID NO: 363987 - RNA, 22 nt, Human
cagagccaaaccucagggcccg

SEQ ID NO: 363988 - RNA, 22 nt, Human
aauaaaaugaacugguagaguu

SEQ ID NO: 363989 - RNA, 22 nt, Human
cccugccucugaagcugcucag

SEQ ID NO: 363990 - RNA, 22 nt, Human
aauaauguugacgauagucuua

SEQ ID NO: 363991 - RNA, 22 nt, Human
cauuguauugaggauacuuaag

SEQ ID NO: 363992 - RNA, 18 nt, Human
ucugucuguacaaguauc

SEQ ID NO: 363993 - RNA, 22 nt, Human
cagugccucuuaagugucaccc

SEQ ID NO: 363994 - RNA, 22 nt, Human
uuuggacuuagccugcagaauu

SEQ ID NO: 363995 - RNA, 17 nt, Human
uguuuucauucauugcu

SEQ ID NO: 363996 - RNA, 22 nt, Human
uuuacagaaugucaauuucuau

SEQ ID NO: 363997 - RNA, 22 nt, Human
uccuggagaauccugccaccug

SEQ ID NO: 363998 - RNA, 22 nt, Human
cagagcauugagggucugccaa

SEQ ID NO: 363999 - RNA, 19 nt, Human
cagaacagaggucauggcc

SEQ ID NO: 364000 - RNA, 22 nt, Human
guggcaggucccauuggagcag

SEQ ID NO: 364001 - RNA, 22 nt, Human
ccguggaguugugcugaguaug

SEQ ID NO: 364002 - RNA, 22 nt, Human
acaaagguggaccauguggcuu

SEQ ID NO: 364003 - RNA, 20 nt, Human
aggagaaauucgggacaccu

SEQ ID NO: 364004 - RNA, 22 nt, Human
uguguacucaauugagccauuu

SEQ ID NO: 364005 - RNA, 22 nt, Human
ucucagaggcccgacguucucc

SEQ ID NO: 364006 - RNA, 22 nt, Human
augugacaauauuuggucuuau

SEQ ID NO: 364007 - RNA, 22 nt, Human
caggcuugauuauucagacaau

SEQ ID NO: 364008 - RNA, 22 nt, Human
ccucugaguccucccugguugc

SEQ ID NO: 364009 - RNA, 22 nt, Human
uagaaaggauauugagaugaau

SEQ ID NO: 364010 - RNA, 22 nt, Human
aggucauuuuugccuucuauuu

SEQ ID NO: 364011 - RNA, 23 nt, Human
uccuccuuuugcuugugcuuccc

SEQ ID NO: 364012 - RNA, 22 nt, Human
aaugccucuuggaagaagacuu

SEQ ID NO: 364013 - RNA, 22 nt, Human
gaaaauagcagauagaccaaug

SEQ ID NO: 364014 - RNA, 18 nt, Human
ugcucuguuuaaugauuu

SEQ ID NO: 364015 - RNA, 22 nt, Human
ggcaugggccgaggugccuccu

SEQ ID NO: 364016 - RNA, 21 nt, Human
aggaggaacccguggcugggc

SEQ ID NO: 364017 - RNA, 22 nt, Human
agagacaggaguucuguuucca

SEQ ID NO: 364018 - RNA, 22 nt, Human
gcccaggaguugguggcugcag

SEQ ID NO: 364019 - RNA, 22 nt, Human
gacuguguccaugugcuggauu

SEQ ID NO: 364020 - RNA, 22 nt, Human
auugacaauuagcccuuaggug

SEQ ID NO: 364021 - RNA, 18 nt, Human
acaaaggucugcaagacc

SEQ ID NO: 364022 - RNA, 22 nt, Human
ggagccaggcaaucuguacuuu

SEQ ID NO: 364023 - RNA, 22 nt, Human
ggaaccaguggaaugauaugcu

SEQ ID NO: 364024 - RNA, 22 nt, Human
auaaaaguucaagagaguacag

SEQ ID NO: 364025 - RNA, 23 nt, Human
uugcuucugugcaauucaguacu

SEQ ID NO: 364026 - RNA, 22 nt, Human
aaguuugcauagauuaagcauu

SEQ ID NO: 364027 - RNA, 22 nt, Human
uaggugugggcucaggaaugug

SEQ ID NO: 364028 - RNA, 22 nt, Human
gugaagagcuguugcagagauu

SEQ ID NO: 364029 - RNA, 22 nt, Human
cuguauuucccacauucucuau

SEQ ID NO: 364030 - RNA, 23 nt, Human
uguugaaguaacuguuacauaga

SEQ ID NO: 364031 - RNA, 22 nt, Human
aggauuuaccgucauuuagucu

SEQ ID NO: 364032 - RNA, 22 nt, Human
ggcagggcagcgcugauuaggg

SEQ ID NO: 364033 - RNA, 23 nt, Human
gcugcagcuguggauguucucag

SEQ ID NO: 364034 - RNA, 22 nt, Human
cagcagcuacuuggagcagcag

SEQ ID NO: 364035 - RNA, 21 nt, Human
cagaggcugagagggcaaucu

SEQ ID NO: 364036 - RNA, 22 nt, Human
caggaggggguggaguuucgcc

SEQ ID NO: 364037 - RNA, 22 nt, Human
uaugcacauucacacaaaaaug

SEQ ID NO: 364038 - RNA, 22 nt, Human
ucugccugcggcugcagguggc

SEQ ID NO: 364039 - RNA, 20 nt, Human
gagggcucguggauggauaa

SEQ ID NO: 364040 - RNA, 22 nt, Human
auguucuuccaaaucuguaaca

SEQ ID NO: 364041 - RNA, 22 nt, Human
ucugaggcuucagacuguacug

SEQ ID NO: 364042 - RNA, 18 nt, Human
uggagccagcucuaggau

SEQ ID NO: 364043 - RNA, 22 nt, Human
uauacagauggaaagauacaca

SEQ ID NO: 364044 - RNA, 21 nt, Human
gucagcagauccagcacuugu

SEQ ID NO: 364045 - RNA, 22 nt, Human
uacaugaaccuuuaugugugau

SEQ ID NO: 364046 - RNA, 22 nt, Human
uccaugaggcagggaggcuggc

SEQ ID NO: 364047 - RNA, 22 nt, Human
gcucuuccauuucucuugaacu

SEQ ID NO: 364048 - RNA, 22 nt, Human
uagcuuuaagaugagaugugga

SEQ ID NO: 364049 - RNA, 22 nt, Human
acucugcuuauugcugcaggca

SEQ ID NO: 364050 - RNA, 22 nt, Human
ugggaccugaagcagguuggca

SEQ ID NO: 364051 - RNA, 22 nt, Human
aagccagauagaagaacucauu

SEQ ID NO: 364052 - RNA, 22 nt, Human
agcucccagcagagcuggccac

SEQ ID NO: 364053 - RNA, 22 nt, Human
auuucuacaguacacaugcauu

SEQ ID NO: 364054 - RNA, 22 nt, Human
guuccaaauuuggaucuuuagg

SEQ ID NO: 364055 - RNA, 22 nt, Human
gcagcguggggcugagucagcu

SEQ ID NO: 364056 - RNA, 22 nt, Human
uccucugcuggaagggcaagag

SEQ ID NO: 364057 - RNA, 16 nt, Human
agcagggcgggaagga

SEQ ID NO: 364058 - RNA, 22 nt, Human
gaugcacagugacccugccagu

SEQ ID NO: 364059 - RNA, 22 nt, Human
gcagcugccgugagcucacgcc

SEQ ID NO: 364060 - RNA, 22 nt, Human
agaccaagacuauaaugagagg

SEQ ID NO: 364061 - RNA, 22 nt, Human
ugcaguggaaagacucagacuu

SEQ ID NO: 364062 - RNA, 22 nt, Human
gcuguauuuauuuucuaggguu

SEQ ID NO: 364063 - RNA, 22 nt, Human
acacaugcugauaagaauauaa

SEQ ID NO: 364064 - RNA, 22 nt, Human
cccaguccuaaagcagacgcca

SEQ ID NO: 364065 - RNA, 22 nt, Human
caguucagcuagaagaaacaaa

SEQ ID NO: 364066 - RNA, 23 nt, Human
ugccagaggcagucacaguggug

SEQ ID NO: 364067 - RNA, 22 nt, Human
cacagggcagugcugcccacuc

SEQ ID NO: 364068 - RNA, 22 nt, Human
gagcugaguuaccuccagauca

SEQ ID NO: 364069 - RNA, 22 nt, Human
cccagcagaccgcugugauggc

SEQ ID NO: 364070 - RNA, 21 nt, Human
agccagcuaucacacagcauu

SEQ ID NO: 364071 - RNA, 22 nt, Human
gaucagaauuuacuuauaauug

SEQ ID NO: 364072 - RNA, 22 nt, Human
uaugccugauaacugugucucu

SEQ ID NO: 364073 - RNA, 20 nt, Human
ucacaucuggcagcugauga

SEQ ID NO: 364074 - RNA, 22 nt, Human
uccagcagguuggucaggugca

SEQ ID NO: 364075 - RNA, 22 nt, Human
ggcccagcacagugcuuggggg

SEQ ID NO: 364076 - RNA, 22 nt, Human
ugaagcaacuggacaaguuggc

SEQ ID NO: 364077 - RNA, 22 nt, Human
auuauucuuaugucaucauggc

SEQ ID NO: 364078 - RNA, 22 nt, Human
gugcgccagcucaaggggaggc

SEQ ID NO: 364079 - RNA, 22 nt, Human
cagaagccugccucagaugcac

SEQ ID NO: 364080 - RNA, 22 nt, Human
ccaggaagcugucugauaugaa

SEQ ID NO: 364081 - RNA, 22 nt, Human
gguggagcuggaccaggagagg

SEQ ID NO: 364082 - RNA, 22 nt, Human
caagagcugugaccucauucac

SEQ ID NO: 364083 - RNA, 22 nt, Human
ccugccaggccagugagcuucc

SEQ ID NO: 364084 - RNA, 21 nt, Human
ugaaacaaucagacagagucu

SEQ ID NO: 364085 - RNA, 22 nt, Human
cccaggaccgcgcggcugagcg

SEQ ID NO: 364086 - RNA, 22 nt, Human
caguguacuuggaauguaacag

SEQ ID NO: 364087 - RNA, 22 nt, Human
caggcagcugacugucagauau

SEQ ID NO: 364088 - RNA, 22 nt, Human
acagccaggagccaugggcagg

SEQ ID NO: 364089 - RNA, 22 nt, Human
aagacacagcgaaauguuccug

SEQ ID NO: 364090 - RNA, 22 nt, Human
gcauuauuaauagcugcaugag

SEQ ID NO: 364091 - RNA, 22 nt, Human
uuaacaauagaguuucuucagg

SEQ ID NO: 364092 - RNA, 19 nt, Human
aggccugggguuuugcacu

SEQ ID NO: 364093 - RNA, 22 nt, Human
aaauucaguuuuaauaaucacu

SEQ ID NO: 364094 - RNA, 22 nt, Human
uagaggcacccuggaggagacu

SEQ ID NO: 364095 - RNA, 22 nt, Human
gcuggugcauuagcugcaguuc

SEQ ID NO: 364096 - RNA, 22 nt, Human
gcgcaggagccgcggagggccg

SEQ ID NO: 364097 - RNA, 22 nt, Human
cauucuuauauuuacucauuca

SEQ ID NO: 364098 - RNA, 22 nt, Human
gaggcgagaagcuggagauggu

SEQ ID NO: 364099 - RNA, 22 nt, Human
gagugcagaugccagccccagu

SEQ ID NO: 364100 - RNA, 19 nt, Human
acccucucagugccugagg

SEQ ID NO: 364101 - RNA, 22 nt, Human
ucauggagacuuugagccuguu

SEQ ID NO: 364102 - RNA, 22 nt, Human
uucauucuuugaaucugaggua

SEQ ID NO: 364103 - RNA, 22 nt, Human
ucagaaauagucuuuaaaauga

SEQ ID NO: 364104 - RNA, 22 nt, Human
uccaggagguuuggaggaagca

SEQ ID NO: 364105 - RNA, 22 nt, Human
gaagggagaagguugggugacg

SEQ ID NO: 364106 - RNA, 22 nt, Human
uccaggcaaaaaccaacuacag

SEQ ID NO: 364107 - RNA, 22 nt, Human
ugaugggaaaaugaggccuggg

SEQ ID NO: 364108 - RNA, 22 nt, Human
aggcuggggaauugaauuugcu

SEQ ID NO: 364109 - RNA, 22 nt, Human
agaagcugccuacaugaccagc

SEQ ID NO: 364110 - RNA, 22 nt, Human
uagugcuuuaggccugaguguc

SEQ ID NO: 364111 - RNA, 22 nt, Human
cccagcagccagaaugaggagc

SEQ ID NO: 364112 - RNA, 22 nt, Human
uggggcaguuaauaaacauucu

SEQ ID NO: 364113 - RNA, 22 nt, Human
guagaaaugguguguuucuucu

SEQ ID NO: 364114 - RNA, 22 nt, Human
aucuggcucuuccuggaguucc

SEQ ID NO: 364115 - RNA, 22 nt, Human
gagccuggagcuggaacgaagc

SEQ ID NO: 364116 - RNA, 22 nt, Human
ugggcagaaggaagagccaccu

SEQ ID NO: 364117 - RNA, 22 nt, Human
guggcugcuacagagcuggagg

SEQ ID NO: 364118 - RNA, 21 nt, Human
uagggcaggcauuggaagaga

SEQ ID NO: 364119 - RNA, 22 nt, Human
agaaauguuuauggcugccuau

SEQ ID NO: 364120 - RNA, 22 nt, Human
ucuuugcaucccuuccauaguu

SEQ ID NO: 364121 - RNA, 22 nt, Human
cacagaauuaagggagaaauau

SEQ ID NO: 364122 - RNA, 22 nt, Human
acagagguaggacaugagauau

SEQ ID NO: 364123 - RNA, 22 nt, Human
ccauaagguugaaaacuguaca

SEQ ID NO: 364124 - RNA, 22 nt, Human
auaaauuuauaauuguuuccug

SEQ ID NO: 364125 - RNA, 22 nt, Human
acaacacagcaaaaccccaucu

SEQ ID NO: 364126 - RNA, 22 nt, Human
acaggugaccugcucauaugaa

SEQ ID NO: 364127 - RNA, 22 nt, Human
agcaaaguagcugcuguucuua

SEQ ID NO: 364128 - RNA, 22 nt, Human
cccaccccuggacaggugagug

SEQ ID NO: 364129 - RNA, 22 nt, Human
cccaggcacagauuaucccaau

SEQ ID NO: 364130 - RNA, 22 nt, Human
gaucauuuacuuguucuggacu

SEQ ID NO: 364131 - RNA, 21 nt, Human
uggcagggguaguaguacagc

SEQ ID NO: 364132 - RNA, 22 nt, Human
guacagaaggagcuuuggauuc

SEQ ID NO: 364133 - RNA, 22 nt, Human
ccaggagacuguacugauauuu

SEQ ID NO: 364134 - RNA, 22 nt, Human
cuggcccagucucagaguguca

SEQ ID NO: 364135 - RNA, 22 nt, Human
caaaugcagucccuuuguugcu

SEQ ID NO: 364136 - RNA, 22 nt, Human
ucaauucaacacaugcacauug

SEQ ID NO: 364137 - RNA, 22 nt, Human
cacaguggcagguguggguugu

SEQ ID NO: 364138 - RNA, 22 nt, Human
cuggcuggccggagcgaggcgg

SEQ ID NO: 364139 - RNA, 22 nt, Human
cauggccuugagugacugcacu

SEQ ID NO: 364140 - RNA, 22 nt, Human
ccugggcagugcuggaguugaa

SEQ ID NO: 364141 - RNA, 22 nt, Human
uagaaacagcauauauuagccc

SEQ ID NO: 364142 - RNA, 22 nt, Human
ucaucaaagucaaagaaugacu

SEQ ID NO: 364143 - RNA, 22 nt, Human
ccagggagccuggugugucagc

SEQ ID NO: 364144 - RNA, 22 nt, Human
uauguacauaacaugaaaugca

SEQ ID NO: 364145 - RNA, 22 nt, Human
guuauuaguaagacucgcacau

SEQ ID NO: 364146 - RNA, 22 nt, Human
gcugccugaucauacaccaggg

SEQ ID NO: 364147 - RNA, 22 nt, Human
cuaacuuuagcuuagauuauca

SEQ ID NO: 364148 - RNA, 22 nt, Human
accaucagagcacaguccgugc

SEQ ID NO: 364149 - RNA, 22 nt, Human
acagaauucucucugcagaggc

SEQ ID NO: 364150 - RNA, 22 nt, Human
uucuugcucaaugucuguuuaa

SEQ ID NO: 364151 - RNA, 22 nt, Human
ccacaggggcccacgagccgcu

SEQ ID NO: 364152 - RNA, 22 nt, Human
gcagugguggagcuuacauauc

SEQ ID NO: 364153 - RNA, 22 nt, Human
ggcuucugccacgagagggaag

SEQ ID NO: 364154 - RNA, 22 nt, Human
agcccagccggauucccaguuc

SEQ ID NO: 364155 - RNA, 22 nt, Human
ugaaaauggccugaagaagcaa

SEQ ID NO: 364156 - RNA, 22 nt, Human
auucacaauuagaaguagauaa

SEQ ID NO: 364157 - RNA, 22 nt, Human
aagcagcuggaagaguaagaug

SEQ ID NO: 364158 - RNA, 22 nt, Human
cuuggcagagggcugggcucag

SEQ ID NO: 364159 - RNA, 22 nt, Human
cagacaggcuagccagacucac

SEQ ID NO: 364160 - RNA, 22 nt, Human
aggcagccaguucagguuucuu

SEQ ID NO: 364161 - RNA, 21 nt, Human
ucucugugucuuuaagcugga

SEQ ID NO: 364162 - RNA, 22 nt, Human
caaagguaguauauauauuguu

SEQ ID NO: 364163 - RNA, 22 nt, Human
cugcaguguucuggaaugcauu

SEQ ID NO: 364164 - RNA, 19 nt, Human
gcuggggccugaccagaca

SEQ ID NO: 364165 - RNA, 19 nt, Human
cacagggcaggucucaugu

SEQ ID NO: 364166 - RNA, 23 nt, Human
aggcgagcucuucuccagcacgu

SEQ ID NO: 364167 - RNA, 22 nt, Human
uuggaaggugagucccuggguu

SEQ ID NO: 364168 - RNA, 22 nt, Human
ggagcugggguuggcaucuucc

SEQ ID NO: 364169 - RNA, 22 nt, Human
auuguacaugcagugagucauc

SEQ ID NO: 364170 - RNA, 22 nt, Human
ggcccaucucuugcucuggguu

SEQ ID NO: 364171 - RNA, 22 nt, Human
uggcugaggcacagcugccgcc

SEQ ID NO: 364172 - RNA, 22 nt, Human
gcugcccaguucugcugcugcc

SEQ ID NO: 364173 - RNA, 22 nt, Human
ggaggccaaggcagguggaucg

SEQ ID NO: 364174 - RNA, 22 nt, Human
uauuuucuguggaggaccagau

SEQ ID NO: 364175 - RNA, 22 nt, Human
auaugcauaugucaaaacuuau

SEQ ID NO: 364176 - RNA, 19 nt, Human
uuagggacaugaauucuag

SEQ ID NO: 364177 - RNA, 22 nt, Human
ugggcagccaucccagccucuc

SEQ ID NO: 364178 - RNA, 22 nt, Human
cccucuacagggaagcgcuuuc

SEQ ID NO: 364179 - RNA, 22 nt, Human
uucuucucggcugucagauagu

SEQ ID NO: 364180 - RNA, 22 nt, Human
uacaguucacaguaucauaaau

SEQ ID NO: 364181 - RNA, 22 nt, Human
cacaucuucuuaacuccaaagu

SEQ ID NO: 364182 - RNA, 22 nt, Human
cagggcugaacugagcuuguga

SEQ ID NO: 364183 - RNA, 22 nt, Human
uuugacaugcaaagcacuuuag

SEQ ID NO: 364184 - RNA, 22 nt, Human
ugcaggagaaaguacggagcgu

SEQ ID NO: 364185 - RNA, 22 nt, Human
cuuggccucuucucaggguggg

SEQ ID NO: 364186 - RNA, 22 nt, Human
uuuccauguuggugaaaugagg

SEQ ID NO: 364187 - RNA, 22 nt, Human
ccagguggugaaagugggcccu

SEQ ID NO: 364188 - RNA, 22 nt, Human
ugaagcaggaaccagcagcauu

SEQ ID NO: 364189 - RNA, 22 nt, Human
ucagagcuuaucucuugcugga

SEQ ID NO: 364190 - RNA, 22 nt, Human
auucuccagcucacuguccaua

SEQ ID NO: 364191 - RNA, 23 nt, Human
ccagcccuccaccagcucuaggc

SEQ ID NO: 364192 - RNA, 22 nt, Human
cugccuggccugaucuccacgc

SEQ ID NO: 364193 - RNA, 22 nt, Human
ugguggccaauucacagggcuc

SEQ ID NO: 364194 - RNA, 22 nt, Human
gcagcuggugcaaaugucacuc

SEQ ID NO: 364195 - RNA, 22 nt, Human
auuucuguuugcuacuauaagu

SEQ ID NO: 364196 - RNA, 22 nt, Human
ugaggcagucacccccuccugc

SEQ ID NO: 364197 - RNA, 22 nt, Human
uucaagguaugguagcugguca

SEQ ID NO: 364198 - RNA, 20 nt, Human
uccugagauuuaagggguuc

SEQ ID NO: 364199 - RNA, 22 nt, Human
ugucagagcaaugagguucagc

SEQ ID NO: 364200 - RNA, 22 nt, Human
gcccaggauucuuucuuccuua

SEQ ID NO: 364201 - RNA, 22 nt, Human
ggaaagccaggugcucuggugu

SEQ ID NO: 364202 - RNA, 21 nt, Human
auccauccaucuuggccuaac

SEQ ID NO: 364203 - RNA, 21 nt, Human
uuuaauuugcauguaugacgc

SEQ ID NO: 364204 - RNA, 19 nt, Human
ugggccugcaucugggucu

SEQ ID NO: 364205 - RNA, 22 nt, Human
gagcagcuccagccgcaugacu

SEQ ID NO: 364206 - RNA, 19 nt, Human
uggcagaggcaguuuguac

SEQ ID NO: 364207 - RNA, 22 nt, Human
uggcucagcugacucggcuucu

SEQ ID NO: 364208 - RNA, 22 nt, Human
gacccaggguuucugcacaggg

SEQ ID NO: 364209 - RNA, 22 nt, Human
ucccagggcagcuguccagaag

SEQ ID NO: 364210 - RNA, 22 nt, Human
ucagggcaccaaaaaagaugcc

SEQ ID NO: 364211 - RNA, 22 nt, Human
agucaggauaugccuugugggc

SEQ ID NO: 364212 - RNA, 22 nt, Human
agaauaaacugcuuuagggcag

SEQ ID NO: 364213 - RNA, 22 nt, Human
uggccaccccuuucucugcacu

SEQ ID NO: 364214 - RNA, 18 nt, Human
uggcagggaggaaauaua

SEQ ID NO: 364215 - RNA, 22 nt, Human
ugagacaaaauugacagacaaa

SEQ ID NO: 364216 - RNA, 22 nt, Human
gggagcugagggaccucugugg

SEQ ID NO: 364217 - RNA, 18 nt, Human
uuccauaauguauguaac

SEQ ID NO: 364218 - RNA, 22 nt, Human
agcugaggcauggacaggcugc

SEQ ID NO: 364219 - RNA, 22 nt, Human
ggcugccugcucaggugcggcg

SEQ ID NO: 364220 - RNA, 22 nt, Human
gcacagggcaacaggucuguua

SEQ ID NO: 364221 - RNA, 22 nt, Human
ccuuuaauuuacaauguuaauu

SEQ ID NO: 364222 - RNA, 22 nt, Human
ggaggagacaguaaaaagcacg

SEQ ID NO: 364223 - RNA, 22 nt, Human
uugaaauacugcauuguucagu

SEQ ID NO: 364224 - RNA, 22 nt, Human
ggcuuggaccagucacaguggu

SEQ ID NO: 364225 - RNA, 18 nt, Human
gggcaucauucacaaagu

SEQ ID NO: 364226 - RNA, 22 nt, Human
agccucugcacgggcacgggug

SEQ ID NO: 364227 - RNA, 22 nt, Human
acagaauuuaaagcucuagacu

SEQ ID NO: 364228 - RNA, 22 nt, Human
aaugguuuucuagaacaugaaa

SEQ ID NO: 364229 - RNA, 22 nt, Human
gcagagaacccagcagauuggc

SEQ ID NO: 364230 - RNA, 22 nt, Human
ucucucuugucaccccaucugc

SEQ ID NO: 364231 - RNA, 22 nt, Human
cugccugugugugccugcagaa

SEQ ID NO: 364232 - RNA, 22 nt, Human
gccugaagaacagcugugagga

SEQ ID NO: 364233 - RNA, 20 nt, Human
aggaggcauagucuggaaag

SEQ ID NO: 364234 - RNA, 22 nt, Human
agcuggcagagcauuuguggcc

SEQ ID NO: 364235 - RNA, 22 nt, Human
auggcuuuuuagacuuugguac

SEQ ID NO: 364236 - RNA, 22 nt, Human
uaaggccaaggggccauagucu

SEQ ID NO: 364237 - RNA, 22 nt, Human
uucauagugauuguucagauag

SEQ ID NO: 364238 - RNA, 22 nt, Human
cauugcacuucugcuuuuccuc

SEQ ID NO: 364239 - RNA, 22 nt, Human
caggaaagguagucacaaugua

SEQ ID NO: 364240 - RNA, 19 nt, Human
ucugucacuggggguauuc

SEQ ID NO: 364241 - RNA, 22 nt, Human
ccaggagaugauguuggggauu

SEQ ID NO: 364242 - RNA, 22 nt, Human
agcugggccugagcuggaagcu

SEQ ID NO: 364243 - RNA, 22 nt, Human
ggccucugaggacagccuuggc

SEQ ID NO: 364244 - RNA, 22 nt, Human
agaggccaugcuagaggccugg

SEQ ID NO: 364245 - RNA, 22 nt, Human
acagcuggaggucugugagcac

SEQ ID NO: 364246 - RNA, 22 nt, Human
cuggcugccacuucagggucuu

SEQ ID NO: 364247 - RNA, 22 nt, Human
ggagcagagcucuucaucugca

SEQ ID NO: 364248 - RNA, 23 nt, Human
cauguacagaguuugauaaagug

SEQ ID NO: 364249 - RNA, 22 nt, Human
uggcagcagccauggaaggccc

SEQ ID NO: 364250 - RNA, 22 nt, Human
uacacauguuuggcaaguaugu

SEQ ID NO: 364251 - RNA, 22 nt, Human
gggcagcuguaucugagcuuau

SEQ ID NO: 364252 - RNA, 17 nt, Human
ucuguucaagugagagg

SEQ ID NO: 364253 - RNA, 22 nt, Human
aaaauaucagcaaagggugaca

SEQ ID NO: 364254 - RNA, 22 nt, Human
cccuccagagcuugaccugcug

SEQ ID NO: 364255 - RNA, 22 nt, Human
acugaaggaagcgggcaggggu

SEQ ID NO: 364256 - RNA, 22 nt, Human
auguuucaugacugagcaaaau

SEQ ID NO: 364257 - RNA, 22 nt, Human
agcugguggauuaugcuguaca

SEQ ID NO: 364258 - RNA, 22 nt, Human
ggcuggaaguccaagaucaaga

SEQ ID NO: 364259 - RNA, 22 nt, Human
uggcuggcaaggcuggagucag

SEQ ID NO: 364260 - RNA, 22 nt, Human
aagagaggacauggugaaccug

SEQ ID NO: 364261 - RNA, 22 nt, Human
aagggcaggcacccacccucac

SEQ ID NO: 364262 - RNA, 22 nt, Human
ugcauuguuugauaggugaauu

SEQ ID NO: 364263 - RNA, 22 nt, Human
ucauuuaauugguuuugcucgu

SEQ ID NO: 364264 - RNA, 22 nt, Human
auggcaagcaagcugaagagau

SEQ ID NO: 364265 - RNA, 22 nt, Human
aaagccagaguguguuagagac

SEQ ID NO: 364266 - RNA, 22 nt, Human
acagcugugaagcaagcacucu

SEQ ID NO: 364267 - RNA, 22 nt, Human
gccagccccuuagggcucuccc

SEQ ID NO: 364268 - RNA, 22 nt, Human
cauuuguaucugggcugcugug

SEQ ID NO: 364269 - RNA, 22 nt, Human
aggggccuggacauggacgcgc

SEQ ID NO: 364270 - RNA, 22 nt, Human
acaacauuauacauagaaagcu

SEQ ID NO: 364271 - RNA, 22 nt, Human
uuucaguucaguuuauuauauc

SEQ ID NO: 364272 - RNA, 19 nt, Human
gaucuuugccaauuuaagc

SEQ ID NO: 364273 - RNA, 22 nt, Human
cauuucuguacauguuuuggug

SEQ ID NO: 364274 - RNA, 22 nt, Human
gcugucugggaggccuccacuu

SEQ ID NO: 364275 - RNA, 22 nt, Human
uuugcagucaaauuugcuaaau

SEQ ID NO: 364276 - RNA, 22 nt, Human
gaaaugcagaaccugagaccau

SEQ ID NO: 364277 - RNA, 22 nt, Human
guguggcugccagccaagaggc

SEQ ID NO: 364278 - RNA, 22 nt, Human
uaaaugugaccuucauuuuaua

SEQ ID NO: 364279 - RNA, 22 nt, Human
gccugagauucccggagccgug

SEQ ID NO: 364280 - RNA, 22 nt, Human
acaggggauugauuggaagucu

SEQ ID NO: 364281 - RNA, 22 nt, Human
ccagcuccucuucccaguguca

SEQ ID NO: 364282 - RNA, 22 nt, Human
gaaagccaucuggcugcuggga

SEQ ID NO: 364283 - RNA, 22 nt, Human
gaaaccucuuagccucucuuug

SEQ ID NO: 364284 - RNA, 22 nt, Human
ccaggugugcucugcaguggau

SEQ ID NO: 364285 - RNA, 22 nt, Human
acagauuuaggacuguagcgau

SEQ ID NO: 364286 - RNA, 22 nt, Human
gcugaguugaaagcagaggaua

SEQ ID NO: 364287 - RNA, 22 nt, Human
agcuggcuccagaaggagucgu

SEQ ID NO: 364288 - RNA, 21 nt, Human
uuucugaaggcaacaucuauc

SEQ ID NO: 364289 - RNA, 22 nt, Human
ugcuuuauaacuuaguuuaugg

SEQ ID NO: 364290 - RNA, 22 nt, Human
gcccaggaggucaaguagcuau

SEQ ID NO: 364291 - RNA, 22 nt, Human
acaggcucucagccaguuggca

SEQ ID NO: 364292 - RNA, 22 nt, Human
uauucacaguugauuuacaguu

SEQ ID NO: 364293 - RNA, 22 nt, Human
caggcugucugaauggaggccc

SEQ ID NO: 364294 - RNA, 22 nt, Human
ggcagcauauauucagugggca

SEQ ID NO: 364295 - RNA, 22 nt, Human
aggcccagcccguccucgugcu

SEQ ID NO: 364296 - RNA, 23 nt, Human
gggagccaggaccucgcgcccca

SEQ ID NO: 364297 - RNA, 22 nt, Human
uguacaaucugaugauguaugg

SEQ ID NO: 364298 - RNA, 22 nt, Human
ugggccacacacagaagaauca

SEQ ID NO: 364299 - RNA, 22 nt, Human
auguguauacuugugcuuacuc

SEQ ID NO: 364300 - RNA, 22 nt, Human
uccuaguucucugccagucgcu

SEQ ID NO: 364301 - RNA, 22 nt, Human
cauuuccagcuccugcaucaug

SEQ ID NO: 364302 - RNA, 22 nt, Human
cuacccagagugaaucucuuaa

SEQ ID NO: 364303 - RNA, 22 nt, Human
ucuacagacagagcagguggga

SEQ ID NO: 364304 - RNA, 22 nt, Human
agaaaucacaggaggcagaagg

SEQ ID NO: 364305 - RNA, 22 nt, Human
aauuuuauuagaaggcaagggg

SEQ ID NO: 364306 - RNA, 22 nt, Human
uauguacauggagagcaauuga

SEQ ID NO: 364307 - RNA, 18 nt, Human
gggcccuggcguccgccc

SEQ ID NO: 364308 - RNA, 22 nt, Human
ugauggcuaucccuggaagggc

SEQ ID NO: 364309 - RNA, 22 nt, Human
uuucaucuaacacuacauaggg

SEQ ID NO: 364310 - RNA, 22 nt, Human
agauacaaaagauaagauuuag

SEQ ID NO: 364311 - RNA, 22 nt, Human
uggccugguuguugcugccguu

SEQ ID NO: 364312 - RNA, 22 nt, Human
cacauauuugaugaagcuuugu

SEQ ID NO: 364313 - RNA, 22 nt, Human
ggcagcaucucuggcagcagcu

SEQ ID NO: 364314 - RNA, 22 nt, Human
agcugcugagagucugccgggc

SEQ ID NO: 364315 - RNA, 22 nt, Human
agucccagaugacccagcuacu

SEQ ID NO: 364316 - RNA, 20 nt, Human
ggcagagggccugggagaag

SEQ ID NO: 364317 - RNA, 22 nt, Human
agggcuccuaugccccauggac

SEQ ID NO: 364318 - RNA, 22 nt, Human
agugcagagaccuggucaggca

SEQ ID NO: 364319 - RNA, 22 nt, Human
ggccucucuccagucagugcag

SEQ ID NO: 364320 - RNA, 22 nt, Human
cccagaggugcuucagaggugc

SEQ ID NO: 364321 - RNA, 22 nt, Human
augucacagcucccauuccucc

SEQ ID NO: 364322 - RNA, 22 nt, Human
ucaggagaguguucaguggagg

SEQ ID NO: 364323 - RNA, 22 nt, Human
uuugaaguguuauuucuaucac

SEQ ID NO: 364324 - RNA, 22 nt, Human
ucauccaguuguggagagggaa

SEQ ID NO: 364325 - RNA, 22 nt, Human
guccaugauucugugacacccu

SEQ ID NO: 364326 - RNA, 23 nt, Human
cacacccaucacuaagagcuccu

SEQ ID NO: 364327 - RNA, 17 nt, Human
acaagcaguggccaugg

SEQ ID NO: 364328 - RNA, 22 nt, Human
ugcaugcagcuggugauaagaa

SEQ ID NO: 364329 - RNA, 23 nt, Human
gcugucugucaucucugcgggag

SEQ ID NO: 364330 - RNA, 22 nt, Human
gauuuccauuuucaacuccugc

SEQ ID NO: 364331 - RNA, 22 nt, Human
cagcugcccaggccaccuggag

SEQ ID NO: 364332 - RNA, 22 nt, Human
cuguuuucaaagagagagaaug

SEQ ID NO: 364333 - RNA, 22 nt, Human
agaagcuugaaggagcagugac

SEQ ID NO: 364334 - RNA, 22 nt, Human
ugggcagagucguggggaauag

SEQ ID NO: 364335 - RNA, 22 nt, Human
ggcugcaggaugcccagccgug

SEQ ID NO: 364336 - RNA, 20 nt, Human
caggcaguuugugguuaggg

SEQ ID NO: 364337 - RNA, 22 nt, Human
agacccugucaguguuaggaaa

SEQ ID NO: 364338 - RNA, 22 nt, Human
agugacugggcagggcagggcc

SEQ ID NO: 364339 - RNA, 22 nt, Human
ggagugacucucggggccacua

SEQ ID NO: 364340 - RNA, 22 nt, Human
caaaagcaguucuaucugaguu

SEQ ID NO: 364341 - RNA, 23 nt, Human
uggcaaggaaugggauggagacu

SEQ ID NO: 364342 - RNA, 22 nt, Human
acaguggaauuuguagaugugu

SEQ ID NO: 364343 - RNA, 22 nt, Human
gccugccugaaggcuguaccag

SEQ ID NO: 364344 - RNA, 22 nt, Human
uauuccuauggccacugcuacu

SEQ ID NO: 364345 - RNA, 22 nt, Human
cuggaaugccucccugucagag

SEQ ID NO: 364346 - RNA, 22 nt, Human
ucagaguggugguuuugccuuc

SEQ ID NO: 364347 - RNA, 22 nt, Human
gggugacauuucccaaugagcc

SEQ ID NO: 364348 - RNA, 22 nt, Human
gaggcucagggaaacagcgcag

SEQ ID NO: 364349 - RNA, 22 nt, Human
ugcagggaaugcuugcagcaug

SEQ ID NO: 364350 - RNA, 22 nt, Human
cuugaaucuggcuuugccacuu

SEQ ID NO: 364351 - RNA, 22 nt, Human
ccagaucuucuuuucagugucu

SEQ ID NO: 364352 - RNA, 22 nt, Human
aguggcagaagccaagucugca

SEQ ID NO: 364353 - RNA, 22 nt, Human
uuucucauagucaugccucuua

SEQ ID NO: 364354 - RNA, 22 nt, Human
uggagcucaaaggccuguggga

SEQ ID NO: 364355 - RNA, 22 nt, Human
acuucacagaaauuuuaugagg

SEQ ID NO: 364356 - RNA, 22 nt, Human
uucucuucuguucagugcccaa

SEQ ID NO: 364357 - RNA, 22 nt, Human
uugcuagcugguguaugcauug

SEQ ID NO: 364358 - RNA, 22 nt, Human
aggcagccaucugcaggaagga

SEQ ID NO: 364359 - RNA, 22 nt, Human
agucaccagguuuuagagaccu

SEQ ID NO: 364360 - RNA, 22 nt, Human
uggccuuguguuuuagagaaag

SEQ ID NO: 364361 - RNA, 22 nt, Human
uaaauuauguuccauguccuuu

SEQ ID NO: 364362 - RNA, 22 nt, Human
ccaggccuuccaguacgcagaa

SEQ ID NO: 364363 - RNA, 22 nt, Human
gcuuuguguagaaggaggaugg

SEQ ID NO: 364364 - RNA, 20 nt, Human
aaguuuucuccaaauacagu

SEQ ID NO: 364365 - RNA, 22 nt, Human
aggagucacucagggcuucauc

SEQ ID NO: 364366 - RNA, 22 nt, Human
uccaggcauuggagagauaaug

SEQ ID NO: 364367 - RNA, 23 nt, Human
agggcugaaugcagagaagcaga

SEQ ID NO: 364368 - RNA, 22 nt, Human
gcucccagcauugcuucccagg

SEQ ID NO: 364369 - RNA, 20 nt, Human
caggcacacucauuccugcu

SEQ ID NO: 364370 - RNA, 22 nt, Human
ccaggagcaacuugaaggcaag

SEQ ID NO: 364371 - RNA, 22 nt, Human
auuuuaucugcuuacuuucagg

SEQ ID NO: 364372 - RNA, 22 nt, Human
uagggcugccuauggcuagaua

SEQ ID NO: 364373 - RNA, 22 nt, Human
uggagcugacucacaccagcua

SEQ ID NO: 364374 - RNA, 22 nt, Human
gcugaaugaauguauuuuaaaa

SEQ ID NO: 364375 - RNA, 22 nt, Human
auacauuagcucauaugauuaa

SEQ ID NO: 364376 - RNA, 22 nt, Human
uucaggaucauuuguuuuaucu

SEQ ID NO: 364377 - RNA, 22 nt, Human
ugcagugugaccuguagcgagc

SEQ ID NO: 364378 - RNA, 20 nt, Human
ucucaggccccaguuuucuu

SEQ ID NO: 364379 - RNA, 23 nt, Human
ugggcaucuccucugugccaggc

SEQ ID NO: 364380 - RNA, 22 nt, Human
agauuucccacuccauguauug

SEQ ID NO: 364381 - RNA, 22 nt, Human
aggcucugcagugcuggaggac

SEQ ID NO: 364382 - RNA, 22 nt, Human
aaguaaaacacacaguccaccg

SEQ ID NO: 364383 - RNA, 22 nt, Human
uuaacauuguccuuagcagauu

SEQ ID NO: 364384 - RNA, 22 nt, Human
cuccucccugcgauugcucugc

SEQ ID NO: 364385 - RNA, 21 nt, Human
uagggcucuauuuuuauuuca

SEQ ID NO: 364386 - RNA, 22 nt, Human
uccucagaaaccccugugaggu

SEQ ID NO: 364387 - RNA, 19 nt, Human
aggugcaggucacagggga

SEQ ID NO: 364388 - RNA, 22 nt, Human
cugcagaggucuugcugauggu

SEQ ID NO: 364389 - RNA, 22 nt, Human
aguccuuaugagaugcugccuu

SEQ ID NO: 364390 - RNA, 22 nt, Human
aacauucugguucuaaaaaccu

SEQ ID NO: 364391 - RNA, 22 nt, Human
auguaacuguuauauuuuguug

SEQ ID NO: 364392 - RNA, 22 nt, Human
gcaucuuucuguccauucagca

SEQ ID NO: 364393 - RNA, 22 nt, Human
cagacacagauaugcauauggc

SEQ ID NO: 364394 - RNA, 22 nt, Human
gagucaccacugugauagucga

SEQ ID NO: 364395 - RNA, 22 nt, Human
uccaggcuagaagucacaggcc

SEQ ID NO: 364396 - RNA, 19 nt, Human
agauggggaagagugugag

SEQ ID NO: 364397 - RNA, 22 nt, Human
uauuucagucacuucuucucug

SEQ ID NO: 364398 - RNA, 22 nt, Human
ggcuggcauccagggaaaucca

SEQ ID NO: 364399 - RNA, 22 nt, Human
ggagagcugguagcuggcucca

SEQ ID NO: 364400 - RNA, 21 nt, Human
ucuauucauuacaguuauuug

SEQ ID NO: 364401 - RNA, 22 nt, Human
cuggccuggggccucagcugcu

SEQ ID NO: 364402 - RNA, 22 nt, Human
ucacaugcucaccuaagccaca

SEQ ID NO: 364403 - RNA, 22 nt, Human
uuguacaaaggauuuggaagag

SEQ ID NO: 364404 - RNA, 22 nt, Human
uugaggaguguuuagggugagg

SEQ ID NO: 364405 - RNA, 21 nt, Human
uggcucugcucagagcagucc

SEQ ID NO: 364406 - RNA, 22 nt, Human
acaauucucucauaucuuauua

SEQ ID NO: 364407 - RNA, 22 nt, Human
cucuucuugucucugguuagaa

SEQ ID NO: 364408 - RNA, 22 nt, Human
agggagguaggagcuucuagcu

SEQ ID NO: 364409 - RNA, 23 nt, Human
gccaggaguggguagacuaaugc

SEQ ID NO: 364410 - RNA, 22 nt, Human
ucugccuucgcugcucccugaa

SEQ ID NO: 364411 - RNA, 22 nt, Human
aggagaguaccauugggccgca

SEQ ID NO: 364412 - RNA, 22 nt, Human
uaguacuuaucucugucauugu

SEQ ID NO: 364413 - RNA, 22 nt, Human
cucagcagugacaagagaguau

SEQ ID NO: 364414 - RNA, 21 nt, Human
ugauuuccaucuuaaaauaaa

SEQ ID NO: 364415 - RNA, 22 nt, Human
aaagcagacugauuugcaucac

SEQ ID NO: 364416 - RNA, 22 nt, Human
gugcuuccccaagccacagccu

SEQ ID NO: 364417 - RNA, 22 nt, Human
ccagauaaggcuuuuuaaaagc

SEQ ID NO: 364418 - RNA, 22 nt, Human
caggugggcuugggagaacacu

SEQ ID NO: 364419 - RNA, 22 nt, Human
uggcagagagagugcagucgac

SEQ ID NO: 364420 - RNA, 22 nt, Human
gggagagguuacccgagcaacu

SEQ ID NO: 364421 - RNA, 19 nt, Human
uauggcaggccgaggcacu

SEQ ID NO: 364422 - RNA, 22 nt, Human
cuaauacucauuucuguaacuc

SEQ ID NO: 364423 - RNA, 23 nt, Human
caugccaguuugugcaggcagau

SEQ ID NO: 364424 - RNA, 22 nt, Human
uccuucaggguugaggccgacu

SEQ ID NO: 364425 - RNA, 22 nt, Human
ugaugggacugccagcugcuga

SEQ ID NO: 364426 - RNA, 22 nt, Human
cagcaggaggugaguagcaggu

SEQ ID NO: 364427 - RNA, 22 nt, Human
ucaaauguucccuguacuggcc

SEQ ID NO: 364428 - RNA, 19 nt, Human
guggccugcgcugggugcg

SEQ ID NO: 364429 - RNA, 22 nt, Human
aggggaggagcuuuucuugccu

SEQ ID NO: 364430 - RNA, 22 nt, Human
gcugagagugggugcagugcuu

SEQ ID NO: 364431 - RNA, 22 nt, Human
caggaugagaggcccagggaag

SEQ ID NO: 364432 - RNA, 22 nt, Human
caaagguauaaguuaauauaca

SEQ ID NO: 364433 - RNA, 22 nt, Human
gcagacuggucuucagccuugg

SEQ ID NO: 364434 - RNA, 22 nt, Human
gccugugcuuaacugacgugag

SEQ ID NO: 364435 - RNA, 22 nt, Human
agcugcuacugcucugccagag

SEQ ID NO: 364436 - RNA, 22 nt, Human
ccguagcacaugcuccuggggc

SEQ ID NO: 364437 - RNA, 22 nt, Human
uacuuguuaucaucuuuuccuu

SEQ ID NO: 364438 - RNA, 21 nt, Human
gcucuuggaaggggcucagcu

SEQ ID NO: 364439 - RNA, 22 nt, Human
ccagcugacgaugccuggucuc

SEQ ID NO: 364440 - RNA, 22 nt, Human
aguguauugauuggaacagccu

SEQ ID NO: 364441 - RNA, 20 nt, Human
cccugcagccaugggagugg

SEQ ID NO: 364442 - RNA, 23 nt, Human
cagaggcaucggauucaacauca

SEQ ID NO: 364443 - RNA, 22 nt, Human
ugcauaguucuccuuccuccuc

SEQ ID NO: 364444 - RNA, 22 nt, Human
acugcccucccaucuauugcaa

SEQ ID NO: 364445 - RNA, 22 nt, Human
cugagguguugaugaccuaugc

SEQ ID NO: 364446 - RNA, 23 nt, Human
ugcuucucugcuugacaguucug

SEQ ID NO: 364447 - RNA, 22 nt, Human
aaaaaguuucaacugccaacuc

SEQ ID NO: 364448 - RNA, 22 nt, Human
ccugucugagccagggugggca

SEQ ID NO: 364449 - RNA, 22 nt, Human
aaggcagcaggauuuggugacu

SEQ ID NO: 364450 - RNA, 21 nt, Human
ugagccaggcugacggcugug

SEQ ID NO: 364451 - RNA, 22 nt, Human
acagguggaggcuuuaggaggu

SEQ ID NO: 364452 - RNA, 22 nt, Human
gcuguucacagacucugcucug

SEQ ID NO: 364453 - RNA, 21 nt, Human
uggcucugagccucauggcug

SEQ ID NO: 364454 - RNA, 22 nt, Human
ugcagggcuuccucuuggaguu

SEQ ID NO: 364455 - RNA, 22 nt, Human
cagcagggaagcugugcuguuu

SEQ ID NO: 364456 - RNA, 22 nt, Human
uuaauuacaaaacacauagguu

SEQ ID NO: 364457 - RNA, 22 nt, Human
acuggcagccacaacuggcagg

SEQ ID NO: 364458 - RNA, 22 nt, Human
uggggcugaggagccucacucu

SEQ ID NO: 364459 - RNA, 22 nt, Human
caggagugaguuggggucuaca

SEQ ID NO: 364460 - RNA, 22 nt, Human
uggcagggaauacagauguuua

SEQ ID NO: 364461 - RNA, 22 nt, Human
ugcagagguguugcugagauaa

SEQ ID NO: 364462 - RNA, 22 nt, Human
uggcuggcuuguucacugacug

SEQ ID NO: 364463 - RNA, 22 nt, Human
gcccaggaaagauagggccuca

SEQ ID NO: 364464 - RNA, 22 nt, Human
gggugcagggucuccagcagcu

SEQ ID NO: 364465 - RNA, 22 nt, Human
aggcaagggggcgccaccuucc

SEQ ID NO: 364466 - RNA, 22 nt, Human
ucuugccucuuccccuuuccau

SEQ ID NO: 364467 - RNA, 22 nt, Human
uuguacuugccauagaacaaca

SEQ ID NO: 364468 - RNA, 22 nt, Human
cccugcagcauucucuaacugg

SEQ ID NO: 364469 - RNA, 22 nt, Human
ugugaaaggagccauagacagu

SEQ ID NO: 364470 - RNA, 22 nt, Human
cagucccaucucccagguggcu

SEQ ID NO: 364471 - RNA, 22 nt, Human
gaaaaaggauaaauacaguguu

SEQ ID NO: 364472 - RNA, 22 nt, Human
ugaaauaggaaacagauguuuc

SEQ ID NO: 364473 - RNA, 18 nt, Human
caggucagccuggccuca

SEQ ID NO: 364474 - RNA, 22 nt, Human
cccagcacuuugaauaugucac

SEQ ID NO: 364475 - RNA, 22 nt, Human
acccaggagccgugagagguua

SEQ ID NO: 364476 - RNA, 22 nt, Human
guuuuacacaccuaugaaagac

SEQ ID NO: 364477 - RNA, 22 nt, Human
auuucuucaggucagaaauaga

SEQ ID NO: 364478 - RNA, 22 nt, Human
gaggcaggcagauugcuugagg

SEQ ID NO: 364479 - RNA, 21 nt, Human
uauacaugugugcauacgugu

SEQ ID NO: 364480 - RNA, 22 nt, Human
ggucauuguucuuuucugugau

SEQ ID NO: 364481 - RNA, 22 nt, Human
ugcagggccagacuggguugga

SEQ ID NO: 364482 - RNA, 22 nt, Human
ugauugacuuuagaauagcacu

SEQ ID NO: 364483 - RNA, 22 nt, Human
ccagcagcgauagggugagugc

SEQ ID NO: 364484 - RNA, 22 nt, Human
gaggcugcuuugaugacaggag

SEQ ID NO: 364485 - RNA, 22 nt, Human
aguccagugucaaggugccauu

SEQ ID NO: 364486 - RNA, 22 nt, Human
agucccagugacuuggccagaa

SEQ ID NO: 364487 - RNA, 23 nt, Human
ggcugagacuacaggcgcuugcc

SEQ ID NO: 364488 - RNA, 22 nt, Human
agggcuggcuccguuaccuuga

SEQ ID NO: 364489 - RNA, 22 nt, Human
agagcucaagacgcucacagua

SEQ ID NO: 364490 - RNA, 22 nt, Human
aucccaugagaccacguuggcu

SEQ ID NO: 364491 - RNA, 22 nt, Human
aggcagucuaucucuggagccu

SEQ ID NO: 364492 - RNA, 22 nt, Human
gaggaaaauaacaacuaagggc

SEQ ID NO: 364493 - RNA, 22 nt, Human
guauucuugguuaucaaaauac

SEQ ID NO: 364494 - RNA, 19 nt, Human
ggaaacaggggccagagga

SEQ ID NO: 364495 - RNA, 22 nt, Human
uucaauucaauucuaaauauau

SEQ ID NO: 364496 - RNA, 21 nt, Human
gaaaagcaagggaguagaaca

SEQ ID NO: 364497 - RNA, 22 nt, Human
agagggcagucucagauuggga

SEQ ID NO: 364498 - RNA, 22 nt, Human
auauuaggaguuaaauguauua

SEQ ID NO: 364499 - RNA, 22 nt, Human
cagagguauugcaaaagccuag

SEQ ID NO: 364500 - RNA, 22 nt, Human
uuuccucuucgauuaaguuugg

SEQ ID NO: 364501 - RNA, 22 nt, Human
guuaauauuuaccugucaagaa

SEQ ID NO: 364502 - RNA, 22 nt, Human
cuuccucugcggcgccgggcgc

SEQ ID NO: 364503 - RNA, 22 nt, Human
cccugccugugggcaucaacau

SEQ ID NO: 364504 - RNA, 22 nt, Human
ccucuucugcuucaggagcacu

SEQ ID NO: 364505 - RNA, 22 nt, Human
uugguacaaaaguaacuguggu

SEQ ID NO: 364506 - RNA, 20 nt, Human
cugccuggaggccucuaccu

SEQ ID NO: 364507 - RNA, 22 nt, Human
aggcagcugaccacaguaugau

SEQ ID NO: 364508 - RNA, 22 nt, Human
caauuucagguggauagguuuu

SEQ ID NO: 364509 - RNA, 22 nt, Human
uguguacaggccuugcuagacu

SEQ ID NO: 364510 - RNA, 22 nt, Human
ugaagccagcuuuggaagacac

SEQ ID NO: 364511 - RNA, 22 nt, Human
gggcacagaagucuaagacauc

SEQ ID NO: 364512 - RNA, 22 nt, Human
acacauuucuaaauuuuuaccg

SEQ ID NO: 364513 - RNA, 22 nt, Human
aguggggaagagcaugggcccu

SEQ ID NO: 364514 - RNA, 22 nt, Human
auugaauagaugcauuauacua

SEQ ID NO: 364515 - RNA, 22 nt, Human
cagcucugugcaggccugggga

SEQ ID NO: 364516 - RNA, 22 nt, Human
agccuggauccuaggcucagcu

SEQ ID NO: 364517 - RNA, 22 nt, Human
augucacagucugacucaguga

SEQ ID NO: 364518 - RNA, 22 nt, Human
uccuggagauaauugcagugaa

SEQ ID NO: 364519 - RNA, 22 nt, Human
aaguuuuccuguguccaagaug

SEQ ID NO: 364520 - RNA, 22 nt, Human
ugaauggucacugagcaucugu

SEQ ID NO: 364521 - RNA, 22 nt, Human
agccagaguugaaugugagucu

SEQ ID NO: 364522 - RNA, 20 nt, Human
uacuggauuagggcucaccc

SEQ ID NO: 364523 - RNA, 22 nt, Human
gcagugaaaaagugcacccugu

SEQ ID NO: 364524 - RNA, 22 nt, Human
gcuuuggaugugugccugaggu

SEQ ID NO: 364525 - RNA, 22 nt, Human
aggugaguugguaggaaguuug

SEQ ID NO: 364526 - RNA, 23 nt, Human
cuuuuaacuagaguaucagcugc

SEQ ID NO: 364527 - RNA, 22 nt, Human
aaugucugccagaacugaucau

SEQ ID NO: 364528 - RNA, 22 nt, Human
gguguccuugcagaaggcggcg

SEQ ID NO: 364529 - RNA, 20 nt, Human
acaauacagguugugucuga

SEQ ID NO: 364530 - RNA, 20 nt, Human
cugcaggguuagaggcucca

SEQ ID NO: 364531 - RNA, 22 nt, Human
aucuggcucacuuagucuagga

SEQ ID NO: 364532 - RNA, 22 nt, Human
caugaagcauguuuugucauga

SEQ ID NO: 364533 - RNA, 22 nt, Human
gcccagcugcacccuggugggu

SEQ ID NO: 364534 - RNA, 22 nt, Human
uugcauuguaggauguuagaag

SEQ ID NO: 364535 - RNA, 22 nt, Human
cacaaugcguacauauaucaaa

SEQ ID NO: 364536 - RNA, 21 nt, Human
cucaaagaccaaaaguguaga

SEQ ID NO: 364537 - RNA, 22 nt, Human
ccaggaguuugaggcugcagug

SEQ ID NO: 364538 - RNA, 22 nt, Human
ccugagugaauucccucacugu

SEQ ID NO: 364539 - RNA, 22 nt, Human
aaggcagcacagcaacugcuca

SEQ ID NO: 364540 - RNA, 22 nt, Human
uuccaggaagcaguuagcagcc

SEQ ID NO: 364541 - RNA, 16 nt, Human
ggagagugucugcaaa

SEQ ID NO: 364542 - RNA, 22 nt, Human
agccauccucccaccucagccu

SEQ ID NO: 364543 - RNA, 22 nt, Human
aaaguguagagacuuuggaacc

SEQ ID NO: 364544 - RNA, 22 nt, Human
ucaggaugguguggaggaaaua

SEQ ID NO: 364545 - RNA, 22 nt, Human
ggggaccuuuccauuucugaga

SEQ ID NO: 364546 - RNA, 22 nt, Human
ucucucagcuuugagaccugcu

SEQ ID NO: 364547 - RNA, 22 nt, Human
guccuuugaaggcaaaaggaga

SEQ ID NO: 364548 - RNA, 21 nt, Human
gagugucuaauccaggcuguc

SEQ ID NO: 364549 - RNA, 22 nt, Human
uauaauuuaucaugucacaguu

SEQ ID NO: 364550 - RNA, 22 nt, Human
guagggacccacagucuauauu

SEQ ID NO: 364551 - RNA, 22 nt, Human
augcagagacagauguggcaug

SEQ ID NO: 364552 - RNA, 22 nt, Human
cagauuucuauuucaaauacau

SEQ ID NO: 364553 - RNA, 22 nt, Human
uuccggaagguucucuagaauu

SEQ ID NO: 364554 - RNA, 22 nt, Human
auuucuuccucugucaguaacu

SEQ ID NO: 364555 - RNA, 22 nt, Human
cugccgaguacagccauagaaa

SEQ ID NO: 364556 - RNA, 22 nt, Human
ggcccagcccgagucagccuuc

SEQ ID NO: 364557 - RNA, 22 nt, Human
acucagaagauauaaugacuca

SEQ ID NO: 364558 - RNA, 22 nt, Human
augaaaauugacagcggaagua

SEQ ID NO: 364559 - RNA, 22 nt, Human
auuucucuuagcaagacauuac

SEQ ID NO: 364560 - RNA, 22 nt, Human
cugccuuggcccuaguucaugg

SEQ ID NO: 364561 - RNA, 22 nt, Human
ccagagcaauucucacagaacu

SEQ ID NO: 364562 - RNA, 22 nt, Human
uuccauaauuaaguggagagaa

SEQ ID NO: 364563 - RNA, 22 nt, Human
uagaaacauguucuguucuguu

SEQ ID NO: 364564 - RNA, 23 nt, Human
cuggcucuguagguggcauccuu

SEQ ID NO: 364565 - RNA, 22 nt, Human
uuuacaaguuuacagaaugaug

SEQ ID NO: 364566 - RNA, 22 nt, Human
cccuggaggcggauguugcagu

SEQ ID NO: 364567 - RNA, 19 nt, Human
guaagggcuaauggacuau

SEQ ID NO: 364568 - RNA, 22 nt, Human
ccagcaggaaagugacguuuga

SEQ ID NO: 364569 - RNA, 16 nt, Human
cagcuuuaugucagug

SEQ ID NO: 364570 - RNA, 22 nt, Human
aaguugaagcaugaaccaaggu

SEQ ID NO: 364571 - RNA, 20 nt, Human
auacaaagagauugauguau

SEQ ID NO: 364572 - RNA, 22 nt, Human
gaaggcugcugggaaguguggu

SEQ ID NO: 364573 - RNA, 22 nt, Human
cccuggcaugcaugucccuggc

SEQ ID NO: 364574 - RNA, 22 nt, Human
gcugucagaaggugaaggguaa

SEQ ID NO: 364575 - RNA, 22 nt, Human
uguuuuaaucucccauugcucu

SEQ ID NO: 364576 - RNA, 22 nt, Human
uggcagcugaauggcuggaugg

SEQ ID NO: 364577 - RNA, 22 nt, Human
agagugaaguaauuguuaggau

SEQ ID NO: 364578 - RNA, 22 nt, Human
gcucugagaggugcagcaguaa

SEQ ID NO: 364579 - RNA, 22 nt, Human
aagucacagcuaaauagcuaag

SEQ ID NO: 364580 - RNA, 23 nt, Human
uucaagauacgguuuccaggcug

SEQ ID NO: 364581 - RNA, 22 nt, Human
aaagucauguaaugauaugauu

SEQ ID NO: 364582 - RNA, 22 nt, Human
acaugucaauuuaguacucuua

SEQ ID NO: 364583 - RNA, 22 nt, Human
gauaucauaucagacaaccucu

SEQ ID NO: 364584 - RNA, 22 nt, Human
guggcaggagacuggaagaugg

SEQ ID NO: 364585 - RNA, 22 nt, Human
aggcaagcauuuaaccacucau

SEQ ID NO: 364586 - RNA, 22 nt, Human
ggcccugggaugcucagcagug

SEQ ID NO: 364587 - RNA, 20 nt, Human
gccugcagguuggaugggau

SEQ ID NO: 364588 - RNA, 22 nt, Human
gcccugcugucuucagaguaua

SEQ ID NO: 364589 - RNA, 23 nt, Human
aguacauucgaaaaauucuguga

SEQ ID NO: 364590 - RNA, 22 nt, Human
aaugggagguaguaugggaggu

SEQ ID NO: 364591 - RNA, 22 nt, Human
cggcuggguagaggugccgggu

SEQ ID NO: 364592 - RNA, 22 nt, Human
auccaugaagguacuucucagg

SEQ ID NO: 364593 - RNA, 22 nt, Human
ggccccacgggggaguccuagu

SEQ ID NO: 364594 - RNA, 19 nt, Human
ucccuggcgccucucgggc

SEQ ID NO: 364595 - RNA, 21 nt, Human
ugauuuccagaaaauuggccc

SEQ ID NO: 364596 - RNA, 22 nt, Human
uugaauaggacucagcagugau

SEQ ID NO: 364597 - RNA, 22 nt, Human
cugccucugcgucccacagagu

SEQ ID NO: 364598 - RNA, 22 nt, Human
cuguggaaaauuuguauguaau

SEQ ID NO: 364599 - RNA, 22 nt, Human
agcaaucaccaccucuauauuu

SEQ ID NO: 364600 - RNA, 22 nt, Human
uggccucaagucugagggccuu

SEQ ID NO: 364601 - RNA, 19 nt, Human
cucugccucccuccugggu

SEQ ID NO: 364602 - RNA, 22 nt, Human
acuaaauaguuuugacagaaca

SEQ ID NO: 364603 - RNA, 22 nt, Human
caguacuuuucuggcuuucuac

SEQ ID NO: 364604 - RNA, 22 nt, Human
aguguuucccaguaggaugaaa

SEQ ID NO: 364605 - RNA, 22 nt, Human
ugacaugcuuguuuuccuugaa

SEQ ID NO: 364606 - RNA, 22 nt, Human
agcuccugcacccagccuugag

SEQ ID NO: 364607 - RNA, 22 nt, Human
ugcuuuggaucuauuugcugag

SEQ ID NO: 364608 - RNA, 22 nt, Human
uagcuguguagacacucagagc

SEQ ID NO: 364609 - RNA, 22 nt, Human
auccaguucucagugcuuacag

SEQ ID NO: 364610 - RNA, 22 nt, Human
acaguuucuccauuuacaccuu

SEQ ID NO: 364611 - RNA, 22 nt, Human
ccugggaggcagagguugcagu

SEQ ID NO: 364612 - RNA, 22 nt, Human
aacuuucagcaaguaauucugg

SEQ ID NO: 364613 - RNA, 22 nt, Human
agguacagaugaaagucuaguu

SEQ ID NO: 364614 - RNA, 22 nt, Human
caguggguaggaaaggcucuuc

SEQ ID NO: 364615 - RNA, 22 nt, Human
aauaucaacaguguccuucuaa

SEQ ID NO: 364616 - RNA, 22 nt, Human
gggcugcuuccuggggaaugcu

SEQ ID NO: 364617 - RNA, 22 nt, Human
gcagguggauuaucagaagugc

SEQ ID NO: 364618 - RNA, 23 nt, Human
auguuauuauuagcagucuugcc

SEQ ID NO: 364619 - RNA, 22 nt, Human
cccauuuagauaacaguucaaa

SEQ ID NO: 364620 - RNA, 22 nt, Human
gaaacaaucaucaugugauuug

SEQ ID NO: 364621 - RNA, 22 nt, Human
guuuuuaucuaauagcaguuau

SEQ ID NO: 364622 - RNA, 22 nt, Human
cauuucaaguaacagauugcuu

SEQ ID NO: 364623 - RNA, 18 nt, Human
ugucauugccagggaagc

SEQ ID NO: 364624 - RNA, 22 nt, Human
cacagaaucugugacuccaaga

SEQ ID NO: 364625 - RNA, 22 nt, Human
cagcugccacaggacuuucuga

SEQ ID NO: 364626 - RNA, 22 nt, Human
augcuguagaucuuagccucua

SEQ ID NO: 364627 - RNA, 22 nt, Human
ugcuuuauagacaaggaaguag

SEQ ID NO: 364628 - RNA, 22 nt, Human
gcagggacugugaucucacaga

SEQ ID NO: 364629 - RNA, 22 nt, Human
ugccacagaggugaagcccacu

SEQ ID NO: 364630 - RNA, 20 nt, Human
auguaaaauuauaaggcuga

SEQ ID NO: 364631 - RNA, 22 nt, Human
aggccagacagcuagaaacagg

SEQ ID NO: 364632 - RNA, 22 nt, Human
ugcugagaucugccaguagaug

SEQ ID NO: 364633 - RNA, 22 nt, Human
agccagagcugaugucauucuc

SEQ ID NO: 364634 - RNA, 19 nt, Human
gccagcagaaugaugaggc

SEQ ID NO: 364635 - RNA, 22 nt, Human
uguuaaucaaucaacaguauua

SEQ ID NO: 364636 - RNA, 22 nt, Human
ccugggcucuauccugacccag

SEQ ID NO: 364637 - RNA, 22 nt, Human
uuuuccucugagcuuugaauaa

SEQ ID NO: 364638 - RNA, 22 nt, Human
uuacacaacaucuguauuauua

SEQ ID NO: 364639 - RNA, 22 nt, Human
uggcagagucucuccuuuccag

SEQ ID NO: 364640 - RNA, 22 nt, Human
ugcacaaacuugugucccaggg

SEQ ID NO: 364641 - RNA, 22 nt, Human
cagcugcccugccuugcccuua

SEQ ID NO: 364642 - RNA, 22 nt, Human
agacaguguguguauauauggu

SEQ ID NO: 364643 - RNA, 22 nt, Human
acagcuuugggcaaugcuauga

SEQ ID NO: 364644 - RNA, 22 nt, Human
ugccuacauuccuugcuuaugg

SEQ ID NO: 364645 - RNA, 22 nt, Human
cuguauuuguccucuauuuauu

SEQ ID NO: 364646 - RNA, 22 nt, Human
gagacacaaacauuuauuccac

SEQ ID NO: 364647 - RNA, 22 nt, Human
aaaugguaagacaacacauuau

SEQ ID NO: 364648 - RNA, 22 nt, Human
cacugaguucccugacauuuca

SEQ ID NO: 364649 - RNA, 22 nt, Human
ggcugucugugguggagcguug

SEQ ID NO: 364650 - RNA, 23 nt, Human
ucagugauguugaaccuagcagu

SEQ ID NO: 364651 - RNA, 22 nt, Human
aaggucauuuaacaauuuauga

SEQ ID NO: 364652 - RNA, 22 nt, Human
uuucuucauagaccuugucuug

SEQ ID NO: 364653 - RNA, 22 nt, Human
gcucaggaaaacagucuaguaa

SEQ ID NO: 364654 - RNA, 22 nt, Human
uguaggccuauguccagcaauu

SEQ ID NO: 364655 - RNA, 22 nt, Human
ccacacagucaguuuccaagaa

SEQ ID NO: 364656 - RNA, 22 nt, Human
cacacaugaaucccuaguaccu

SEQ ID NO: 364657 - RNA, 22 nt, Human
agaggggagagcuaagcaauuc

SEQ ID NO: 364658 - RNA, 21 nt, Human
ggccuuggcgggggccgaauu

SEQ ID NO: 364659 - RNA, 22 nt, Human
agcccuucaaccugccuacucc

SEQ ID NO: 364660 - RNA, 22 nt, Human
aggagcagaauuuaaugugcag

SEQ ID NO: 364661 - RNA, 22 nt, Human
ggucugagcuugagcccaugcu

SEQ ID NO: 364662 - RNA, 21 nt, Human
ucccagagugcuugggacugc

SEQ ID NO: 364663 - RNA, 22 nt, Human
auucauucugaccucaagagaa

SEQ ID NO: 364664 - RNA, 22 nt, Human
gccugugguuugauuaagcauu

SEQ ID NO: 364665 - RNA, 22 nt, Human
ugaaggaaaugacggcagaaga

SEQ ID NO: 364666 - RNA, 22 nt, Human
caggauccccaggucgccgucc

SEQ ID NO: 364667 - RNA, 22 nt, Human
cagccagcuggcacugugagua

SEQ ID NO: 364668 - RNA, 17 nt, Human
aggcugcugggccaggg

SEQ ID NO: 364669 - RNA, 22 nt, Human
gugcaugaagacucagaaaguc

SEQ ID NO: 364670 - RNA, 22 nt, Human
gcaggccucuguugagggccuu

SEQ ID NO: 364671 - RNA, 22 nt, Human
aagcugccuagaguugaauguc

SEQ ID NO: 364672 - RNA, 22 nt, Human
ggaggagacccugugucaguuu

SEQ ID NO: 364673 - RNA, 22 nt, Human
cccaggaaccuaccagcucgag

SEQ ID NO: 364674 - RNA, 22 nt, Human
ggugagggaguggaacgaggug

SEQ ID NO: 364675 - RNA, 22 nt, Human
aaugcugcucucauaauuauag

SEQ ID NO: 364676 - RNA, 22 nt, Human
aacugcauuugcauaaguccau

SEQ ID NO: 364677 - RNA, 22 nt, Human
gagggcucuacucaccacccug

SEQ ID NO: 364678 - RNA, 22 nt, Human
cagagccacugucugccaggca

SEQ ID NO: 364679 - RNA, 22 nt, Human
aucacaaaggguuuucucugag

SEQ ID NO: 364680 - RNA, 17 nt, Human
ucaggauguagcaguag

SEQ ID NO: 364681 - RNA, 22 nt, Human
auugaaagguuuugagcagaua

SEQ ID NO: 364682 - RNA, 22 nt, Human
uccaggcauguugggaagauga

SEQ ID NO: 364683 - RNA, 22 nt, Human
agcugcugugugcucaggcagg

SEQ ID NO: 364684 - RNA, 22 nt, Human
gcaaguuauuuccauuuaaagc

SEQ ID NO: 364685 - RNA, 22 nt, Human
ugugccuuaugaauucuuucug

SEQ ID NO: 364686 - RNA, 19 nt, Human
cgcaggagccgaggugacc

SEQ ID NO: 364687 - RNA, 22 nt, Human
ucaauucaauugaacaguuacu

SEQ ID NO: 364688 - RNA, 22 nt, Human
gggguggauuccuacaggucca

SEQ ID NO: 364689 - RNA, 22 nt, Human
uauauuuaaauccagguugaaa

SEQ ID NO: 364690 - RNA, 22 nt, Human
gaaggcaggcuucugauuaggu

SEQ ID NO: 364691 - RNA, 22 nt, Human
auuucuacugugagaaacauga

SEQ ID NO: 364692 - RNA, 22 nt, Human
ugugccugucacccucagagag

SEQ ID NO: 364693 - RNA, 22 nt, Human
gccugcagacguguuuuccuca

SEQ ID NO: 364694 - RNA, 16 nt, Human
cagaguguaaacagga

SEQ ID NO: 364695 - RNA, 22 nt, Human
ucucagagaucuuucugcaugu

SEQ ID NO: 364696 - RNA, 22 nt, Human
ucaggauaaaauguaauggcaa

SEQ ID NO: 364697 - RNA, 22 nt, Human
uggaaagucucuuuugacugua

SEQ ID NO: 364698 - RNA, 22 nt, Human
agucucuuccuucaaggcuggu

SEQ ID NO: 364699 - RNA, 18 nt, Human
gggaagaggaucuggccc

SEQ ID NO: 364700 - RNA, 22 nt, Human
agaccaagugcaggugccacua

SEQ ID NO: 364701 - RNA, 22 nt, Human
ggcugccucugaugugcagacg

SEQ ID NO: 364702 - RNA, 22 nt, Human
cagggccugccugguuccugga

SEQ ID NO: 364703 - RNA, 21 nt, Human
auacagaacauugauccaaga

SEQ ID NO: 364704 - RNA, 20 nt, Human
cauuuguuagcuuucuacug

SEQ ID NO: 364705 - RNA, 21 nt, Human
cacaggugggucagugaggcc

SEQ ID NO: 364706 - RNA, 22 nt, Human
gcugugugacugagagccuggc

SEQ ID NO: 364707 - RNA, 23 nt, Human
gagguacagcaccagugaauagg

SEQ ID NO: 364708 - RNA, 22 nt, Human
gcucccagaaccaaggcugggg

SEQ ID NO: 364709 - RNA, 22 nt, Human
uucagaaacccauugggucucu

SEQ ID NO: 364710 - RNA, 17 nt, Human
uuucuccuuccaucuca

SEQ ID NO: 364711 - RNA, 22 nt, Human
cagauuuaccuaacuccaaguu

SEQ ID NO: 364712 - RNA, 22 nt, Human
ugcagcucugaacagucaugaa

SEQ ID NO: 364713 - RNA, 22 nt, Human
ucugcaggcuguacaggaagca

SEQ ID NO: 364714 - RNA, 22 nt, Human
uggcuuccuggacagaugcggu

SEQ ID NO: 364715 - RNA, 22 nt, Human
auccaggguguggagagagcuc

SEQ ID NO: 364716 - RNA, 22 nt, Human
uauugaaauucuucauguccuc

SEQ ID NO: 364717 - RNA, 22 nt, Human
uugaccuauguuucuucaucug

SEQ ID NO: 364718 - RNA, 18 nt, Human
ucugagggugcgggagcu

SEQ ID NO: 364719 - RNA, 22 nt, Human
ccagcuuuucagaaucugccug

SEQ ID NO: 364720 - RNA, 22 nt, Human
agagggaaugugauugcaccau

SEQ ID NO: 364721 - RNA, 22 nt, Human
cugggguggauggguccaaguu

SEQ ID NO: 364722 - RNA, 20 nt, Human
ucagggcaugggacagcccc

SEQ ID NO: 364723 - RNA, 22 nt, Human
caggcagagugagguggucuaa

SEQ ID NO: 364724 - RNA, 22 nt, Human
agauggguaacuggagucugcu

SEQ ID NO: 364725 - RNA, 22 nt, Human
uauuuccauguuagaacuaagu

SEQ ID NO: 364726 - RNA, 22 nt, Human
gcauuucuuccuggugugagcc

SEQ ID NO: 364727 - RNA, 22 nt, Human
uuucaacguguaaucuuauuua

SEQ ID NO: 364728 - RNA, 22 nt, Human
caagagagaugcagcucacuca

SEQ ID NO: 364729 - RNA, 21 nt, Human
cugguguagcacucaggugcu

SEQ ID NO: 364730 - RNA, 21 nt, Human
cagagcagcguucugcugugg

SEQ ID NO: 364731 - RNA, 18 nt, Human
cccagcuccacuucccuc

SEQ ID NO: 364732 - RNA, 22 nt, Human
cucagcagcagggaagagguca

SEQ ID NO: 364733 - RNA, 22 nt, Human
ccagggcagggaccacgugucu

SEQ ID NO: 364734 - RNA, 19 nt, Human
aaaugugaugguacaauuc

SEQ ID NO: 364735 - RNA, 21 nt, Human
uucaaagacuugaugcugacc

SEQ ID NO: 364736 - RNA, 22 nt, Human
gcaguggaagccucuuuaagca

SEQ ID NO: 364737 - RNA, 22 nt, Human
aaauguguauaugaaacaugau

SEQ ID NO: 364738 - RNA, 23 nt, Human
agcaggaaaccgagggugauguu

SEQ ID NO: 364739 - RNA, 22 nt, Human
ccaggagagcgcccucccggcc

SEQ ID NO: 364740 - RNA, 22 nt, Human
uaagauaugguaggaaguuugg

SEQ ID NO: 364741 - RNA, 22 nt, Human
gcagccacucucauuccacgug

SEQ ID NO: 364742 - RNA, 22 nt, Human
uucacaggauauaugugcaggg

SEQ ID NO: 364743 - RNA, 22 nt, Human
cacugugucaguuugguuagac

SEQ ID NO: 364744 - RNA, 22 nt, Human
agugcaaaauucagaagcaauu

SEQ ID NO: 364745 - RNA, 22 nt, Human
cagcgucucguugugggccucg

SEQ ID NO: 364746 - RNA, 22 nt, Human
gggcacuguacacugugcaugg

SEQ ID NO: 364747 - RNA, 23 nt, Human
auggagcugguacuagcuaccuc

SEQ ID NO: 364748 - RNA, 22 nt, Human
aggccuggccuuuauguucaag

SEQ ID NO: 364749 - RNA, 22 nt, Human
guguuuuaagaaagaagcucag

SEQ ID NO: 364750 - RNA, 22 nt, Human
uuuucuuauggugaagcacaaa

SEQ ID NO: 364751 - RNA, 22 nt, Human
agagacagaggcaauauagcuu

SEQ ID NO: 364752 - RNA, 23 nt, Human
uacuuaggguuuagaucugacug

SEQ ID NO: 364753 - RNA, 22 nt, Human
cccagcaguaaccaguggaaau

SEQ ID NO: 364754 - RNA, 22 nt, Human
uuuccuaagguagugauaauuu

SEQ ID NO: 364755 - RNA, 22 nt, Human
cagaggcuguguaggcagacug

SEQ ID NO: 364756 - RNA, 22 nt, Human
ugugaaagcaagucuaguucuc

SEQ ID NO: 364757 - RNA, 22 nt, Human
cugggcucagaugagaggaagg

SEQ ID NO: 364758 - RNA, 22 nt, Human
acuguguguuugucuagcacag

SEQ ID NO: 364759 - RNA, 22 nt, Human
auuugucucugcacuuuacuca

SEQ ID NO: 364760 - RNA, 22 nt, Human
uagaaaagaauuuuauuugaua

SEQ ID NO: 364761 - RNA, 22 nt, Human
uuuuccucaggaaugcuaagcu

SEQ ID NO: 364762 - RNA, 22 nt, Human
caagaaucagaccugucagggu

SEQ ID NO: 364763 - RNA, 22 nt, Human
cuguggcauugugaggacugca

SEQ ID NO: 364764 - RNA, 22 nt, Human
cugggcugcaguuccugguccu

SEQ ID NO: 364765 - RNA, 22 nt, Human
uacaugaacaaaauagcagaaa

SEQ ID NO: 364766 - RNA, 22 nt, Human
caguacuuggucaaggaagcag

SEQ ID NO: 364767 - RNA, 22 nt, Human
gaagaacaagcagugcuuuccu

SEQ ID NO: 364768 - RNA, 20 nt, Human
uauaacaguguugggugugu

SEQ ID NO: 364769 - RNA, 22 nt, Human
agggaauguagcaagaugccaa

SEQ ID NO: 364770 - RNA, 22 nt, Human
uggaaguggcagaaaaugaaca

SEQ ID NO: 364771 - RNA, 22 nt, Human
caauuucaugccauguauugcu

SEQ ID NO: 364772 - RNA, 22 nt, Human
uaccugcaaaguuccuuuugcc

SEQ ID NO: 364773 - RNA, 22 nt, Human
auacaugucaucauauguuugu

SEQ ID NO: 364774 - RNA, 22 nt, Human
caccugcagggggagucaagag

SEQ ID NO: 364775 - RNA, 22 nt, Human
ccuggaucagucacuguugcug

SEQ ID NO: 364776 - RNA, 22 nt, Human
ucaggauguuaauauagcauua

SEQ ID NO: 364777 - RNA, 22 nt, Human
ggucucuguugccuccaucaag

SEQ ID NO: 364778 - RNA, 23 nt, Human
aguaaagcaauuguuggcgagag

SEQ ID NO: 364779 - RNA, 22 nt, Human
uaugcacauauaaccugcacug

SEQ ID NO: 364780 - RNA, 22 nt, Human
uugcauugaugucuauacgcug

SEQ ID NO: 364781 - RNA, 23 nt, Human
gccugggacucaggaggagcuca

SEQ ID NO: 364782 - RNA, 22 nt, Human
ccuuuugcucucccauccagaa

SEQ ID NO: 364783 - RNA, 22 nt, Human
gaaaggucuuccggucuuccag

SEQ ID NO: 364784 - RNA, 18 nt, Human
cccacggugcuguagggc

SEQ ID NO: 364785 - RNA, 22 nt, Human
caguggagaggcaugcuuggca

SEQ ID NO: 364786 - RNA, 22 nt, Human
caguucacacugugcuaucugc

SEQ ID NO: 364787 - RNA, 22 nt, Human
uggaccugcuggaugggcaggu

SEQ ID NO: 364788 - RNA, 22 nt, Human
cacagggcuaaaugaaggguug

SEQ ID NO: 364789 - RNA, 22 nt, Human
ccaggagagcucuaaauggcug

SEQ ID NO: 364790 - RNA, 23 nt, Human
aucaaacuggugagaaugucagu

SEQ ID NO: 364791 - RNA, 22 nt, Human
aaggggaauagaguggguugug

SEQ ID NO: 364792 - RNA, 22 nt, Human
cggcagagcuuccugcucagcg

SEQ ID NO: 364793 - RNA, 22 nt, Human
uggagccugagucagcggaggc

SEQ ID NO: 364794 - RNA, 20 nt, Human
aaguuacauuguauuguacc

SEQ ID NO: 364795 - RNA, 22 nt, Human
uuucauuuugguuaugccauaa

SEQ ID NO: 364796 - RNA, 22 nt, Human
acauauuuccaugcagcauguc

SEQ ID NO: 364797 - RNA, 23 nt, Human
uaucagugugaugaggcugcugc

SEQ ID NO: 364798 - RNA, 22 nt, Human
aaaucaguuaagaugaggccau

SEQ ID NO: 364799 - RNA, 21 nt, Human
aaauguguuccauaaugcuuu

SEQ ID NO: 364800 - RNA, 22 nt, Human
uguguuuuacaaauucucuuaa

SEQ ID NO: 364801 - RNA, 22 nt, Human
agaggggcucauauccugucau

SEQ ID NO: 364802 - RNA, 22 nt, Human
caggaguggugugagggacucc

SEQ ID NO: 364803 - RNA, 22 nt, Human
uggccuggcccugaggcccugu

SEQ ID NO: 364804 - RNA, 22 nt, Human
gagauuggauuuaauggccaaa

SEQ ID NO: 364805 - RNA, 22 nt, Human
uaguuuuuucaacaaauggugc

SEQ ID NO: 364806 - RNA, 22 nt, Human
auacaugugggucuaaacauau

SEQ ID NO: 364807 - RNA, 22 nt, Human
ugucccagauacuggacauaga

SEQ ID NO: 364808 - RNA, 22 nt, Human
cagcacuggggggauucggagc

SEQ ID NO: 364809 - RNA, 22 nt, Human
ugaggcagccugcauuaaagag

SEQ ID NO: 364810 - RNA, 22 nt, Human
uggccuggggaccugugagacc

SEQ ID NO: 364811 - RNA, 22 nt, Human
gggcugacaaccaucugacaag

SEQ ID NO: 364812 - RNA, 22 nt, Human
agagccugggaauuugcauguu

SEQ ID NO: 364813 - RNA, 22 nt, Human
cagcuuugugcaaugcagucuc

SEQ ID NO: 364814 - RNA, 23 nt, Human
cccuggagcuagucugagcagag

SEQ ID NO: 364815 - RNA, 22 nt, Human
agucccagagaggucggggcca

SEQ ID NO: 364816 - RNA, 22 nt, Human
cucugagcccgcugcagcccca

SEQ ID NO: 364817 - RNA, 22 nt, Human
agaaaugaagcaggaguuauua

SEQ ID NO: 364818 - RNA, 22 nt, Human
ucacauuuucuacuacuguacg

SEQ ID NO: 364819 - RNA, 19 nt, Human
uggcugagcuggacugagg

SEQ ID NO: 364820 - RNA, 22 nt, Human
ucuauaaauuaugcagucucag

SEQ ID NO: 364821 - RNA, 22 nt, Human
uagagaaaagcagggaucagga

SEQ ID NO: 364822 - RNA, 22 nt, Human
aaucagaaucaguugacacagc

SEQ ID NO: 364823 - RNA, 20 nt, Human
aggaagccaaaggcugucuu

SEQ ID NO: 364824 - RNA, 22 nt, Human
caaaaguucucacccagacaug

SEQ ID NO: 364825 - RNA, 22 nt, Human
ccaggagcagauauggacauaa

SEQ ID NO: 364826 - RNA, 22 nt, Human
ggaugggagcagaggacgacca

SEQ ID NO: 364827 - RNA, 22 nt, Human
ucagagaguuuucacuagggug

SEQ ID NO: 364828 - RNA, 20 nt, Human
uggagcuguaaucuugucug

SEQ ID NO: 364829 - RNA, 22 nt, Human
agccaagcacucaacuccugga

SEQ ID NO: 364830 - RNA, 22 nt, Human
cagggacaauggcagagccuga

SEQ ID NO: 364831 - RNA, 22 nt, Human
ccucugagaccagcucugcacc

SEQ ID NO: 364832 - RNA, 22 nt, Human
gaagccaagugcaaaugccuua

SEQ ID NO: 364833 - RNA, 22 nt, Human
agugcuuuauguuguugugcaa

SEQ ID NO: 364834 - RNA, 22 nt, Human
aaagauuugaguucugcuuaua

SEQ ID NO: 364835 - RNA, 22 nt, Human
cuguuaauugugaauuuuacau

SEQ ID NO: 364836 - RNA, 22 nt, Human
ucugccuguucaagucuucuag

SEQ ID NO: 364837 - RNA, 22 nt, Human
cugaagagcucuccuguccccu

SEQ ID NO: 364838 - RNA, 22 nt, Human
ccucuugccaaucagcuacaga

SEQ ID NO: 364839 - RNA, 22 nt, Human
uggaccugggguggccuccucu

SEQ ID NO: 364840 - RNA, 22 nt, Human
gaaauagacacuuucuaugaau

SEQ ID NO: 364841 - RNA, 22 nt, Human
gcauugucaaaagugguaugac

SEQ ID NO: 364842 - RNA, 22 nt, Human
acugucucucuagcaguucagg

SEQ ID NO: 364843 - RNA, 22 nt, Human
ccucauggccuugagcugaggg

SEQ ID NO: 364844 - RNA, 22 nt, Human
guggccuggaguuugauguagg

SEQ ID NO: 364845 - RNA, 22 nt, Human
agcuguucccucacugcaguca

SEQ ID NO: 364846 - RNA, 22 nt, Human
cugaggucaauuaaucaacaac

SEQ ID NO: 364847 - RNA, 22 nt, Human
ugcugccaggucuugcugucca

SEQ ID NO: 364848 - RNA, 22 nt, Human
aagccagggucaggggccuccu

SEQ ID NO: 364849 - RNA, 22 nt, Human
gaaaggccauuucugaggguuu

SEQ ID NO: 364850 - RNA, 20 nt, Human
cugagagucugugcuuaguc

SEQ ID NO: 364851 - RNA, 22 nt, Human
cugcugugauugggagaaaccg

SEQ ID NO: 364852 - RNA, 22 nt, Human
cauaaaauggcuuguucuuuaa

SEQ ID NO: 364853 - RNA, 22 nt, Human
cacuggugacuucugagcugga

SEQ ID NO: 364854 - RNA, 22 nt, Human
caagcccaggauuccccaguua

SEQ ID NO: 364855 - RNA, 22 nt, Human
ccagagugacgugaagugugaa

SEQ ID NO: 364856 - RNA, 22 nt, Human
ugcuucucccaaccagggccug

SEQ ID NO: 364857 - RNA, 22 nt, Human
agucugcacucagguggagguc

SEQ ID NO: 364858 - RNA, 22 nt, Human
gcucuccaaacccuguggcuuu

SEQ ID NO: 364859 - RNA, 22 nt, Human
gaagcccacguuuggugaugua

SEQ ID NO: 364860 - RNA, 22 nt, Human
aguggcagcugucaugcccuag

SEQ ID NO: 364861 - RNA, 22 nt, Human
guguaucaaagcacagacuuca

SEQ ID NO: 364862 - RNA, 22 nt, Human
uuuuauuaguggcuagaugggg

SEQ ID NO: 364863 - RNA, 22 nt, Human
agcagggcccacuaggggagau

SEQ ID NO: 364864 - RNA, 22 nt, Human
guguuuccucacuucucugacu

SEQ ID NO: 364865 - RNA, 22 nt, Human
gcuggccuucugcagaguucug

SEQ ID NO: 364866 - RNA, 20 nt, Human
ggcagcaggaguuuccucuu

SEQ ID NO: 364867 - RNA, 22 nt, Human
uggucgaccaguuggaaaguaa

SEQ ID NO: 364868 - RNA, 22 nt, Human
gccucuggggcagcugagucau

SEQ ID NO: 364869 - RNA, 22 nt, Human
agggaggaaggauguuccaaag

SEQ ID NO: 364870 - RNA, 22 nt, Human
aggauuuauuacaagccauggu

SEQ ID NO: 364871 - RNA, 22 nt, Human
cagagcugggcauggugaaagg

SEQ ID NO: 364872 - RNA, 22 nt, Human
gauuucaagcccccagagauuc

SEQ ID NO: 364873 - RNA, 22 nt, Human
uccuggagggaggcggugcuac

SEQ ID NO: 364874 - RNA, 22 nt, Human
gucccagaggcuuuggccacag

SEQ ID NO: 364875 - RNA, 22 nt, Human
ggaggguuagcaaaggcacaga

SEQ ID NO: 364876 - RNA, 22 nt, Human
aaugcacacauuugguacugaa

SEQ ID NO: 364877 - RNA, 22 nt, Human
ucagccagugccuugaucuugc

SEQ ID NO: 364878 - RNA, 22 nt, Human
aggcaccuugcgguccagugaa

SEQ ID NO: 364879 - RNA, 22 nt, Human
uccagggauguccuguagcacu

SEQ ID NO: 364880 - RNA, 22 nt, Human
auuaggcauucaugcagcuccu

SEQ ID NO: 364881 - RNA, 22 nt, Human
augugucaauuuucaaaugcuu

SEQ ID NO: 364882 - RNA, 22 nt, Human
augcagcugugggcaagaaaug

SEQ ID NO: 364883 - RNA, 22 nt, Human
aggccaaguagcuagcauugaa

SEQ ID NO: 364884 - RNA, 22 nt, Human
aaauauaguaaaugcauaguuc

SEQ ID NO: 364885 - RNA, 22 nt, Human
ccuggaucuuuguuguaaauau

SEQ ID NO: 364886 - RNA, 22 nt, Human
uuaauuuuuauguauagugugu

SEQ ID NO: 364887 - RNA, 22 nt, Human
ucaguaaaugguugcuguuauu

SEQ ID NO: 364888 - RNA, 22 nt, Human
uaacagaaauagaaaugagagu

SEQ ID NO: 364889 - RNA, 22 nt, Human
auuugcuuuaagguauaaaagg

SEQ ID NO: 364890 - RNA, 22 nt, Human
uggagauggguuaauggagaga

SEQ ID NO: 364891 - RNA, 20 nt, Human
agaaucugacccagagagac

SEQ ID NO: 364892 - RNA, 22 nt, Human
cuucuuaaugacagauuaaaau

SEQ ID NO: 364893 - RNA, 17 nt, Human
gucugggcuuuagagac

SEQ ID NO: 364894 - RNA, 22 nt, Human
guggcugggcuccgagcggcuu

SEQ ID NO: 364895 - RNA, 22 nt, Human
gaagagcuuaguuguccuagaa

SEQ ID NO: 364896 - RNA, 22 nt, Human
aagguacaguuuuaagaauaag

SEQ ID NO: 364897 - RNA, 22 nt, Human
aggagggcuaggaaaaccagga

SEQ ID NO: 364898 - RNA, 19 nt, Human
uggcagcauugguaccuug

SEQ ID NO: 364899 - RNA, 22 nt, Human
agacaucauguuacagauuaag

SEQ ID NO: 364900 - RNA, 22 nt, Human
aacacaaagaagcugcaggauc

SEQ ID NO: 364901 - RNA, 22 nt, Human
gccuggagugcaguggcgugau

SEQ ID NO: 364902 - RNA, 22 nt, Human
uaaacauuuguuauucuuguuu

SEQ ID NO: 364903 - RNA, 20 nt, Human
ggcagccaaucagcgugccg

SEQ ID NO: 364904 - RNA, 22 nt, Human
aagaacaacugcuuuaaaagca

SEQ ID NO: 364905 - RNA, 22 nt, Human
cucuggagugcagccugguggc

SEQ ID NO: 364906 - RNA, 22 nt, Human
ggcagcuggccuccucgcccac

SEQ ID NO: 364907 - RNA, 22 nt, Human
cauucugcauuuggaaggggca

SEQ ID NO: 364908 - RNA, 22 nt, Human
aaggaagguucauagucaaaga

SEQ ID NO: 364909 - RNA, 23 nt, Human
cugcugugaaacaugguuuuggu

SEQ ID NO: 364910 - RNA, 22 nt, Human
caguacuugggggguucuaagu

SEQ ID NO: 364911 - RNA, 22 nt, Human
uccaggcuccccugcgugcucc

SEQ ID NO: 364912 - RNA, 22 nt, Human
aucaggaagaagaauguguugg

SEQ ID NO: 364913 - RNA, 22 nt, Human
gaggccuggcugucagucccca

SEQ ID NO: 364914 - RNA, 22 nt, Human
cagcaucuuucucuucuggagu

SEQ ID NO: 364915 - RNA, 22 nt, Human
uucuuugaguuaguacagucca

SEQ ID NO: 364916 - RNA, 22 nt, Human
ccaugagccaggcugaggaagc

SEQ ID NO: 364917 - RNA, 20 nt, Human
aagagcauaguacaggaaga

SEQ ID NO: 364918 - RNA, 22 nt, Human
cuucucagcaugguuacuguga

SEQ ID NO: 364919 - RNA, 22 nt, Human
cagcccucagguccucagcagc

SEQ ID NO: 364920 - RNA, 20 nt, Human
cugagcgucuaagaggugag

SEQ ID NO: 364921 - RNA, 19 nt, Human
cagcaauaaugccagaugg

SEQ ID NO: 364922 - RNA, 22 nt, Human
uuccuguauucuaaagggaaag

SEQ ID NO: 364923 - RNA, 22 nt, Human
auuuuccaaaauaauuguuacu

SEQ ID NO: 364924 - RNA, 22 nt, Human
ggagauggcucugcaaggucua

SEQ ID NO: 364925 - RNA, 22 nt, Human
ucaucacucauuggacaacaga

SEQ ID NO: 364926 - RNA, 22 nt, Human
uccaggcaucccccaggacaga

SEQ ID NO: 364927 - RNA, 22 nt, Human
ggcaguggguggaucucaggga

SEQ ID NO: 364928 - RNA, 23 nt, Human
aagcuuccuucacgucuccuggg

SEQ ID NO: 364929 - RNA, 19 nt, Human
gaggcgaggcgugcaggag

SEQ ID NO: 364930 - RNA, 22 nt, Human
aucuagaacuuaaagucaguca

SEQ ID NO: 364931 - RNA, 22 nt, Human
uagauuuccucuuccucauucc

SEQ ID NO: 364932 - RNA, 22 nt, Human
gcucucuggguggugggcaaca

SEQ ID NO: 364933 - RNA, 22 nt, Human
uaaggccaaacuauuauaguuc

SEQ ID NO: 364934 - RNA, 22 nt, Human
aggccugagcagaggaguggac

SEQ ID NO: 364935 - RNA, 22 nt, Human
aauucuaaauguaauuuagaau

SEQ ID NO: 364936 - RNA, 22 nt, Human
guuauuuuaacuucucaguaau

SEQ ID NO: 364937 - RNA, 22 nt, Human
agaagucauuuauguuagauga

SEQ ID NO: 364938 - RNA, 22 nt, Human
ucagaggaucaugucccuacuc

SEQ ID NO: 364939 - RNA, 23 nt, Human
gccaggcacaugguggacacgca

SEQ ID NO: 364940 - RNA, 22 nt, Human
cagguggggcgcccucaggcag

SEQ ID NO: 364941 - RNA, 22 nt, Human
gcccaggagccuggagaugugu

SEQ ID NO: 364942 - RNA, 22 nt, Human
ugucaccagcugcuccucagga

SEQ ID NO: 364943 - RNA, 22 nt, Human
uacagagauacucuagaucaaa

SEQ ID NO: 364944 - RNA, 22 nt, Human
uccauucuaugcuuacauuuau

SEQ ID NO: 364945 - RNA, 21 nt, Human
agcagccauuucacagagacu

SEQ ID NO: 364946 - RNA, 23 nt, Human
cagggccaggcagcagcugucac

SEQ ID NO: 364947 - RNA, 19 nt, Human
auuucaagagguuuauugg

SEQ ID NO: 364948 - RNA, 22 nt, Human
ucagagguaagggcugagagga

SEQ ID NO: 364949 - RNA, 22 nt, Human
gccuggaguagcauggcaagcc

SEQ ID NO: 364950 - RNA, 22 nt, Human
gaauuucuggacccuuugagaa

SEQ ID NO: 364951 - RNA, 23 nt, Human
uuucauaugguguggaugaagaa

SEQ ID NO: 364952 - RNA, 22 nt, Human
caguggagugggacuggucuga

SEQ ID NO: 364953 - RNA, 22 nt, Human
cccagagccucauucuguuggg

SEQ ID NO: 364954 - RNA, 22 nt, Human
cagggccuucguaaguguccgg

SEQ ID NO: 364955 - RNA, 22 nt, Human
acauucuagaagucuuugcaau

SEQ ID NO: 364956 - RNA, 22 nt, Human
acucacuuuccauucaagcacc

SEQ ID NO: 364957 - RNA, 22 nt, Human
augcagcaguuuacaaagcaau

SEQ ID NO: 364958 - RNA, 22 nt, Human
agcuccugaaaagcgcuugcuu

SEQ ID NO: 364959 - RNA, 22 nt, Human
cugggagagaagcgaagcuggg

SEQ ID NO: 364960 - RNA, 22 nt, Human
uacugugacagaguacuuaaac

SEQ ID NO: 364961 - RNA, 17 nt, Human
ucagcaaagacaaagga

SEQ ID NO: 364962 - RNA, 22 nt, Human
augcugugcuggcuaaccaugg

SEQ ID NO: 364963 - RNA, 22 nt, Human
aaagucugagcagaauuucuca

SEQ ID NO: 364964 - RNA, 19 nt, Human
agacagagcucaguggguu

SEQ ID NO: 364965 - RNA, 17 nt, Human
gccuggcccagccuggc

SEQ ID NO: 364966 - RNA, 19 nt, Human
ggcaggcuggauagagagg

SEQ ID NO: 364967 - RNA, 22 nt, Human
uccucagggaagaugagccuca

SEQ ID NO: 364968 - RNA, 22 nt, Human
caggugggccaugaaaaaugac

SEQ ID NO: 364969 - RNA, 22 nt, Human
ugaauccagagcuauuucgucc

SEQ ID NO: 364970 - RNA, 22 nt, Human
agucagcagccuggccaggaga

SEQ ID NO: 364971 - RNA, 22 nt, Human
aguugaauaauuagacauaucu

SEQ ID NO: 364972 - RNA, 22 nt, Human
ugccaggcauuugacagacacu

SEQ ID NO: 364973 - RNA, 22 nt, Human
aaaguguaaaagcauguuaggg

SEQ ID NO: 364974 - RNA, 22 nt, Human
ugaauaugugacuuugauuuca

SEQ ID NO: 364975 - RNA, 22 nt, Human
ugaaaaggguagaucccuaagu

SEQ ID NO: 364976 - RNA, 22 nt, Human
cagcuggcguggagugauugca

SEQ ID NO: 364977 - RNA, 18 nt, Human
cugccuguugcugagagg

SEQ ID NO: 364978 - RNA, 22 nt, Human
uucucugaucuugcuagacuga

SEQ ID NO: 364979 - RNA, 22 nt, Human
uggcuuccuccagagcaggagg

SEQ ID NO: 364980 - RNA, 22 nt, Human
gcucucugaggugcuggcagag

SEQ ID NO: 364981 - RNA, 20 nt, Human
ugcagcugcaggaggguggg

SEQ ID NO: 364982 - RNA, 22 nt, Human
ugucaaauuuuuauugcaguau

SEQ ID NO: 364983 - RNA, 22 nt, Human
gcugucugcugggucgcucagg

SEQ ID NO: 364984 - RNA, 22 nt, Human
uuauuagguuauucucuguacu

SEQ ID NO: 364985 - RNA, 22 nt, Human
ugcugcucuucaccauggccuc

SEQ ID NO: 364986 - RNA, 22 nt, Human
gggcauggugaugugcaccugu

SEQ ID NO: 364987 - RNA, 22 nt, Human
aaugcacauauauguguauaca

SEQ ID NO: 364988 - RNA, 22 nt, Human
auuucucaguguacauuauguu

SEQ ID NO: 364989 - RNA, 22 nt, Human
gacagaguuguugauguaugcu

SEQ ID NO: 364990 - RNA, 22 nt, Human
cauuuguaauacugacuugcag

SEQ ID NO: 364991 - RNA, 22 nt, Human
gucagaggaauggaugagugau

SEQ ID NO: 364992 - RNA, 22 nt, Human
caaauguaaauucuuuugaagc

SEQ ID NO: 364993 - RNA, 22 nt, Human
uuguggcucgugagauguuagg

SEQ ID NO: 364994 - RNA, 21 nt, Human
ucauucacaggguauuguaua

SEQ ID NO: 364995 - RNA, 19 nt, Human
cucuggagcagacacugga

SEQ ID NO: 364996 - RNA, 22 nt, Human
aguguuucuggcaaaugaaagu

SEQ ID NO: 364997 - RNA, 22 nt, Human
augccuguaaucccagugcuuu

SEQ ID NO: 364998 - RNA, 22 nt, Human
cagggcuccccagagagccucu

SEQ ID NO: 364999 - RNA, 22 nt, Human
gggcugggaauggcuaaguaug

SEQ ID NO: 365000 - RNA, 22 nt, Human
gagcugccaguguaugaauucu

SEQ ID NO: 365001 - RNA, 22 nt, Human
aagagcuggaugaagaaaucaa

SEQ ID NO: 365002 - RNA, 22 nt, Human
gcacacaggcaguuuccagcca

SEQ ID NO: 365003 - RNA, 21 nt, Human
uaaagaagaugaaugugauca

SEQ ID NO: 365004 - RNA, 22 nt, Human
ucaccccuacauuucccuugcu

SEQ ID NO: 365005 - RNA, 22 nt, Human
agggcugaagggaggugcucau

SEQ ID NO: 365006 - RNA, 22 nt, Human
agcuuuaucacaauauuggcua

SEQ ID NO: 365007 - RNA, 22 nt, Human
aagcagaaguugaucuaccaua

SEQ ID NO: 365008 - RNA, 22 nt, Human
gugguuuucuccaacccagaac

SEQ ID NO: 365009 - RNA, 22 nt, Human
ucaggccacggcucacugagac

SEQ ID NO: 365010 - RNA, 22 nt, Human
cuuccugcauugugccagaguu

SEQ ID NO: 365011 - RNA, 22 nt, Human
aggagaaggaagugcaucacua

SEQ ID NO: 365012 - RNA, 22 nt, Human
ucagagugaccuuacauggucu

SEQ ID NO: 365013 - RNA, 22 nt, Human
aagaugcagcuuuacaauaagg

SEQ ID NO: 365014 - RNA, 22 nt, Human
cauauuugguauaacuuaagca

SEQ ID NO: 365015 - RNA, 22 nt, Human
ccuggagcacagcccaguccca

SEQ ID NO: 365016 - RNA, 22 nt, Human
cccaggagauggagguugcagu

SEQ ID NO: 365017 - RNA, 22 nt, Human
ggaggccaggguggguggaucg

SEQ ID NO: 365018 - RNA, 22 nt, Human
cugggccuagaggaagcugaca

SEQ ID NO: 365019 - RNA, 22 nt, Human
agccaggccagacucacacccu

SEQ ID NO: 365020 - RNA, 22 nt, Human
gcugcccucccagggcaagcuu

SEQ ID NO: 365021 - RNA, 22 nt, Human
ggccaagauggaaggagagaug

SEQ ID NO: 365022 - RNA, 20 nt, Human
agaggccaguuaggagucua

SEQ ID NO: 365023 - RNA, 22 nt, Human
agggucagugaugagggagccc

SEQ ID NO: 365024 - RNA, 22 nt, Human
ccauggcuuuugagucucaaga

SEQ ID NO: 365025 - RNA, 22 nt, Human
ucauccagccucaucaggagcu

SEQ ID NO: 365026 - RNA, 22 nt, Human
uccuucaguucaauuaguccgu

SEQ ID NO: 365027 - RNA, 22 nt, Human
ggaccugcucucccaguucucu

SEQ ID NO: 365028 - RNA, 22 nt, Human
uugaaagaagaagcugcgaugu

SEQ ID NO: 365029 - RNA, 22 nt, Human
cuggagcaggcuugucccagcu

SEQ ID NO: 365030 - RNA, 20 nt, Human
ugacucugcaaccgucucuc

SEQ ID NO: 365031 - RNA, 22 nt, Human
aucuacagugcacaggacagcc

SEQ ID NO: 365032 - RNA, 22 nt, Human
ccagcuggcacuguggcugccc

SEQ ID NO: 365033 - RNA, 22 nt, Human
ccaggagaagcaucugagugua

SEQ ID NO: 365034 - RNA, 22 nt, Human
uggcucugaccagguagaggag

SEQ ID NO: 365035 - RNA, 22 nt, Human
uguucuucuagauugccuuuua

SEQ ID NO: 365036 - RNA, 20 nt, Human
uuccuuaggcauuggaagaa

SEQ ID NO: 365037 - RNA, 22 nt, Human
gcaagcugcucuuauguggagg

SEQ ID NO: 365038 - RNA, 22 nt, Human
ccagagucuuuauauuccugaa

SEQ ID NO: 365039 - RNA, 22 nt, Human
ggccagcucuuguccacggagg

SEQ ID NO: 365040 - RNA, 22 nt, Human
ggagucagccugucagagugua

SEQ ID NO: 365041 - RNA, 19 nt, Human
ugaaggagggggauggcca

SEQ ID NO: 365042 - RNA, 22 nt, Human
uauggcuuuuuauucaucuuac

SEQ ID NO: 365043 - RNA, 22 nt, Human
ggaggccaccugaccugcuguu

SEQ ID NO: 365044 - RNA, 22 nt, Human
ugggcagaaugugggauccaga

SEQ ID NO: 365045 - RNA, 22 nt, Human
ugcuuuauucagucucugccau

SEQ ID NO: 365046 - RNA, 22 nt, Human
uguaacaauuucuuacuauugu

SEQ ID NO: 365047 - RNA, 22 nt, Human
ccugggcagggcuggacucuca

SEQ ID NO: 365048 - RNA, 22 nt, Human
cugaggaggggccugagugaga

SEQ ID NO: 365049 - RNA, 18 nt, Human
agagcagcggcaucacac

SEQ ID NO: 365050 - RNA, 22 nt, Human
gggaagggagggaccucagucu

SEQ ID NO: 365051 - RNA, 22 nt, Human
ucucaggaguagugggauccau

SEQ ID NO: 365052 - RNA, 22 nt, Human
gggcagcugccagaggccaugg

SEQ ID NO: 365053 - RNA, 19 nt, Human
ccucuccgcccaccagccc

SEQ ID NO: 365054 - RNA, 22 nt, Human
agccuauuccaggaugagcuca

SEQ ID NO: 365055 - RNA, 22 nt, Human
gucccuaguggaaagacaugau

SEQ ID NO: 365056 - RNA, 22 nt, Human
ccucaggggugcccacagcugc

SEQ ID NO: 365057 - RNA, 19 nt, Human
uuugcagugguuccuuugu

SEQ ID NO: 365058 - RNA, 22 nt, Human
gccuggguccacugaucaugcu

SEQ ID NO: 365059 - RNA, 22 nt, Human
aagcagccucauuugugguaag

SEQ ID NO: 365060 - RNA, 22 nt, Human
acuuucuauucccacagagaua

SEQ ID NO: 365061 - RNA, 22 nt, Human
gucaggaugggcagccaaacua

SEQ ID NO: 365062 - RNA, 22 nt, Human
ccagccuggagggcaguggugg

SEQ ID NO: 365063 - RNA, 22 nt, Human
augcuguguuuuaaauggaaau

SEQ ID NO: 365064 - RNA, 22 nt, Human
ucagaagcugguguccuuugaa

SEQ ID NO: 365065 - RNA, 22 nt, Human
ucccaggaggugcuuccuagga

SEQ ID NO: 365066 - RNA, 22 nt, Human
aagggcugccagggggugccag

SEQ ID NO: 365067 - RNA, 22 nt, Human
cccagcauuucugggcugcacu

SEQ ID NO: 365068 - RNA, 22 nt, Human
ugcuuuauuuuaaauaugccau

SEQ ID NO: 365069 - RNA, 22 nt, Human
uccuggccuugcuccugaugcc

SEQ ID NO: 365070 - RNA, 22 nt, Human
cagagcaucgcgcagagagccu

SEQ ID NO: 365071 - RNA, 22 nt, Human
gggacagcuguagugcuuggcu

SEQ ID NO: 365072 - RNA, 22 nt, Human
aucaggauucaguaucuccagc

SEQ ID NO: 365073 - RNA, 22 nt, Human
ucucuucuaauuuucccgagua

SEQ ID NO: 365074 - RNA, 22 nt, Human
uguuugaacugaauaacauagu

SEQ ID NO: 365075 - RNA, 23 nt, Human
cuggcuccgaagacuccaggauc

SEQ ID NO: 365076 - RNA, 20 nt, Human
agugucuggugcagggccuc

SEQ ID NO: 365077 - RNA, 22 nt, Human
ugcuggcuacauuauugcuguc

SEQ ID NO: 365078 - RNA, 22 nt, Human
gcggagggcgagcccgcggagc

SEQ ID NO: 365079 - RNA, 22 nt, Human
cagagcuggagcuugaauggag

SEQ ID NO: 365080 - RNA, 22 nt, Human
gccaggugcuaucccugcgcug

SEQ ID NO: 365081 - RNA, 21 nt, Human
ccugcugugaucuuagugagu

SEQ ID NO: 365082 - RNA, 22 nt, Human
uaguuuuacuugcgaugauaau

SEQ ID NO: 365083 - RNA, 22 nt, Human
ugggcugcugcggugcucuugg

SEQ ID NO: 365084 - RNA, 22 nt, Human
gucuggagccacccuaagcauu

SEQ ID NO: 365085 - RNA, 22 nt, Human
cugucccuucauuauucacuac

SEQ ID NO: 365086 - RNA, 22 nt, Human
ucuuagaaaugaaguucuuucu

SEQ ID NO: 365087 - RNA, 22 nt, Human
ccagggccucguguucugagug

SEQ ID NO: 365088 - RNA, 22 nt, Human
auaugcacacucugcccacaga

SEQ ID NO: 365089 - RNA, 22 nt, Human
agggagcugagcugugagcagc

SEQ ID NO: 365090 - RNA, 22 nt, Human
cagagacuggagugcaguggcg

SEQ ID NO: 365091 - RNA, 22 nt, Human
cauccagggcagccauggccug

SEQ ID NO: 365092 - RNA, 22 nt, Human
ucccagcagagccagcaagccg

SEQ ID NO: 365093 - RNA, 22 nt, Human
ccacugggcguuucuguccaau

SEQ ID NO: 365094 - RNA, 22 nt, Human
ugaaagaacuagcaucuucaag

SEQ ID NO: 365095 - RNA, 22 nt, Human
guucuaauaggagaaaagacag

SEQ ID NO: 365096 - RNA, 22 nt, Human
cugggcagcuaccaccacugcu

SEQ ID NO: 365097 - RNA, 23 nt, Human
uucuuucaagaaguucacagugc

SEQ ID NO: 365098 - RNA, 22 nt, Human
agggaccucauguaaguggauu

SEQ ID NO: 365099 - RNA, 22 nt, Human
uggcuuuagguugcauguuucu

SEQ ID NO: 365100 - RNA, 22 nt, Human
ccagagcccgggaccuggacuu

SEQ ID NO: 365101 - RNA, 19 nt, Human
auagaaaggguuaaagaca

SEQ ID NO: 365102 - RNA, 22 nt, Human
ggaggugaggccguagggugug

SEQ ID NO: 365103 - RNA, 22 nt, Human
aaaugauugucaaaguucuguu

SEQ ID NO: 365104 - RNA, 20 nt, Human
caauuucaucauuuccugug

SEQ ID NO: 365105 - RNA, 22 nt, Human
aguugaaauuagaguccuggcu

SEQ ID NO: 365106 - RNA, 22 nt, Human
uuuuccaaaguaccaugucccu

SEQ ID NO: 365107 - RNA, 22 nt, Human
uugcauguguaauuuuucuaaa

SEQ ID NO: 365108 - RNA, 17 nt, Human
acagggcagaaacagcu

SEQ ID NO: 365109 - RNA, 18 nt, Human
aaagaaggauuggagagc

SEQ ID NO: 365110 - RNA, 22 nt, Human
uguaauggaagugggauugcau

SEQ ID NO: 365111 - RNA, 22 nt, Human
cuagaaauacaggcacgugcca

SEQ ID NO: 365112 - RNA, 22 nt, Human
cuguugucuccucucagauuau

SEQ ID NO: 365113 - RNA, 22 nt, Human
ugaaaugaaugugauucgauag

SEQ ID NO: 365114 - RNA, 22 nt, Human
agaaaugugagccccuuaucaa

SEQ ID NO: 365115 - RNA, 22 nt, Human
ugcccaggguggagugcagcgg

SEQ ID NO: 365116 - RNA, 23 nt, Human
uccaggcacgcauuucuucuagc

SEQ ID NO: 365117 - RNA, 22 nt, Human
agcuacccgaggacaggcuaag

SEQ ID NO: 365118 - RNA, 22 nt, Human
ccagagagagaggucaauggca

SEQ ID NO: 365119 - RNA, 22 nt, Human
uuucuucagccacuccaaacug

SEQ ID NO: 365120 - RNA, 22 nt, Human
cccuuccuccucgccugucaga

SEQ ID NO: 365121 - RNA, 22 nt, Human
uccuucagggggccgccugcac

SEQ ID NO: 365122 - RNA, 22 nt, Human
ucucagagaugucaagagucua

SEQ ID NO: 365123 - RNA, 22 nt, Human
ucaucugucauccacaaagcug

SEQ ID NO: 365124 - RNA, 22 nt, Human
aggcucagagaugaguaagcac

SEQ ID NO: 365125 - RNA, 22 nt, Human
uugaacauuaacuucagucuau

SEQ ID NO: 365126 - RNA, 20 nt, Human
cagcuuuagaucuuugauua

SEQ ID NO: 365127 - RNA, 22 nt, Human
cuggugguucaggagaauggcu

SEQ ID NO: 365128 - RNA, 22 nt, Human
ugaugguugauuauaaaucagu

SEQ ID NO: 365129 - RNA, 22 nt, Human
caaagguaaagaucugcugugg

SEQ ID NO: 365130 - RNA, 22 nt, Human
ucuucuuccucauuuauacaua

SEQ ID NO: 365131 - RNA, 22 nt, Human
gcugucugucucugucccacca

SEQ ID NO: 365132 - RNA, 22 nt, Human
agaugaaaauacgugacuuuaa

SEQ ID NO: 365133 - RNA, 22 nt, Human
acagagagaaacaaucagcagc

SEQ ID NO: 365134 - RNA, 22 nt, Human
cugccacuuacuaggcauggug

SEQ ID NO: 365135 - RNA, 22 nt, Human
uuuccucuccggggccuccagg

SEQ ID NO: 365136 - RNA, 22 nt, Human
gacagggaggagcagagcuucu

SEQ ID NO: 365137 - RNA, 22 nt, Human
ucugcuggccuuagcaggucua

SEQ ID NO: 365138 - RNA, 22 nt, Human
aggcugaggaucguacuuucca

SEQ ID NO: 365139 - RNA, 22 nt, Human
uggcaggcagugugggagcugg

SEQ ID NO: 365140 - RNA, 22 nt, Human
uuuuuccuagugcuuucuggua

SEQ ID NO: 365141 - RNA, 22 nt, Human
aggucauuccuugucuucuugc

SEQ ID NO: 365142 - RNA, 22 nt, Human
augcaguacugauacaugccac

SEQ ID NO: 365143 - RNA, 22 nt, Human
uggcugagaccaucagggugua

SEQ ID NO: 365144 - RNA, 22 nt, Human
ucaguucuuuauuucacaguga

SEQ ID NO: 365145 - RNA, 22 nt, Human
acuuuggaucugauguaaucag

SEQ ID NO: 365146 - RNA, 22 nt, Human
uaaauaugcauguauccuuauc

SEQ ID NO: 365147 - RNA, 22 nt, Human
agagcugcaccuaugcagaccu

SEQ ID NO: 365148 - RNA, 22 nt, Human
acucugggccccagguggagcu

SEQ ID NO: 365149 - RNA, 22 nt, Human
ucuggcuccacucugugcaugc

SEQ ID NO: 365150 - RNA, 22 nt, Human
guuauacauauguguuaacaaa

SEQ ID NO: 365151 - RNA, 22 nt, Human
aggccugucuggggcucagcca

SEQ ID NO: 365152 - RNA, 22 nt, Human
uugaauaguuuuggauagcaua

SEQ ID NO: 365153 - RNA, 22 nt, Human
cacugucuuuugugaagacaau

SEQ ID NO: 365154 - RNA, 19 nt, Human
agucuuucccacucgucuu

SEQ ID NO: 365155 - RNA, 22 nt, Human
caguggauuagccagagcugga

SEQ ID NO: 365156 - RNA, 22 nt, Human
cuuguccccagcagguugguuu

SEQ ID NO: 365157 - RNA, 22 nt, Human
gagagcuguccggcugagcagc

SEQ ID NO: 365158 - RNA, 22 nt, Human
cccugcaggcucagacuggagu

SEQ ID NO: 365159 - RNA, 22 nt, Human
gcuggauccugauucgucuuug

SEQ ID NO: 365160 - RNA, 22 nt, Human
cagccaccauacagcagaagcu

SEQ ID NO: 365161 - RNA, 22 nt, Human
ccucaggaaaugaauaaauggc

SEQ ID NO: 365162 - RNA, 22 nt, Human
guggugaagccccaucucugcu

SEQ ID NO: 365163 - RNA, 22 nt, Human
guuaggcagcccaagaugucag

SEQ ID NO: 365164 - RNA, 22 nt, Human
augcuguggccagaguucaacu

SEQ ID NO: 365165 - RNA, 22 nt, Human
cugguccuccuugccuucagau

SEQ ID NO: 365166 - RNA, 21 nt, Human
gcugcccaacccugcaucucc

SEQ ID NO: 365167 - RNA, 22 nt, Human
aggcagcaagauuauuuaaucc

SEQ ID NO: 365168 - RNA, 22 nt, Human
uccagcucuaacaugcugggcc

SEQ ID NO: 365169 - RNA, 22 nt, Human
ucuggcucucucaucacccaau

SEQ ID NO: 365170 - RNA, 22 nt, Human
ucuuugaauucaaacuguucaa

SEQ ID NO: 365171 - RNA, 22 nt, Human
cugagaguguggcuuccaggcc

SEQ ID NO: 365172 - RNA, 23 nt, Human
uggcugagguccagguaguuuca

SEQ ID NO: 365173 - RNA, 22 nt, Human
agagaagagcaaugauaaauuu

SEQ ID NO: 365174 - RNA, 22 nt, Human
uucagaaagugaaucuuguuau

SEQ ID NO: 365175 - RNA, 22 nt, Human
acguguucaauuuccaucugac

SEQ ID NO: 365176 - RNA, 23 nt, Human
agggcuccuuguugauuagcauu

SEQ ID NO: 365177 - RNA, 20 nt, Human
guggccuguccuguuguggg

SEQ ID NO: 365178 - RNA, 22 nt, Human
ggcuccugggaugggacugagc

SEQ ID NO: 365179 - RNA, 22 nt, Human
aaauuauucucauguguuucuu

SEQ ID NO: 365180 - RNA, 22 nt, Human
gucauuccuuauguugauucag

SEQ ID NO: 365181 - RNA, 22 nt, Human
aauucucagguaaaaguuaagu

SEQ ID NO: 365182 - RNA, 22 nt, Human
acagucauuagauacaaugucu

SEQ ID NO: 365183 - RNA, 22 nt, Human
ccacagggcacagacaggaagc

SEQ ID NO: 365184 - RNA, 22 nt, Human
gugcauuugacgaauacucacu

SEQ ID NO: 365185 - RNA, 22 nt, Human
agacaaagaaaccguagaagca

SEQ ID NO: 365186 - RNA, 21 nt, Human
gcaaauguucaggaaaaaaga

SEQ ID NO: 365187 - RNA, 22 nt, Human
ccagagagcuacaaggcauaaa

SEQ ID NO: 365188 - RNA, 22 nt, Human
acccucccauuuccauguagca

SEQ ID NO: 365189 - RNA, 22 nt, Human
ccuggcugcuauagcagcaugu

SEQ ID NO: 365190 - RNA, 22 nt, Human
acugccaaugguaguuugaugg

SEQ ID NO: 365191 - RNA, 22 nt, Human
ugaaggugaaugucuaugggga

SEQ ID NO: 365192 - RNA, 20 nt, Human
ccuaggcaugcugagucucc

SEQ ID NO: 365193 - RNA, 22 nt, Human
aagcagcauaauugcuauuuua

SEQ ID NO: 365194 - RNA, 22 nt, Human
aggcagcuuuaacugguaguag

SEQ ID NO: 365195 - RNA, 22 nt, Human
gcuggaucauauggugguucua

SEQ ID NO: 365196 - RNA, 21 nt, Human
agccugggaggcggagguugc

SEQ ID NO: 365197 - RNA, 22 nt, Human
gaggcugauucggggaacagca

SEQ ID NO: 365198 - RNA, 22 nt, Human
cacauacaaugguguuauuugg

SEQ ID NO: 365199 - RNA, 22 nt, Human
auugucgcuuauuuaggugcuu

SEQ ID NO: 365200 - RNA, 22 nt, Human
aaaggcuaugagauagaagaua

SEQ ID NO: 365201 - RNA, 22 nt, Human
caagccugucucaccagugcua

SEQ ID NO: 365202 - RNA, 19 nt, Human
cagaaauagcgaaguguaa

SEQ ID NO: 365203 - RNA, 22 nt, Human
auguccuuugcuucucuggucc

SEQ ID NO: 365204 - RNA, 22 nt, Human
ggggacccucaggacugcgucu

SEQ ID NO: 365205 - RNA, 22 nt, Human
aucagcuuuucucaucagaaau

SEQ ID NO: 365206 - RNA, 22 nt, Human
gaggcugccccuuccucagcug

SEQ ID NO: 365207 - RNA, 22 nt, Human
gcuggcauuacaggagagaacc

SEQ ID NO: 365208 - RNA, 18 nt, Human
ccucaggggaccuggcag

SEQ ID NO: 365209 - RNA, 22 nt, Human
cuggaugcuuccucucugcuag

SEQ ID NO: 365210 - RNA, 22 nt, Human
aaaguuugagugauuugacaca

SEQ ID NO: 365211 - RNA, 22 nt, Human
agggacuuguguccuauguaug

SEQ ID NO: 365212 - RNA, 21 nt, Human
acagacagggccagugucccc

SEQ ID NO: 365213 - RNA, 23 nt, Human
ccugggcauuggcugcagcuucu

SEQ ID NO: 365214 - RNA, 22 nt, Human
gccagucugcucccacaaguuc

SEQ ID NO: 365215 - RNA, 22 nt, Human
gggaggaaggcuugggugagua

SEQ ID NO: 365216 - RNA, 22 nt, Human
agcagacaacccagaugaccca

SEQ ID NO: 365217 - RNA, 22 nt, Human
uacaugaaguugucuaaacugg

SEQ ID NO: 365218 - RNA, 22 nt, Human
cuucaguuuaucccaucaucca

SEQ ID NO: 365219 - RNA, 22 nt, Human
aucuuucagagcuccaucaggg

SEQ ID NO: 365220 - RNA, 22 nt, Human
gacaugcaacaauuuggcauuu

SEQ ID NO: 365221 - RNA, 22 nt, Human
cagggcaggaauuugacauugc

SEQ ID NO: 365222 - RNA, 20 nt, Human
agggucaguagcacagagcu

SEQ ID NO: 365223 - RNA, 22 nt, Human
caugggcaccuuaaaaugaggc

SEQ ID NO: 365224 - RNA, 23 nt, Human
cuggggcuuucaaaucugggcag

SEQ ID NO: 365225 - RNA, 22 nt, Human
ucagcaauccucccacaggugg

SEQ ID NO: 365226 - RNA, 16 nt, Human
gcaacuuugggguuga

SEQ ID NO: 365227 - RNA, 22 nt, Human
cugccaggccuccgcugucccc

SEQ ID NO: 365228 - RNA, 22 nt, Human
aaucauaauucaaauaagcuua

SEQ ID NO: 365229 - RNA, 22 nt, Human
aaaggccaccaacaugaagcau

SEQ ID NO: 365230 - RNA, 22 nt, Human
uccuugaaaggggcugcagggc

SEQ ID NO: 365231 - RNA, 22 nt, Human
cagcuggaucccugcagaacuu

SEQ ID NO: 365232 - RNA, 19 nt, Human
ugccagcauuaggcugaag

SEQ ID NO: 365233 - RNA, 22 nt, Human
auucccaucgucaacuucacug

SEQ ID NO: 365234 - RNA, 22 nt, Human
aaaugcuacauacacaucaggg

SEQ ID NO: 365235 - RNA, 22 nt, Human
auguuaaaugguuuauuauuaa

SEQ ID NO: 365236 - RNA, 22 nt, Human
uaucagaacacauguuuugcag

SEQ ID NO: 365237 - RNA, 22 nt, Human
agccaucauuucugucacuggc

SEQ ID NO: 365238 - RNA, 23 nt, Human
ugggggugcacgggccacaucuu

SEQ ID NO: 365239 - RNA, 22 nt, Human
gcaaacaagcugccugaagauu

SEQ ID NO: 365240 - RNA, 22 nt, Human
gcagacuguaucaaugucagua

SEQ ID NO: 365241 - RNA, 22 nt, Human
agcugcucugauaaaccuacuu

SEQ ID NO: 365242 - RNA, 22 nt, Human
guauccuuugcggaaauuucua

SEQ ID NO: 365243 - RNA, 22 nt, Human
cagcagaggaaagcaaaucuaa

SEQ ID NO: 365244 - RNA, 22 nt, Human
ccagggcacguugggacaguac

SEQ ID NO: 365245 - RNA, 22 nt, Human
ggcucuggugugaagcagccuc

SEQ ID NO: 365246 - RNA, 21 nt, Human
cuccugggcuaagauauagug

SEQ ID NO: 365247 - RNA, 22 nt, Human
gagcccaggcagagguugcagu

SEQ ID NO: 365248 - RNA, 22 nt, Human
cagccaggacagggaaacuagu

SEQ ID NO: 365249 - RNA, 21 nt, Human
ugcagcagaguaagcagggga

SEQ ID NO: 365250 - RNA, 22 nt, Human
gggcuggaggagauccagaggc

SEQ ID NO: 365251 - RNA, 22 nt, Human
uagaaaugauuuugaugcuuca

SEQ ID NO: 365252 - RNA, 22 nt, Human
ucuguuccauguuuuguuccau

SEQ ID NO: 365253 - RNA, 22 nt, Human
auguuuccagguucuuccuaug

SEQ ID NO: 365254 - RNA, 22 nt, Human
acagccauagaugcuuauguaa

SEQ ID NO: 365255 - RNA, 18 nt, Human
gaggcagcuagcaauuuu

SEQ ID NO: 365256 - RNA, 22 nt, Human
acagggcagagggcaguuggua

SEQ ID NO: 365257 - RNA, 22 nt, Human
guagggacaauauguuauuaga

SEQ ID NO: 365258 - RNA, 22 nt, Human
uuuaauauuucuuuccugaagc

SEQ ID NO: 365259 - RNA, 23 nt, Human
uuuauuuauuuaggcugagggau

SEQ ID NO: 365260 - RNA, 22 nt, Human
uggcagagaacacggcugaucu

SEQ ID NO: 365261 - RNA, 22 nt, Human
ucugcagaaguggcugggccac

SEQ ID NO: 365262 - RNA, 22 nt, Human
cacauuuaauccuuuauaagua

SEQ ID NO: 365263 - RNA, 22 nt, Human
uguagggaggaaggguuggaaa

SEQ ID NO: 365264 - RNA, 18 nt, Human
cugcugcaggcacucagg

SEQ ID NO: 365265 - RNA, 22 nt, Human
aggcaagcgcagaagcggagga

SEQ ID NO: 365266 - RNA, 22 nt, Human
uuuauguacauauccacaagga

SEQ ID NO: 365267 - RNA, 22 nt, Human
ucucugguggcuccaucaguag

SEQ ID NO: 365268 - RNA, 22 nt, Human
uaggccagcccuuaguccuguc

SEQ ID NO: 365269 - RNA, 22 nt, Human
ggcagugaaaaaguauguuucc

SEQ ID NO: 365270 - RNA, 19 nt, Human
uggagggguuugaaugugg

SEQ ID NO: 365271 - RNA, 22 nt, Human
cucucugcuguauccuuaggcu

SEQ ID NO: 365272 - RNA, 22 nt, Human
ggucucagacuggcaggcagug

SEQ ID NO: 365273 - RNA, 22 nt, Human
uuaaacauuuauggaggcagca

SEQ ID NO: 365274 - RNA, 22 nt, Human
auacagaacucucaguuguaua

SEQ ID NO: 365275 - RNA, 22 nt, Human
cuuuggcagccucugcuauuga

SEQ ID NO: 365276 - RNA, 22 nt, Human
uagagcaguuggcagcuguauu

SEQ ID NO: 365277 - RNA, 22 nt, Human
auucauaacggcaaaugucacc

SEQ ID NO: 365278 - RNA, 22 nt, Human
acuuugugcccaacagaaagaa

SEQ ID NO: 365279 - RNA, 22 nt, Human
ccuccugguccagcaucucuuu

SEQ ID NO: 365280 - RNA, 22 nt, Human
uggaccugaagaauaggaagua

SEQ ID NO: 365281 - RNA, 22 nt, Human
gcugucacauuuggagcacugg

SEQ ID NO: 365282 - RNA, 22 nt, Human
ucagugcacagagauuuuuguu

SEQ ID NO: 365283 - RNA, 19 nt, Human
uaaggccaaaaguaagugu

SEQ ID NO: 365284 - RNA, 22 nt, Human
cagggagcuuucccaggacccu

SEQ ID NO: 365285 - RNA, 21 nt, Human
cagugagguccccagccuagg

SEQ ID NO: 365286 - RNA, 22 nt, Human
ggcuggaaaagacaaagcuauu

SEQ ID NO: 365287 - RNA, 22 nt, Human
cuggcagucugccucuucacug

SEQ ID NO: 365288 - RNA, 22 nt, Human
gcacaggcacagagggccacug

SEQ ID NO: 365289 - RNA, 22 nt, Human
uaaauguguuagucaugguuuu

SEQ ID NO: 365290 - RNA, 22 nt, Human
aaggcaguagguguuucaaacu

SEQ ID NO: 365291 - RNA, 22 nt, Human
augcugaauugaugcgagggag

SEQ ID NO: 365292 - RNA, 22 nt, Human
caaugugguggcagaugucagu

SEQ ID NO: 365293 - RNA, 22 nt, Human
cacagaguggaggcuuggccug

SEQ ID NO: 365294 - RNA, 22 nt, Human
gcagggacaaggcagguguucu

SEQ ID NO: 365295 - RNA, 22 nt, Human
uguacaugugucuguauaucuu

SEQ ID NO: 365296 - RNA, 22 nt, Human
augaagucuagcaagcauugaa

SEQ ID NO: 365297 - RNA, 22 nt, Human
ugcuuuauggagcccaucucau

SEQ ID NO: 365298 - RNA, 22 nt, Human
uccaauauggauaaaaggggcc

SEQ ID NO: 365299 - RNA, 22 nt, Human
cagguggggagaguguggagca

SEQ ID NO: 365300 - RNA, 22 nt, Human
cucagggccaaggaugcuguug

SEQ ID NO: 365301 - RNA, 22 nt, Human
aauauguucaaaauagaucacu

SEQ ID NO: 365302 - RNA, 20 nt, Human
uuguuucugcuauuuucuaa

SEQ ID NO: 365303 - RNA, 22 nt, Human
uuuauuugaaucaggggagaau

SEQ ID NO: 365304 - RNA, 22 nt, Human
ccuggaucccgauggcugugag

SEQ ID NO: 365305 - RNA, 22 nt, Human
acagcagcacuauugacauuuu

SEQ ID NO: 365306 - RNA, 21 nt, Human
agccugcaauguagguaccgg

SEQ ID NO: 365307 - RNA, 22 nt, Human
aguaaugugccugaaauacuug

SEQ ID NO: 365308 - RNA, 22 nt, Human
aguaaaaucuuaagcacagugg

SEQ ID NO: 365309 - RNA, 22 nt, Human
cuccaggccauggcugcggagg

SEQ ID NO: 365310 - RNA, 22 nt, Human
gaggcucagagagguccacaua

SEQ ID NO: 365311 - RNA, 22 nt, Human
agagccugcagcugugaagaaa

SEQ ID NO: 365312 - RNA, 20 nt, Human
ccagaagagaugaucaucca

SEQ ID NO: 365313 - RNA, 22 nt, Human
cucaggauuuacuaauuucaag

SEQ ID NO: 365314 - RNA, 22 nt, Human
gcucucuuuuuccagugguggu

SEQ ID NO: 365315 - RNA, 22 nt, Human
auuuuucucuccacuccauuaa

SEQ ID NO: 365316 - RNA, 22 nt, Human
acaggcuuuuuuagaaugacau

SEQ ID NO: 365317 - RNA, 22 nt, Human
ggccucggcccacugcugcggu

SEQ ID NO: 365318 - RNA, 22 nt, Human
ggcucagguugggucacaugac

SEQ ID NO: 365319 - RNA, 22 nt, Human
ggccaggcugcugggaccccgc

SEQ ID NO: 365320 - RNA, 22 nt, Human
aagggacuuugucagcuuucca

SEQ ID NO: 365321 - RNA, 22 nt, Human
uagggcucgggcacaggacagg

SEQ ID NO: 365322 - RNA, 22 nt, Human
augcaguagauaggcacuuuua

SEQ ID NO: 365323 - RNA, 22 nt, Human
uccauggguagcccugguugag

SEQ ID NO: 365324 - RNA, 22 nt, Human
aggaaccagagguugagcaacu

SEQ ID NO: 365325 - RNA, 20 nt, Human
ggaagccagcauccuugagg

SEQ ID NO: 365326 - RNA, 22 nt, Human
ugaggaaacuuacaaggcagaa

SEQ ID NO: 365327 - RNA, 22 nt, Human
aaaacaguuuaggcaucacagu

SEQ ID NO: 365328 - RNA, 22 nt, Human
uugaaaggaauacagaggccua

SEQ ID NO: 365329 - RNA, 22 nt, Human
aauuuccagaucagaugacuca

SEQ ID NO: 365330 - RNA, 22 nt, Human
gaauauuuuuaaagggacuaau

SEQ ID NO: 365331 - RNA, 22 nt, Human
uguggcagcuggagguggagaa

SEQ ID NO: 365332 - RNA, 22 nt, Human
cccuugcaucccauguguggcc

SEQ ID NO: 365333 - RNA, 22 nt, Human
gagcagugagugaauguugccu

SEQ ID NO: 365334 - RNA, 22 nt, Human
cuuggcagcuuuuggaggagcc

SEQ ID NO: 365335 - RNA, 22 nt, Human
acagagauggcacagagaaggu

SEQ ID NO: 365336 - RNA, 22 nt, Human
caguguggagggagagagccug

SEQ ID NO: 365337 - RNA, 22 nt, Human
agcaggaguuugaugcuuuuau

SEQ ID NO: 365338 - RNA, 22 nt, Human
caauuuuuguacuuauaguacu

SEQ ID NO: 365339 - RNA, 22 nt, Human
agauuucacaugcugcucuauu

SEQ ID NO: 365340 - RNA, 22 nt, Human
cucugagcugaaacaugagcau

SEQ ID NO: 365341 - RNA, 23 nt, Human
uccaggagcaugcuggcuggcga

SEQ ID NO: 365342 - RNA, 22 nt, Human
cagcacacagugacucgcaccu

SEQ ID NO: 365343 - RNA, 22 nt, Human
auggggugagacuaggauuaaa

SEQ ID NO: 365344 - RNA, 22 nt, Human
cccugccuucuuggccuuuaaa

SEQ ID NO: 365345 - RNA, 22 nt, Human
gggcuggucuggcuuagucagg

SEQ ID NO: 365346 - RNA, 20 nt, Human
uuuacauuuugaaacaguga

SEQ ID NO: 365347 - RNA, 22 nt, Human
cagccccucccucaggcaggug

SEQ ID NO: 365348 - RNA, 22 nt, Human
gagucaccacacggugcugacu

SEQ ID NO: 365349 - RNA, 22 nt, Human
ggaugcugcuaucaggcuucga

SEQ ID NO: 365350 - RNA, 21 nt, Human
ucacagacuggucagugaggc

SEQ ID NO: 365351 - RNA, 22 nt, Human
auaucaaacgaaguuauuuuaa

SEQ ID NO: 365352 - RNA, 22 nt, Human
ccucaggggcuuuucguuguug

SEQ ID NO: 365353 - RNA, 22 nt, Human
gaaggcugaugacagauucugc

SEQ ID NO: 365354 - RNA, 22 nt, Human
gccaggcagcagcgaggauggu

SEQ ID NO: 365355 - RNA, 22 nt, Human
agggcuccgggccaccggccug

SEQ ID NO: 365356 - RNA, 22 nt, Human
agagugguacuucuuuuucuuc

SEQ ID NO: 365357 - RNA, 20 nt, Human
uuccaacucacaucucuaca

SEQ ID NO: 365358 - RNA, 22 nt, Human
uugcagcuuagugauguuaucu

SEQ ID NO: 365359 - RNA, 22 nt, Human
gaaaugcaaauucucucucgcu

SEQ ID NO: 365360 - RNA, 22 nt, Human
ucugcagauuuaucagcagcug

SEQ ID NO: 365361 - RNA, 22 nt, Human
augccacugacauggacaauuu

SEQ ID NO: 365362 - RNA, 22 nt, Human
acuuugcagggcuugauaucca

SEQ ID NO: 365363 - RNA, 19 nt, Human
ugagugggccccugcagac

SEQ ID NO: 365364 - RNA, 22 nt, Human
uccauguguuuuccuguccaca

SEQ ID NO: 365365 - RNA, 22 nt, Human
uugaaauggaagugaaaauucu

SEQ ID NO: 365366 - RNA, 22 nt, Human
acauucuguuuccccaaagaga

SEQ ID NO: 365367 - RNA, 22 nt, Human
gaauuucagaucagagaccauu

SEQ ID NO: 365368 - RNA, 22 nt, Human
caaagagcuguucagugucgcu

SEQ ID NO: 365369 - RNA, 22 nt, Human
uuuccucuuauacaguguuuau

SEQ ID NO: 365370 - RNA, 22 nt, Human
uaaaguucuggugagagguaag

SEQ ID NO: 365371 - RNA, 22 nt, Human
cagcugagaaauggggaaaggg

SEQ ID NO: 365372 - RNA, 16 nt, Human
gcaggcagaucacaug

SEQ ID NO: 365373 - RNA, 22 nt, Human
ugccuaggaaaccucaugcuuc

SEQ ID NO: 365374 - RNA, 22 nt, Human
aagcugccacacggugaguacu

SEQ ID NO: 365375 - RNA, 22 nt, Human
guaugcaucgacucaagucuga

SEQ ID NO: 365376 - RNA, 22 nt, Human
uccugagauaaaucucauguga

SEQ ID NO: 365377 - RNA, 22 nt, Human
auucauuuagguauucacuuac

SEQ ID NO: 365378 - RNA, 22 nt, Human
ucucagaguuuuuuuccaggac

SEQ ID NO: 365379 - RNA, 22 nt, Human
aggcugagugcuccccuagaug

SEQ ID NO: 365380 - RNA, 22 nt, Human
gcuggccacacugcugauggag

SEQ ID NO: 365381 - RNA, 22 nt, Human
uggcagcagggccccuggagga

SEQ ID NO: 365382 - RNA, 22 nt, Human
ucugucugcucauuuaccucag

SEQ ID NO: 365383 - RNA, 22 nt, Human
gagauucuguagucaggcaucu

SEQ ID NO: 365384 - RNA, 22 nt, Human
agaaaagguugaaaguaggauu

SEQ ID NO: 365385 - RNA, 22 nt, Human
agcaggagcugugggaagaugg

SEQ ID NO: 365386 - RNA, 22 nt, Human
ugucugugaccucuuaggcaag

SEQ ID NO: 365387 - RNA, 22 nt, Human
ugauuuccccagucuugcugcu

SEQ ID NO: 365388 - RNA, 22 nt, Human
ucuuagcauuucauaacaacug

SEQ ID NO: 365389 - RNA, 22 nt, Human
agaaugcaagauaaacuuuauu

SEQ ID NO: 365390 - RNA, 22 nt, Human
ucagcaaugagaacuggcauuu

SEQ ID NO: 365391 - RNA, 22 nt, Human
gccuccugaaaggaagagcucc

SEQ ID NO: 365392 - RNA, 22 nt, Human
uacagacaguuuuucagauauu

SEQ ID NO: 365393 - RNA, 22 nt, Human
ugcagggaagcaaggguggcuc

SEQ ID NO: 365394 - RNA, 18 nt, Human
cacaggcaggugauaggu

SEQ ID NO: 365395 - RNA, 22 nt, Human
accaaaggcagagcugaacacu

SEQ ID NO: 365396 - RNA, 22 nt, Human
agugggggccaacgagggcagc

SEQ ID NO: 365397 - RNA, 22 nt, Human
gauagaaagaauauagauucca

SEQ ID NO: 365398 - RNA, 22 nt, Human
cugccaggcagcagagggagaa

SEQ ID NO: 365399 - RNA, 22 nt, Human
cauguuauuuauccauuaaaca

SEQ ID NO: 365400 - RNA, 22 nt, Human
gucaggauuggggucaugaguc

SEQ ID NO: 365401 - RNA, 20 nt, Human
cccaggaguuugcucuuacu

SEQ ID NO: 365402 - RNA, 22 nt, Human
uauuucuugaguggucaguuuc

SEQ ID NO: 365403 - RNA, 22 nt, Human
ugcauuauacuuuuagaaauuu

SEQ ID NO: 365404 - RNA, 22 nt, Human
cuauagaaaauuguaucacacg

SEQ ID NO: 365405 - RNA, 22 nt, Human
uucagaaacagagugagugagu

SEQ ID NO: 365406 - RNA, 22 nt, Human
gccucugcggagcuguacauca

SEQ ID NO: 365407 - RNA, 18 nt, Human
ccuggagcuccacagcaa

SEQ ID NO: 365408 - RNA, 22 nt, Human
auucacuggcagacagaacuca

SEQ ID NO: 365409 - RNA, 22 nt, Human
uguccugggaaugggaugcagu

SEQ ID NO: 365410 - RNA, 18 nt, Human
uuccaugauuccuuucac

SEQ ID NO: 365411 - RNA, 22 nt, Human
guaacagaaagucaugcucauu

SEQ ID NO: 365412 - RNA, 22 nt, Human
aagauauagauggugguauaaa

SEQ ID NO: 365413 - RNA, 20 nt, Human
ggcagagcuaugucuguugc

SEQ ID NO: 365414 - RNA, 22 nt, Human
ucaaacuagccugacugguauu

SEQ ID NO: 365415 - RNA, 22 nt, Human
ugccaggcacgugagaguggcc

SEQ ID NO: 365416 - RNA, 22 nt, Human
cugucaguucuuccagauagag

SEQ ID NO: 365417 - RNA, 21 nt, Human
uccucugcucucauaccacaa

SEQ ID NO: 365418 - RNA, 22 nt, Human
guccaguguguuuaucuuggau

SEQ ID NO: 365419 - RNA, 22 nt, Human
aggcaggcucaaugcccagucu

SEQ ID NO: 365420 - RNA, 22 nt, Human
gggcagauggggcacaggcuga

SEQ ID NO: 365421 - RNA, 22 nt, Human
gaaaaaugagcugaugucaggg

SEQ ID NO: 365422 - RNA, 22 nt, Human
caggagagcccggguccgggcu

SEQ ID NO: 365423 - RNA, 22 nt, Human
uccugcugagcgucugucauuu

SEQ ID NO: 365424 - RNA, 22 nt, Human
cuggcagcauggagccugugcu

SEQ ID NO: 365425 - RNA, 22 nt, Human
gccaaaucacagggccaaaagc

SEQ ID NO: 365426 - RNA, 22 nt, Human
uuugcagugucagcuucugugu

SEQ ID NO: 365427 - RNA, 22 nt, Human
uugauuuauagaauguucaagc

SEQ ID NO: 365428 - RNA, 22 nt, Human
cagaguccuggacacagagaca

SEQ ID NO: 365429 - RNA, 22 nt, Human
cauugcuuugugcauauuuaaa

SEQ ID NO: 365430 - RNA, 22 nt, Human
gcaggggcuacucugagcuucc

SEQ ID NO: 365431 - RNA, 22 nt, Human
ucucuuaauaaguaaauacuga

SEQ ID NO: 365432 - RNA, 22 nt, Human
aauauccacacugugucccugc

SEQ ID NO: 365433 - RNA, 22 nt, Human
auguccagccaaccacuggauu

SEQ ID NO: 365434 - RNA, 22 nt, Human
cagagcugcaaaugccccuccg

SEQ ID NO: 365435 - RNA, 22 nt, Human
uauugacagagggucagaagag

SEQ ID NO: 365436 - RNA, 22 nt, Human
cuuccucccggcccaugcucug

SEQ ID NO: 365437 - RNA, 22 nt, Human
ucacaguuauagucuguagaau

SEQ ID NO: 365438 - RNA, 18 nt, Human
cagaagcaggcagugcag

SEQ ID NO: 365439 - RNA, 19 nt, Human
agccagugagccucugggu

SEQ ID NO: 365440 - RNA, 22 nt, Human
aaucagucauuagcucugaccu

SEQ ID NO: 365441 - RNA, 21 nt, Human
ugcuccuuagcugccccugcc

SEQ ID NO: 365442 - RNA, 22 nt, Human
accaggaguagaauaucuguga

SEQ ID NO: 365443 - RNA, 22 nt, Human
gguuuauuaaugugaacuguau

SEQ ID NO: 365444 - RNA, 22 nt, Human
gcagggaagacccggagcagcg

SEQ ID NO: 365445 - RNA, 19 nt, Human
uccugggcugggccagguc

SEQ ID NO: 365446 - RNA, 22 nt, Human
ucaaaggcaccaaggucacugc

SEQ ID NO: 365447 - RNA, 22 nt, Human
guacauaaaggaggcucuuugc

SEQ ID NO: 365448 - RNA, 22 nt, Human
uuacuuuguucucaagauaugu

SEQ ID NO: 365449 - RNA, 20 nt, Human
cagaggcaaggagacuugga

SEQ ID NO: 365450 - RNA, 20 nt, Human
cuggguggcaagcaaggggg

SEQ ID NO: 365451 - RNA, 22 nt, Human
agcugccaaguuggaguagcaa

SEQ ID NO: 365452 - RNA, 22 nt, Human
agagcagcuggggcagagacca

SEQ ID NO: 365453 - RNA, 22 nt, Human
acaaagucuuuuacaacaguca

SEQ ID NO: 365454 - RNA, 22 nt, Human
caguuuuugccauuaagaguaa

SEQ ID NO: 365455 - RNA, 22 nt, Human
ugacaauacagagagagcaaaa

SEQ ID NO: 365456 - RNA, 22 nt, Human
aagggcucugcugucucucccc

SEQ ID NO: 365457 - RNA, 22 nt, Human
gccaggcacaguucuaggugcu

SEQ ID NO: 365458 - RNA, 22 nt, Human
uucucagaggagucgggagcug

SEQ ID NO: 365459 - RNA, 21 nt, Human
agucccaggggugagugaugu

SEQ ID NO: 365460 - RNA, 22 nt, Human
ggcugcuucucacucauuugca

SEQ ID NO: 365461 - RNA, 22 nt, Human
caucugcuguuccuuggacuca

SEQ ID NO: 365462 - RNA, 22 nt, Human
auauuaggugcucaauacaugc

SEQ ID NO: 365463 - RNA, 22 nt, Human
ggcuguggucauuaggagguug

SEQ ID NO: 365464 - RNA, 19 nt, Human
ucugaggguccagaugcau

SEQ ID NO: 365465 - RNA, 22 nt, Human
acacugaauaauugagaguuga

SEQ ID NO: 365466 - RNA, 22 nt, Human
ccuccacaggagcugcagugcu

SEQ ID NO: 365467 - RNA, 22 nt, Human
aaggccugcucagcugucugug

SEQ ID NO: 365468 - RNA, 22 nt, Human
gagcaggcucugccuguguguc

SEQ ID NO: 365469 - RNA, 22 nt, Human
uucaggauccccaccgcguuua

SEQ ID NO: 365470 - RNA, 22 nt, Human
caggguggcccuguggucucau

SEQ ID NO: 365471 - RNA, 22 nt, Human
cucaggaaaggccaugcaaggg

SEQ ID NO: 365472 - RNA, 21 nt, Human
uucauaaaccauucucaugca

SEQ ID NO: 365473 - RNA, 22 nt, Human
uuucuauugaucuaauaaacau

SEQ ID NO: 365474 - RNA, 22 nt, Human
gugcuuuccauccucccugcug

SEQ ID NO: 365475 - RNA, 22 nt, Human
ugagcuuacuucuguacacaga

SEQ ID NO: 365476 - RNA, 18 nt, Human
aaguccuuccuuugcuuu

SEQ ID NO: 365477 - RNA, 22 nt, Human
augggcugugagguccggcagg

SEQ ID NO: 365478 - RNA, 22 nt, Human
ccuggccagccagggcuggggu

SEQ ID NO: 365479 - RNA, 22 nt, Human
ugggaccuguuacauugaguua

SEQ ID NO: 365480 - RNA, 22 nt, Human
aggcugggaaauguagucuucc

SEQ ID NO: 365481 - RNA, 21 nt, Human
aagcuucccugcucuccaggg

SEQ ID NO: 365482 - RNA, 22 nt, Human
ucauucuugaucacuaguuagu

SEQ ID NO: 365483 - RNA, 22 nt, Human
uaugcacgucuauuuaugaaga

SEQ ID NO: 365484 - RNA, 18 nt, Human
acugugguuuauguguag

SEQ ID NO: 365485 - RNA, 22 nt, Human
gacaggguacgggcuaggcaca

SEQ ID NO: 365486 - RNA, 22 nt, Human
cuagggacagaaagaggguaga

SEQ ID NO: 365487 - RNA, 20 nt, Human
cugcuguguuauuguagaac

SEQ ID NO: 365488 - RNA, 22 nt, Human
ggcagccagcaaugagaaguuu

SEQ ID NO: 365489 - RNA, 22 nt, Human
uccuuucaccaaaaaguguugu

SEQ ID NO: 365490 - RNA, 22 nt, Human
uuuguguuuguacaaugcacua

SEQ ID NO: 365491 - RNA, 22 nt, Human
ugcagggauuagaggccgggga

SEQ ID NO: 365492 - RNA, 22 nt, Human
ucaaaagucugcauucuucaca

SEQ ID NO: 365493 - RNA, 22 nt, Human
cccagugccaggcacaggcagc

SEQ ID NO: 365494 - RNA, 22 nt, Human
agccacagcuccuugguggaga

SEQ ID NO: 365495 - RNA, 22 nt, Human
ugcaggccucacaccuggcacc

SEQ ID NO: 365496 - RNA, 22 nt, Human
uuacagaaaguuucccaugccg

SEQ ID NO: 365497 - RNA, 22 nt, Human
gaaauucugugucccagagugc

SEQ ID NO: 365498 - RNA, 22 nt, Human
ggaggaggggcgcuuugucuau

SEQ ID NO: 365499 - RNA, 20 nt, Human
uguuaaaggacacuugcuuu

SEQ ID NO: 365500 - RNA, 22 nt, Human
caauuucauggauaaaagaugu

SEQ ID NO: 365501 - RNA, 21 nt, Human
uuacuuuugcaccaaccuaau

SEQ ID NO: 365502 - RNA, 22 nt, Human
gaggcugguaggaaaggaaaca

SEQ ID NO: 365503 - RNA, 22 nt, Human
uggcagaaguacacaagcaugc

SEQ ID NO: 365504 - RNA, 22 nt, Human
acacuucucccaucuccuguug

SEQ ID NO: 365505 - RNA, 22 nt, Human
cucaccacagagccuguccagc

SEQ ID NO: 365506 - RNA, 22 nt, Human
cugcugggaaggucugcucagu

SEQ ID NO: 365507 - RNA, 22 nt, Human
gcucugagagugggugauucug

SEQ ID NO: 365508 - RNA, 22 nt, Human
agcuaggaaauugaggcugaga

SEQ ID NO: 365509 - RNA, 22 nt, Human
gaauuuuucuggaagcaauuau

SEQ ID NO: 365510 - RNA, 22 nt, Human
agggcaugugggagaggagccu

SEQ ID NO: 365511 - RNA, 22 nt, Human
acuggcagagguuggacaccau

SEQ ID NO: 365512 - RNA, 22 nt, Human
ugcuggguuaccuaagccuaaa

SEQ ID NO: 365513 - RNA, 22 nt, Human
cagucccaccaggaucgcucuu

SEQ ID NO: 365514 - RNA, 22 nt, Human
uccugcagcauccgucgucugu

SEQ ID NO: 365515 - RNA, 22 nt, Human
ucuauacaugugcacacacauc

SEQ ID NO: 365516 - RNA, 22 nt, Human
aaaugcauuuuuaauuagaccc

SEQ ID NO: 365517 - RNA, 17 nt, Human
uggcagcugaaagcucu

SEQ ID NO: 365518 - RNA, 22 nt, Human
cuuggggcugucacucuggcau

SEQ ID NO: 365519 - RNA, 22 nt, Human
ugagagugauugguucgaaugu

SEQ ID NO: 365520 - RNA, 22 nt, Human
auugacaaauggauguugacau

SEQ ID NO: 365521 - RNA, 22 nt, Human
cccugggcagucugcacuucag

SEQ ID NO: 365522 - RNA, 22 nt, Human
uggagcccagggugagaaggag

SEQ ID NO: 365523 - RNA, 22 nt, Human
cagacuuucaaggagugaaggc

SEQ ID NO: 365524 - RNA, 22 nt, Human
gcacagccacugagugagaacc

SEQ ID NO: 365525 - RNA, 22 nt, Human
uucuucucagggucccacaugg

SEQ ID NO: 365526 - RNA, 22 nt, Human
uguggcagaaccagaauucaaa

SEQ ID NO: 365527 - RNA, 22 nt, Human
ugccugggccuucccaccucug

SEQ ID NO: 365528 - RNA, 22 nt, Human
ucagagucauugcaaguagaag

SEQ ID NO: 365529 - RNA, 22 nt, Human
cagaccugagguugaguaccag

SEQ ID NO: 365530 - RNA, 22 nt, Human
cagaccagaaggaagccgacaa

SEQ ID NO: 365531 - RNA, 22 nt, Human
gccugccacgcaugcagaguca

SEQ ID NO: 365532 - RNA, 22 nt, Human
acaaaagugagugugucucaga

SEQ ID NO: 365533 - RNA, 20 nt, Human
caggcagaggaugcugacca

SEQ ID NO: 365534 - RNA, 22 nt, Human
cuggagagaccgaaagaggcug

SEQ ID NO: 365535 - RNA, 21 nt, Human
aucacauuggcuguuauuauu

SEQ ID NO: 365536 - RNA, 18 nt, Human
cugagggcagccccuggg

SEQ ID NO: 365537 - RNA, 22 nt, Human
uguccuuagaagaagugaaaga

SEQ ID NO: 365538 - RNA, 23 nt, Human
cagaaaacccagagcucaguccc

SEQ ID NO: 365539 - RNA, 19 nt, Human
cugcugggugcugagggag

SEQ ID NO: 365540 - RNA, 22 nt, Human
aagugggaauagaaaugaaggu

SEQ ID NO: 365541 - RNA, 22 nt, Human
uguggccuggaaggggcugcuc

SEQ ID NO: 365542 - RNA, 22 nt, Human
aaaagcaguuaucugggaggaa

SEQ ID NO: 365543 - RNA, 22 nt, Human
ccucccuuggccauagccagcc

SEQ ID NO: 365544 - RNA, 22 nt, Human
auuuuucucucacacuuaccag

SEQ ID NO: 365545 - RNA, 22 nt, Human
guuucauuaccugacccaugag

SEQ ID NO: 365546 - RNA, 22 nt, Human
gcuuugaagacuuuuccagggu

SEQ ID NO: 365547 - RNA, 22 nt, Human
ugcauuugucuugucucaugaa

SEQ ID NO: 365548 - RNA, 22 nt, Human
acaaagucaaauugcagccgcc

SEQ ID NO: 365549 - RNA, 22 nt, Human
ucugccuggguguggagcagag

SEQ ID NO: 365550 - RNA, 22 nt, Human
ccaggccugugcaaggagggag

SEQ ID NO: 365551 - RNA, 22 nt, Human
cucagaaucugccaaguucagg

SEQ ID NO: 365552 - RNA, 22 nt, Human
gcucuguccagcgugcacagaa

SEQ ID NO: 365553 - RNA, 22 nt, Human
aagaauguucuuguagucauga

SEQ ID NO: 365554 - RNA, 22 nt, Human
gcagggaccagggccagaucca

SEQ ID NO: 365555 - RNA, 22 nt, Human
gcaggcugauagaggauuccau

SEQ ID NO: 365556 - RNA, 22 nt, Human
cggcagcugauugcagagcacc

SEQ ID NO: 365557 - RNA, 22 nt, Human
uugcagagcaguaggaauauag

SEQ ID NO: 365558 - RNA, 22 nt, Human
ugccugucuuuccucccucgua

SEQ ID NO: 365559 - RNA, 22 nt, Human
ugaagggcaaccccaggcccag

SEQ ID NO: 365560 - RNA, 22 nt, Human
aggaccaguaugagagcaucug

SEQ ID NO: 365561 - RNA, 23 nt, Human
uaauucacauauacauugcuuca

SEQ ID NO: 365562 - RNA, 21 nt, Human
uucuucaaagaagaaggcaca

SEQ ID NO: 365563 - RNA, 22 nt, Human
ccagcuccccucagcagguaau

SEQ ID NO: 365564 - RNA, 22 nt, Human
ucucacugggucacagcagagg

SEQ ID NO: 365565 - RNA, 22 nt, Human
acugcagggcauccuggccaag

SEQ ID NO: 365566 - RNA, 22 nt, Human
gcagcuuuuuggaugucaguua

SEQ ID NO: 365567 - RNA, 22 nt, Human
aguucucagcuuaguaugcugu

SEQ ID NO: 365568 - RNA, 22 nt, Human
uaauuuaauuucaugccagccu

SEQ ID NO: 365569 - RNA, 22 nt, Human
aucuauacccaucaugauuuaa

SEQ ID NO: 365570 - RNA, 22 nt, Human
aaauccuaaaaguuugacuuaa

SEQ ID NO: 365571 - RNA, 22 nt, Human
agacaucagcuugugugcaggg

SEQ ID NO: 365572 - RNA, 22 nt, Human
uuuaucuguuguacauuuaugc

SEQ ID NO: 365573 - RNA, 22 nt, Human
cugagauggaguuucgcucuuc

SEQ ID NO: 365574 - RNA, 22 nt, Human
guggagacuucuacuagagacc

SEQ ID NO: 365575 - RNA, 22 nt, Human
ucccagagugagccaggggcag

SEQ ID NO: 365576 - RNA, 22 nt, Human
caggguggaauggaaugcuggc

SEQ ID NO: 365577 - RNA, 22 nt, Human
ucagaauuugauuccugggaua

SEQ ID NO: 365578 - RNA, 22 nt, Human
cagccagaaccuaggaugagcu

SEQ ID NO: 365579 - RNA, 22 nt, Human
ccuguucaauauucuuccuugu

SEQ ID NO: 365580 - RNA, 21 nt, Human
ucaggggcuguguuuuccauc

SEQ ID NO: 365581 - RNA, 22 nt, Human
ugcagggcagauaugacuguag

SEQ ID NO: 365582 - RNA, 22 nt, Human
gaggggaaaguucugcacaagg

SEQ ID NO: 365583 - RNA, 22 nt, Human
aagccagccagugccagucuua

SEQ ID NO: 365584 - RNA, 22 nt, Human
ggagagagaugccgccuugcuc

SEQ ID NO: 365585 - RNA, 22 nt, Human
uggccugaauuauggcagaucu

SEQ ID NO: 365586 - RNA, 22 nt, Human
caggcagcagaggaguguggga

SEQ ID NO: 365587 - RNA, 22 nt, Human
uugcucugauuagguggaaaca

SEQ ID NO: 365588 - RNA, 22 nt, Human
ggagaggguguggaaaguuauc

SEQ ID NO: 365589 - RNA, 22 nt, Human
gcuccucucccagagcugcagg

SEQ ID NO: 365590 - RNA, 22 nt, Human
ugccuggauucgguuguuguca

SEQ ID NO: 365591 - RNA, 22 nt, Human
cauuuguaguaucuguuuauau

SEQ ID NO: 365592 - RNA, 22 nt, Human
cagcccuguccagcagagggug

SEQ ID NO: 365593 - RNA, 22 nt, Human
ggcugagcacuuuaggcaggag

SEQ ID NO: 365594 - RNA, 22 nt, Human
ggcugcugugaccucaggugau

SEQ ID NO: 365595 - RNA, 22 nt, Human
cucuucuuauggccguggcuga

SEQ ID NO: 365596 - RNA, 22 nt, Human
ucaguuuugaaaacauugaaug

SEQ ID NO: 365597 - RNA, 22 nt, Human
auuauaggcuugagccaccgug

SEQ ID NO: 365598 - RNA, 21 nt, Human
cccugcaggccagggcugagc

SEQ ID NO: 365599 - RNA, 22 nt, Human
aagggcucccaacucaucuuuu

SEQ ID NO: 365600 - RNA, 22 nt, Human
ucccagaguuuccuguguccca

SEQ ID NO: 365601 - RNA, 22 nt, Human
gcauuguccugcuucugagugu

SEQ ID NO: 365602 - RNA, 22 nt, Human
gacauaauccuccucaccuacu

SEQ ID NO: 365603 - RNA, 22 nt, Human
gcacacagccagcugagggcua

SEQ ID NO: 365604 - RNA, 22 nt, Human
auaaguucagguaaagaaauca

SEQ ID NO: 365605 - RNA, 22 nt, Human
ccugccuguaagauggguacaa

SEQ ID NO: 365606 - RNA, 22 nt, Human
ccaaggagaaugacaccaugga

SEQ ID NO: 365607 - RNA, 22 nt, Human
uuuauccaccuuacccuguucc

SEQ ID NO: 365608 - RNA, 22 nt, Human
cagcuuuuuagaaucuagggca

SEQ ID NO: 365609 - RNA, 22 nt, Human
uggagaagucaaagugaacagg

SEQ ID NO: 365610 - RNA, 22 nt, Human
ccuggcugugcauugccggccc

SEQ ID NO: 365611 - RNA, 22 nt, Human
cagggcccaggccacuggguug

SEQ ID NO: 365612 - RNA, 22 nt, Human
agugaaauugcuguaagaggaa

SEQ ID NO: 365613 - RNA, 22 nt, Human
ucuggcugcugcgugagugcuu

SEQ ID NO: 365614 - RNA, 20 nt, Human
uaucaaucagaaagaagacu

SEQ ID NO: 365615 - RNA, 22 nt, Human
ugcccaggcuggaaugcagugg

SEQ ID NO: 365616 - RNA, 22 nt, Human
cugccaaggcuggggaggacaa

SEQ ID NO: 365617 - RNA, 19 nt, Human
ccuggaggugaagguucuc

SEQ ID NO: 365618 - RNA, 22 nt, Human
ccagcagcucccucaggguccg

SEQ ID NO: 365619 - RNA, 22 nt, Human
aaaggugacugcagcagcuauu

SEQ ID NO: 365620 - RNA, 22 nt, Human
cucugcaugccuugcucagaca

SEQ ID NO: 365621 - RNA, 22 nt, Human
uacacuuuuuacuacagauucu

SEQ ID NO: 365622 - RNA, 22 nt, Human
auuucucagcacuuccuaucuc

SEQ ID NO: 365623 - RNA, 22 nt, Human
aagacagaccacgugacagggc

SEQ ID NO: 365624 - RNA, 22 nt, Human
gagcacugagcuggaauuggag

SEQ ID NO: 365625 - RNA, 22 nt, Human
auccagucaaaauuaguaaggu

SEQ ID NO: 365626 - RNA, 22 nt, Human
uggcaggauuugcccggaagga

SEQ ID NO: 365627 - RNA, 22 nt, Human
cauggcuuuguucuguuagaug

SEQ ID NO: 365628 - RNA, 22 nt, Human
agcaccugcacaguggaggaaa

SEQ ID NO: 365629 - RNA, 22 nt, Human
aagagcuggucacagguccauu

SEQ ID NO: 365630 - RNA, 22 nt, Human
uggccuggaagagaggucgagg

SEQ ID NO: 365631 - RNA, 21 nt, Human
uccuucaguucugcacuuucu

SEQ ID NO: 365632 - RNA, 22 nt, Human
agcagugagugggaggaccaug

SEQ ID NO: 365633 - RNA, 22 nt, Human
gaguccuucuggcuggcaggau

SEQ ID NO: 365634 - RNA, 17 nt, Human
ggaaaaggaugauacag

SEQ ID NO: 365635 - RNA, 22 nt, Human
gggagcugguuccugcccucca

SEQ ID NO: 365636 - RNA, 22 nt, Human
gugcuuuuaaaggcaauuagua

SEQ ID NO: 365637 - RNA, 22 nt, Human
uuaaacagacaguaaaugaaac

SEQ ID NO: 365638 - RNA, 22 nt, Human
uggaauaaagugcuuugaucag

SEQ ID NO: 365639 - RNA, 22 nt, Human
cccagcuugucugauucagccu

SEQ ID NO: 365640 - RNA, 22 nt, Human
gacccaggagagaggguugcau

SEQ ID NO: 365641 - RNA, 22 nt, Human
agguauuauuagcaucucuauu

SEQ ID NO: 365642 - RNA, 22 nt, Human
auguccagaguaaagcacauuc

SEQ ID NO: 365643 - RNA, 22 nt, Human
auaggcuuauauaaaaacaucu

SEQ ID NO: 365644 - RNA, 22 nt, Human
ggaaagaccugagauaggaaua

SEQ ID NO: 365645 - RNA, 22 nt, Human
ggggcagagcauagcuccaauu

SEQ ID NO: 365646 - RNA, 22 nt, Human
ucauuuuucacacagggucacc

SEQ ID NO: 365647 - RNA, 22 nt, Human
cugcuuuguaaaauagacauaa

SEQ ID NO: 365648 - RNA, 22 nt, Human
gcuguucagaugcgauucagga

SEQ ID NO: 365649 - RNA, 22 nt, Human
gcucuguguugucagaggcacc

SEQ ID NO: 365650 - RNA, 22 nt, Human
auuucacaaagaacagaugcag

SEQ ID NO: 365651 - RNA, 20 nt, Human
cagagacccaggcuucagcu

SEQ ID NO: 365652 - RNA, 22 nt, Human
uaaggcacuucaauguuuagaa

SEQ ID NO: 365653 - RNA, 22 nt, Human
ccagggcagugggagaaggugc

SEQ ID NO: 365654 - RNA, 17 nt, Human
ucugggcuucagugguc

SEQ ID NO: 365655 - RNA, 22 nt, Human
acagggcaaccucugggagacu

SEQ ID NO: 365656 - RNA, 22 nt, Human
gcagggcagaaggugcugagga

SEQ ID NO: 365657 - RNA, 22 nt, Human
cccagccagccucuucccauau

SEQ ID NO: 365658 - RNA, 22 nt, Human
aggcuguccucucuugcucagu

SEQ ID NO: 365659 - RNA, 22 nt, Human
cagcaaucgggugauaugcaau

SEQ ID NO: 365660 - RNA, 17 nt, Human
gcagccagugcagcagg

SEQ ID NO: 365661 - RNA, 22 nt, Human
cugaagcaaaugaaacagcucu

SEQ ID NO: 365662 - RNA, 22 nt, Human
ucugccuggaugauggcagggc

SEQ ID NO: 365663 - RNA, 22 nt, Human
ugagaaagugggugccuagcaa

SEQ ID NO: 365664 - RNA, 22 nt, Human
ugccuggcaacuguggugggcu

SEQ ID NO: 365665 - RNA, 23 nt, Human
ugcucccaggugacgcugcuguu

SEQ ID NO: 365666 - RNA, 22 nt, Human
uuucuguaaggacuuaaugcaa

SEQ ID NO: 365667 - RNA, 22 nt, Human
agauacauauagaaaacaucaa

SEQ ID NO: 365668 - RNA, 22 nt, Human
uccaucaccauuucugcgagcu

SEQ ID NO: 365669 - RNA, 22 nt, Human
agcucccagggcugggcaaguu

SEQ ID NO: 365670 - RNA, 22 nt, Human
uucacauuugcccuuaugugug

SEQ ID NO: 365671 - RNA, 22 nt, Human
uucauaaucaccaaaaacugga

SEQ ID NO: 365672 - RNA, 22 nt, Human
ugccagagaagacccagucacu

SEQ ID NO: 365673 - RNA, 22 nt, Human
ggcucagagaccugcgaucuga

SEQ ID NO: 365674 - RNA, 22 nt, Human
ccagagagguagcuuacccucu

SEQ ID NO: 365675 - RNA, 22 nt, Human
cagcuucugcuaucgaacaucu

SEQ ID NO: 365676 - RNA, 21 nt, Human
aggcccagcuuuccucuugcu

SEQ ID NO: 365677 - RNA, 22 nt, Human
cacaccuguaauaccagcuacu

SEQ ID NO: 365678 - RNA, 20 nt, Human
ccugggguacacuggcaugu

SEQ ID NO: 365679 - RNA, 19 nt, Human
uccuuugaauaucaguuga

SEQ ID NO: 365680 - RNA, 22 nt, Human
aaguggaggccgaguucacgca

SEQ ID NO: 365681 - RNA, 22 nt, Human
gcugucaccaaagcaggcacug

SEQ ID NO: 365682 - RNA, 22 nt, Human
agcuucuggaaggcaaggcuug

SEQ ID NO: 365683 - RNA, 22 nt, Human
ggcuguccuuggccaaggcacu

SEQ ID NO: 365684 - RNA, 22 nt, Human
ucccaaggauaagagagucuga

SEQ ID NO: 365685 - RNA, 22 nt, Human
caaagugcuaggauuacaggcc

SEQ ID NO: 365686 - RNA, 22 nt, Human
aacuuaaacccacucauguaga

SEQ ID NO: 365687 - RNA, 22 nt, Human
aaauguauccuacuuccugagu

SEQ ID NO: 365688 - RNA, 22 nt, Human
cugggcacuuuggggagccuac

SEQ ID NO: 365689 - RNA, 22 nt, Human
auuuaaaugcuuaagaggguuu

SEQ ID NO: 365690 - RNA, 22 nt, Human
agaggggacagccaccugcccg

SEQ ID NO: 365691 - RNA, 22 nt, Human
cagagcagugaggaguugugua

SEQ ID NO: 365692 - RNA, 20 nt, Human
ugaugguucuuuccggguug

SEQ ID NO: 365693 - RNA, 22 nt, Human
cucccacuccuggcucaccaca

SEQ ID NO: 365694 - RNA, 22 nt, Human
agcucagcuuccucuccaugcu

SEQ ID NO: 365695 - RNA, 23 nt, Human
uuaaacuucagugcagaacacuc

SEQ ID NO: 365696 - RNA, 22 nt, Human
ccugucuguauugguuugcuau

SEQ ID NO: 365697 - RNA, 22 nt, Human
uugcucaggcuggugugcagug

SEQ ID NO: 365698 - RNA, 22 nt, Human
aggugucuggauggguguccuu

SEQ ID NO: 365699 - RNA, 22 nt, Human
ucagacaguuugcagugugccu

SEQ ID NO: 365700 - RNA, 22 nt, Human
uucagugugugauaccugcugu

SEQ ID NO: 365701 - RNA, 22 nt, Human
cuguaaaacacuguaguaucug

SEQ ID NO: 365702 - RNA, 22 nt, Human
uuugaaaggaauuaggaugaca

SEQ ID NO: 365703 - RNA, 22 nt, Human
aaacugcuuuccacaguggcua

SEQ ID NO: 365704 - RNA, 22 nt, Human
ccucacugaagaggugacauuu

SEQ ID NO: 365705 - RNA, 22 nt, Human
uacaaagugugcccaugcugag

SEQ ID NO: 365706 - RNA, 22 nt, Human
ggcuucuguccucuggaucugu

SEQ ID NO: 365707 - RNA, 22 nt, Human
uauuucuuucagguauguguug

SEQ ID NO: 365708 - RNA, 22 nt, Human
aagccaaugagagaggccucag

SEQ ID NO: 365709 - RNA, 22 nt, Human
aguauuuccuggcuuaucugcu

SEQ ID NO: 365710 - RNA, 20 nt, Human
ugcugucguguuuucugcuu

SEQ ID NO: 365711 - RNA, 22 nt, Human
guaaugaaugaaagaaacuggg

SEQ ID NO: 365712 - RNA, 22 nt, Human
uuucauugcagagucugugugc

SEQ ID NO: 365713 - RNA, 22 nt, Human
agggaggaguccucaaagucau

SEQ ID NO: 365714 - RNA, 22 nt, Human
caguagcauguaauaaagacag

SEQ ID NO: 365715 - RNA, 17 nt, Human
uuucagauucacuuucu

SEQ ID NO: 365716 - RNA, 22 nt, Human
ugcugccuuugggaccuggccu

SEQ ID NO: 365717 - RNA, 20 nt, Human
cuguggcaucugucauggug

SEQ ID NO: 365718 - RNA, 22 nt, Human
gcagaggagcaaguugcuacag

SEQ ID NO: 365719 - RNA, 22 nt, Human
aaguugagaugucauaggagac

SEQ ID NO: 365720 - RNA, 22 nt, Human
aaggaccuauauugucagagga

SEQ ID NO: 365721 - RNA, 22 nt, Human
gaggcagagacuccaccuucag

SEQ ID NO: 365722 - RNA, 22 nt, Human
agugagaguauuaaugugaacu

SEQ ID NO: 365723 - RNA, 22 nt, Human
aaagaagguagggcuggugacu

SEQ ID NO: 365724 - RNA, 22 nt, Human
ugguaauuuacgcauuucugua

SEQ ID NO: 365725 - RNA, 22 nt, Human
ucaaaggcccauugucccguug

SEQ ID NO: 365726 - RNA, 22 nt, Human
ugcugugguucccagaguggau

SEQ ID NO: 365727 - RNA, 22 nt, Human
ucaggcacugcuuucugauaug

SEQ ID NO: 365728 - RNA, 22 nt, Human
gaggcaguguugaaaaggagag

SEQ ID NO: 365729 - RNA, 21 nt, Human
uucugggaaaugagcuggggc

SEQ ID NO: 365730 - RNA, 22 nt, Human
uacaacauguaaagugguuuaa

SEQ ID NO: 365731 - RNA, 22 nt, Human
cucccugggcagauguggcucu

SEQ ID NO: 365732 - RNA, 22 nt, Human
gagauauguuagaaagcuauug

SEQ ID NO: 365733 - RNA, 22 nt, Human
aacagcagggggaccugcuggu

SEQ ID NO: 365734 - RNA, 23 nt, Human
auuugagaaaguauuuuuaagac

SEQ ID NO: 365735 - RNA, 22 nt, Human
gcaggagcaaacugcagugugg

SEQ ID NO: 365736 - RNA, 22 nt, Human
gcuuccaaaucuguucaaaaug

SEQ ID NO: 365737 - RNA, 22 nt, Human
gcuggccugcgagggcaggcug

SEQ ID NO: 365738 - RNA, 22 nt, Human
gcacagggaggcuggccuggcc

SEQ ID NO: 365739 - RNA, 22 nt, Human
auuucaguguugguuagcaagc

SEQ ID NO: 365740 - RNA, 22 nt, Human
cugcugcugcuaucuacccagg

SEQ ID NO: 365741 - RNA, 22 nt, Human
uaaagccaauauaccuagcaua

SEQ ID NO: 365742 - RNA, 22 nt, Human
cagggcucuuccggagcaggga

SEQ ID NO: 365743 - RNA, 22 nt, Human
ugauguucuguauaucauauag

SEQ ID NO: 365744 - RNA, 22 nt, Human
gaggacagagccgccuggcaag

SEQ ID NO: 365745 - RNA, 22 nt, Human
cuguauuuaguuaaaaugcuaa

SEQ ID NO: 365746 - RNA, 22 nt, Human
ucucugaguaagugacaguuca

SEQ ID NO: 365747 - RNA, 22 nt, Human
aaacaugaauagauauuaaaca

SEQ ID NO: 365748 - RNA, 22 nt, Human
cagcccuggcuagggcgagggc

SEQ ID NO: 365749 - RNA, 22 nt, Human
gcucugcucuugacuuaccagg

SEQ ID NO: 365750 - RNA, 22 nt, Human
ugcccagcugucaaaguagaua

SEQ ID NO: 365751 - RNA, 22 nt, Human
uucaacccaaguucuccauuuu

SEQ ID NO: 365752 - RNA, 22 nt, Human
agaguccauaugugggaggagu

SEQ ID NO: 365753 - RNA, 23 nt, Human
uuccacaaugaaaauaaagcagg

SEQ ID NO: 365754 - RNA, 23 nt, Human
ccuucagaagaaguaacaggggc

SEQ ID NO: 365755 - RNA, 22 nt, Human
auguucaaacuuuuuacacacc

SEQ ID NO: 365756 - RNA, 22 nt, Human
ucccaggacccaggcauucaca

SEQ ID NO: 365757 - RNA, 22 nt, Human
ggcccacuugaaauggagcuca

SEQ ID NO: 365758 - RNA, 19 nt, Human
gggcuccuugggccucucu

SEQ ID NO: 365759 - RNA, 22 nt, Human
aaauguguguauguacauauau

SEQ ID NO: 365760 - RNA, 20 nt, Human
aggagcugaauuagaggguu

SEQ ID NO: 365761 - RNA, 22 nt, Human
uaauuuaauccaaguguuacau

SEQ ID NO: 365762 - RNA, 22 nt, Human
cuaugacacaggccauuauaua

SEQ ID NO: 365763 - RNA, 22 nt, Human
guuagggaucaggaacaagagc

SEQ ID NO: 365764 - RNA, 22 nt, Human
caggauggagaguuguugguug

SEQ ID NO: 365765 - RNA, 22 nt, Human
uggaggaaaauuacuggggucu

SEQ ID NO: 365766 - RNA, 22 nt, Human
gaggcagcuuaggguacugacu

SEQ ID NO: 365767 - RNA, 19 nt, Human
gcucugugaugcugagggg

SEQ ID NO: 365768 - RNA, 22 nt, Human
cuggagugauacucagaaugug

SEQ ID NO: 365769 - RNA, 22 nt, Human
cucuuaguuuaucuuugacaaa

SEQ ID NO: 365770 - RNA, 19 nt, Human
uggauuuauauucuuuauc

SEQ ID NO: 365771 - RNA, 22 nt, Human
aaccaggacaauuugaauagaa

SEQ ID NO: 365772 - RNA, 22 nt, Human
agcgugaaggcgggcagucggc

SEQ ID NO: 365773 - RNA, 22 nt, Human
uucaagaugacccagucacacg

SEQ ID NO: 365774 - RNA, 22 nt, Human
aucaguuucuaccauguggaau

SEQ ID NO: 365775 - RNA, 22 nt, Human
gacucugcuacaggccgagguu

SEQ ID NO: 365776 - RNA, 22 nt, Human
ugugccauuucuauucugcagc

SEQ ID NO: 365777 - RNA, 22 nt, Human
cagcuuucaucagugacacuca

SEQ ID NO: 365778 - RNA, 22 nt, Human
aaauuucaguuaccuuuacguu

SEQ ID NO: 365779 - RNA, 22 nt, Human
aggccugaaguguggagugggg

SEQ ID NO: 365780 - RNA, 22 nt, Human
uucaugugauaaaugugugacu

SEQ ID NO: 365781 - RNA, 22 nt, Human
gcagcaggagaguuuguccugc

SEQ ID NO: 365782 - RNA, 22 nt, Human
uuaauuuuaaccuguuuguguc

SEQ ID NO: 365783 - RNA, 22 nt, Human
ggguggcacaggugcagagggu

SEQ ID NO: 365784 - RNA, 22 nt, Human
aguccuucaagaaaucuggaaa

SEQ ID NO: 365785 - RNA, 21 nt, Human
ucucuacacuuucacuaggcu

SEQ ID NO: 365786 - RNA, 22 nt, Human
agcugucuccagauacaggauu

SEQ ID NO: 365787 - RNA, 22 nt, Human
cuacuucuaaguacauggugau

SEQ ID NO: 365788 - RNA, 22 nt, Human
cuacccaggcuggagugcagua

SEQ ID NO: 365789 - RNA, 22 nt, Human
cgucccaguuccagccgcgcug

SEQ ID NO: 365790 - RNA, 22 nt, Human
aagacaugcaauuagcaaggaa

SEQ ID NO: 365791 - RNA, 22 nt, Human
gcugagcuagcuaucucagucu

SEQ ID NO: 365792 - RNA, 22 nt, Human
aaagccagcaaggugaguuuca

SEQ ID NO: 365793 - RNA, 22 nt, Human
cuggccuggucuggccucucca

SEQ ID NO: 365794 - RNA, 22 nt, Human
acuaaagaagccaaaguuuucu

SEQ ID NO: 365795 - RNA, 22 nt, Human
gccuuccugcagcucugagcgu

SEQ ID NO: 365796 - RNA, 22 nt, Human
gaaugcagauggcugguguaug

SEQ ID NO: 365797 - RNA, 22 nt, Human
ugggccagcaauugcugcucag

SEQ ID NO: 365798 - RNA, 23 nt, Human
ucacacagcuggucagguacaga

SEQ ID NO: 365799 - RNA, 22 nt, Human
gcccccucuuuggagccagcca

SEQ ID NO: 365800 - RNA, 22 nt, Human
acacuaaugagaaaggaauuaa

SEQ ID NO: 365801 - RNA, 22 nt, Human
acaacauucuuaaauacacuga

SEQ ID NO: 365802 - RNA, 19 nt, Human
auaaggcaggaggaaauuu

SEQ ID NO: 365803 - RNA, 22 nt, Human
uuuaaaaucagaugggaguugg

SEQ ID NO: 365804 - RNA, 21 nt, Human
gggaaauuaggauugcucauc

SEQ ID NO: 365805 - RNA, 22 nt, Human
gggcuugcugauuugggcagga

SEQ ID NO: 365806 - RNA, 23 nt, Human
ccagcugugccuggcccaggagc

SEQ ID NO: 365807 - RNA, 22 nt, Human
ugacuucaagguucagcaccuu

SEQ ID NO: 365808 - RNA, 23 nt, Human
gggagccauggguggucauggag

SEQ ID NO: 365809 - RNA, 22 nt, Human
aagacuuucaaguaugcaugca

SEQ ID NO: 365810 - RNA, 22 nt, Human
aaguccuuauguggaggggcua

SEQ ID NO: 365811 - RNA, 22 nt, Human
gauggcacacagacauccccgc

SEQ ID NO: 365812 - RNA, 22 nt, Human
agggcugacaguaaaaguauga

SEQ ID NO: 365813 - RNA, 22 nt, Human
gagcacugauuuauuuuugucu

SEQ ID NO: 365814 - RNA, 22 nt, Human
ggaggccaugaggcucuaggug

SEQ ID NO: 365815 - RNA, 20 nt, Human
aucuggcucagauccugcag

SEQ ID NO: 365816 - RNA, 22 nt, Human
ugcauguguuugccacagugag

SEQ ID NO: 365817 - RNA, 23 nt, Human
uggcagcuguguaagagaaagca

SEQ ID NO: 365818 - RNA, 22 nt, Human
uucucagagcucacuguaguaa

SEQ ID NO: 365819 - RNA, 20 nt, Human
gugggcagaugugugcaugg

SEQ ID NO: 365820 - RNA, 22 nt, Human
ucagagaguuggaaagaauuaa

SEQ ID NO: 365821 - RNA, 22 nt, Human
ugcuuaauauugugauguaaua

SEQ ID NO: 365822 - RNA, 19 nt, Human
gggcucuggccucaguggg

SEQ ID NO: 365823 - RNA, 22 nt, Human
aaauguuuugcucccauguggu

SEQ ID NO: 365824 - RNA, 22 nt, Human
gugggagcuuuggcaucaggcu

SEQ ID NO: 365825 - RNA, 22 nt, Human
ugggacuugccucgagggcugc

SEQ ID NO: 365826 - RNA, 22 nt, Human
cagggcagggauguugcggcag

SEQ ID NO: 365827 - RNA, 22 nt, Human
acccaggguagaaccucagagc

SEQ ID NO: 365828 - RNA, 22 nt, Human
ucagaauucuacaauagaucag

SEQ ID NO: 365829 - RNA, 16 nt, Human
gcccaggacgggaggc

SEQ ID NO: 365830 - RNA, 22 nt, Human
ccacaucucgguccccucuuug

SEQ ID NO: 365831 - RNA, 23 nt, Human
cagaaauaaacugguuuguagau

SEQ ID NO: 365832 - RNA, 22 nt, Human
uacaguagaauuuuuaguaacu

SEQ ID NO: 365833 - RNA, 22 nt, Human
ucccuggacagccuugccuggg

SEQ ID NO: 365834 - RNA, 22 nt, Human
gggcccuggggccugauuugca

SEQ ID NO: 365835 - RNA, 22 nt, Human
uggccuggggaagaccaugggc

SEQ ID NO: 365836 - RNA, 22 nt, Human
acuuugcaauacuuaauacaaa

SEQ ID NO: 365837 - RNA, 22 nt, Human
aggcagggucuugcuauguugc

SEQ ID NO: 365838 - RNA, 22 nt, Human
cagggcaguaccgcccucuggc

SEQ ID NO: 365839 - RNA, 22 nt, Human
acacaaacagucuauagcacca

SEQ ID NO: 365840 - RNA, 22 nt, Human
agaucuauuagcaaacugccau

SEQ ID NO: 365841 - RNA, 22 nt, Human
cccagguguuuguggcagaggu

SEQ ID NO: 365842 - RNA, 19 nt, Human
cuauacagccucugaggaa

SEQ ID NO: 365843 - RNA, 22 nt, Human
gcaggagcccuggcauguucuu

SEQ ID NO: 365844 - RNA, 22 nt, Human
cugcucugacccuuucaccuuc

SEQ ID NO: 365845 - RNA, 22 nt, Human
uaauuucaccguugcuagaaau

SEQ ID NO: 365846 - RNA, 20 nt, Human
ugcucaggauggagaggugu

SEQ ID NO: 365847 - RNA, 22 nt, Human
ucugucaccgagggcauccaaa

SEQ ID NO: 365848 - RNA, 22 nt, Human
acaguggagaagcaaaugcagu

SEQ ID NO: 365849 - RNA, 22 nt, Human
cagaguguugaccauaagccca

SEQ ID NO: 365850 - RNA, 22 nt, Human
guccacauaggaacccagcuuc

SEQ ID NO: 365851 - RNA, 22 nt, Human
agcugaugccauguggaacagu

SEQ ID NO: 365852 - RNA, 22 nt, Human
gccugucugcagggcugucauu

SEQ ID NO: 365853 - RNA, 22 nt, Human
ccaggacuuuaaguccagcacu

SEQ ID NO: 365854 - RNA, 22 nt, Human
agcagaugagccucaugacugg

SEQ ID NO: 365855 - RNA, 22 nt, Human
auucuagaugcuguaaguagca

SEQ ID NO: 365856 - RNA, 22 nt, Human
acaaaauuuuuagacaaggcuu

SEQ ID NO: 365857 - RNA, 22 nt, Human
uuggaucagaugauaucuuugu

SEQ ID NO: 365858 - RNA, 22 nt, Human
uggacagcgaaagugccuggga

SEQ ID NO: 365859 - RNA, 22 nt, Human
uucuuauagaagcaaccauugu

SEQ ID NO: 365860 - RNA, 20 nt, Human
agcagcauuguucuagagca

SEQ ID NO: 365861 - RNA, 22 nt, Human
aagccaguccucuacugggcac

SEQ ID NO: 365862 - RNA, 22 nt, Human
cacugcauggaugauggcugua

SEQ ID NO: 365863 - RNA, 19 nt, Human
ugcauaaauuauauacuuu

SEQ ID NO: 365864 - RNA, 22 nt, Human
uaggaaaagucuagauugauga

SEQ ID NO: 365865 - RNA, 22 nt, Human
ugccacacuccccugcugcagu

SEQ ID NO: 365866 - RNA, 22 nt, Human
ugggaccugcccuggccccauc

SEQ ID NO: 365867 - RNA, 22 nt, Human
aggcacuguggaagacaugguu

SEQ ID NO: 365868 - RNA, 21 nt, Human
gcugcaucaaucuacccaggg

SEQ ID NO: 365869 - RNA, 22 nt, Human
cccaucacagacacuggguuau

SEQ ID NO: 365870 - RNA, 22 nt, Human
aguuggagugaacaugagauug

SEQ ID NO: 365871 - RNA, 21 nt, Human
gaugaagcaaucuuucuguug

SEQ ID NO: 365872 - RNA, 22 nt, Human
gggaccugaggcccugcuccac

SEQ ID NO: 365873 - RNA, 22 nt, Human
cacugcaguaacucuaggacug

SEQ ID NO: 365874 - RNA, 22 nt, Human
aauguacaaggguuccaguuuu

SEQ ID NO: 365875 - RNA, 22 nt, Human
gaaggagcuaaagggagcccug

SEQ ID NO: 365876 - RNA, 17 nt, Human
ggccuuggggccucagu

SEQ ID NO: 365877 - RNA, 22 nt, Human
gcaggcuccaaggccugggaga

SEQ ID NO: 365878 - RNA, 22 nt, Human
uucagaaugugaccuuauuugg

SEQ ID NO: 365879 - RNA, 22 nt, Human
aauuccaaguagcaucccauca

SEQ ID NO: 365880 - RNA, 22 nt, Human
agcagcauacacaucauguuga

SEQ ID NO: 365881 - RNA, 22 nt, Human
ucccagaggcaguugguaacuu

SEQ ID NO: 365882 - RNA, 22 nt, Human
gcagcuuucuuuuugcaugucu

SEQ ID NO: 365883 - RNA, 17 nt, Human
acacagccagguucucc

SEQ ID NO: 365884 - RNA, 22 nt, Human
ucuucaaauccuacagugucug

SEQ ID NO: 365885 - RNA, 23 nt, Human
uauggcuuacagugcuuuaggua

SEQ ID NO: 365886 - RNA, 22 nt, Human
ucaaaaguuucacauagagaua

SEQ ID NO: 365887 - RNA, 22 nt, Human
ggaggccaaggaggagcuugcc

SEQ ID NO: 365888 - RNA, 22 nt, Human
caggcacucauucagagaggug

SEQ ID NO: 365889 - RNA, 22 nt, Human
uugaaucauuacaauagauaag

SEQ ID NO: 365890 - RNA, 22 nt, Human
cugcaggcccccuuccuggagu

SEQ ID NO: 365891 - RNA, 22 nt, Human
caggugccucaggaugagacaa

SEQ ID NO: 365892 - RNA, 22 nt, Human
augccuggacugacaugcacug

SEQ ID NO: 365893 - RNA, 22 nt, Human
cucucugaggcaggccuguggg

SEQ ID NO: 365894 - RNA, 22 nt, Human
acuaagugauucuaagcaucuu

SEQ ID NO: 365895 - RNA, 21 nt, Human
uggcaggcagcuggaagcuug

SEQ ID NO: 365896 - RNA, 22 nt, Human
aagcagugcgcucaucuaaggg

SEQ ID NO: 365897 - RNA, 22 nt, Human
acagggcaugugcaagagacau

SEQ ID NO: 365898 - RNA, 19 nt, Human
uggcagggagugauauuag

SEQ ID NO: 365899 - RNA, 22 nt, Human
uuuaccaaauagauuaugucag

SEQ ID NO: 365900 - RNA, 22 nt, Human
uuaggaaauuaugguuucagau

SEQ ID NO: 365901 - RNA, 22 nt, Human
gaggagaagcuaagaaacacag

SEQ ID NO: 365902 - RNA, 22 nt, Human
gcagccucagggcacucagaug

SEQ ID NO: 365903 - RNA, 22 nt, Human
aauuauccuuaaugcaguaagc

SEQ ID NO: 365904 - RNA, 21 nt, Human
ccuggcugcacaguugcuggu

SEQ ID NO: 365905 - RNA, 22 nt, Human
ccaccaggacagcccugagggg

SEQ ID NO: 365906 - RNA, 22 nt, Human
acugucacuccaacugagucgu

SEQ ID NO: 365907 - RNA, 22 nt, Human
uggcagcuugaaugcagucuuu

SEQ ID NO: 365908 - RNA, 22 nt, Human
ugccuggguucccaccccaaag

SEQ ID NO: 365909 - RNA, 22 nt, Human
cccaggcagccccagaagcuug

SEQ ID NO: 365910 - RNA, 22 nt, Human
aggagagggguaggauuaauuu

SEQ ID NO: 365911 - RNA, 22 nt, Human
guggggcaguggccugggagca

SEQ ID NO: 365912 - RNA, 22 nt, Human
cagggaggaugggcuguuuugc

SEQ ID NO: 365913 - RNA, 22 nt, Human
uuaauuacuaagcacaaugcaa

SEQ ID NO: 365914 - RNA, 22 nt, Human
uccucaggugacuagguaucuu

SEQ ID NO: 365915 - RNA, 19 nt, Human
ggaugagggucaggcauag

SEQ ID NO: 365916 - RNA, 22 nt, Human
auuuacugagguaaauaaacug

SEQ ID NO: 365917 - RNA, 22 nt, Human
uggcacugagcagccgcggcag

SEQ ID NO: 365918 - RNA, 23 nt, Human
gggcuccagucucugcucaguug

SEQ ID NO: 365919 - RNA, 22 nt, Human
cccagcacaggcaauuccauac

SEQ ID NO: 365920 - RNA, 22 nt, Human
cagggccaaguuggugccuuuu

SEQ ID NO: 365921 - RNA, 22 nt, Human
gggccaugagagguucaucaac

SEQ ID NO: 365922 - RNA, 22 nt, Human
gagggagggacuagcauucucu

SEQ ID NO: 365923 - RNA, 22 nt, Human
ggugcccaccugucuuccugga

SEQ ID NO: 365924 - RNA, 22 nt, Human
auuugcuugugcuaugaaaguu

SEQ ID NO: 365925 - RNA, 22 nt, Human
ugggcucugaagucagucugcu

SEQ ID NO: 365926 - RNA, 22 nt, Human
cuuagggagaaugccucugcag

SEQ ID NO: 365927 - RNA, 22 nt, Human
ggcacugagcugccuuggggca

SEQ ID NO: 365928 - RNA, 22 nt, Human
cucaggauccaucuccugcccu

SEQ ID NO: 365929 - RNA, 22 nt, Human
ucacaccuguaaucccaggccu

SEQ ID NO: 365930 - RNA, 22 nt, Human
caggcagcucgaugccuuguug

SEQ ID NO: 365931 - RNA, 19 nt, Human
ugagagugaggaaggcuuc

SEQ ID NO: 365932 - RNA, 22 nt, Human
gggcacugcuggaggcucccug

SEQ ID NO: 365933 - RNA, 22 nt, Human
gagugaaaaaggaagggccaua

SEQ ID NO: 365934 - RNA, 22 nt, Human
cauggcuuuguucauauaauuu

SEQ ID NO: 365935 - RNA, 22 nt, Human
uaguuacagcaggcaggauaua

SEQ ID NO: 365936 - RNA, 20 nt, Human
aauuuacucacagaaugaau

SEQ ID NO: 365937 - RNA, 22 nt, Human
ccaggagucaauaaaggaagcu

SEQ ID NO: 365938 - RNA, 22 nt, Human
uguuaacaucuuggacucguga

SEQ ID NO: 365939 - RNA, 22 nt, Human
cauuuacauuuaagguuaauau

SEQ ID NO: 365940 - RNA, 22 nt, Human
agcugauuccacuuuuucccca

SEQ ID NO: 365941 - RNA, 21 nt, Human
agggagcuauuuauaguaagc

SEQ ID NO: 365942 - RNA, 22 nt, Human
uuggcaguaaaagaaaaugcuu

SEQ ID NO: 365943 - RNA, 20 nt, Human
aagauucauuguaauuaggg

SEQ ID NO: 365944 - RNA, 22 nt, Human
acuccuggguugcaguccucaa

SEQ ID NO: 365945 - RNA, 22 nt, Human
gcaaagcauucuguggagucua

SEQ ID NO: 365946 - RNA, 22 nt, Human
gggcaugagaggcaggcaagug

SEQ ID NO: 365947 - RNA, 22 nt, Human
aggcagagaaaaaccagauaug

SEQ ID NO: 365948 - RNA, 23 nt, Human
ugucauugugacuacagaaccag

SEQ ID NO: 365949 - RNA, 22 nt, Human
cagagaaagggugaauuccuuc

SEQ ID NO: 365950 - RNA, 22 nt, Human
caagaacauugugaucacuuca

SEQ ID NO: 365951 - RNA, 22 nt, Human
ccagcugcaggggagcagugga

SEQ ID NO: 365952 - RNA, 22 nt, Human
gagguggccucaagcagucuuc

SEQ ID NO: 365953 - RNA, 22 nt, Human
ccuuaaaagaacuaucucuucu

SEQ ID NO: 365954 - RNA, 22 nt, Human
acuggcagagacccugauggcc

SEQ ID NO: 365955 - RNA, 22 nt, Human
aacauaaauuugaaguggcaaa

SEQ ID NO: 365956 - RNA, 22 nt, Human
ucucuuauuuugccuuugacaa

SEQ ID NO: 365957 - RNA, 22 nt, Human
uccuggccucacaguccugggu

SEQ ID NO: 365958 - RNA, 22 nt, Human
uaaguccuucaccuaauccuca

SEQ ID NO: 365959 - RNA, 22 nt, Human
gccugguggacacugggcauca

SEQ ID NO: 365960 - RNA, 22 nt, Human
uggcugaguuacgaacagagca

SEQ ID NO: 365961 - RNA, 22 nt, Human
acagcagcuggguucccaccau

SEQ ID NO: 365962 - RNA, 22 nt, Human
aggcucagucccggcccgcgcc

SEQ ID NO: 365963 - RNA, 22 nt, Human
ucccagccggugccuggguccc

SEQ ID NO: 365964 - RNA, 22 nt, Human
ccagagcugcauccagcagguu

SEQ ID NO: 365965 - RNA, 22 nt, Human
ucccagcagcauagcucagaau

SEQ ID NO: 365966 - RNA, 22 nt, Human
uagcucuucauuucaucugauu

SEQ ID NO: 365967 - RNA, 22 nt, Human
agggggcaggagagaccugcug

SEQ ID NO: 365968 - RNA, 17 nt, Human
agaggcagauacuugga

SEQ ID NO: 365969 - RNA, 22 nt, Human
gucaggaucaaauugaaguuau

SEQ ID NO: 365970 - RNA, 22 nt, Human
agagcuuauaucuuggccaucc

SEQ ID NO: 365971 - RNA, 22 nt, Human
gggcugcuuuuaagggucucag

SEQ ID NO: 365972 - RNA, 19 nt, Human
ggagaggcuggagggaugc

SEQ ID NO: 365973 - RNA, 22 nt, Human
uuucucugaggcuggccucccu

SEQ ID NO: 365974 - RNA, 19 nt, Human
caaggguugggucugucau

SEQ ID NO: 365975 - RNA, 22 nt, Human
cgggcuccgggucuuugcaguc

SEQ ID NO: 365976 - RNA, 22 nt, Human
ugauuuccucuacuagcaauua

SEQ ID NO: 365977 - RNA, 22 nt, Human
guucuucagucacaucacagaa

SEQ ID NO: 365978 - RNA, 22 nt, Human
ucaggagaaucagggcuguccu

SEQ ID NO: 365979 - RNA, 22 nt, Human
cauuuguauguuccuccuuagg

SEQ ID NO: 365980 - RNA, 22 nt, Human
cccauucauccucgcuuccuuc

SEQ ID NO: 365981 - RNA, 22 nt, Human
agucucuuauucccuauugcug

SEQ ID NO: 365982 - RNA, 22 nt, Human
agcugcucuuugaaggacacuu

SEQ ID NO: 365983 - RNA, 23 nt, Human
uugcauguagcccaugaguaacu

SEQ ID NO: 365984 - RNA, 22 nt, Human
cacugaagccacuggaagagga

SEQ ID NO: 365985 - RNA, 22 nt, Human
auuuuacuuugugaauauugac

SEQ ID NO: 365986 - RNA, 22 nt, Human
augugucuuugagacucugcua

SEQ ID NO: 365987 - RNA, 22 nt, Human
ugaacaguuucaagaaaacuuu

SEQ ID NO: 365988 - RNA, 22 nt, Human
ucagagaaguaagguggggugc

SEQ ID NO: 365989 - RNA, 22 nt, Human
ucacguuuuacugagugagaua

SEQ ID NO: 365990 - RNA, 22 nt, Human
augaaaauguacauguguauaa

SEQ ID NO: 365991 - RNA, 22 nt, Human
gcaaggcugagcacauuugcau

SEQ ID NO: 365992 - RNA, 20 nt, Human
agaagucagcucagaaguga

SEQ ID NO: 365993 - RNA, 22 nt, Human
uccaggcagcccuuccugacuc

SEQ ID NO: 365994 - RNA, 22 nt, Human
aaagaacaaauuagcuguuuua

SEQ ID NO: 365995 - RNA, 22 nt, Human
uuuacagaucuguugauuuguu

SEQ ID NO: 365996 - RNA, 22 nt, Human
auuuagccucauuuuugacaua

SEQ ID NO: 365997 - RNA, 22 nt, Human
uuaaagaauagugccccuauug

SEQ ID NO: 365998 - RNA, 22 nt, Human
ucuuagaaguuuauggcacgga

SEQ ID NO: 365999 - RNA, 22 nt, Human
uggagcaggugggaugucguga

SEQ ID NO: 366000 - RNA, 22 nt, Human
agggcgacaauggagagcguuu

SEQ ID NO: 366001 - RNA, 22 nt, Human
ggcuggcuuucucuccgcaccu

SEQ ID NO: 366002 - RNA, 22 nt, Human
aguauacauauauuagccuucg

SEQ ID NO: 366003 - RNA, 22 nt, Human
agcugucucugguauuauguga

SEQ ID NO: 366004 - RNA, 22 nt, Human
cagguacauucguagacccauu

SEQ ID NO: 366005 - RNA, 22 nt, Human
guagggagcccagagcccagug

SEQ ID NO: 366006 - RNA, 22 nt, Human
ccccuuccacagugcuuccuaa

SEQ ID NO: 366007 - RNA, 20 nt, Human
accuuucaaaugauucagca

SEQ ID NO: 366008 - RNA, 22 nt, Human
ucagccaguugccccaguuagu

SEQ ID NO: 366009 - RNA, 22 nt, Human
agcacagguacggagaugcuac

SEQ ID NO: 366010 - RNA, 22 nt, Human
cagcugugggccugacguggca

SEQ ID NO: 366011 - RNA, 22 nt, Human
cagugguggaaugaggaauugu

SEQ ID NO: 366012 - RNA, 22 nt, Human
cauuugaaauaguucauucuug

SEQ ID NO: 366013 - RNA, 22 nt, Human
acugucuuccaggucuggaggu

SEQ ID NO: 366014 - RNA, 22 nt, Human
uucuguuuuagaaauaaguagu

SEQ ID NO: 366015 - RNA, 21 nt, Human
gugcucugggcagcagagggc

SEQ ID NO: 366016 - RNA, 22 nt, Human
gggcagugucggggcccaggga

SEQ ID NO: 366017 - RNA, 22 nt, Human
gccaggcaauguguuagaagcg

SEQ ID NO: 366018 - RNA, 19 nt, Human
cuguggcugaccucuggcc

SEQ ID NO: 366019 - RNA, 22 nt, Human
auguuucaaauauauagaguug

SEQ ID NO: 366020 - RNA, 22 nt, Human
uuucagauggagguuuaggaca

SEQ ID NO: 366021 - RNA, 22 nt, Human
cugggacagcugagacaggaga

SEQ ID NO: 366022 - RNA, 22 nt, Human
ugacccauggucugaucauagg

SEQ ID NO: 366023 - RNA, 22 nt, Human
agggucagagaucggccaugug

SEQ ID NO: 366024 - RNA, 22 nt, Human
ugaggcuuagagaagaugggau

SEQ ID NO: 366025 - RNA, 22 nt, Human
agucaccaucuguggcagccug

SEQ ID NO: 366026 - RNA, 22 nt, Human
cucccaggggaacuaucaagua

SEQ ID NO: 366027 - RNA, 23 nt, Human
gccauggcugccccacaggccuc

SEQ ID NO: 366028 - RNA, 22 nt, Human
cuguacaaguccuucaucaggg

SEQ ID NO: 366029 - RNA, 22 nt, Human
aauaugcauguauacaugugua

SEQ ID NO: 366030 - RNA, 22 nt, Human
ugcccacaggaagacaccagcg

SEQ ID NO: 366031 - RNA, 22 nt, Human
gcccaggaguugaaugcagcag

SEQ ID NO: 366032 - RNA, 22 nt, Human
gaggaaugucagcacaggccuc

SEQ ID NO: 366033 - RNA, 22 nt, Human
gcagcuggucuggccuagagua

SEQ ID NO: 366034 - RNA, 22 nt, Human
agggcagagauuaauuaagaca

SEQ ID NO: 366035 - RNA, 22 nt, Human
acugaaauacugcucuuggauu

SEQ ID NO: 366036 - RNA, 22 nt, Human
uggccuuggacagagcgcuccu

SEQ ID NO: 366037 - RNA, 22 nt, Human
gcugugcacuaccuauacaucc

SEQ ID NO: 366038 - RNA, 22 nt, Human
uuugaauagaggccccucagaa

SEQ ID NO: 366039 - RNA, 22 nt, Human
aaggggaaguagcaccagaggu

SEQ ID NO: 366040 - RNA, 22 nt, Human
ucugggcagcagcagcuaguag

SEQ ID NO: 366041 - RNA, 23 nt, Human
uucauuugucuacuucacuuguu

SEQ ID NO: 366042 - RNA, 22 nt, Human
uguuauugagguuacuuauaag

SEQ ID NO: 366043 - RNA, 22 nt, Human
gggagaagaaugugucaauugu

SEQ ID NO: 366044 - RNA, 22 nt, Human
gggaguggauuauguggaccca

SEQ ID NO: 366045 - RNA, 22 nt, Human
ccugggcaacauagugagaccu

SEQ ID NO: 366046 - RNA, 22 nt, Human
uaaguccuggcugguuugaagc

SEQ ID NO: 366047 - RNA, 22 nt, Human
uggccuggaaaaaugcagaugg

SEQ ID NO: 366048 - RNA, 22 nt, Human
ucugaggccccugggcaggaug

SEQ ID NO: 366049 - RNA, 22 nt, Human
agcagagucugugugcacuuua

SEQ ID NO: 366050 - RNA, 22 nt, Human
uuucuguauuuaaaagaucugg

SEQ ID NO: 366051 - RNA, 20 nt, Human
ugggccuguggcagaagucu

SEQ ID NO: 366052 - RNA, 22 nt, Human
uggccucugcaauggauucacc

SEQ ID NO: 366053 - RNA, 22 nt, Human
gaggcagcagaacauggaagag

SEQ ID NO: 366054 - RNA, 22 nt, Human
ucagagugaggcccagcaaucu

SEQ ID NO: 366055 - RNA, 22 nt, Human
uucauaguguuuccuuccagug

SEQ ID NO: 366056 - RNA, 22 nt, Human
cucacagaugcugugggucagg

SEQ ID NO: 366057 - RNA, 22 nt, Human
cacagaagaaucaugcuguguu

SEQ ID NO: 366058 - RNA, 22 nt, Human
ugcaguggcgccaucucagcuc

SEQ ID NO: 366059 - RNA, 22 nt, Human
aaaugcagguaguauuuauuuu

SEQ ID NO: 366060 - RNA, 22 nt, Human
aaagauaauguuuccuuauucu

SEQ ID NO: 366061 - RNA, 22 nt, Human
gagcuuggugaugccuccuggu

SEQ ID NO: 366062 - RNA, 20 nt, Human
cugcccagccacugagggau

SEQ ID NO: 366063 - RNA, 20 nt, Human
cagcucugggaaagaggcca

SEQ ID NO: 366064 - RNA, 22 nt, Human
ugcucugcaagcaggagcaaga

SEQ ID NO: 366065 - RNA, 22 nt, Human
uugguccacugugaaauuggga

SEQ ID NO: 366066 - RNA, 19 nt, Human
agugaaauggaguauucaa

SEQ ID NO: 366067 - RNA, 22 nt, Human
gcagcuguggguuccaagucua

SEQ ID NO: 366068 - RNA, 22 nt, Human
ccugagagcagcuuccugcuua

SEQ ID NO: 366069 - RNA, 22 nt, Human
cuggugcuggagccuagucccu

SEQ ID NO: 366070 - RNA, 22 nt, Human
aaugguuugauggacaaaauga

SEQ ID NO: 366071 - RNA, 22 nt, Human
aagcuuccugaaugcucauuua

SEQ ID NO: 366072 - RNA, 22 nt, Human
gccauuuucugucuuguuuauu

SEQ ID NO: 366073 - RNA, 22 nt, Human
auugucuguacuuuaaaaaugu

SEQ ID NO: 366074 - RNA, 22 nt, Human
cacagcuggugacagagcccag

SEQ ID NO: 366075 - RNA, 22 nt, Human
cuggcuugcagcucaucauaaa

SEQ ID NO: 366076 - RNA, 22 nt, Human
gagagcuggguucaaguagcug

SEQ ID NO: 366077 - RNA, 22 nt, Human
uggcacuggaaucguagccuug

SEQ ID NO: 366078 - RNA, 22 nt, Human
gcccauggacacccaagugcca

SEQ ID NO: 366079 - RNA, 23 nt, Human
ugggaguguugggaucucugcuc

SEQ ID NO: 366080 - RNA, 22 nt, Human
cccaaggaagacgcuugugaua

SEQ ID NO: 366081 - RNA, 17 nt, Human
agcugagcuggccaggg

SEQ ID NO: 366082 - RNA, 17 nt, Human
ccaggugggaggugggg

SEQ ID NO: 366083 - RNA, 22 nt, Human
ggagcugggacccugucaucug

SEQ ID NO: 366084 - RNA, 22 nt, Human
uuccucuccucccaccagguga

SEQ ID NO: 366085 - RNA, 22 nt, Human
uuuuucagccaugaauuacacu

SEQ ID NO: 366086 - RNA, 22 nt, Human
ucaaauaccagcuuuuccagaa

SEQ ID NO: 366087 - RNA, 22 nt, Human
gagcugugagggacacauugcu

SEQ ID NO: 366088 - RNA, 22 nt, Human
gacagcuguggagaggcaugug

SEQ ID NO: 366089 - RNA, 22 nt, Human
cuuagaaaucgaacucagguua

SEQ ID NO: 366090 - RNA, 22 nt, Human
aagggcucgguagcaguccuga

SEQ ID NO: 366091 - RNA, 22 nt, Human
ugcauugcaguuaacucaguau

SEQ ID NO: 366092 - RNA, 22 nt, Human
gaagcacauggcuauagcuauu

SEQ ID NO: 366093 - RNA, 22 nt, Human
uuaaauauuuucagcaggguca

SEQ ID NO: 366094 - RNA, 20 nt, Human
uccugguggauacugcuuaa

SEQ ID NO: 366095 - RNA, 22 nt, Human
cauaucccauuggccaggacau

SEQ ID NO: 366096 - RNA, 22 nt, Human
ugggagcugggguuggacgucu

SEQ ID NO: 366097 - RNA, 22 nt, Human
aucagaaaaacauaauguuauu

SEQ ID NO: 366098 - RNA, 22 nt, Human
agcugcccuuuaugaugcugaa

SEQ ID NO: 366099 - RNA, 22 nt, Human
augauugaaaaugacauugcca

SEQ ID NO: 366100 - RNA, 20 nt, Human
ucaggcaguggggaaaggca

SEQ ID NO: 366101 - RNA, 22 nt, Human
ccaggugugauuuggcaguguc

SEQ ID NO: 366102 - RNA, 22 nt, Human
auuuggaaaugcaucucuugag

SEQ ID NO: 366103 - RNA, 22 nt, Human
ucucccaggcuggagugcagug

SEQ ID NO: 366104 - RNA, 22 nt, Human
ucaucaguguccuuaucacuua

SEQ ID NO: 366105 - RNA, 23 nt, Human
uuucaaauuacucugcagaugac

SEQ ID NO: 366106 - RNA, 22 nt, Human
gcaagcaagcagguagagcuga

SEQ ID NO: 366107 - RNA, 22 nt, Human
cugugccaggcccagcugacuu

SEQ ID NO: 366108 - RNA, 19 nt, Human
uugaaagauuagcuuucua

SEQ ID NO: 366109 - RNA, 22 nt, Human
uacuuuaaaaacugauaauuca

SEQ ID NO: 366110 - RNA, 22 nt, Human
cuuaaacugaaagcuacaagau

SEQ ID NO: 366111 - RNA, 22 nt, Human
gcuucccacagcuggacugggg

SEQ ID NO: 366112 - RNA, 22 nt, Human
aaaugugucaguuucauucucu

SEQ ID NO: 366113 - RNA, 22 nt, Human
cgcugccaggauccccugccgg

SEQ ID NO: 366114 - RNA, 22 nt, Human
uaacugauauugaaaaacauca

SEQ ID NO: 366115 - RNA, 22 nt, Human
agcuggccuccgggugccuggg

SEQ ID NO: 366116 - RNA, 23 nt, Human
uccagcagagccuuccaggaggg

SEQ ID NO: 366117 - RNA, 22 nt, Human
ccagugcacagccaggcaggug

SEQ ID NO: 366118 - RNA, 22 nt, Human
aauuuggcagugucuugaagua

SEQ ID NO: 366119 - RNA, 22 nt, Human
cagaggaaaugggaaggagaua

SEQ ID NO: 366120 - RNA, 18 nt, Human
agcuggcccuggcugccg

SEQ ID NO: 366121 - RNA, 22 nt, Human
ucucagagauucagggagaagu

SEQ ID NO: 366122 - RNA, 22 nt, Human
gcauuuccugugcuuggcauau

SEQ ID NO: 366123 - RNA, 22 nt, Human
caguguuuguauagaauaugca

SEQ ID NO: 366124 - RNA, 22 nt, Human
aucaggaucacugggagucuug

SEQ ID NO: 366125 - RNA, 22 nt, Human
ugcauguuaagaaaauauugag

SEQ ID NO: 366126 - RNA, 22 nt, Human
cugccaucugagccaaaagugc

SEQ ID NO: 366127 - RNA, 22 nt, Human
gggccccuuguaucucuggcuc

SEQ ID NO: 366128 - RNA, 22 nt, Human
cacaaauggccguguucaaaga

SEQ ID NO: 366129 - RNA, 22 nt, Human
cccuuccucccaggcuucugug

SEQ ID NO: 366130 - RNA, 22 nt, Human
auugugcaaauauuaucuguag

SEQ ID NO: 366131 - RNA, 22 nt, Human
cacagcuggggaagcugaggcc

SEQ ID NO: 366132 - RNA, 22 nt, Human
uucauauaaauggaaucagaau

SEQ ID NO: 366133 - RNA, 22 nt, Human
aggccuuaccauagcuguagca

SEQ ID NO: 366134 - RNA, 22 nt, Human
uuucuggcagcgggacaggggu

SEQ ID NO: 366135 - RNA, 22 nt, Human
uggcuguguuaccacuucaugu

SEQ ID NO: 366136 - RNA, 22 nt, Human
gcccuggccuucaucucagaca

SEQ ID NO: 366137 - RNA, 22 nt, Human
accccagcccugcuucugggag

SEQ ID NO: 366138 - RNA, 22 nt, Human
uaauuucuggagggagaaagag

SEQ ID NO: 366139 - RNA, 22 nt, Human
ccuggaaguuggagguugcagu

SEQ ID NO: 366140 - RNA, 22 nt, Human
aggcugcaggucugggucaugu

SEQ ID NO: 366141 - RNA, 22 nt, Human
acuggcaguuugagaaugcauu

SEQ ID NO: 366142 - RNA, 22 nt, Human
aaguaaaauguuuccuuuauua

SEQ ID NO: 366143 - RNA, 22 nt, Human
uaguccuuuaucaaacauuuau

SEQ ID NO: 366144 - RNA, 22 nt, Human
ucagcuuuuaaaaacaagaagu

SEQ ID NO: 366145 - RNA, 22 nt, Human
ggaaggaggggcaaagcaguuc

SEQ ID NO: 366146 - RNA, 22 nt, Human
acaguaaaaagccuuagaauuu

SEQ ID NO: 366147 - RNA, 21 nt, Human
agaauaaugguaucauuugcu

SEQ ID NO: 366148 - RNA, 22 nt, Human
ugugucagagguagagauggca

SEQ ID NO: 366149 - RNA, 22 nt, Human
cgcuggccauagccuccugugu

SEQ ID NO: 366150 - RNA, 22 nt, Human
ugguuugcccacucgagugauu

SEQ ID NO: 366151 - RNA, 22 nt, Human
aggggagcuaacaccagagccc

SEQ ID NO: 366152 - RNA, 22 nt, Human
cucuggaguucucaugaggaac

SEQ ID NO: 366153 - RNA, 22 nt, Human
cuuaagaugaggucaugcuaua

SEQ ID NO: 366154 - RNA, 22 nt, Human
uguacaguauauuucaaagcca

SEQ ID NO: 366155 - RNA, 22 nt, Human
ucaagugcuugugagguauuug

SEQ ID NO: 366156 - RNA, 22 nt, Human
agaaauguacgauguuaugcag

SEQ ID NO: 366157 - RNA, 22 nt, Human
uugucugucccagcuugugcau

SEQ ID NO: 366158 - RNA, 22 nt, Human
gcagggacgccagggacagcaa

SEQ ID NO: 366159 - RNA, 22 nt, Human
gugacagucaaagacaugacuu

SEQ ID NO: 366160 - RNA, 22 nt, Human
uuagaaauacaagugagguuga

SEQ ID NO: 366161 - RNA, 22 nt, Human
ucaggcugcuguacugugaaug

SEQ ID NO: 366162 - RNA, 22 nt, Human
acguuuucuagagaauaugcag

SEQ ID NO: 366163 - RNA, 22 nt, Human
cuccucuuuacccgcauggucu

SEQ ID NO: 366164 - RNA, 22 nt, Human
caaggccagggaauuuuucugg

SEQ ID NO: 366165 - RNA, 22 nt, Human
acccaggguagagugcaguggc

SEQ ID NO: 366166 - RNA, 21 nt, Human
aagccucaagcagaagacaga

SEQ ID NO: 366167 - RNA, 22 nt, Human
uagucaccagcuacaggacagc

SEQ ID NO: 366168 - RNA, 22 nt, Human
cuggagcccaggccuggugucu

SEQ ID NO: 366169 - RNA, 22 nt, Human
augcuguguggucaaguuaauu

SEQ ID NO: 366170 - RNA, 21 nt, Human
uguggcagauguugggaggca

SEQ ID NO: 366171 - RNA, 22 nt, Human
ccucagccuuggccccaggcag

SEQ ID NO: 366172 - RNA, 22 nt, Human
uggaagcagugauucuugucug

SEQ ID NO: 366173 - RNA, 22 nt, Human
aagaugauguuguguuuucacu

SEQ ID NO: 366174 - RNA, 22 nt, Human
uuuaacagaugcuaugucuacc

SEQ ID NO: 366175 - RNA, 22 nt, Human
ucugucucaaguucuugcacuc

SEQ ID NO: 366176 - RNA, 22 nt, Human
ucugcagggaugugagggguga

SEQ ID NO: 366177 - RNA, 22 nt, Human
gcccaggaaauaaaagugggcu

SEQ ID NO: 366178 - RNA, 22 nt, Human
uaaguccuaacagacugggggc

SEQ ID NO: 366179 - RNA, 23 nt, Human
guggagccacaucacaggcuccu

SEQ ID NO: 366180 - RNA, 22 nt, Human
ugcuuaauguacgugaguguac

SEQ ID NO: 366181 - RNA, 22 nt, Human
aagagagagcauucuucuguua

SEQ ID NO: 366182 - RNA, 19 nt, Human
cccaggaggcggagguugc

SEQ ID NO: 366183 - RNA, 22 nt, Human
ucccagggacugggcuaggcuu

SEQ ID NO: 366184 - RNA, 22 nt, Human
gcucugggcugcccucuggaca

SEQ ID NO: 366185 - RNA, 22 nt, Human
uagaaaucagguuuuuagaaag

SEQ ID NO: 366186 - RNA, 22 nt, Human
agcugccugcuuaugagcucca

SEQ ID NO: 366187 - RNA, 22 nt, Human
agacuuugagcucuuagagaag

SEQ ID NO: 366188 - RNA, 22 nt, Human
gagcuuuaggagaaggagguca

SEQ ID NO: 366189 - RNA, 22 nt, Human
uuugcuuguucaagauuucugu

SEQ ID NO: 366190 - RNA, 22 nt, Human
agcugagccagcagcaacagga

SEQ ID NO: 366191 - RNA, 22 nt, Human
gggaaauugucaacacucucaa

SEQ ID NO: 366192 - RNA, 22 nt, Human
ugcccaaguguuuggcugaguc

SEQ ID NO: 366193 - RNA, 22 nt, Human
ucuggccuauuucugucagauc

SEQ ID NO: 366194 - RNA, 22 nt, Human
cuggcucagugccuucagaagu

SEQ ID NO: 366195 - RNA, 22 nt, Human
aggguagggccguagggccaug

SEQ ID NO: 366196 - RNA, 22 nt, Human
ucugccagaaguucugagagua

SEQ ID NO: 366197 - RNA, 22 nt, Human
acucccacuccagaguagaagc

SEQ ID NO: 366198 - RNA, 22 nt, Human
gaggcagugucgguggcaggau

SEQ ID NO: 366199 - RNA, 22 nt, Human
ccugugugucugucacugcaca

SEQ ID NO: 366200 - RNA, 22 nt, Human
agccauugaguuuuaugugcua

SEQ ID NO: 366201 - RNA, 22 nt, Human
cugagcccaggcgggagcugag

SEQ ID NO: 366202 - RNA, 22 nt, Human
ugucccaguuuaucugggacug

SEQ ID NO: 366203 - RNA, 22 nt, Human
uagcuguguaagcuugguaaga

SEQ ID NO: 366204 - RNA, 21 nt, Human
ugcccacagcaaaugcagagg

SEQ ID NO: 366205 - RNA, 16 nt, Human
ccuuucucugccuucc

SEQ ID NO: 366206 - RNA, 22 nt, Human
gucucuuuuauggugaguugau

SEQ ID NO: 366207 - RNA, 22 nt, Human
cuucagagugcagaagauuggg

SEQ ID NO: 366208 - RNA, 23 nt, Human
cuugcaggaagcagauggcacac

SEQ ID NO: 366209 - RNA, 22 nt, Human
agcauuuauuucuuagaaauug

SEQ ID NO: 366210 - RNA, 22 nt, Human
aauggcugccagggcaggaggu

SEQ ID NO: 366211 - RNA, 22 nt, Human
uagaugaccuuguguuaggcaa

SEQ ID NO: 366212 - RNA, 22 nt, Human
uuccucuccucacaugagucac

SEQ ID NO: 366213 - RNA, 22 nt, Human
ggagccaguauuuaguggucuu

SEQ ID NO: 366214 - RNA, 22 nt, Human
cagucucuugcuucauuaguug

SEQ ID NO: 366215 - RNA, 20 nt, Human
uggccuuuaaauaguauucc

SEQ ID NO: 366216 - RNA, 22 nt, Human
gggaccugcgccacucacuguc

SEQ ID NO: 366217 - RNA, 22 nt, Human
uugaauaaaugagcagugaauu

SEQ ID NO: 366218 - RNA, 22 nt, Human
caagaugaaacuacagggagga

SEQ ID NO: 366219 - RNA, 22 nt, Human
agccccaggcccggacgccucu

SEQ ID NO: 366220 - RNA, 22 nt, Human
ugaaguuauauauguugaaaau

SEQ ID NO: 366221 - RNA, 22 nt, Human
ccuccaggcugaauaucuagaa

SEQ ID NO: 366222 - RNA, 22 nt, Human
agaauuagaggccauguacuug

SEQ ID NO: 366223 - RNA, 22 nt, Human
ccugagaccaaguugcagccau

SEQ ID NO: 366224 - RNA, 22 nt, Human
aaacugaauucccaagggcaug

SEQ ID NO: 366225 - RNA, 20 nt, Human
gaaauucucguauuaguuua

SEQ ID NO: 366226 - RNA, 22 nt, Human
guuuauaaggcccaauauuucu

SEQ ID NO: 366227 - RNA, 22 nt, Human
accuuuuuucagaacucuaaag

SEQ ID NO: 366228 - RNA, 22 nt, Human
uuacauuuuaguuaaccuguga

SEQ ID NO: 366229 - RNA, 22 nt, Human
uaaaauguagcuucuaggcugg

SEQ ID NO: 366230 - RNA, 22 nt, Human
uauucacauucucaggccuggu

SEQ ID NO: 366231 - RNA, 22 nt, Human
ugagacaguucugcagcugggu

SEQ ID NO: 366232 - RNA, 22 nt, Human
guagggacaugccauuaucuca

SEQ ID NO: 366233 - RNA, 22 nt, Human
ggcucuggcguccaauggagcg

SEQ ID NO: 366234 - RNA, 23 nt, Human
auugaugacuugauuacacuuuu

SEQ ID NO: 366235 - RNA, 22 nt, Human
aagggagguaaagcuauuuaaa

SEQ ID NO: 366236 - RNA, 22 nt, Human
uggccacagccucugccaguuc

SEQ ID NO: 366237 - RNA, 22 nt, Human
cccagcuucugagggggccuug

SEQ ID NO: 366238 - RNA, 22 nt, Human
aagagcuggaguuugcagcccu

SEQ ID NO: 366239 - RNA, 22 nt, Human
aguacuuuacuucuuacaguuu

SEQ ID NO: 366240 - RNA, 22 nt, Human
ggcuuccuaauacucccuacac

SEQ ID NO: 366241 - RNA, 22 nt, Human
ugaggaggucagagucuggcug

SEQ ID NO: 366242 - RNA, 22 nt, Human
cagggcagugaagaacacacgu

SEQ ID NO: 366243 - RNA, 22 nt, Human
guaaucucagcuacuugggagg

SEQ ID NO: 366244 - RNA, 22 nt, Human
gccugucucuuggaacuuggua

SEQ ID NO: 366245 - RNA, 22 nt, Human
gcucccacgcaauucuuuucag

SEQ ID NO: 366246 - RNA, 22 nt, Human
ugggaggaaugucacugagcca

SEQ ID NO: 366247 - RNA, 22 nt, Human
uuagggcuuuucugaauaggcc

SEQ ID NO: 366248 - RNA, 22 nt, Human
ugcuuaauagugcacugguuuc

SEQ ID NO: 366249 - RNA, 22 nt, Human
agaggcagccguauuucaaagg

SEQ ID NO: 366250 - RNA, 22 nt, Human
cagugguuauacuuacuguuuc

SEQ ID NO: 366251 - RNA, 22 nt, Human
cucugguucagggcucccuggc

SEQ ID NO: 366252 - RNA, 22 nt, Human
caaagugcuggaauuacaggug

SEQ ID NO: 366253 - RNA, 22 nt, Human
agaggaugguugaggaagaccu

SEQ ID NO: 366254 - RNA, 21 nt, Human
aacaaagggaugcucaucuuu

SEQ ID NO: 366255 - RNA, 22 nt, Human
uggcauuuucuccuuugaguuu

SEQ ID NO: 366256 - RNA, 22 nt, Human
agcagcauguucauuacauuau

SEQ ID NO: 366257 - RNA, 21 nt, Human
uaucagaagagaaagaaugau

SEQ ID NO: 366258 - RNA, 22 nt, Human
aaucuucauuuugacaagauuc

SEQ ID NO: 366259 - RNA, 22 nt, Human
gagacagaguuucacucuuguu

SEQ ID NO: 366260 - RNA, 22 nt, Human
gagcagaugugugccaggaugc

SEQ ID NO: 366261 - RNA, 23 nt, Human
auguauuuaaauuucagugauga

SEQ ID NO: 366262 - RNA, 22 nt, Human
ugcuuuauguggcugauacuca

SEQ ID NO: 366263 - RNA, 22 nt, Human
ugagccagaggaggcugugugg

SEQ ID NO: 366264 - RNA, 22 nt, Human
aguuuccaaauauuguuuuagc

SEQ ID NO: 366265 - RNA, 22 nt, Human
gcugguccacucccuggaggcu

SEQ ID NO: 366266 - RNA, 22 nt, Human
cagcugccacaccucuuucucu

SEQ ID NO: 366267 - RNA, 22 nt, Human
aggcaggcccucuggaaaggua

SEQ ID NO: 366268 - RNA, 22 nt, Human
ccuggcagaauauuaaagugca

SEQ ID NO: 366269 - RNA, 22 nt, Human
ugcagcucauugguguccuggu

SEQ ID NO: 366270 - RNA, 22 nt, Human
agaggcugaaugaugucaucau

SEQ ID NO: 366271 - RNA, 22 nt, Human
cuguucacacacuuguacucuc

SEQ ID NO: 366272 - RNA, 22 nt, Human
gugcagcagggggaagacagug

SEQ ID NO: 366273 - RNA, 22 nt, Human
agcauugccugccuauugcuaa

SEQ ID NO: 366274 - RNA, 19 nt, Human
cagaccuguccagccugug

SEQ ID NO: 366275 - RNA, 22 nt, Human
cccaggcacacugaagugacau

SEQ ID NO: 366276 - RNA, 22 nt, Human
ggguggagcuuggacaccagua

SEQ ID NO: 366277 - RNA, 22 nt, Human
ggcacugggcaccggcugaggg

SEQ ID NO: 366278 - RNA, 20 nt, Human
aagggagaauaaugauugua

SEQ ID NO: 366279 - RNA, 22 nt, Human
augguuuacaauguuuucaguu

SEQ ID NO: 366280 - RNA, 22 nt, Human
ugucuucagcaaaugccuuucu

SEQ ID NO: 366281 - RNA, 22 nt, Human
gcaucuaauccaguccagcauc

SEQ ID NO: 366282 - RNA, 22 nt, Human
ucuuuaauaucugccccagagc

SEQ ID NO: 366283 - RNA, 22 nt, Human
uggccuggugucugcgaggccu

SEQ ID NO: 366284 - RNA, 22 nt, Human
uaguccuuuccggcugcuauaa

SEQ ID NO: 366285 - RNA, 20 nt, Human
gcugaggucauuaugccuca

SEQ ID NO: 366286 - RNA, 22 nt, Human
aauggacaggagagcauaguca

SEQ ID NO: 366287 - RNA, 22 nt, Human
uuggcagugucugcaaaaugga

SEQ ID NO: 366288 - RNA, 22 nt, Human
cuccaggcucguccaagaucga

SEQ ID NO: 366289 - RNA, 22 nt, Human
cugcgcagggguggcgccagaa

SEQ ID NO: 366290 - RNA, 22 nt, Human
aagaaauauugggccuuauaaa

SEQ ID NO: 366291 - RNA, 22 nt, Human
cugcuucuaagaaccugcagcu

SEQ ID NO: 366292 - RNA, 22 nt, Human
aaaaguaauugcaauuuuguag

SEQ ID NO: 366293 - RNA, 23 nt, Human
agaauuguaaauagaauauaccu

SEQ ID NO: 366294 - RNA, 22 nt, Human
ccuuguccucugguuuccuguu

SEQ ID NO: 366295 - RNA, 22 nt, Human
cuggccaacuugcuuguuggca

SEQ ID NO: 366296 - RNA, 22 nt, Human
cuguacaucccgagagccagua

SEQ ID NO: 366297 - RNA, 22 nt, Human
guucuucagcauuagaagucau

SEQ ID NO: 366298 - RNA, 23 nt, Human
uggcuggcagaaacugaagcaug

SEQ ID NO: 366299 - RNA, 22 nt, Human
acagagcaauaacagggagagg

SEQ ID NO: 366300 - RNA, 22 nt, Human
ucaguuuuuaaaugauauaauu

SEQ ID NO: 366301 - RNA, 22 nt, Human
gaagaggaugacaggagccggu

SEQ ID NO: 366302 - RNA, 22 nt, Human
gccaccuggacagcugugcccu

SEQ ID NO: 366303 - RNA, 22 nt, Human
acccuguaugcuauaucccuaa

SEQ ID NO: 366304 - RNA, 22 nt, Human
ccaaaguccacaguuuacauua

SEQ ID NO: 366305 - RNA, 23 nt, Human
gcaguggaaugucucuguuugga

SEQ ID NO: 366306 - RNA, 22 nt, Human
uaauuauucuagucacauagca

SEQ ID NO: 366307 - RNA, 19 nt, Human
cugagagaugcuucacaca

SEQ ID NO: 366308 - RNA, 22 nt, Human
uuuccauauuuaaucaaaauaa

SEQ ID NO: 366309 - RNA, 22 nt, Human
cucuccaggacuuuggcccaau

SEQ ID NO: 366310 - RNA, 22 nt, Human
ucugggaacugagcuccccuag

SEQ ID NO: 366311 - RNA, 22 nt, Human
agagccaguuacaacuguggag

SEQ ID NO: 366312 - RNA, 21 nt, Human
uuacuuuugcagcaaccuaau

SEQ ID NO: 366313 - RNA, 22 nt, Human
cagagcaugaauaaaaguuaca

SEQ ID NO: 366314 - RNA, 22 nt, Human
cagagacagaaaauggaucuag

SEQ ID NO: 366315 - RNA, 22 nt, Human
ugaagcaggugaauggaugucg

SEQ ID NO: 366316 - RNA, 22 nt, Human
gucccagggaugcagacaugag

SEQ ID NO: 366317 - RNA, 21 nt, Human
ugaaaguuggagucaaaugua

SEQ ID NO: 366318 - RNA, 22 nt, Human
ggagaggcgaugagucacagcc

SEQ ID NO: 366319 - RNA, 22 nt, Human
acaaaguuugugguauuccaag

SEQ ID NO: 366320 - RNA, 22 nt, Human
ggaggccaaggcgggcggauca

SEQ ID NO: 366321 - RNA, 22 nt, Human
uuucaaauagaaucuuuccaaa

SEQ ID NO: 366322 - RNA, 22 nt, Human
ucuucaauuagauuuaccaauu

SEQ ID NO: 366323 - RNA, 22 nt, Human
cuuuggcaaggguuuuaauugu

SEQ ID NO: 366324 - RNA, 22 nt, Human
cauuucugucacguucuuuuau

SEQ ID NO: 366325 - RNA, 22 nt, Human
cugcaggguuuuucaaggacaa

SEQ ID NO: 366326 - RNA, 22 nt, Human
gauuuucauuugcacucuagaa

SEQ ID NO: 366327 - RNA, 22 nt, Human
uuuacaaccucauauucugaug

SEQ ID NO: 366328 - RNA, 18 nt, Human
uucagcagcagacacacu

SEQ ID NO: 366329 - RNA, 22 nt, Human
ucuguaguagguuguaguucuu

SEQ ID NO: 366330 - RNA, 22 nt, Human
uggcucagauuuuuguaggcuu

SEQ ID NO: 366331 - RNA, 22 nt, Human
uggacucagaaguguucuuuua

SEQ ID NO: 366332 - RNA, 22 nt, Human
ccccaccagcacccucucuauc

SEQ ID NO: 366333 - RNA, 21 nt, Human
ucaggcaggcgcagagggaag

SEQ ID NO: 366334 - RNA, 22 nt, Human
ccagcuuuuagugggcuuauua

SEQ ID NO: 366335 - RNA, 22 nt, Human
agggcugcugcuccgggcccag

SEQ ID NO: 366336 - RNA, 22 nt, Human
ugggccuggcccuguggaggag

SEQ ID NO: 366337 - RNA, 22 nt, Human
gagauuuagagagacuuaaaca

SEQ ID NO: 366338 - RNA, 22 nt, Human
cauuucauaguugucacaauaa

SEQ ID NO: 366339 - RNA, 22 nt, Human
gaggcucauugcauugugcauu

SEQ ID NO: 366340 - RNA, 22 nt, Human
caauuucuggaacuaauucuga

SEQ ID NO: 366341 - RNA, 22 nt, Human
ucccaggcuggcaggcagcagu

SEQ ID NO: 366342 - RNA, 22 nt, Human
gggagggguugcauguuugagu

SEQ ID NO: 366343 - RNA, 19 nt, Human
acaaagcugugagcagcuu

SEQ ID NO: 366344 - RNA, 22 nt, Human
gcucaagggaugggagugggug

SEQ ID NO: 366345 - RNA, 22 nt, Human
ugcugcugaucauuuauagucu

SEQ ID NO: 366346 - RNA, 22 nt, Human
aggccugaaggaagaugagcug

SEQ ID NO: 366347 - RNA, 22 nt, Human
ggcccagaauacuuuguaaaau

SEQ ID NO: 366348 - RNA, 22 nt, Human
ccuggccucuccgaguaaccug

SEQ ID NO: 366349 - RNA, 22 nt, Human
ccaggcugggcggggaaccugg

SEQ ID NO: 366350 - RNA, 22 nt, Human
gccaggcugaggcucuggaaga

SEQ ID NO: 366351 - RNA, 22 nt, Human
cuuucauucuuagauauuagug

SEQ ID NO: 366352 - RNA, 22 nt, Human
ccugcuucagggaugauggcac

SEQ ID NO: 366353 - RNA, 22 nt, Human
cccagggacagaugggcagcua

SEQ ID NO: 366354 - RNA, 22 nt, Human
caaagccaggcuuucuaaugua

SEQ ID NO: 366355 - RNA, 19 nt, Human
guggccagggcaggggcug

SEQ ID NO: 366356 - RNA, 22 nt, Human
uauccaaaguuucucagaaacu

SEQ ID NO: 366357 - RNA, 20 nt, Human
agugggagagggcagacugc

SEQ ID NO: 366358 - RNA, 22 nt, Human
gggaggucagggugccugcugg

SEQ ID NO: 366359 - RNA, 22 nt, Human
gccaggcagagccccgugcagc

SEQ ID NO: 366360 - RNA, 22 nt, Human
uccuucaguuaucacaguacug

SEQ ID NO: 366361 - RNA, 21 nt, Human
ugcaggcaggcagagaugcug

SEQ ID NO: 366362 - RNA, 22 nt, Human
uuguugguggaauugaugcuag

SEQ ID NO: 366363 - RNA, 22 nt, Human
ggcugccugggagcccuccucu

SEQ ID NO: 366364 - RNA, 22 nt, Human
aagaagguguggaaagaugcuc

SEQ ID NO: 366365 - RNA, 22 nt, Human
ugggcaaguaucggacucugag

SEQ ID NO: 366366 - RNA, 23 nt, Human
uuguuuuuagagguggcaugaga

SEQ ID NO: 366367 - RNA, 22 nt, Human
ggggagaguccuuuccaguucc

SEQ ID NO: 366368 - RNA, 19 nt, Human
uugaaauuguuugauaugg

SEQ ID NO: 366369 - RNA, 22 nt, Human
gcuggcagagacaagaagacua

SEQ ID NO: 366370 - RNA, 22 nt, Human
uugaaucuauguauucagugua

SEQ ID NO: 366371 - RNA, 21 nt, Human
ugcauaaagaaauacaaauac

SEQ ID NO: 366372 - RNA, 22 nt, Human
acagcuguggccacuugcaucc

SEQ ID NO: 366373 - RNA, 22 nt, Human
gccaccuguuucgcuugcccag

SEQ ID NO: 366374 - RNA, 22 nt, Human
agaggccagguccagaguuugu

SEQ ID NO: 366375 - RNA, 22 nt, Human
agcucuggaauaaugaugugau

SEQ ID NO: 366376 - RNA, 20 nt, Human
aauaaaagaagccuucaccc

SEQ ID NO: 366377 - RNA, 22 nt, Human
ugaaggcccuaucuccauauac

SEQ ID NO: 366378 - RNA, 22 nt, Human
cagagcccagggccuacguccc

SEQ ID NO: 366379 - RNA, 22 nt, Human
cagcuuuauugagguauaauug

SEQ ID NO: 366380 - RNA, 22 nt, Human
accucccagcucugagcuuggg

SEQ ID NO: 366381 - RNA, 22 nt, Human
accaggggugucaacagcauuu

SEQ ID NO: 366382 - RNA, 23 nt, Human
ucagucuucccugucaguaauag

SEQ ID NO: 366383 - RNA, 22 nt, Human
ugccucugaggaagauuguguu

SEQ ID NO: 366384 - RNA, 22 nt, Human
agucaguguagaaagcccaggc

SEQ ID NO: 366385 - RNA, 22 nt, Human
ucaucacauguguagucauccc

SEQ ID NO: 366386 - RNA, 22 nt, Human
uggugcugacaguucugagugc

SEQ ID NO: 366387 - RNA, 22 nt, Human
gcaguguuuacauauuagaaac

SEQ ID NO: 366388 - RNA, 22 nt, Human
ggcaggguggcagaggcucaga

SEQ ID NO: 366389 - RNA, 22 nt, Human
cugcucuggggaagccagaugu

SEQ ID NO: 366390 - RNA, 22 nt, Human
aggacugacuuuugccaugaaa

SEQ ID NO: 366391 - RNA, 22 nt, Human
ccacagggcucuaggcgcuucc

SEQ ID NO: 366392 - RNA, 22 nt, Human
ugcagcaggcacaggacggaag

SEQ ID NO: 366393 - RNA, 22 nt, Human
gcacccaggcuugggcagcaac

SEQ ID NO: 366394 - RNA, 22 nt, Human
aacuuuaaggcuauaaauuaug

SEQ ID NO: 366395 - RNA, 22 nt, Human
gaagcagccacggggagacaga

SEQ ID NO: 366396 - RNA, 22 nt, Human
uuaaagggccgauuuccaggcc

SEQ ID NO: 366397 - RNA, 21 nt, Human
uucuccccagcgaauccucgg

SEQ ID NO: 366398 - RNA, 22 nt, Human
acaaguaccaaaugcucaagua

SEQ ID NO: 366399 - RNA, 22 nt, Human
uggccuggcugcccugucugga

SEQ ID NO: 366400 - RNA, 22 nt, Human
aggagagaauguuccaggcuug

SEQ ID NO: 366401 - RNA, 22 nt, Human
uuacaguuuaguccaagccaga

SEQ ID NO: 366402 - RNA, 18 nt, Human
cauuaugugguuauagaa

SEQ ID NO: 366403 - RNA, 22 nt, Human
ugcaaacuauugguagagaugg

SEQ ID NO: 366404 - RNA, 22 nt, Human
ccaaguacucucaccaaagcuu

SEQ ID NO: 366405 - RNA, 22 nt, Human
ggcagggaagcuggcaucacgg

SEQ ID NO: 366406 - RNA, 22 nt, Human
gaggggagacagggaaaucagu

SEQ ID NO: 366407 - RNA, 20 nt, Human
gugggcagcaggcauacugg

SEQ ID NO: 366408 - RNA, 22 nt, Human
ccugccugcuuucugcuuugca

SEQ ID NO: 366409 - RNA, 20 nt, Human
uggcaggaauagggccagag

SEQ ID NO: 366410 - RNA, 22 nt, Human
ucucugaaggggagcuguuuaa

SEQ ID NO: 366411 - RNA, 22 nt, Human
uuaacauacaucaugaacaaug

SEQ ID NO: 366412 - RNA, 22 nt, Human
acccagcuguuucccgugucau

SEQ ID NO: 366413 - RNA, 22 nt, Human
uuucagugcuucuguuuaccgg

SEQ ID NO: 366414 - RNA, 22 nt, Human
uauuucuuguuauucucguuga

SEQ ID NO: 366415 - RNA, 22 nt, Human
gcagagcugucuaagucacuuc

SEQ ID NO: 366416 - RNA, 22 nt, Human
cugugcuuccaggauggcagcu

SEQ ID NO: 366417 - RNA, 22 nt, Human
ugcauauuguccuugauauuau

SEQ ID NO: 366418 - RNA, 22 nt, Human
aggaggcugguucaggccauau

SEQ ID NO: 366419 - RNA, 22 nt, Human
caguuucuuggaugccaauuuc

SEQ ID NO: 366420 - RNA, 22 nt, Human
auguccagaguguccuggaaag

SEQ ID NO: 366421 - RNA, 22 nt, Human
aaaaaugucauuauggaacuga

SEQ ID NO: 366422 - RNA, 22 nt, Human
gccugcagcugcuuccacacac

SEQ ID NO: 366423 - RNA, 22 nt, Human
auuuuacuacuccaauuaauga

SEQ ID NO: 366424 - RNA, 22 nt, Human
cugccugcugccuguggagggu

SEQ ID NO: 366425 - RNA, 20 nt, Human
uggcagaguugucccaccca

SEQ ID NO: 366426 - RNA, 17 nt, Human
uucaaagcuuaucaagg

SEQ ID NO: 366427 - RNA, 19 nt, Human
guccaguguuuuccaguca

SEQ ID NO: 366428 - RNA, 22 nt, Human
cucuuuccaggguaccccaggu

SEQ ID NO: 366429 - RNA, 17 nt, Human
gacaggcucagugacga

SEQ ID NO: 366430 - RNA, 22 nt, Human
ucuggcucuauaacuccuagcu

SEQ ID NO: 366431 - RNA, 22 nt, Human
aaggcagucugguuucaaagca

SEQ ID NO: 366432 - RNA, 21 nt, Human
cugagggccgcagcugggcuc

SEQ ID NO: 366433 - RNA, 22 nt, Human
ucaugacaucuguuuaucucaa

SEQ ID NO: 366434 - RNA, 22 nt, Human
caaguccuaggucugauugaac

SEQ ID NO: 366435 - RNA, 22 nt, Human
ucagaaauacuaucagcuuuug

SEQ ID NO: 366436 - RNA, 22 nt, Human
uagagcuguaucaaagagccuu

SEQ ID NO: 366437 - RNA, 22 nt, Human
gcccugggauuggguggaggcu

SEQ ID NO: 366438 - RNA, 22 nt, Human
uuucuagucucgaucucuuaau

SEQ ID NO: 366439 - RNA, 22 nt, Human
uagccgggugugguggaacucc

SEQ ID NO: 366440 - RNA, 22 nt, Human
cugcaucaguggauaugauggu

SEQ ID NO: 366441 - RNA, 19 nt, Human
aucugccuguuaucacaua

SEQ ID NO: 366442 - RNA, 22 nt, Human
guuuuucuaggaccaugugauu

SEQ ID NO: 366443 - RNA, 21 nt, Human
uggcccuggccacggcugcca

SEQ ID NO: 366444 - RNA, 22 nt, Human
aaaugcuugcucuugauuauuu

SEQ ID NO: 366445 - RNA, 22 nt, Human
cagcauuuucuuaauguaggug

SEQ ID NO: 366446 - RNA, 22 nt, Human
gaaagaagcuuuagauggcuau

SEQ ID NO: 366447 - RNA, 22 nt, Human
uuauuuauggcacuguuggugg

SEQ ID NO: 366448 - RNA, 22 nt, Human
gagucacaaagccuuucuuauu

SEQ ID NO: 366449 - RNA, 22 nt, Human
uagaaacagaaaacuguaauag

SEQ ID NO: 366450 - RNA, 22 nt, Human
ucuggcaggcaaucggcucugg

SEQ ID NO: 366451 - RNA, 22 nt, Human
aaccaggacaauuuugaaagua

SEQ ID NO: 366452 - RNA, 22 nt, Human
ugcuuuaucaaagcuauaguga

SEQ ID NO: 366453 - RNA, 22 nt, Human
agugcuuugagcguuugaaaag

SEQ ID NO: 366454 - RNA, 22 nt, Human
cuccuuagugccucugcacgag

SEQ ID NO: 366455 - RNA, 22 nt, Human
aaguucaaucagaugaaaaagc

SEQ ID NO: 366456 - RNA, 22 nt, Human
gcugucaggccaugugggccuu

SEQ ID NO: 366457 - RNA, 22 nt, Human
ucuuguccuaagagcuggauuc

SEQ ID NO: 366458 - RNA, 22 nt, Human
uugcagagagguuaggaacuca

SEQ ID NO: 366459 - RNA, 22 nt, Human
ggucccagcuggucacugucag

SEQ ID NO: 366460 - RNA, 22 nt, Human
aggccucaggaagguaaagaag

SEQ ID NO: 366461 - RNA, 22 nt, Human
cugaggcuggggaagggaagug

SEQ ID NO: 366462 - RNA, 22 nt, Human
agacuucucaguuuuauuagua

SEQ ID NO: 366463 - RNA, 22 nt, Human
auaugaagucagacaaacuggg

SEQ ID NO: 366464 - RNA, 22 nt, Human
cugcccuguuuggacagcccgg

SEQ ID NO: 366465 - RNA, 22 nt, Human
acacauaugguugcugcaguga

SEQ ID NO: 366466 - RNA, 22 nt, Human
caaauucaaugaacauguuuaa

SEQ ID NO: 366467 - RNA, 22 nt, Human
auuuccucaugaucauaaugca

SEQ ID NO: 366468 - RNA, 22 nt, Human
auuuucucucaaaccuuaaaau

SEQ ID NO: 366469 - RNA, 22 nt, Human
acuuugcacuaaguuacucauu

SEQ ID NO: 366470 - RNA, 22 nt, Human
auguaauuugcccucaaguuaa

SEQ ID NO: 366471 - RNA, 19 nt, Human
uguguaaagucugugguca

SEQ ID NO: 366472 - RNA, 22 nt, Human
uugcugugucugauggcugaga

SEQ ID NO: 366473 - RNA, 22 nt, Human
uggcuggggagccccgacuccc

SEQ ID NO: 366474 - RNA, 22 nt, Human
cugaaugaggaaaagagugagg

SEQ ID NO: 366475 - RNA, 21 nt, Human
acagccugucaucucaugguc

SEQ ID NO: 366476 - RNA, 22 nt, Human
aggcacugacucaagggagcca

SEQ ID NO: 366477 - RNA, 22 nt, Human
augaagucugcacaugcaugug

SEQ ID NO: 366478 - RNA, 17 nt, Human
gcccaggaaggacggcc

SEQ ID NO: 366479 - RNA, 22 nt, Human
caggaggcuuugggauccaagu

SEQ ID NO: 366480 - RNA, 22 nt, Human
gccuugccucagccauggaaac

SEQ ID NO: 366481 - RNA, 22 nt, Human
agaaaguuuugugcuauauaug

SEQ ID NO: 366482 - RNA, 22 nt, Human
aucucagggcuggagcccugga

SEQ ID NO: 366483 - RNA, 22 nt, Human
ggccaggagcaagccaggcucu

SEQ ID NO: 366484 - RNA, 22 nt, Human
gcagugggcaacaagagcugga

SEQ ID NO: 366485 - RNA, 22 nt, Human
augaggcagaaaaaagucggag

SEQ ID NO: 366486 - RNA, 22 nt, Human
cagcugcaugucuguggugguc

SEQ ID NO: 366487 - RNA, 22 nt, Human
ggagcugugcugggugaucagg

SEQ ID NO: 366488 - RNA, 22 nt, Human
ucaguucaguauacacuauucu

SEQ ID NO: 366489 - RNA, 21 nt, Human
aucuuuauuacgcagagaaga

SEQ ID NO: 366490 - RNA, 23 nt, Human
ucugggcaccuuguugacaugau

SEQ ID NO: 366491 - RNA, 22 nt, Human
gcagccucaaacuccccagcuc

SEQ ID NO: 366492 - RNA, 22 nt, Human
aaaggccaugguuggaguguuu

SEQ ID NO: 366493 - RNA, 22 nt, Human
caggaggaggugagguagaacu

SEQ ID NO: 366494 - RNA, 22 nt, Human
agagaggcugggcguagggcuu

SEQ ID NO: 366495 - RNA, 22 nt, Human
caaggagauaaaauguugagcu

SEQ ID NO: 366496 - RNA, 22 nt, Human
uggcugcugagaaggcagcugu

SEQ ID NO: 366497 - RNA, 22 nt, Human
agggcuggcaagggauugaaau

SEQ ID NO: 366498 - RNA, 22 nt, Human
auggacaggcugagcuuccuca

SEQ ID NO: 366499 - RNA, 22 nt, Human
agcacaggaccaaggaagcugu

SEQ ID NO: 366500 - RNA, 22 nt, Human
ggcaaaaacagcaaugacuuuu

SEQ ID NO: 366501 - RNA, 22 nt, Human
cuagaaaugcucaagagaaagu

SEQ ID NO: 366502 - RNA, 22 nt, Human
cugguucauccccuuccaggaa

SEQ ID NO: 366503 - RNA, 22 nt, Human
uucagaaacaucaguggaugga

SEQ ID NO: 366504 - RNA, 22 nt, Human
gccaggcauuuguuaggugcug

SEQ ID NO: 366505 - RNA, 22 nt, Human
augggcaguuaggaggccagga

SEQ ID NO: 366506 - RNA, 22 nt, Human
agaccauggccauccuaggaaa

SEQ ID NO: 366507 - RNA, 20 nt, Human
uauuuguauuugggaaaguu

SEQ ID NO: 366508 - RNA, 22 nt, Human
uaaauuauggcuggcagagcag

SEQ ID NO: 366509 - RNA, 22 nt, Human
gggugggacugaagucugaggg

SEQ ID NO: 366510 - RNA, 22 nt, Human
ggggccugcgagguucaacuuc

SEQ ID NO: 366511 - RNA, 22 nt, Human
acaugcauacacguacauaccu

SEQ ID NO: 366512 - RNA, 22 nt, Human
ccggggacuuaaagugaaggaa

SEQ ID NO: 366513 - RNA, 22 nt, Human
agugccuugugugugggcagcc

SEQ ID NO: 366514 - RNA, 22 nt, Human
ugggcagauguccucugaagug

SEQ ID NO: 366515 - RNA, 22 nt, Human
ucuuuauugcuacugguuuguc

SEQ ID NO: 366516 - RNA, 22 nt, Human
acccaggagacggaggugcagu

SEQ ID NO: 366517 - RNA, 22 nt, Human
cccucccagaugggcuugaggu

SEQ ID NO: 366518 - RNA, 22 nt, Human
gcagggcagagggagaaucucu

SEQ ID NO: 366519 - RNA, 22 nt, Human
ugagagugguucagcucagaag

SEQ ID NO: 366520 - RNA, 22 nt, Human
aagagggcugcaaucuuauugc

SEQ ID NO: 366521 - RNA, 22 nt, Human
aaucaggaugacugucauuuca

SEQ ID NO: 366522 - RNA, 22 nt, Human
cagggcuggauuucauuucuag

SEQ ID NO: 366523 - RNA, 22 nt, Human
gcugccacuuggucaugucaug

SEQ ID NO: 366524 - RNA, 22 nt, Human
agccagagagccccagguucua

SEQ ID NO: 366525 - RNA, 22 nt, Human
agcaggaacucagggaguucuc

SEQ ID NO: 366526 - RNA, 22 nt, Human
uccuggagcuuccuucauggua

SEQ ID NO: 366527 - RNA, 22 nt, Human
cauauaauguuugaagaugugg

SEQ ID NO: 366528 - RNA, 22 nt, Human
agaaaucaugacuaagagcagu

SEQ ID NO: 366529 - RNA, 22 nt, Human
cuggcugcgucugcucugacag

SEQ ID NO: 366530 - RNA, 22 nt, Human
uuccuuccgggcaccaggcacu

SEQ ID NO: 366531 - RNA, 22 nt, Human
uuucuguagugugguauguagg

SEQ ID NO: 366532 - RNA, 22 nt, Human
gcagcugcagagaccggguggg

SEQ ID NO: 366533 - RNA, 23 nt, Human
uggcucugagagguucagaugcu

SEQ ID NO: 366534 - RNA, 23 nt, Human
uggcccugaaucuguccuggagg

SEQ ID NO: 366535 - RNA, 22 nt, Human
caggugcucccagagaagugcu

SEQ ID NO: 366536 - RNA, 22 nt, Human
uggggugggcaugcgcuguccu

SEQ ID NO: 366537 - RNA, 23 nt, Human
aggagccaggaaccagcuucccc

SEQ ID NO: 366538 - RNA, 19 nt, Human
gcaggcacagcccugggug

SEQ ID NO: 366539 - RNA, 22 nt, Human
ugggcaggagagaagcuaaaga

SEQ ID NO: 366540 - RNA, 22 nt, Human
agcaccugcuuaaugugcagug

SEQ ID NO: 366541 - RNA, 22 nt, Human
uaggggugaggccaggcaucag

SEQ ID NO: 366542 - RNA, 22 nt, Human
aggccuggccugggcggcauug

SEQ ID NO: 366543 - RNA, 22 nt, Human
gguggccucugcaggccucgac

SEQ ID NO: 366544 - RNA, 22 nt, Human
caggggcaagaaugcugucagc

SEQ ID NO: 366545 - RNA, 22 nt, Human
gagcugggcacacgccacuuga

SEQ ID NO: 366546 - RNA, 22 nt, Human
uuccaggaauucagcucucagu

SEQ ID NO: 366547 - RNA, 22 nt, Human
ccaaaauguuugaaugcaugug

SEQ ID NO: 366548 - RNA, 22 nt, Human
uaucuguucaauggaagaugac

SEQ ID NO: 366549 - RNA, 21 nt, Human
ucucugggcccuccugugggg

SEQ ID NO: 366550 - RNA, 22 nt, Human
gcucugcugcuuacuagauggu

SEQ ID NO: 366551 - RNA, 22 nt, Human
uuccuuagggucagccagaucu

SEQ ID NO: 366552 - RNA, 20 nt, Human
agucccagaucaaauuucug

SEQ ID NO: 366553 - RNA, 22 nt, Human
cagcuuuaguaacccacugcuc

SEQ ID NO: 366554 - RNA, 22 nt, Human
cucccuggaggugagcuggcac

SEQ ID NO: 366555 - RNA, 22 nt, Human
uucccaauauucugcuuuuaug

SEQ ID NO: 366556 - RNA, 22 nt, Human
ugccaggcauauggccucuuug

SEQ ID NO: 366557 - RNA, 22 nt, Human
ggccugaggcgucccagcugug

SEQ ID NO: 366558 - RNA, 23 nt, Human
aggcagagccaaggucaaaaccc

SEQ ID NO: 366559 - RNA, 22 nt, Human
uggugcuguggaggggcagaag

SEQ ID NO: 366560 - RNA, 22 nt, Human
gggcacagcugcuacccagugc

SEQ ID NO: 366561 - RNA, 22 nt, Human
cagaaagcuuaggcaaguugga

SEQ ID NO: 366562 - RNA, 22 nt, Human
guggcagguuauaagcaucuca

SEQ ID NO: 366563 - RNA, 22 nt, Human
agggaaauuaaugugagcaaug

SEQ ID NO: 366564 - RNA, 20 nt, Human
guggccucucacauucugag

SEQ ID NO: 366565 - RNA, 22 nt, Human
aaagaucagucugaagcaacau

SEQ ID NO: 366566 - RNA, 20 nt, Human
ugcguguguauuuauuuucu

SEQ ID NO: 366567 - RNA, 22 nt, Human
ucaaaguuuguggcaauuuauu

SEQ ID NO: 366568 - RNA, 20 nt, Human
ggggcaguggcucaugccug

SEQ ID NO: 366569 - RNA, 22 nt, Human
agugauggagcuuccucugcua

SEQ ID NO: 366570 - RNA, 22 nt, Human
ucagcuuucuauguugcuaaac

SEQ ID NO: 366571 - RNA, 22 nt, Human
ugucuuuagagucacaaaacca

SEQ ID NO: 366572 - RNA, 22 nt, Human
ugggagcacccugaggagcuuc

SEQ ID NO: 366573 - RNA, 22 nt, Human
aucagcaagauguaauuucuau

SEQ ID NO: 366574 - RNA, 22 nt, Human
ugcagcagguuccaaaggguua

SEQ ID NO: 366575 - RNA, 22 nt, Human
caggcagcucuaauggaaagug

SEQ ID NO: 366576 - RNA, 22 nt, Human
ucccagccuuccagucugguuu

SEQ ID NO: 366577 - RNA, 22 nt, Human
agagcuggguggacuuguaguu

SEQ ID NO: 366578 - RNA, 22 nt, Human
uaucuaaauggaauauuccaga

SEQ ID NO: 366579 - RNA, 22 nt, Human
agcaguggaccucagugcuauu

SEQ ID NO: 366580 - RNA, 21 nt, Human
aggauuuacuauuaacugugu

SEQ ID NO: 366581 - RNA, 22 nt, Human
agagaauuacagaagaauguca

SEQ ID NO: 366582 - RNA, 22 nt, Human
ucaggcaggacaauuauuuagg

SEQ ID NO: 366583 - RNA, 22 nt, Human
gcugugcuugggaagaaucucu

SEQ ID NO: 366584 - RNA, 22 nt, Human
ccaggggcuggugcugagcugg

SEQ ID NO: 366585 - RNA, 22 nt, Human
ucaccaggauugggcuguaggc

SEQ ID NO: 366586 - RNA, 22 nt, Human
uucucuggaacugaaacaagau

SEQ ID NO: 366587 - RNA, 22 nt, Human
uccccagggcugcagagggugu

SEQ ID NO: 366588 - RNA, 22 nt, Human
cugagcugcucccgcugcagcg

SEQ ID NO: 366589 - RNA, 22 nt, Human
augcaguacauacaaacacuga

SEQ ID NO: 366590 - RNA, 22 nt, Human
agucccaguucgguucuuccuc

SEQ ID NO: 366591 - RNA, 22 nt, Human
uucacagaugccugaugugugg

SEQ ID NO: 366592 - RNA, 22 nt, Human
uacuuuuugucucuuugaaugu

SEQ ID NO: 366593 - RNA, 22 nt, Human
cucacugucuguacuagcugau

SEQ ID NO: 366594 - RNA, 22 nt, Human
ucagggcacauucugcaguggc

SEQ ID NO: 366595 - RNA, 22 nt, Human
cccaggaggucgaagcugcagu

SEQ ID NO: 366596 - RNA, 22 nt, Human
cccagaaggucgaggcugcagu

SEQ ID NO: 366597 - RNA, 22 nt, Human
aaguucaaguaguguuacaugg

SEQ ID NO: 366598 - RNA, 22 nt, Human
cuuuuccacugagccucacaaa

SEQ ID NO: 366599 - RNA, 22 nt, Human
uucauauauaugcacuacguac

SEQ ID NO: 366600 - RNA, 22 nt, Human
gccucccuguagaggccagccu

SEQ ID NO: 366601 - RNA, 22 nt, Human
uucaggauaguggugaguggca

SEQ ID NO: 366602 - RNA, 22 nt, Human
augaugguuguccuaggugcau

SEQ ID NO: 366603 - RNA, 22 nt, Human
agaccugcagggccaggccugc

SEQ ID NO: 366604 - RNA, 22 nt, Human
aacuagaaaacaagaugcugau

SEQ ID NO: 366605 - RNA, 22 nt, Human
aaggcacugagccagccgucuc

SEQ ID NO: 366606 - RNA, 21 nt, Human
aggucagcccagcucuggaag

SEQ ID NO: 366607 - RNA, 19 nt, Human
ucccaggaaccuuuuauuu

SEQ ID NO: 366608 - RNA, 22 nt, Human
aagguucuaagggaagccaugc

SEQ ID NO: 366609 - RNA, 22 nt, Human
gcugguuuccuuaucuauaaag

SEQ ID NO: 366610 - RNA, 22 nt, Human
gauguguuuccaggauuuguuu

SEQ ID NO: 366611 - RNA, 20 nt, Human
aaaagcagccagagauggua

SEQ ID NO: 366612 - RNA, 18 nt, Human
aguaguggguuuagcuuc

SEQ ID NO: 366613 - RNA, 23 nt, Human
gggcugcuccaggccaaggcugg

SEQ ID NO: 366614 - RNA, 22 nt, Human
ccaucuccacugucccugucaa

SEQ ID NO: 366615 - RNA, 22 nt, Human
auuguaucuugucauuaugcau

SEQ ID NO: 366616 - RNA, 22 nt, Human
ucccaggguuacagccagggca

SEQ ID NO: 366617 - RNA, 22 nt, Human
ugauuuccaguugcugggugcu

SEQ ID NO: 366618 - RNA, 22 nt, Human
gcacagggcccugugcguaggu

SEQ ID NO: 366619 - RNA, 22 nt, Human
gagccugagugcugccuccccu

SEQ ID NO: 366620 - RNA, 22 nt, Human
aaugauuuccccuacacagaag

SEQ ID NO: 366621 - RNA, 22 nt, Human
gggcacugugcuaggugcugag

SEQ ID NO: 366622 - RNA, 22 nt, Human
caagagcuagaaauugguuaga

SEQ ID NO: 366623 - RNA, 22 nt, Human
aauguucagaggacaauauaaa

SEQ ID NO: 366624 - RNA, 22 nt, Human
ggauggagguucucagaugcuc

SEQ ID NO: 366625 - RNA, 22 nt, Human
augggaggguggaaaggcucug

SEQ ID NO: 366626 - RNA, 22 nt, Human
uagaugcuacaauuuuguacuc

SEQ ID NO: 366627 - RNA, 22 nt, Human
uuuaacagaugugaaauuuuca

SEQ ID NO: 366628 - RNA, 22 nt, Human
auucuccaucaccacuggcacu

SEQ ID NO: 366629 - RNA, 22 nt, Human
gcugcaggcgccugcggucucu

SEQ ID NO: 366630 - RNA, 22 nt, Human
gagagcugcauucucagacaca

SEQ ID NO: 366631 - RNA, 22 nt, Human
ccagggugugagaaggaaguag

SEQ ID NO: 366632 - RNA, 22 nt, Human
cuccagggaaaggggcguccgc

SEQ ID NO: 366633 - RNA, 22 nt, Human
ccuaagaauuaaugaauacacc

SEQ ID NO: 366634 - RNA, 19 nt, Human
ucaaagcaagcauguucug

SEQ ID NO: 366635 - RNA, 22 nt, Human
aaaaguucccugguuagaaaag

SEQ ID NO: 366636 - RNA, 22 nt, Human
gugucccagcagcacauuggcu

SEQ ID NO: 366637 - RNA, 22 nt, Human
auguacaaaaugccacugaauu

SEQ ID NO: 366638 - RNA, 22 nt, Human
ggcuuuauuaacucauccguaa

SEQ ID NO: 366639 - RNA, 22 nt, Human
aaugggaagccagaagacaagg

SEQ ID NO: 366640 - RNA, 22 nt, Human
aauaauuauuugagagcagacc

SEQ ID NO: 366641 - RNA, 22 nt, Human
uucuuuggggaauauucugguu

SEQ ID NO: 366642 - RNA, 22 nt, Human
uuggaaagcaagcuggacauac

SEQ ID NO: 366643 - RNA, 22 nt, Human
augcugagacuggagcagcugg

SEQ ID NO: 366644 - RNA, 22 nt, Human
cuggggggagcugcguccagca

SEQ ID NO: 366645 - RNA, 22 nt, Human
ccaggcccugcuccucacacca

SEQ ID NO: 366646 - RNA, 22 nt, Human
aagggcugaaagaccuugggca

SEQ ID NO: 366647 - RNA, 21 nt, Human
cugugcuucuuccuaagccag

SEQ ID NO: 366648 - RNA, 23 nt, Human
cccuggaguaaauucuuggaagg

SEQ ID NO: 366649 - RNA, 22 nt, Human
gcucaggaaggcucaaccagga

SEQ ID NO: 366650 - RNA, 22 nt, Human
ugggcugccggcaggcucugcc

SEQ ID NO: 366651 - RNA, 22 nt, Human
ugggggugaaagucuggacagu

SEQ ID NO: 366652 - RNA, 22 nt, Human
gaggaugugucuggucugggca

SEQ ID NO: 366653 - RNA, 19 nt, Human
uccaggagcaaagccaguu

SEQ ID NO: 366654 - RNA, 22 nt, Human
ugaggcagcuuuuucugugugu

SEQ ID NO: 366655 - RNA, 22 nt, Human
uuuaacagguaaaguaaaugug

SEQ ID NO: 366656 - RNA, 22 nt, Human
aguguuccacacaucuggggaa

SEQ ID NO: 366657 - RNA, 22 nt, Human
ugcuggcccaugaagacgcagu

SEQ ID NO: 366658 - RNA, 22 nt, Human
cuuucacauaauugaccuugaa

SEQ ID NO: 366659 - RNA, 22 nt, Human
auaaacaguaaaugugagcagu

SEQ ID NO: 366660 - RNA, 22 nt, Human
aagcugccaaugguaagcugcu

SEQ ID NO: 366661 - RNA, 22 nt, Human
ugcagagggacagccacagcuc

SEQ ID NO: 366662 - RNA, 22 nt, Human
ggcugagacuagagugaggcau

SEQ ID NO: 366663 - RNA, 22 nt, Human
ugccugucuccucugcagggug

SEQ ID NO: 366664 - RNA, 20 nt, Human
aggcugaguucuaugcacuu

SEQ ID NO: 366665 - RNA, 22 nt, Human
acuauacagaagaggauaggaa

SEQ ID NO: 366666 - RNA, 22 nt, Human
ugggcugcagggguugagagcu

SEQ ID NO: 366667 - RNA, 22 nt, Human
caugggcuuuggaggcuggagg

SEQ ID NO: 366668 - RNA, 22 nt, Human
aggagguggcugaacuugaggg

SEQ ID NO: 366669 - RNA, 22 nt, Human
uucaagaugccagggacgcggc

SEQ ID NO: 366670 - RNA, 22 nt, Human
ucccagagcccaaguuggagag

SEQ ID NO: 366671 - RNA, 22 nt, Human
uucacaguggcugugccauuug

SEQ ID NO: 366672 - RNA, 22 nt, Human
uucaucaauguguuuaauaaug

SEQ ID NO: 366673 - RNA, 22 nt, Human
auuuaagauugcguauucaugu

SEQ ID NO: 366674 - RNA, 22 nt, Human
auaucuuuuagagcaagcuugu

SEQ ID NO: 366675 - RNA, 22 nt, Human
ccuucagaccuagacaggaauc

SEQ ID NO: 366676 - RNA, 22 nt, Human
ucagaguguuuuacuaaacaag

SEQ ID NO: 366677 - RNA, 22 nt, Human
cugcaggcucgaagacacggau

SEQ ID NO: 366678 - RNA, 22 nt, Human
uggagcugagaaguggagcucu

SEQ ID NO: 366679 - RNA, 22 nt, Human
aaaugcaggaaauuaugcuuuu

SEQ ID NO: 366680 - RNA, 18 nt, Human
ucagagagaauaguaauu

SEQ ID NO: 366681 - RNA, 22 nt, Human
acauauauuacuaguaaagaca

SEQ ID NO: 366682 - RNA, 22 nt, Human
acauaauaggugccugaauauu

SEQ ID NO: 366683 - RNA, 22 nt, Human
gagcucauucauucauugccug

SEQ ID NO: 366684 - RNA, 22 nt, Human
gaguccaguuguucacagaggc

SEQ ID NO: 366685 - RNA, 22 nt, Human
agugcuuugaacgaaaggcuga

SEQ ID NO: 366686 - RNA, 22 nt, Human
gaagagcugugauucaggcuua

SEQ ID NO: 366687 - RNA, 22 nt, Human
agcacagauucugaagaguccu

SEQ ID NO: 366688 - RNA, 21 nt, Human
aacugcuggucuuuucugucu

SEQ ID NO: 366689 - RNA, 22 nt, Human
uccugggcuguggccccgggca

SEQ ID NO: 366690 - RNA, 22 nt, Human
cagaggcagaauggagauuugg

SEQ ID NO: 366691 - RNA, 22 nt, Human
gcagcuuucuaagcuuuauugc

SEQ ID NO: 366692 - RNA, 21 nt, Human
acagggcaugcagcuggcugu

SEQ ID NO: 366693 - RNA, 22 nt, Human
gggcacugaaugccaagcuagg

SEQ ID NO: 366694 - RNA, 21 nt, Human
caaguccuuugccaaagugcu

SEQ ID NO: 366695 - RNA, 22 nt, Human
gagcuuuaagggcacuggucuu

SEQ ID NO: 366696 - RNA, 19 nt, Human
uagcugccuguuaccucca

SEQ ID NO: 366697 - RNA, 22 nt, Human
gggccugugcacaguucuguua

SEQ ID NO: 366698 - RNA, 22 nt, Human
gggcagcuggauaguuuuaaau

SEQ ID NO: 366699 - RNA, 22 nt, Human
gcagacagcauguugggcuauu

SEQ ID NO: 366700 - RNA, 22 nt, Human
caggugucuaauucucaccccc

SEQ ID NO: 366701 - RNA, 22 nt, Human
cucaugauguagcgaaugagaa

SEQ ID NO: 366702 - RNA, 22 nt, Human
agguaagggucacaguucauau

SEQ ID NO: 366703 - RNA, 22 nt, Human
caggcccagugaucagggcucu

SEQ ID NO: 366704 - RNA, 22 nt, Human
uucuucaguguagcaacuguau

SEQ ID NO: 366705 - RNA, 22 nt, Human
gaaguucaggugggaauugagc

SEQ ID NO: 366706 - RNA, 22 nt, Human
acccaggccugagagacaggag

SEQ ID NO: 366707 - RNA, 22 nt, Human
cccccagccagcagugcucagc

SEQ ID NO: 366708 - RNA, 22 nt, Human
uggggaggacgggcgccuuccu

SEQ ID NO: 366709 - RNA, 22 nt, Human
aggugccaauuuucagugaaca

SEQ ID NO: 366710 - RNA, 22 nt, Human
gaggggcugcccuggugucagg

SEQ ID NO: 366711 - RNA, 22 nt, Human
ugacauuuaagccucugauuuc

SEQ ID NO: 366712 - RNA, 22 nt, Human
cagcuugcuaauuuugacuuca

SEQ ID NO: 366713 - RNA, 22 nt, Human
agaugagggguagaaaggacuu

SEQ ID NO: 366714 - RNA, 22 nt, Human
acaauguaggauauguacuugu

SEQ ID NO: 366715 - RNA, 22 nt, Human
ugggggagauuagagcuucuua

SEQ ID NO: 366716 - RNA, 22 nt, Human
gccaggcacugcucuaagcccu

SEQ ID NO: 366717 - RNA, 22 nt, Human
uuuaggcaagggcaagauuauc

SEQ ID NO: 366718 - RNA, 22 nt, Human
uaggcuggaggaagcagugccu

SEQ ID NO: 366719 - RNA, 22 nt, Human
aacaugaaaguugcuaagugca

SEQ ID NO: 366720 - RNA, 22 nt, Human
uagaggugacacugagaccaua

SEQ ID NO: 366721 - RNA, 22 nt, Human
uaagaacaagauguuccuguuu

SEQ ID NO: 366722 - RNA, 22 nt, Human
cuguuuuugugcugugucuccc

SEQ ID NO: 366723 - RNA, 22 nt, Human
cuaaaauuaucaagauaauucc

SEQ ID NO: 366724 - RNA, 22 nt, Human
agcagcauggcugacuaaagac

SEQ ID NO: 366725 - RNA, 22 nt, Human
caggaggcagaggaugcccagu

SEQ ID NO: 366726 - RNA, 22 nt, Human
cacacaggagagugcuggaggu

SEQ ID NO: 366727 - RNA, 20 nt, Human
cagcaggaaaagugccucag

SEQ ID NO: 366728 - RNA, 22 nt, Human
uucacagggccacuggcaggag

SEQ ID NO: 366729 - RNA, 22 nt, Human
gcuggccucuggagaagggcuu

SEQ ID NO: 366730 - RNA, 22 nt, Human
cagaauuuuucgaauguacugu

SEQ ID NO: 366731 - RNA, 22 nt, Human
ggccucucucccuggcuugcag

SEQ ID NO: 366732 - RNA, 22 nt, Human
cuuaaaaucuggcaguuagcua

SEQ ID NO: 366733 - RNA, 20 nt, Human
agcaccagugggggcagccc

SEQ ID NO: 366734 - RNA, 22 nt, Human
agcuggagaucaugcugauacu

SEQ ID NO: 366735 - RNA, 22 nt, Human
agaugauggccauguccucucc

SEQ ID NO: 366736 - RNA, 22 nt, Human
caagcugguaucagcuagagcg

SEQ ID NO: 366737 - RNA, 22 nt, Human
ugcuggggauccguaccaaccc

SEQ ID NO: 366738 - RNA, 22 nt, Human
auauaggcuaacaacuauugag

SEQ ID NO: 366739 - RNA, 22 nt, Human
caggcagcauuuacucugauga

SEQ ID NO: 366740 - RNA, 22 nt, Human
caucagaaucugagucucugcc

SEQ ID NO: 366741 - RNA, 22 nt, Human
uggaaggcaacggagugagcug

SEQ ID NO: 366742 - RNA, 22 nt, Human
gcuuucucuucacugauguuca

SEQ ID NO: 366743 - RNA, 22 nt, Human
uuugaauguuuuagguacuuaa

SEQ ID NO: 366744 - RNA, 22 nt, Human
ugccugggaaccaauccuggcu

SEQ ID NO: 366745 - RNA, 22 nt, Human
acaaagucucuaauaaucuucu

SEQ ID NO: 366746 - RNA, 22 nt, Human
agagugcagauaagagaauguu

SEQ ID NO: 366747 - RNA, 20 nt, Human
cucugcagcaaggccugggu

SEQ ID NO: 366748 - RNA, 22 nt, Human
aaggaagauauaucaagcuuaa

SEQ ID NO: 366749 - RNA, 19 nt, Human
uccugcagaccagaccugu

SEQ ID NO: 366750 - RNA, 22 nt, Human
ugcugggggugucucaccaggc

SEQ ID NO: 366751 - RNA, 22 nt, Human
gcagggaccugccacugcuguc

SEQ ID NO: 366752 - RNA, 22 nt, Human
ccaguggacaauuucugaggaa

SEQ ID NO: 366753 - RNA, 22 nt, Human
uagaacagaguuccagugauca

SEQ ID NO: 366754 - RNA, 22 nt, Human
aggcaguuuauccccagagccu

SEQ ID NO: 366755 - RNA, 22 nt, Human
gcggcaggaagagcgcagcccc

SEQ ID NO: 366756 - RNA, 22 nt, Human
auauuucaugggguuccauacu

SEQ ID NO: 366757 - RNA, 22 nt, Human
gagacugcauagauggccacaa

SEQ ID NO: 366758 - RNA, 22 nt, Human
gucaggauguuuauucuccagu

SEQ ID NO: 366759 - RNA, 22 nt, Human
cugggcacuugcucacagcucu

SEQ ID NO: 366760 - RNA, 22 nt, Human
cuucaagauccauagauauugc

SEQ ID NO: 366761 - RNA, 23 nt, Human
uuuauauuccuaaugucuugagc

SEQ ID NO: 366762 - RNA, 22 nt, Human
gcagagccuugcgucaugugcc

SEQ ID NO: 366763 - RNA, 22 nt, Human
agcucccugagaugccacagca

SEQ ID NO: 366764 - RNA, 22 nt, Human
gaaaucugcggugaggccugag

SEQ ID NO: 366765 - RNA, 22 nt, Human
aauauuucugcagaaugguuuu

SEQ ID NO: 366766 - RNA, 22 nt, Human
uuccauaauaggcuuaagugaa

SEQ ID NO: 366767 - RNA, 22 nt, Human
aguuuuucugcuggucucacua

SEQ ID NO: 366768 - RNA, 22 nt, Human
ccagcuccgggaguugcugcug

SEQ ID NO: 366769 - RNA, 22 nt, Human
ggcagcugugaagugccucaca

SEQ ID NO: 366770 - RNA, 22 nt, Human
ugcauauuuguaugauguuuag

SEQ ID NO: 366771 - RNA, 22 nt, Human
ccugggcuuucaaaaccagccu

SEQ ID NO: 366772 - RNA, 22 nt, Human
accucugcuucccggguucaag

SEQ ID NO: 366773 - RNA, 22 nt, Human
cacagcuucugagugaggauuu

SEQ ID NO: 366774 - RNA, 21 nt, Human
uggagcugaauuuuuggcauc

SEQ ID NO: 366775 - RNA, 22 nt, Human
cuguaugaggaucagacuggac

SEQ ID NO: 366776 - RNA, 18 nt, Human
gaggccugagaaccaggu

SEQ ID NO: 366777 - RNA, 22 nt, Human
auuaugcugguuuacacauuuu

SEQ ID NO: 366778 - RNA, 22 nt, Human
agggcugggcugcuuguuguca

SEQ ID NO: 366779 - RNA, 22 nt, Human
ggcucugcugguaagaugccuc

SEQ ID NO: 366780 - RNA, 22 nt, Human
gcugccuccugaaagcgcucug

SEQ ID NO: 366781 - RNA, 22 nt, Human
cucccaagggguaagggagcug

SEQ ID NO: 366782 - RNA, 22 nt, Human
aaggcugugucagaagcucccu

SEQ ID NO: 366783 - RNA, 22 nt, Human
ugucugagugugccugggcauu

SEQ ID NO: 366784 - RNA, 22 nt, Human
agggcagaaaucgauuacaccu

SEQ ID NO: 366785 - RNA, 22 nt, Human
accaggcagagcugggccuuaa

SEQ ID NO: 366786 - RNA, 22 nt, Human
ggccucugcaacuggcuguggc

SEQ ID NO: 366787 - RNA, 22 nt, Human
ccaaggcuggagugcaguggcg

SEQ ID NO: 366788 - RNA, 22 nt, Human
aaggccugggaggccucucuuc

SEQ ID NO: 366789 - RNA, 20 nt, Human
gucugaggagcagugggaaa

SEQ ID NO: 366790 - RNA, 22 nt, Human
aaguucaagcucugccuaaaau

SEQ ID NO: 366791 - RNA, 22 nt, Human
ucuuugcacugugcaagcagaa

SEQ ID NO: 366792 - RNA, 22 nt, Human
uugcauugaaugcacauuuuua

SEQ ID NO: 366793 - RNA, 22 nt, Human
ggcugcaguuugucuuuugcuu

SEQ ID NO: 366794 - RNA, 22 nt, Human
augcacgccccacacuggugug

SEQ ID NO: 366795 - RNA, 22 nt, Human
ggcugugggaugcauaggagcu

SEQ ID NO: 366796 - RNA, 22 nt, Human
uaaacauggcuguuucaguuau

SEQ ID NO: 366797 - RNA, 22 nt, Human
cuggguggaaagugcugagaau

SEQ ID NO: 366798 - RNA, 22 nt, Human
gcuggcuguuggagguaccugc

SEQ ID NO: 366799 - RNA, 22 nt, Human
aggugucuuugcggcccgccgc

SEQ ID NO: 366800 - RNA, 22 nt, Human
ucugggaagcugguccuguucu

SEQ ID NO: 366801 - RNA, 22 nt, Human
agagggcccauguugggcugcu

SEQ ID NO: 366802 - RNA, 22 nt, Human
guugaaaguggagaaccugguu

SEQ ID NO: 366803 - RNA, 22 nt, Human
uacauuugcuuugauuuucagc

SEQ ID NO: 366804 - RNA, 22 nt, Human
ggcucuggucagugaggggccu

SEQ ID NO: 366805 - RNA, 22 nt, Human
acauuucuuccacaugcugcug

SEQ ID NO: 366806 - RNA, 22 nt, Human
aucuggcugcugugcuuaagcu

SEQ ID NO: 366807 - RNA, 22 nt, Human
ucauuuguucaucugcucuucu

SEQ ID NO: 366808 - RNA, 22 nt, Human
ucugggagauccaagcagaacu

SEQ ID NO: 366809 - RNA, 22 nt, Human
ggucccagaauugguuagcaca

SEQ ID NO: 366810 - RNA, 22 nt, Human
auaauguagguauguguauuua

SEQ ID NO: 366811 - RNA, 22 nt, Human
caggggcuagcacuuaauguuu

SEQ ID NO: 366812 - RNA, 22 nt, Human
aaaggucagacuuaggcugggc

SEQ ID NO: 366813 - RNA, 22 nt, Human
gaguccuugucauaauucagug

SEQ ID NO: 366814 - RNA, 22 nt, Human
agacaaaugguaauuaugucua

SEQ ID NO: 366815 - RNA, 22 nt, Human
auuucaaggcuauuaauauaaa

SEQ ID NO: 366816 - RNA, 22 nt, Human
ucacaaauagcuauauuaagga

SEQ ID NO: 366817 - RNA, 22 nt, Human
ugcuuaaaauaguucauuuuug

SEQ ID NO: 366818 - RNA, 19 nt, Human
gggaugggcccucacccuc

SEQ ID NO: 366819 - RNA, 21 nt, Human
ccuucucuugcuucagcuuca

SEQ ID NO: 366820 - RNA, 22 nt, Human
aggccagagaggggaccagccu

SEQ ID NO: 366821 - RNA, 22 nt, Human
aguguuugagacacauuucacu

SEQ ID NO: 366822 - RNA, 22 nt, Human
guaaacaucgacccaacagggg

SEQ ID NO: 366823 - RNA, 17 nt, Human
gcaguggagggguaguu

SEQ ID NO: 366824 - RNA, 22 nt, Human
ucagauggcacacagagccugc

SEQ ID NO: 366825 - RNA, 21 nt, Human
ucagggcagcugcucuucaga

SEQ ID NO: 366826 - RNA, 22 nt, Human
gagacagcacaggccacuggga

SEQ ID NO: 366827 - RNA, 22 nt, Human
gauuuauugucccuguccugcu

SEQ ID NO: 366828 - RNA, 22 nt, Human
gccuggagaagauggaacuagc

SEQ ID NO: 366829 - RNA, 22 nt, Human
ucucaggaucuaauacauggua

SEQ ID NO: 366830 - RNA, 22 nt, Human
uacuuuuagccuauuugauucu

SEQ ID NO: 366831 - RNA, 22 nt, Human
ugggcaggugcuauuuuccaug

SEQ ID NO: 366832 - RNA, 22 nt, Human
cauuuguuggucagauuguagu

SEQ ID NO: 366833 - RNA, 22 nt, Human
gaaacugugaggaucuuaacuu

SEQ ID NO: 366834 - RNA, 22 nt, Human
agcuaccuggcuuaucacuguc

SEQ ID NO: 366835 - RNA, 22 nt, Human
uucauuaguucugaagaugucu

SEQ ID NO: 366836 - RNA, 19 nt, Human
ucaguggaugaacauguuu

SEQ ID NO: 366837 - RNA, 22 nt, Human
aaaaaugcuuggacuuaauaaa

SEQ ID NO: 366838 - RNA, 22 nt, Human
cauuucuguucucuuccuguac

SEQ ID NO: 366839 - RNA, 20 nt, Human
aagagaggaaguuauacuag

SEQ ID NO: 366840 - RNA, 22 nt, Human
cugcuuugauuagaagaguaca

SEQ ID NO: 366841 - RNA, 22 nt, Human
gcuggcaggguucucacugaaa

SEQ ID NO: 366842 - RNA, 22 nt, Human
acacagggcaaugcuuugaccu

SEQ ID NO: 366843 - RNA, 22 nt, Human
ccugggcaaaugccagagacaa

SEQ ID NO: 366844 - RNA, 22 nt, Human
ccugccugggcucacuugccag

SEQ ID NO: 366845 - RNA, 22 nt, Human
ugcuuccugaggccgucuucuc

SEQ ID NO: 366846 - RNA, 22 nt, Human
uucaagaucgaguuuaaaguga

SEQ ID NO: 366847 - RNA, 22 nt, Human
gaaaauuauugaaaauggcucu

SEQ ID NO: 366848 - RNA, 22 nt, Human
ucugucugcaccuaagcacagu

SEQ ID NO: 366849 - RNA, 22 nt, Human
gcagcacauauaaacaaagaga

SEQ ID NO: 366850 - RNA, 22 nt, Human
agaccaagaaaggaugaggauc

SEQ ID NO: 366851 - RNA, 22 nt, Human
gcagggcaugggcccugucugc

SEQ ID NO: 366852 - RNA, 20 nt, Human
accucugcaucaauccuuug

SEQ ID NO: 366853 - RNA, 18 nt, Human
aaaaugcaggcgacaugg

SEQ ID NO: 366854 - RNA, 22 nt, Human
ucaaaauuuuauuucucaagga

SEQ ID NO: 366855 - RNA, 22 nt, Human
aggcucugcagaccccagcugu

SEQ ID NO: 366856 - RNA, 22 nt, Human
acugugcaaugaguaauaaacu

SEQ ID NO: 366857 - RNA, 22 nt, Human
agaguucugcucuucucaguga

SEQ ID NO: 366858 - RNA, 22 nt, Human
ggggaggcugaugugggcaaag

SEQ ID NO: 366859 - RNA, 22 nt, Human
gagagcugucagcguagcaccg

SEQ ID NO: 366860 - RNA, 21 nt, Human
aggcucccagaaaugggcauc

SEQ ID NO: 366861 - RNA, 22 nt, Human
aggcagcagagguugaggaaag

SEQ ID NO: 366862 - RNA, 22 nt, Human
ccugcacuaccuggggcugcug

SEQ ID NO: 366863 - RNA, 22 nt, Human
ugaggggagcccgcccuggacg

SEQ ID NO: 366864 - RNA, 22 nt, Human
ggagccagaggcugcugcugug

SEQ ID NO: 366865 - RNA, 22 nt, Human
aggcagcauuucugcuuaucca

SEQ ID NO: 366866 - RNA, 22 nt, Human
uggggcugugagacuacaggau

SEQ ID NO: 366867 - RNA, 22 nt, Human
gcuguucugcgucccaggcugg

SEQ ID NO: 366868 - RNA, 20 nt, Human
uccuggccucccuggggcuc

SEQ ID NO: 366869 - RNA, 23 nt, Human
agcagccagagauccucggcccu

SEQ ID NO: 366870 - RNA, 22 nt, Human
caggaagcugugaaggagacgg

SEQ ID NO: 366871 - RNA, 22 nt, Human
ugugcaggugcaggaagggggc

SEQ ID NO: 366872 - RNA, 22 nt, Human
uccucuggcccagcugccucug

SEQ ID NO: 366873 - RNA, 21 nt, Human
ggugggcacaggagagcagag

SEQ ID NO: 366874 - RNA, 22 nt, Human
ccaaaauuaagccucuuauguu

SEQ ID NO: 366875 - RNA, 22 nt, Human
gggagggaagguaccuguguga

SEQ ID NO: 366876 - RNA, 22 nt, Human
agucccagcucagaaccacuag

SEQ ID NO: 366877 - RNA, 22 nt, Human
cagagccagcccacuguucccg

SEQ ID NO: 366878 - RNA, 22 nt, Human
gaaggagagggucaaggauaau

SEQ ID NO: 366879 - RNA, 22 nt, Human
uggcagcaauuugugauguuga

SEQ ID NO: 366880 - RNA, 22 nt, Human
uugaacuguaagcaugucugcc

SEQ ID NO: 366881 - RNA, 22 nt, Human
gcugucugggaugucacugcug

SEQ ID NO: 366882 - RNA, 22 nt, Human
acugccuugaaagauuguugag

SEQ ID NO: 366883 - RNA, 22 nt, Human
ucccaggcuggggccaggugac

SEQ ID NO: 366884 - RNA, 22 nt, Human
caugugucaaaugauguagcug

SEQ ID NO: 366885 - RNA, 22 nt, Human
ugaggcaggacuugcauaaagu

SEQ ID NO: 366886 - RNA, 21 nt, Human
aagaagcaauuuauuggaagg

SEQ ID NO: 366887 - RNA, 22 nt, Human
uuccuguaugucagugaagagc

SEQ ID NO: 366888 - RNA, 22 nt, Human
gcccuuccaacccagagggcaa

SEQ ID NO: 366889 - RNA, 22 nt, Human
gcagaggccuagguggaaggcc

SEQ ID NO: 366890 - RNA, 22 nt, Human
gugccugguuuggggaauguuc

SEQ ID NO: 366891 - RNA, 22 nt, Human
aacauucuauuuugcuaaaaca

SEQ ID NO: 366892 - RNA, 22 nt, Human
ccagaggacuugggggcugaau

SEQ ID NO: 366893 - RNA, 22 nt, Human
uuucucuaaauagggaggcuua

SEQ ID NO: 366894 - RNA, 22 nt, Human
ccuggcuggcaagaucgugaag

SEQ ID NO: 366895 - RNA, 22 nt, Human
ugcugccucagcuuccugggcu

SEQ ID NO: 366896 - RNA, 22 nt, Human
uacucagagucauugcccuucu

SEQ ID NO: 366897 - RNA, 22 nt, Human
auggaaagccaguguuccauca

SEQ ID NO: 366898 - RNA, 22 nt, Human
ucucuucugaaaccugucuuua

SEQ ID NO: 366899 - RNA, 22 nt, Human
agaaacauuuagauuauauguc

SEQ ID NO: 366900 - RNA, 22 nt, Human
cugggcaguuuuacaucauugc

SEQ ID NO: 366901 - RNA, 22 nt, Human
auuugaagaaaguuuucuagau

SEQ ID NO: 366902 - RNA, 22 nt, Human
ccagccugguucagaauuggcu

SEQ ID NO: 366903 - RNA, 22 nt, Human
aaagccuugagauccuauaguu

SEQ ID NO: 366904 - RNA, 22 nt, Human
gccaggagaaaaggcgaaugau

SEQ ID NO: 366905 - RNA, 22 nt, Human
cagcugcccaagccccagaugu

SEQ ID NO: 366906 - RNA, 22 nt, Human
ugcugcuccccagcacacagca

SEQ ID NO: 366907 - RNA, 22 nt, Human
uauaauuaguaaauggcagauu

SEQ ID NO: 366908 - RNA, 22 nt, Human
aggcacagcacaccuggccccc

SEQ ID NO: 366909 - RNA, 22 nt, Human
ggcugcucuucuuggcgaccuc

SEQ ID NO: 366910 - RNA, 22 nt, Human
uuccagcuaacucacaucccuu

SEQ ID NO: 366911 - RNA, 22 nt, Human
cagcuggacuuuugauagaagu

SEQ ID NO: 366912 - RNA, 22 nt, Human
accugagaaugggggcaugugu

SEQ ID NO: 366913 - RNA, 21 nt, Human
gagagggcauuauaggaagug

SEQ ID NO: 366914 - RNA, 22 nt, Human
agccuggccugggcaggcacau

SEQ ID NO: 366915 - RNA, 22 nt, Human
agccacagggggugagggacaa

SEQ ID NO: 366916 - RNA, 22 nt, Human
caggacugauguuccuccagcc

SEQ ID NO: 366917 - RNA, 22 nt, Human
ucugucugacaggguaugaacu

SEQ ID NO: 366918 - RNA, 22 nt, Human
ugggcacuauggcucugugcac

SEQ ID NO: 366919 - RNA, 19 nt, Human
ggaccagguccugggcagc

SEQ ID NO: 366920 - RNA, 22 nt, Human
ccaaaauuauuacauuuguagg

SEQ ID NO: 366921 - RNA, 22 nt, Human
gaguaagagcuggcuuuggugu

SEQ ID NO: 366922 - RNA, 22 nt, Human
gcaggcaguuugcuuuucccuc

SEQ ID NO: 366923 - RNA, 22 nt, Human
aagacuguacauuuuccagucu

SEQ ID NO: 366924 - RNA, 23 nt, Human
acaaaugcccauacaucuaguuc

SEQ ID NO: 366925 - RNA, 20 nt, Human
uuucagugguuugugccuag

SEQ ID NO: 366926 - RNA, 22 nt, Human
aaaaggcauggagguugauagu

SEQ ID NO: 366927 - RNA, 22 nt, Human
cugucucuguugccuguaggug

SEQ ID NO: 366928 - RNA, 22 nt, Human
ucaaagagcuauucaguugugg

SEQ ID NO: 366929 - RNA, 22 nt, Human
aaucaguucuacaucuuaucca

SEQ ID NO: 366930 - RNA, 22 nt, Human
gggcuggcaggaccugggcuga

SEQ ID NO: 366931 - RNA, 22 nt, Human
uacuaucucuucuaacuucaga

SEQ ID NO: 366932 - RNA, 22 nt, Human
cucuucuuggcccccaugaggg

SEQ ID NO: 366933 - RNA, 22 nt, Human
uaaagguacgaagugagggauu

SEQ ID NO: 366934 - RNA, 23 nt, Human
ucuguucaaggcuuucuccuuga

SEQ ID NO: 366935 - RNA, 22 nt, Human
uggccugguaccacauagauuu

SEQ ID NO: 366936 - RNA, 22 nt, Human
agggcagcagcggcccaggccu

SEQ ID NO: 366937 - RNA, 22 nt, Human
acagcauucaauaaauaauaac

SEQ ID NO: 366938 - RNA, 22 nt, Human
gagccugggacugggggucaug

SEQ ID NO: 366939 - RNA, 22 nt, Human
aaaauccucuaauucuagaaua

SEQ ID NO: 366940 - RNA, 20 nt, Human
cugagcugagcuccaugggu

SEQ ID NO: 366941 - RNA, 22 nt, Human
aggguggcuggaggaaucagaa

SEQ ID NO: 366942 - RNA, 22 nt, Human
ggcagccaugucccagggcuuc

SEQ ID NO: 366943 - RNA, 22 nt, Human
agaaacugaauuauuucugagg

SEQ ID NO: 366944 - RNA, 22 nt, Human
cugcucugcaaggcacagugau

SEQ ID NO: 366945 - RNA, 22 nt, Human
ggcucccacccauagggcgagu

SEQ ID NO: 366946 - RNA, 22 nt, Human
cugacucuccucaagcauaaau

SEQ ID NO: 366947 - RNA, 22 nt, Human
agcaccugucacaagcagaagg

SEQ ID NO: 366948 - RNA, 22 nt, Human
ucaguggauugacaugaaaaag

SEQ ID NO: 366949 - RNA, 16 nt, Human
agcagccagcacugga

SEQ ID NO: 366950 - RNA, 22 nt, Human
auguuucaccaguuuuauaaga

SEQ ID NO: 366951 - RNA, 19 nt, Human
agugguagaugagcaggag

SEQ ID NO: 366952 - RNA, 22 nt, Human
ucugggcucuuaguguacccuc

SEQ ID NO: 366953 - RNA, 22 nt, Human
aagugacaaaaggguauccaaa

SEQ ID NO: 366954 - RNA, 22 nt, Human
uaggugucugcucuuauuuaac

SEQ ID NO: 366955 - RNA, 22 nt, Human
uaacagaaacagauaaguguaa

SEQ ID NO: 366956 - RNA, 19 nt, Human
auacacauacguaaacuga

SEQ ID NO: 366957 - RNA, 22 nt, Human
auuuguagugaagugaaaauaa

SEQ ID NO: 366958 - RNA, 22 nt, Human
agaacuuaggaacaacagcuua

SEQ ID NO: 366959 - RNA, 17 nt, Human
uccagagcacagagcuc

SEQ ID NO: 366960 - RNA, 22 nt, Human
auagugguuggauaugucagag

SEQ ID NO: 366961 - RNA, 22 nt, Human
ccagggcaacgcugucucagag

SEQ ID NO: 366962 - RNA, 22 nt, Human
aucuauuaugcugagaaacugu

SEQ ID NO: 366963 - RNA, 22 nt, Human
agugcuguuagguuaauauagu

SEQ ID NO: 366964 - RNA, 22 nt, Human
cuuguucaguugccucuccugc

SEQ ID NO: 366965 - RNA, 22 nt, Human
gggcaagcucuucagaagcucu

SEQ ID NO: 366966 - RNA, 20 nt, Human
ucagugauuuugaagaggaa

SEQ ID NO: 366967 - RNA, 22 nt, Human
aagaaaucugauauuuguuuca

SEQ ID NO: 366968 - RNA, 19 nt, Human
aagaagcaauaagcuguga

SEQ ID NO: 366969 - RNA, 22 nt, Human
ugcucccaaacgaccuacugug

SEQ ID NO: 366970 - RNA, 22 nt, Human
ucacaaaugaggaaaucgagca

SEQ ID NO: 366971 - RNA, 22 nt, Human
cacuggggugggccugguagag

SEQ ID NO: 366972 - RNA, 22 nt, Human
cccagcagugacccagugauac

SEQ ID NO: 366973 - RNA, 22 nt, Human
ggcauuuaauccaucugauuga

SEQ ID NO: 366974 - RNA, 19 nt, Human
gguagaagggaaguguuuu

SEQ ID NO: 366975 - RNA, 22 nt, Human
gggucuggacggcugcaggaag

SEQ ID NO: 366976 - RNA, 22 nt, Human
gguacaauccacuguggguuag

SEQ ID NO: 366977 - RNA, 22 nt, Human
ccagugcuaagguagccucugc

SEQ ID NO: 366978 - RNA, 22 nt, Human
uuccaagagcuuuaauuguuga

SEQ ID NO: 366979 - RNA, 22 nt, Human
gguggggucacgacagagggaa

SEQ ID NO: 366980 - RNA, 22 nt, Human
ucacaggguaucugggauggau

SEQ ID NO: 366981 - RNA, 22 nt, Human
gcugcugguccucagagcucau

SEQ ID NO: 366982 - RNA, 22 nt, Human
gcagcuuugaagacuuauuugc

SEQ ID NO: 366983 - RNA, 18 nt, Human
ccuggcagccaugcgcgc

SEQ ID NO: 366984 - RNA, 22 nt, Human
gggcugacgaaggccaugugug

SEQ ID NO: 366985 - RNA, 19 nt, Human
gaggaggcuucagcuuucu

SEQ ID NO: 366986 - RNA, 22 nt, Human
ugcuaucucuauauccauuuau

SEQ ID NO: 366987 - RNA, 22 nt, Human
gaaguccuccuaucuugcucuu

SEQ ID NO: 366988 - RNA, 22 nt, Human
aaguccagaacuccugugauag

SEQ ID NO: 366989 - RNA, 22 nt, Human
uuauuauugugaccugagaaug

SEQ ID NO: 366990 - RNA, 22 nt, Human
uccaugaggaccaaauucguag

SEQ ID NO: 366991 - RNA, 22 nt, Human
aagaacagauucagccugaacu

SEQ ID NO: 366992 - RNA, 20 nt, Human
aucuucuuggccagcuugcu

SEQ ID NO: 366993 - RNA, 22 nt, Human
gcuuccugagaaacaaucugau

SEQ ID NO: 366994 - RNA, 22 nt, Human
uauuucuggcuuugagggugau

SEQ ID NO: 366995 - RNA, 22 nt, Human
augcaguaaauguuaagaaaaa

SEQ ID NO: 366996 - RNA, 22 nt, Human
ggccucgcggcuucugguggcu

SEQ ID NO: 366997 - RNA, 22 nt, Human
ugccagcccaccuuggggccuc

SEQ ID NO: 366998 - RNA, 22 nt, Human
gcauuuguguucuuccuagagc

SEQ ID NO: 366999 - RNA, 22 nt, Human
uggugugggcguggcaggcaag

SEQ ID NO: 367000 - RNA, 22 nt, Human
aauuaacagagggcuuauuacu

SEQ ID NO: 367001 - RNA, 22 nt, Human
uagcauuuauggucaugugucc

SEQ ID NO: 367002 - RNA, 22 nt, Human
augaggcaaggcuggccguguu

SEQ ID NO: 367003 - RNA, 22 nt, Human
gauaaugaugacaaugacaacc

SEQ ID NO: 367004 - RNA, 22 nt, Human
gucagcaccucuuuggggagcu

SEQ ID NO: 367005 - RNA, 22 nt, Human
cugugucccaguaccuugggua

SEQ ID NO: 367006 - RNA, 22 nt, Human
guccuggggauuauagaguguu

SEQ ID NO: 367007 - RNA, 22 nt, Human
aggggagccccugguccuggug

SEQ ID NO: 367008 - RNA, 22 nt, Human
uaugcauaauuggauaaguaga

SEQ ID NO: 367009 - RNA, 22 nt, Human
uggccuggcagagcaaggccug

SEQ ID NO: 367010 - RNA, 22 nt, Human
uagaaacucaggauacucuucc

SEQ ID NO: 367011 - RNA, 22 nt, Human
aggaccugacauuguguuuucu

SEQ ID NO: 367012 - RNA, 22 nt, Human
uaauuucacaguucaacgcaca

SEQ ID NO: 367013 - RNA, 22 nt, Human
caugcagugacucagacacagg

SEQ ID NO: 367014 - RNA, 22 nt, Human
cagcaaaagccagcauaagcuc

SEQ ID NO: 367015 - RNA, 22 nt, Human
gcaguggcuaagcucgcaugca

SEQ ID NO: 367016 - RNA, 22 nt, Human
agcccagggaaccaggaagugg

SEQ ID NO: 367017 - RNA, 22 nt, Human
ugaggcaggagguugagaacug

SEQ ID NO: 367018 - RNA, 22 nt, Human
aggauuuagauuuggaggaacu

SEQ ID NO: 367019 - RNA, 23 nt, Human
uggccuggagagaaaagaugagu

SEQ ID NO: 367020 - RNA, 18 nt, Human
acaaauguagugucuuaa

SEQ ID NO: 367021 - RNA, 22 nt, Human
ccugccuguacuagagacccag

SEQ ID NO: 367022 - RNA, 22 nt, Human
agaaaucaugucuuauuucuau

SEQ ID NO: 367023 - RNA, 22 nt, Human
uguguccauucaggcacugacc

SEQ ID NO: 367024 - RNA, 22 nt, Human
ugcugaggagguggcugugcuu

SEQ ID NO: 367025 - RNA, 20 nt, Human
gcagagcuguucugugggga

SEQ ID NO: 367026 - RNA, 22 nt, Human
uuucuuagcgaugcuugauaaa

SEQ ID NO: 367027 - RNA, 20 nt, Human
aggaaaaauggaaacuggag

SEQ ID NO: 367028 - RNA, 22 nt, Human
uuggccuucccuaccugggcca

SEQ ID NO: 367029 - RNA, 22 nt, Human
gagaggcugaaaucacaggagc

SEQ ID NO: 367030 - RNA, 21 nt, Human
ccugccaggaaacugaguguc

SEQ ID NO: 367031 - RNA, 22 nt, Human
agaaaucuaagaugcucaagga

SEQ ID NO: 367032 - RNA, 22 nt, Human
ugcagcagacugaguaugagaa

SEQ ID NO: 367033 - RNA, 22 nt, Human
auauaguuggguuucauucuac

SEQ ID NO: 367034 - RNA, 20 nt, Human
guggcaggcagugaaggagc

SEQ ID NO: 367035 - RNA, 19 nt, Human
caaggccaccauuucuccg

SEQ ID NO: 367036 - RNA, 22 nt, Human
guguccuuauaagaagagaugc

SEQ ID NO: 367037 - RNA, 22 nt, Human
agggcugacaguggcguggcgu

SEQ ID NO: 367038 - RNA, 22 nt, Human
cacauuuaaagguugaagcuga

SEQ ID NO: 367039 - RNA, 22 nt, Human
uggggcucaccuaggcuggaag

SEQ ID NO: 367040 - RNA, 22 nt, Human
ugcccugcagugagugcgucug

SEQ ID NO: 367041 - RNA, 22 nt, Human
aauguacaauaagacaaagagg

SEQ ID NO: 367042 - RNA, 22 nt, Human
aauuuacacuucauuuggaggg

SEQ ID NO: 367043 - RNA, 22 nt, Human
aacaugauuuaguauaaugcag

SEQ ID NO: 367044 - RNA, 20 nt, Human
gcagggcaagggauaugaaa

SEQ ID NO: 367045 - RNA, 20 nt, Human
cuguaucagguuacaaagua

SEQ ID NO: 367046 - RNA, 20 nt, Human
cagagaccaggccagguguc

SEQ ID NO: 367047 - RNA, 23 nt, Human
ucuggcuccauccuuggggaucc

SEQ ID NO: 367048 - RNA, 22 nt, Human
aagccaguguuuuugagaguug

SEQ ID NO: 367049 - RNA, 22 nt, Human
ucuggcucauaggaaggccauu

SEQ ID NO: 367050 - RNA, 22 nt, Human
acaguggagcucagaugaaaau

SEQ ID NO: 367051 - RNA, 22 nt, Human
ugccucagagugggcuugcuau

SEQ ID NO: 367052 - RNA, 19 nt, Human
gggcaguggcacuagggag

SEQ ID NO: 367053 - RNA, 22 nt, Human
cuucuucaauagcaagcgcaua

SEQ ID NO: 367054 - RNA, 22 nt, Human
ggucagggcucuuccaguggcu

SEQ ID NO: 367055 - RNA, 22 nt, Human
uucauucuugggaucagagagu

SEQ ID NO: 367056 - RNA, 22 nt, Human
ucagccaguuugauucuauuug

SEQ ID NO: 367057 - RNA, 22 nt, Human
uggcucagugaagagauaacuu

SEQ ID NO: 367058 - RNA, 22 nt, Human
cugaggcuuggaggggucuggu

SEQ ID NO: 367059 - RNA, 22 nt, Human
gacaggcuuugagucccagaac

SEQ ID NO: 367060 - RNA, 23 nt, Human
aggagaagagauuuccacaugca

SEQ ID NO: 367061 - RNA, 22 nt, Human
ccagaggugcugggagaggucu

SEQ ID NO: 367062 - RNA, 22 nt, Human
caauuucacugacacccuggaa

SEQ ID NO: 367063 - RNA, 22 nt, Human
ggagccagcagggugacacuga

SEQ ID NO: 367064 - RNA, 22 nt, Human
agguuauaugucauacugaagu

SEQ ID NO: 367065 - RNA, 22 nt, Human
cucuuucaguucugauagucuc

SEQ ID NO: 367066 - RNA, 22 nt, Human
uccauuuuagaagaaaauccac

SEQ ID NO: 367067 - RNA, 22 nt, Human
uuccuguauuuugcgaauuuuc

SEQ ID NO: 367068 - RNA, 22 nt, Human
ucacuguaucauguugcacuua

SEQ ID NO: 367069 - RNA, 22 nt, Human
acucaggagggaucagcuauca

SEQ ID NO: 367070 - RNA, 22 nt, Human
uguuuauucauggcuaaugaaa

SEQ ID NO: 367071 - RNA, 22 nt, Human
aagagguaaccauagcaaccac

SEQ ID NO: 367072 - RNA, 22 nt, Human
cagggcuguuagcugcugcucu

SEQ ID NO: 367073 - RNA, 22 nt, Human
ggagaaugauauauagcucagu

SEQ ID NO: 367074 - RNA, 22 nt, Human
uggagcaggaagucuauggcug

SEQ ID NO: 367075 - RNA, 22 nt, Human
ggagaggacauggcucccacag

SEQ ID NO: 367076 - RNA, 17 nt, Human
cccagcuggcagugccg

SEQ ID NO: 367077 - RNA, 22 nt, Human
ucugggaacagccuggcugugu

SEQ ID NO: 367078 - RNA, 22 nt, Human
aggggcugcuggguccgccccu

SEQ ID NO: 367079 - RNA, 22 nt, Human
ugccagaagugcuuuauaagug

SEQ ID NO: 367080 - RNA, 22 nt, Human
aaaggaagauugagcuuuucca

SEQ ID NO: 367081 - RNA, 22 nt, Human
aaggagcucccggcagaccagg

SEQ ID NO: 367082 - RNA, 22 nt, Human
uccaggcuaauuuugcauuguu

SEQ ID NO: 367083 - RNA, 22 nt, Human
ggcucaggacugcagcguagag

SEQ ID NO: 367084 - RNA, 22 nt, Human
augagcuguaagguggcuuccu

SEQ ID NO: 367085 - RNA, 22 nt, Human
aggcugggaagguaaaguugua

SEQ ID NO: 367086 - RNA, 22 nt, Human
cuacauaaucuggauuugucug

SEQ ID NO: 367087 - RNA, 22 nt, Human
ggagcugcuuugaucugaagaa

SEQ ID NO: 367088 - RNA, 22 nt, Human
ugcugucuuccaggauggugaa

SEQ ID NO: 367089 - RNA, 22 nt, Human
ggccucucuggcauggcugccc

SEQ ID NO: 367090 - RNA, 22 nt, Human
agacaugucaccaauucuuacu

SEQ ID NO: 367091 - RNA, 22 nt, Human
cugcugugcacccaggaaggcu

SEQ ID NO: 367092 - RNA, 22 nt, Human
acuguccaagcaugccuggcuu

SEQ ID NO: 367093 - RNA, 22 nt, Human
augcugugaaaaagaaggcuga

SEQ ID NO: 367094 - RNA, 21 nt, Human
ucuggagcccuaagcugagaa

SEQ ID NO: 367095 - RNA, 22 nt, Human
cugcagagcuaggcugagugaa

SEQ ID NO: 367096 - RNA, 22 nt, Human
uggcagggccugaaucuuauac

SEQ ID NO: 367097 - RNA, 22 nt, Human
agaaaugacaagacugaucagg

SEQ ID NO: 367098 - RNA, 22 nt, Human
cgcagcagccccgugguaggug

SEQ ID NO: 367099 - RNA, 20 nt, Human
acauugauuauguuuguaga

SEQ ID NO: 367100 - RNA, 21 nt, Human
agcagcagaucuggugagggc

SEQ ID NO: 367101 - RNA, 22 nt, Human
gggacccugggaggcuggcgca

SEQ ID NO: 367102 - RNA, 22 nt, Human
cucuggaguucuucaagcuacu

SEQ ID NO: 367103 - RNA, 22 nt, Human
caaaugcagauucaggaguucu

SEQ ID NO: 367104 - RNA, 22 nt, Human
ugcuuaauaggaguugaacauu

SEQ ID NO: 367105 - RNA, 19 nt, Human
gcugucugaugcugagguc

SEQ ID NO: 367106 - RNA, 22 nt, Human
ccaaaggccaagcucagguaaa

SEQ ID NO: 367107 - RNA, 22 nt, Human
uuccaugugaguacacugugau

SEQ ID NO: 367108 - RNA, 22 nt, Human
gaagccaacauuccaaguagaa

SEQ ID NO: 367109 - RNA, 22 nt, Human
caggaaccuaaugaaggcucac

SEQ ID NO: 367110 - RNA, 22 nt, Human
cacucuccagcacaccccauuu

SEQ ID NO: 367111 - RNA, 22 nt, Human
ugaagcaaacgcuucuguuccu

SEQ ID NO: 367112 - RNA, 20 nt, Human
ccaggccugggccugcucua

SEQ ID NO: 367113 - RNA, 22 nt, Human
ccaggcugccgaggaaagaaag

SEQ ID NO: 367114 - RNA, 22 nt, Human
acagaauuaucaggaaauguua

SEQ ID NO: 367115 - RNA, 22 nt, Human
agccauucauugugcucucaga

SEQ ID NO: 367116 - RNA, 22 nt, Human
uggcugagccacuuguucagau

SEQ ID NO: 367117 - RNA, 22 nt, Human
uggccugcagcucucagggaag

SEQ ID NO: 367118 - RNA, 22 nt, Human
cacauaaguggguuccauugca

SEQ ID NO: 367119 - RNA, 21 nt, Human
ccucuggcuugugcugugccc

SEQ ID NO: 367120 - RNA, 22 nt, Human
ucagaagacuacuaggacacau

SEQ ID NO: 367121 - RNA, 22 nt, Human
aguguuccugcucucaggaagc

SEQ ID NO: 367122 - RNA, 22 nt, Human
agaaggaguguacaggucaugc

SEQ ID NO: 367123 - RNA, 22 nt, Human
agugcuguaacaacuuauuugg

SEQ ID NO: 367124 - RNA, 19 nt, Human
agauggcaaaaugcaaaga

SEQ ID NO: 367125 - RNA, 22 nt, Human
cuccagugagcgcggggcaugg

SEQ ID NO: 367126 - RNA, 22 nt, Human
ucaugcccagagcaguaaauua

SEQ ID NO: 367127 - RNA, 22 nt, Human
gccagcagguugucaaggagcu

SEQ ID NO: 367128 - RNA, 22 nt, Human
uuucaagaacaacauucauuca

SEQ ID NO: 367129 - RNA, 22 nt, Human
caaaugauagagccgauuauca

SEQ ID NO: 367130 - RNA, 22 nt, Human
cuggcucaggaaaguugcugcu

SEQ ID NO: 367131 - RNA, 22 nt, Human
gcagcauugcacuuuuguucuu

SEQ ID NO: 367132 - RNA, 22 nt, Human
caacagagagaccagaaacagg

SEQ ID NO: 367133 - RNA, 22 nt, Human
guuagggagggugcauaugugu

SEQ ID NO: 367134 - RNA, 22 nt, Human
aauaguguuguucacucaggag

SEQ ID NO: 367135 - RNA, 22 nt, Human
ugcuggaggcaguggaggugcc

SEQ ID NO: 367136 - RNA, 22 nt, Human
augcaucuauucccaagggcag

SEQ ID NO: 367137 - RNA, 21 nt, Human
aguugcauaggccagccaucc

SEQ ID NO: 367138 - RNA, 21 nt, Human
ugggcacugagggugcugcuc

SEQ ID NO: 367139 - RNA, 22 nt, Human
cagcucugcugggaggaugcag

SEQ ID NO: 367140 - RNA, 22 nt, Human
uggaaagacauucagccgcugg

SEQ ID NO: 367141 - RNA, 22 nt, Human
gagaggauccacaaaccaggaa

SEQ ID NO: 367142 - RNA, 22 nt, Human
uguauuuucuucuggaagcuua

SEQ ID NO: 367143 - RNA, 22 nt, Human
gccucugcaacuccgccuuggu

SEQ ID NO: 367144 - RNA, 22 nt, Human
aagcagaauuuaauagaaaggu

SEQ ID NO: 367145 - RNA, 22 nt, Human
uguggccagcagguggcugugu

SEQ ID NO: 367146 - RNA, 20 nt, Human
gaaggaagggggcaagguga

SEQ ID NO: 367147 - RNA, 22 nt, Human
ccaccuccaccuauugccagcc

SEQ ID NO: 367148 - RNA, 22 nt, Human
ccaggaguggcuggugaccuuc

SEQ ID NO: 367149 - RNA, 22 nt, Human
uguuacuuaucucacgugaugc

SEQ ID NO: 367150 - RNA, 22 nt, Human
augauacaagcaaaacuaauca

SEQ ID NO: 367151 - RNA, 22 nt, Human
ggcugagccaugggcacugcag

SEQ ID NO: 367152 - RNA, 22 nt, Human
cucaggcccacagcagacccac

SEQ ID NO: 367153 - RNA, 22 nt, Human
gcagugcuuuagucuguccuuu

SEQ ID NO: 367154 - RNA, 22 nt, Human
cugugcccuggccaggccucuc

SEQ ID NO: 367155 - RNA, 22 nt, Human
aguugacauccauaacaggaag

SEQ ID NO: 367156 - RNA, 22 nt, Human
uauuuaauuagugauuguagag

SEQ ID NO: 367157 - RNA, 22 nt, Human
agauuuccugcacugccuuuga

SEQ ID NO: 367158 - RNA, 22 nt, Human
gaaggaaaaauacucuguaagg

SEQ ID NO: 367159 - RNA, 19 nt, Human
ggcugcugguuacagaggc

SEQ ID NO: 367160 - RNA, 22 nt, Human
acuucaugcagaagagagcugu

SEQ ID NO: 367161 - RNA, 22 nt, Human
uugcagggaccugcagaaagcu

SEQ ID NO: 367162 - RNA, 22 nt, Human
acugugugaaacaucaaugugu

SEQ ID NO: 367163 - RNA, 22 nt, Human
gucagagagggcacgugcacac

SEQ ID NO: 367164 - RNA, 22 nt, Human
caggaggcaucauggagcggac

SEQ ID NO: 367165 - RNA, 22 nt, Human
uggccugacugucaggcuguau

SEQ ID NO: 367166 - RNA, 22 nt, Human
cauuaagauuuuuuucuacugg

SEQ ID NO: 367167 - RNA, 22 nt, Human
ggucccagguugacagggagac

SEQ ID NO: 367168 - RNA, 22 nt, Human
cccagcucugcagaccugcccu

SEQ ID NO: 367169 - RNA, 22 nt, Human
cccugagcccauaguugacauu

SEQ ID NO: 367170 - RNA, 19 nt, Human
ggugaccaccuggucagug

SEQ ID NO: 367171 - RNA, 22 nt, Human
ucuggcucuccagugcucuuag

SEQ ID NO: 367172 - RNA, 22 nt, Human
ucugccugagggagcugaggaa

SEQ ID NO: 367173 - RNA, 19 nt, Human
accaggcuuauggucagug

SEQ ID NO: 367174 - RNA, 22 nt, Human
aggaagcucaaagccaugaugu

SEQ ID NO: 367175 - RNA, 20 nt, Human
gaggcucugggcauggcgcc

SEQ ID NO: 367176 - RNA, 22 nt, Human
ucaguaacuuacuuauucaccu

SEQ ID NO: 367177 - RNA, 22 nt, Human
ggacaggaugcugaagaugaag

SEQ ID NO: 367178 - RNA, 22 nt, Human
gaggccuggcucugcccuccug

SEQ ID NO: 367179 - RNA, 22 nt, Human
gcacaugagcugcugggauggg

SEQ ID NO: 367180 - RNA, 22 nt, Human
ugagaagcugcugacuuagccu

SEQ ID NO: 367181 - RNA, 22 nt, Human
uguccuuauaagaaaaggaaau

SEQ ID NO: 367182 - RNA, 22 nt, Human
ucagguggcuucggggaguggc

SEQ ID NO: 367183 - RNA, 22 nt, Human
cagaggcaaaagagguggaggu

SEQ ID NO: 367184 - RNA, 22 nt, Human
aaaauucugucauuaaauugug

SEQ ID NO: 367185 - RNA, 22 nt, Human
ucacauuuuaucugagauugac

SEQ ID NO: 367186 - RNA, 22 nt, Human
ugggcuguccagcaccugggcu

SEQ ID NO: 367187 - RNA, 22 nt, Human
gguggccaggccagcucuggcc

SEQ ID NO: 367188 - RNA, 22 nt, Human
agagccagcaacucuagcccug

SEQ ID NO: 367189 - RNA, 22 nt, Human
ccugugugcugaugacgacaga

SEQ ID NO: 367190 - RNA, 22 nt, Human
accaaaaauuguggggcugaau

SEQ ID NO: 367191 - RNA, 21 nt, Human
ucaaagcacauauuugcacau

SEQ ID NO: 367192 - RNA, 22 nt, Human
gugccuuccccgguggucuguu

SEQ ID NO: 367193 - RNA, 22 nt, Human
ucucuggagcugcagauccagg

SEQ ID NO: 367194 - RNA, 20 nt, Human
uugauaggcagcuugucagg

SEQ ID NO: 367195 - RNA, 22 nt, Human
cucagagcccaggguacacccg

SEQ ID NO: 367196 - RNA, 22 nt, Human
uugcagcuucgagucuaucugu

SEQ ID NO: 367197 - RNA, 22 nt, Human
uuauuugcccauguuuagcaga

SEQ ID NO: 367198 - RNA, 22 nt, Human
agucccagugagaugagccacg

SEQ ID NO: 367199 - RNA, 22 nt, Human
augcaguguuuggaagcuuaag

SEQ ID NO: 367200 - RNA, 22 nt, Human
cuuugaagagauuacugugcuc

SEQ ID NO: 367201 - RNA, 22 nt, Human
acauuuuuauucaucaaagcag

SEQ ID NO: 367202 - RNA, 17 nt, Human
gaaagguccuagaaauc

SEQ ID NO: 367203 - RNA, 22 nt, Human
gcugggaagugcaagaucaagg

SEQ ID NO: 367204 - RNA, 22 nt, Human
gaucagaaugggacauauccug

SEQ ID NO: 367205 - RNA, 22 nt, Human
aucaguuaguuacugcuaagau

SEQ ID NO: 367206 - RNA, 22 nt, Human
acauucaugucccacuucuagc

SEQ ID NO: 367207 - RNA, 22 nt, Human
gaacagcccuguuaagucuguu

SEQ ID NO: 367208 - RNA, 22 nt, Human
uggcucugaucagauguccagu

SEQ ID NO: 367209 - RNA, 22 nt, Human
uugcagcuucuaccacuguuuc

SEQ ID NO: 367210 - RNA, 22 nt, Human
uuugaauagcauaggauuacau

SEQ ID NO: 367211 - RNA, 22 nt, Human
ucuguucagaaauggaagugcc

SEQ ID NO: 367212 - RNA, 22 nt, Human
ccaggagagcaggcgugcagcu

SEQ ID NO: 367213 - RNA, 22 nt, Human
gucacuguauccagguuccagc

SEQ ID NO: 367214 - RNA, 18 nt, Human
cugaggcuuagagagguu

SEQ ID NO: 367215 - RNA, 22 nt, Human
guaggaagcucugaggcuaguu

SEQ ID NO: 367216 - RNA, 22 nt, Human
aagaacauguuaaaagauucac

SEQ ID NO: 367217 - RNA, 22 nt, Human
ucacaggcuugugaacauugca

SEQ ID NO: 367218 - RNA, 22 nt, Human
gaguccaguucuuuccagcagu

SEQ ID NO: 367219 - RNA, 22 nt, Human
aauuucaaguggcaucuuugau

SEQ ID NO: 367220 - RNA, 22 nt, Human
gaggcucagagggagcaugguc

SEQ ID NO: 367221 - RNA, 22 nt, Human
cagauuucagcucauauauuau

SEQ ID NO: 367222 - RNA, 22 nt, Human
agguggggccaaaugcuacagu

SEQ ID NO: 367223 - RNA, 22 nt, Human
agggugguucuuuuaguggaag

SEQ ID NO: 367224 - RNA, 22 nt, Human
cagugauggauauggagaaguc

SEQ ID NO: 367225 - RNA, 17 nt, Human
cagcuuuaugcuacugu

SEQ ID NO: 367226 - RNA, 23 nt, Human
uccucccaaauuucagccucauu

SEQ ID NO: 367227 - RNA, 22 nt, Human
cugcugccggcgagccucccuu

SEQ ID NO: 367228 - RNA, 21 nt, Human
acagcaagccuuccuuucagg

SEQ ID NO: 367229 - RNA, 22 nt, Human
cagagccccucagcucucuccc

SEQ ID NO: 367230 - RNA, 22 nt, Human
gaggcagcgggucaggaccgug

SEQ ID NO: 367231 - RNA, 22 nt, Human
cagaagaauggugucugagcuc

SEQ ID NO: 367232 - RNA, 18 nt, Human
cugcccagagcacuugug

SEQ ID NO: 367233 - RNA, 22 nt, Human
aaaagguuuugaguacaaauau

SEQ ID NO: 367234 - RNA, 22 nt, Human
ucugggagacguguguugucag

SEQ ID NO: 367235 - RNA, 22 nt, Human
ccaggccucccuuuuccagcca

SEQ ID NO: 367236 - RNA, 22 nt, Human
agagggcugccucagucagcua

SEQ ID NO: 367237 - RNA, 22 nt, Human
ggcugcuguuucagagacuguu

SEQ ID NO: 367238 - RNA, 22 nt, Human
ugggcccugacuucaagcaucc

SEQ ID NO: 367239 - RNA, 22 nt, Human
aagagagggguugcauggaaau

SEQ ID NO: 367240 - RNA, 22 nt, Human
aggcuauuuccacucuucucau

SEQ ID NO: 367241 - RNA, 23 nt, Human
gggaccagcuagggcugugaccu

SEQ ID NO: 367242 - RNA, 22 nt, Human
agguaacacuacuuaguauacu

SEQ ID NO: 367243 - RNA, 22 nt, Human
gaggagaaagcagugauuugug

SEQ ID NO: 367244 - RNA, 22 nt, Human
gagacguggccuuugccugagc

SEQ ID NO: 367245 - RNA, 22 nt, Human
aucagaaaguucaucauguuug

SEQ ID NO: 367246 - RNA, 22 nt, Human
cuggcucacuagcccugcccug

SEQ ID NO: 367247 - RNA, 22 nt, Human
auggggugaccaugagcauuua

SEQ ID NO: 367248 - RNA, 22 nt, Human
cuguccauuuucgugccuccuu

SEQ ID NO: 367249 - RNA, 22 nt, Human
acaguggaugugauguccaggu

SEQ ID NO: 367250 - RNA, 22 nt, Human
gaaagcaguaaaugggucccau

SEQ ID NO: 367251 - RNA, 22 nt, Human
ugcagggagcucuggggugcag

SEQ ID NO: 367252 - RNA, 22 nt, Human
aauggcugggaguguauuuugg

SEQ ID NO: 367253 - RNA, 22 nt, Human
auuguauaacagcauguauuuu

SEQ ID NO: 367254 - RNA, 22 nt, Human
ccagagaggggaagggcuugcc

SEQ ID NO: 367255 - RNA, 22 nt, Human
aacaaccaaaaagaugaaugua

SEQ ID NO: 367256 - RNA, 22 nt, Human
aagaaauguagagccuaguaaa

SEQ ID NO: 367257 - RNA, 22 nt, Human
gcuguggaaaugccuaacauga

SEQ ID NO: 367258 - RNA, 20 nt, Human
ucauuucuugggguuccaag

SEQ ID NO: 367259 - RNA, 22 nt, Human
cagcaggauuggauacaucuca

SEQ ID NO: 367260 - RNA, 22 nt, Human
ucucuucuugauuuucacugga

SEQ ID NO: 367261 - RNA, 23 nt, Human
uuucuguuggguauauauccaag

SEQ ID NO: 367262 - RNA, 22 nt, Human
uggcuggggccugaauccugca

SEQ ID NO: 367263 - RNA, 22 nt, Human
gccucugccaagggggcugcgg

SEQ ID NO: 367264 - RNA, 22 nt, Human
accuggcacuacaggcaccugu

SEQ ID NO: 367265 - RNA, 22 nt, Human
ugugucagaaggcaauggggau

SEQ ID NO: 367266 - RNA, 22 nt, Human
ggugcagaggagccagcugggg

SEQ ID NO: 367267 - RNA, 22 nt, Human
agaugcugugaggaagcuagga

SEQ ID NO: 367268 - RNA, 22 nt, Human
ccugggagugucagacuugcuu

SEQ ID NO: 367269 - RNA, 22 nt, Human
aagcugccauagaacgagaggu

SEQ ID NO: 367270 - RNA, 23 nt, Human
uucaaagcuuaagcucuuuccac

SEQ ID NO: 367271 - RNA, 22 nt, Human
ucaggcuggagugcaguggcgc

SEQ ID NO: 367272 - RNA, 22 nt, Human
aaucuggcauuugagaguagga

SEQ ID NO: 367273 - RNA, 18 nt, Human
uugcuuuguaagcuugca

SEQ ID NO: 367274 - RNA, 22 nt, Human
acaggcagcacuaaucucuggu

SEQ ID NO: 367275 - RNA, 22 nt, Human
ggcuagaacuuuacacuuugca

SEQ ID NO: 367276 - RNA, 17 nt, Human
ugaaggaaggaugaugu

SEQ ID NO: 367277 - RNA, 22 nt, Human
gcaugcugcaccagagccucuc

SEQ ID NO: 367278 - RNA, 22 nt, Human
aaauauagugacacuuauaguc

SEQ ID NO: 367279 - RNA, 22 nt, Human
gcaugguggccuuaggguagcc

SEQ ID NO: 367280 - RNA, 22 nt, Human
ccacuggcauccagcugccauc

SEQ ID NO: 367281 - RNA, 22 nt, Human
cagaauaaaagucccaaggcau

SEQ ID NO: 367282 - RNA, 22 nt, Human
agccuccuggaguuucugggau

SEQ ID NO: 367283 - RNA, 22 nt, Human
cucucccccacagcagccuucu

SEQ ID NO: 367284 - RNA, 22 nt, Human
aggcaggcacuccggaaguguc

SEQ ID NO: 367285 - RNA, 22 nt, Human
cagacccucgggugaguuggcc

SEQ ID NO: 367286 - RNA, 22 nt, Human
caaugauguuuagauaaaaucc

SEQ ID NO: 367287 - RNA, 22 nt, Human
guuuucuuugaaugcuucuaga

SEQ ID NO: 367288 - RNA, 22 nt, Human
aguuugaauugaaaugcagaug

SEQ ID NO: 367289 - RNA, 22 nt, Human
gcagauggcagcccaggcuggg

SEQ ID NO: 367290 - RNA, 22 nt, Human
cagggguguuuuuggccaggag

SEQ ID NO: 367291 - RNA, 22 nt, Human
auucuuauuuaaauagagucug

SEQ ID NO: 367292 - RNA, 22 nt, Human
auucuucauacagacaaguccu

SEQ ID NO: 367293 - RNA, 22 nt, Human
auaagguaugaaaaguaaaugg

SEQ ID NO: 367294 - RNA, 22 nt, Human
gcagaggagcaagcuggacacc

SEQ ID NO: 367295 - RNA, 22 nt, Human
caggcagccaggggaccugucc

SEQ ID NO: 367296 - RNA, 22 nt, Human
ccuggcagcauugguagagauu

SEQ ID NO: 367297 - RNA, 22 nt, Human
ugaggcucacaaaucugcauuu

SEQ ID NO: 367298 - RNA, 22 nt, Human
cagccagagaaagggcacugcc

SEQ ID NO: 367299 - RNA, 20 nt, Human
gaagcagcuucauguagaca

SEQ ID NO: 367300 - RNA, 21 nt, Human
ugccagcauguaggcuaguug

SEQ ID NO: 367301 - RNA, 22 nt, Human
cccaggaaguggagguugcagu

SEQ ID NO: 367302 - RNA, 22 nt, Human
cuuaauuucaaacugcuaguga

SEQ ID NO: 367303 - RNA, 22 nt, Human
ugcagcugcuugauucaucuug

SEQ ID NO: 367304 - RNA, 17 nt, Human
ucucuuucccuuucugc

SEQ ID NO: 367305 - RNA, 20 nt, Human
ucuggcaggugaacgagcug

SEQ ID NO: 367306 - RNA, 22 nt, Human
cuguacaucucugaggacagua

SEQ ID NO: 367307 - RNA, 22 nt, Human
cuggagggugagccucaucucu

SEQ ID NO: 367308 - RNA, 20 nt, Human
cagaggcauuuucagacucu

SEQ ID NO: 367309 - RNA, 22 nt, Human
uauugacaauuugugaaacuau

SEQ ID NO: 367310 - RNA, 22 nt, Human
cauugaaaccuaacauaggcug

SEQ ID NO: 367311 - RNA, 22 nt, Human
cccaggagauaacguucccaag

SEQ ID NO: 367312 - RNA, 22 nt, Human
guggauggauuuugaggaaugg

SEQ ID NO: 367313 - RNA, 22 nt, Human
ucaaaguaaaaguauagaguuu

SEQ ID NO: 367314 - RNA, 22 nt, Human
gagaaacuuggaguuauucugg

SEQ ID NO: 367315 - RNA, 22 nt, Human
aggugccagcucucaggcagga

SEQ ID NO: 367316 - RNA, 22 nt, Human
uuaacagauguuuauggagcau

SEQ ID NO: 367317 - RNA, 22 nt, Human
ucucugggauaaacugggccag

SEQ ID NO: 367318 - RNA, 18 nt, Human
uccauuguucuacuguga

SEQ ID NO: 367319 - RNA, 22 nt, Human
aaaugcaugagaaaguauucug

SEQ ID NO: 367320 - RNA, 22 nt, Human
ucaaaugcuucuacuccuaaga

SEQ ID NO: 367321 - RNA, 22 nt, Human
ucaauucugguccucaggaacu

SEQ ID NO: 367322 - RNA, 22 nt, Human
ucuguucaugucuuuuuaagug

SEQ ID NO: 367323 - RNA, 22 nt, Human
augugcuuuauuaaguaaaaau

SEQ ID NO: 367324 - RNA, 22 nt, Human
cugcaggggcuggaguuggcuu

SEQ ID NO: 367325 - RNA, 22 nt, Human
uccaucaccacagaggacagag

SEQ ID NO: 367326 - RNA, 22 nt, Human
aauaugugagguauguucagug

SEQ ID NO: 367327 - RNA, 22 nt, Human
agaaugcauuuuguguagcuau

SEQ ID NO: 367328 - RNA, 22 nt, Human
gugaauggggcaggaaggaugg

SEQ ID NO: 367329 - RNA, 22 nt, Human
uaguaucuuucuauauuuccca

SEQ ID NO: 367330 - RNA, 23 nt, Human
agccacuucuaucuugcuccugg

SEQ ID NO: 367331 - RNA, 22 nt, Human
gcuguggcugaccaccaggggg

SEQ ID NO: 367332 - RNA, 22 nt, Human
ucccagcauuaaugccugucag

SEQ ID NO: 367333 - RNA, 22 nt, Human
uccugggcccaggcugccaggg

SEQ ID NO: 367334 - RNA, 22 nt, Human
ugcaggaguccaaucaggagac

SEQ ID NO: 367335 - RNA, 22 nt, Human
aaauuauuacaagcuaguuggc

SEQ ID NO: 367336 - RNA, 22 nt, Human
caucacuguccucagcauucca

SEQ ID NO: 367337 - RNA, 22 nt, Human
uggaaggagcuaaggaccuggg

SEQ ID NO: 367338 - RNA, 22 nt, Human
aggguggcaccuggaagggaug

SEQ ID NO: 367339 - RNA, 22 nt, Human
acugccaggauggcacuagagg

SEQ ID NO: 367340 - RNA, 22 nt, Human
aacucaguucuuuccacaaugc

SEQ ID NO: 367341 - RNA, 22 nt, Human
caaugguggugucagaagagau

SEQ ID NO: 367342 - RNA, 22 nt, Human
aggagcugcagauucugccuug

SEQ ID NO: 367343 - RNA, 22 nt, Human
gagcugccagacaugggaauga

SEQ ID NO: 367344 - RNA, 22 nt, Human
uagaacauaagucauucauuug

SEQ ID NO: 367345 - RNA, 22 nt, Human
uugaaggacaucuuguuucuag

SEQ ID NO: 367346 - RNA, 20 nt, Human
gaaguccuuucacucuuccc

SEQ ID NO: 367347 - RNA, 22 nt, Human
uggauuagguacuaugaauaua

SEQ ID NO: 367348 - RNA, 22 nt, Human
gugagggcagcuuggucagugu

SEQ ID NO: 367349 - RNA, 22 nt, Human
guacagaauuaugccaugaggg

SEQ ID NO: 367350 - RNA, 22 nt, Human
gcuaugcaggagccuaaugaca

SEQ ID NO: 367351 - RNA, 20 nt, Human
uccagccacuuccgcugguc

SEQ ID NO: 367352 - RNA, 22 nt, Human
cccagggaaugacucuggccuu

SEQ ID NO: 367353 - RNA, 22 nt, Human
aauucacaaaaguuagauccau

SEQ ID NO: 367354 - RNA, 22 nt, Human
gguggcagaggugcaucagccc

SEQ ID NO: 367355 - RNA, 22 nt, Human
ccagcugguuaaaauagagaaa

SEQ ID NO: 367356 - RNA, 22 nt, Human
cagggagggacaauugucaccu

SEQ ID NO: 367357 - RNA, 22 nt, Human
ugccaggaggaggugggacaga

SEQ ID NO: 367358 - RNA, 22 nt, Human
cacugcagcaccaugcagggcu

SEQ ID NO: 367359 - RNA, 22 nt, Human
uugacaagaaucguugccuugg

SEQ ID NO: 367360 - RNA, 22 nt, Human
aaguccuucccaagcauguacc

SEQ ID NO: 367361 - RNA, 22 nt, Human
auacauauaugguacuuccugg

SEQ ID NO: 367362 - RNA, 22 nt, Human
uucaaucauuagaaucucaggc

SEQ ID NO: 367363 - RNA, 22 nt, Human
cagcugaacauguagagcaucu

SEQ ID NO: 367364 - RNA, 22 nt, Human
auugacaauguauuuguaucug

SEQ ID NO: 367365 - RNA, 22 nt, Human
uucacaaagcuggagcauuucc

SEQ ID NO: 367366 - RNA, 22 nt, Human
cagggccuccuaaggcaucuaa

SEQ ID NO: 367367 - RNA, 22 nt, Human
ccugcaggcugcaggccaguuc

SEQ ID NO: 367368 - RNA, 22 nt, Human
gccaccaggagcccaguccaaa

SEQ ID NO: 367369 - RNA, 22 nt, Human
gcugucucauacaaggcccugc

SEQ ID NO: 367370 - RNA, 22 nt, Human
auuucccagcuuugaucaguuu

SEQ ID NO: 367371 - RNA, 22 nt, Human
ucagugucuugggcuugaaugc

SEQ ID NO: 367372 - RNA, 22 nt, Human
cugggcagcugugcaaacaaua

SEQ ID NO: 367373 - RNA, 22 nt, Human
cagugcagucaaggaagaacca

SEQ ID NO: 367374 - RNA, 22 nt, Human
cugucuccagggcaggugcagg

SEQ ID NO: 367375 - RNA, 18 nt, Human
gugacagcugcuagcuca

SEQ ID NO: 367376 - RNA, 22 nt, Human
augugcuuguaauguuaaaugu

SEQ ID NO: 367377 - RNA, 22 nt, Human
cuggcuccacucccugccugac

SEQ ID NO: 367378 - RNA, 22 nt, Human
cauuuacaauguacagguugug

SEQ ID NO: 367379 - RNA, 22 nt, Human
ucucugcugagaagggcuggca

SEQ ID NO: 367380 - RNA, 22 nt, Human
cucugagaggugagaagcagca

SEQ ID NO: 367381 - RNA, 22 nt, Human
agggcuggaggguacuaguuua

SEQ ID NO: 367382 - RNA, 21 nt, Human
aauaaaacaguuggugucaau

SEQ ID NO: 367383 - RNA, 19 nt, Human
agccagggugagaaggagc

SEQ ID NO: 367384 - RNA, 22 nt, Human
agcagcucaaagccugcaagga

SEQ ID NO: 367385 - RNA, 22 nt, Human
cagagccccccuucugaucaca

SEQ ID NO: 367386 - RNA, 18 nt, Human
gcaggagauggguggggu

SEQ ID NO: 367387 - RNA, 22 nt, Human
ccugucuggccuuccacggggg

SEQ ID NO: 367388 - RNA, 22 nt, Human
gugcugugcgcuuuuucuguau

SEQ ID NO: 367389 - RNA, 22 nt, Human
ccugcagaccacacucaguccu

SEQ ID NO: 367390 - RNA, 22 nt, Human
gaggcccuccagcugucagcug

SEQ ID NO: 367391 - RNA, 22 nt, Human
uguggcugcucaggugcagacc

SEQ ID NO: 367392 - RNA, 22 nt, Human
gcaggaagaggcucgaagcccc

SEQ ID NO: 367393 - RNA, 22 nt, Human
uauuccuaagucccaacuacau

SEQ ID NO: 367394 - RNA, 22 nt, Human
acaaugcaccagcaucuucacc

SEQ ID NO: 367395 - RNA, 22 nt, Human
gucuucuuuaaccuacuaaagc

SEQ ID NO: 367396 - RNA, 22 nt, Human
ccugucugcaugagugagcaua

SEQ ID NO: 367397 - RNA, 22 nt, Human
gaauuaguguugaaaucagggc

SEQ ID NO: 367398 - RNA, 22 nt, Human
aaggcaguaaaaucuaccuugc

SEQ ID NO: 367399 - RNA, 22 nt, Human
gaucuucuauguaaugaagugu

SEQ ID NO: 367400 - RNA, 22 nt, Human
cugccacuagcuuucacaucuu

SEQ ID NO: 367401 - RNA, 22 nt, Human
agcaucuggucaugagugagaa

SEQ ID NO: 367402 - RNA, 22 nt, Human
ggccagagagccgcuguuagga

SEQ ID NO: 367403 - RNA, 22 nt, Human
aggaggugacagccugcaucug

SEQ ID NO: 367404 - RNA, 22 nt, Human
uccaaauacauuuacuguauuu

SEQ ID NO: 367405 - RNA, 22 nt, Human
gccugggagagggauagugcag

SEQ ID NO: 367406 - RNA, 22 nt, Human
uggccugggucacaccaggguc

SEQ ID NO: 367407 - RNA, 22 nt, Human
aagagcaucgguggagccccca

SEQ ID NO: 367408 - RNA, 22 nt, Human
cugccuggcuaaacucaagucg

SEQ ID NO: 367409 - RNA, 22 nt, Human
ucugccugagcagagggaggcc

SEQ ID NO: 367410 - RNA, 22 nt, Human
agauuucaaugugagcauuagu

SEQ ID NO: 367411 - RNA, 22 nt, Human
ucagcuggagaugagaaccgaa

SEQ ID NO: 367412 - RNA, 22 nt, Human
gccuucaguagugucagcugua

SEQ ID NO: 367413 - RNA, 22 nt, Human
aguugcagacgcagagauguug

SEQ ID NO: 367414 - RNA, 22 nt, Human
uaaagccaacacuuuacugcuc

SEQ ID NO: 367415 - RNA, 22 nt, Human
gcagguggagcaguagucuggu

SEQ ID NO: 367416 - RNA, 22 nt, Human
ugccugcucuuaccacucuccc

SEQ ID NO: 367417 - RNA, 22 nt, Human
auaugcuugggacugauacagu

SEQ ID NO: 367418 - RNA, 22 nt, Human
caugagauaauuuuucuccagu

SEQ ID NO: 367419 - RNA, 22 nt, Human
gaugagcauuguuucauguguu

SEQ ID NO: 367420 - RNA, 22 nt, Human
uaaggcaccuguccaggcuggg

SEQ ID NO: 367421 - RNA, 22 nt, Human
cuccagggaggucugcaggacu

SEQ ID NO: 367422 - RNA, 22 nt, Human
agugaagaggaaguggggcaca

SEQ ID NO: 367423 - RNA, 22 nt, Human
cacauacuuguguguacauaug

SEQ ID NO: 367424 - RNA, 22 nt, Human
gggcucuggauggagccugcag

SEQ ID NO: 367425 - RNA, 22 nt, Human
guuuuuccugcugacuuggguc

SEQ ID NO: 367426 - RNA, 22 nt, Human
gugcagguguuuuggcugccag

SEQ ID NO: 367427 - RNA, 20 nt, Human
aggcucagagcaguaguaca

SEQ ID NO: 367428 - RNA, 22 nt, Human
agagcuguagcuuccuagagcc

SEQ ID NO: 367429 - RNA, 22 nt, Human
ggggcagcuaccggaaguaggg

SEQ ID NO: 367430 - RNA, 22 nt, Human
cagagggcacaugguuuccuca

SEQ ID NO: 367431 - RNA, 23 nt, Human
cugcagucgccggccugggugcc

SEQ ID NO: 367432 - RNA, 22 nt, Human
ccugucugaggaggugcucuuu

SEQ ID NO: 367433 - RNA, 22 nt, Human
ccuuuccuuuuuagugugggag

SEQ ID NO: 367434 - RNA, 22 nt, Human
ucuucauuccguagauauuuau

SEQ ID NO: 367435 - RNA, 22 nt, Human
gacccaggguggucaccugaaa

SEQ ID NO: 367436 - RNA, 22 nt, Human
guggcugcagcccagcggcacg

SEQ ID NO: 367437 - RNA, 22 nt, Human
ccaggauggggagcagauagaa

SEQ ID NO: 367438 - RNA, 22 nt, Human
uuagaaaucaccucugaagauc

SEQ ID NO: 367439 - RNA, 22 nt, Human
cagagccaggguugcaccccug

SEQ ID NO: 367440 - RNA, 22 nt, Human
ugagccagaguggagugugccu

SEQ ID NO: 367441 - RNA, 22 nt, Human
cggcagagacggcgcuuugaac

SEQ ID NO: 367442 - RNA, 22 nt, Human
uuugaaguucccccauaucaga

SEQ ID NO: 367443 - RNA, 22 nt, Human
cuuugcaauagaggcacacaug

SEQ ID NO: 367444 - RNA, 22 nt, Human
aggcucaggaggagcugccgga

SEQ ID NO: 367445 - RNA, 22 nt, Human
guccagugacaaguagcuggcc

SEQ ID NO: 367446 - RNA, 22 nt, Human
uugcauugauguuccuucuugc

SEQ ID NO: 367447 - RNA, 22 nt, Human
uuuauugacccaaagcgagagu

SEQ ID NO: 367448 - RNA, 22 nt, Human
aggggcuggcuuaucugagagu

SEQ ID NO: 367449 - RNA, 22 nt, Human
aagagcuggauggaaucuggga

SEQ ID NO: 367450 - RNA, 22 nt, Human
agcuguggcagcagccguggca

SEQ ID NO: 367451 - RNA, 22 nt, Human
gcacagggcugccaggcggcuu

SEQ ID NO: 367452 - RNA, 22 nt, Human
agcagcugguaggaguggccac

SEQ ID NO: 367453 - RNA, 22 nt, Human
cuuguacauagagaagaagccu

SEQ ID NO: 367454 - RNA, 22 nt, Human
uucagaaagguaaauggauuuc

SEQ ID NO: 367455 - RNA, 15 nt, Human
uccaggcauucauuc

SEQ ID NO: 367456 - RNA, 22 nt, Human
ucagaggagccaaaguucugag

SEQ ID NO: 367457 - RNA, 22 nt, Human
uucaauucugcucugaucuuag

SEQ ID NO: 367458 - RNA, 22 nt, Human
aaggcugaguaaaacagagaac

SEQ ID NO: 367459 - RNA, 22 nt, Human
cacugaagcuuucauucucuug

SEQ ID NO: 367460 - RNA, 22 nt, Human
agauuccagaucccaaaaauga

SEQ ID NO: 367461 - RNA, 22 nt, Human
gcaggggcugcugggaacucgg

SEQ ID NO: 367462 - RNA, 22 nt, Human
agcaaagucaguggaaccaucc

SEQ ID NO: 367463 - RNA, 22 nt, Human
aggggagaguuaaugugaaugu

SEQ ID NO: 367464 - RNA, 22 nt, Human
agaggaggcuggguccagauaa

SEQ ID NO: 367465 - RNA, 22 nt, Human
auuucaguguuuuaagaguuca

SEQ ID NO: 367466 - RNA, 22 nt, Human
cugaggcuggcguuugaggaag

SEQ ID NO: 367467 - RNA, 22 nt, Human
ugccugugguuccaguuuuuuc

SEQ ID NO: 367468 - RNA, 22 nt, Human
ucacaugcuugaggaaagaaaa

SEQ ID NO: 367469 - RNA, 22 nt, Human
agccaggauggucucgaucggc

SEQ ID NO: 367470 - RNA, 22 nt, Human
gaaggccuaggaaggaagccuu

SEQ ID NO: 367471 - RNA, 22 nt, Human
uguauacaauucacacuuccca

SEQ ID NO: 367472 - RNA, 22 nt, Human
gaggaggcuaagugggcucugg

SEQ ID NO: 367473 - RNA, 22 nt, Human
auacaaagacaaaucucaaucu

SEQ ID NO: 367474 - RNA, 22 nt, Human
gcccauggcagaacugugagca

SEQ ID NO: 367475 - RNA, 18 nt, Human
aggcaggcuggagugacu

SEQ ID NO: 367476 - RNA, 22 nt, Human
ccuggcagcgugccgagcugcg

SEQ ID NO: 367477 - RNA, 22 nt, Human
guaggcagauaggagugcagcc

SEQ ID NO: 367478 - RNA, 22 nt, Human
caggaugcacuaggaaccaggg

SEQ ID NO: 367479 - RNA, 22 nt, Human
gccaggugggagacagacagca

SEQ ID NO: 367480 - RNA, 22 nt, Human
cugcagagcagccaguccccca

SEQ ID NO: 367481 - RNA, 22 nt, Human
cugagacuuucaugugcuuuua

SEQ ID NO: 367482 - RNA, 21 nt, Human
ugguuugcggccaaaguuaaa

SEQ ID NO: 367483 - RNA, 22 nt, Human
ggauuugaauuguugaaaugau

SEQ ID NO: 367484 - RNA, 22 nt, Human
agugcugaagacuggcuaggga

SEQ ID NO: 367485 - RNA, 22 nt, Human
caggauggagggagggcuguua

SEQ ID NO: 367486 - RNA, 22 nt, Human
uccaggagugugugcuaauggg

SEQ ID NO: 367487 - RNA, 22 nt, Human
ucaggcugaggucaucugcauc

SEQ ID NO: 367488 - RNA, 22 nt, Human
uuucuucucgacaccuuauccc

SEQ ID NO: 367489 - RNA, 22 nt, Human
accugagcaugccaggagagug

SEQ ID NO: 367490 - RNA, 22 nt, Human
aaauuauaggugccaccuugga

SEQ ID NO: 367491 - RNA, 19 nt, Human
cuggggcuuugguacugcc

SEQ ID NO: 367492 - RNA, 22 nt, Human
auuugucuuugagugcccugcu

SEQ ID NO: 367493 - RNA, 22 nt, Human
uuccaaagugcuggaauuacau

SEQ ID NO: 367494 - RNA, 22 nt, Human
aucagagaccggucaagucaug

SEQ ID NO: 367495 - RNA, 17 nt, Human
uaaagccagucaaguca

SEQ ID NO: 367496 - RNA, 22 nt, Human
gccuggagaggaagccggugga

SEQ ID NO: 367497 - RNA, 20 nt, Human
cagagccaagagcagcaucu

SEQ ID NO: 367498 - RNA, 21 nt, Human
cucuugugucagagccagagg

SEQ ID NO: 367499 - RNA, 17 nt, Human
uauacacagacagacug

SEQ ID NO: 367500 - RNA, 22 nt, Human
gaugcugaagugaagugaucuu

SEQ ID NO: 367501 - RNA, 22 nt, Human
uuauuauugugguugcauuauc

SEQ ID NO: 367502 - RNA, 22 nt, Human
ucugagggcuugaggggaagua

SEQ ID NO: 367503 - RNA, 22 nt, Human
auauauuuugcggucacguggc

SEQ ID NO: 367504 - RNA, 22 nt, Human
cagccagcuucagauccaagcc

SEQ ID NO: 367505 - RNA, 22 nt, Human
aggaguguggccagggcucugg

SEQ ID NO: 367506 - RNA, 22 nt, Human
ugguuuugcuccaguauaaaua

SEQ ID NO: 367507 - RNA, 23 nt, Human
ugcugggcagagcuggugcugag

SEQ ID NO: 367508 - RNA, 22 nt, Human
cacauggggcgcugcauuggcc

SEQ ID NO: 367509 - RNA, 22 nt, Human
agcccaagcauaggagggaggc

SEQ ID NO: 367510 - RNA, 22 nt, Human
ccagccuccauguagauagcug

SEQ ID NO: 367511 - RNA, 22 nt, Human
ccucccuggccagagcagcagc

SEQ ID NO: 367512 - RNA, 22 nt, Human
gugugcaggugucagugcagcu

SEQ ID NO: 367513 - RNA, 22 nt, Human
gagagcuguguucauucuacca

SEQ ID NO: 367514 - RNA, 19 nt, Human
ggcccaaguacugagugcc

SEQ ID NO: 367515 - RNA, 22 nt, Human
caacagaagguguacuacugaa

SEQ ID NO: 367516 - RNA, 22 nt, Human
aaggcacugaaaaauugugugu

SEQ ID NO: 367517 - RNA, 22 nt, Human
uccuucagggcugaccacaggc

SEQ ID NO: 367518 - RNA, 22 nt, Human
acuuucucaggaauucacagac

SEQ ID NO: 367519 - RNA, 22 nt, Human
gggcagcuccuguggaauccac

SEQ ID NO: 367520 - RNA, 22 nt, Human
caguagccacuagacacaugua

SEQ ID NO: 367521 - RNA, 22 nt, Human
acagagcacugcccugugccgc

SEQ ID NO: 367522 - RNA, 22 nt, Human
auggcuuucucuaaugugguau

SEQ ID NO: 367523 - RNA, 22 nt, Human
aguuucauauuaccaugucacc

SEQ ID NO: 367524 - RNA, 19 nt, Human
gagggcucauuugaacaau

SEQ ID NO: 367525 - RNA, 22 nt, Human
augucuuuuaugauuacgggau

SEQ ID NO: 367526 - RNA, 22 nt, Human
agagccaggacugugucucacu

SEQ ID NO: 367527 - RNA, 19 nt, Human
uccaaaggacccaccucca

SEQ ID NO: 367528 - RNA, 22 nt, Human
cggcuggugucgggcacagcaa

SEQ ID NO: 367529 - RNA, 22 nt, Human
caggaugugaggaggccauuug

SEQ ID NO: 367530 - RNA, 22 nt, Human
augguguagcaugugauaugac

SEQ ID NO: 367531 - RNA, 22 nt, Human
ugaaaaggaguccuuguuuuca

SEQ ID NO: 367532 - RNA, 18 nt, Human
acugugugaauuagcucc

SEQ ID NO: 367533 - RNA, 22 nt, Human
caaguccaggucaauuuaaagc

SEQ ID NO: 367534 - RNA, 22 nt, Human
gccugagauucugcauuucuaa

SEQ ID NO: 367535 - RNA, 22 nt, Human
agaggcagcagucauacuacag

SEQ ID NO: 367536 - RNA, 22 nt, Human
ugcagugggccggaggccaggg

SEQ ID NO: 367537 - RNA, 22 nt, Human
caugugguucaaguacuccaca

SEQ ID NO: 367538 - RNA, 22 nt, Human
aggagcugucagagugccagag

SEQ ID NO: 367539 - RNA, 19 nt, Human
gcugugggacagcagggug

SEQ ID NO: 367540 - RNA, 22 nt, Human
agcuggggguuggauaagggua

SEQ ID NO: 367541 - RNA, 22 nt, Human
cugaggucuagacaccccaggg

SEQ ID NO: 367542 - RNA, 22 nt, Human
uuuuaagaugcuaguauuucag

SEQ ID NO: 367543 - RNA, 21 nt, Human
cccaggucguggucuucccag

SEQ ID NO: 367544 - RNA, 22 nt, Human
ccagagaguaucauggagagua

SEQ ID NO: 367545 - RNA, 22 nt, Human
guggauggacaugggcaagagg

SEQ ID NO: 367546 - RNA, 17 nt, Human
gucauucucagaaaaug

SEQ ID NO: 367547 - RNA, 22 nt, Human
aggagcuggaguccaggcaagu

SEQ ID NO: 367548 - RNA, 22 nt, Human
agaugcugugucuguucccuug

SEQ ID NO: 367549 - RNA, 21 nt, Human
gcagggacaaagcuucaggag

SEQ ID NO: 367550 - RNA, 18 nt, Human
cugcugugucgucugggc

SEQ ID NO: 367551 - RNA, 22 nt, Human
gaggcagaaguugcagugagca

SEQ ID NO: 367552 - RNA, 22 nt, Human
agcugguaugaacaggauagga

SEQ ID NO: 367553 - RNA, 22 nt, Human
acguuuucagugacugugcuuc

SEQ ID NO: 367554 - RNA, 22 nt, Human
cuuccuucugaagcauagaagc

SEQ ID NO: 367555 - RNA, 22 nt, Human
agagaugaaaaguggagacugg

SEQ ID NO: 367556 - RNA, 23 nt, Human
aaguucaagucacagccugucuu

SEQ ID NO: 367557 - RNA, 19 nt, Human
ugcagaagacacaguggug

SEQ ID NO: 367558 - RNA, 22 nt, Human
gaaaugugaccuacuuccuugu

SEQ ID NO: 367559 - RNA, 22 nt, Human
uggcuggcccugggagugcaga

SEQ ID NO: 367560 - RNA, 22 nt, Human
caguggggaggccaggauagaa

SEQ ID NO: 367561 - RNA, 22 nt, Human
ucagaggagaccaaggggaaua

SEQ ID NO: 367562 - RNA, 22 nt, Human
acagagcaugcucaguguguga

SEQ ID NO: 367563 - RNA, 22 nt, Human
gagugcaggccugagcaccauc

SEQ ID NO: 367564 - RNA, 22 nt, Human
acaguaauauugaugcucguca

SEQ ID NO: 367565 - RNA, 22 nt, Human
ucuguucuauuggucuaugugu

SEQ ID NO: 367566 - RNA, 22 nt, Human
ccucccaccguaucucaguggc

SEQ ID NO: 367567 - RNA, 22 nt, Human
uuaagucauuucugauuauaga

SEQ ID NO: 367568 - RNA, 22 nt, Human
guaggcagugguuggaagagaa

SEQ ID NO: 367569 - RNA, 22 nt, Human
ccuggaucuccucuauucauau

SEQ ID NO: 367570 - RNA, 22 nt, Human
cugggaguguucuaggucacau

SEQ ID NO: 367571 - RNA, 22 nt, Human
uagggcuccacucccagagauu

SEQ ID NO: 367572 - RNA, 22 nt, Human
gaggagcuugaggcuaggagcc

SEQ ID NO: 367573 - RNA, 22 nt, Human
ggcuagaguggaacuggagcgg

SEQ ID NO: 367574 - RNA, 22 nt, Human
uacuacauuaauaaaacauuca

SEQ ID NO: 367575 - RNA, 22 nt, Human
ucuucacaugaccuucaugucu

SEQ ID NO: 367576 - RNA, 22 nt, Human
uggcccugacacgugguacugg

SEQ ID NO: 367577 - RNA, 22 nt, Human
agagcagugcugaagaguaggg

SEQ ID NO: 367578 - RNA, 22 nt, Human
cagcagagaccaagugauuuga

SEQ ID NO: 367579 - RNA, 22 nt, Human
ucagggacgugagcucagaguc

SEQ ID NO: 367580 - RNA, 22 nt, Human
uuuagaaguucacacauuuaaa

SEQ ID NO: 367581 - RNA, 22 nt, Human
auauuaaauggauuuugggagc

SEQ ID NO: 367582 - RNA, 21 nt, Human
aucagaaguuuuggucaguag

SEQ ID NO: 367583 - RNA, 19 nt, Human
ugcagccacgugagagacu

SEQ ID NO: 367584 - RNA, 22 nt, Human
agggacagucuacuguucacug

SEQ ID NO: 367585 - RNA, 22 nt, Human
ugggaauggaugcuaagugcua

SEQ ID NO: 367586 - RNA, 22 nt, Human
ugcuggaggaguuuacuguggc

SEQ ID NO: 367587 - RNA, 22 nt, Human
aaugauggauuuagacaagcug

SEQ ID NO: 367588 - RNA, 22 nt, Human
uggcucuguugagguauggauu

SEQ ID NO: 367589 - RNA, 22 nt, Human
uagacacauccguggaagcuuc

SEQ ID NO: 367590 - RNA, 22 nt, Human
gcagcuggagcaucuucucauc

SEQ ID NO: 367591 - RNA, 22 nt, Human
gccuggcuccuaagagcacaac

SEQ ID NO: 367592 - RNA, 22 nt, Human
ccaggguggaggcuggauggag

SEQ ID NO: 367593 - RNA, 21 nt, Human
agcucagccgggcacaguggc

SEQ ID NO: 367594 - RNA, 22 nt, Human
uggcugaguuucaugcaucaug

SEQ ID NO: 367595 - RNA, 22 nt, Human
aaucaagaaaaugaggauucuu

SEQ ID NO: 367596 - RNA, 22 nt, Human
uaggcagaauuguugaaugaag

SEQ ID NO: 367597 - RNA, 22 nt, Human
ugaaggcacuugccuaggggca

SEQ ID NO: 367598 - RNA, 22 nt, Human
gaaggcuguuucugguagugau

SEQ ID NO: 367599 - RNA, 22 nt, Human
uuugcagugauucuugcaguga

SEQ ID NO: 367600 - RNA, 22 nt, Human
auuucacaucuaucucagauuu

SEQ ID NO: 367601 - RNA, 22 nt, Human
gcagaagaccaugguggaaaga

SEQ ID NO: 367602 - RNA, 20 nt, Human
uguacacaguacuuuacaau

SEQ ID NO: 367603 - RNA, 20 nt, Human
ggaagccagggugcagggga

SEQ ID NO: 367604 - RNA, 22 nt, Human
cccaggaaugaggggcggaggc

SEQ ID NO: 367605 - RNA, 20 nt, Human
aggcucagcugagcucuugg

SEQ ID NO: 367606 - RNA, 20 nt, Human
cagccuccacucacucagcu

SEQ ID NO: 367607 - RNA, 22 nt, Human
ugcuggccgugagcucucggga

SEQ ID NO: 367608 - RNA, 22 nt, Human
uaagaaucuauuaggaauaugu

SEQ ID NO: 367609 - RNA, 22 nt, Human
gcuguguuuuauguuagguuaa

SEQ ID NO: 367610 - RNA, 22 nt, Human
uguacauuuagagcucaauaga

SEQ ID NO: 367611 - RNA, 22 nt, Human
aauuaugauuggucuaaaccag

SEQ ID NO: 367612 - RNA, 22 nt, Human
accaaagggcagaacaugagca

SEQ ID NO: 367613 - RNA, 22 nt, Human
cuucuucauaggcaguccuguu

SEQ ID NO: 367614 - RNA, 22 nt, Human
uggaggaugccuggggaggccu

SEQ ID NO: 367615 - RNA, 23 nt, Human
aaacugcuuccaauuccugccau

SEQ ID NO: 367616 - RNA, 22 nt, Human
caguuucucucaauaagcaucg

SEQ ID NO: 367617 - RNA, 22 nt, Human
agauuugcggcuuuacuuugca

SEQ ID NO: 367618 - RNA, 22 nt, Human
ggccagcugggccaccaggugc

SEQ ID NO: 367619 - RNA, 22 nt, Human
ccugccugcguccucugagggc

SEQ ID NO: 367620 - RNA, 22 nt, Human
auuuccaauuucauccaugucc

SEQ ID NO: 367621 - RNA, 22 nt, Human
guguggcugauugacaugguca

SEQ ID NO: 367622 - RNA, 22 nt, Human
gguggccucucaugcaagguag

SEQ ID NO: 367623 - RNA, 22 nt, Human
uacccagcccaugccuaccuca

SEQ ID NO: 367624 - RNA, 22 nt, Human
ggccagggggcuucagacucca

SEQ ID NO: 367625 - RNA, 19 nt, Human
ggucucagugcagcugcag

SEQ ID NO: 367626 - RNA, 22 nt, Human
uucauucugcaguucucagcuc

SEQ ID NO: 367627 - RNA, 23 nt, Human
ccuggcuggauucucugcauuca

SEQ ID NO: 367628 - RNA, 22 nt, Human
cuggggugagcagaaacagggg

SEQ ID NO: 367629 - RNA, 22 nt, Human
ggccuagggaguggccaugccu

SEQ ID NO: 367630 - RNA, 21 nt, Human
ugaaaucugaugggacaaaug

SEQ ID NO: 367631 - RNA, 22 nt, Human
uccaggcauguggccaguacuc

SEQ ID NO: 367632 - RNA, 22 nt, Human
ccagagccggcucccucagcuu

SEQ ID NO: 367633 - RNA, 22 nt, Human
uugaacagcuguuacauuguua

SEQ ID NO: 367634 - RNA, 22 nt, Human
gucuuuaugguaugaaaacuga

SEQ ID NO: 367635 - RNA, 18 nt, Human
aggccugggaagcugagg

SEQ ID NO: 367636 - RNA, 22 nt, Human
cagagugagggccugcaccugc

SEQ ID NO: 367637 - RNA, 22 nt, Human
cugccugugccaaugcuccuuu

SEQ ID NO: 367638 - RNA, 22 nt, Human
ucugagccaauuucugugucca

SEQ ID NO: 367639 - RNA, 22 nt, Human
gacaaaggaucagagguuggga

SEQ ID NO: 367640 - RNA, 22 nt, Human
uggaggagaauuuauggucgaa

SEQ ID NO: 367641 - RNA, 22 nt, Human
ucucugucccuaggagccuugc

SEQ ID NO: 367642 - RNA, 22 nt, Human
caggcgagugaacagacucuca

SEQ ID NO: 367643 - RNA, 22 nt, Human
cauguuuuguguacagaauauu

SEQ ID NO: 367644 - RNA, 22 nt, Human
aggcuggcccuacuggcugccu

SEQ ID NO: 367645 - RNA, 22 nt, Human
aaaucaguuagugguaggauug

SEQ ID NO: 367646 - RNA, 22 nt, Human
ccaggacucaguggggaaaggg

SEQ ID NO: 367647 - RNA, 22 nt, Human
uucuuccucagcagggcugccu

SEQ ID NO: 367648 - RNA, 22 nt, Human
gcucagccgaacuucagagcag

SEQ ID NO: 367649 - RNA, 22 nt, Human
cugggcugucaauggcccucug

SEQ ID NO: 367650 - RNA, 21 nt, Human
ccuccaggugauuccgugcuc

SEQ ID NO: 367651 - RNA, 22 nt, Human
cuauugaaaguguacaauucaa

SEQ ID NO: 367652 - RNA, 22 nt, Human
aagccacugagauuucacugca

SEQ ID NO: 367653 - RNA, 22 nt, Human
agguggcuccucccauggcugg

SEQ ID NO: 367654 - RNA, 22 nt, Human
cauuuacauaacaguaacgcug

SEQ ID NO: 367655 - RNA, 19 nt, Human
auuuacugccuaaaaucuc

SEQ ID NO: 367656 - RNA, 22 nt, Human
ccugagagcauuccacacugaa

SEQ ID NO: 367657 - RNA, 22 nt, Human
uuugagauggagucuugcucug

SEQ ID NO: 367658 - RNA, 22 nt, Human
aggcugccucgugagcucgcug

SEQ ID NO: 367659 - RNA, 19 nt, Human
cucagagaggggcagugcc

SEQ ID NO: 367660 - RNA, 22 nt, Human
aaaguuucaauagaggaagugg

SEQ ID NO: 367661 - RNA, 22 nt, Human
cagcugaauucuucagacucca

SEQ ID NO: 367662 - RNA, 22 nt, Human
accugcaggggugcucucuggg

SEQ ID NO: 367663 - RNA, 22 nt, Human
ugggcagggucucuguuaucag

SEQ ID NO: 367664 - RNA, 22 nt, Human
ggagccuguuaguugagugcuc

SEQ ID NO: 367665 - RNA, 22 nt, Human
gaggcugcggggaggagccugc

SEQ ID NO: 367666 - RNA, 22 nt, Human
uucuccccugacccugaugagg

SEQ ID NO: 367667 - RNA, 22 nt, Human
guuugaaugcaguaugcauuuu

SEQ ID NO: 367668 - RNA, 23 nt, Human
gccucugcucugcguuggggacu

SEQ ID NO: 367669 - RNA, 22 nt, Human
ugccuuccuggagcugaaggcu

SEQ ID NO: 367670 - RNA, 22 nt, Human
ggggaaggauugaguugaccca

SEQ ID NO: 367671 - RNA, 21 nt, Human
gccaccucgucucggagcagc

SEQ ID NO: 367672 - RNA, 22 nt, Human
uaucuaaaggauuuaauuuagu

SEQ ID NO: 367673 - RNA, 22 nt, Human
gugucccaaucuacuuuucccu

SEQ ID NO: 367674 - RNA, 22 nt, Human
gugaauaaccuacuccaggccu

SEQ ID NO: 367675 - RNA, 22 nt, Human
ccacauuuuugauacucucacu

SEQ ID NO: 367676 - RNA, 22 nt, Human
agcugggaugauaaccucaguc

SEQ ID NO: 367677 - RNA, 19 nt, Human
gccugcagaaaaggcaggg

SEQ ID NO: 367678 - RNA, 18 nt, Human
agacccucuaagggcagu

SEQ ID NO: 367679 - RNA, 22 nt, Human
acaguaaugauucugagucucu

SEQ ID NO: 367680 - RNA, 22 nt, Human
ccagcaggagagaacauuuccc

SEQ ID NO: 367681 - RNA, 22 nt, Human
ugcagggacacgaagacaaaua

SEQ ID NO: 367682 - RNA, 20 nt, Human
gcuuccuucccagcccccac

SEQ ID NO: 367683 - RNA, 22 nt, Human
cacaggcucuucucacuugauu

SEQ ID NO: 367684 - RNA, 22 nt, Human
ucucaagcuuguugguauguuu

SEQ ID NO: 367685 - RNA, 22 nt, Human
cauugcacugcagcccgggcaa

SEQ ID NO: 367686 - RNA, 22 nt, Human
gagaggagguggcuaugacagc

SEQ ID NO: 367687 - RNA, 20 nt, Human
uaggcagcuugacccuuggu

SEQ ID NO: 367688 - RNA, 19 nt, Human
gagcagcugcacccauuga

SEQ ID NO: 367689 - RNA, 22 nt, Human
agcagggccuggcacuccuggg

SEQ ID NO: 367690 - RNA, 22 nt, Human
uuccuguccgcaauggccuggg

SEQ ID NO: 367691 - RNA, 22 nt, Human
guuaaauucgaugauggauaaa

SEQ ID NO: 367692 - RNA, 22 nt, Human
aggcaguggcugagaccagggg

SEQ ID NO: 367693 - RNA, 22 nt, Human
cagggcaguaacgggaacaucu

SEQ ID NO: 367694 - RNA, 22 nt, Human
gccucccuguucuuccacaaua

SEQ ID NO: 367695 - RNA, 22 nt, Human
gaaggccauugcguccugggau

SEQ ID NO: 367696 - RNA, 22 nt, Human
ugcuggcuacugauggcaggcc

SEQ ID NO: 367697 - RNA, 22 nt, Human
agaccuggauuccaauccuacc

SEQ ID NO: 367698 - RNA, 22 nt, Human
uuaggaaaaucaugagagauga

SEQ ID NO: 367699 - RNA, 22 nt, Human
ccagcuccagguagaugggcag

SEQ ID NO: 367700 - RNA, 22 nt, Human
gcagagaagaugcccaggcuuc

SEQ ID NO: 367701 - RNA, 23 nt, Human
auuuccuacuauaaaagagguaa

SEQ ID NO: 367702 - RNA, 22 nt, Human
auuuaguguguauugcuauuau

SEQ ID NO: 367703 - RNA, 22 nt, Human
cugcuguguggugaaacucagu

SEQ ID NO: 367704 - RNA, 22 nt, Human
aagucacccacaggcagcagaa

SEQ ID NO: 367705 - RNA, 22 nt, Human
uaaaucaguuucucuuauuggu

SEQ ID NO: 367706 - RNA, 22 nt, Human
uucaagaucuuccaaaggauac

SEQ ID NO: 367707 - RNA, 22 nt, Human
agaauucuguucuucgggugug

SEQ ID NO: 367708 - RNA, 22 nt, Human
agcugucugucuccugaggaga

SEQ ID NO: 367709 - RNA, 21 nt, Human
acauuuucuguuuuaggaagu

SEQ ID NO: 367710 - RNA, 22 nt, Human
uggcagagcaaaaagauagaau

SEQ ID NO: 367711 - RNA, 22 nt, Human
cuuaacagagagaaguguugcu

SEQ ID NO: 367712 - RNA, 22 nt, Human
ucugcagcgugcaggcuggugc

SEQ ID NO: 367713 - RNA, 22 nt, Human
cuucuuuacuuucuagaaauaa

SEQ ID NO: 367714 - RNA, 22 nt, Human
agggccagccaggcccuacaaa

SEQ ID NO: 367715 - RNA, 22 nt, Human
ugggaccaagucauuucuuuag

SEQ ID NO: 367716 - RNA, 22 nt, Human
agaauucauaggaaguuuccua

SEQ ID NO: 367717 - RNA, 22 nt, Human
aaaaucugguaauuugaaugug

SEQ ID NO: 367718 - RNA, 22 nt, Human
gagaggccaaaaucccugcccc

SEQ ID NO: 367719 - RNA, 22 nt, Human
cagccagggagcaaagaguuga

SEQ ID NO: 367720 - RNA, 22 nt, Human
gaagccacccuccuuccagccc

SEQ ID NO: 367721 - RNA, 22 nt, Human
ccugucucuguuaccacauuug

SEQ ID NO: 367722 - RNA, 22 nt, Human
uaaaggcuucugcagggacuga

SEQ ID NO: 367723 - RNA, 22 nt, Human
agaagccagucgcucucccgca

SEQ ID NO: 367724 - RNA, 22 nt, Human
ucuccucuauuucuguauguau

SEQ ID NO: 367725 - RNA, 22 nt, Human
ccuggagcuuuuccauccugga

SEQ ID NO: 367726 - RNA, 22 nt, Human
caguggccugagccaggcuucc

SEQ ID NO: 367727 - RNA, 21 nt, Human
ugggaccuagcuuugcacagg

SEQ ID NO: 367728 - RNA, 20 nt, Human
uccaguuuuggagacauucu

SEQ ID NO: 367729 - RNA, 20 nt, Human
gaggccucagccucagcucc

SEQ ID NO: 367730 - RNA, 22 nt, Human
agcagggcugcggccccaccac

SEQ ID NO: 367731 - RNA, 22 nt, Human
aucuggcugagcgaggcccaca

SEQ ID NO: 367732 - RNA, 22 nt, Human
gggcugggauggcuugaagauu

SEQ ID NO: 367733 - RNA, 19 nt, Human
ugagaggcuuaaggcagcu

SEQ ID NO: 367734 - RNA, 22 nt, Human
cagggcaggacagauacauuac

SEQ ID NO: 367735 - RNA, 22 nt, Human
auacauuagaaucugguacuca

SEQ ID NO: 367736 - RNA, 22 nt, Human
agcuggagaauguggaugaucc

SEQ ID NO: 367737 - RNA, 22 nt, Human
caggcagauuugcugcccucca

SEQ ID NO: 367738 - RNA, 22 nt, Human
cccuggaggcuggaggcaguag

SEQ ID NO: 367739 - RNA, 22 nt, Human
gcagagccaugggagguuuuug

SEQ ID NO: 367740 - RNA, 17 nt, Human
uccaggcauaucuccua

SEQ ID NO: 367741 - RNA, 19 nt, Human
ugaggggaggagaggccug

SEQ ID NO: 367742 - RNA, 23 nt, Human
gaagccacacaaaggucgccaag

SEQ ID NO: 367743 - RNA, 22 nt, Human
cagucuggaggucagcuggcuu

SEQ ID NO: 367744 - RNA, 22 nt, Human
uccaggaggccucauuuccugu

SEQ ID NO: 367745 - RNA, 23 nt, Human
agcagggccagaauacuugcugu

SEQ ID NO: 367746 - RNA, 22 nt, Human
gggcagcucuuugguauccuuc

SEQ ID NO: 367747 - RNA, 22 nt, Human
auuagggaaggauuuggccuga

SEQ ID NO: 367748 - RNA, 22 nt, Human
acacacacaagcagguugugga

SEQ ID NO: 367749 - RNA, 23 nt, Human
gugugccaagcacugugccagga

SEQ ID NO: 367750 - RNA, 22 nt, Human
uuuuauagcugaauaguauucc

SEQ ID NO: 367751 - RNA, 22 nt, Human
gauaaaauucuuauuuuacccg

SEQ ID NO: 367752 - RNA, 21 nt, Human
augacagaugcugcagaucgu

SEQ ID NO: 367753 - RNA, 22 nt, Human
ucuaaaaaagucuguucacuug

SEQ ID NO: 367754 - RNA, 22 nt, Human
acagccuguguaccagcuggga

SEQ ID NO: 367755 - RNA, 19 nt, Human
uuugugaagaaaaugaugc

SEQ ID NO: 367756 - RNA, 22 nt, Human
auuccaaacuuaccccagagga

SEQ ID NO: 367757 - RNA, 22 nt, Human
uuccaggacaagauguuucagg

SEQ ID NO: 367758 - RNA, 22 nt, Human
aaggcaguuugggccaccaucu

SEQ ID NO: 367759 - RNA, 23 nt, Human
uccuucagagccucccuccaagc

SEQ ID NO: 367760 - RNA, 22 nt, Human
guguggcuaccucagaggagca

SEQ ID NO: 367761 - RNA, 22 nt, Human
ugggcacuggaagccugcugug

SEQ ID NO: 367762 - RNA, 22 nt, Human
acauacuuuuuaaaagauugcu

SEQ ID NO: 367763 - RNA, 22 nt, Human
ccucaggggucacugugaggag

SEQ ID NO: 367764 - RNA, 22 nt, Human
acagaaugggauuugaauauuu

SEQ ID NO: 367765 - RNA, 22 nt, Human
ccugucugcggaggaguggaag

SEQ ID NO: 367766 - RNA, 23 nt, Human
ugcagcugccucuggcgggccgg

SEQ ID NO: 367767 - RNA, 22 nt, Human
uugcauuccaguccccacugug

SEQ ID NO: 367768 - RNA, 22 nt, Human
ugagauuuguuuuauaaaauag

SEQ ID NO: 367769 - RNA, 22 nt, Human
ggacccugggcuugcuccuggg

SEQ ID NO: 367770 - RNA, 22 nt, Human
aaugcacaugccacauguggua

SEQ ID NO: 367771 - RNA, 22 nt, Human
uaucugagaaagaagcaccaga

SEQ ID NO: 367772 - RNA, 22 nt, Human
gaggagagccugcacuuugacc

SEQ ID NO: 367773 - RNA, 22 nt, Human
aguauggggcugugugugcaca

SEQ ID NO: 367774 - RNA, 22 nt, Human
ccaggagccugggccaggcugg

SEQ ID NO: 367775 - RNA, 22 nt, Human
gaggagagaugguagauugggu

SEQ ID NO: 367776 - RNA, 22 nt, Human
ucagccugcgucauggugacac

SEQ ID NO: 367777 - RNA, 19 nt, Human
gaggaggaaaacuagugua

SEQ ID NO: 367778 - RNA, 22 nt, Human
auauccaagaaacaauuaauuc

SEQ ID NO: 367779 - RNA, 22 nt, Human
uggcauuugcucccuuguguuc

SEQ ID NO: 367780 - RNA, 22 nt, Human
cugggcuggagugcaauggcgc

SEQ ID NO: 367781 - RNA, 22 nt, Human
cucucaggcuugggucguggca

SEQ ID NO: 367782 - RNA, 22 nt, Human
uuucaugaggggcaaaaucuca

SEQ ID NO: 367783 - RNA, 22 nt, Human
agggaaagguagugaggucaca

SEQ ID NO: 367784 - RNA, 22 nt, Human
uuauuuauggcccucaccugau

SEQ ID NO: 367785 - RNA, 22 nt, Human
ucaaggcuaaacuuucagagua

SEQ ID NO: 367786 - RNA, 22 nt, Human
ggcuucccagcagagggcgcac

SEQ ID NO: 367787 - RNA, 22 nt, Human
agccuggcccugcugaacucug

SEQ ID NO: 367788 - RNA, 22 nt, Human
caccagguuccgggcagagcug

SEQ ID NO: 367789 - RNA, 20 nt, Human
agucucuguagugccugaga

SEQ ID NO: 367790 - RNA, 22 nt, Human
cucagaguggggcucccugagg

SEQ ID NO: 367791 - RNA, 22 nt, Human
aggcacugaccugcuuccuuga

SEQ ID NO: 367792 - RNA, 22 nt, Human
agagccugcaucaggcuugggg

SEQ ID NO: 367793 - RNA, 22 nt, Human
uguuucauguggacauaguugu

SEQ ID NO: 367794 - RNA, 22 nt, Human
ggcagaccucuccagccccaca

SEQ ID NO: 367795 - RNA, 22 nt, Human
cuuauguaaaacggaaagggaa

SEQ ID NO: 367796 - RNA, 22 nt, Human
cuguccugauggugccacuggu

SEQ ID NO: 367797 - RNA, 22 nt, Human
uugaaagugccaaguccuagug

SEQ ID NO: 367798 - RNA, 22 nt, Human
cuugcugucccuugguaugaac

SEQ ID NO: 367799 - RNA, 22 nt, Human
uuuccucugcugccauugcccc

SEQ ID NO: 367800 - RNA, 22 nt, Human
cacugcuuaguugguaaaugug

SEQ ID NO: 367801 - RNA, 22 nt, Human
uuuauugcauacacaaauguca

SEQ ID NO: 367802 - RNA, 22 nt, Human
gacccaggaagcuacuucuggu

SEQ ID NO: 367803 - RNA, 22 nt, Human
uagcaguggaaucuuuugucca

SEQ ID NO: 367804 - RNA, 22 nt, Human
aaggugucaccagauuggcagg

SEQ ID NO: 367805 - RNA, 22 nt, Human
aaucaguuaaauauugaguaca

SEQ ID NO: 367806 - RNA, 22 nt, Human
uggcagugggaagcuggaaguc

SEQ ID NO: 367807 - RNA, 19 nt, Human
ggcuccuguggcugcagcc

SEQ ID NO: 367808 - RNA, 22 nt, Human
cagcaauaacucaaagccauuu

SEQ ID NO: 367809 - RNA, 22 nt, Human
ggugggcacccgagacuggauc

SEQ ID NO: 367810 - RNA, 22 nt, Human
augguauugcaacaacugucau

SEQ ID NO: 367811 - RNA, 22 nt, Human
uguuuuucaaauauugcucugu

SEQ ID NO: 367812 - RNA, 22 nt, Human
auucuucacaccuguuccuguu

SEQ ID NO: 367813 - RNA, 22 nt, Human
agauuucccaaauacuuguuau

SEQ ID NO: 367814 - RNA, 22 nt, Human
aacauacagugagcaguggacu

SEQ ID NO: 367815 - RNA, 22 nt, Human
acuguccauucacucauauuca

SEQ ID NO: 367816 - RNA, 22 nt, Human
ccagugccugugggcauggugc

SEQ ID NO: 367817 - RNA, 22 nt, Human
cucaggacccgguccagguggg

SEQ ID NO: 367818 - RNA, 22 nt, Human
cacaucagguagaccuacagag

SEQ ID NO: 367819 - RNA, 21 nt, Human
ugggggagaauugguugcuuu

SEQ ID NO: 367820 - RNA, 22 nt, Human
cucccaagcugugcugaacugu

SEQ ID NO: 367821 - RNA, 22 nt, Human
ugggggucaggaugaggccuug

SEQ ID NO: 367822 - RNA, 22 nt, Human
cagagcuggagggaacccuggc

SEQ ID NO: 367823 - RNA, 22 nt, Human
gaagucuucauucucucugaga

SEQ ID NO: 367824 - RNA, 22 nt, Human
uaaggccauuauggugggcccg

SEQ ID NO: 367825 - RNA, 22 nt, Human
aggcaagcugcagagaguccuu

SEQ ID NO: 367826 - RNA, 22 nt, Human
agcauuuaauuacaguuuaauu

SEQ ID NO: 367827 - RNA, 22 nt, Human
gaggcagugaacaauuccugug

SEQ ID NO: 367828 - RNA, 22 nt, Human
ugggcacaaacaucugccuguu

SEQ ID NO: 367829 - RNA, 22 nt, Human
gcugucuucacuuccugguuuc

SEQ ID NO: 367830 - RNA, 22 nt, Human
gcccagugguaaaagcaggccu

SEQ ID NO: 367831 - RNA, 22 nt, Human
agcagggcagugaucagaaagg

SEQ ID NO: 367832 - RNA, 22 nt, Human
uggagcagcaucacuuugagcu

SEQ ID NO: 367833 - RNA, 22 nt, Human
cucugugggggagaggcagcug

SEQ ID NO: 367834 - RNA, 22 nt, Human
cccagcuccuuggaugggcagg

SEQ ID NO: 367835 - RNA, 23 nt, Human
ucucuuucaagagcuuaaugugc

SEQ ID NO: 367836 - RNA, 22 nt, Human
uccucagggggccaacccagcc

SEQ ID NO: 367837 - RNA, 22 nt, Human
uuucacaaguaaaguccuaagu

SEQ ID NO: 367838 - RNA, 22 nt, Human
ucaggaguccugccugcagccu

SEQ ID NO: 367839 - RNA, 22 nt, Human
caggaaagaaaugagaacacca

SEQ ID NO: 367840 - RNA, 20 nt, Human
uccugcagucgcuagcgccc

SEQ ID NO: 367841 - RNA, 22 nt, Human
gucuucuuuucagucugcuugu

SEQ ID NO: 367842 - RNA, 22 nt, Human
uaucagaaggcacauggagucu

SEQ ID NO: 367843 - RNA, 22 nt, Human
gcugggagcaaguacucaucuu

SEQ ID NO: 367844 - RNA, 22 nt, Human
gccucugcaccaguacugugcc

SEQ ID NO: 367845 - RNA, 22 nt, Human
aagccucaccuuuuagaagcua

SEQ ID NO: 367846 - RNA, 22 nt, Human
cugcuuccaugcaauggcaguc

SEQ ID NO: 367847 - RNA, 22 nt, Human
aagcccagcugaaagcauuuuu

SEQ ID NO: 367848 - RNA, 22 nt, Human
ccugccuggcuuccagaagaga

SEQ ID NO: 367849 - RNA, 22 nt, Human
auaauuuaaauuaguaugugau

SEQ ID NO: 367850 - RNA, 22 nt, Human
gccaaagcagucuugccucugc

SEQ ID NO: 367851 - RNA, 21 nt, Human
ucugucucuccacugcccugc

SEQ ID NO: 367852 - RNA, 22 nt, Human
agggccuggaacuggagaccac

SEQ ID NO: 367853 - RNA, 22 nt, Human
cagucccagaagagccugggag

SEQ ID NO: 367854 - RNA, 22 nt, Human
cugugcaagacuuacuuuaaua

SEQ ID NO: 367855 - RNA, 22 nt, Human
cagggcagaaggcacucuacuc

SEQ ID NO: 367856 - RNA, 17 nt, Human
uguagcuucuccuucuc

SEQ ID NO: 367857 - RNA, 22 nt, Human
ggcauuaagaauaucauuaaaa

SEQ ID NO: 367858 - RNA, 22 nt, Human
aaaucaaaagacauguguuuua

SEQ ID NO: 367859 - RNA, 22 nt, Human
uuagucaauagugaauauagag

SEQ ID NO: 367860 - RNA, 22 nt, Human
ggcagcuguggacgucgucauu

SEQ ID NO: 367861 - RNA, 22 nt, Human
agggcacaagacucugagcccc

SEQ ID NO: 367862 - RNA, 21 nt, Human
uagaaaucagcuggugccucu

SEQ ID NO: 367863 - RNA, 22 nt, Human
ucuuuacaucacaauuguaugg

SEQ ID NO: 367864 - RNA, 21 nt, Human
agacagagugcagucuacaua

SEQ ID NO: 367865 - RNA, 22 nt, Human
caggcagcucaaccuugggagc

SEQ ID NO: 367866 - RNA, 22 nt, Human
cuccugggaauuuaguugugag

SEQ ID NO: 367867 - RNA, 18 nt, Human
uagggcucuagggaguga

SEQ ID NO: 367868 - RNA, 22 nt, Human
cccuuagcucaauuucuugccc

SEQ ID NO: 367869 - RNA, 22 nt, Human
aggggagguggcagaaaugugc

SEQ ID NO: 367870 - RNA, 22 nt, Human
auucaaguggcugcuauguuaa

SEQ ID NO: 367871 - RNA, 22 nt, Human
uuccagaauuuuguucugcuug

SEQ ID NO: 367872 - RNA, 21 nt, Human
agagagaaggccauauggucc

SEQ ID NO: 367873 - RNA, 22 nt, Human
cacagcugcacagaggaggugc

SEQ ID NO: 367874 - RNA, 22 nt, Human
ugccagcaguagcaguaggcca

SEQ ID NO: 367875 - RNA, 18 nt, Human
acacacacaccuguguau

SEQ ID NO: 367876 - RNA, 22 nt, Human
cucuguccuaugcuugauagaa

SEQ ID NO: 367877 - RNA, 22 nt, Human
gcagcugcuggaaguuccugcc

SEQ ID NO: 367878 - RNA, 22 nt, Human
agggcagauggaacuuccccga

SEQ ID NO: 367879 - RNA, 22 nt, Human
ucaggaugguccuuuaugagaa

SEQ ID NO: 367880 - RNA, 22 nt, Human
ugcagaagauggucugagcacc

SEQ ID NO: 367881 - RNA, 18 nt, Human
agcagggcauuuugccau

SEQ ID NO: 367882 - RNA, 22 nt, Human
aggccugagguuccugugcuca

SEQ ID NO: 367883 - RNA, 23 nt, Human
ucaggauauugugugccaaggug

SEQ ID NO: 367884 - RNA, 22 nt, Human
ugagccuguggggugacaacca

SEQ ID NO: 367885 - RNA, 22 nt, Human
uaguggaguagaaaccaaagaa

SEQ ID NO: 367886 - RNA, 22 nt, Human
auuucagcccaguaugagcccc

SEQ ID NO: 367887 - RNA, 22 nt, Human
acaggagacccugcugguucug

SEQ ID NO: 367888 - RNA, 22 nt, Human
ugaguccaccuuaguauauggg

SEQ ID NO: 367889 - RNA, 22 nt, Human
caguacuuuucaaccaguauga

SEQ ID NO: 367890 - RNA, 22 nt, Human
uuaauaaacaggugcagcugaa

SEQ ID NO: 367891 - RNA, 22 nt, Human
ucuaaacagccucuuaccaacu

SEQ ID NO: 367892 - RNA, 22 nt, Human
acccagcucuuugauggucuug

SEQ ID NO: 367893 - RNA, 22 nt, Human
acacacaauuaguuuuaugcuu

SEQ ID NO: 367894 - RNA, 22 nt, Human
agcaugcugguguucauggcag

SEQ ID NO: 367895 - RNA, 22 nt, Human
auuaaaauuccaagguaugcca

SEQ ID NO: 367896 - RNA, 20 nt, Human
caaugcacacagcugcuucu

SEQ ID NO: 367897 - RNA, 22 nt, Human
ccugagguggcugcagcacugc

SEQ ID NO: 367898 - RNA, 22 nt, Human
ggcugagcaauuuugaugacau

SEQ ID NO: 367899 - RNA, 22 nt, Human
ggccucuguuuggagccaggau

SEQ ID NO: 367900 - RNA, 22 nt, Human
gcucagagaaucagcagacacc

SEQ ID NO: 367901 - RNA, 22 nt, Human
uucacuuauagggauguuauug

SEQ ID NO: 367902 - RNA, 22 nt, Human
aauguguacuuuuucaugcuca

SEQ ID NO: 367903 - RNA, 22 nt, Human
uggcucagaggggaagugguuu

SEQ ID NO: 367904 - RNA, 22 nt, Human
uuuaaugauagcuguuucacau

SEQ ID NO: 367905 - RNA, 22 nt, Human
agucagugaaaacuagaauguu

SEQ ID NO: 367906 - RNA, 22 nt, Human
ccaggcaggcagcguucucagg

SEQ ID NO: 367907 - RNA, 22 nt, Human
uaauaucuacuucauagaguuu

SEQ ID NO: 367908 - RNA, 22 nt, Human
ccuggcugggguagaagugagg

SEQ ID NO: 367909 - RNA, 22 nt, Human
caggccucagagaguggcgggg

SEQ ID NO: 367910 - RNA, 22 nt, Human
aaucagaaccuugggucauaac

SEQ ID NO: 367911 - RNA, 22 nt, Human
accucugcaaugcaaugucaug

SEQ ID NO: 367912 - RNA, 23 nt, Human
uuucaacuccugccauuauuucu

SEQ ID NO: 367913 - RNA, 22 nt, Human
acccagcaaagauaaacuuaug

SEQ ID NO: 367914 - RNA, 22 nt, Human
ccuagaugggauggcggccggg

SEQ ID NO: 367915 - RNA, 22 nt, Human
ccacacagggggaugaguuauu

SEQ ID NO: 367916 - RNA, 22 nt, Human
aauaaaauggucaguuuucuca

SEQ ID NO: 367917 - RNA, 22 nt, Human
ugccugggccucugaggaaggc

SEQ ID NO: 367918 - RNA, 22 nt, Human
gggccugacugagagcuccuca

SEQ ID NO: 367919 - RNA, 22 nt, Human
agccuguggaucccugcacugg

SEQ ID NO: 367920 - RNA, 22 nt, Human
gaaggaaaacagaucugccuga

SEQ ID NO: 367921 - RNA, 22 nt, Human
uguacaguguagucaugagguu

SEQ ID NO: 367922 - RNA, 22 nt, Human
agauuucccucuuguauuugca

SEQ ID NO: 367923 - RNA, 22 nt, Human
cagggcucagaagacagaccuc

SEQ ID NO: 367924 - RNA, 22 nt, Human
aggucaaggccaaaagaguggu

SEQ ID NO: 367925 - RNA, 22 nt, Human
aggugcuagguguguaguggag

SEQ ID NO: 367926 - RNA, 22 nt, Human
cuggcccuucucuugcuuccug

SEQ ID NO: 367927 - RNA, 22 nt, Human
cugggccagggaggugucugua

SEQ ID NO: 367928 - RNA, 22 nt, Human
cagaucuguaguaaaagaucuc

SEQ ID NO: 367929 - RNA, 22 nt, Human
ggcuguggccagcggggcugag

SEQ ID NO: 367930 - RNA, 21 nt, Human
aauuacagauggaauuacaga

SEQ ID NO: 367931 - RNA, 22 nt, Human
gugaggugguacaauauuaacu

SEQ ID NO: 367932 - RNA, 22 nt, Human
guacacauuaugcuucucuaaa

SEQ ID NO: 367933 - RNA, 22 nt, Human
ccagugcaggugagcaccaggu

SEQ ID NO: 367934 - RNA, 22 nt, Human
gugugcagggaugagugcaggu

SEQ ID NO: 367935 - RNA, 22 nt, Human
cugcucuggcuguguacuucag

SEQ ID NO: 367936 - RNA, 22 nt, Human
ggaaccaggaguuacacgaguu

SEQ ID NO: 367937 - RNA, 22 nt, Human
ccccaccugugcgucugccgca

SEQ ID NO: 367938 - RNA, 22 nt, Human
ugcucugggcaacagccucccu

SEQ ID NO: 367939 - RNA, 22 nt, Human
agcaggaaguagucuguaagca

SEQ ID NO: 367940 - RNA, 20 nt, Human
augcuuucuugugugcugcu

SEQ ID NO: 367941 - RNA, 22 nt, Human
aaacauguuuucugaauauuuu

SEQ ID NO: 367942 - RNA, 22 nt, Human
gaacagcugcuagagaucugug

SEQ ID NO: 367943 - RNA, 22 nt, Human
aggauuuauuggugggaaguua

SEQ ID NO: 367944 - RNA, 22 nt, Human
ucacagaauagcacuguaagcg

SEQ ID NO: 367945 - RNA, 22 nt, Human
ggcagaguugguggagucaguu

SEQ ID NO: 367946 - RNA, 17 nt, Human
uuccaguuuaguauugu

SEQ ID NO: 367947 - RNA, 22 nt, Human
cugggagcccugacuagccugg

SEQ ID NO: 367948 - RNA, 22 nt, Human
ccagcauggcaccugagaugag

SEQ ID NO: 367949 - RNA, 22 nt, Human
guggcugcagagggcacagcau

SEQ ID NO: 367950 - RNA, 22 nt, Human
agagcugugaaaaugagguuug

SEQ ID NO: 367951 - RNA, 22 nt, Human
cagaguguauucugcaguugca

SEQ ID NO: 367952 - RNA, 22 nt, Human
aaacagcuaauggccaggaaua

SEQ ID NO: 367953 - RNA, 22 nt, Human
gccagcuggagugagagugggc

SEQ ID NO: 367954 - RNA, 22 nt, Human
aaaauauuuuagggccaggaga

SEQ ID NO: 367955 - RNA, 22 nt, Human
ggccugcuuuccgagccugcag

SEQ ID NO: 367956 - RNA, 22 nt, Human
gaguggggucugggcaucaguc

SEQ ID NO: 367957 - RNA, 19 nt, Human
ccagaggacuguuaaugaa

SEQ ID NO: 367958 - RNA, 22 nt, Human
gcacugcaucuacuggcaagua

SEQ ID NO: 367959 - RNA, 22 nt, Human
caaaggcuuugcuaugaugcau

SEQ ID NO: 367960 - RNA, 22 nt, Human
ugaugcugagccugggacugac

SEQ ID NO: 367961 - RNA, 22 nt, Human
uuccuuaguuauuugguccccu

SEQ ID NO: 367962 - RNA, 22 nt, Human
ugcauuguaggauguuuagcag

SEQ ID NO: 367963 - RNA, 22 nt, Human
aggcaggccccugagaauagac

SEQ ID NO: 367964 - RNA, 22 nt, Human
uucacagacuuuccauagauug

SEQ ID NO: 367965 - RNA, 22 nt, Human
ugccacacauugucagguuagu

SEQ ID NO: 367966 - RNA, 22 nt, Human
ugccacccagccaggaguggga

SEQ ID NO: 367967 - RNA, 22 nt, Human
uugaaaggguuaaagugguaaa

SEQ ID NO: 367968 - RNA, 22 nt, Human
gcccaggcuagcguagagugca

SEQ ID NO: 367969 - RNA, 22 nt, Human
ucucucuuuuuaaucauguaau

SEQ ID NO: 367970 - RNA, 22 nt, Human
ugcuauacggagcaucuucagg

SEQ ID NO: 367971 - RNA, 22 nt, Human
acacuucuauucccugcacaaa

SEQ ID NO: 367972 - RNA, 23 nt, Human
aggucagcaggcaaggaaauggc

SEQ ID NO: 367973 - RNA, 22 nt, Human
agguggguccuggcucugccau

SEQ ID NO: 367974 - RNA, 23 nt, Human
caguggagacucaugcuuccuua

SEQ ID NO: 367975 - RNA, 22 nt, Human
gaggccugcuuuggcacucugg

SEQ ID NO: 367976 - RNA, 22 nt, Human
auggagugggccaauuuuagug

SEQ ID NO: 367977 - RNA, 22 nt, Human
cuucucagaucucagcuuugag

SEQ ID NO: 367978 - RNA, 22 nt, Human
uguaaauaaugcauguaaauca

SEQ ID NO: 367979 - RNA, 22 nt, Human
ccucagagguuuucauucugua

SEQ ID NO: 367980 - RNA, 22 nt, Human
ugcugagcgcauccggcggccg

SEQ ID NO: 367981 - RNA, 22 nt, Human
ugucugucugcaagccagaaag

SEQ ID NO: 367982 - RNA, 22 nt, Human
gaaacaugucugacaauuuacc

SEQ ID NO: 367983 - RNA, 22 nt, Human
aguucccaggugaugcugaugu

SEQ ID NO: 367984 - RNA, 22 nt, Human
acaugcuuuucccacaauuaua

SEQ ID NO: 367985 - RNA, 22 nt, Human
ucugggugcccuuugcucuguu

SEQ ID NO: 367986 - RNA, 22 nt, Human
gcugggcuugguuucccugcuu

SEQ ID NO: 367987 - RNA, 22 nt, Human
agacacaggauucugcauuucu

SEQ ID NO: 367988 - RNA, 22 nt, Human
agcaugaaaggcgugccaacuu

SEQ ID NO: 367989 - RNA, 18 nt, Human
uggcucugcagccagaug

SEQ ID NO: 367990 - RNA, 22 nt, Human
cugcuguguaucauuuuagaug

SEQ ID NO: 367991 - RNA, 22 nt, Human
ugucugugaccucuuuggagcc

SEQ ID NO: 367992 - RNA, 22 nt, Human
auggcuuuguuccaauaaaacu

SEQ ID NO: 367993 - RNA, 22 nt, Human
caagaaucaacauuauuuagug

SEQ ID NO: 367994 - RNA, 22 nt, Human
uucuugauuucaugcaguuaag

SEQ ID NO: 367995 - RNA, 22 nt, Human
ucuggcuccaccuccuuuacua

SEQ ID NO: 367996 - RNA, 22 nt, Human
acacagaaccucauagccucuc

SEQ ID NO: 367997 - RNA, 22 nt, Human
cccaggaggcagagcuugcagu

SEQ ID NO: 367998 - RNA, 22 nt, Human
cuucagaaugggacuguguuug

SEQ ID NO: 367999 - RNA, 22 nt, Human
cugcugggcagaggcugcauga

SEQ ID NO: 368000 - RNA, 22 nt, Human
agccccuuccaguucucagauc

SEQ ID NO: 368001 - RNA, 22 nt, Human
ggcuucauggaggaggugaguc

SEQ ID NO: 368002 - RNA, 22 nt, Human
aggcuuccuggaggaagaggua

SEQ ID NO: 368003 - RNA, 22 nt, Human
uaauuucacugauaugaaguca

SEQ ID NO: 368004 - RNA, 22 nt, Human
uaacagaauuugcuaaacuccg

SEQ ID NO: 368005 - RNA, 22 nt, Human
ggcagggguccugguguugacu

SEQ ID NO: 368006 - RNA, 22 nt, Human
aaaagccaagguccucuucaga

SEQ ID NO: 368007 - RNA, 22 nt, Human
cugcccugcccaggccuugggc

SEQ ID NO: 368008 - RNA, 22 nt, Human
uccagaccaugugagaggcgca

SEQ ID NO: 368009 - RNA, 22 nt, Human
gcccuggaaucucuccauggga

SEQ ID NO: 368010 - RNA, 22 nt, Human
ggcagaggaagcuggaaguggg

SEQ ID NO: 368011 - RNA, 21 nt, Human
aaggagccuaggaggcucagg

SEQ ID NO: 368012 - RNA, 22 nt, Human
gauuuccuugcauauugguaau

SEQ ID NO: 368013 - RNA, 22 nt, Human
acaguaccugcucucaagcaaa

SEQ ID NO: 368014 - RNA, 22 nt, Human
ggcagcugucucugaguuagca

SEQ ID NO: 368015 - RNA, 22 nt, Human
guagcuuauuagggauaauagu

SEQ ID NO: 368016 - RNA, 22 nt, Human
aagggcagccugacucacgguc

SEQ ID NO: 368017 - RNA, 22 nt, Human
uagccggguguugugucaugca

SEQ ID NO: 368018 - RNA, 22 nt, Human
gcagguguggaguggggugagc

SEQ ID NO: 368019 - RNA, 22 nt, Human
gcaugucaugucauguaggaau

SEQ ID NO: 368020 - RNA, 22 nt, Human
agauuguagaaacuguagcauu

SEQ ID NO: 368021 - RNA, 22 nt, Human
ggagaggaaaugccagcacuuc

SEQ ID NO: 368022 - RNA, 22 nt, Human
uggccuggcucacagugagauu

SEQ ID NO: 368023 - RNA, 22 nt, Human
uggcccugcuguaucaucugcu

SEQ ID NO: 368024 - RNA, 22 nt, Human
cugggagguggagguugcauug

SEQ ID NO: 368025 - RNA, 22 nt, Human
gggcccuggauuuaagcaugga

SEQ ID NO: 368026 - RNA, 22 nt, Human
agccccucuguggcucugccuc

SEQ ID NO: 368027 - RNA, 22 nt, Human
aggcucauucuugccucugagc

SEQ ID NO: 368028 - RNA, 22 nt, Human
ugaagcugugggcaguggagcc

SEQ ID NO: 368029 - RNA, 19 nt, Human
gcuggcagauguggccgug

SEQ ID NO: 368030 - RNA, 22 nt, Human
caaauucagaaaauugguagag

SEQ ID NO: 368031 - RNA, 22 nt, Human
ggaagccaggcugggggaucug

SEQ ID NO: 368032 - RNA, 22 nt, Human
ccaggagaugggaaaguagcag

SEQ ID NO: 368033 - RNA, 22 nt, Human
ccaggcucaggugcgagagaca

SEQ ID NO: 368034 - RNA, 22 nt, Human
gggcaguguggucgugccuuug

SEQ ID NO: 368035 - RNA, 22 nt, Human
auccuugacacacuccaguacu

SEQ ID NO: 368036 - RNA, 22 nt, Human
cccuugcacauuugucuuuaau

SEQ ID NO: 368037 - RNA, 22 nt, Human
cuuuccaaugcauuuccaaugu

SEQ ID NO: 368038 - RNA, 22 nt, Human
ggcuagaauaauugacuucauu

SEQ ID NO: 368039 - RNA, 22 nt, Human
aggcaggcugcuauggaguaga

SEQ ID NO: 368040 - RNA, 22 nt, Human
ccagaagucaggaaugagucuu

SEQ ID NO: 368041 - RNA, 22 nt, Human
augcugugagugugccgcagag

SEQ ID NO: 368042 - RNA, 22 nt, Human
augcuuuuccuaaaaugaugcc

SEQ ID NO: 368043 - RNA, 22 nt, Human
uauccaaaggaacaaucacagc

SEQ ID NO: 368044 - RNA, 22 nt, Human
uuucucaaggugucauguauuu

SEQ ID NO: 368045 - RNA, 22 nt, Human
gggcagcugucuugguucucaa

SEQ ID NO: 368046 - RNA, 22 nt, Human
uguauuagagcaguagaauuau

SEQ ID NO: 368047 - RNA, 22 nt, Human
acagaauugaaaguauaaucug

SEQ ID NO: 368048 - RNA, 22 nt, Human
gagcagugaagacagaaguaca

SEQ ID NO: 368049 - RNA, 22 nt, Human
ugcuuuaagagauuguuaguac

SEQ ID NO: 368050 - RNA, 22 nt, Human
cagcaggaccauugaggcauca

SEQ ID NO: 368051 - RNA, 20 nt, Human
aguuauaguaucuagccaug

SEQ ID NO: 368052 - RNA, 18 nt, Human
ugaaacaagaauggugca

SEQ ID NO: 368053 - RNA, 22 nt, Human
acacaguaccccaaggcugggc

SEQ ID NO: 368054 - RNA, 22 nt, Human
agccacaccuguccugccagcu

SEQ ID NO: 368055 - RNA, 22 nt, Human
cgugucaucugagccuugggcg

SEQ ID NO: 368056 - RNA, 22 nt, Human
caaguccuaaauguauuuguug

SEQ ID NO: 368057 - RNA, 19 nt, Human
gccucugcuggggacaggc

SEQ ID NO: 368058 - RNA, 22 nt, Human
gcccucagaggacagcugacuu

SEQ ID NO: 368059 - RNA, 22 nt, Human
gagauguacaauguguauuaau

SEQ ID NO: 368060 - RNA, 22 nt, Human
ggacagcugcuuucaggccaca

SEQ ID NO: 368061 - RNA, 22 nt, Human
aggccaggaccauuagcccaga

SEQ ID NO: 368062 - RNA, 22 nt, Human
gcugguuagaaaacagagcuca

SEQ ID NO: 368063 - RNA, 22 nt, Human
ccuggagcgcgggucaagcugg

SEQ ID NO: 368064 - RNA, 20 nt, Human
cacaggccuugugagcagac

SEQ ID NO: 368065 - RNA, 22 nt, Human
ugcugucaguuggcaggaugag

SEQ ID NO: 368066 - RNA, 22 nt, Human
cacaggcuccggccuugcagcc

SEQ ID NO: 368067 - RNA, 22 nt, Human
ggccagagucuauaugcagaca

SEQ ID NO: 368068 - RNA, 22 nt, Human
aucuggcuuucuuaaugacuua

SEQ ID NO: 368069 - RNA, 22 nt, Human
aggcacugauucucagaguuac

SEQ ID NO: 368070 - RNA, 22 nt, Human
uaccuuggguugaguucauucu

SEQ ID NO: 368071 - RNA, 22 nt, Human
gugugccaacaaaagacagugc

SEQ ID NO: 368072 - RNA, 22 nt, Human
cuagcaucagaugagaagcugu

SEQ ID NO: 368073 - RNA, 22 nt, Human
agcugagcacauucaaacaggu

SEQ ID NO: 368074 - RNA, 22 nt, Human
caguggaaaucagagugagagu

SEQ ID NO: 368075 - RNA, 22 nt, Human
aaugaaacuguauauagacugu

SEQ ID NO: 368076 - RNA, 22 nt, Human
gcacccaguuugucucaggguu

SEQ ID NO: 368077 - RNA, 22 nt, Human
agcugucagugcugugccugua

SEQ ID NO: 368078 - RNA, 22 nt, Human
ugcagggcuaagucagagccug

SEQ ID NO: 368079 - RNA, 22 nt, Human
aaacggauauaacagcaaacgc

SEQ ID NO: 368080 - RNA, 22 nt, Human
uuuaagauucaguaaggcaaac

SEQ ID NO: 368081 - RNA, 19 nt, Human
ccaggccugcgggcguugg

SEQ ID NO: 368082 - RNA, 22 nt, Human
gcuggggucugugaggagggcu

SEQ ID NO: 368083 - RNA, 18 nt, Human
cccucuccugcuaguggg

SEQ ID NO: 368084 - RNA, 23 nt, Human
aggaaagcauucauuuuuaccau

SEQ ID NO: 368085 - RNA, 22 nt, Human
cuauuagguaugcagccuauuu

SEQ ID NO: 368086 - RNA, 22 nt, Human
aggccugggcaagaaggggcgu

SEQ ID NO: 368087 - RNA, 22 nt, Human
ggcugccuccucgagacaggau

SEQ ID NO: 368088 - RNA, 22 nt, Human
ucaggcugaaggaggccuaucu

SEQ ID NO: 368089 - RNA, 22 nt, Human
auguuuccauuuucuuguauca

SEQ ID NO: 368090 - RNA, 22 nt, Human
acaugauuaaaagauuuuaaag

SEQ ID NO: 368091 - RNA, 22 nt, Human
uuugcauuuccagaguagcaga

SEQ ID NO: 368092 - RNA, 22 nt, Human
aaggccugggaguacugggaca

SEQ ID NO: 368093 - RNA, 22 nt, Human
gaggcagaggaagguggucucu

SEQ ID NO: 368094 - RNA, 22 nt, Human
uggcagcacaagguggcccaug

SEQ ID NO: 368095 - RNA, 22 nt, Human
ggccuguguccuccuugcccug

SEQ ID NO: 368096 - RNA, 22 nt, Human
accugccucagugcagcuggau

SEQ ID NO: 368097 - RNA, 22 nt, Human
uaggcagcugcaaacuucgguc

SEQ ID NO: 368098 - RNA, 22 nt, Human
cucacugcccugaaguuggguu

SEQ ID NO: 368099 - RNA, 22 nt, Human
acuguggaugccaaaggggagg

SEQ ID NO: 368100 - RNA, 22 nt, Human
gccuggagagcacugugcgcuu

SEQ ID NO: 368101 - RNA, 22 nt, Human
caacuuugugugaccuagauag

SEQ ID NO: 368102 - RNA, 22 nt, Human
aaacuuuggauugugauugugc

SEQ ID NO: 368103 - RNA, 19 nt, Human
uacauuuguguacacuugu

SEQ ID NO: 368104 - RNA, 19 nt, Human
ucauuguugguuugucggg

SEQ ID NO: 368105 - RNA, 22 nt, Human
caggccuggguucaaaucccuu

SEQ ID NO: 368106 - RNA, 22 nt, Human
cauuugcauaugaagaaguaag

SEQ ID NO: 368107 - RNA, 22 nt, Human
agucucugcaugccugcugugc

SEQ ID NO: 368108 - RNA, 22 nt, Human
acgugcaggaucugguuggcga

SEQ ID NO: 368109 - RNA, 22 nt, Human
ccugcagaaaggguccccagga

SEQ ID NO: 368110 - RNA, 22 nt, Human
cuacauuaaauuggcuuacuua

SEQ ID NO: 368111 - RNA, 22 nt, Human
uaguccuuacuuacuagaauaa

SEQ ID NO: 368112 - RNA, 22 nt, Human
ccuggccucgugcucacggcuc

SEQ ID NO: 368113 - RNA, 19 nt, Human
ucccgcccacugagcgugc

SEQ ID NO: 368114 - RNA, 21 nt, Human
uucuucaugaugauuaauggc

SEQ ID NO: 368115 - RNA, 22 nt, Human
gaagcagcucagauugacugaa

SEQ ID NO: 368116 - RNA, 22 nt, Human
cucccaggcacagggaggagcc

SEQ ID NO: 368117 - RNA, 19 nt, Human
agcuuccauauucucuagu

SEQ ID NO: 368118 - RNA, 22 nt, Human
acaggcagguccugucccagcu

SEQ ID NO: 368119 - RNA, 23 nt, Human
cccuggccuuggggcacaggcug

SEQ ID NO: 368120 - RNA, 19 nt, Human
uguguguuuauauauguau

SEQ ID NO: 368121 - RNA, 22 nt, Human
aguuauaaucugcuacugauau

SEQ ID NO: 368122 - RNA, 22 nt, Human
uccuucagcucucuauuuagau

SEQ ID NO: 368123 - RNA, 22 nt, Human
ccagaccacccuggccaugcac

SEQ ID NO: 368124 - RNA, 22 nt, Human
aaaacauguccauacagaaacu

SEQ ID NO: 368125 - RNA, 22 nt, Human
caugaaaauaacauuguuguga

SEQ ID NO: 368126 - RNA, 20 nt, Human
aggauuuacuacuaccugcu

SEQ ID NO: 368127 - RNA, 22 nt, Human
cuagaaaaauacuuuauuguga

SEQ ID NO: 368128 - RNA, 23 nt, Human
cuggaagugcuuuuauagcuuug

SEQ ID NO: 368129 - RNA, 22 nt, Human
aagcaagacagaaguuacugcc

SEQ ID NO: 368130 - RNA, 22 nt, Human
cugcuguguggauucaauggcu

SEQ ID NO: 368131 - RNA, 22 nt, Human
ucacaggguguacaucaccuau

SEQ ID NO: 368132 - RNA, 22 nt, Human
ggcagcugauuagcaucaagga

SEQ ID NO: 368133 - RNA, 22 nt, Human
gaagaaggugcuacacagggca

SEQ ID NO: 368134 - RNA, 23 nt, Human
ccugugugcccuuaauucacagc

SEQ ID NO: 368135 - RNA, 22 nt, Human
uucugcagcccaacaguaguuu

SEQ ID NO: 368136 - RNA, 22 nt, Human
aucugccugcaguggagguggg

SEQ ID NO: 368137 - RNA, 22 nt, Human
uuuucauuuuuguagaugcaag

SEQ ID NO: 368138 - RNA, 20 nt, Human
ugccaggcugcacgccugcc

SEQ ID NO: 368139 - RNA, 22 nt, Human
cauuacauuucaaaauguuucc

SEQ ID NO: 368140 - RNA, 22 nt, Human
caggccuggggcuggcuuccag

SEQ ID NO: 368141 - RNA, 22 nt, Human
ucauuucaaguucugacagcua

SEQ ID NO: 368142 - RNA, 22 nt, Human
ccuggaugauccaugucaugga

SEQ ID NO: 368143 - RNA, 22 nt, Human
caaaauguucuggcaccuuuaa

SEQ ID NO: 368144 - RNA, 22 nt, Human
ugcauuauuugcaugugccugu

SEQ ID NO: 368145 - RNA, 22 nt, Human
cagagcagguaucuuuggugaa

SEQ ID NO: 368146 - RNA, 22 nt, Human
ccuccaggaacuugagagacac

SEQ ID NO: 368147 - RNA, 22 nt, Human
aaagcaguauauugguaguugu

SEQ ID NO: 368148 - RNA, 22 nt, Human
ugggauggcauccugggccuug

SEQ ID NO: 368149 - RNA, 22 nt, Human
uucuucaacaaggacacuguua

SEQ ID NO: 368150 - RNA, 17 nt, Human
cauuuguugaucaguug

SEQ ID NO: 368151 - RNA, 22 nt, Human
gccuccugguugcuucuccaac

SEQ ID NO: 368152 - RNA, 22 nt, Human
aaagguuaguucuuagaagugc

SEQ ID NO: 368153 - RNA, 22 nt, Human
cagcaggaggugagaugugacc

SEQ ID NO: 368154 - RNA, 22 nt, Human
uucauucuuauuugugaucugg

SEQ ID NO: 368155 - RNA, 22 nt, Human
ucugcuguucauucuuuuagcu

SEQ ID NO: 368156 - RNA, 20 nt, Human
ggucccugcccucugucauc

SEQ ID NO: 368157 - RNA, 22 nt, Human
ggcccugggcagaggagugggc

SEQ ID NO: 368158 - RNA, 22 nt, Human
ccucaggguggcaucagaucuu

SEQ ID NO: 368159 - RNA, 22 nt, Human
cugggaggauacacaagaucag

SEQ ID NO: 368160 - RNA, 22 nt, Human
aguuuaugaaacacagauuuga

SEQ ID NO: 368161 - RNA, 22 nt, Human
ucaauaaaauuguuuuccuauc

SEQ ID NO: 368162 - RNA, 22 nt, Human
agcccuagagcuggaggucagu

SEQ ID NO: 368163 - RNA, 20 nt, Human
ugcuuuaugcuauacuuugu

SEQ ID NO: 368164 - RNA, 22 nt, Human
ucucagagagaugaaacuucca

SEQ ID NO: 368165 - RNA, 22 nt, Human
aucugccuccaaguccaugugu

SEQ ID NO: 368166 - RNA, 22 nt, Human
aggaguggaauuacuggguucu

SEQ ID NO: 368167 - RNA, 22 nt, Human
cucagggggaaucaggucacag

SEQ ID NO: 368168 - RNA, 17 nt, Human
uucucugagcuguauug

SEQ ID NO: 368169 - RNA, 22 nt, Human
ucucagggaccaugaugaugac

SEQ ID NO: 368170 - RNA, 21 nt, Human
agggucaggaaccaggguacc

SEQ ID NO: 368171 - RNA, 22 nt, Human
gagaagccgagucagcugagcc

SEQ ID NO: 368172 - RNA, 22 nt, Human
gcccagcagaucucagugucuc

SEQ ID NO: 368173 - RNA, 19 nt, Human
cagagccucagagcuagaa

SEQ ID NO: 368174 - RNA, 22 nt, Human
aagcuggcaugucaccugagaa

SEQ ID NO: 368175 - RNA, 22 nt, Human
uggucucugacucugaagaccc

SEQ ID NO: 368176 - RNA, 22 nt, Human
uggcucaguggcagccgcagcu

SEQ ID NO: 368177 - RNA, 22 nt, Human
ugugcuucugcagagacuauuu

SEQ ID NO: 368178 - RNA, 22 nt, Human
uuccucaugggguuccuucaga

SEQ ID NO: 368179 - RNA, 22 nt, Human
cuuaauuuuuguaguagaugga

SEQ ID NO: 368180 - RNA, 22 nt, Human
aagacauuacuggaaucugacu

SEQ ID NO: 368181 - RNA, 22 nt, Human
ccuugcaggggaacaggcagug

SEQ ID NO: 368182 - RNA, 22 nt, Human
ugccaggcaacugcccagccau

SEQ ID NO: 368183 - RNA, 22 nt, Human
aauuucaaugcacucaugguug

SEQ ID NO: 368184 - RNA, 22 nt, Human
uggccugggccugccggugcaa

SEQ ID NO: 368185 - RNA, 22 nt, Human
uucuucuugaaacuuuagguug

SEQ ID NO: 368186 - RNA, 22 nt, Human
guuaucaugcuucaucaucacu

SEQ ID NO: 368187 - RNA, 23 nt, Human
cagggcugggcuugguguuaggc

SEQ ID NO: 368188 - RNA, 22 nt, Human
ugagcauggugggugcagagca

SEQ ID NO: 368189 - RNA, 22 nt, Human
acaccauacucauguugguucc

SEQ ID NO: 368190 - RNA, 22 nt, Human
ucagcuggcaguucagaggcug

SEQ ID NO: 368191 - RNA, 22 nt, Human
cugaaggacuuggugauaguug

SEQ ID NO: 368192 - RNA, 22 nt, Human
cuuuccuagauggccaucuuuc

SEQ ID NO: 368193 - RNA, 22 nt, Human
uuguuuuuaugaacauccagga

SEQ ID NO: 368194 - RNA, 22 nt, Human
ucugucacucuagagauggcag

SEQ ID NO: 368195 - RNA, 22 nt, Human
ccagcuggagccaagguggacu

SEQ ID NO: 368196 - RNA, 22 nt, Human
ucagcaguggcucucaugcagu

SEQ ID NO: 368197 - RNA, 22 nt, Human
cugcugugucagaguccagggg

SEQ ID NO: 368198 - RNA, 22 nt, Human
gcaaagcugggugugaaugcac

SEQ ID NO: 368199 - RNA, 20 nt, Human
aggcaguuagaaggagauga

SEQ ID NO: 368200 - RNA, 22 nt, Human
cuggagccccagacagggagag

SEQ ID NO: 368201 - RNA, 22 nt, Human
ggcuguggacacugagcucaga

SEQ ID NO: 368202 - RNA, 22 nt, Human
gcucccagcuggagccucaaca

SEQ ID NO: 368203 - RNA, 22 nt, Human
ggcaggcucagcagccaaggag

SEQ ID NO: 368204 - RNA, 22 nt, Human
ccagcuccugggucuuagucag

SEQ ID NO: 368205 - RNA, 22 nt, Human
aggacuccauguguccuggaga

SEQ ID NO: 368206 - RNA, 22 nt, Human
cagaaauguucuaaugauucag

SEQ ID NO: 368207 - RNA, 22 nt, Human
ccugccuggagcugagugugga

SEQ ID NO: 368208 - RNA, 22 nt, Human
gcuguucacauuuugggccaaa

SEQ ID NO: 368209 - RNA, 22 nt, Human
uuucuuauauucugucauuguu

SEQ ID NO: 368210 - RNA, 21 nt, Human
ugaggcucaucuuauguggcu

SEQ ID NO: 368211 - RNA, 22 nt, Human
aaagcagaacugagagagcugg

SEQ ID NO: 368212 - RNA, 22 nt, Human
ugugcuucuugcagcuccugua

SEQ ID NO: 368213 - RNA, 22 nt, Human
cagggcagagccaggauuucaa

SEQ ID NO: 368214 - RNA, 22 nt, Human
aagggcuggagacugggucuuc

SEQ ID NO: 368215 - RNA, 22 nt, Human
ggggcaggagguguucucuuuu

SEQ ID NO: 368216 - RNA, 22 nt, Human
gaaggcuggcuuucugagagca

SEQ ID NO: 368217 - RNA, 22 nt, Human
auacuuacuuuucuucagacua

SEQ ID NO: 368218 - RNA, 22 nt, Human
agcagugaugcaugacagccua

SEQ ID NO: 368219 - RNA, 21 nt, Human
gagcauggcuuacaucagcag

SEQ ID NO: 368220 - RNA, 22 nt, Human
cagagcuggguuugggaaaccu

SEQ ID NO: 368221 - RNA, 22 nt, Human
cuacugaguccuucagcugcca

SEQ ID NO: 368222 - RNA, 21 nt, Human
cugcucuggggaccggcugug

SEQ ID NO: 368223 - RNA, 22 nt, Human
ggugcuggacacguggcacucc

SEQ ID NO: 368224 - RNA, 22 nt, Human
agaggccagcagugccuaucug

SEQ ID NO: 368225 - RNA, 22 nt, Human
ggaagaggcucucauugagggc

SEQ ID NO: 368226 - RNA, 22 nt, Human
auaaagaggauguauuuacagc

SEQ ID NO: 368227 - RNA, 22 nt, Human
aacaucagaauauccauguugg

SEQ ID NO: 368228 - RNA, 22 nt, Human
cucacagguaccagcacccucc

SEQ ID NO: 368229 - RNA, 20 nt, Human
ccucaagcagacugacagcu

SEQ ID NO: 368230 - RNA, 22 nt, Human
ugcuccauucucuagccagugc

SEQ ID NO: 368231 - RNA, 22 nt, Human
ucucuuuuauguacacccugac

SEQ ID NO: 368232 - RNA, 22 nt, Human
cccaggagaccuagaucuguuu

SEQ ID NO: 368233 - RNA, 22 nt, Human
gcaggcagagagggguuuccag

SEQ ID NO: 368234 - RNA, 22 nt, Human
aauucuauaggcaagcuauuuu

SEQ ID NO: 368235 - RNA, 22 nt, Human
guggccucaugucuauaaagag

SEQ ID NO: 368236 - RNA, 22 nt, Human
ucaccaggcuccuguuaagaug

SEQ ID NO: 368237 - RNA, 22 nt, Human
aaggccaggacaccaggggacu

SEQ ID NO: 368238 - RNA, 20 nt, Human
gaugggaaucggagcuggua

SEQ ID NO: 368239 - RNA, 22 nt, Human
uauacagaacugcacgugcacg

SEQ ID NO: 368240 - RNA, 22 nt, Human
gccaggcuccaggcccuccuga

SEQ ID NO: 368241 - RNA, 22 nt, Human
ggcccaaggcccaggucgagcu

SEQ ID NO: 368242 - RNA, 19 nt, Human
guucaaacacugauucagc

SEQ ID NO: 368243 - RNA, 22 nt, Human
cuccaggaaagccugaggcccg

SEQ ID NO: 368244 - RNA, 22 nt, Human
gugcagugacccuggagagcug

SEQ ID NO: 368245 - RNA, 22 nt, Human
ugaacauauucaccucuaaaua

SEQ ID NO: 368246 - RNA, 22 nt, Human
cugggcucagcccaugcugucc

SEQ ID NO: 368247 - RNA, 22 nt, Human
aagauauucaaagauuuauuag

SEQ ID NO: 368248 - RNA, 22 nt, Human
cuggacuuuggcccaucugcca

SEQ ID NO: 368249 - RNA, 22 nt, Human
uggggugguaauacaccguucu

SEQ ID NO: 368250 - RNA, 22 nt, Human
gagagugaggcaucaggggcag

SEQ ID NO: 368251 - RNA, 22 nt, Human
uggaggaaguugcuggaaguca

SEQ ID NO: 368252 - RNA, 22 nt, Human
gugaaggcuacaagagaucaag

SEQ ID NO: 368253 - RNA, 22 nt, Human
uggggugccgacagggagggca

SEQ ID NO: 368254 - RNA, 22 nt, Human
uugauacauuuuuaggauaaac

SEQ ID NO: 368255 - RNA, 22 nt, Human
agauuuacugagaacugauuac

SEQ ID NO: 368256 - RNA, 22 nt, Human
gaagcagcuggugagauggagc

SEQ ID NO: 368257 - RNA, 22 nt, Human
ugcauauuuuauaaagauggaa

SEQ ID NO: 368258 - RNA, 22 nt, Human
gcaggagcucguuuccaggcug

SEQ ID NO: 368259 - RNA, 22 nt, Human
aggaggccgggauucuggagau

SEQ ID NO: 368260 - RNA, 22 nt, Human
uggcuccuaggauggugccugg

SEQ ID NO: 368261 - RNA, 22 nt, Human
uuuguacauccuaauucugagu

SEQ ID NO: 368262 - RNA, 23 nt, Human
ggagaggggugugggcaucuuua

SEQ ID NO: 368263 - RNA, 22 nt, Human
uggcaugauaggaggugcagaa

SEQ ID NO: 368264 - RNA, 22 nt, Human
gaggugagaagggggucagaug

SEQ ID NO: 368265 - RNA, 22 nt, Human
gcuggcuccucuguccucacgg

SEQ ID NO: 368266 - RNA, 22 nt, Human
gggcugggcaugguguucccuc

SEQ ID NO: 368267 - RNA, 23 nt, Human
aaucuauacuuaggcugguaaua

SEQ ID NO: 368268 - RNA, 22 nt, Human
gcugagugagguccagagcuug

SEQ ID NO: 368269 - RNA, 21 nt, Human
auggauuuaaacaggccacaa

SEQ ID NO: 368270 - RNA, 22 nt, Human
agccuggauucgugcauccaca

SEQ ID NO: 368271 - RNA, 22 nt, Human
guuauaaaggugauaaugguca

SEQ ID NO: 368272 - RNA, 20 nt, Human
agugugcauuuagagucugc

SEQ ID NO: 368273 - RNA, 22 nt, Human
cauuugcaagagauaaauguuu

SEQ ID NO: 368274 - RNA, 22 nt, Human
agagcugugcuuugcaccacgu

SEQ ID NO: 368275 - RNA, 22 nt, Human
ggcucaccauggccucccugcu

SEQ ID NO: 368276 - RNA, 22 nt, Human
uuacauuuugggguaaggauaa

SEQ ID NO: 368277 - RNA, 23 nt, Human
acuauaaaguuguucugauuuac

SEQ ID NO: 368278 - RNA, 22 nt, Human
ugucaugccauuuaaaauguuu

SEQ ID NO: 368279 - RNA, 22 nt, Human
ggcugcucugccuuccagcugg

SEQ ID NO: 368280 - RNA, 22 nt, Human
acauacauaugacaacuuuccu

SEQ ID NO: 368281 - RNA, 22 nt, Human
agaaggcacucacacuggcacg

SEQ ID NO: 368282 - RNA, 22 nt, Human
ccaaaguccuuucuccaccugc

SEQ ID NO: 368283 - RNA, 22 nt, Human
cauacuuuugcccugacauucu

SEQ ID NO: 368284 - RNA, 22 nt, Human
auuugcaaagucguaucuguga

SEQ ID NO: 368285 - RNA, 22 nt, Human
ucaggagagagaaauuggggcu

SEQ ID NO: 368286 - RNA, 17 nt, Human
acaggccugcuugcacu

SEQ ID NO: 368287 - RNA, 22 nt, Human
cuaaaugcccuacaaugacugg

SEQ ID NO: 368288 - RNA, 22 nt, Human
cagagggagcccuccaggagca

SEQ ID NO: 368289 - RNA, 22 nt, Human
cugccuggaccggcagcccucc

SEQ ID NO: 368290 - RNA, 22 nt, Human
gcugccuguugaagggucugug

SEQ ID NO: 368291 - RNA, 22 nt, Human
aucagcaagcauuuauugagug

SEQ ID NO: 368292 - RNA, 22 nt, Human
uccuuuuuauaguuagagaaac

SEQ ID NO: 368293 - RNA, 22 nt, Human
auaacaugaccugugcuucaca

SEQ ID NO: 368294 - RNA, 22 nt, Human
ugggcuccggcggccucaggcu

SEQ ID NO: 368295 - RNA, 22 nt, Human
uaggagcuaaaauauuuuauau

SEQ ID NO: 368296 - RNA, 22 nt, Human
agcugcuccuuuccugcaggcg

SEQ ID NO: 368297 - RNA, 22 nt, Human
uggaagccaggcccgcuccuaa

SEQ ID NO: 368298 - RNA, 22 nt, Human
ggguggagaggcuaaguccagu

SEQ ID NO: 368299 - RNA, 22 nt, Human
aggagccaagauggggcaagua

SEQ ID NO: 368300 - RNA, 22 nt, Human
gggcuguaggagcuggaauggg

SEQ ID NO: 368301 - RNA, 18 nt, Human
uggcagccagcugcuccu

SEQ ID NO: 368302 - RNA, 22 nt, Human
caagggccuccaccuugcucgu

SEQ ID NO: 368303 - RNA, 22 nt, Human
caggugggagcggagacugauu

SEQ ID NO: 368304 - RNA, 22 nt, Human
aggcagauuacuugaggccagg

SEQ ID NO: 368305 - RNA, 22 nt, Human
agggcuggccacaugauuuggu

SEQ ID NO: 368306 - RNA, 22 nt, Human
ccagcugcuugggaaaaugucu

SEQ ID NO: 368307 - RNA, 22 nt, Human
cccagccucugggcucacccaa

SEQ ID NO: 368308 - RNA, 22 nt, Human
cauugcacuccaucuugggcaa

SEQ ID NO: 368309 - RNA, 17 nt, Human
ugaaaucagcacccagg

SEQ ID NO: 368310 - RNA, 22 nt, Human
aaaugaacucuuccugcauccc

SEQ ID NO: 368311 - RNA, 22 nt, Human
guucuguacuccaagcucuucc

SEQ ID NO: 368312 - RNA, 22 nt, Human
gccaggcaggccacgcuguguu

SEQ ID NO: 368313 - RNA, 22 nt, Human
cuggagccacuuuuuauccuuu

SEQ ID NO: 368314 - RNA, 22 nt, Human
gaaacugugaucguguucuggg

SEQ ID NO: 368315 - RNA, 22 nt, Human
ugcagggccccucugcaugagu

SEQ ID NO: 368316 - RNA, 22 nt, Human
gcagccaccucccauggcgggg

SEQ ID NO: 368317 - RNA, 22 nt, Human
cagcuuuguggccuugaccucg

SEQ ID NO: 368318 - RNA, 22 nt, Human
acaaauuuauugaagggcauau

SEQ ID NO: 368319 - RNA, 22 nt, Human
gcuggggaggcagcagagaaca

SEQ ID NO: 368320 - RNA, 22 nt, Human
cuagagggauguuaggauagca

SEQ ID NO: 368321 - RNA, 22 nt, Human
gcaccacaucaaugaggggagc

SEQ ID NO: 368322 - RNA, 22 nt, Human
gcagcuuuguggagaggcccau

SEQ ID NO: 368323 - RNA, 21 nt, Human
acagucuccccagaucucucc

SEQ ID NO: 368324 - RNA, 22 nt, Human
ccagcccucacugaggccucuc

SEQ ID NO: 368325 - RNA, 22 nt, Human
gcugucuccauagcuguguguc

SEQ ID NO: 368326 - RNA, 22 nt, Human
ugugaaggcagcagcucugucc

SEQ ID NO: 368327 - RNA, 22 nt, Human
gagggaauggugugcaagaggu

SEQ ID NO: 368328 - RNA, 22 nt, Human
gaagaauccuguccucuuuagg

SEQ ID NO: 368329 - RNA, 22 nt, Human
ucugagagcuguagaagccuau

SEQ ID NO: 368330 - RNA, 22 nt, Human
uacauugugauguuucaauaca

SEQ ID NO: 368331 - RNA, 22 nt, Human
uuucaaaccuacuuguauguuu

SEQ ID NO: 368332 - RNA, 22 nt, Human
acuggcugaaguuuacuuuuug

SEQ ID NO: 368333 - RNA, 19 nt, Human
ggcugggucuggcagguuc

SEQ ID NO: 368334 - RNA, 22 nt, Human
uacauaaugagcuaguuaaguu

SEQ ID NO: 368335 - RNA, 22 nt, Human
ucugucuucaucagcaugugau

SEQ ID NO: 368336 - RNA, 22 nt, Human
agcuuuguggcuuugcaagacu

SEQ ID NO: 368337 - RNA, 22 nt, Human
cucucugagugagggacaagcu

SEQ ID NO: 368338 - RNA, 22 nt, Human
cagaguguaucuguguaagcau

SEQ ID NO: 368339 - RNA, 22 nt, Human
ccagccaguccagcauuggugu

SEQ ID NO: 368340 - RNA, 22 nt, Human
augcaagauguauagaagacuu

SEQ ID NO: 368341 - RNA, 22 nt, Human
gggagucugggcuagacuccuu

SEQ ID NO: 368342 - RNA, 22 nt, Human
ugucccagggaaggcccagcac

SEQ ID NO: 368343 - RNA, 17 nt, Human
aaucagauuucugagga

SEQ ID NO: 368344 - RNA, 22 nt, Human
uucugaaagccaauucauugaa

SEQ ID NO: 368345 - RNA, 22 nt, Human
ccucuggcaacuucacagccca

SEQ ID NO: 368346 - RNA, 22 nt, Human
ggcauggcuggguucuggugag

SEQ ID NO: 368347 - RNA, 22 nt, Human
ugguggcuucugaggauggcga

SEQ ID NO: 368348 - RNA, 22 nt, Human
uggcucaggccacuucuuuuau

SEQ ID NO: 368349 - RNA, 22 nt, Human
uuuuauguaauccuuacugucg

SEQ ID NO: 368350 - RNA, 22 nt, Human
uuugaagucagacacugcuuug

SEQ ID NO: 368351 - RNA, 22 nt, Human
gugaaaauaaggcugguucuug

SEQ ID NO: 368352 - RNA, 22 nt, Human
uuagaaaaaggcuguggucuua

SEQ ID NO: 368353 - RNA, 22 nt, Human
uccugcagacauuuacaccuuu

SEQ ID NO: 368354 - RNA, 22 nt, Human
ggagccuuccagacugcccaca

SEQ ID NO: 368355 - RNA, 22 nt, Human
agcagcauagaugcuauccgag

SEQ ID NO: 368356 - RNA, 22 nt, Human
aucaggaucagggcuagcagag

SEQ ID NO: 368357 - RNA, 22 nt, Human
uccugguggugccagcugcagg

SEQ ID NO: 368358 - RNA, 21 nt, Human
aaauuucugcaagccucaacu

SEQ ID NO: 368359 - RNA, 22 nt, Human
cccagcccaucucaaaggucua

SEQ ID NO: 368360 - RNA, 22 nt, Human
gcauguuauguaucugcccagc

SEQ ID NO: 368361 - RNA, 22 nt, Human
gcuguggccuggcgcagagcug

SEQ ID NO: 368362 - RNA, 22 nt, Human
gaauuucagggucugguaggaa

SEQ ID NO: 368363 - RNA, 22 nt, Human
cagggccaguucucgcagcagu

SEQ ID NO: 368364 - RNA, 22 nt, Human
uaguaacagauuuauacagucu

SEQ ID NO: 368365 - RNA, 17 nt, Human
auuucacuuagcaugag

SEQ ID NO: 368366 - RNA, 22 nt, Human
uccauugucuuugguccuagcc

SEQ ID NO: 368367 - RNA, 22 nt, Human
uuaaauauuauguugucugcaa

SEQ ID NO: 368368 - RNA, 19 nt, Human
uacuuuuucaggacagagu

SEQ ID NO: 368369 - RNA, 22 nt, Human
agauaacuuuuggguauucaug

SEQ ID NO: 368370 - RNA, 22 nt, Human
cccaggaggcgcagguugcggu

SEQ ID NO: 368371 - RNA, 22 nt, Human
ccccggaggcggagguugcagu

SEQ ID NO: 368372 - RNA, 21 nt, Human
ccccugggagcccugucagua

SEQ ID NO: 368373 - RNA, 22 nt, Human
uaguccaguaaaacagcuaacg

SEQ ID NO: 368374 - RNA, 22 nt, Human
agagcuggacgucugagcccua

SEQ ID NO: 368375 - RNA, 21 nt, Human
agagaagggacucuuccaguc

SEQ ID NO: 368376 - RNA, 22 nt, Human
ugagcuguagcagaugcuguug

SEQ ID NO: 368377 - RNA, 22 nt, Human
ucaguguaaguuauguagaugu

SEQ ID NO: 368378 - RNA, 22 nt, Human
aagcagcauucagugaaaugug

SEQ ID NO: 368379 - RNA, 22 nt, Human
uuuguuaauucuuauguuagag

SEQ ID NO: 368380 - RNA, 22 nt, Human
augaugguggguaauguguaaa

SEQ ID NO: 368381 - RNA, 22 nt, Human
caguagcacucugucagugaag

SEQ ID NO: 368382 - RNA, 22 nt, Human
ugcugcucucagccaccaggaa

SEQ ID NO: 368383 - RNA, 22 nt, Human
ugcccauguuucucuguauccc

SEQ ID NO: 368384 - RNA, 22 nt, Human
aaguuacaggagaaagagauca

SEQ ID NO: 368385 - RNA, 22 nt, Human
agggaggauaguagucaguuua

SEQ ID NO: 368386 - RNA, 22 nt, Human
cuggggcugcgguggaggagcc

SEQ ID NO: 368387 - RNA, 22 nt, Human
aauuuccagaccccauccacag

SEQ ID NO: 368388 - RNA, 22 nt, Human
gaaggcuugcagcucuguggca

SEQ ID NO: 368389 - RNA, 18 nt, Human
aggccagcccugcuacug

SEQ ID NO: 368390 - RNA, 22 nt, Human
uuucagaugugugucucugaag

SEQ ID NO: 368391 - RNA, 22 nt, Human
gaguccuuggcaucaucaguac

SEQ ID NO: 368392 - RNA, 22 nt, Human
uuugaaucugauauggcagcau

SEQ ID NO: 368393 - RNA, 19 nt, Human
agggccugcagcucaagcu

SEQ ID NO: 368394 - RNA, 22 nt, Human
uguccuuaucuccaaacaauca

SEQ ID NO: 368395 - RNA, 22 nt, Human
uuuaggcacagaguugagggac

SEQ ID NO: 368396 - RNA, 22 nt, Human
uuguuuuaucuuucuacagacu

SEQ ID NO: 368397 - RNA, 22 nt, Human
agggcugaguggugcagucaaa

SEQ ID NO: 368398 - RNA, 22 nt, Human
gggauggggagcuggaaagggg

SEQ ID NO: 368399 - RNA, 22 nt, Human
cagcaggacauggaggaguaaa

SEQ ID NO: 368400 - RNA, 22 nt, Human
ggcucugcccagguggacagca

SEQ ID NO: 368401 - RNA, 22 nt, Human
gagcucagcccaaagagcagug

SEQ ID NO: 368402 - RNA, 20 nt, Human
ugaaggccagcagcauaggg

SEQ ID NO: 368403 - RNA, 22 nt, Human
agcuuccuuggcgcugaggccu

SEQ ID NO: 368404 - RNA, 22 nt, Human
gaggaguggaguugcuggguug

SEQ ID NO: 368405 - RNA, 22 nt, Human
caggaggaggguacaccaucag

SEQ ID NO: 368406 - RNA, 22 nt, Human
caggguccaucuuucaucacug

SEQ ID NO: 368407 - RNA, 22 nt, Human
gagagugaugaaugguuaaaca

SEQ ID NO: 368408 - RNA, 22 nt, Human
cuuuuauuuugaauuaagggcu

SEQ ID NO: 368409 - RNA, 20 nt, Human
uucuuaaagaccucacuuug

SEQ ID NO: 368410 - RNA, 22 nt, Human
acucacauuucaucaggccaag

SEQ ID NO: 368411 - RNA, 19 nt, Human
ggaagagaggaaaggugga

SEQ ID NO: 368412 - RNA, 22 nt, Human
gccuggagcucaugugggcauu

SEQ ID NO: 368413 - RNA, 22 nt, Human
uccuuccucggggacccagauc

SEQ ID NO: 368414 - RNA, 22 nt, Human
ccugacgaaaggcgugcuggag

SEQ ID NO: 368415 - RNA, 22 nt, Human
ccuggaucagagccagagaagc

SEQ ID NO: 368416 - RNA, 22 nt, Human
cuggccugaucucaugcugucc

SEQ ID NO: 368417 - RNA, 21 nt, Human
ccugcagcaccagaaggagau

SEQ ID NO: 368418 - RNA, 22 nt, Human
uugaaucuggguacuuguaaua

SEQ ID NO: 368419 - RNA, 22 nt, Human
gagggaggugauacugaacgua

SEQ ID NO: 368420 - RNA, 22 nt, Human
uuucaugugcaauuagcaauau

SEQ ID NO: 368421 - RNA, 22 nt, Human
ccagcucuuggugcacuuacau

SEQ ID NO: 368422 - RNA, 22 nt, Human
aaaucagugcucauuugaaagg

SEQ ID NO: 368423 - RNA, 22 nt, Human
agagauguucauucagcauguu

SEQ ID NO: 368424 - RNA, 22 nt, Human
cuucccuuggugaacagagcau

SEQ ID NO: 368425 - RNA, 22 nt, Human
gggagggauuaguucugccugg

SEQ ID NO: 368426 - RNA, 17 nt, Human
ucugccgacugccagcu

SEQ ID NO: 368427 - RNA, 22 nt, Human
uccugagaaggcacagcuugca

SEQ ID NO: 368428 - RNA, 22 nt, Human
gaggcucaccuagggagcacug

SEQ ID NO: 368429 - RNA, 22 nt, Human
aggcagcuaagauggauaauga

SEQ ID NO: 368430 - RNA, 22 nt, Human
cugcucuguuaauuaaacuuug

SEQ ID NO: 368431 - RNA, 22 nt, Human
agcagcuguggaaaaguaacua

SEQ ID NO: 368432 - RNA, 22 nt, Human
cucaggagacaguguccacaug

SEQ ID NO: 368433 - RNA, 22 nt, Human
uuugaaauaugaggcauuauga

SEQ ID NO: 368434 - RNA, 22 nt, Human
uucacagauguauuggaacucc

SEQ ID NO: 368435 - RNA, 22 nt, Human
agauggaguuaguaccagaguc

SEQ ID NO: 368436 - RNA, 22 nt, Human
guggcagcaaaauccugcauuc

SEQ ID NO: 368437 - RNA, 22 nt, Human
aaggaagagaauccuucucaga

SEQ ID NO: 368438 - RNA, 22 nt, Human
caggaagcugagcugcacugca

SEQ ID NO: 368439 - RNA, 22 nt, Human
gccuggagggucccucucugga

SEQ ID NO: 368440 - RNA, 22 nt, Human
guuagaauaaaaggucagagag

SEQ ID NO: 368441 - RNA, 22 nt, Human
cuuuaagagaucaccaaucaca

SEQ ID NO: 368442 - RNA, 22 nt, Human
gcagagccugugucugagcaaa

SEQ ID NO: 368443 - RNA, 22 nt, Human
caucaaauggcaagugaaagcu

SEQ ID NO: 368444 - RNA, 22 nt, Human
cugggagcggcugucacugguu

SEQ ID NO: 368445 - RNA, 22 nt, Human
gacagaggcaagaccagaagcc

SEQ ID NO: 368446 - RNA, 22 nt, Human
cacugagaggucucauuuccaa

SEQ ID NO: 368447 - RNA, 22 nt, Human
ugaaaucuucacuaagucucuu

SEQ ID NO: 368448 - RNA, 22 nt, Human
ggcugugccucaaggcuacuca

SEQ ID NO: 368449 - RNA, 22 nt, Human
cccaggaggcagagauagcagu

SEQ ID NO: 368450 - RNA, 22 nt, Human
aggcacugcagauuacaggcgc

SEQ ID NO: 368451 - RNA, 22 nt, Human
uuaaaaugcagauucugauuca

SEQ ID NO: 368452 - RNA, 22 nt, Human
auuauaaaccuuugaggguggg

SEQ ID NO: 368453 - RNA, 22 nt, Human
agccuggcuguaaccucauggu

SEQ ID NO: 368454 - RNA, 22 nt, Human
gcuccugucuuggggcacuggc

SEQ ID NO: 368455 - RNA, 22 nt, Human
cagagcagggugcaccuugggc

SEQ ID NO: 368456 - RNA, 22 nt, Human
aguuauuucaguaacauaauag

SEQ ID NO: 368457 - RNA, 22 nt, Human
ucuguagcaagugagaggcauu

SEQ ID NO: 368458 - RNA, 22 nt, Human
aggacagggauucaaacuccca

SEQ ID NO: 368459 - RNA, 22 nt, Human
uguaugcuuguguauaauauaa

SEQ ID NO: 368460 - RNA, 22 nt, Human
uuccuuagaguuuccagaaagc

SEQ ID NO: 368461 - RNA, 22 nt, Human
uuguaacaggcacucugugcca

SEQ ID NO: 368462 - RNA, 22 nt, Human
uggcagagugcagaagaggcau

SEQ ID NO: 368463 - RNA, 22 nt, Human
ugcauguguguguauuuauaaa

SEQ ID NO: 368464 - RNA, 22 nt, Human
gagggagggaaaguuuaacacu

SEQ ID NO: 368465 - RNA, 22 nt, Human
ggucccaggaaucuguguucua

SEQ ID NO: 368466 - RNA, 21 nt, Human
gccaccccuggcacaggugcu

SEQ ID NO: 368467 - RNA, 22 nt, Human
aaggucauuguugcauguucuc

SEQ ID NO: 368468 - RNA, 22 nt, Human
gcccagcugucuggcagggaug

SEQ ID NO: 368469 - RNA, 22 nt, Human
aggagucagauuguuugaaugu

SEQ ID NO: 368470 - RNA, 22 nt, Human
gacagcugugcaggagaagggg

SEQ ID NO: 368471 - RNA, 22 nt, Human
ugggagcucagaaagggagguc

SEQ ID NO: 368472 - RNA, 22 nt, Human
guccugucccccaaggcugugg

SEQ ID NO: 368473 - RNA, 22 nt, Human
cugccuugaaaaugaagcuuua

SEQ ID NO: 368474 - RNA, 22 nt, Human
aagcugcccuguguuagaguuc

SEQ ID NO: 368475 - RNA, 22 nt, Human
uggagaugaauauguguaccug

SEQ ID NO: 368476 - RNA, 22 nt, Human
uuuaacacuaguuucuuuaacu

SEQ ID NO: 368477 - RNA, 22 nt, Human
ggaagccaguugcuuggugugg

SEQ ID NO: 368478 - RNA, 22 nt, Human
gcauccagagguagccacugug

SEQ ID NO: 368479 - RNA, 22 nt, Human
uaaguucaaugaacucaguucu

SEQ ID NO: 368480 - RNA, 22 nt, Human
aaaggucagcugccaucguucu

SEQ ID NO: 368481 - RNA, 22 nt, Human
agggcuccuaugaugcucugcc

SEQ ID NO: 368482 - RNA, 22 nt, Human
cuacauaaauauuuaugugucu

SEQ ID NO: 368483 - RNA, 22 nt, Human
ugggugcuucgucagcucugag

SEQ ID NO: 368484 - RNA, 22 nt, Human
ucucucagaggccaggguccug

SEQ ID NO: 368485 - RNA, 22 nt, Human
aaguggacuaauacaaggacua

SEQ ID NO: 368486 - RNA, 21 nt, Human
ccaggcuccugaggcugguca

SEQ ID NO: 368487 - RNA, 21 nt, Human
gcagccacugccuucaacaau

SEQ ID NO: 368488 - RNA, 22 nt, Human
aagccaggggcugcuuaggaga

SEQ ID NO: 368489 - RNA, 16 nt, Human
aggaggggaauuagga

SEQ ID NO: 368490 - RNA, 21 nt, Human
ggagucauuagucauuuccuu

SEQ ID NO: 368491 - RNA, 22 nt, Human
ugaggcaggagaauggcgggaa

SEQ ID NO: 368492 - RNA, 22 nt, Human
cagccugcauuuguaucuguau

SEQ ID NO: 368493 - RNA, 22 nt, Human
uauuaguagcuugaaauuggug

SEQ ID NO: 368494 - RNA, 22 nt, Human
ccugagggaggguauaggcugu

SEQ ID NO: 368495 - RNA, 22 nt, Human
ucucuucuaauuaggguccaug

SEQ ID NO: 368496 - RNA, 22 nt, Human
gagugcagaugaacagaagauu

SEQ ID NO: 368497 - RNA, 22 nt, Human
uagagcuggaaaacugcaggua

SEQ ID NO: 368498 - RNA, 22 nt, Human
gcagucaguaaggcagccagaa

SEQ ID NO: 368499 - RNA, 22 nt, Human
gaauaaucaugaaauucaguga

SEQ ID NO: 368500 - RNA, 22 nt, Human
uuugcauucuagaaaaauuucu

SEQ ID NO: 368501 - RNA, 20 nt, Human
ugcuggggacauacagggug

SEQ ID NO: 368502 - RNA, 22 nt, Human
aauuccaggaugcaggaggugc

SEQ ID NO: 368503 - RNA, 22 nt, Human
gaggagaaauuauccuuggugu

SEQ ID NO: 368504 - RNA, 22 nt, Human
guuaggcaugaguguguauuaa

SEQ ID NO: 368505 - RNA, 22 nt, Human
ggaggcagaacuucccgucagu

SEQ ID NO: 368506 - RNA, 22 nt, Human
aggcucagugcaaaucauucug

SEQ ID NO: 368507 - RNA, 20 nt, Human
ccuguucacugcgcaguuuc

SEQ ID NO: 368508 - RNA, 19 nt, Human
caguccuuuccgcuuucuc

SEQ ID NO: 368509 - RNA, 22 nt, Human
gugaauaaucacccuucuggau

SEQ ID NO: 368510 - RNA, 22 nt, Human
ugacacagaaauuaagcuguca

SEQ ID NO: 368511 - RNA, 22 nt, Human
caguccuuggcuucauccgagu

SEQ ID NO: 368512 - RNA, 22 nt, Human
agcagggcagguaaggaucaga

SEQ ID NO: 368513 - RNA, 22 nt, Human
cagggacauugguggccagguu

SEQ ID NO: 368514 - RNA, 22 nt, Human
ggagugggcagcacugcccugu

SEQ ID NO: 368515 - RNA, 22 nt, Human
gcagcaggcacggucucgacau

SEQ ID NO: 368516 - RNA, 22 nt, Human
cggcagcucgagggccacccgu

SEQ ID NO: 368517 - RNA, 22 nt, Human
agcugccgaugcccagcugcau

SEQ ID NO: 368518 - RNA, 22 nt, Human
gucaccagcaccaaugccacau

SEQ ID NO: 368519 - RNA, 22 nt, Human
caguccaggccuggaggagcca

SEQ ID NO: 368520 - RNA, 22 nt, Human
uuucaacaccagagaccaugcg

SEQ ID NO: 368521 - RNA, 22 nt, Human
ccuguucaccauggucacgugc

SEQ ID NO: 368522 - RNA, 22 nt, Human
gaaugcacacgugugugcaugc

SEQ ID NO: 368523 - RNA, 22 nt, Human
ucugucugcgcuugcccuggug

SEQ ID NO: 368524 - RNA, 22 nt, Human
accaaggagacaaagguguauu

SEQ ID NO: 368525 - RNA, 20 nt, Human
aacuuguucuaccuguuuca

SEQ ID NO: 368526 - RNA, 22 nt, Human
agagugaaaagcuagagcagua

SEQ ID NO: 368527 - RNA, 22 nt, Human
acaugcuuguuuuucacaaccu

SEQ ID NO: 368528 - RNA, 22 nt, Human
aaggcagaaagggaugugagug

SEQ ID NO: 368529 - RNA, 22 nt, Human
ugugccagccucuggcuguguc

SEQ ID NO: 368530 - RNA, 22 nt, Human
uggcauuucuguuagacucuca

SEQ ID NO: 368531 - RNA, 20 nt, Human
aacacagauaccaaagguug

SEQ ID NO: 368532 - RNA, 22 nt, Human
ccucccacauugaggacaugcu

SEQ ID NO: 368533 - RNA, 22 nt, Human
cagggaguuuuuguuccucuag

SEQ ID NO: 368534 - RNA, 22 nt, Human
ucacauucucagcaucuauaca

SEQ ID NO: 368535 - RNA, 22 nt, Human
ugagugaggaagcgguggagga

SEQ ID NO: 368536 - RNA, 21 nt, Human
ggagggcagcccagacuggcu

SEQ ID NO: 368537 - RNA, 22 nt, Human
uccagcuugacaaaugauuuua

SEQ ID NO: 368538 - RNA, 22 nt, Human
ccugggcuucugucuagauguu

SEQ ID NO: 368539 - RNA, 22 nt, Human
uuuccaagagcuuauuucugaa

SEQ ID NO: 368540 - RNA, 22 nt, Human
ucaggcugcaucuguaagggug

SEQ ID NO: 368541 - RNA, 22 nt, Human
cuucuuaaucccuuauauauuu

SEQ ID NO: 368542 - RNA, 19 nt, Human
ggcauccacgaaugcagag

SEQ ID NO: 368543 - RNA, 22 nt, Human
agggaagcuuguuacugagaag

SEQ ID NO: 368544 - RNA, 22 nt, Human
agcagggcugcagugugucuuu

SEQ ID NO: 368545 - RNA, 22 nt, Human
ugccugucuucaggagugucac

SEQ ID NO: 368546 - RNA, 22 nt, Human
gacccaggcucgugggacggcu

SEQ ID NO: 368547 - RNA, 19 nt, Human
ccuguucaugacucugucc

SEQ ID NO: 368548 - RNA, 22 nt, Human
aaugucugccugaacuuuauau

SEQ ID NO: 368549 - RNA, 19 nt, Human
uucacaauuaugaaauuag

SEQ ID NO: 368550 - RNA, 22 nt, Human
cagcagagcauuugguaggagg

SEQ ID NO: 368551 - RNA, 22 nt, Human
agccaggcagacucucuuucuu

SEQ ID NO: 368552 - RNA, 22 nt, Human
guauuagguuggugcaaaauug

SEQ ID NO: 368553 - RNA, 22 nt, Human
aaagggaggggcgauaagccgg

SEQ ID NO: 368554 - RNA, 22 nt, Human
gguaaaaugcagauucuuagcc

SEQ ID NO: 368555 - RNA, 22 nt, Human
gcuguguuugacaguagcagac

SEQ ID NO: 368556 - RNA, 22 nt, Human
aaggcuuuaugugaccaaaaga

SEQ ID NO: 368557 - RNA, 22 nt, Human
cuuucaacuacauacaggcgau

SEQ ID NO: 368558 - RNA, 22 nt, Human
auuuccauacacccauuucuga

SEQ ID NO: 368559 - RNA, 22 nt, Human
uagcuuuagaaauauucucaga

SEQ ID NO: 368560 - RNA, 22 nt, Human
ggugaaggucuacugugugcca

SEQ ID NO: 368561 - RNA, 22 nt, Human
cuccagugggggugagccuaga

SEQ ID NO: 368562 - RNA, 22 nt, Human
uugaaagucacaauggcauuaa

SEQ ID NO: 368563 - RNA, 22 nt, Human
aauauuaucaaaagcuuuuuca

SEQ ID NO: 368564 - RNA, 22 nt, Human
ggcagaguggagugcggccucc

SEQ ID NO: 368565 - RNA, 22 nt, Human
uggcccugacugauguggaggg

SEQ ID NO: 368566 - RNA, 22 nt, Human
ggugccagccuagugcaguggu

SEQ ID NO: 368567 - RNA, 22 nt, Human
uggcagagaaccugggcuuugu

SEQ ID NO: 368568 - RNA, 22 nt, Human
uuuauuagauuaucaaagaggu

SEQ ID NO: 368569 - RNA, 22 nt, Human
guucacauccuugugaggauuu

SEQ ID NO: 368570 - RNA, 22 nt, Human
guugcacaguuccucaagcagg

SEQ ID NO: 368571 - RNA, 22 nt, Human
gcccugugcgacucuagagguu

SEQ ID NO: 368572 - RNA, 22 nt, Human
cagugguauuugagagaaugga

SEQ ID NO: 368573 - RNA, 22 nt, Human
agugaguggguuacagauggga

SEQ ID NO: 368574 - RNA, 20 nt, Human
gugaccagaagacagugggu

SEQ ID NO: 368575 - RNA, 22 nt, Human
cugucccaggagcuguaagaca

SEQ ID NO: 368576 - RNA, 22 nt, Human
ccacugaggcaggcaguaucua

SEQ ID NO: 368577 - RNA, 22 nt, Human
ccaagggcucugacuugccugc

SEQ ID NO: 368578 - RNA, 22 nt, Human
ggaggcucugcuccguguguuc

SEQ ID NO: 368579 - RNA, 22 nt, Human
ugaagccauaggacagaggaua

SEQ ID NO: 368580 - RNA, 22 nt, Human
auaguauuuaauaguuagcuca

SEQ ID NO: 368581 - RNA, 22 nt, Human
ucauuauuuuggacuggagugu

SEQ ID NO: 368582 - RNA, 22 nt, Human
ugggaccugcucuuggaaugag

SEQ ID NO: 368583 - RNA, 21 nt, Human
agaugcugugcuccaggagca

SEQ ID NO: 368584 - RNA, 22 nt, Human
aggagguggccugagcgugccc

SEQ ID NO: 368585 - RNA, 22 nt, Human
gugcugugucuaucaggaauaa

SEQ ID NO: 368586 - RNA, 22 nt, Human
ugauucacagacuucacaaggc

SEQ ID NO: 368587 - RNA, 22 nt, Human
gaggcaacacauuuggaaagca

SEQ ID NO: 368588 - RNA, 22 nt, Human
aggcuucacgaugggugaggug

SEQ ID NO: 368589 - RNA, 22 nt, Human
aggcucagcugguggugaucgc

SEQ ID NO: 368590 - RNA, 22 nt, Human
uccucugcuccaucuuuacugu

SEQ ID NO: 368591 - RNA, 19 nt, Human
uggcaggcccaggauggac

SEQ ID NO: 368592 - RNA, 22 nt, Human
cuuaagaauauugaaguugugg

SEQ ID NO: 368593 - RNA, 22 nt, Human
agcagggcagugcuucagcucu

SEQ ID NO: 368594 - RNA, 22 nt, Human
augcagaaggagccaugcuugc

SEQ ID NO: 368595 - RNA, 22 nt, Human
cugucuccuccacugcauggga

SEQ ID NO: 368596 - RNA, 22 nt, Human
aaauacuguagauaauagaguu

SEQ ID NO: 368597 - RNA, 20 nt, Human
ccagagcagccacugaaguu

SEQ ID NO: 368598 - RNA, 22 nt, Human
gagugugggcacgggggccuug

SEQ ID NO: 368599 - RNA, 22 nt, Human
agugaaauggaugcugcuacug

SEQ ID NO: 368600 - RNA, 22 nt, Human
uacaguagacaauguuaguaug

SEQ ID NO: 368601 - RNA, 22 nt, Human
ugggaguggggcauagaaggua

SEQ ID NO: 368602 - RNA, 22 nt, Human
ggaggcagaauagagugugggu

SEQ ID NO: 368603 - RNA, 22 nt, Human
uggaagcaucacuucuugccug

SEQ ID NO: 368604 - RNA, 22 nt, Human
agacgagggccuggcacacagu

SEQ ID NO: 368605 - RNA, 22 nt, Human
ugucucugggugauucaguccu

SEQ ID NO: 368606 - RNA, 22 nt, Human
agcccagaggcugggcgugcau

SEQ ID NO: 368607 - RNA, 22 nt, Human
uguguacauaucuauccuagau

SEQ ID NO: 368608 - RNA, 22 nt, Human
gccuaggaguacagaaugguuu

SEQ ID NO: 368609 - RNA, 20 nt, Human
ccuuuauuauuuguaugaug

SEQ ID NO: 368610 - RNA, 22 nt, Human
uccuugaauauaauaacaguag

SEQ ID NO: 368611 - RNA, 22 nt, Human
acugcagccuuugggcucauaa

SEQ ID NO: 368612 - RNA, 22 nt, Human
cucagaagaacccaggguccca

SEQ ID NO: 368613 - RNA, 22 nt, Human
ccugcccagcuucaccucaggc

SEQ ID NO: 368614 - RNA, 22 nt, Human
ccccaggcagggccuaacagag

SEQ ID NO: 368615 - RNA, 22 nt, Human
guauuaggugguggaauuguag

SEQ ID NO: 368616 - RNA, 22 nt, Human
uuccucucgcucuccggggccc

SEQ ID NO: 368617 - RNA, 22 nt, Human
aagcagagcaagcguauuuauu

SEQ ID NO: 368618 - RNA, 22 nt, Human
uuaaagaugcagcuuuagagaa

SEQ ID NO: 368619 - RNA, 22 nt, Human
cucucugaggaaggagcaucug

SEQ ID NO: 368620 - RNA, 22 nt, Human
cagcugaguuuccaagucugcc

SEQ ID NO: 368621 - RNA, 22 nt, Human
ucccagagaagagcuggaugga

SEQ ID NO: 368622 - RNA, 22 nt, Human
uggcugagggggcucugcucag

SEQ ID NO: 368623 - RNA, 22 nt, Human
caaggccaagguuuugugaacu

SEQ ID NO: 368624 - RNA, 22 nt, Human
auuuuuccaugauacuuaucug

SEQ ID NO: 368625 - RNA, 22 nt, Human
gcuggccugcaaagcccggcug

SEQ ID NO: 368626 - RNA, 22 nt, Human
gauaaaauauguggccuuuagu

SEQ ID NO: 368627 - RNA, 22 nt, Human
ucugcaucauuuuucagagccg

SEQ ID NO: 368628 - RNA, 22 nt, Human
ugaaaugagcauuuauucuuua

SEQ ID NO: 368629 - RNA, 22 nt, Human
cagaagucacccucagaauaac

SEQ ID NO: 368630 - RNA, 22 nt, Human
caggccucaggggcucaggcug

SEQ ID NO: 368631 - RNA, 22 nt, Human
gauugaaacauaggcagucgag

SEQ ID NO: 368632 - RNA, 20 nt, Human
cagcccuccaguggaggcag

SEQ ID NO: 368633 - RNA, 22 nt, Human
aaccauuugcaguuacugagac

SEQ ID NO: 368634 - RNA, 19 nt, Human
caggaaugagguaauggcu

SEQ ID NO: 368635 - RNA, 22 nt, Human
ccagcagguguagggcucaugg

SEQ ID NO: 368636 - RNA, 22 nt, Human
agugucauuuuguccaucuucu

SEQ ID NO: 368637 - RNA, 22 nt, Human
aagugacacauggcacuucuau

SEQ ID NO: 368638 - RNA, 22 nt, Human
agagaagggccuguauguaauc

SEQ ID NO: 368639 - RNA, 22 nt, Human
acagcuuuguguuaaugggaag

SEQ ID NO: 368640 - RNA, 22 nt, Human
uuuauuguuaucaugggugagu

SEQ ID NO: 368641 - RNA, 22 nt, Human
acacauauauacauauuugugc

SEQ ID NO: 368642 - RNA, 22 nt, Human
auauucguggucaaguaaggcc

SEQ ID NO: 368643 - RNA, 22 nt, Human
aaaguccuugcaguuuccucuu

SEQ ID NO: 368644 - RNA, 22 nt, Human
gccuucugaucgcuggacugac

SEQ ID NO: 368645 - RNA, 22 nt, Human
ugcccaagcagaggagugauuc

SEQ ID NO: 368646 - RNA, 22 nt, Human
agcauaaaggcacuagaaagag

SEQ ID NO: 368647 - RNA, 22 nt, Human
uggcucagcagguuagaaacua

SEQ ID NO: 368648 - RNA, 17 nt, Human
aaguccagaguugagca

SEQ ID NO: 368649 - RNA, 22 nt, Human
guggccugggguuuguucugag

SEQ ID NO: 368650 - RNA, 22 nt, Human
ccagggcaaaugagaucauagc

SEQ ID NO: 368651 - RNA, 22 nt, Human
uggcccucagucuugcuccugc

SEQ ID NO: 368652 - RNA, 22 nt, Human
uucucucauucaaauuaaagug

SEQ ID NO: 368653 - RNA, 22 nt, Human
cugaggucucuuuccauaguga

SEQ ID NO: 368654 - RNA, 22 nt, Human
aaagcagcagcaccugcauuuc

SEQ ID NO: 368655 - RNA, 22 nt, Human
ggaccugcccuggcucagaugc

SEQ ID NO: 368656 - RNA, 22 nt, Human
cugcagggaccacaagcagguu

SEQ ID NO: 368657 - RNA, 22 nt, Human
cucccuggcacagcgagagguu

SEQ ID NO: 368658 - RNA, 22 nt, Human
auugcacaaacacagucagacu

SEQ ID NO: 368659 - RNA, 23 nt, Human
agaggccaacuucuugccccucc

SEQ ID NO: 368660 - RNA, 22 nt, Human
uaaacaugugagugugcauaua

SEQ ID NO: 368661 - RNA, 22 nt, Human
gcuuccucgcugggcagaggca

SEQ ID NO: 368662 - RNA, 22 nt, Human
cacagggcagaggguccguggc

SEQ ID NO: 368663 - RNA, 22 nt, Human
aagugccugaccuagccuggag

SEQ ID NO: 368664 - RNA, 22 nt, Human
ucacauuuguguuuuauuagag

SEQ ID NO: 368665 - RNA, 22 nt, Human
ggccagcuuugagcugcaggaa

SEQ ID NO: 368666 - RNA, 22 nt, Human
uuuauccagcagcuauucaaaa

SEQ ID NO: 368667 - RNA, 22 nt, Human
ugggccugugaugcugggcuau

SEQ ID NO: 368668 - RNA, 22 nt, Human
uguacacugcaggaugcauugc

SEQ ID NO: 368669 - RNA, 23 nt, Human
cuguggcugaguccuguuggagu

SEQ ID NO: 368670 - RNA, 22 nt, Human
agugcagccgagaucaggugcu

SEQ ID NO: 368671 - RNA, 22 nt, Human
gaagaauccaugcuaauuuacc

SEQ ID NO: 368672 - RNA, 22 nt, Human
cauggggagacaccuagggaaa

SEQ ID NO: 368673 - RNA, 22 nt, Human
gugggccucuugaggguggcua

SEQ ID NO: 368674 - RNA, 20 nt, Human
cccucccagaugcuucccaa

SEQ ID NO: 368675 - RNA, 22 nt, Human
aaggcagccauagcaccaucca

SEQ ID NO: 368676 - RNA, 21 nt, Human
ggccugagcaccuguccaccu

SEQ ID NO: 368677 - RNA, 22 nt, Human
cuuucaaugugccugccuuggg

SEQ ID NO: 368678 - RNA, 22 nt, Human
auacuuuggucacuauuauugg

SEQ ID NO: 368679 - RNA, 20 nt, Human
cugcagggugagugggcgau

SEQ ID NO: 368680 - RNA, 22 nt, Human
ugaggcaggacugagcgggaug

SEQ ID NO: 368681 - RNA, 21 nt, Human
uagcacuucgcuguaauuggg

SEQ ID NO: 368682 - RNA, 22 nt, Human
agugaaauaaagcugccuaugg

SEQ ID NO: 368683 - RNA, 22 nt, Human
gggagcugagcuggaagagaau

SEQ ID NO: 368684 - RNA, 17 nt, Human
agaaagaggauccacag

SEQ ID NO: 368685 - RNA, 22 nt, Human
ugcagucuggauguccucagau

SEQ ID NO: 368686 - RNA, 22 nt, Human
gcuccaggagagggaagcagau

SEQ ID NO: 368687 - RNA, 22 nt, Human
gaggcagcuuggggcugugggu

SEQ ID NO: 368688 - RNA, 22 nt, Human
uggcucagaguucaucuuuuag

SEQ ID NO: 368689 - RNA, 22 nt, Human
ugucucugugagaucugacgau

SEQ ID NO: 368690 - RNA, 21 nt, Human
ggcagcucagcagauggggac

SEQ ID NO: 368691 - RNA, 22 nt, Human
cugccugugcaugcagucagaa

SEQ ID NO: 368692 - RNA, 22 nt, Human
acccugccgugggcugcuugug

SEQ ID NO: 368693 - RNA, 22 nt, Human
gggccugggaacuugcauuuag

SEQ ID NO: 368694 - RNA, 22 nt, Human
ugccaggcauguaguagacuug

SEQ ID NO: 368695 - RNA, 22 nt, Human
aggaugagaagauuggaaucuu

SEQ ID NO: 368696 - RNA, 22 nt, Human
cuggggaggcagggcugccccu

SEQ ID NO: 368697 - RNA, 22 nt, Human
cuucaguucuaaaguagaaugu

SEQ ID NO: 368698 - RNA, 22 nt, Human
ucuuaagcagagaagaaguuga

SEQ ID NO: 368699 - RNA, 22 nt, Human
auguucuguuuuguaauucaua

SEQ ID NO: 368700 - RNA, 21 nt, Human
agagaagaggacuuucucaca

SEQ ID NO: 368701 - RNA, 22 nt, Human
gccugcuggauguggccaggcc

SEQ ID NO: 368702 - RNA, 22 nt, Human
aaucagugguucccagcccagg

SEQ ID NO: 368703 - RNA, 22 nt, Human
ggagucaggagcaggcugggcu

SEQ ID NO: 368704 - RNA, 22 nt, Human
gucaggaugcuauuguuauuaa

SEQ ID NO: 368705 - RNA, 21 nt, Human
gagccuucccucugcccuuuc

SEQ ID NO: 368706 - RNA, 22 nt, Human
aggucauuuccuuagaggcaga

SEQ ID NO: 368707 - RNA, 22 nt, Human
aaaugugugcacaaagacagcu

SEQ ID NO: 368708 - RNA, 22 nt, Human
uucuucaaacaaaaguggcaug

SEQ ID NO: 368709 - RNA, 21 nt, Human
gagcucucaggcaagaagcag

SEQ ID NO: 368710 - RNA, 22 nt, Human
uagucccauuuugagguauuug

SEQ ID NO: 368711 - RNA, 22 nt, Human
caggcacugugcaagggucucg

SEQ ID NO: 368712 - RNA, 22 nt, Human
gcugagcucccagcaguaucug

SEQ ID NO: 368713 - RNA, 22 nt, Human
aagaaaucagaaaagcauucgu

SEQ ID NO: 368714 - RNA, 22 nt, Human
cucucagacugaagggccugug

SEQ ID NO: 368715 - RNA, 22 nt, Human
aaaugugucauauucaaaguca

SEQ ID NO: 368716 - RNA, 20 nt, Human
aauaaacuacugagagaugu

SEQ ID NO: 368717 - RNA, 22 nt, Human
uacaguaucuucuggcaagcau

SEQ ID NO: 368718 - RNA, 22 nt, Human
gggacuguaaauucauauggcc

SEQ ID NO: 368719 - RNA, 22 nt, Human
uuaacaugucuugacuucaucu

SEQ ID NO: 368720 - RNA, 22 nt, Human
ggcugagccuggagcaucuggu

SEQ ID NO: 368721 - RNA, 22 nt, Human
cuucugugcuucacaguugcca

SEQ ID NO: 368722 - RNA, 21 nt, Human
ggcacugagccagauggacuc

SEQ ID NO: 368723 - RNA, 22 nt, Human
accaggaggcuacacuguccca

SEQ ID NO: 368724 - RNA, 22 nt, Human
ugcuggcugggcugcuggagac

SEQ ID NO: 368725 - RNA, 22 nt, Human
ugaacuccaaauacugcugauu

SEQ ID NO: 368726 - RNA, 22 nt, Human
gcaguggggaaugcuggggaga

SEQ ID NO: 368727 - RNA, 22 nt, Human
caggggcuuuuccucuauaagg

SEQ ID NO: 368728 - RNA, 22 nt, Human
gagggcucaacuacuacuaggc

SEQ ID NO: 368729 - RNA, 22 nt, Human
ugcagccaucuuucuuggagga

SEQ ID NO: 368730 - RNA, 22 nt, Human
caggugcugcguggcggagcug

SEQ ID NO: 368731 - RNA, 22 nt, Human
gccagcccagcuccaggggaaa

SEQ ID NO: 368732 - RNA, 22 nt, Human
uuccugaugcacacagucauuu

SEQ ID NO: 368733 - RNA, 22 nt, Human
gcaagcaguuguggcuucugag

SEQ ID NO: 368734 - RNA, 22 nt, Human
ccuggagcucacugggagccgg

SEQ ID NO: 368735 - RNA, 23 nt, Human
gggauauggaccuuggaggaguc

SEQ ID NO: 368736 - RNA, 22 nt, Human
gggcagcuggccagguauucug

SEQ ID NO: 368737 - RNA, 22 nt, Human
gagggagugccagagggccagc

SEQ ID NO: 368738 - RNA, 22 nt, Human
ggcaccuggagguuuacuggau

SEQ ID NO: 368739 - RNA, 22 nt, Human
acagagagggagugauaaaucc

SEQ ID NO: 368740 - RNA, 22 nt, Human
ccucgaccuccccaggcucagg

SEQ ID NO: 368741 - RNA, 22 nt, Human
cagcucugaagaaaggugucua

SEQ ID NO: 368742 - RNA, 21 nt, Human
agcaccuuacagcuauaaugg

SEQ ID NO: 368743 - RNA, 22 nt, Human
gcucagaggagcaucauaagga

SEQ ID NO: 368744 - RNA, 22 nt, Human
gcagccacccucaaggcugaau

SEQ ID NO: 368745 - RNA, 22 nt, Human
gaauuucauugcucugcugugu

SEQ ID NO: 368746 - RNA, 22 nt, Human
gcccuuccuuagacagcaggau

SEQ ID NO: 368747 - RNA, 22 nt, Human
agcccaagcuaugaggugaccu

SEQ ID NO: 368748 - RNA, 22 nt, Human
uggagaauucuauguugagggg

SEQ ID NO: 368749 - RNA, 22 nt, Human
auaaggcaucucucaguuagca

SEQ ID NO: 368750 - RNA, 22 nt, Human
agcagcuccugccaugagugcu

SEQ ID NO: 368751 - RNA, 22 nt, Human
gaaauuuauuaucuacaucauu

SEQ ID NO: 368752 - RNA, 19 nt, Human
uggcugggugccaauggcc

SEQ ID NO: 368753 - RNA, 22 nt, Human
ccaccagcuuugccacccugcu

SEQ ID NO: 368754 - RNA, 21 nt, Human
ccaggguccagcugccauggu

SEQ ID NO: 368755 - RNA, 22 nt, Human
acaaaggcagccaaucaucugc

SEQ ID NO: 368756 - RNA, 22 nt, Human
gcucccaccuccagccugaguu

SEQ ID NO: 368757 - RNA, 22 nt, Human
gccaggcauucuagaaguagug

SEQ ID NO: 368758 - RNA, 22 nt, Human
ggcagccauggacacuggcuag

SEQ ID NO: 368759 - RNA, 23 nt, Human
uggaccugaaccagugccucugu

SEQ ID NO: 368760 - RNA, 22 nt, Human
ccuggcugccgagugugcagcg

SEQ ID NO: 368761 - RNA, 22 nt, Human
ucaaaugcuguauuguaguaau

SEQ ID NO: 368762 - RNA, 22 nt, Human
auaugagaauuggaaaauauca

SEQ ID NO: 368763 - RNA, 22 nt, Human
ucugucuccugccagugccucu

SEQ ID NO: 368764 - RNA, 21 nt, Human
augggcagaggcagagaggcu

SEQ ID NO: 368765 - RNA, 22 nt, Human
cuuugaaagcucccaggacuua

SEQ ID NO: 368766 - RNA, 22 nt, Human
uugauacauagcacaguuuagg

SEQ ID NO: 368767 - RNA, 17 nt, Human
ugcugccaagucccaac

SEQ ID NO: 368768 - RNA, 22 nt, Human
gcagugaaacaauaggaucaaa

SEQ ID NO: 368769 - RNA, 22 nt, Human
ggcuucucucccccagcuccac

SEQ ID NO: 368770 - RNA, 22 nt, Human
ucuggagcgaggucccugucug

SEQ ID NO: 368771 - RNA, 22 nt, Human
gacccagaaggagugcccuaga

SEQ ID NO: 368772 - RNA, 19 nt, Human
agacacacuugauaugugu

SEQ ID NO: 368773 - RNA, 22 nt, Human
caaacugagcaucagaaaguuu

SEQ ID NO: 368774 - RNA, 22 nt, Human
uuauuccauucaguucaacaag

SEQ ID NO: 368775 - RNA, 22 nt, Human
gagacacagagaggcuguguga

SEQ ID NO: 368776 - RNA, 22 nt, Human
uagaaaugcccagauucugcua

SEQ ID NO: 368777 - RNA, 22 nt, Human
ccugggcaggaugggcccggug

SEQ ID NO: 368778 - RNA, 22 nt, Human
augucccaagauacagcuagag

SEQ ID NO: 368779 - RNA, 22 nt, Human
gagcugagccuggguggaccgc

SEQ ID NO: 368780 - RNA, 22 nt, Human
aguggcaggcggagauguagga

SEQ ID NO: 368781 - RNA, 22 nt, Human
gcuggccugggcucaagaccag

SEQ ID NO: 368782 - RNA, 21 nt, Human
aaggaaaagcuuggucucuga

SEQ ID NO: 368783 - RNA, 22 nt, Human
aauauaaugcuguuuuaugcca

SEQ ID NO: 368784 - RNA, 22 nt, Human
cuggagaggccccaagauauuu

SEQ ID NO: 368785 - RNA, 22 nt, Human
agcuggcccucgagagccaauu

SEQ ID NO: 368786 - RNA, 21 nt, Human
ucagagagucacagugaacug

SEQ ID NO: 368787 - RNA, 22 nt, Human
gccuggcaggccuguuggggcu

SEQ ID NO: 368788 - RNA, 22 nt, Human
cccuucccuucugggagaucca

SEQ ID NO: 368789 - RNA, 22 nt, Human
cacugcccagcgucuuaggcac

SEQ ID NO: 368790 - RNA, 22 nt, Human
uuaugacauaugaguacaagua

SEQ ID NO: 368791 - RNA, 22 nt, Human
ucccagagucuucuccuguaau

SEQ ID NO: 368792 - RNA, 22 nt, Human
cucuccuggggagcacacacac

SEQ ID NO: 368793 - RNA, 22 nt, Human
gugccagcucuccccacaucug

SEQ ID NO: 368794 - RNA, 22 nt, Human
aggcugaggcaagaggaucacu

SEQ ID NO: 368795 - RNA, 22 nt, Human
uuuauuccaugugucuaugacc

SEQ ID NO: 368796 - RNA, 22 nt, Human
ggaggccaaagugugggcggcu

SEQ ID NO: 368797 - RNA, 22 nt, Human
uggggcagggaugggaaacuau

SEQ ID NO: 368798 - RNA, 22 nt, Human
gcuggccugggcagccugucgg

SEQ ID NO: 368799 - RNA, 23 nt, Human
gugagucuugccuuugcugugga

SEQ ID NO: 368800 - RNA, 22 nt, Human
ggagaaggaagaaagcuacuau

SEQ ID NO: 368801 - RNA, 21 nt, Human
ccucugcucgggcaugcguuu

SEQ ID NO: 368802 - RNA, 22 nt, Human
auggcagagggauugaacagcu

SEQ ID NO: 368803 - RNA, 22 nt, Human
cgccucagccguggucaucuuc

SEQ ID NO: 368804 - RNA, 22 nt, Human
gcaucuaaacuugcaucauugu

SEQ ID NO: 368805 - RNA, 22 nt, Human
gagcccuccauggagccaggca

SEQ ID NO: 368806 - RNA, 22 nt, Human
uuugcauuccugccugcauuca

SEQ ID NO: 368807 - RNA, 22 nt, Human
caaaagauacuugcaucuaacu

SEQ ID NO: 368808 - RNA, 22 nt, Human
aagcaguguucccagcuggccc

SEQ ID NO: 368809 - RNA, 21 nt, Human
agugaaaugaaguguaugcuc

SEQ ID NO: 368810 - RNA, 22 nt, Human
aggcuccuuguucaucauccau

SEQ ID NO: 368811 - RNA, 22 nt, Human
aguucucaagacaauuaccugu

SEQ ID NO: 368812 - RNA, 22 nt, Human
ucagaacaauugggaaccauua

SEQ ID NO: 368813 - RNA, 22 nt, Human
ucccacugugaauccaaggccu

SEQ ID NO: 368814 - RNA, 22 nt, Human
accugaggcuguuagucuaggu

SEQ ID NO: 368815 - RNA, 21 nt, Human
cccuguguuccacagcagaca

SEQ ID NO: 368816 - RNA, 22 nt, Human
cccugcagggaggauucugaag

SEQ ID NO: 368817 - RNA, 17 nt, Human
uuccuggaagucauucc

SEQ ID NO: 368818 - RNA, 20 nt, Human
uguuccaugacuauuuggau

SEQ ID NO: 368819 - RNA, 22 nt, Human
cacauaaucaccaaguccuuuc

SEQ ID NO: 368820 - RNA, 22 nt, Human
cagcaugacagucugcagcaga

SEQ ID NO: 368821 - RNA, 22 nt, Human
caaugauugcuauuuacauaaa

SEQ ID NO: 368822 - RNA, 22 nt, Human
ucagagugcagggaguagcagc

SEQ ID NO: 368823 - RNA, 22 nt, Human
gcauagucaguaggauucucaa

SEQ ID NO: 368824 - RNA, 22 nt, Human
guuccaaacaagucauaaagua

SEQ ID NO: 368825 - RNA, 22 nt, Human
uacuaaacaucuggcauuaaau

SEQ ID NO: 368826 - RNA, 22 nt, Human
gaaucacgguauucugcacggg

SEQ ID NO: 368827 - RNA, 22 nt, Human
caggaaggcccaccuguccugu

SEQ ID NO: 368828 - RNA, 22 nt, Human
ugaaacacugcgauaaaauccu

SEQ ID NO: 368829 - RNA, 22 nt, Human
uauuuugucuucugcucaucac

SEQ ID NO: 368830 - RNA, 22 nt, Human
ugaaacaaugugaaguugcuga

SEQ ID NO: 368831 - RNA, 22 nt, Human
ggacaggguaaguacuagugug

SEQ ID NO: 368832 - RNA, 22 nt, Human
gccaggcuccccggaucccugg

SEQ ID NO: 368833 - RNA, 22 nt, Human
caugcuuaugauuugcuaagcc

SEQ ID NO: 368834 - RNA, 22 nt, Human
uaaggcacccgugagcugccag

SEQ ID NO: 368835 - RNA, 20 nt, Human
ucucccaggcucagggaaga

SEQ ID NO: 368836 - RNA, 22 nt, Human
acugaaggaaagccuuugcaug

SEQ ID NO: 368837 - RNA, 22 nt, Human
gcugggcuucucaaugcugccu

SEQ ID NO: 368838 - RNA, 22 nt, Human
gcugagugauugauauuuuagu

SEQ ID NO: 368839 - RNA, 21 nt, Human
uggaccuguccuucucgcugu

SEQ ID NO: 368840 - RNA, 19 nt, Human
ugcucaggccaaggagccc

SEQ ID NO: 368841 - RNA, 22 nt, Human
cuucuucauguauugauagucu

SEQ ID NO: 368842 - RNA, 22 nt, Human
uuguuacaucuuauguaagugg

SEQ ID NO: 368843 - RNA, 22 nt, Human
accugccuaucagcugccugcu

SEQ ID NO: 368844 - RNA, 22 nt, Human
uggagacucugcaucugugaca

SEQ ID NO: 368845 - RNA, 22 nt, Human
caccaggcuggagugcagaggu

SEQ ID NO: 368846 - RNA, 22 nt, Human
acucagaaugacugaugcugug

SEQ ID NO: 368847 - RNA, 22 nt, Human
gagaagcaauuuccaacugugc

SEQ ID NO: 368848 - RNA, 22 nt, Human
uccaggcugggcugaagggugc

SEQ ID NO: 368849 - RNA, 20 nt, Human
gucagaggacccuagagcga

SEQ ID NO: 368850 - RNA, 22 nt, Human
uguggccaccagagcugcuauu

SEQ ID NO: 368851 - RNA, 22 nt, Human
gugauuucuaaucaucugaaug

SEQ ID NO: 368852 - RNA, 20 nt, Human
uauuugaaauggccaagugu

SEQ ID NO: 368853 - RNA, 22 nt, Human
gaacaguaucaguagugccagu

SEQ ID NO: 368854 - RNA, 21 nt, Human
uccagaaaagaggucauuagc

SEQ ID NO: 368855 - RNA, 22 nt, Human
uccauacauugaaauaccauuc

SEQ ID NO: 368856 - RNA, 21 nt, Human
ugccagggauuuacagagccu

SEQ ID NO: 368857 - RNA, 22 nt, Human
ggcagagcugcaugagcacuca

SEQ ID NO: 368858 - RNA, 22 nt, Human
cugcccucuagaggaggacuga

SEQ ID NO: 368859 - RNA, 22 nt, Human
caggaugggauguagugggccc

SEQ ID NO: 368860 - RNA, 22 nt, Human
gcaaaggcuucuuuuauucucc

SEQ ID NO: 368861 - RNA, 22 nt, Human
ggcucaggaugagccuucucau

SEQ ID NO: 368862 - RNA, 22 nt, Human
cuggccagcauuuuugcuuuag

SEQ ID NO: 368863 - RNA, 22 nt, Human
cugccucucaggucccugagau

SEQ ID NO: 368864 - RNA, 22 nt, Human
ucagcugaaguggagaagcaga

SEQ ID NO: 368865 - RNA, 22 nt, Human
cuugugcaauugacauugaauc

SEQ ID NO: 368866 - RNA, 20 nt, Human
uuuuccagaaaguaucauug

SEQ ID NO: 368867 - RNA, 22 nt, Human
uaaaauguuugcaagagaccag

SEQ ID NO: 368868 - RNA, 22 nt, Human
cuuugcauacaauuuuuagaaa

SEQ ID NO: 368869 - RNA, 22 nt, Human
guuccuauauagccuuaaggau

SEQ ID NO: 368870 - RNA, 22 nt, Human
ucacaucucccuggaggacaca

SEQ ID NO: 368871 - RNA, 22 nt, Human
uuaugggagcaauuggggaggu

SEQ ID NO: 368872 - RNA, 22 nt, Human
gcugccuggcuuuaguccacuu

SEQ ID NO: 368873 - RNA, 22 nt, Human
ucugaacagaaaagaugcacaa

SEQ ID NO: 368874 - RNA, 22 nt, Human
ugacacaggcagcucccagcac

SEQ ID NO: 368875 - RNA, 22 nt, Human
aaagggagcauggcugcaggga

SEQ ID NO: 368876 - RNA, 22 nt, Human
acugaaggcuuaacucuuucau

SEQ ID NO: 368877 - RNA, 22 nt, Human
ucccaggauuuuaggcucucag

SEQ ID NO: 368878 - RNA, 22 nt, Human
agaagaaacugucggggauauu

SEQ ID NO: 368879 - RNA, 22 nt, Human
uuagccauuaaauuacaaggug

SEQ ID NO: 368880 - RNA, 22 nt, Human
gcugaguguaaugauggcagag

SEQ ID NO: 368881 - RNA, 22 nt, Human
guauagaaacccagaaagauag

SEQ ID NO: 368882 - RNA, 22 nt, Human
gccuccuggauuuuagugccau

SEQ ID NO: 368883 - RNA, 22 nt, Human
acucugagcaucccaagucuua

SEQ ID NO: 368884 - RNA, 22 nt, Human
ucccacacagcccgcucaccgg

SEQ ID NO: 368885 - RNA, 22 nt, Human
ugcagggcaucuuugaagugug

SEQ ID NO: 368886 - RNA, 22 nt, Human
ccaguccagugccaugcauggc

SEQ ID NO: 368887 - RNA, 22 nt, Human
augggaggaagagaagaugucu

SEQ ID NO: 368888 - RNA, 22 nt, Human
caggagaucuuaggaauucuua

SEQ ID NO: 368889 - RNA, 22 nt, Human
aguuuauguagaauuggcaaua

SEQ ID NO: 368890 - RNA, 22 nt, Human
uuguuuuggagaugagcuaaaa

SEQ ID NO: 368891 - RNA, 20 nt, Human
aaaauauguauaacucuucu

SEQ ID NO: 368892 - RNA, 22 nt, Human
caguggaagcuggcugugaaga

SEQ ID NO: 368893 - RNA, 22 nt, Human
ugaggcagugcugggaagccug

SEQ ID NO: 368894 - RNA, 22 nt, Human
cagagagagucaaaucuuugcu

SEQ ID NO: 368895 - RNA, 22 nt, Human
uguaagauauucagcuuauuga

SEQ ID NO: 368896 - RNA, 22 nt, Human
ucuggcaggucaaucauucuuu

SEQ ID NO: 368897 - RNA, 22 nt, Human
acauaucuuucccucuccugaa

SEQ ID NO: 368898 - RNA, 21 nt, Human
ucacaucuauguuaagcaaac

SEQ ID NO: 368899 - RNA, 22 nt, Human
uagcagagcagggaucagagcc

SEQ ID NO: 368900 - RNA, 22 nt, Human
gaagcagcugccagagaugucu

SEQ ID NO: 368901 - RNA, 22 nt, Human
gaggcacaccagggagucuugu

SEQ ID NO: 368902 - RNA, 22 nt, Human
acuggacagaggaaauauggag

SEQ ID NO: 368903 - RNA, 22 nt, Human
agagugaaggccagguuacagu

SEQ ID NO: 368904 - RNA, 22 nt, Human
caggguggggaaauagcgcccu

SEQ ID NO: 368905 - RNA, 22 nt, Human
gcagaggggaagcugaggaauu

SEQ ID NO: 368906 - RNA, 22 nt, Human
caacagaaggaagcagggucag

SEQ ID NO: 368907 - RNA, 22 nt, Human
uuguuucaaauauuucagaaua

SEQ ID NO: 368908 - RNA, 22 nt, Human
uuuccucuuuguaccuugacua

SEQ ID NO: 368909 - RNA, 22 nt, Human
ccaggagaaugggauuacccua

SEQ ID NO: 368910 - RNA, 20 nt, Human
aggagggaccuggauuggcg

SEQ ID NO: 368911 - RNA, 22 nt, Human
agaaaguucacugguauauuuu

SEQ ID NO: 368912 - RNA, 22 nt, Human
ggcagcuuccugagccagcagc

SEQ ID NO: 368913 - RNA, 22 nt, Human
agccacagugcaagagagaaaa

SEQ ID NO: 368914 - RNA, 22 nt, Human
uuucagaaaacuuaucaucagu

SEQ ID NO: 368915 - RNA, 22 nt, Human
auagucacugccuuccauuugu

SEQ ID NO: 368916 - RNA, 22 nt, Human
agaagccauucccuguaggcuc

SEQ ID NO: 368917 - RNA, 22 nt, Human
ccaggagaugggagcaucuaaa

SEQ ID NO: 368918 - RNA, 22 nt, Human
aggggcaggugcugcacuuaga

SEQ ID NO: 368919 - RNA, 22 nt, Human
gggcccacuggcugucugaccc

SEQ ID NO: 368920 - RNA, 22 nt, Human
uccagaggcuccaaagggagau

SEQ ID NO: 368921 - RNA, 22 nt, Human
agaauuuccuaugagagauucc

SEQ ID NO: 368922 - RNA, 22 nt, Human
augaaaauacugugguugauag

SEQ ID NO: 368923 - RNA, 22 nt, Human
ggagaguggauuccagcuguau

SEQ ID NO: 368924 - RNA, 22 nt, Human
agcuucccaagguuggaagguu

SEQ ID NO: 368925 - RNA, 22 nt, Human
guccucugggcuuugagcaguc

SEQ ID NO: 368926 - RNA, 22 nt, Human
auacagaaaaguggauagccag

SEQ ID NO: 368927 - RNA, 22 nt, Human
ucccaggguccucuucuggaau

SEQ ID NO: 368928 - RNA, 22 nt, Human
ucaaaggcauugccaauaagua

SEQ ID NO: 368929 - RNA, 22 nt, Human
ccucugccaccucccacgaggc

SEQ ID NO: 368930 - RNA, 22 nt, Human
cacaggagauugaucuauuggu

SEQ ID NO: 368931 - RNA, 20 nt, Human
cagcugccuggcucugggau

SEQ ID NO: 368932 - RNA, 21 nt, Human
ggagauggguaucgccugggc

SEQ ID NO: 368933 - RNA, 22 nt, Human
ucugaagauuaccagcuaaaug

SEQ ID NO: 368934 - RNA, 22 nt, Human
cuacccaggcuuagagggcugg

SEQ ID NO: 368935 - RNA, 22 nt, Human
caugaaugcuggguucauguaa

SEQ ID NO: 368936 - RNA, 22 nt, Human
ugcucagggacaauggagaggg

SEQ ID NO: 368937 - RNA, 22 nt, Human
aguuauucauuuauucuguaca

SEQ ID NO: 368938 - RNA, 20 nt, Human
acuuucucgguuucucaccu

SEQ ID NO: 368939 - RNA, 22 nt, Human
acagaggaaggcugagcugccc

SEQ ID NO: 368940 - RNA, 22 nt, Human
uauaauuuuaagugguaaauua

SEQ ID NO: 368941 - RNA, 16 nt, Human
uuuccaaagggcagcu

SEQ ID NO: 368942 - RNA, 22 nt, Human
aggcuggaguacaguggcuauu

SEQ ID NO: 368943 - RNA, 22 nt, Human
gcagugaacauaacacagaagg

SEQ ID NO: 368944 - RNA, 22 nt, Human
gagcacccuuugcacaucaguc

SEQ ID NO: 368945 - RNA, 22 nt, Human
aaugggaaagagacuagaugcu

SEQ ID NO: 368946 - RNA, 22 nt, Human
uccuugaaugaauguucucucc

SEQ ID NO: 368947 - RNA, 22 nt, Human
cacacuuugugcuaaucuauuu

SEQ ID NO: 368948 - RNA, 22 nt, Human
accauuuuggguauuuucagag

SEQ ID NO: 368949 - RNA, 23 nt, Human
aaaugcagggucgcagguuacag

SEQ ID NO: 368950 - RNA, 22 nt, Human
cccuggccagcucaugucugag

SEQ ID NO: 368951 - RNA, 22 nt, Human
gggagcuguaagggacagguag

SEQ ID NO: 368952 - RNA, 22 nt, Human
aauuucagaccauuugcaauua

SEQ ID NO: 368953 - RNA, 22 nt, Human
cagauaaaggcuuacuaguagu

SEQ ID NO: 368954 - RNA, 23 nt, Human
aucagucuugguagcugugccca

SEQ ID NO: 368955 - RNA, 22 nt, Human
ucuagaaauuuugccuuguauu

SEQ ID NO: 368956 - RNA, 22 nt, Human
agcauuuaguuaguaaauguuu

SEQ ID NO: 368957 - RNA, 22 nt, Human
uggcagagucaucacaucugga

SEQ ID NO: 368958 - RNA, 22 nt, Human
uccucacaagcaagcacaggua

SEQ ID NO: 368959 - RNA, 22 nt, Human
guggcagcaaaugccuggacua

SEQ ID NO: 368960 - RNA, 22 nt, Human
uggcugaggucuggggcuucug

SEQ ID NO: 368961 - RNA, 22 nt, Human
gagagucuagugcaccuaguuu

SEQ ID NO: 368962 - RNA, 22 nt, Human
caggcugcagugcaguggcuau

SEQ ID NO: 368963 - RNA, 22 nt, Human
caggcacugugcugagcucugc

SEQ ID NO: 368964 - RNA, 23 nt, Human
agucucagcuggaaacauguguc

SEQ ID NO: 368965 - RNA, 22 nt, Human
ugucuuuucuacuguaagcaua

SEQ ID NO: 368966 - RNA, 22 nt, Human
ccagagcagauguggccuuggu

SEQ ID NO: 368967 - RNA, 19 nt, Human
gggcuuggggcugaagccu

SEQ ID NO: 368968 - RNA, 22 nt, Human
ucuucacauggaacaugaagcu

SEQ ID NO: 368969 - RNA, 22 nt, Human
ccuccagggcagacggggagca

SEQ ID NO: 368970 - RNA, 19 nt, Human
uccuucagucagaucuggg

SEQ ID NO: 368971 - RNA, 22 nt, Human
uggccuccccuaacagccucuu

SEQ ID NO: 368972 - RNA, 22 nt, Human
agaaaucagaacccugaaguuc

SEQ ID NO: 368973 - RNA, 22 nt, Human
uguuuaagcugaugagguaucg

SEQ ID NO: 368974 - RNA, 22 nt, Human
ucaggcugagaaaaucuggacc

SEQ ID NO: 368975 - RNA, 22 nt, Human
cugcccugagucaugccagaug

SEQ ID NO: 368976 - RNA, 22 nt, Human
accaaggagaaggugcaagcuu

SEQ ID NO: 368977 - RNA, 22 nt, Human
cagauccacccuuguagugaca

SEQ ID NO: 368978 - RNA, 22 nt, Human
aggguggggugcuacaucuuua

SEQ ID NO: 368979 - RNA, 22 nt, Human
aacagacagaaaaaugugaucu

SEQ ID NO: 368980 - RNA, 22 nt, Human
gaauacaagccugccaccugga

SEQ ID NO: 368981 - RNA, 22 nt, Human
ggagugaguacuggaguagcug

SEQ ID NO: 368982 - RNA, 20 nt, Human
cucucuggaaggugggagcc

SEQ ID NO: 368983 - RNA, 22 nt, Human
ccugugucuuccccacuggugu

SEQ ID NO: 368984 - RNA, 22 nt, Human
agcagagccagaauuggaccag

SEQ ID NO: 368985 - RNA, 22 nt, Human
caugagaaguggccuucaaaaa

SEQ ID NO: 368986 - RNA, 22 nt, Human
aagcagcuuuugaagagugagg

SEQ ID NO: 368987 - RNA, 22 nt, Human
ggcauuuagagggcuuuucuga

SEQ ID NO: 368988 - RNA, 22 nt, Human
ccugcccagcuucccgagugca

SEQ ID NO: 368989 - RNA, 21 nt, Human
cagcaaaucauugggcagacu

SEQ ID NO: 368990 - RNA, 22 nt, Human
gccugggaacucugaucuccug

SEQ ID NO: 368991 - RNA, 22 nt, Human
ucccacucccaggcaggccucu

SEQ ID NO: 368992 - RNA, 22 nt, Human
cacugaaggcuaggauuagaug

SEQ ID NO: 368993 - RNA, 22 nt, Human
ucuguggauuuuaguguucaug

SEQ ID NO: 368994 - RNA, 22 nt, Human
uaugaaaagguggccaauguag

SEQ ID NO: 368995 - RNA, 22 nt, Human
gcuccagaugaaaggccagagg

SEQ ID NO: 368996 - RNA, 22 nt, Human
cugguacaaaaugcugauauca

SEQ ID NO: 368997 - RNA, 22 nt, Human
cuggcagcagcuucuggaucga

SEQ ID NO: 368998 - RNA, 22 nt, Human
uuuaggcauugaauuagaauag

SEQ ID NO: 368999 - RNA, 22 nt, Human
agggcaguucagccacaggcuc

SEQ ID NO: 369000 - RNA, 22 nt, Human
agggcaguguggugggacugac

SEQ ID NO: 369001 - RNA, 22 nt, Human
ggucccaggagaauaggugcaa

SEQ ID NO: 369002 - RNA, 22 nt, Human
aacaugcucuguuucuuggaug

SEQ ID NO: 369003 - RNA, 22 nt, Human
ucagguguuagaagaaauuuca

SEQ ID NO: 369004 - RNA, 22 nt, Human
cagcaugguggagcugcucuuu

SEQ ID NO: 369005 - RNA, 22 nt, Human
cccaggaauuggaggcugcagu

SEQ ID NO: 369006 - RNA, 19 nt, Human
accaggccucagaggcccu

SEQ ID NO: 369007 - RNA, 22 nt, Human
uagcugucaccagaaauggcca

SEQ ID NO: 369008 - RNA, 22 nt, Human
ccaaaguccauaguuuacauaa

SEQ ID NO: 369009 - RNA, 18 nt, Human
aauuuccauaugaauugc

SEQ ID NO: 369010 - RNA, 22 nt, Human
guuauguauugggaaauccaag

SEQ ID NO: 369011 - RNA, 22 nt, Human
aaagaaucuauauaucaccacc

SEQ ID NO: 369012 - RNA, 22 nt, Human
uaagacauuugaaaugugaucc

SEQ ID NO: 369013 - RNA, 20 nt, Human
cuuuggcaaugagaacaggg

SEQ ID NO: 369014 - RNA, 22 nt, Human
cucugugagggucuguacagaa

SEQ ID NO: 369015 - RNA, 22 nt, Human
cucuaacaccacagugugguuu

SEQ ID NO: 369016 - RNA, 22 nt, Human
acaggacauguaccaggugguc

SEQ ID NO: 369017 - RNA, 22 nt, Human
cauugcacuuuggguccaggac

SEQ ID NO: 369018 - RNA, 22 nt, Human
guuucaaauagguuucagcaaa

SEQ ID NO: 369019 - RNA, 22 nt, Human
gucuugaucuccugaccuugug

SEQ ID NO: 369020 - RNA, 19 nt, Human
ugcuuccucaccaucuccc

SEQ ID NO: 369021 - RNA, 22 nt, Human
cucagggcuugaguguccagga

SEQ ID NO: 369022 - RNA, 22 nt, Human
guggcagcugguaugcagacag

SEQ ID NO: 369023 - RNA, 22 nt, Human
cagagagaggccacugcuauua

SEQ ID NO: 369024 - RNA, 22 nt, Human
cccuggaggcggagcuugcagu

SEQ ID NO: 369025 - RNA, 22 nt, Human
gggcguggauggucagugcagg

SEQ ID NO: 369026 - RNA, 17 nt, Human
cacaggugugguuugag

SEQ ID NO: 369027 - RNA, 22 nt, Human
gcagcugauggaaguccuauug

SEQ ID NO: 369028 - RNA, 22 nt, Human
ugcuuuauucaggguuuacccc

SEQ ID NO: 369029 - RNA, 22 nt, Human
ugacucuguaccugucugccuu

SEQ ID NO: 369030 - RNA, 22 nt, Human
gagggcugaugcuuacuuauuu

SEQ ID NO: 369031 - RNA, 22 nt, Human
ccagagaggccaaggucguggu

SEQ ID NO: 369032 - RNA, 21 nt, Human
uuugaaagcuacaucuauagc

SEQ ID NO: 369033 - RNA, 22 nt, Human
agggaagcccuggcugagaccc

SEQ ID NO: 369034 - RNA, 22 nt, Human
ugugaauagugccgcaauaaac

SEQ ID NO: 369035 - RNA, 22 nt, Human
guuagggaagcgcuguguucuu

SEQ ID NO: 369036 - RNA, 22 nt, Human
auuuaugauuagccuauuguug

SEQ ID NO: 369037 - RNA, 22 nt, Human
uggcacugggaugcuacuguua

SEQ ID NO: 369038 - RNA, 22 nt, Human
gggcagcugccaagugcaucgc

SEQ ID NO: 369039 - RNA, 22 nt, Human
agugugaccuuauuuggaaaca

SEQ ID NO: 369040 - RNA, 22 nt, Human
gaauuucaacaguccucaaaug

SEQ ID NO: 369041 - RNA, 20 nt, Human
gcuguugccaguacagaugg

SEQ ID NO: 369042 - RNA, 22 nt, Human
gcucagaggcacgaccucuugg

SEQ ID NO: 369043 - RNA, 22 nt, Human
ugcagugccucggcagugcagc

SEQ ID NO: 369044 - RNA, 22 nt, Human
cuggaguuagaguagacacuga

SEQ ID NO: 369045 - RNA, 22 nt, Human
agacccagaaagcagcugcauu

SEQ ID NO: 369046 - RNA, 22 nt, Human
guuuucaaggggauuuaacuga

SEQ ID NO: 369047 - RNA, 22 nt, Human
acagcuggcaggggggcaugaa

SEQ ID NO: 369048 - RNA, 22 nt, Human
agucccagacuccaguuuucug

SEQ ID NO: 369049 - RNA, 22 nt, Human
uucuauacaaagauuucucaca

SEQ ID NO: 369050 - RNA, 22 nt, Human
gcuggcagacugggggcagaac

SEQ ID NO: 369051 - RNA, 22 nt, Human
aguucuagaagacuuuuccauu

SEQ ID NO: 369052 - RNA, 22 nt, Human
ugugcuucagguugucgccacg

SEQ ID NO: 369053 - RNA, 22 nt, Human
caacugugaauuuuaugauacc

SEQ ID NO: 369054 - RNA, 22 nt, Human
auauucuugugauuauaaagua

SEQ ID NO: 369055 - RNA, 19 nt, Human
ggaggccuggguauuugcc

SEQ ID NO: 369056 - RNA, 22 nt, Human
uuugaacaagagcuucacauua

SEQ ID NO: 369057 - RNA, 22 nt, Human
caagggcuucaaguggccaaga

SEQ ID NO: 369058 - RNA, 22 nt, Human
aaugggaagucacuacuguuac

SEQ ID NO: 369059 - RNA, 22 nt, Human
gacuucuauuaauaccucuacu

SEQ ID NO: 369060 - RNA, 22 nt, Human
gccuccccugcaauuguccuug

SEQ ID NO: 369061 - RNA, 22 nt, Human
uaugagcuuccaguguugcaug

SEQ ID NO: 369062 - RNA, 22 nt, Human
ugggcccaagagagucuccaac

SEQ ID NO: 369063 - RNA, 19 nt, Human
ugggcagguucaguaaugg

SEQ ID NO: 369064 - RNA, 22 nt, Human
cagcagcagccccaggaagguu

SEQ ID NO: 369065 - RNA, 22 nt, Human
cugagggcccugaagcuuggca

SEQ ID NO: 369066 - RNA, 22 nt, Human
auggcaggcccagguguucauu

SEQ ID NO: 369067 - RNA, 21 nt, Human
ugaggcaggggugcuuuuguc

SEQ ID NO: 369068 - RNA, 19 nt, Human
ccugugacuaucuuuguaa

SEQ ID NO: 369069 - RNA, 22 nt, Human
ugggccuggacaaggccacuag

SEQ ID NO: 369070 - RNA, 22 nt, Human
cugggcugugguguggcccaaa

SEQ ID NO: 369071 - RNA, 22 nt, Human
ugucacaguuuguacuuuauag

SEQ ID NO: 369072 - RNA, 22 nt, Human
agccccaguaagggagggccug

SEQ ID NO: 369073 - RNA, 22 nt, Human
accaugggucagccaccucagc

SEQ ID NO: 369074 - RNA, 18 nt, Human
gagucuuuguuacugcug

SEQ ID NO: 369075 - RNA, 22 nt, Human
uuuuugaaggcugaugugauua

SEQ ID NO: 369076 - RNA, 22 nt, Human
agucccagaucuacaggaggga

SEQ ID NO: 369077 - RNA, 22 nt, Human
auggggagagaagggcugagcu

SEQ ID NO: 369078 - RNA, 22 nt, Human
gaggcuggaauauuagaaaugu

SEQ ID NO: 369079 - RNA, 22 nt, Human
auuaucuauguagaaugauuuu

SEQ ID NO: 369080 - RNA, 21 nt, Human
uccaaaaaggagcguccuucu

SEQ ID NO: 369081 - RNA, 22 nt, Human
ggguccagcuacaucagggugg

SEQ ID NO: 369082 - RNA, 19 nt, Human
agcuggagauuggagggca

SEQ ID NO: 369083 - RNA, 22 nt, Human
uccagccaagccuugguagcug

SEQ ID NO: 369084 - RNA, 22 nt, Human
agaaaugcucuuccugaccaga

SEQ ID NO: 369085 - RNA, 22 nt, Human
cuguccuaugaguacucacuag

SEQ ID NO: 369086 - RNA, 22 nt, Human
gaugggaggaaccugggucccu

SEQ ID NO: 369087 - RNA, 22 nt, Human
uucaaaggcaggauagcagcug

SEQ ID NO: 369088 - RNA, 19 nt, Human
cugagcagcggcagcacuu

SEQ ID NO: 369089 - RNA, 22 nt, Human
uucauuaauucauucagugacu

SEQ ID NO: 369090 - RNA, 22 nt, Human
gcaaggcagcgcggaguagcua

SEQ ID NO: 369091 - RNA, 23 nt, Human
gaguguucauagcaggcucuugc

SEQ ID NO: 369092 - RNA, 23 nt, Human
agaauuccaguuucuuaugucac

SEQ ID NO: 369093 - RNA, 22 nt, Human
gugggcuggacccuccugcucc

SEQ ID NO: 369094 - RNA, 22 nt, Human
ucccaaggccaggcaucuagaa

SEQ ID NO: 369095 - RNA, 22 nt, Human
uuuguuuagaaagagauuggug

SEQ ID NO: 369096 - RNA, 22 nt, Human
gaggggcagagguagagaacaa

SEQ ID NO: 369097 - RNA, 22 nt, Human
aaguccuuuauccuaaaagguc

SEQ ID NO: 369098 - RNA, 22 nt, Human
caccagcagaagacugagggug

SEQ ID NO: 369099 - RNA, 22 nt, Human
uuucacaaucaaauggugaaau

SEQ ID NO: 369100 - RNA, 22 nt, Human
cauacuuugggauaagagugga

SEQ ID NO: 369101 - RNA, 22 nt, Human
ugggcugagcacugaggaagga

SEQ ID NO: 369102 - RNA, 22 nt, Human
cuccaggagggggauggcugua

SEQ ID NO: 369103 - RNA, 22 nt, Human
uugaaaggugcugugugcugau

SEQ ID NO: 369104 - RNA, 22 nt, Human
ugccuggcaaugccagaagcca

SEQ ID NO: 369105 - RNA, 20 nt, Human
gcagcugaaaguaugacacc

SEQ ID NO: 369106 - RNA, 22 nt, Human
ucagggcagccuaaggcaccuc

SEQ ID NO: 369107 - RNA, 20 nt, Human
caccaggcgcucugagaaca

SEQ ID NO: 369108 - RNA, 22 nt, Human
uaggcaggcugaauguagauuu

SEQ ID NO: 369109 - RNA, 22 nt, Human
gguuucaaugagaagugcuugu

SEQ ID NO: 369110 - RNA, 22 nt, Human
agcagggcucacauuaguggau

SEQ ID NO: 369111 - RNA, 22 nt, Human
gacugccagaaugugaggccug

SEQ ID NO: 369112 - RNA, 22 nt, Human
cagcaggcugcgauugcucauu

SEQ ID NO: 369113 - RNA, 22 nt, Human
caauuucagaccuuuccuugga

SEQ ID NO: 369114 - RNA, 22 nt, Human
aauauuguuucaagaucacaga

SEQ ID NO: 369115 - RNA, 22 nt, Human
ggaagaggcugaggccaugcug

SEQ ID NO: 369116 - RNA, 22 nt, Human
ggcuuucuagaucuagcucugu

SEQ ID NO: 369117 - RNA, 17 nt, Human
caagagagaugacugga

SEQ ID NO: 369118 - RNA, 22 nt, Human
ugucuuuagaaagaagcagaca

SEQ ID NO: 369119 - RNA, 20 nt, Human
cuucuucauuaacccuacug

SEQ ID NO: 369120 - RNA, 22 nt, Human
cuggccuuuuguuucuggagaa

SEQ ID NO: 369121 - RNA, 22 nt, Human
ggucucagcaguugcuuugacu

SEQ ID NO: 369122 - RNA, 19 nt, Human
gcugugccucucuccugcu

SEQ ID NO: 369123 - RNA, 22 nt, Human
gcucccagucugauggaggaga

SEQ ID NO: 369124 - RNA, 22 nt, Human
ugccucuguugagccuuggcug

SEQ ID NO: 369125 - RNA, 22 nt, Human
auggaaaggcuguggaaacuua

SEQ ID NO: 369126 - RNA, 22 nt, Human
aggcagcuggacauaacuaacc

SEQ ID NO: 369127 - RNA, 22 nt, Human
guucucucugcuuccaagaugg

SEQ ID NO: 369128 - RNA, 22 nt, Human
ucccaggaucugagggcagaga

SEQ ID NO: 369129 - RNA, 22 nt, Human
gucugaggaagaugcaggggga

SEQ ID NO: 369130 - RNA, 22 nt, Human
gggcaggucugggucagccuga

SEQ ID NO: 369131 - RNA, 18 nt, Human
gaaaugugauucuagggc

SEQ ID NO: 369132 - RNA, 22 nt, Human
uggccugaggcucggcaugggu

SEQ ID NO: 369133 - RNA, 22 nt, Human
agcuuaggaggaugaugaacau

SEQ ID NO: 369134 - RNA, 22 nt, Human
gccagcugcuggaacagcgcga

SEQ ID NO: 369135 - RNA, 22 nt, Human
aaucagaaauugagggucuggu

SEQ ID NO: 369136 - RNA, 22 nt, Human
auugaaaauaaggccagaaaca

SEQ ID NO: 369137 - RNA, 22 nt, Human
gcacccagagggcagggucucc

SEQ ID NO: 369138 - RNA, 22 nt, Human
caguacuucuuggaaacuggau

SEQ ID NO: 369139 - RNA, 22 nt, Human
agaggaaguaaucaggaccugc

SEQ ID NO: 369140 - RNA, 22 nt, Human
ugaagaaucagauuggccugcg

SEQ ID NO: 369141 - RNA, 22 nt, Human
ucagggcauguauguuucuuua

SEQ ID NO: 369142 - RNA, 23 nt, Human
uucuucucaauuaguugauucag

SEQ ID NO: 369143 - RNA, 17 nt, Human
gcugagugcagggaguc

SEQ ID NO: 369144 - RNA, 22 nt, Human
ccccaggagcuuguuuuagaga

SEQ ID NO: 369145 - RNA, 20 nt, Human
acaaaugcauucugugacau

SEQ ID NO: 369146 - RNA, 22 nt, Human
aaucuggcucagaagaagauga

SEQ ID NO: 369147 - RNA, 22 nt, Human
ggagcagacauaaccuuacaga

SEQ ID NO: 369148 - RNA, 22 nt, Human
uuuauacauggagaauuuuugc

SEQ ID NO: 369149 - RNA, 22 nt, Human
acacacagguaaaggagccugg

SEQ ID NO: 369150 - RNA, 22 nt, Human
augauucagcaauuuuauaucu

SEQ ID NO: 369151 - RNA, 22 nt, Human
uggaaauguauuugggcaugcc

SEQ ID NO: 369152 - RNA, 22 nt, Human
ggcugugaacccuggcagugug

SEQ ID NO: 369153 - RNA, 22 nt, Human
aggaccuguaccucagcaucua

SEQ ID NO: 369154 - RNA, 22 nt, Human
agugccuggaccccaugacaua

SEQ ID NO: 369155 - RNA, 22 nt, Human
agcccagcaaagggagguucag

SEQ ID NO: 369156 - RNA, 22 nt, Human
agggcagccucucagccuaggu

SEQ ID NO: 369157 - RNA, 22 nt, Human
ugcugccuuagcagccaggcaa

SEQ ID NO: 369158 - RNA, 22 nt, Human
aaggucauggcaaauuacuuuu

SEQ ID NO: 369159 - RNA, 22 nt, Human
cuggcagcgguuugcagccugg

SEQ ID NO: 369160 - RNA, 22 nt, Human
uggaaagcgaggaguuggcauu

SEQ ID NO: 369161 - RNA, 22 nt, Human
caauguguguguuuuucucaac

SEQ ID NO: 369162 - RNA, 22 nt, Human
gcuggccauggccugcgccauc

SEQ ID NO: 369163 - RNA, 22 nt, Human
uggaggaaguggacaguugugu

SEQ ID NO: 369164 - RNA, 22 nt, Human
gaguuguucaacgugugugaaa

SEQ ID NO: 369165 - RNA, 22 nt, Human
ucuggccuuaucuguccaagcc

SEQ ID NO: 369166 - RNA, 22 nt, Human
ucucccuggagcccugaagcau

SEQ ID NO: 369167 - RNA, 22 nt, Human
aagggccauaacuugcaguguu

SEQ ID NO: 369168 - RNA, 22 nt, Human
ucauggcacuuagcacaguccu

SEQ ID NO: 369169 - RNA, 22 nt, Human
ccagcuggagcucgcagauagg

SEQ ID NO: 369170 - RNA, 22 nt, Human
uaaggucauggugaauaauaag

SEQ ID NO: 369171 - RNA, 22 nt, Human
cugcugagguccuugcucagac

SEQ ID NO: 369172 - RNA, 22 nt, Human
uacagaguggugagaucuuuug

SEQ ID NO: 369173 - RNA, 22 nt, Human
uuccucagccaaggcugggauc

SEQ ID NO: 369174 - RNA, 22 nt, Human
auggggcucugcggcugcuccc

SEQ ID NO: 369175 - RNA, 22 nt, Human
gccuaggaguggggauggcggu

SEQ ID NO: 369176 - RNA, 22 nt, Human
ccugggagggcaagugcugaug

SEQ ID NO: 369177 - RNA, 22 nt, Human
uccagaccuagggcaccccagu

SEQ ID NO: 369178 - RNA, 22 nt, Human
cuccuuccugccccagugauaa

SEQ ID NO: 369179 - RNA, 22 nt, Human
ugaaaaaacaaguuggcccauu

SEQ ID NO: 369180 - RNA, 22 nt, Human
agggagacacaugaggaaguca

SEQ ID NO: 369181 - RNA, 22 nt, Human
agggaguguaaauggugcucag

SEQ ID NO: 369182 - RNA, 22 nt, Human
agcaucuggcagaaagucagaa

SEQ ID NO: 369183 - RNA, 22 nt, Human
cuauuauuagauaaucuacuug

SEQ ID NO: 369184 - RNA, 22 nt, Human
uacuuucuagcucuccccaguu

SEQ ID NO: 369185 - RNA, 22 nt, Human
cccaggaacuccagagcuccuc

SEQ ID NO: 369186 - RNA, 22 nt, Human
cuguggaccugcucuuagagac

SEQ ID NO: 369187 - RNA, 22 nt, Human
cugcccugagggccuguguguu

SEQ ID NO: 369188 - RNA, 22 nt, Human
auacuguuuugugacuuaucuu

SEQ ID NO: 369189 - RNA, 22 nt, Human
gagugagggcagcaggggcugc

SEQ ID NO: 369190 - RNA, 22 nt, Human
guccagggcuaaaucagguucc

SEQ ID NO: 369191 - RNA, 22 nt, Human
auuauuagauucuuaauuguaa

SEQ ID NO: 369192 - RNA, 22 nt, Human
aaucaagucaaccaucaugugc

SEQ ID NO: 369193 - RNA, 22 nt, Human
cuggaagguuccucccagcucc

SEQ ID NO: 369194 - RNA, 22 nt, Human
gaggugggaugugugugcuacu

SEQ ID NO: 369195 - RNA, 19 nt, Human
cagugcccgacgcaggucu

SEQ ID NO: 369196 - RNA, 22 nt, Human
uggcuuaagcgcaacucugucu

SEQ ID NO: 369197 - RNA, 22 nt, Human
caggagcaugcugaugccagaa

SEQ ID NO: 369198 - RNA, 22 nt, Human
acaggcacugucaagucaugaa

SEQ ID NO: 369199 - RNA, 22 nt, Human
aggcugagagcaacgugucaga

SEQ ID NO: 369200 - RNA, 22 nt, Human
gggcaguagcuucguaggcauc

SEQ ID NO: 369201 - RNA, 22 nt, Human
gcacacacaugugaguacaugc

SEQ ID NO: 369202 - RNA, 22 nt, Human
aagcugccugccacgcuagaua

SEQ ID NO: 369203 - RNA, 22 nt, Human
gaggccagaagugccucgggcu

SEQ ID NO: 369204 - RNA, 22 nt, Human
gaagaaggugccagaggcuuac

SEQ ID NO: 369205 - RNA, 22 nt, Human
ugggcucugugccagguuggug

SEQ ID NO: 369206 - RNA, 22 nt, Human
guagaaauagugguugacagga

SEQ ID NO: 369207 - RNA, 22 nt, Human
aaagcagagguugcagugagcu

SEQ ID NO: 369208 - RNA, 22 nt, Human
aucagaaaggugggcaagcaga

SEQ ID NO: 369209 - RNA, 22 nt, Human
uggcucagcauucacuggucuu

SEQ ID NO: 369210 - RNA, 22 nt, Human
aacacagcuaauuucugucaau

SEQ ID NO: 369211 - RNA, 22 nt, Human
cuggcucauccagguguugcuc

SEQ ID NO: 369212 - RNA, 22 nt, Human
caguguuuaaucauugugaauu

SEQ ID NO: 369213 - RNA, 22 nt, Human
caaaugauacuguuuuuagucu

SEQ ID NO: 369214 - RNA, 22 nt, Human
augcaguaaauguucuaguuug

SEQ ID NO: 369215 - RNA, 22 nt, Human
ucagaauuagagcucuucuuga

SEQ ID NO: 369216 - RNA, 22 nt, Human
acaguccuuguguggaacauua

SEQ ID NO: 369217 - RNA, 22 nt, Human
ugggccugauucuugaauccug

SEQ ID NO: 369218 - RNA, 22 nt, Human
ccauccuaucugaccuacuugu

SEQ ID NO: 369219 - RNA, 22 nt, Human
gcccaggauggcuggaggugcu

SEQ ID NO: 369220 - RNA, 22 nt, Human
ucuucagagugaaagucuguga

SEQ ID NO: 369221 - RNA, 22 nt, Human
ugaaauagucuaaaaaaccaga

SEQ ID NO: 369222 - RNA, 22 nt, Human
uccaguggcacuggagacuaga

SEQ ID NO: 369223 - RNA, 22 nt, Human
uuauuuaaaagugguaagauuc

SEQ ID NO: 369224 - RNA, 22 nt, Human
uccaggagacacaagguacaua

SEQ ID NO: 369225 - RNA, 22 nt, Human
aguuugaaaguauugacagaag

SEQ ID NO: 369226 - RNA, 22 nt, Human
uguucuuucaguuagacacagu

SEQ ID NO: 369227 - RNA, 22 nt, Human
cuggcuggucaucagcaguacg

SEQ ID NO: 369228 - RNA, 22 nt, Human
cuccuucccuucaaguguuccu

SEQ ID NO: 369229 - RNA, 22 nt, Human
uguggaaaagaauaagggagau

SEQ ID NO: 369230 - RNA, 22 nt, Human
aggauccuguauggagaagcug

SEQ ID NO: 369231 - RNA, 22 nt, Human
aggagggaccuaggaauauugc

SEQ ID NO: 369232 - RNA, 22 nt, Human
uuuuugcugauaagcagaauuc

SEQ ID NO: 369233 - RNA, 22 nt, Human
gcugcccugucugcagcaggac

SEQ ID NO: 369234 - RNA, 22 nt, Human
ugcaauaaggaguaauaguaaa

SEQ ID NO: 369235 - RNA, 22 nt, Human
gugcucuggcuggucucccggu

SEQ ID NO: 369236 - RNA, 22 nt, Human
gauggggaugagaagugagcag

SEQ ID NO: 369237 - RNA, 20 nt, Human
ccugucuccucuuaccuggc

SEQ ID NO: 369238 - RNA, 22 nt, Human
cagcaggaaaaucaauucugug

SEQ ID NO: 369239 - RNA, 22 nt, Human
gaugcaggauagcuucacccag

SEQ ID NO: 369240 - RNA, 22 nt, Human
uccuuuccaugcuucuagaggc

SEQ ID NO: 369241 - RNA, 19 nt, Human
cagcugcaccgugaccauc

SEQ ID NO: 369242 - RNA, 18 nt, Human
cagaggagagacauucag

SEQ ID NO: 369243 - RNA, 23 nt, Human
gggaccugguaggaggugauugg

SEQ ID NO: 369244 - RNA, 22 nt, Human
gucuuguuugggauguggaugg

SEQ ID NO: 369245 - RNA, 22 nt, Human
gacaauacagaaagggacaugc

SEQ ID NO: 369246 - RNA, 22 nt, Human
acagagcuuaggaugacuccca

SEQ ID NO: 369247 - RNA, 22 nt, Human
gucaggaugacaagugcuuuca

SEQ ID NO: 369248 - RNA, 22 nt, Human
uuucuuguaagauguuuauuaa

SEQ ID NO: 369249 - RNA, 22 nt, Human
gcacacagauuaggaaacagaa

SEQ ID NO: 369250 - RNA, 22 nt, Human
gccaggcagauaugugagcuua

SEQ ID NO: 369251 - RNA, 22 nt, Human
gccaggcaugggcuucugggcg

SEQ ID NO: 369252 - RNA, 21 nt, Human
gcaggcuggucaaaccucagu

SEQ ID NO: 369253 - RNA, 22 nt, Human
aaaguguugauaugugacaucc

SEQ ID NO: 369254 - RNA, 22 nt, Human
caggaaugacugcagauggggc

SEQ ID NO: 369255 - RNA, 22 nt, Human
aggcugucucaccucaggaggg

SEQ ID NO: 369256 - RNA, 22 nt, Human
uugcagagccaugaggcuggcu

SEQ ID NO: 369257 - RNA, 22 nt, Human
gcacagaacagagaaauagcca

SEQ ID NO: 369258 - RNA, 22 nt, Human
gggauuugugggauggccagug

SEQ ID NO: 369259 - RNA, 22 nt, Human
guccucugcuucaugcccugau

SEQ ID NO: 369260 - RNA, 22 nt, Human
ucagcuuuuuacaugugaaaua

SEQ ID NO: 369261 - RNA, 22 nt, Human
uccuggauaucaaacaaacauu

SEQ ID NO: 369262 - RNA, 22 nt, Human
auugaaagauaggcuacugugg

SEQ ID NO: 369263 - RNA, 22 nt, Human
aaguuaugaaauuuggacagcu

SEQ ID NO: 369264 - RNA, 18 nt, Human
aaugcacacauuuacucc

SEQ ID NO: 369265 - RNA, 22 nt, Human
uuuauuuggcauccagggagaa

SEQ ID NO: 369266 - RNA, 22 nt, Human
aaguggagagcccuggaggucu

SEQ ID NO: 369267 - RNA, 22 nt, Human
ugaagccagucaauguuaaguu

SEQ ID NO: 369268 - RNA, 22 nt, Human
gggaguguugagcgcccugcca

SEQ ID NO: 369269 - RNA, 22 nt, Human
ccagcuuuccugcgaguugauu

SEQ ID NO: 369270 - RNA, 22 nt, Human
gugugcagugagcaaaagaucu

SEQ ID NO: 369271 - RNA, 22 nt, Human
uuucaggguacauggagcaaau

SEQ ID NO: 369272 - RNA, 22 nt, Human
gcugugcuggaaggggaccugc

SEQ ID NO: 369273 - RNA, 22 nt, Human
ccagagccuaagaucugauccu

SEQ ID NO: 369274 - RNA, 22 nt, Human
cuuaaauucuuaaugcccucau

SEQ ID NO: 369275 - RNA, 22 nt, Human
uguguguauaugcauuuaucua

SEQ ID NO: 369276 - RNA, 22 nt, Human
aggacuucuccgauaagucaga

SEQ ID NO: 369277 - RNA, 22 nt, Human
ugaaagcucugucaucauuccu

SEQ ID NO: 369278 - RNA, 19 nt, Human
auacagauguauccaugau

SEQ ID NO: 369279 - RNA, 22 nt, Human
cugcagggaacugaggcccaga

SEQ ID NO: 369280 - RNA, 22 nt, Human
uagaaaugcaguguacuguguc

SEQ ID NO: 369281 - RNA, 22 nt, Human
uguggccuccccacuucugggg

SEQ ID NO: 369282 - RNA, 22 nt, Human
gcugccaccguggagaugagug

SEQ ID NO: 369283 - RNA, 22 nt, Human
ggcaggcagaggcugagacagg

SEQ ID NO: 369284 - RNA, 22 nt, Human
aucaggauuauuaaaucuggau

SEQ ID NO: 369285 - RNA, 22 nt, Human
ugugaugguucacugggcauga

SEQ ID NO: 369286 - RNA, 22 nt, Human
gcugugcagccaagugccucug

SEQ ID NO: 369287 - RNA, 22 nt, Human
acucaagauagggaaaguacaa

SEQ ID NO: 369288 - RNA, 22 nt, Human
uugcauuuccuguacuguuuga

SEQ ID NO: 369289 - RNA, 22 nt, Human
auacaguauuaccuguucagga

SEQ ID NO: 369290 - RNA, 22 nt, Human
ggcagcagaacuggcccuguau

SEQ ID NO: 369291 - RNA, 22 nt, Human
aaaaguauuggccaccauuucu

SEQ ID NO: 369292 - RNA, 22 nt, Human
gugcugcagagucucgugccgc

SEQ ID NO: 369293 - RNA, 22 nt, Human
cccaggaguuagagguuguggu

SEQ ID NO: 369294 - RNA, 22 nt, Human
uuuuuaagagauucuccagucu

SEQ ID NO: 369295 - RNA, 22 nt, Human
aggcaggcaaccaccugggaag

SEQ ID NO: 369296 - RNA, 21 nt, Human
gcucucugcaugguggcucag

SEQ ID NO: 369297 - RNA, 20 nt, Human
agugccagggcaggugagag

SEQ ID NO: 369298 - RNA, 22 nt, Human
agugaaauacugucguuuuuag

SEQ ID NO: 369299 - RNA, 19 nt, Human
ggccuggauuuagggcucc

SEQ ID NO: 369300 - RNA, 22 nt, Human
cauugcacgggcgucugucugu

SEQ ID NO: 369301 - RNA, 22 nt, Human
ccagagaggccuuggcaagaca

SEQ ID NO: 369302 - RNA, 22 nt, Human
aguguguguuugggcgguuuau

SEQ ID NO: 369303 - RNA, 22 nt, Human
agccagcuguucuggggcagca

SEQ ID NO: 369304 - RNA, 22 nt, Human
accaggagaggcacuugcaaug

SEQ ID NO: 369305 - RNA, 22 nt, Human
aaauaaguaguuuaguguugug

SEQ ID NO: 369306 - RNA, 22 nt, Human
uggcauuugggcuggcuuuucu

SEQ ID NO: 369307 - RNA, 18 nt, Human
ccuggcuuccaucuuggu

SEQ ID NO: 369308 - RNA, 22 nt, Human
uagaaauaaaucugcagcuggg

SEQ ID NO: 369309 - RNA, 22 nt, Human
aaagcucuuuuccaaguauuga

SEQ ID NO: 369310 - RNA, 22 nt, Human
cagagccuuccuagcagacucu

SEQ ID NO: 369311 - RNA, 22 nt, Human
ccaagggaaaccgagaggcugg

SEQ ID NO: 369312 - RNA, 22 nt, Human
agugcuuucccugaaaccuucc

SEQ ID NO: 369313 - RNA, 19 nt, Human
auaaggcagugacuuuuuu

SEQ ID NO: 369314 - RNA, 22 nt, Human
agggccucuaccauccaagguu

SEQ ID NO: 369315 - RNA, 22 nt, Human
aaaugucuuucaauagagaaau

SEQ ID NO: 369316 - RNA, 22 nt, Human
guuaggcaaauaacuguggagc

SEQ ID NO: 369317 - RNA, 22 nt, Human
auuauuaggugcucucugacaa

SEQ ID NO: 369318 - RNA, 21 nt, Human
uguaaguuucaucugaauugg

SEQ ID NO: 369319 - RNA, 22 nt, Human
uggcagcuagcuguuuucaugc

SEQ ID NO: 369320 - RNA, 22 nt, Human
cagucccaaggaggaagcaguc

SEQ ID NO: 369321 - RNA, 22 nt, Human
cauggcaggugcagauucugug

SEQ ID NO: 369322 - RNA, 20 nt, Human
uuucugugagaaacacuguu

SEQ ID NO: 369323 - RNA, 22 nt, Human
ucacuucacacccacuaucaug

SEQ ID NO: 369324 - RNA, 22 nt, Human
auggagacgcaagggaccuagg

SEQ ID NO: 369325 - RNA, 22 nt, Human
acugccauuggucaaaugagug

SEQ ID NO: 369326 - RNA, 22 nt, Human
agacccugcaccucucgugggc

SEQ ID NO: 369327 - RNA, 22 nt, Human
aagcccagaugugagaacugag

SEQ ID NO: 369328 - RNA, 22 nt, Human
uuccuaauggcaaaacauguuu

SEQ ID NO: 369329 - RNA, 22 nt, Human
auuuccaguccuaaugaucugg

SEQ ID NO: 369330 - RNA, 22 nt, Human
agcugcccuggcggagcugcuc

SEQ ID NO: 369331 - RNA, 22 nt, Human
agggaccugucaaugacaguua

SEQ ID NO: 369332 - RNA, 18 nt, Human
aaacuggcuuggccugug

SEQ ID NO: 369333 - RNA, 22 nt, Human
caggcugaucagggcugggaug

SEQ ID NO: 369334 - RNA, 22 nt, Human
ccacagagacaggguccuugcu

SEQ ID NO: 369335 - RNA, 22 nt, Human
uaauuucagugcaagcucacgg

SEQ ID NO: 369336 - RNA, 22 nt, Human
acauagcuuaaaugagaagaua

SEQ ID NO: 369337 - RNA, 22 nt, Human
gaggagagagggacugucugca

SEQ ID NO: 369338 - RNA, 17 nt, Human
gcugacccuggagaagu

SEQ ID NO: 369339 - RNA, 22 nt, Human
uguauuuaagcuuuaccuaaaa

SEQ ID NO: 369340 - RNA, 22 nt, Human
agagccaggaaguggcgugggg

SEQ ID NO: 369341 - RNA, 22 nt, Human
gcagagccaggagagacccuug

SEQ ID NO: 369342 - RNA, 22 nt, Human
caguaaauuugagggaucuaau

SEQ ID NO: 369343 - RNA, 22 nt, Human
aaauaauugaguuggucaauau

SEQ ID NO: 369344 - RNA, 22 nt, Human
ugcagccaccaccucugcugaa

SEQ ID NO: 369345 - RNA, 22 nt, Human
uggcugccuagugucugagcag

SEQ ID NO: 369346 - RNA, 22 nt, Human
ucagucuucccuccagugcaac

SEQ ID NO: 369347 - RNA, 22 nt, Human
gggccuggggugacguaccccu

SEQ ID NO: 369348 - RNA, 22 nt, Human
aagcgccaugguuccugcgcag

SEQ ID NO: 369349 - RNA, 22 nt, Human
uuucaaguguccugauuaaugg

SEQ ID NO: 369350 - RNA, 22 nt, Human
cagggccacccucugcugggug

SEQ ID NO: 369351 - RNA, 22 nt, Human
gaggaaaauggaguguaauuaa

SEQ ID NO: 369352 - RNA, 22 nt, Human
cacugcaguuccccagugcgca

SEQ ID NO: 369353 - RNA, 22 nt, Human
uggcucuggcgugaagcccaga

SEQ ID NO: 369354 - RNA, 22 nt, Human
ucaggaucggccuuuuuuuaag

SEQ ID NO: 369355 - RNA, 22 nt, Human
cagggagcuggcuggcgugagu

SEQ ID NO: 369356 - RNA, 22 nt, Human
uugggcugaacccugcagcuga

SEQ ID NO: 369357 - RNA, 22 nt, Human
gccaggcagccacccucugcga

SEQ ID NO: 369358 - RNA, 22 nt, Human
acuuggcaaguaucuauaaagu

SEQ ID NO: 369359 - RNA, 22 nt, Human
ccugagaggcccucucacuguc

SEQ ID NO: 369360 - RNA, 22 nt, Human
gaggcuggcagaaaagcacagg

SEQ ID NO: 369361 - RNA, 22 nt, Human
uagcagcucugauucugggccc

SEQ ID NO: 369362 - RNA, 17 nt, Human
cccagagaugcugccuu

SEQ ID NO: 369363 - RNA, 22 nt, Human
gggcacuggaaggcucucaggc

SEQ ID NO: 369364 - RNA, 22 nt, Human
uccagggcuuggcugggacggu

SEQ ID NO: 369365 - RNA, 22 nt, Human
agcagcaucugguucugaugug

SEQ ID NO: 369366 - RNA, 18 nt, Human
gggcacuggggacuggag

SEQ ID NO: 369367 - RNA, 22 nt, Human
ccagccacagcuuccagcuccu

SEQ ID NO: 369368 - RNA, 22 nt, Human
cuucucucccuggcacucagac

SEQ ID NO: 369369 - RNA, 22 nt, Human
uccugugccuccaccugcuccg

SEQ ID NO: 369370 - RNA, 22 nt, Human
cccuggguucuggcugggcugc

SEQ ID NO: 369371 - RNA, 22 nt, Human
aaaucuaggcucauccuggucc

SEQ ID NO: 369372 - RNA, 22 nt, Human
agccaggcucaaggccugcucc

SEQ ID NO: 369373 - RNA, 22 nt, Human
ccagggcauccucacaucgcag

SEQ ID NO: 369374 - RNA, 22 nt, Human
gcagagcuguuaauggagcuga

SEQ ID NO: 369375 - RNA, 22 nt, Human
gggccuccggggugagcugugg

SEQ ID NO: 369376 - RNA, 22 nt, Human
gccagguggcugagcagcugca

SEQ ID NO: 369377 - RNA, 22 nt, Human
ggacagagcccugguggccuaa

SEQ ID NO: 369378 - RNA, 22 nt, Human
ucuuacauauagcaugaguaca

SEQ ID NO: 369379 - RNA, 22 nt, Human
cagcaucuaaucuucaugccgg

SEQ ID NO: 369380 - RNA, 22 nt, Human
ucagaggaauaaugcugcauuu

SEQ ID NO: 369381 - RNA, 19 nt, Human
gaaaggcugcugcuaccug

SEQ ID NO: 369382 - RNA, 22 nt, Human
cuggggcuggugaggcaggcuc

SEQ ID NO: 369383 - RNA, 22 nt, Human
ucugcucuaguugcuuccugcc

SEQ ID NO: 369384 - RNA, 22 nt, Human
cauggcagaaaccugagcugcu

SEQ ID NO: 369385 - RNA, 21 nt, Human
guggcccugccgcagugucca

SEQ ID NO: 369386 - RNA, 22 nt, Human
aaaacuaaauacgcuuugccuc

SEQ ID NO: 369387 - RNA, 22 nt, Human
ucuggcucuguguccccaccca

SEQ ID NO: 369388 - RNA, 22 nt, Human
agcuguggggcaggcagcgagg

SEQ ID NO: 369389 - RNA, 22 nt, Human
ucucucugccaacucacagcca

SEQ ID NO: 369390 - RNA, 22 nt, Human
auuaaaagcuucccaagaguua

SEQ ID NO: 369391 - RNA, 22 nt, Human
agaccacagucaggcuccuggu

SEQ ID NO: 369392 - RNA, 18 nt, Human
cacaggcucccagugagg

SEQ ID NO: 369393 - RNA, 22 nt, Human
ccaggguguagggauuccagau

SEQ ID NO: 369394 - RNA, 22 nt, Human
gcucccaccaggcagaccuacc

SEQ ID NO: 369395 - RNA, 22 nt, Human
auaugugugccauuucagcagu

SEQ ID NO: 369396 - RNA, 19 nt, Human
agagaaggauccuaugguu

SEQ ID NO: 369397 - RNA, 20 nt, Human
ugaaaaggucaggagacaug

SEQ ID NO: 369398 - RNA, 22 nt, Human
agccaagcaccacuggcacucg

SEQ ID NO: 369399 - RNA, 22 nt, Human
gcagagaggauauuauugucca

SEQ ID NO: 369400 - RNA, 22 nt, Human
ucucagagauuuauggaaaacu

SEQ ID NO: 369401 - RNA, 22 nt, Human
agucauauguggcauuuucuaa

SEQ ID NO: 369402 - RNA, 22 nt, Human
ucucugauguauaucagagaac

SEQ ID NO: 369403 - RNA, 22 nt, Human
uaccugcacagccagccaugug

SEQ ID NO: 369404 - RNA, 21 nt, Human
uggcucaguugcugggcacag

SEQ ID NO: 369405 - RNA, 22 nt, Human
gggcccagcgugguuccaucug

SEQ ID NO: 369406 - RNA, 22 nt, Human
cccaccaguacagaugguagau

SEQ ID NO: 369407 - RNA, 22 nt, Human
gcagaagcugggcagcgaggug

SEQ ID NO: 369408 - RNA, 21 nt, Human
ccuggcuucagggugcacugg

SEQ ID NO: 369409 - RNA, 22 nt, Human
ggcaugggguguauguggcacg

SEQ ID NO: 369410 - RNA, 22 nt, Human
uccaggcaguuuuccagguugu

SEQ ID NO: 369411 - RNA, 22 nt, Human
agugugugcaugcauucgugca

SEQ ID NO: 369412 - RNA, 22 nt, Human
auucagcaaugagcuuggauuu

SEQ ID NO: 369413 - RNA, 22 nt, Human
ccugucugaaggcagggggaug

SEQ ID NO: 369414 - RNA, 22 nt, Human
ccuggagauuucuucaagcuuu

SEQ ID NO: 369415 - RNA, 22 nt, Human
aacaaauguguuuuguaauuaa

SEQ ID NO: 369416 - RNA, 22 nt, Human
ugggccuguugggguugaguua

SEQ ID NO: 369417 - RNA, 22 nt, Human
ccagcuccuucugucuguggag

SEQ ID NO: 369418 - RNA, 22 nt, Human
ucagggacauuuagacacugau

SEQ ID NO: 369419 - RNA, 22 nt, Human
uacuauaccauguaagauauga

SEQ ID NO: 369420 - RNA, 22 nt, Human
uacccagggcuuuucugaugca

SEQ ID NO: 369421 - RNA, 22 nt, Human
caucacagauguuguguggagu

SEQ ID NO: 369422 - RNA, 22 nt, Human
uucuucaugcuguugcugcuug

SEQ ID NO: 369423 - RNA, 22 nt, Human
uuccauaaugagauucccagcc

SEQ ID NO: 369424 - RNA, 22 nt, Human
gcaguggauggccagcaggggc

SEQ ID NO: 369425 - RNA, 22 nt, Human
cuuauaguaugauguugagaau

SEQ ID NO: 369426 - RNA, 22 nt, Human
aauuaacaaauguagcugugau

SEQ ID NO: 369427 - RNA, 22 nt, Human
uaugaagauauaucugaucucu

SEQ ID NO: 369428 - RNA, 22 nt, Human
ggacagaggguugacagaguau

SEQ ID NO: 369429 - RNA, 22 nt, Human
uugaaucucuugaaucucuguu

SEQ ID NO: 369430 - RNA, 21 nt, Human
uccaggaguggcugggcaggg

SEQ ID NO: 369431 - RNA, 22 nt, Human
uuuucauugagcaccugaguaa

SEQ ID NO: 369432 - RNA, 22 nt, Human
aggcuuuaauuaucuacaggag

SEQ ID NO: 369433 - RNA, 22 nt, Human
uuucaguuuccagcuuugucau

SEQ ID NO: 369434 - RNA, 22 nt, Human
aggcacugagaggcuguguugc

SEQ ID NO: 369435 - RNA, 22 nt, Human
cccaggagaugcacuccauugg

SEQ ID NO: 369436 - RNA, 20 nt, Human
uccucagaagacauuugggg

SEQ ID NO: 369437 - RNA, 22 nt, Human
uaaggcagaaauaugagcaggg

SEQ ID NO: 369438 - RNA, 18 nt, Human
aggcccuggccucgaaca

SEQ ID NO: 369439 - RNA, 22 nt, Human
aacaugcuuugauaaauaaaag

SEQ ID NO: 369440 - RNA, 22 nt, Human
cagcuuugcaggcuggucagug

SEQ ID NO: 369441 - RNA, 17 nt, Human
gcgcagcuccuggcgcg

SEQ ID NO: 369442 - RNA, 22 nt, Human
gccugccuuugugaggaagcgg

SEQ ID NO: 369443 - RNA, 22 nt, Human
ccagggugagaaaaggcuggau

SEQ ID NO: 369444 - RNA, 19 nt, Human
agacagagacugaaauaga

SEQ ID NO: 369445 - RNA, 22 nt, Human
gucacuguuuccuauuauauuu

SEQ ID NO: 369446 - RNA, 22 nt, Human
auuaauuuuaccuuuguaaaca

SEQ ID NO: 369447 - RNA, 22 nt, Human
aggcuccuugcucacaggcuca

SEQ ID NO: 369448 - RNA, 22 nt, Human
aggcacuguacuagguacaggg

SEQ ID NO: 369449 - RNA, 22 nt, Human
uugccuugauucuucucaugug

SEQ ID NO: 369450 - RNA, 22 nt, Human
guugaaagagcauggacuugaa

SEQ ID NO: 369451 - RNA, 22 nt, Human
gaggcugcugagagcccuguuu

SEQ ID NO: 369452 - RNA, 22 nt, Human
gucccagaugucuggaacuccc

SEQ ID NO: 369453 - RNA, 22 nt, Human
caguccuugcucugggaugaug

SEQ ID NO: 369454 - RNA, 22 nt, Human
cugggcacacagugacucugca

SEQ ID NO: 369455 - RNA, 22 nt, Human
acaagagacaagagguucuucu

SEQ ID NO: 369456 - RNA, 22 nt, Human
agccaggcggggcagguuuccu

SEQ ID NO: 369457 - RNA, 22 nt, Human
ccucacagggccaggccccuca

SEQ ID NO: 369458 - RNA, 19 nt, Human
gcucagagggcccugugcu

SEQ ID NO: 369459 - RNA, 21 nt, Human
agaggcaggcauuaaguacac

SEQ ID NO: 369460 - RNA, 22 nt, Human
caguagcaggcacucagcacgu

SEQ ID NO: 369461 - RNA, 22 nt, Human
uacauacacaaauauacuguuu

SEQ ID NO: 369462 - RNA, 22 nt, Human
gcaguucuacuuauccauagac

SEQ ID NO: 369463 - RNA, 22 nt, Human
uggcucagcuuacuuuugaggg

SEQ ID NO: 369464 - RNA, 22 nt, Human
ccaaggcaggggaucaaaguuu

SEQ ID NO: 369465 - RNA, 22 nt, Human
guaaaguucuauuugaauuuag

SEQ ID NO: 369466 - RNA, 22 nt, Human
uuuagaguugaguauucauugg

SEQ ID NO: 369467 - RNA, 22 nt, Human
aagccacuauggugauucucaa

SEQ ID NO: 369468 - RNA, 22 nt, Human
cagagcagggguuucccagguu

SEQ ID NO: 369469 - RNA, 22 nt, Human
gcaccuggacagugacccuagc

SEQ ID NO: 369470 - RNA, 22 nt, Human
gggugggccacugagcagcgug

SEQ ID NO: 369471 - RNA, 19 nt, Human
cuuuucaucaacagccaau

SEQ ID NO: 369472 - RNA, 22 nt, Human
gaucauuuugaugcccuuuuag

SEQ ID NO: 369473 - RNA, 22 nt, Human
gauccuugcaacucugugaggu

SEQ ID NO: 369474 - RNA, 22 nt, Human
cugccuugaggagguuguggga

SEQ ID NO: 369475 - RNA, 22 nt, Human
auagaauagcauagaaaauuga

SEQ ID NO: 369476 - RNA, 22 nt, Human
cuguccuguggaccugaggacg

SEQ ID NO: 369477 - RNA, 22 nt, Human
uuauuaggaaaaggucagaugu

SEQ ID NO: 369478 - RNA, 22 nt, Human
uggacagguugaguaggaggag

SEQ ID NO: 369479 - RNA, 22 nt, Human
ggugaggcagguggcugcugag

SEQ ID NO: 369480 - RNA, 20 nt, Human
auuuggcaugaaguauugau

SEQ ID NO: 369481 - RNA, 22 nt, Human
gcugccuguguggccacucacu

SEQ ID NO: 369482 - RNA, 22 nt, Human
ugaguagcggcuauguguaacu

SEQ ID NO: 369483 - RNA, 20 nt, Human
ccagacagcaccugccuggu

SEQ ID NO: 369484 - RNA, 22 nt, Human
agaaaaggcuugaagagguuuu

SEQ ID NO: 369485 - RNA, 22 nt, Human
cucagaagaacaaaggcucuac

SEQ ID NO: 369486 - RNA, 22 nt, Human
uggccucugugggagcugagca

SEQ ID NO: 369487 - RNA, 18 nt, Human
acauacauucugucugca

SEQ ID NO: 369488 - RNA, 22 nt, Human
aaucacaauuacuuuugcacca

SEQ ID NO: 369489 - RNA, 20 nt, Human
cugaacacagaauaagcaca

SEQ ID NO: 369490 - RNA, 22 nt, Human
uccugggccuguacuccauccg

SEQ ID NO: 369491 - RNA, 18 nt, Human
gagaggagccagaauuuu

SEQ ID NO: 369492 - RNA, 22 nt, Human
agauggggcagaauggagccau

SEQ ID NO: 369493 - RNA, 21 nt, Human
auucagaguaauucaucuuua

SEQ ID NO: 369494 - RNA, 19 nt, Human
uccauaaugaagauagagg

SEQ ID NO: 369495 - RNA, 22 nt, Human
agcaguggcuggauggugugcu

SEQ ID NO: 369496 - RNA, 15 nt, Human
aaucuggcggcaagu

SEQ ID NO: 369497 - RNA, 22 nt, Human
acaguacauaauccugagucug

SEQ ID NO: 369498 - RNA, 22 nt, Human
gcucaagagagaugcaguucuu

SEQ ID NO: 369499 - RNA, 22 nt, Human
gcccucagcuccuggacacaug

SEQ ID NO: 369500 - RNA, 22 nt, Human
aaggcagcaugaaucccuguac

SEQ ID NO: 369501 - RNA, 22 nt, Human
ucugagaggauuccugucccga

SEQ ID NO: 369502 - RNA, 22 nt, Human
cucagagcaaugaacaugcaaa

SEQ ID NO: 369503 - RNA, 22 nt, Human
agggaagaaaauccaucgcugc

SEQ ID NO: 369504 - RNA, 22 nt, Human
agcagcaggagccgugggguga

SEQ ID NO: 369505 - RNA, 22 nt, Human
cagaggcauauaauugcugggg

SEQ ID NO: 369506 - RNA, 21 nt, Human
gcagaugggagucaucaggcu

SEQ ID NO: 369507 - RNA, 22 nt, Human
ucuucacaccgggcagcaggaa

SEQ ID NO: 369508 - RNA, 22 nt, Human
uaagaaguacaaaaauuuucug

SEQ ID NO: 369509 - RNA, 22 nt, Human
cuucugggcauucagcugcaca

SEQ ID NO: 369510 - RNA, 22 nt, Human
agagugucugguagcugcucug

SEQ ID NO: 369511 - RNA, 19 nt, Human
uucauucuuucuacuuacc

SEQ ID NO: 369512 - RNA, 23 nt, Human
ucacagggcacuggcugggguug

SEQ ID NO: 369513 - RNA, 22 nt, Human
cuggggugucucgucugccauu

SEQ ID NO: 369514 - RNA, 22 nt, Human
cccuuccuugugacuggugggg

SEQ ID NO: 369515 - RNA, 22 nt, Human
cugacuguaauucuguucuuaa

SEQ ID NO: 369516 - RNA, 17 nt, Human
cugcuuugugcaacgcu

SEQ ID NO: 369517 - RNA, 22 nt, Human
cagaggauucccuagugaccug

SEQ ID NO: 369518 - RNA, 22 nt, Human
cacacaugucucuccaugcucu

SEQ ID NO: 369519 - RNA, 22 nt, Human
cauccacuagaaugacagaguu

SEQ ID NO: 369520 - RNA, 22 nt, Human
ucacuguauuugcugaugcaua

SEQ ID NO: 369521 - RNA, 22 nt, Human
gauggcagguaguggucucauc

SEQ ID NO: 369522 - RNA, 22 nt, Human
cugagcugcggcaggcaccugg

SEQ ID NO: 369523 - RNA, 22 nt, Human
gagaggugaaggcugcccuggg

SEQ ID NO: 369524 - RNA, 20 nt, Human
uucacagaggacucagguca

SEQ ID NO: 369525 - RNA, 22 nt, Human
gcagcaaucuucacagugucau

SEQ ID NO: 369526 - RNA, 22 nt, Human
agggcagccaugagccuucagg

SEQ ID NO: 369527 - RNA, 22 nt, Human
uaagaacagugucugucucaca

SEQ ID NO: 369528 - RNA, 22 nt, Human
ccugaagggacuccagagagca

SEQ ID NO: 369529 - RNA, 22 nt, Human
uguggcucucaugcacucccag

SEQ ID NO: 369530 - RNA, 22 nt, Human
cugucaccuguucacugcagca

SEQ ID NO: 369531 - RNA, 22 nt, Human
gcagagaguugggcugcgccag

SEQ ID NO: 369532 - RNA, 22 nt, Human
acaggcucuggggcaggauggc

SEQ ID NO: 369533 - RNA, 22 nt, Human
agcuucuugggcuuuacacaaa

SEQ ID NO: 369534 - RNA, 22 nt, Human
gcagcuuuaaucugaauaagua

SEQ ID NO: 369535 - RNA, 22 nt, Human
ugcucuucggggccacugcuug

SEQ ID NO: 369536 - RNA, 22 nt, Human
cccaggagguggagguugcagc

SEQ ID NO: 369537 - RNA, 22 nt, Human
uacaggaggauuaucaaaggau

SEQ ID NO: 369538 - RNA, 22 nt, Human
acaacuuuguagcaauuccacg

SEQ ID NO: 369539 - RNA, 22 nt, Human
ucuguucauacagaguauagua

SEQ ID NO: 369540 - RNA, 16 nt, Human
gcacacacaucaauga

SEQ ID NO: 369541 - RNA, 22 nt, Human
gggcugugcugaguaggaggug

SEQ ID NO: 369542 - RNA, 22 nt, Human
augggagugacagggccacugg

SEQ ID NO: 369543 - RNA, 22 nt, Human
aagggcugggucugguuaaccc

SEQ ID NO: 369544 - RNA, 22 nt, Human
acagcaagccagcuugucacug

SEQ ID NO: 369545 - RNA, 22 nt, Human
uuuugaauaauucagaaacagc

SEQ ID NO: 369546 - RNA, 22 nt, Human
cugccucuggccucaggcccag

SEQ ID NO: 369547 - RNA, 22 nt, Human
uggcucuguuuguuaacuagac

SEQ ID NO: 369548 - RNA, 23 nt, Human
ugguucuaggccuauaauuauau

SEQ ID NO: 369549 - RNA, 22 nt, Human
caagaacaguuugccaaauugg

SEQ ID NO: 369550 - RNA, 22 nt, Human
uucagagacagcaaccaggaca

SEQ ID NO: 369551 - RNA, 22 nt, Human
aggcucugaucagguggcugug

SEQ ID NO: 369552 - RNA, 22 nt, Human
ggagaccagaaggaagcuucga

SEQ ID NO: 369553 - RNA, 22 nt, Human
ugaccugcguaggugguuucug

SEQ ID NO: 369554 - RNA, 22 nt, Human
caggagagauaugaguccccac

SEQ ID NO: 369555 - RNA, 22 nt, Human
aggcaggugcuuaugacuugcu

SEQ ID NO: 369556 - RNA, 22 nt, Human
uaucuugagagacaacacagca

SEQ ID NO: 369557 - RNA, 22 nt, Human
uaacagaaguuguucauugugg

SEQ ID NO: 369558 - RNA, 22 nt, Human
ggcucaggccuguaauccuagc

SEQ ID NO: 369559 - RNA, 22 nt, Human
gagguagccacagauagagacu

SEQ ID NO: 369560 - RNA, 22 nt, Human
uuacagaaaauguguuuuaacu

SEQ ID NO: 369561 - RNA, 21 nt, Human
ucagaacaauuccaugccucc

SEQ ID NO: 369562 - RNA, 22 nt, Human
ucagggacuuacaaaccagaag

SEQ ID NO: 369563 - RNA, 22 nt, Human
uggcucugucaaacugcacaca

SEQ ID NO: 369564 - RNA, 22 nt, Human
auuaauuuuucugacagccaca

SEQ ID NO: 369565 - RNA, 22 nt, Human
gccaggcugacucccccggccu

SEQ ID NO: 369566 - RNA, 22 nt, Human
cugcugugcaacauugcaccua

SEQ ID NO: 369567 - RNA, 19 nt, Human
uguuuuguuaaagcagucc

SEQ ID NO: 369568 - RNA, 22 nt, Human
cccagcagggucucugugucua

SEQ ID NO: 369569 - RNA, 22 nt, Human
cuucaagaagacagcagagcau

SEQ ID NO: 369570 - RNA, 20 nt, Human
ugugcaggagagugaggcug

SEQ ID NO: 369571 - RNA, 22 nt, Human
uuucucaguuacuagcuguggu

SEQ ID NO: 369572 - RNA, 22 nt, Human
guuucauuuacaucuguaggua

SEQ ID NO: 369573 - RNA, 22 nt, Human
ggaggacaggggcugcagcaca

SEQ ID NO: 369574 - RNA, 22 nt, Human
gaggcugaauggccagaagcca

SEQ ID NO: 369575 - RNA, 22 nt, Human
cacaucagggcugcuugggggu

SEQ ID NO: 369576 - RNA, 22 nt, Human
ugcagggcagcuagggagcuuu

SEQ ID NO: 369577 - RNA, 22 nt, Human
gcugucacaaauauuucucagc

SEQ ID NO: 369578 - RNA, 22 nt, Human
uguccauggauagagcugcucg

SEQ ID NO: 369579 - RNA, 20 nt, Human
cccaggagcugugccccauc

SEQ ID NO: 369580 - RNA, 22 nt, Human
cugagauggaguuuugcucuug

SEQ ID NO: 369581 - RNA, 22 nt, Human
gagccuucaucgcagccuuguu

SEQ ID NO: 369582 - RNA, 22 nt, Human
uucaaacaaaacuguucccaua

SEQ ID NO: 369583 - RNA, 22 nt, Human
gacagggcgcccagccuguuuc

SEQ ID NO: 369584 - RNA, 22 nt, Human
ccacagggucagccacucugca

SEQ ID NO: 369585 - RNA, 22 nt, Human
ucacaggagggagagacaccca

SEQ ID NO: 369586 - RNA, 22 nt, Human
auaauucaugggccuuucaccu

SEQ ID NO: 369587 - RNA, 22 nt, Human
aggacccagaggcagaggacgu

SEQ ID NO: 369588 - RNA, 22 nt, Human
cuuugaauuccaguacaauaac

SEQ ID NO: 369589 - RNA, 22 nt, Human
ggcuccagggaguggagagaag

SEQ ID NO: 369590 - RNA, 23 nt, Human
augcaguauaugucaguaguuua

SEQ ID NO: 369591 - RNA, 22 nt, Human
aucuucucaagcagcauccugu

SEQ ID NO: 369592 - RNA, 22 nt, Human
aaaugcagauuuugaugcagca

SEQ ID NO: 369593 - RNA, 22 nt, Human
uggaggaaucagggcuuaggcu

SEQ ID NO: 369594 - RNA, 22 nt, Human
ucauacauaacuuguacaguga

SEQ ID NO: 369595 - RNA, 22 nt, Human
uuggcagugaugcagcuuguuc

SEQ ID NO: 369596 - RNA, 22 nt, Human
gggagaaggaggacugugcugu

SEQ ID NO: 369597 - RNA, 22 nt, Human
cagggcugaagaaauucaaaag

SEQ ID NO: 369598 - RNA, 22 nt, Human
uaaaucuccuguuuuucaucua

SEQ ID NO: 369599 - RNA, 22 nt, Human
cggcagagugugugcgugcaug

SEQ ID NO: 369600 - RNA, 22 nt, Human
aaaugguauuuacucuguauua

SEQ ID NO: 369601 - RNA, 17 nt, Human
cccugccaccaggaagc

SEQ ID NO: 369602 - RNA, 22 nt, Human
cagcaaaauuugaggauugccu

SEQ ID NO: 369603 - RNA, 20 nt, Human
ggcugcugugggcagagagg

SEQ ID NO: 369604 - RNA, 22 nt, Human
cugggagucaccaggagcaagg

SEQ ID NO: 369605 - RNA, 22 nt, Human
auugaaaggcaaaguaggaagc

SEQ ID NO: 369606 - RNA, 22 nt, Human
agugcagugguuaggagccagg

SEQ ID NO: 369607 - RNA, 22 nt, Human
aggaggccgcugaugggcuccc

SEQ ID NO: 369608 - RNA, 22 nt, Human
agaaaucugacugcugugcaca

SEQ ID NO: 369609 - RNA, 22 nt, Human
uuucaaacauaucuucauuacu

SEQ ID NO: 369610 - RNA, 22 nt, Human
uucuacaugguugcucagaggg

SEQ ID NO: 369611 - RNA, 22 nt, Human
uucauucccaagaguaaacaua

SEQ ID NO: 369612 - RNA, 22 nt, Human
uaagaauuguguugaauagagu

SEQ ID NO: 369613 - RNA, 22 nt, Human
cugucugucaaguucaucucca

SEQ ID NO: 369614 - RNA, 22 nt, Human
augguuuaaagaguaugacuuu

SEQ ID NO: 369615 - RNA, 22 nt, Human
agcagccagagucugaacauua

SEQ ID NO: 369616 - RNA, 22 nt, Human
aagcuguucucuaaguuucaug

SEQ ID NO: 369617 - RNA, 22 nt, Human
gcuuuaaugaagucacgcaaag

SEQ ID NO: 369618 - RNA, 19 nt, Human
gugcuuuuuaagagcucag

SEQ ID NO: 369619 - RNA, 22 nt, Human
caaauagugucacauugugagg

SEQ ID NO: 369620 - RNA, 22 nt, Human
aaaguuuuagaacuaggaagca

SEQ ID NO: 369621 - RNA, 22 nt, Human
ugucccaggccucauguugcca

SEQ ID NO: 369622 - RNA, 22 nt, Human
agcagcucuguuuaccuggagg

SEQ ID NO: 369623 - RNA, 22 nt, Human
gugcaugugucuuuauaguagc

SEQ ID NO: 369624 - RNA, 17 nt, Human
gccucugcuugugucau

SEQ ID NO: 369625 - RNA, 22 nt, Human
gggcagagguucaacuucaaca

SEQ ID NO: 369626 - RNA, 22 nt, Human
aaugaacagauacacauaggca

SEQ ID NO: 369627 - RNA, 22 nt, Human
gggagccuugggagugccagcc

SEQ ID NO: 369628 - RNA, 22 nt, Human
gcugagaggcacuaucuccgga

SEQ ID NO: 369629 - RNA, 22 nt, Human
guccucugggcagcugccccac

SEQ ID NO: 369630 - RNA, 22 nt, Human
ggcagcuuuuaucccugacaga

SEQ ID NO: 369631 - RNA, 22 nt, Human
agggaaggaaaagcugucgcuu

SEQ ID NO: 369632 - RNA, 22 nt, Human
ugggguggauagaaagugaugu

SEQ ID NO: 369633 - RNA, 20 nt, Human
aaaggaauauaugaaguaua

SEQ ID NO: 369634 - RNA, 22 nt, Human
agccuucauaaucuugggcuuu

SEQ ID NO: 369635 - RNA, 22 nt, Human
caggcagaaauuuuguuucauu

SEQ ID NO: 369636 - RNA, 22 nt, Human
ucuaugaaaagucuauucauuc

SEQ ID NO: 369637 - RNA, 22 nt, Human
guuagggagucagguggcucuu

SEQ ID NO: 369638 - RNA, 22 nt, Human
ucagagaguuagugucuuagcu

SEQ ID NO: 369639 - RNA, 22 nt, Human
ccucuggggugagugggccacu

SEQ ID NO: 369640 - RNA, 22 nt, Human
ugaggcagggagaguggauaug

SEQ ID NO: 369641 - RNA, 22 nt, Human
uuucuagaggcuccaggggagu

SEQ ID NO: 369642 - RNA, 22 nt, Human
ccagcagaggggcggagugcag

SEQ ID NO: 369643 - RNA, 22 nt, Human
aggccagcccugggcugagaga

SEQ ID NO: 369644 - RNA, 22 nt, Human
uuucauggcuaggacuagagug

SEQ ID NO: 369645 - RNA, 22 nt, Human
cuucuucagcacaauauugaug

SEQ ID NO: 369646 - RNA, 22 nt, Human
aauuuuaagcauaugacugguu

SEQ ID NO: 369647 - RNA, 22 nt, Human
ugggcuggcguggagaguuuag

SEQ ID NO: 369648 - RNA, 22 nt, Human
aggaccuggaucacagagaucu

SEQ ID NO: 369649 - RNA, 22 nt, Human
ccuggaucuuucugacugacaa

SEQ ID NO: 369650 - RNA, 22 nt, Human
gcagcuggagccagccagacac

SEQ ID NO: 369651 - RNA, 21 nt, Human
acagagcauaaugguguggca

SEQ ID NO: 369652 - RNA, 22 nt, Human
ggccugcucugcagccucuaca

SEQ ID NO: 369653 - RNA, 22 nt, Human
aucuacagcugucugcacagua

SEQ ID NO: 369654 - RNA, 22 nt, Human
auagaaauguauuuuggacuag

SEQ ID NO: 369655 - RNA, 22 nt, Human
gacauaauaaucugaccuagau

SEQ ID NO: 369656 - RNA, 22 nt, Human
ccaggcagggcucaaggaaccu

SEQ ID NO: 369657 - RNA, 22 nt, Human
aaguuuuaacaaguacuuacua

SEQ ID NO: 369658 - RNA, 22 nt, Human
gaagagcugacagugucauccu

SEQ ID NO: 369659 - RNA, 22 nt, Human
aggaagcuccaugaaggcagag

SEQ ID NO: 369660 - RNA, 22 nt, Human
uggggcuccuccuggcaggagg

SEQ ID NO: 369661 - RNA, 22 nt, Human
ggagcuggcuacagagaacucc

SEQ ID NO: 369662 - RNA, 22 nt, Human
gucuaacaagcauuaggaaccc

SEQ ID NO: 369663 - RNA, 22 nt, Human
aggcagaauguuggaaaggaag

SEQ ID NO: 369664 - RNA, 22 nt, Human
uagauuuaagacccugaauuug

SEQ ID NO: 369665 - RNA, 22 nt, Human
ccagcuggaagagugcagaacu

SEQ ID NO: 369666 - RNA, 22 nt, Human
agaggggaaggaugugauguga

SEQ ID NO: 369667 - RNA, 22 nt, Human
agcugcccugggcuggagaugg

SEQ ID NO: 369668 - RNA, 22 nt, Human
cuugaaagcuuugcgucuucua

SEQ ID NO: 369669 - RNA, 22 nt, Human
ucagagagccucaggcacugcc

SEQ ID NO: 369670 - RNA, 22 nt, Human
ucaggggacagccagcuggagg

SEQ ID NO: 369671 - RNA, 22 nt, Human
guuuauuagaguuuucugucug

SEQ ID NO: 369672 - RNA, 22 nt, Human
gccacagggcagaugcgcagag

SEQ ID NO: 369673 - RNA, 22 nt, Human
gucaggauuuuaaaaucccagu

SEQ ID NO: 369674 - RNA, 22 nt, Human
guucuccauucagcuuccugug

SEQ ID NO: 369675 - RNA, 19 nt, Human
agaaguuagacauugcaau

SEQ ID NO: 369676 - RNA, 22 nt, Human
uggaaagagguagaggaucugg

SEQ ID NO: 369677 - RNA, 22 nt, Human
cagcccuggaacagcugacuca

SEQ ID NO: 369678 - RNA, 22 nt, Human
cucuggagguggagguugcagu

SEQ ID NO: 369679 - RNA, 22 nt, Human
aagggcuggcccugggaagagu

SEQ ID NO: 369680 - RNA, 22 nt, Human
gccuggagcagacgugucccgg

SEQ ID NO: 369681 - RNA, 20 nt, Human
gucagugucuucaguaguga

SEQ ID NO: 369682 - RNA, 22 nt, Human
cuggcuuuaacccuacaaaccu

SEQ ID NO: 369683 - RNA, 22 nt, Human
agugcaugccuuccuguggaug

SEQ ID NO: 369684 - RNA, 22 nt, Human
acaguggaggccauaugguccu

SEQ ID NO: 369685 - RNA, 22 nt, Human
ggagcuguucaggacugcuuca

SEQ ID NO: 369686 - RNA, 22 nt, Human
uuauguauggauggcugaaagu

SEQ ID NO: 369687 - RNA, 22 nt, Human
ugucagcagcugguuugcuguu

SEQ ID NO: 369688 - RNA, 22 nt, Human
cugagaggugacagcgugcugg

SEQ ID NO: 369689 - RNA, 22 nt, Human
cuuaggcaagcagagcccaucc

SEQ ID NO: 369690 - RNA, 17 nt, Human
cucugcagugcauggcu

SEQ ID NO: 369691 - RNA, 22 nt, Human
aggggcucaguuacuuuggcag

SEQ ID NO: 369692 - RNA, 22 nt, Human
gaaaagggcaagagagagggca

SEQ ID NO: 369693 - RNA, 22 nt, Human
cuggcaggcagacuucugcaag

SEQ ID NO: 369694 - RNA, 22 nt, Human
uauuugcaaagaacuacacuag

SEQ ID NO: 369695 - RNA, 22 nt, Human
cagagcagaaaccugggugauu

SEQ ID NO: 369696 - RNA, 19 nt, Human
ugccuggcaccagcuccac

SEQ ID NO: 369697 - RNA, 22 nt, Human
agguggagaagagaugggcagu

SEQ ID NO: 369698 - RNA, 22 nt, Human
cagagaccccgcugcccuucug

SEQ ID NO: 369699 - RNA, 22 nt, Human
cacaggagugcugcuauuguug

SEQ ID NO: 369700 - RNA, 22 nt, Human
cauggaaggcaaaagacacaga

SEQ ID NO: 369701 - RNA, 18 nt, Human
aagucaccccugcucccu

SEQ ID NO: 369702 - RNA, 22 nt, Human
auuucacaaaccauccugauuu

SEQ ID NO: 369703 - RNA, 22 nt, Human
caggacaguuugcuuugcccug

SEQ ID NO: 369704 - RNA, 22 nt, Human
gcuggagcugcagccugggccu

SEQ ID NO: 369705 - RNA, 22 nt, Human
agugguaacuaaguccugcuua

SEQ ID NO: 369706 - RNA, 22 nt, Human
cugagagugcucuuugauguca

SEQ ID NO: 369707 - RNA, 22 nt, Human
cccuggaguccggagcucaccu

SEQ ID NO: 369708 - RNA, 22 nt, Human
uucuuacagaguuuacagagcc

SEQ ID NO: 369709 - RNA, 21 nt, Human
aaagagguuaauauuguaagu

SEQ ID NO: 369710 - RNA, 22 nt, Human
gggagaaguggaaaucucauua

SEQ ID NO: 369711 - RNA, 22 nt, Human
caagaugugccuaaucagaccu

SEQ ID NO: 369712 - RNA, 22 nt, Human
ugaguucuaguggcugcagauu

SEQ ID NO: 369713 - RNA, 22 nt, Human
gccuggugguauccuggcaaga

SEQ ID NO: 369714 - RNA, 22 nt, Human
cugcucugcagcuuggacuccc

SEQ ID NO: 369715 - RNA, 22 nt, Human
caggacagguguucuagaucag

SEQ ID NO: 369716 - RNA, 22 nt, Human
ggccacuccgcugcuacuggaa

SEQ ID NO: 369717 - RNA, 21 nt, Human
agcagaacagucgagcacugc

SEQ ID NO: 369718 - RNA, 22 nt, Human
ggagagcagggaggcugcucug

SEQ ID NO: 369719 - RNA, 22 nt, Human
aaagccuugggauuugugauca

SEQ ID NO: 369720 - RNA, 22 nt, Human
gccuggagggcucuagagaggc

SEQ ID NO: 369721 - RNA, 22 nt, Human
cagggcucccugcagccucugu

SEQ ID NO: 369722 - RNA, 22 nt, Human
aucaguuuauacuuauaaaucu

SEQ ID NO: 369723 - RNA, 22 nt, Human
aagccaguguccagaaugggca

SEQ ID NO: 369724 - RNA, 22 nt, Human
agggucuguggaugcaucuggg

SEQ ID NO: 369725 - RNA, 22 nt, Human
ucaggcagagcuguggagcucu

SEQ ID NO: 369726 - RNA, 22 nt, Human
ugcagggcaguggagguugagu

SEQ ID NO: 369727 - RNA, 22 nt, Human
acugggaguucuccaugucccu

SEQ ID NO: 369728 - RNA, 22 nt, Human
gggggacuaacuggauccugga

SEQ ID NO: 369729 - RNA, 22 nt, Human
ugucucagaggcaggaagagcc

SEQ ID NO: 369730 - RNA, 22 nt, Human
uugaagaaagucauauauaaug

SEQ ID NO: 369731 - RNA, 22 nt, Human
ccagccaggcuggcuguggagg

SEQ ID NO: 369732 - RNA, 22 nt, Human
cccucugaccuccugccacagu

SEQ ID NO: 369733 - RNA, 19 nt, Human
auuuccaagaauuggagag

SEQ ID NO: 369734 - RNA, 19 nt, Human
agaggcugucaccuguagc

SEQ ID NO: 369735 - RNA, 22 nt, Human
cugggaggcagucucucuagaa

SEQ ID NO: 369736 - RNA, 22 nt, Human
uuguucaugguuguaaguuuga

SEQ ID NO: 369737 - RNA, 22 nt, Human
agucucagcuacuugggaggcu

SEQ ID NO: 369738 - RNA, 22 nt, Human
aucauucugauggucaaugcua

SEQ ID NO: 369739 - RNA, 20 nt, Human
augccucuaauuuugcaaac

SEQ ID NO: 369740 - RNA, 22 nt, Human
cagggcugguuugucgaagaaa

SEQ ID NO: 369741 - RNA, 22 nt, Human
ucaagagacaggacguguuuca

SEQ ID NO: 369742 - RNA, 22 nt, Human
ucuuagaaguucauguuccagc

SEQ ID NO: 369743 - RNA, 23 nt, Human
aggcuuccuaucuuagagcuggg

SEQ ID NO: 369744 - RNA, 22 nt, Human
agugugcugcuuaaacaguugu

SEQ ID NO: 369745 - RNA, 22 nt, Human
gaggcucagggaguauaugaau

SEQ ID NO: 369746 - RNA, 22 nt, Human
cugcugagcaucagggcugccc

SEQ ID NO: 369747 - RNA, 22 nt, Human
cugcagggagaggggacagccu

SEQ ID NO: 369748 - RNA, 22 nt, Human
uaugcacaauaugaucuauuug

SEQ ID NO: 369749 - RNA, 23 nt, Human
agcuggguggccugcgugaagcu

SEQ ID NO: 369750 - RNA, 22 nt, Human
gcucccugcacucugcagcccu

SEQ ID NO: 369751 - RNA, 18 nt, Human
gccugcaggcacgggggu

SEQ ID NO: 369752 - RNA, 22 nt, Human
ggcaggagcucuccaguuugcc

SEQ ID NO: 369753 - RNA, 22 nt, Human
ugacauuuaucuucuacaauga

SEQ ID NO: 369754 - RNA, 23 nt, Human
acuuuagauaaauuaugugcaca

SEQ ID NO: 369755 - RNA, 22 nt, Human
gcuguucauuagaaauagaaug

SEQ ID NO: 369756 - RNA, 22 nt, Human
ucuguucauuugccucggcucu

SEQ ID NO: 369757 - RNA, 22 nt, Human
gccucccugagucacccaagca

SEQ ID NO: 369758 - RNA, 22 nt, Human
gaggaggcuggcgccgccugcc

SEQ ID NO: 369759 - RNA, 22 nt, Human
uuuucauuguaaaucaggaaac

SEQ ID NO: 369760 - RNA, 22 nt, Human
ucaccaggcaacuauguacucc

SEQ ID NO: 369761 - RNA, 22 nt, Human
ggccugagcucuggggaggcaa

SEQ ID NO: 369762 - RNA, 22 nt, Human
cagaccucaguccucaguagga

SEQ ID NO: 369763 - RNA, 22 nt, Human
gggcuggcucccagguguugaa

SEQ ID NO: 369764 - RNA, 22 nt, Human
agcaggaaggucugugugaguc

SEQ ID NO: 369765 - RNA, 22 nt, Human
ccugucacgaugacugcacucu

SEQ ID NO: 369766 - RNA, 22 nt, Human
gcagacaauuuauuagcagauu

SEQ ID NO: 369767 - RNA, 22 nt, Human
uuuuccuuucaucaggacaaag

SEQ ID NO: 369768 - RNA, 22 nt, Human
ugaaauagaaaaacaggcuucu

SEQ ID NO: 369769 - RNA, 22 nt, Human
cugaaggagaaggccacuguuc

SEQ ID NO: 369770 - RNA, 22 nt, Human
cagugcagaggugcaagcaugu

SEQ ID NO: 369771 - RNA, 22 nt, Human
cugccaggggccucacaggcca

SEQ ID NO: 369772 - RNA, 22 nt, Human
caguaaauacauaucagagaag

SEQ ID NO: 369773 - RNA, 22 nt, Human
gcucacugccauucucuagaug

SEQ ID NO: 369774 - RNA, 22 nt, Human
uguacaauguggccaguguuaa

SEQ ID NO: 369775 - RNA, 22 nt, Human
ucuuugaaagcuguucuagagu

SEQ ID NO: 369776 - RNA, 22 nt, Human
cagguggcuucucccuaggcca

SEQ ID NO: 369777 - RNA, 20 nt, Human
aggcugggguguuuugccca

SEQ ID NO: 369778 - RNA, 22 nt, Human
agugucugccagcugccaggug

SEQ ID NO: 369779 - RNA, 22 nt, Human
ccagcugauucgguggugguug

SEQ ID NO: 369780 - RNA, 22 nt, Human
gcugcugcgcuugucuacuguu

SEQ ID NO: 369781 - RNA, 22 nt, Human
uuguuuguaugcugagaagaau

SEQ ID NO: 369782 - RNA, 22 nt, Human
ggcucuggagacauguggagag

SEQ ID NO: 369783 - RNA, 22 nt, Human
gagaggcauggaacagauucuu

SEQ ID NO: 369784 - RNA, 22 nt, Human
acaggagaaaucuggucaaaag

SEQ ID NO: 369785 - RNA, 22 nt, Human
augaccccuaaaauuuacuguc

SEQ ID NO: 369786 - RNA, 22 nt, Human
auagaauuugcacuaaaucugc

SEQ ID NO: 369787 - RNA, 22 nt, Human
gccuggcacauugcaguggauu

SEQ ID NO: 369788 - RNA, 22 nt, Human
aaauucuaugucaauguuuauu

SEQ ID NO: 369789 - RNA, 22 nt, Human
ugcaggcuguaaucugaggcua

SEQ ID NO: 369790 - RNA, 22 nt, Human
uccaggagauucauuaggucau

SEQ ID NO: 369791 - RNA, 22 nt, Human
acaucuguuugagaaaaagaag

SEQ ID NO: 369792 - RNA, 22 nt, Human
auuauuaggacuacugggguug

SEQ ID NO: 369793 - RNA, 22 nt, Human
cuugcaggccuuucuagcucua

SEQ ID NO: 369794 - RNA, 22 nt, Human
gauuuucugagccuucaaauuu

SEQ ID NO: 369795 - RNA, 22 nt, Human
uucaugugaauauauuugucuu

SEQ ID NO: 369796 - RNA, 22 nt, Human
cuucccagacgggguggcagcc

SEQ ID NO: 369797 - RNA, 22 nt, Human
acacaggaagucagcacugaug

SEQ ID NO: 369798 - RNA, 22 nt, Human
caauuuuuuccaugcucuuaca

SEQ ID NO: 369799 - RNA, 22 nt, Human
aguaacuaugcuugagaaucag

SEQ ID NO: 369800 - RNA, 22 nt, Human
uuuucaagggcagggaaaucau

SEQ ID NO: 369801 - RNA, 22 nt, Human
caguguuugcuuaaguuauaug

SEQ ID NO: 369802 - RNA, 22 nt, Human
gucagcaggguccccuugagug

SEQ ID NO: 369803 - RNA, 22 nt, Human
gcagggcaaugaucccgagagg

SEQ ID NO: 369804 - RNA, 22 nt, Human
agggggaggcugugcugcgucu

SEQ ID NO: 369805 - RNA, 22 nt, Human
uccaggaggcucugguugacgu

SEQ ID NO: 369806 - RNA, 22 nt, Human
augcagcugucagggagaacau

SEQ ID NO: 369807 - RNA, 22 nt, Human
cuggcaggagcauucacagagg

SEQ ID NO: 369808 - RNA, 22 nt, Human
gagagcugggaaagccguggag

SEQ ID NO: 369809 - RNA, 22 nt, Human
ugaggcaguucuuacuuguauu

SEQ ID NO: 369810 - RNA, 22 nt, Human
ugcagaagcagagaguugccaa

SEQ ID NO: 369811 - RNA, 22 nt, Human
ucuuugcaacucccauuuccau

SEQ ID NO: 369812 - RNA, 20 nt, Human
uccaagggcagcagaaucag

SEQ ID NO: 369813 - RNA, 22 nt, Human
cauuuccugucuggaggucaaa

SEQ ID NO: 369814 - RNA, 22 nt, Human
caagccucagaaucuucuccau

SEQ ID NO: 369815 - RNA, 22 nt, Human
gggcugagugggccucuuacuu

SEQ ID NO: 369816 - RNA, 22 nt, Human
gugguaaucggauucuuaccgg

SEQ ID NO: 369817 - RNA, 22 nt, Human
ucauugcaccccagucccagcu

SEQ ID NO: 369818 - RNA, 22 nt, Human
ccucugggugggaggccgggcg

SEQ ID NO: 369819 - RNA, 22 nt, Human
gagcagcucgagaaggaagcag

SEQ ID NO: 369820 - RNA, 23 nt, Human
ggccucuguguucugcccacaug

SEQ ID NO: 369821 - RNA, 22 nt, Human
agaucaaagccaugagagauuu

SEQ ID NO: 369822 - RNA, 22 nt, Human
cuagggcacuaggacucaugug

SEQ ID NO: 369823 - RNA, 22 nt, Human
cacugcuuuuuuggcuauguac

SEQ ID NO: 369824 - RNA, 22 nt, Human
ugcuucaggagaugucaccaug

SEQ ID NO: 369825 - RNA, 22 nt, Human
agagcccuuucuccaggcaccu

SEQ ID NO: 369826 - RNA, 22 nt, Human
ugccuugcacauaauauacauu

SEQ ID NO: 369827 - RNA, 22 nt, Human
uggcagcucauuuggaaaugga

SEQ ID NO: 369828 - RNA, 22 nt, Human
acucugccaucccaggugcugu

SEQ ID NO: 369829 - RNA, 22 nt, Human
ggcacugauaauguccucucuc

SEQ ID NO: 369830 - RNA, 22 nt, Human
cuccucuggaaauuccucugcc

SEQ ID NO: 369831 - RNA, 22 nt, Human
uggagccauaacccuuucguac

SEQ ID NO: 369832 - RNA, 22 nt, Human
uugcugaaguuaaugcuugcaa

SEQ ID NO: 369833 - RNA, 23 nt, Human
ucagaaugcacugaauuuacccu

SEQ ID NO: 369834 - RNA, 22 nt, Human
agcaggguuccaggaguugcag

SEQ ID NO: 369835 - RNA, 22 nt, Human
ggccccuggcaccaggcugauu

SEQ ID NO: 369836 - RNA, 22 nt, Human
auugaaaaauucacaauucugg

SEQ ID NO: 369837 - RNA, 22 nt, Human
ccagagcccagggucaugcagg

SEQ ID NO: 369838 - RNA, 20 nt, Human
uaugaagauaugugaacagc

SEQ ID NO: 369839 - RNA, 22 nt, Human
gugucccagccccacaggccug

SEQ ID NO: 369840 - RNA, 22 nt, Human
aggguauguuuuuaucuacugu

SEQ ID NO: 369841 - RNA, 22 nt, Human
uugaaguuguaguucagugaag

SEQ ID NO: 369842 - RNA, 20 nt, Human
uucuucucuaguuaucuuca

SEQ ID NO: 369843 - RNA, 22 nt, Human
cugcugcugagagcucagccug

SEQ ID NO: 369844 - RNA, 22 nt, Human
ccuguucagagcuaagcaucau

SEQ ID NO: 369845 - RNA, 22 nt, Human
aaaauguguuuaugcauuucgu

SEQ ID NO: 369846 - RNA, 22 nt, Human
gccacccccaaguagguggucu

SEQ ID NO: 369847 - RNA, 22 nt, Human
augcaucauggaaaacucaguu

SEQ ID NO: 369848 - RNA, 22 nt, Human
caggccucuccuuagucuggca

SEQ ID NO: 369849 - RNA, 22 nt, Human
aucuaucccaguuuaacucauu

SEQ ID NO: 369850 - RNA, 19 nt, Human
cccaaggcccugggcaggc

SEQ ID NO: 369851 - RNA, 22 nt, Human
ggauuuacaaguuuaacucuca

SEQ ID NO: 369852 - RNA, 20 nt, Human
ugccaggcacggagugcaug

SEQ ID NO: 369853 - RNA, 22 nt, Human
aaguccuuuaauaucacauagu

SEQ ID NO: 369854 - RNA, 22 nt, Human
ucagugugaggucuuccacccg

SEQ ID NO: 369855 - RNA, 22 nt, Human
ugacagcauaacacuggucuug

SEQ ID NO: 369856 - RNA, 22 nt, Human
ugagauguaagguaugcuuacu

SEQ ID NO: 369857 - RNA, 22 nt, Human
ucccaagugucuuggaccaggg

SEQ ID NO: 369858 - RNA, 22 nt, Human
ugugcccaucccucuggagugu

SEQ ID NO: 369859 - RNA, 22 nt, Human
ggagggagucagcugauuagaa

SEQ ID NO: 369860 - RNA, 22 nt, Human
uggcucucagcucccagcagcc

SEQ ID NO: 369861 - RNA, 22 nt, Human
auuauuauauagggaaaguccc

SEQ ID NO: 369862 - RNA, 22 nt, Human
guucuucagaggggaaagaacc

SEQ ID NO: 369863 - RNA, 22 nt, Human
gcucucagguacaaagcugugu

SEQ ID NO: 369864 - RNA, 22 nt, Human
ugaguuuugucuugcuagaagu

SEQ ID NO: 369865 - RNA, 22 nt, Human
gaauacaaauaauaccaaggug

SEQ ID NO: 369866 - RNA, 22 nt, Human
gagaagguggaccugaaggagc

SEQ ID NO: 369867 - RNA, 22 nt, Human
cagaguggcagucccaggccca

SEQ ID NO: 369868 - RNA, 23 nt, Human
acugucugauauguuuuccauca

SEQ ID NO: 369869 - RNA, 22 nt, Human
cugaggccagcugcagagcucu

SEQ ID NO: 369870 - RNA, 22 nt, Human
aggaagcuuagugaaaggacca

SEQ ID NO: 369871 - RNA, 22 nt, Human
cugggcagaauuuuaggauggc

SEQ ID NO: 369872 - RNA, 22 nt, Human
cugggcacaggggagcagaguc

SEQ ID NO: 369873 - RNA, 22 nt, Human
gugccuggagcuaauguguaua

SEQ ID NO: 369874 - RNA, 22 nt, Human
aguucaggcauaaggcaugaac

SEQ ID NO: 369875 - RNA, 22 nt, Human
caugccaguuuugagaugcacc

SEQ ID NO: 369876 - RNA, 22 nt, Human
acaguggaagcaugaugcuauc

SEQ ID NO: 369877 - RNA, 22 nt, Human
cuucaagauauuucuagaauca

SEQ ID NO: 369878 - RNA, 22 nt, Human
gagggcuccacacgggcccagc

SEQ ID NO: 369879 - RNA, 15 nt, Human
uucaggauaugacuc

SEQ ID NO: 369880 - RNA, 22 nt, Human
agccaaggcagcuagagcucug

SEQ ID NO: 369881 - RNA, 22 nt, Human
uccaggcagucauuaaucucua

SEQ ID NO: 369882 - RNA, 22 nt, Human
uuccagauuucuacacaagacc

SEQ ID NO: 369883 - RNA, 22 nt, Human
cagcuuccaucuccacugcccu

SEQ ID NO: 369884 - RNA, 22 nt, Human
uucagcaagaccaccauguacc

SEQ ID NO: 369885 - RNA, 22 nt, Human
aggcaguuguagagagggcucu

SEQ ID NO: 369886 - RNA, 22 nt, Human
auucuggccuuggcucugucac

SEQ ID NO: 369887 - RNA, 22 nt, Human
cugggagucuggccucuggucc

SEQ ID NO: 369888 - RNA, 20 nt, Human
cagggccacgcuccaaggca

SEQ ID NO: 369889 - RNA, 22 nt, Human
gaggcacaauacaugucucaag

SEQ ID NO: 369890 - RNA, 22 nt, Human
acuucacacagcaaauuuaucu

SEQ ID NO: 369891 - RNA, 19 nt, Human
ucaaagucugagucacuuu

SEQ ID NO: 369892 - RNA, 22 nt, Human
acagguggcuuauuggcugauu

SEQ ID NO: 369893 - RNA, 22 nt, Human
uccuggaguugugcagugcaca

SEQ ID NO: 369894 - RNA, 22 nt, Human
ugguaaaguguacugaauauga

SEQ ID NO: 369895 - RNA, 22 nt, Human
ggugucuguugccuccugguua

SEQ ID NO: 369896 - RNA, 22 nt, Human
ggcucagaaacuaaaggcgcug

SEQ ID NO: 369897 - RNA, 22 nt, Human
ucucagaguuuagagcugagcc

SEQ ID NO: 369898 - RNA, 19 nt, Human
ugcaagcuuuuucuuguua

SEQ ID NO: 369899 - RNA, 20 nt, Human
acagccagaggaggcagaca

SEQ ID NO: 369900 - RNA, 22 nt, Human
gugcauuucucauacacuaaau

SEQ ID NO: 369901 - RNA, 22 nt, Human
gccugagaaggacacagcaggu

SEQ ID NO: 369902 - RNA, 22 nt, Human
ccccagccagcaggaccucuga

SEQ ID NO: 369903 - RNA, 22 nt, Human
uuggcucaggaccccugugacu

SEQ ID NO: 369904 - RNA, 22 nt, Human
ucuacuguagugaugcugcagu

SEQ ID NO: 369905 - RNA, 22 nt, Human
uugaggagcacuagucagguau

SEQ ID NO: 369906 - RNA, 22 nt, Human
ccucagcucuucccugugcaca

SEQ ID NO: 369907 - RNA, 22 nt, Human
auucuucauguugaagcuguca

SEQ ID NO: 369908 - RNA, 22 nt, Human
agagccuggucugagauaggac

SEQ ID NO: 369909 - RNA, 22 nt, Human
cagcugccaagaaucuuuucua

SEQ ID NO: 369910 - RNA, 22 nt, Human
gaugguuuaugauagaugggaa

SEQ ID NO: 369911 - RNA, 22 nt, Human
cuaaagaagcuagcaaucuaua

SEQ ID NO: 369912 - RNA, 22 nt, Human
ugagcagagucgcuccagagug

SEQ ID NO: 369913 - RNA, 22 nt, Human
gaaugaaagauuugcauucuau

SEQ ID NO: 369914 - RNA, 22 nt, Human
acuggcagcagcagcccuuggg

SEQ ID NO: 369915 - RNA, 22 nt, Human
cccaggcuggagugcaauggca

SEQ ID NO: 369916 - RNA, 22 nt, Human
uuuugugagcccauaaaugcca

SEQ ID NO: 369917 - RNA, 22 nt, Human
aagggcaggagaagacggauau

SEQ ID NO: 369918 - RNA, 19 nt, Human
gcagcugcuugaaaagaaa

SEQ ID NO: 369919 - RNA, 22 nt, Human
gcagaaggucuggcacuucagg

SEQ ID NO: 369920 - RNA, 22 nt, Human
cauugucacccaaagcucauag

SEQ ID NO: 369921 - RNA, 22 nt, Human
gaaggccauuuuuagguagaau

SEQ ID NO: 369922 - RNA, 22 nt, Human
caaguaaagaaucacauuucuu

SEQ ID NO: 369923 - RNA, 22 nt, Human
aacuggauuuaggaacagagaa

SEQ ID NO: 369924 - RNA, 22 nt, Human
ccaguggaauuaaaaauaagug

SEQ ID NO: 369925 - RNA, 22 nt, Human
cuuguaauuauaauguacuguu

SEQ ID NO: 369926 - RNA, 22 nt, Human
augaggcaucugcagucacuag

SEQ ID NO: 369927 - RNA, 22 nt, Human
ggccugagucccaccuggcugu

SEQ ID NO: 369928 - RNA, 22 nt, Human
acugggccuggauuggcguguc

SEQ ID NO: 369929 - RNA, 22 nt, Human
gauuucuuuagguguaauagug

SEQ ID NO: 369930 - RNA, 21 nt, Human
acaggcuuuagaaaaugacuc

SEQ ID NO: 369931 - RNA, 22 nt, Human
agauacaucuugaacuucuaga

SEQ ID NO: 369932 - RNA, 22 nt, Human
ugucaccaguuccaggaaauaa

SEQ ID NO: 369933 - RNA, 22 nt, Human
cauaacuagagugaaauguuga

SEQ ID NO: 369934 - RNA, 22 nt, Human
uaacaauaguguuugcuaguca

SEQ ID NO: 369935 - RNA, 22 nt, Human
guggcagagggugagcuggacu

SEQ ID NO: 369936 - RNA, 22 nt, Human
uacauggugguggcacuugacu

SEQ ID NO: 369937 - RNA, 22 nt, Human
gaggggaagacuucuggacagu

SEQ ID NO: 369938 - RNA, 16 nt, Human
agccaggcugccucgg

SEQ ID NO: 369939 - RNA, 22 nt, Human
gcugucacaucaaggcacuaaa

SEQ ID NO: 369940 - RNA, 22 nt, Human
aggguaggguaaaugaugcauc

SEQ ID NO: 369941 - RNA, 22 nt, Human
aggcuccaugcaaaggcuguuu

SEQ ID NO: 369942 - RNA, 22 nt, Human
auaugcaagcacauagaauacu

SEQ ID NO: 369943 - RNA, 22 nt, Human
auauaauacaaccugcuaagug

SEQ ID NO: 369944 - RNA, 22 nt, Human
agcagccagaaauccagaggug

SEQ ID NO: 369945 - RNA, 22 nt, Human
cauuucaauacuaucugagaau

SEQ ID NO: 369946 - RNA, 22 nt, Human
aagagagaacucccuucgccag

SEQ ID NO: 369947 - RNA, 22 nt, Human
aggcaguguauugcuagcggcu

SEQ ID NO: 369948 - RNA, 23 nt, Human
cccagaccuugugcugcccuugg

SEQ ID NO: 369949 - RNA, 22 nt, Human
uggcucaggccuacgacgccuu

SEQ ID NO: 369950 - RNA, 22 nt, Human
ccugggugacccgugagcgucc

SEQ ID NO: 369951 - RNA, 22 nt, Human
auuauuucucacucacauaaua

SEQ ID NO: 369952 - RNA, 22 nt, Human
acauuccaaaaacuagcagaua

SEQ ID NO: 369953 - RNA, 22 nt, Human
ggcauggcucggagucagaaca

SEQ ID NO: 369954 - RNA, 22 nt, Human
agugagcauucguuuggaaccc

SEQ ID NO: 369955 - RNA, 22 nt, Human
ugagcaguaggucugaauagug

SEQ ID NO: 369956 - RNA, 18 nt, Human
ucuuccaacacugacacc

SEQ ID NO: 369957 - RNA, 22 nt, Human
uacuuagagcgauaauuuauac

SEQ ID NO: 369958 - RNA, 22 nt, Human
aagaauucacugguagagucaa

SEQ ID NO: 369959 - RNA, 22 nt, Human
ucagcagugcagggugaggcag

SEQ ID NO: 369960 - RNA, 22 nt, Human
gagguucacaggcuaucacagu

SEQ ID NO: 369961 - RNA, 22 nt, Human
ugccaggccaaugaaggcaggg

SEQ ID NO: 369962 - RNA, 22 nt, Human
caggccugugaguugaggcccc

SEQ ID NO: 369963 - RNA, 22 nt, Human
uaguggagaggauguggagaaa

SEQ ID NO: 369964 - RNA, 17 nt, Human
ucagcaggggccaagcu

SEQ ID NO: 369965 - RNA, 19 nt, Human
auaaggcaauuggauuugg

SEQ ID NO: 369966 - RNA, 22 nt, Human
gagcugggacauggguccucuc

SEQ ID NO: 369967 - RNA, 22 nt, Human
acagagcauuugggacagagag

SEQ ID NO: 369968 - RNA, 22 nt, Human
gcauuccugagaaugcagagug

SEQ ID NO: 369969 - RNA, 22 nt, Human
gaguuauuggguggaaagguag

SEQ ID NO: 369970 - RNA, 17 nt, Human
agaugcuggccacaugu

SEQ ID NO: 369971 - RNA, 22 nt, Human
uggagcagagaugguggccuuc

SEQ ID NO: 369972 - RNA, 22 nt, Human
agaggccacuuugccugugaug

SEQ ID NO: 369973 - RNA, 22 nt, Human
augugguugaagaauuacaucu

SEQ ID NO: 369974 - RNA, 22 nt, Human
ugucccucauugacgcugugcc

SEQ ID NO: 369975 - RNA, 22 nt, Human
uuugcauuucucguaaggaaac

SEQ ID NO: 369976 - RNA, 21 nt, Human
gcagaggaaugguauacauaa

SEQ ID NO: 369977 - RNA, 22 nt, Human
ucucuuucuauaugugagucuu

SEQ ID NO: 369978 - RNA, 22 nt, Human
gaagaagguggcccagggguag

SEQ ID NO: 369979 - RNA, 22 nt, Human
cuguguccucccgcugcaccca

SEQ ID NO: 369980 - RNA, 22 nt, Human
ggggcagccuccaggaaagcug

SEQ ID NO: 369981 - RNA, 22 nt, Human
cagaggccucacuuccagccag

SEQ ID NO: 369982 - RNA, 18 nt, Human
ugagaggcagguagagga

SEQ ID NO: 369983 - RNA, 22 nt, Human
cugccuggggaaugugaggauu

SEQ ID NO: 369984 - RNA, 22 nt, Human
ucuuuauuuuaugcuugugcaa

SEQ ID NO: 369985 - RNA, 22 nt, Human
ggcauccaaauaccaagaugua

SEQ ID NO: 369986 - RNA, 22 nt, Human
uccaggcaggguuaaggguccu

SEQ ID NO: 369987 - RNA, 22 nt, Human
cugugccuaagaugcaugucuc

SEQ ID NO: 369988 - RNA, 22 nt, Human
uccuguaguugcuaaguuuguu

SEQ ID NO: 369989 - RNA, 22 nt, Human
gucaggggccaugggccaagga

SEQ ID NO: 369990 - RNA, 22 nt, Human
cugagccauccauaccagcuua

SEQ ID NO: 369991 - RNA, 17 nt, Human
uagagcugguucaggag

SEQ ID NO: 369992 - RNA, 22 nt, Human
cccaggccagaacuugguugcu

SEQ ID NO: 369993 - RNA, 22 nt, Human
uggggcuguggauucucacgaa

SEQ ID NO: 369994 - RNA, 22 nt, Human
uuuagggaugucagaacaggga

SEQ ID NO: 369995 - RNA, 22 nt, Human
uggaagcuguggcauaacugag

SEQ ID NO: 369996 - RNA, 22 nt, Human
cuuaaagaguauuuaauauaau

SEQ ID NO: 369997 - RNA, 22 nt, Human
agagcauccaucggccaggacc

SEQ ID NO: 369998 - RNA, 22 nt, Human
agggcugcuauguugauucaga

SEQ ID NO: 369999 - RNA, 22 nt, Human
caggcagcaucagucugcugua

SEQ ID NO: 370000 - RNA, 22 nt, Human
gcccacagcucguuccucuccu

SEQ ID NO: 370001 - RNA, 22 nt, Human
ugaaggugucuuugugaacauc

SEQ ID NO: 370002 - RNA, 22 nt, Human
ucagggcucaccagccucugcc

SEQ ID NO: 370003 - RNA, 22 nt, Human
caggaaugaggucguaaguguc

SEQ ID NO: 370004 - RNA, 22 nt, Human
agauuuacuggagucuuuggug

SEQ ID NO: 370005 - RNA, 22 nt, Human
uuaacagacauauauauuugua

SEQ ID NO: 370006 - RNA, 22 nt, Human
agagcagguggcaacucuggga

SEQ ID NO: 370007 - RNA, 18 nt, Human
ugucucaggcugaaacag

SEQ ID NO: 370008 - RNA, 21 nt, Human
acagcagacaggcuuaggacc

SEQ ID NO: 370009 - RNA, 22 nt, Human
aggcaacuguuugauaauguug

SEQ ID NO: 370010 - RNA, 22 nt, Human
cccacaggcuagggguagggca

SEQ ID NO: 370011 - RNA, 22 nt, Human
gccggggcuggggagagacaug

SEQ ID NO: 370012 - RNA, 22 nt, Human
ugacagaaugugacucucagau

SEQ ID NO: 370013 - RNA, 22 nt, Human
gcaagcuggcuguuagaggaug

SEQ ID NO: 370014 - RNA, 22 nt, Human
gggcugagugucccaggccgaa

SEQ ID NO: 370015 - RNA, 22 nt, Human
acauuuacagugcuagacaauc

SEQ ID NO: 370016 - RNA, 18 nt, Human
aggcagcagcaucuucuc

SEQ ID NO: 370017 - RNA, 22 nt, Human echovirus 1
ccaugggaggugaaggugucgu

SEQ ID NO: 370018 - RNA, 22 nt, Human echovirus 1
acucggcacacaugggggccac

SEQ ID NO: 370019 - RNA, 22 nt, Human echovirus 1
cucaaguguuuggcuuucaacu

SEQ ID NO: 370020 - RNA, 22 nt, Human
uggcagaaguucacuaguagcu

SEQ ID NO: 370021 - RNA, 22 nt, Human
cugggcacagcguugggcucuu

SEQ ID NO: 370022 - RNA, 22 nt, Human
aagcuggcaauuaucaaaacug

SEQ ID NO: 370023 - RNA, 23 nt, Human
uggcagcagaucuuaaagugacc

SEQ ID NO: 370024 - RNA, 22 nt, Human
accagggcacaggagucugaag

SEQ ID NO: 370025 - RNA, 22 nt, Human
cucaggggaccuggcuccgagu

SEQ ID NO: 370026 - RNA, 22 nt, Human
accagcugcugauugcuaaaug

SEQ ID NO: 370027 - RNA, 22 nt, Human
gcuucacacuaaaaauguuaaa

SEQ ID NO: 370028 - RNA, 22 nt, Human
aaggcauaggacaaaucaguga

SEQ ID NO: 370029 - RNA, 22 nt, Human
gccaggcauuauuccgaucccu

SEQ ID NO: 370030 - RNA, 22 nt, Human
uuuuauauggcacauugguugg

SEQ ID NO: 370031 - RNA, 22 nt, Human
caggugaccuuuguccuaaguu

SEQ ID NO: 370032 - RNA, 22 nt, Human
ugguaaagaaggcuagaucuga

SEQ ID NO: 370033 - RNA, 22 nt, Human
cagugagguggauggauggccu

SEQ ID NO: 370034 - RNA, 22 nt, Human
gauuucuucauucauuagaugg

SEQ ID NO: 370035 - RNA, 22 nt, Human
gccccugggagcagagccacca

SEQ ID NO: 370036 - RNA, 22 nt, Human
cugugaccuccaggaaggggug

SEQ ID NO: 370037 - RNA, 22 nt, Human
ccuccugggcuccugucugcac

SEQ ID NO: 370038 - RNA, 22 nt, Human
agaauuucuggaagauugcaag

SEQ ID NO: 370039 - RNA, 22 nt, Human
aaguguagauuauggagugucu

SEQ ID NO: 370040 - RNA, 22 nt, Human
agagacaaugccaaugcacacg

SEQ ID NO: 370041 - RNA, 22 nt, Human
uaggagagcugaacuauugucu

SEQ ID NO: 370042 - RNA, 22 nt, Human
ggagucagccugucagagugua

SEQ ID NO: 370043 - RNA, 22 nt, Human
agcuuuaucacaauauuggcua

SEQ ID NO: 370044 - RNA, 22 nt, Human
gcaguguuaggaauaaaaauga

SEQ ID NO: 370045 - RNA, 22 nt, Human
ggcagggcuugucucugugaug

SEQ ID NO: 370046 - RNA, 22 nt, Human
agagacaggauaucugcucaug

SEQ ID NO: 370047 - RNA, 19 nt, Human
gaguuauugccagggcaug

SEQ ID NO: 370048 - RNA, 22 nt, Human
agaggcugucccuugcuauucc

SEQ ID NO: 370049 - RNA, 22 nt, Human
gagcacccuuugcacaucaguc

SEQ ID NO: 370050 - RNA, 21 nt, Human
gcugcucgagauccagugcuu

SEQ ID NO: 370051 - RNA, 22 nt, Human
uuugacaguaauaaagcacaag

SEQ ID NO: 370052 - RNA, 22 nt, Human
gaggaggcuggcgccgccugcc

SEQ ID NO: 370053 - RNA, 22 nt, Human
ucacaucuuauuagaguaucuc

SEQ ID NO: 370054 - RNA, 21 nt, Human
ccagcagcucaaggaucucuu

SEQ ID NO: 370055 - RNA, 22 nt, Human
uuuaggcagcuacauacuaacu

SEQ ID NO: 370056 - RNA, 23 nt, Human
uggcugagguccagguaguuuca

SEQ ID NO: 370057 - RNA, 22 nt, Human
gaggccaggggccuggagauga

SEQ ID NO: 370058 - RNA, 22 nt, Human
guggcuugaccaucccugcuac

SEQ ID NO: 370059 - RNA, 22 nt, Human
cagcagcuacuuggagcagcag

SEQ ID NO: 370060 - RNA, 22 nt, Human
aggcuucccaagcagcugcaaa

SEQ ID NO: 370061 - RNA, 22 nt, Human
ucugggaaccagugcggcuggg

SEQ ID NO: 370062 - RNA, 22 nt, Human
acagauugaucuugagaauuau

SEQ ID NO: 370063 - RNA, 22 nt, Human
uuugaauagcauaggauuacau

SEQ ID NO: 370064 - RNA, 22 nt, Human
uuuucucaggugcuuaucuaag

SEQ ID NO: 370065 - RNA, 22 nt, Human
aauaugugagguauguucagug

SEQ ID NO: 370066 - RNA, 20 nt, Human
gcagggcaucuuggccccca

SEQ ID NO: 370067 - RNA, 22 nt, Human
aaggucauuuaacaauuuauga

SEQ ID NO: 370068 - RNA, 22 nt, Human
gcucucuugguggcuguccugg

SEQ ID NO: 370069 - RNA, 23 nt, Human
cagaagcaccuguugacugcugc

SEQ ID NO: 370070 - RNA, 22 nt, Human
acacaucagaaauaugaaugag

SEQ ID NO: 370071 - RNA, 20 nt, Human
gccuguccugagugucaugg

SEQ ID NO: 370072 - RNA, 21 nt, Human
agagccugagaucuuccagca

SEQ ID NO: 370073 - RNA, 23 nt, Human
ucucugaguuguacuuucccuug

SEQ ID NO: 370074 - RNA, 22 nt, Human
uaaauacagucauuugagccau

SEQ ID NO: 370075 - RNA, 22 nt, Human
uucagcaaacacgaugcuuguu

SEQ ID NO: 370076 - RNA, 22 nt, Human
acagucuugcuguauggucagg

SEQ ID NO: 370077 - RNA, 22 nt, Human
gcagcugcagagaccggguggg

SEQ ID NO: 370078 - RNA, 22 nt, Human
ggcugggcuccgggagcaugcg

SEQ ID NO: 370079 - RNA, 22 nt, Human
gccugucugcgucacgcuuauu

SEQ ID NO: 370080 - RNA, 22 nt, Human
uacauagaacauguuuaauguc

SEQ ID NO: 370081 - RNA, 22 nt, Human
ggaggcugagaaguccaagauc

SEQ ID NO: 370082 - RNA, 22 nt, Human
ggggcugguggugguuucucca

SEQ ID NO: 370083 - RNA, 18 nt, Human
ccagguggugacagagau

SEQ ID NO: 370084 - RNA, 22 nt, Human
cgagcaugaugacggcuguggc

SEQ ID NO: 370085 - RNA, 22 nt, Human
gcuuuaaugcuucguggggcca

SEQ ID NO: 370086 - RNA, 22 nt, Human
ggcugggcaaacaagacucuuc

SEQ ID NO: 370087 - RNA, 22 nt, Human
aaagacacacagugcuucaguu

SEQ ID NO: 370088 - RNA, 22 nt, Human
ucaggaguaaagacagaguucc

SEQ ID NO: 370089 - RNA, 22 nt, Human
accaggcaguauggugcugcaa

SEQ ID NO: 370090 - RNA, 22 nt, Human
ccuggaagauucaccacuacca

SEQ ID NO: 370091 - RNA, 22 nt, Human
ugaggcaggacauggacaacug

SEQ ID NO: 370092 - RNA, 22 nt, Human
aaugucuucaguguauacaugg

SEQ ID NO: 370093 - RNA, 22 nt, Human
gggaggaaagagaaguggucca

SEQ ID NO: 370094 - RNA, 22 nt, Human
aagacccacaaggcugaauguu

SEQ ID NO: 370095 - RNA, 22 nt, Human
aagggcugcaauccaaaacacu

SEQ ID NO: 370096 - RNA, 22 nt, Human
auggccuuagugaugauuaaua

SEQ ID NO: 370097 - RNA, 22 nt, Human
aaaggccaagcaugagguggac

SEQ ID NO: 370098 - RNA, 22 nt, Human
auacagaacucucaguuguaua

SEQ ID NO: 370099 - RNA, 22 nt, Human
aguggcaguggggcagggcccu

SEQ ID NO: 370100 - RNA, 22 nt, Human
augaugugugcugaucaagcuu

SEQ ID NO: 370101 - RNA, 20 nt, Human
aagaaacuugaaaguacaag

SEQ ID NO: 370102 - RNA, 22 nt, Human
agcacaauagagcaguuaaaaa

SEQ ID NO: 370103 - RNA, 22 nt, Human
cacaggcuuccaguccccagcu

SEQ ID NO: 370104 - RNA, 22 nt, Human
ggagaggguguggaaaguuauc

SEQ ID NO: 370105 - RNA, 22 nt, Human
ccagcuuuccaggguugacugg

SEQ ID NO: 370106 - RNA, 22 nt, Human
uguguauuucuggaacagacua

SEQ ID NO: 370107 - RNA, 22 nt, Human
uggcucugugucucccagcagc

SEQ ID NO: 370108 - RNA, 22 nt, Human
guggaauguccuugaucauaag

SEQ ID NO: 370109 - RNA, 19 nt, Human
ggaggccuggguauuugcc

SEQ ID NO: 370110 - RNA, 22 nt, Human
uguucuuuggcuucacagcucu

SEQ ID NO: 370111 - RNA, 22 nt, Human
ggggccagcaauguugaggaau

SEQ ID NO: 370112 - RNA, 22 nt, Human
ccacacugaaccucagugucuu

SEQ ID NO: 370113 - RNA, 22 nt, Human
agugggguccucaguaugguuc

SEQ ID NO: 370114 - RNA, 22 nt, Human
uugcauuuuuagaugcuucugu

SEQ ID NO: 370115 - RNA, 22 nt, Human
gccugccugcugugugcaaguu

SEQ ID NO: 370116 - RNA, 22 nt, Human
guauacagauacuuagacgugc

SEQ ID NO: 370117 - RNA, 22 nt, Human
ggagugacucucggggccacua

SEQ ID NO: 370118 - RNA, 22 nt, Human
ugcugaggagguggcugugcuu

SEQ ID NO: 370119 - RNA, 22 nt, Human
agagugaucagauaucaggugu

SEQ ID NO: 370120 - RNA, 22 nt, Human
agucuucucauuucacaugcuu

SEQ ID NO: 370121 - RNA, 22 nt, Human
cuuaauuacccaaugugguagg

SEQ ID NO: 370122 - RNA, 22 nt, Human
ugugugccugagccgugccugg

SEQ ID NO: 370123 - RNA, 22 nt, Human
gucaggcugccagucuuuauug

SEQ ID NO: 370124 - RNA, 22 nt, Human
ucaucucaaaacccaaggggca

SEQ ID NO: 370125 - RNA, 22 nt, Human
cauuagggccaccauaacaaaa

SEQ ID NO: 370126 - RNA, 22 nt, Human
gcaaauauucaagacuuuucca

SEQ ID NO: 370127 - RNA, 23 nt, Human
uggagcugacagucagagggagg

SEQ ID NO: 370128 - RNA, 22 nt, Human
auauuauucuaguaacagugau

SEQ ID NO: 370129 - RNA, 22 nt, Human
ucaacacuauccaggcaaucuu

SEQ ID NO: 370130 - RNA, 22 nt, Human
gugguaauuuaauccuacacug

SEQ ID NO: 370131 - RNA, 22 nt, Human
uuuugcuugagugcacaaaaug

SEQ ID NO: 370132 - RNA, 22 nt, Human
gcauuuaaauuugaacuucaga

SEQ ID NO: 370133 - RNA, 22 nt, Human
auaauaacaccugaauaggaaa

SEQ ID NO: 370134 - RNA, 22 nt, Human
ccagggcaugggaagaacugaa

SEQ ID NO: 370135 - RNA, 22 nt, Human
uggcagaguuauggguauuuau

SEQ ID NO: 370136 - RNA, 22 nt, Human
uguguguauaugcauuuaucua

SEQ ID NO: 370137 - RNA, 22 nt, Human
uccucccacauaggacaauggg

SEQ ID NO: 370138 - RNA, 22 nt, Human
gaggagaggcuggacgcgguga

SEQ ID NO: 370139 - RNA, 22 nt, Human
cccugcaguccuuucuuggcuc

SEQ ID NO: 370140 - RNA, 22 nt, Human
cagccucuaagcacagccucuc

SEQ ID NO: 370141 - RNA, 22 nt, Human
ccagcccuugagauggaaggga

SEQ ID NO: 370142 - RNA, 22 nt, Human
cugcuuugaaaauaaacuuguc

SEQ ID NO: 370143 - RNA, 22 nt, Human
uccauucauucauugaugaaca

SEQ ID NO: 370144 - RNA, 17 nt, Human
gccaaaggguuccaauc

SEQ ID NO: 370145 - RNA, 22 nt, Human
ucucugagcugcuucuugcaua

SEQ ID NO: 370146 - RNA, 22 nt, Human
uggaggcagucaaaugacugac

SEQ ID NO: 370147 - RNA, 22 nt, Human
uucuuguauguaugcaaaauca

SEQ ID NO: 370148 - RNA, 22 nt, Human
gagagugaggccugggaaucua

SEQ ID NO: 370149 - RNA, 22 nt, Human
aagggcuccaagagguagcugg

SEQ ID NO: 370150 - RNA, 22 nt, Human
uggcacuggaaucguagccuug

SEQ ID NO: 370151 - RNA, 22 nt, Human
cgcagaagagguugucuagucc

SEQ ID NO: 370152 - RNA, 22 nt, Human
uguauuaacauuaauaaaaugg

SEQ ID NO: 370153 - RNA, 21 nt, Human
cucacaggaugcaguguuacu

SEQ ID NO: 370154 - RNA, 22 nt, Human
auuuucaucauggguuuaacau

SEQ ID NO: 370155 - RNA, 19 nt, Human
uuggaaggagccagagugg

SEQ ID NO: 370156 - RNA, 22 nt, Human
uccaggaguccugggagugauu

SEQ ID NO: 370157 - RNA, 22 nt, Human
cugggacagcugagacaggaga

SEQ ID NO: 370158 - RNA, 22 nt, Human
aaggcagagggcuggaucagag

SEQ ID NO: 370159 - RNA, 22 nt, Human
uggcagggccugaaucuuauac

SEQ ID NO: 370160 - RNA, 20 nt, Human
cagaaggucuaagcuuuaga

SEQ ID NO: 370161 - RNA, 22 nt, Human
ggcugagggccagggcuagucu

SEQ ID NO: 370162 - RNA, 22 nt, Human
gcugccaguaguuggagcucca

SEQ ID NO: 370163 - RNA, 22 nt, Human
uucucuuugacauuauucaggu

SEQ ID NO: 370164 - RNA, 22 nt, Human
cagagccaaaugcugugguuau

SEQ ID NO: 370165 - RNA, 22 nt, Human
gagacaggauuuaaccaaagcu

SEQ ID NO: 370166 - RNA, 22 nt, Human
uggaaggagcuaaggaccuggg

SEQ ID NO: 370167 - RNA, 22 nt, Human
uggcugagggggcaguucagga

SEQ ID NO: 370168 - RNA, 22 nt, Human
ugcagguaggccugacuuccag

SEQ ID NO: 370169 - RNA, 21 nt, Human
guuuuaagggagaaaaccuag

SEQ ID NO: 370170 - RNA, 22 nt, Human
caggcccauucuaggcuugcua

SEQ ID NO: 370171 - RNA, 22 nt, Human
agggcuccgggccaccggccug

SEQ ID NO: 370172 - RNA, 22 nt, Human
uaauuuaauccaaguguuacau

SEQ ID NO: 370173 - RNA, 22 nt, Human
aaauacuguugaaugaaguaag

SEQ ID NO: 370174 - RNA, 22 nt, Human
uugucuguaaagacggccacca

SEQ ID NO: 370175 - RNA, 22 nt, Human
aacagaauaguugauguacagu

SEQ ID NO: 370176 - RNA, 22 nt, Human
ugggagcucagaaagggagguc

SEQ ID NO: 370177 - RNA, 21 nt, Human
caaagccaggcaacucucucc

SEQ ID NO: 370178 - RNA, 22 nt, Human
ucauugcacuccagccugggca

SEQ ID NO: 370179 - RNA, 22 nt, Human
acccaggcugcuucucaguggc

SEQ ID NO: 370180 - RNA, 21 nt, Human
uagagaaaagaagcuguuccu

SEQ ID NO: 370181 - RNA, 22 nt, Human
aggucauuguuaagucaccaua

SEQ ID NO: 370182 - RNA, 19 nt, Human
agguggucuaggcuggaga

SEQ ID NO: 370183 - RNA, 22 nt, Human
ucagagaggauuuuaauaagug

SEQ ID NO: 370184 - RNA, 22 nt, Human
gggcaggucugggucagccuga

SEQ ID NO: 370185 - RNA, 22 nt, Human
ugaauaauuccuuuuugucaag

SEQ ID NO: 370186 - RNA, 22 nt, Human
ucugagaggauuccugucccga

SEQ ID NO: 370187 - RNA, 22 nt, Human
gcugggagugggcaagaugaga

SEQ ID NO: 370188 - RNA, 22 nt, Human
gcugugcaguaguagguacagu

SEQ ID NO: 370189 - RNA, 22 nt, Human
auguagcaucuauccugauaaa

SEQ ID NO: 370190 - RNA, 22 nt, Human
ccugagugaauucccucacugu

SEQ ID NO: 370191 - RNA, 22 nt, Human
acucagaagauauaaugacuca

SEQ ID NO: 370192 - RNA, 22 nt, Human
cccagcagugacccagugauac

SEQ ID NO: 370193 - RNA, 22 nt, Human
aguucacugcuuaagccuuuga

SEQ ID NO: 370194 - RNA, 19 nt, Human
ccagguggaacugagguag

SEQ ID NO: 370195 - RNA, 22 nt, Human
gaauauuuuuaaagggacuaau

SEQ ID NO: 370196 - RNA, 22 nt, Human
aggaugaauaacugaaauggug

SEQ ID NO: 370197 - RNA, 22 nt, Human
ucaggagauguaaccuuagcug

SEQ ID NO: 370198 - RNA, 22 nt, Human
uaucaaaggcuaugugauuuuu

SEQ ID NO: 370199 - RNA, 22 nt, Human
aggagaaagacuggacagccaa

SEQ ID NO: 370200 - RNA, 22 nt, Human
ccagccugguucagaauuggcu

SEQ ID NO: 370201 - RNA, 22 nt, Human
aauuuccagaucagaugacuca

SEQ ID NO: 370202 - RNA, 22 nt, Human
cuaacuuuagcuuagauuauca

SEQ ID NO: 370203 - RNA, 22 nt, Human
acauuucucagguaagucauuu

SEQ ID NO: 370204 - RNA, 22 nt, Human
uuuacauuucccucugucaguu

SEQ ID NO: 370205 - RNA, 22 nt, Human
aagcaccucuaugauugcuuuu

SEQ ID NO: 370206 - RNA, 22 nt, Human
ucggagcuguagaugaaacccu

SEQ ID NO: 370207 - RNA, 22 nt, Human
cuauuauuagauaaucuacuug

SEQ ID NO: 370208 - RNA, 22 nt, Human
cccagggucccugcucucugug

SEQ ID NO: 370209 - RNA, 22 nt, Human
cagaugaggcaaccucauugcu

SEQ ID NO: 370210 - RNA, 22 nt, Human
ucagcccugaggacagaggcag

SEQ ID NO: 370211 - RNA, 22 nt, Human
gaucagaauuuacuuauaauug

SEQ ID NO: 370212 - RNA, 22 nt, Human
uacccagcccaugccuaccuca

SEQ ID NO: 370213 - RNA, 22 nt, Human
cauuagggacugaggaauaagg

SEQ ID NO: 370214 - RNA, 22 nt, Human
agcagagcuauucuugugcaau

SEQ ID NO: 370215 - RNA, 20 nt, Human
ugcuguaagauuagagagcu

SEQ ID NO: 370216 - RNA, 22 nt, Human
ccucccacauugaggacaugcu

SEQ ID NO: 370217 - RNA, 22 nt, Human
aagugaguggccuggagaggug

SEQ ID NO: 370218 - RNA, 19 nt, Human
agcagccauagacaauaug

SEQ ID NO: 370219 - RNA, 22 nt, Human
uaagaaucaguagauauagauu

SEQ ID NO: 370220 - RNA, 22 nt, Human
gcacagggcugccaggcggcuu

SEQ ID NO: 370221 - RNA, 22 nt, Human
agaucacaguggcaacucccuu

SEQ ID NO: 370222 - RNA, 22 nt, Human
cugggugguuuugaugugaauu

SEQ ID NO: 370223 - RNA, 22 nt, Human
cccagccucuguuugcuccucu

SEQ ID NO: 370224 - RNA, 21 nt, Human
agugaaauugcaucagaggga

SEQ ID NO: 370225 - RNA, 22 nt, Human
ucaggagagaaagaauacaauu

SEQ ID NO: 370226 - RNA, 22 nt, Human
uuccagcuaacucacaucccuu

SEQ ID NO: 370227 - RNA, 22 nt, Human
ucagccaggccaccuucagcuu

SEQ ID NO: 370228 - RNA, 22 nt, Human
ugggccugggcuccuguccucu

SEQ ID NO: 370229 - RNA, 22 nt, Human
cagucccagcugcucagaaggc

SEQ ID NO: 370230 - RNA, 22 nt, Human
ucaugaauauugaaugcuucau

SEQ ID NO: 370231 - RNA, 22 nt, Human
gagguacagaguguuccaaugu

SEQ ID NO: 370232 - RNA, 22 nt, Human
gaagagcugacagugucauccu

SEQ ID NO: 370233 - RNA, 22 nt, Human
gcuguggcugaccaccaggggg

SEQ ID NO: 370234 - RNA, 18 nt, Human
gcuccuggaccaggucac

SEQ ID NO: 370235 - RNA, 22 nt, Human
gagauuucuuuugaugccuguc

SEQ ID NO: 370236 - RNA, 22 nt, Human
gugccucagcaccgccugcagc

SEQ ID NO: 370237 - RNA, 22 nt, Human
acaugucaauuuaguacucuua

SEQ ID NO: 370238 - RNA, 22 nt, Human
ugaauggucacugagcaucugu

SEQ ID NO: 370239 - RNA, 22 nt, Human
uaugaagauauaucugaucucu

SEQ ID NO: 370240 - RNA, 22 nt, Human
cauugcucaggcccagcaggaa

SEQ ID NO: 370241 - RNA, 22 nt, Human
aaagcucuuauagcagagugug

SEQ ID NO: 370242 - RNA, 22 nt, Human
gaucauuuugaugcccuuuuag

SEQ ID NO: 370243 - RNA, 22 nt, Human
guguguuucagaagccaggugu

SEQ ID NO: 370244 - RNA, 22 nt, Human
uguuuuauuucuccaagaggga

SEQ ID NO: 370245 - RNA, 22 nt, Human
guuugcauguguacuuaauugg

SEQ ID NO: 370246 - RNA, 22 nt, Human
uaauuuacuugcaaauaacaau

SEQ ID NO: 370247 - RNA, 22 nt, Human
ucaauucaauugaacaguuacu

SEQ ID NO: 370248 - RNA, 22 nt, Human
cucaggauucucgacacucaca

SEQ ID NO: 370249 - RNA, 22 nt, Human
auuucuacugugagaaacauga

SEQ ID NO: 370250 - RNA, 22 nt, Human
cagaagaaaguggggagacaag

SEQ ID NO: 370251 - RNA, 22 nt, Human
aaauccuaccaagaaauucccu

SEQ ID NO: 370252 - RNA, 22 nt, Human
caccaggcugcccaggacaggg

SEQ ID NO: 370253 - RNA, 22 nt, Human
ugaguccauguggaggggaggu

SEQ ID NO: 370254 - RNA, 22 nt, Human
ucccacuggacgucugugcugg

SEQ ID NO: 370255 - RNA, 22 nt, Human
ccagcagggcagugcccuggac

SEQ ID NO: 370256 - RNA, 22 nt, Human
aaccaggacaauuugaauagaa

SEQ ID NO: 370257 - RNA, 22 nt, Human
auggcuuuccugggacaugggc

SEQ ID NO: 370258 - RNA, 22 nt, Human
cagcugagaccagaaugcaggu

SEQ ID NO: 370259 - RNA, 22 nt, Human
agcugaggcucugagagggaag

SEQ ID NO: 370260 - RNA, 22 nt, Human
ugccugucuccucugcagggug

SEQ ID NO: 370261 - RNA, 22 nt, Human
gcucugagccgggggccugucc

SEQ ID NO: 370262 - RNA, 22 nt, Human
gccagcagccacagaagucacu

SEQ ID NO: 370263 - RNA, 22 nt, Human
cccugcagaucuaggguccuuc

SEQ ID NO: 370264 - RNA, 22 nt, Human
uacccaggggcugagcagaggu

SEQ ID NO: 370265 - RNA, 22 nt, Human
uccucagggaagaugagccuca

SEQ ID NO: 370266 - RNA, 22 nt, Human
agagccaggaaguggcgugggg

SEQ ID NO: 370267 - RNA, 22 nt, Human
caggaggcuccuagggcucugu

SEQ ID NO: 370268 - RNA, 22 nt, Human
cagcagagcauuugguaggagg

SEQ ID NO: 370269 - RNA, 22 nt, Human
ugcucacagcccagaacauaau

SEQ ID NO: 370270 - RNA, 22 nt, Human
ucagugcagaauagugaugcau

SEQ ID NO: 370271 - RNA, 22 nt, Human
aacagcaauagcacuauucauu

SEQ ID NO: 370272 - RNA, 22 nt, Human
gagaggccaccugacgagcagu

SEQ ID NO: 370273 - RNA, 22 nt, Human
uguaggauuuucaccagaccuu

SEQ ID NO: 370274 - RNA, 20 nt, Human
uucuuucaucuacacguugu

SEQ ID NO: 370275 - RNA, 22 nt, Human
cucugggcaaguaugauagaaa

SEQ ID NO: 370276 - RNA, 22 nt, Human
cagauuuaagagauaaacagug

SEQ ID NO: 370277 - RNA, 22 nt, Human
cagcugugcugauugcucagua

SEQ ID NO: 370278 - RNA, 22 nt, Human
aagcagcuggaagaguaagaug

SEQ ID NO: 370279 - RNA, 22 nt, Human
uuccucuuucucugugcuaugu

SEQ ID NO: 370280 - RNA, 22 nt, Human
gccugcagacguguuuuccuca

SEQ ID NO: 370281 - RNA, 22 nt, Human
gccucuggggcagcugagucau

SEQ ID NO: 370282 - RNA, 22 nt, Human
cagcccuggugccaagguuccc

SEQ ID NO: 370283 - RNA, 22 nt, Human
ugauacagucagcucacaauug

SEQ ID NO: 370284 - RNA, 20 nt, Human
agggucaguagcacagagcu

SEQ ID NO: 370285 - RNA, 22 nt, Human
auuuaucaccaguuagcugacu

SEQ ID NO: 370286 - RNA, 22 nt, Human
cacugcagcaccaugcagggcu

SEQ ID NO: 370287 - RNA, 22 nt, Human
guguuuccuaguuuaaugaaug

SEQ ID NO: 370288 - RNA, 22 nt, Human
ugaggcagggagaguggauaug

SEQ ID NO: 370289 - RNA, 22 nt, Human
aguaauaauuuauauuagggag

SEQ ID NO: 370290 - RNA, 22 nt, Human
gaaggaaaaauacucuguaagg

SEQ ID NO: 370291 - RNA, 18 nt, Human
ucagagagaauaguaauu

SEQ ID NO: 370292 - RNA, 22 nt, Human
aaguuucaaauauaaaauuaca

SEQ ID NO: 370293 - RNA, 22 nt, Human
gggaccugccaaggccacccag

SEQ ID NO: 370294 - RNA, 22 nt, Human
cuggcugcaggaugaggcugcc

SEQ ID NO: 370295 - RNA, 19 nt, Human
gcccugcaggagguggggc

SEQ ID NO: 370296 - RNA, 22 nt, Human
gagcugcuucugugugccgggu

SEQ ID NO: 370297 - RNA, 22 nt, Human
acuguucauuuguccuguaucu

SEQ ID NO: 370298 - RNA, 22 nt, Human
aauacagaggggucacaauuca

SEQ ID NO: 370299 - RNA, 18 nt, Human
aggcacuggaauuaaggg

SEQ ID NO: 370300 - RNA, 22 nt, Human
uuaaaguucauuaaaugagcca

SEQ ID NO: 370301 - RNA, 22 nt, Human
ucaaguuucucucagauuaugg

SEQ ID NO: 370302 - RNA, 22 nt, Human
cagggccacacggaagggaaca

SEQ ID NO: 370303 - RNA, 22 nt, Human
cacauauuguaguucaccagga

SEQ ID NO: 370304 - RNA, 22 nt, Human
aggggcugccuggcuuggcacu

SEQ ID NO: 370305 - RNA, 22 nt, Human
uaaacauuuguuauucuuguuu

SEQ ID NO: 370306 - RNA, 22 nt, Human
aagcgccaugguuccugcgcag

SEQ ID NO: 370307 - RNA, 22 nt, Human
cuggggcugcggacgggagccc

SEQ ID NO: 370308 - RNA, 22 nt, Human
uauggaaaaauguaucuuguca

SEQ ID NO: 370309 - RNA, 22 nt, Human
cauuucaaaagaauugccagaa

SEQ ID NO: 370310 - RNA, 22 nt, Human
aaagcagagguugcagugagcu

SEQ ID NO: 370311 - RNA, 22 nt, Human
aaagucaucuaggagcagauuu

SEQ ID NO: 370312 - RNA, 22 nt, Human
ccaggaagccucagaugcugag

SEQ ID NO: 370313 - RNA, 22 nt, Human
agggccugggguagcuuacugc

SEQ ID NO: 370314 - RNA, 22 nt, Human
ggcugcucuucuuggcgaccuc

SEQ ID NO: 370315 - RNA, 22 nt, Human
cagaggccuuucuacagugaua

SEQ ID NO: 370316 - RNA, 22 nt, Human
agcaugaaaggcgugccaacuu

SEQ ID NO: 370317 - RNA, 22 nt, Human
ggcuuggaaaugguaaugagcu

SEQ ID NO: 370318 - RNA, 22 nt, Human
gggaauuauagcugucacaggc

SEQ ID NO: 370319 - RNA, 23 nt, Human
cagguggcuccacgagggguggg

SEQ ID NO: 370320 - RNA, 22 nt, Human
acuggcagagguuggacaccau

SEQ ID NO: 370321 - RNA, 22 nt, Human
gggaggaaggcuugggugagua

SEQ ID NO: 370322 - RNA, 22 nt, Human
uacaugcucaguaacuuucagu

SEQ ID NO: 370323 - RNA, 22 nt, Human
agcccugggaggccagcuugua

SEQ ID NO: 370324 - RNA, 22 nt, Human
agcuguggaagacugucagggu

SEQ ID NO: 370325 - RNA, 22 nt, Human
caugaagcuugaagcaguccac

SEQ ID NO: 370326 - RNA, 22 nt, Human
cggcuggugucgggcacagcaa

SEQ ID NO: 370327 - RNA, 17 nt, Human
acagagcacaucaagau

SEQ ID NO: 370328 - RNA, 22 nt, Human
acacagggucuagaguuaggcc

SEQ ID NO: 370329 - RNA, 22 nt, Human
caggccugggcuucggggcuga

SEQ ID NO: 370330 - RNA, 22 nt, Human
gcucugggcugcccucuggaca

SEQ ID NO: 370331 - RNA, 22 nt, Human
ucuucuuccucauuuauacaua

SEQ ID NO: 370332 - RNA, 22 nt, Human
uuuuauagcugaauaguauucc

SEQ ID NO: 370333 - RNA, 22 nt, Human
acagaguagcucaagaagauug

SEQ ID NO: 370334 - RNA, 22 nt, Human
agggcagagaucugagugggca

SEQ ID NO: 370335 - RNA, 22 nt, Human
uuaaggauguugugauuuauua

SEQ ID NO: 370336 - RNA, 22 nt, Human
agucugucugucacuucugcag

SEQ ID NO: 370337 - RNA, 22 nt, Human
agaggagguccuuuucugaugu

SEQ ID NO: 370338 - RNA, 19 nt, Human
gcacacccugcaccaccau

SEQ ID NO: 370339 - RNA, 22 nt, Human
uacagagacuuuauggcacaaa

SEQ ID NO: 370340 - RNA, 22 nt, Human
agcagggcagugcuucagcucu

SEQ ID NO: 370341 - RNA, 22 nt, Human
gcauggcagugaggauggugcu

SEQ ID NO: 370342 - RNA, 22 nt, Human
augaagcugguuuuggcuuggg

SEQ ID NO: 370343 - RNA, 23 nt, Human
cgcccagccucagugaccugggc

SEQ ID NO: 370344 - RNA, 22 nt, Human
gcugcucucucccuaaguuggg

SEQ ID NO: 370345 - RNA, 22 nt, Human
aacaucagaauauccauguugg

SEQ ID NO: 370346 - RNA, 22 nt, Human
cuccagaagacccauccucaug

SEQ ID NO: 370347 - RNA, 22 nt, Human
ggggcuccagucuucacauuuu

SEQ ID NO: 370348 - RNA, 22 nt, Human
ugccaggcccucccacagauua

SEQ ID NO: 370349 - RNA, 22 nt, Human
uacaaaguuugggguccucaaa

SEQ ID NO: 370350 - RNA, 22 nt, Human
aacaugaaaguugcuaagugca

SEQ ID NO: 370351 - RNA, 22 nt, Human
agaaauacuaggaauauucaua

SEQ ID NO: 370352 - RNA, 22 nt, Human
cagauuucuauuucaaauacau

SEQ ID NO: 370353 - RNA, 22 nt, Human
gcuggggagggcgucaaggcca

SEQ ID NO: 370354 - RNA, 22 nt, Human
agggcuccuccccggccuccac

SEQ ID NO: 370355 - RNA, 22 nt, Human
aggcugccuguuccaaucuccu

SEQ ID NO: 370356 - RNA, 22 nt, Human
aggcagagaaaaaccagauaug

SEQ ID NO: 370357 - RNA, 22 nt, Human
ggagcuggcuacagagaacucc

SEQ ID NO: 370358 - RNA, 20 nt, Human
uauggcuuggcaaagcuuca

SEQ ID NO: 370359 - RNA, 22 nt, Human
aggcuggagggcaauggcaaga

SEQ ID NO: 370360 - RNA, 22 nt, Human
uggcucugccacuaacuuggua

SEQ ID NO: 370361 - RNA, 22 nt, Human
aacaggagaguaaauauaugau

SEQ ID NO: 370362 - RNA, 22 nt, Human
auacagaacaagccucaccucc

SEQ ID NO: 370363 - RNA, 22 nt, Human
ucacaacuugaagcugauuuaa

SEQ ID NO: 370364 - RNA, 20 nt, Human
ggggcugcaugcagagaaga

SEQ ID NO: 370365 - RNA, 22 nt, Human
ugcagggccagacuggguugga

SEQ ID NO: 370366 - RNA, 16 nt, Human
aggcagagauuuaccc

SEQ ID NO: 370367 - RNA, 21 nt, Human
ugccagggauuuacagagccu

SEQ ID NO: 370368 - RNA, 22 nt, Human
uggcucaguuaggucagaaaca

SEQ ID NO: 370369 - RNA, 22 nt, Human
agagccuggaccugagcuacaa

SEQ ID NO: 370370 - RNA, 22 nt, Human
cagggcagcuuccuuuguuagg

SEQ ID NO: 370371 - RNA, 22 nt, Human
ucagaaauacaaaacacuuacu

SEQ ID NO: 370372 - RNA, 22 nt, Human
ugaugaaaauaugauucugagg

SEQ ID NO: 370373 - RNA, 22 nt, Human
caaaguuaugaaugauaagauu

SEQ ID NO: 370374 - RNA, 22 nt, Human
agucaacaaaaauguggagccu

SEQ ID NO: 370375 - RNA, 22 nt, Human
ucaaguguaguggugucagguc

SEQ ID NO: 370376 - RNA, 22 nt, Human
aguguuccugcucucaggaagc

SEQ ID NO: 370377 - RNA, 22 nt, Human
caggaagagaacauggaggcug

SEQ ID NO: 370378 - RNA, 22 nt, Human
aagaacaguguccugggacucg

SEQ ID NO: 370379 - RNA, 21 nt, Human
gagccuucccucugcccuuuc

SEQ ID NO: 370380 - RNA, 22 nt, Human
uccugguggugccagcugcagg

SEQ ID NO: 370381 - RNA, 22 nt, Human
uuuaaaaucagaugggaguugg

SEQ ID NO: 370382 - RNA, 22 nt, Human
ccuggacucaggcugugggcac

SEQ ID NO: 370383 - RNA, 22 nt, Human
gccugcuggcuguccauugcag

SEQ ID NO: 370384 - RNA, 22 nt, Human
acagaaauauucguggugcuug

SEQ ID NO: 370385 - RNA, 22 nt, Human
uugcagagaucagcagguuuga

SEQ ID NO: 370386 - RNA, 22 nt, Human
uauacaaugaguacauucuggg

SEQ ID NO: 370387 - RNA, 22 nt, Human
cuuacauugucuuaguuuucaa

SEQ ID NO: 370388 - RNA, 22 nt, Human
gggcuaggcuuggccagcacug

SEQ ID NO: 370389 - RNA, 22 nt, Human
cugggagcccugacuagccugg

SEQ ID NO: 370390 - RNA, 22 nt, Human
cuagaaaugcucaagagaaagu

SEQ ID NO: 370391 - RNA, 22 nt, Human
uuccucagccagcacuuagggg

SEQ ID NO: 370392 - RNA, 22 nt, Human
ggcugcagagcugggugggccu

SEQ ID NO: 370393 - RNA, 22 nt, Human
uuugcaaauauguguuucuauu

SEQ ID NO: 370394 - RNA, 22 nt, Human
ggaggcagaauagagugugggu

SEQ ID NO: 370395 - RNA, 22 nt, Human
auuucaggauagccuaguuuug

SEQ ID NO: 370396 - RNA, 22 nt, Human
agaagauuuagguugacgcuau

SEQ ID NO: 370397 - RNA, 22 nt, Human
cugccucucagccugaccgcca

SEQ ID NO: 370398 - RNA, 22 nt, Human
caggaguggugugagggacucc

SEQ ID NO: 370399 - RNA, 22 nt, Human
uccaggcaaaaaccaacuacag

SEQ ID NO: 370400 - RNA, 22 nt, Human
ggcugcaggcaggguauccacu

SEQ ID NO: 370401 - RNA, 22 nt, Human
ucugccuguucaagucuucuag

SEQ ID NO: 370402 - RNA, 22 nt, Human
aaggaagagucuagaacaggca

SEQ ID NO: 370403 - RNA, 22 nt, Human
gcagcugagagaagaacagggc

SEQ ID NO: 370404 - RNA, 22 nt, Human
aaacuucauggauaauauaaag

SEQ ID NO: 370405 - RNA, 22 nt, Human
ccagggugagaaaaggcuggau

SEQ ID NO: 370406 - RNA, 22 nt, Human
ggcuggaaguccaagaucaagg

SEQ ID NO: 370407 - RNA, 22 nt, Human
agccaccaccacugaaagguua

SEQ ID NO: 370408 - RNA, 22 nt, Human
gguuucaacuaaaucaagaagg

SEQ ID NO: 370409 - RNA, 22 nt, Human
agucaccaacaugguucccagg

SEQ ID NO: 370410 - RNA, 22 nt, Human
gacauaauaaucugaccuagau

SEQ ID NO: 370411 - RNA, 22 nt, Human
agaaaugggccuugggacacaa

SEQ ID NO: 370412 - RNA, 22 nt, Human
ucuggccuuaucuguccaagcc

SEQ ID NO: 370413 - RNA, 22 nt, Human
aaguugaaugcguacgugacau

SEQ ID NO: 370414 - RNA, 22 nt, Human
cuccucuggcuuccuggaggca

SEQ ID NO: 370415 - RNA, 22 nt, Human
cuguacaucucugaggacagua

SEQ ID NO: 370416 - RNA, 22 nt, Human
aaaugugugcacaaagacagcu

SEQ ID NO: 370417 - RNA, 22 nt, Human
aggcccugcuuuccagagcuca

SEQ ID NO: 370418 - RNA, 22 nt, Human
aacucuauuuacccuacuaaac

SEQ ID NO: 370419 - RNA, 18 nt, Human
cccacggugcuguagggc

SEQ ID NO: 370420 - RNA, 22 nt, Human
ugccacacauugucagguuagu

SEQ ID NO: 370421 - RNA, 22 nt, Human
gagguagcaugcuggaagggac

SEQ ID NO: 370422 - RNA, 22 nt, Human
uugaagcauuguggcuuguauu

SEQ ID NO: 370423 - RNA, 22 nt, Human
cuggcagcccaaccuagagucu

SEQ ID NO: 370424 - RNA, 22 nt, Human
acuguucauuuggauuucucug

SEQ ID NO: 370425 - RNA, 22 nt, Human
ugcuggaggcaguggaggugcc

SEQ ID NO: 370426 - RNA, 22 nt, Human
uucagauguggcuuugucaggc

SEQ ID NO: 370427 - RNA, 22 nt, Human
uggcucuguuuuaugaguacca

SEQ ID NO: 370428 - RNA, 22 nt, Human
agaauucugacaauagaauugg

SEQ ID NO: 370429 - RNA, 22 nt, Human
aaagaaucuauauaucaccacc

SEQ ID NO: 370430 - RNA, 22 nt, Human
agcuggagaaaccugggagggu

SEQ ID NO: 370431 - RNA, 22 nt, Human
ucaggggcugugcauuucccag

SEQ ID NO: 370432 - RNA, 22 nt, Human
ggaugggagcagaggacgacca

SEQ ID NO: 370433 - RNA, 22 nt, Human
uauugaaauccauuacguucuu

SEQ ID NO: 370434 - RNA, 19 nt, Human
aggcucugagcuccuggag

SEQ ID NO: 370435 - RNA, 22 nt, Human
gggagucugggcuagacuccuu

SEQ ID NO: 370436 - RNA, 22 nt, Human
gaaaggccagcucacagaugag

SEQ ID NO: 370437 - RNA, 17 nt, Human
ugagcaguagaagaugc

SEQ ID NO: 370438 - RNA, 22 nt, Human
gaagcccagggcguggccgggc

SEQ ID NO: 370439 - RNA, 22 nt, Human
gaaccucagugaaacuggaggu

SEQ ID NO: 370440 - RNA, 22 nt, Human
ucucccagaggaucccagugga

SEQ ID NO: 370441 - RNA, 22 nt, Human
ucagcuuugggggucucaggag

SEQ ID NO: 370442 - RNA, 22 nt, Human
ugaauagauuuuuaacauauaa

SEQ ID NO: 370443 - RNA, 22 nt, Human
ccaggccuucugaggacacucu

SEQ ID NO: 370444 - RNA, 22 nt, Human
gucucagaguccuacuuauucc

SEQ ID NO: 370445 - RNA, 22 nt, Human
uggcagggucuugcuguguugc

SEQ ID NO: 370446 - RNA, 22 nt, Human
cuagggaguggcagagcuggga

SEQ ID NO: 370447 - RNA, 22 nt, Human
aagagcuggagcugcuacagga

SEQ ID NO: 370448 - RNA, 22 nt, Human
uccuuuccagccucaccucagc

SEQ ID NO: 370449 - RNA, 22 nt, Human
acucugugugaguagagccugu

SEQ ID NO: 370450 - RNA, 22 nt, Human
aguacauauaguaauuuagcca

SEQ ID NO: 370451 - RNA, 22 nt, Human
auguuucaccaguuuuauaaga

SEQ ID NO: 370452 - RNA, 18 nt, Human
cuggcuuucuuauccauc

SEQ ID NO: 370453 - RNA, 22 nt, Human
uggccucugggaaagcagauuc

SEQ ID NO: 370454 - RNA, 22 nt, Human
aguguggguuuuauggagcccu

SEQ ID NO: 370455 - RNA, 22 nt, Human
aaaugcagcagcuaauugaaaa

SEQ ID NO: 370456 - RNA, 22 nt, Human
uacaggaaguaaguaaugaaau

SEQ ID NO: 370457 - RNA, 22 nt, Human
ugaaaugagcauuuauucuuua

SEQ ID NO: 370458 - RNA, 22 nt, Human
aggcagguuucccggcugucaa

SEQ ID NO: 370459 - RNA, 22 nt, Human
acauguggucaaucuguguagg

SEQ ID NO: 370460 - RNA, 22 nt, Human
aaucauucuuauuucacagcaa

SEQ ID NO: 370461 - RNA, 22 nt, Human
uggccuggcccugaggcccugu

SEQ ID NO: 370462 - RNA, 22 nt, Human
aagcagaguccccuucccaugg

SEQ ID NO: 370463 - RNA, 22 nt, Human
uuaagacaguguauuuguuuuc

SEQ ID NO: 370464 - RNA, 22 nt, Human
cuaguggaaacuaacuggaauu

SEQ ID NO: 370465 - RNA, 22 nt, Human
aaagccagcucugagcugcacc

SEQ ID NO: 370466 - RNA, 22 nt, Human
aagcagccacuggccaguuaua

SEQ ID NO: 370467 - RNA, 22 nt, Human
gcaaagguagccaaggagcuca

SEQ ID NO: 370468 - RNA, 22 nt, Human
uuccagagcaguuuucagauca

SEQ ID NO: 370469 - RNA, 22 nt, Human
gauggcacacagacauccccgc

SEQ ID NO: 370470 - RNA, 22 nt, Human
aagaacauuuuguagaaugaca

SEQ ID NO: 370471 - RNA, 22 nt, Human
cugcagagcaaguaacauccuc

SEQ ID NO: 370472 - RNA, 22 nt, Human
aauucacaaaaguuagauccau

SEQ ID NO: 370473 - RNA, 22 nt, Human
cucucuguuaugcuuucaugaa

SEQ ID NO: 370474 - RNA, 22 nt, Human
ggccagaggccacagcuguguc

SEQ ID NO: 370475 - RNA, 22 nt, Human
augaaaauugacagcggaagua

SEQ ID NO: 370476 - RNA, 22 nt, Human
augagcuguaagguggcuuccu

SEQ ID NO: 370477 - RNA, 22 nt, Human
guccucugacucagccuuggga

SEQ ID NO: 370478 - RNA, 19 nt, Human
uggcagaggcaguuuguac

SEQ ID NO: 370479 - RNA, 22 nt, Human
ccagcugcgggcaucgagaguu

SEQ ID NO: 370480 - RNA, 22 nt, Human
ugucaccagcugcuccucagga

SEQ ID NO: 370481 - RNA, 22 nt, Human
guucaaagcuccugguacagua

SEQ ID NO: 370482 - RNA, 22 nt, Human
uuugcuauuuuucugugcagcu

SEQ ID NO: 370483 - RNA, 22 nt, Human
aggguaggaacugaguggaagg

SEQ ID NO: 370484 - RNA, 22 nt, Human
ugcccacaggaagacaccagcg

SEQ ID NO: 370485 - RNA, 22 nt, Human
ggagcggagggagggccacugu

SEQ ID NO: 370486 - RNA, 19 nt, Human
acccucucagugccugagg

SEQ ID NO: 370487 - RNA, 17 nt, Human
gcugcagcgguaggcag

SEQ ID NO: 370488 - RNA, 22 nt, Human
uacaagagguauauagaaacag

SEQ ID NO: 370489 - RNA, 22 nt, Human
auuaggcagugccauuguacgg

SEQ ID NO: 370490 - RNA, 22 nt, Human
ugcagugugaccuguagcgagc

SEQ ID NO: 370491 - RNA, 22 nt, Human
ucugccugccagucugguccuc

SEQ ID NO: 370492 - RNA, 22 nt, Human
ugggaguggggcauagaaggua

SEQ ID NO: 370493 - RNA, 22 nt, Human
ucagccagaggcuucuugguuu

SEQ ID NO: 370494 - RNA, 22 nt, Human
cucagagucccuucccucgugg

SEQ ID NO: 370495 - RNA, 22 nt, Human
aagaggaagucuccauggagag

SEQ ID NO: 370496 - RNA, 18 nt, Human
ugaauuaguuugugguuu

SEQ ID NO: 370497 - RNA, 22 nt, Human
ucugaaaguaucuggaucuuuu

SEQ ID NO: 370498 - RNA, 22 nt, Human
cagaacauucacucauaugugg

SEQ ID NO: 370499 - RNA, 23 nt, Human
gcugucaguuguuuuugucucua

SEQ ID NO: 370500 - RNA, 22 nt, Human
ucauugcaccccagucccagcu

SEQ ID NO: 370501 - RNA, 22 nt, Human
ggaggaguguggggcacucugc

SEQ ID NO: 370502 - RNA, 22 nt, Human
uggcccucagucuugcuccugc

SEQ ID NO: 370503 - RNA, 23 nt, Human
caguggagacucaugcuuccuua

SEQ ID NO: 370504 - RNA, 22 nt, Human
ucagggcacguuucugcaaugc

SEQ ID NO: 370505 - RNA, 22 nt, Human
agaaaacuugucacagcucuca

SEQ ID NO: 370506 - RNA, 22 nt, Human
ccagugcacagccaggcaggug

SEQ ID NO: 370507 - RNA, 22 nt, Human
uggccugggccggcagauauac

SEQ ID NO: 370508 - RNA, 22 nt, Human
gagggggcgugcaaggcuccgc

SEQ ID NO: 370509 - RNA, 22 nt, Human
cauuuccacuucugaaaacugg

SEQ ID NO: 370510 - RNA, 22 nt, Human
gcugguuuccuuaucuauaaag

SEQ ID NO: 370511 - RNA, 22 nt, Human
uuugaacuucuaccugucauau

SEQ ID NO: 370512 - RNA, 22 nt, Human
aauguguauaugaacauacagg

SEQ ID NO: 370513 - RNA, 20 nt, Human
aggaagccaaaggcugucuu

SEQ ID NO: 370514 - RNA, 19 nt, Human
ggcugucucggcccagcca

SEQ ID NO: 370515 - RNA, 22 nt, Human
agagcuggacgucugagcccua

SEQ ID NO: 370516 - RNA, 22 nt, Human
cuguggcugcagccuugguccu

SEQ ID NO: 370517 - RNA, 22 nt, Human
cugcaggaauucaaagugagcu

SEQ ID NO: 370518 - RNA, 22 nt, Human
uuuuccuucugauacuccauuu

SEQ ID NO: 370519 - RNA, 22 nt, Human
aaaugaacucuuccugcauccc

SEQ ID NO: 370520 - RNA, 22 nt, Human
uaucagaaacucuggggcaggg

SEQ ID NO: 370521 - RNA, 22 nt, Human
caucaguguggcaguucacugu

SEQ ID NO: 370522 - RNA, 22 nt, Human
gggaccugcgccacucacuguc

SEQ ID NO: 370523 - RNA, 22 nt, Human
gaaacugugaggaucuuaacuu

SEQ ID NO: 370524 - RNA, 22 nt, Human
ccaggcugcucacaagcugccc

SEQ ID NO: 370525 - RNA, 22 nt, Human
aggaagcuccuggagagccagu

SEQ ID NO: 370526 - RNA, 22 nt, Human
agggcugccugacuccagagcc

SEQ ID NO: 370527 - RNA, 22 nt, Human
agggcuggccacaugauuuggu

SEQ ID NO: 370528 - RNA, 19 nt, Human
uugaaauuguuugauaugg

SEQ ID NO: 370529 - RNA, 22 nt, Human
acacugcucacuucuucccuug

SEQ ID NO: 370530 - RNA, 22 nt, Human
aagaugauguuguguuuucacu

SEQ ID NO: 370531 - RNA, 22 nt, Human
uauuucaacguaugaaaagcug

SEQ ID NO: 370532 - RNA, 22 nt, Human
uauagaaguaagcauugugaug

SEQ ID NO: 370533 - RNA, 22 nt, Human
caaagucagcugccagucccaa

SEQ ID NO: 370534 - RNA, 22 nt, Human
aacuuuguguguuuaauauggc

SEQ ID NO: 370535 - RNA, 22 nt, Human
uaucuuuaacuugcaguauuua

SEQ ID NO: 370536 - RNA, 22 nt, Human
gguggcagaggugcaucagccc

SEQ ID NO: 370537 - RNA, 22 nt, Human
ugaaaaggagccuuagguaggu

SEQ ID NO: 370538 - RNA, 22 nt, Human
ugcuucuggaaacaguggcugu

SEQ ID NO: 370539 - RNA, 22 nt, Human
uuuauaaaauagacugggucua

SEQ ID NO: 370540 - RNA, 22 nt, Human
cccagcagccagaaugaggagc

SEQ ID NO: 370541 - RNA, 21 nt, Human
aaacugaccuugccugagaca

SEQ ID NO: 370542 - RNA, 23 nt, Human
gccagccuugcucuccugcagcc

SEQ ID NO: 370543 - RNA, 23 nt, Human
uaauacugcuucagaggcuuaga

SEQ ID NO: 370544 - RNA, 23 nt, Human
gcaggugguucgaacagaaguuu

SEQ ID NO: 370545 - RNA, 23 nt, Human
agcuucauugaccuccgcagggg

SEQ ID NO: 370546 - RNA, 22 nt, Human
ugcagggcuauaacuccauucu

SEQ ID NO: 370547 - RNA, 22 nt, Human
gaguccuucuggcuggcaggau

SEQ ID NO: 370548 - RNA, 22 nt, Human
uuugcauuuguucaaguauuga

SEQ ID NO: 370549 - RNA, 23 nt, Human
aggagaagagauuuccacaugca

SEQ ID NO: 370550 - RNA, 22 nt, Human
agggcagccugagugcuggccc

SEQ ID NO: 370551 - RNA, 22 nt, Human
ucugcucagugcuuaucucuaa

SEQ ID NO: 370552 - RNA, 22 nt, Human
aguacagaccugucucuuccug

SEQ ID NO: 370553 - RNA, 23 nt, Human
cccuggagcuagucugagcagag

SEQ ID NO: 370554 - RNA, 22 nt, Human
cagcugcaggaacaaaaaugug

SEQ ID NO: 370555 - RNA, 22 nt, Human
uuuuauguuccucuuuaugcga

SEQ ID NO: 370556 - RNA, 22 nt, Human
gagauggggaauaggagcaagc

SEQ ID NO: 370557 - RNA, 22 nt, Human
gcugcccugucugcagcaggac

SEQ ID NO: 370558 - RNA, 22 nt, Human
aaugucugaaaaucagacugca

SEQ ID NO: 370559 - RNA, 22 nt, Human
uuuccuaagguagugauaauuu

SEQ ID NO: 370560 - RNA, 22 nt, Human
aauacauguuuucuacuauucu

SEQ ID NO: 370561 - RNA, 22 nt, Human
uuucaggguacauggagcaaau

SEQ ID NO: 370562 - RNA, 22 nt, Human
caguucaggccggcugacucag

SEQ ID NO: 370563 - RNA, 22 nt, Human
cauuuguuggucagauuguagu

SEQ ID NO: 370564 - RNA, 22 nt, Human
agacccugucaguguuaggaaa

SEQ ID NO: 370565 - RNA, 22 nt, Human
gucaaacauagggacuuugugg

SEQ ID NO: 370566 - RNA, 22 nt, Human
auucuucacauaagugcuguac

SEQ ID NO: 370567 - RNA, 22 nt, Human
uucucucauucaaauuaaagug

SEQ ID NO: 370568 - RNA, 22 nt, Human
cccuuccucccaggcuucugug

SEQ ID NO: 370569 - RNA, 22 nt, Human
ucuuaagcagagaagaaguuga

SEQ ID NO: 370570 - RNA, 22 nt, Human
acaaguggguccuacauaaagc

SEQ ID NO: 370571 - RNA, 22 nt, Human
uaaagcacgucuauuuaaugau

SEQ ID NO: 370572 - RNA, 22 nt, Human
uuccucucaacaugccugccgg

SEQ ID NO: 370573 - RNA, 22 nt, Human
uccaggagagguguggggacug

SEQ ID NO: 370574 - RNA, 22 nt, Human
ucugaggcauaaccuguucugc

SEQ ID NO: 370575 - RNA, 22 nt, Human
uagcuuuaggcacguuugaauu

SEQ ID NO: 370576 - RNA, 22 nt, Human
cccaugagauucugaauuuggc

SEQ ID NO: 370577 - RNA, 22 nt, Human
gcgcaggagccgcggagggccg

SEQ ID NO: 370578 - RNA, 22 nt, Human
gcuguucucuguaacaugcauu

SEQ ID NO: 370579 - RNA, 22 nt, Human
cuggcagguggauggggacucc

SEQ ID NO: 370580 - RNA, 22 nt, Human
gcuuccugucccucagccauga

SEQ ID NO: 370581 - RNA, 22 nt, Human
aggagcugagggagcgcccuug

SEQ ID NO: 370582 - RNA, 22 nt, Human
uuucaacuuguuugcuuccaua

SEQ ID NO: 370583 - RNA, 22 nt, Human
uuggaaggagucaaccagcuga

SEQ ID NO: 370584 - RNA, 22 nt, Human
agggagcugcucugcuuccgug

SEQ ID NO: 370585 - RNA, 21 nt, Human
ggcagcucagcagauggggac

SEQ ID NO: 370586 - RNA, 22 nt, Human
auagugguuggauaugucagag

SEQ ID NO: 370587 - RNA, 22 nt, Human
gucagcugucuccccagagugg

SEQ ID NO: 370588 - RNA, 22 nt, Human
agucucugcugguugugccuau

SEQ ID NO: 370589 - RNA, 22 nt, Human
ggucugagcuugagcccaugcu

SEQ ID NO: 370590 - RNA, 22 nt, Human
uauuucugauugcucaugaggc

SEQ ID NO: 370591 - RNA, 22 nt, Human
uccauacauugaaauaccauuc

SEQ ID NO: 370592 - RNA, 22 nt, Human
aagggagguaaagcuauuuaaa

SEQ ID NO: 370593 - RNA, 22 nt, Human
uucacagagaguaugcagagaa

SEQ ID NO: 370594 - RNA, 20 nt, Human
guaaaauauggucuuugggu

SEQ ID NO: 370595 - RNA, 22 nt, Human
caugaauauacauccugauggc

SEQ ID NO: 370596 - RNA, 22 nt, Human
gcagcuuuaaacauuggaaaua

SEQ ID NO: 370597 - RNA, 22 nt, Human
cucuccagccacagaagcugcu

SEQ ID NO: 370598 - RNA, 22 nt, Human
cacaggggcaaacuguagggga

SEQ ID NO: 370599 - RNA, 22 nt, Human
cagucccagacauaguaaggga

SEQ ID NO: 370600 - RNA, 22 nt, Human
gaggccuggucuaugagauguu

SEQ ID NO: 370601 - RNA, 22 nt, Human
gggcucucgauuagacccuggg

SEQ ID NO: 370602 - RNA, 22 nt, Human
ccaggccugauugggaaucuug

SEQ ID NO: 370603 - RNA, 17 nt, Human
uucaaagcuuaucaagg

SEQ ID NO: 370604 - RNA, 22 nt, Human
uuccaugaaagugaaauggagc

SEQ ID NO: 370605 - RNA, 22 nt, Human
gcuggcucagggacuagaguuu

SEQ ID NO: 370606 - RNA, 22 nt, Human
uacauaguauucacauuguuuu

SEQ ID NO: 370607 - RNA, 22 nt, Human
ugaaggagggaagaaggcucug

SEQ ID NO: 370608 - RNA, 22 nt, Human
agcuuuguggcuuugcaagacu

SEQ ID NO: 370609 - RNA, 22 nt, Human
ggggaugguggcauuuguaaaa

SEQ ID NO: 370610 - RNA, 22 nt, Human
uucaaacauucaaauaaaccgg

SEQ ID NO: 370611 - RNA, 22 nt, Human
ggagagcugguagcuggcucca

SEQ ID NO: 370612 - RNA, 22 nt, Human
ugcugucccuaagucucuucaa

SEQ ID NO: 370613 - RNA, 22 nt, Human
ucaauaaaucccucugacccug

SEQ ID NO: 370614 - RNA, 22 nt, Human
ggccagggccuggggacugucc

SEQ ID NO: 370615 - RNA, 22 nt, Human
gaggagaaauuauccuuggugu

SEQ ID NO: 370616 - RNA, 20 nt, Human
acagaaagagagaaugucag

SEQ ID NO: 370617 - RNA, 22 nt, Human
cuguccugcaguugggggcagg

SEQ ID NO: 370618 - RNA, 22 nt, Human
ccagggccaagagaccucgagg

SEQ ID NO: 370619 - RNA, 19 nt, Human
ccucuccgcccaccagccc

SEQ ID NO: 370620 - RNA, 17 nt, Human
ucuguucaugcauaccu

SEQ ID NO: 370621 - RNA, 22 nt, Human
caggaugaagggcaaaggcaag

SEQ ID NO: 370622 - RNA, 22 nt, Human
ucagcuuuuuggauugcccaag

SEQ ID NO: 370623 - RNA, 21 nt, Human
auccauccaucuuggccuaac

SEQ ID NO: 370624 - RNA, 22 nt, Human
aaaaccaggcguuuccuauuau

SEQ ID NO: 370625 - RNA, 22 nt, Human
cuggagccauguauagccuaug

SEQ ID NO: 370626 - RNA, 22 nt, Human
agacccagaaagcagcugcauu

SEQ ID NO: 370627 - RNA, 22 nt, Human
agagaggcugggcguagggcuu

SEQ ID NO: 370628 - RNA, 17 nt, Human
uccagagcacagagcuc

SEQ ID NO: 370629 - RNA, 22 nt, Human
gggccucugugcagaggggccu

SEQ ID NO: 370630 - RNA, 22 nt, Human
aagauauucaaagauuuauuag

SEQ ID NO: 370631 - RNA, 22 nt, Human
ccacagggugucaucagcuuga

SEQ ID NO: 370632 - RNA, 22 nt, Human
uugcucaggcuggugugcagug

SEQ ID NO: 370633 - RNA, 22 nt, Human
cagucucucugaaguauuaaga

SEQ ID NO: 370634 - RNA, 22 nt, Human
gcagaauucuacagaugauaaa

SEQ ID NO: 370635 - RNA, 22 nt, Human
ggguguguuccuaaggaaacca

SEQ ID NO: 370636 - RNA, 22 nt, Human
cccaggaaagagacugcugggu

SEQ ID NO: 370637 - RNA, 22 nt, Human
cggcagagcggcgagccccucc

SEQ ID NO: 370638 - RNA, 21 nt, Human
uggaggaauaaagcacagaag

SEQ ID NO: 370639 - RNA, 22 nt, Human
cugggccugucagggcuuuuug

SEQ ID NO: 370640 - RNA, 22 nt, Human
caaaugcuacuaauaggcaagu

SEQ ID NO: 370641 - RNA, 22 nt, Human
gagggcucugucuggaagggaa

SEQ ID NO: 370642 - RNA, 22 nt, Human
uggagaauuuugucaccagaca

SEQ ID NO: 370643 - RNA, 22 nt, Human
acauucuagaagucuuugcaau

SEQ ID NO: 370644 - RNA, 22 nt, Human
gccaugccugugucuccaggcc

SEQ ID NO: 370645 - RNA, 22 nt, Human
gaaaucugcuucuugcauagua

SEQ ID NO: 370646 - RNA, 22 nt, Human
acuauacaagauuagggauuug

SEQ ID NO: 370647 - RNA, 22 nt, Human
gacagagugcagggcuagaaga

SEQ ID NO: 370648 - RNA, 22 nt, Human
aguuauaaucugcuacugauau

SEQ ID NO: 370649 - RNA, 22 nt, Human
gccuguccuggaugcucugcaa

SEQ ID NO: 370650 - RNA, 22 nt, Human
ggggaccuaggcucugucucuu

SEQ ID NO: 370651 - RNA, 22 nt, Human
agcccggcuuccccgguugcua

SEQ ID NO: 370652 - RNA, 23 nt, Human
cccagcagauuguaaagugucca

SEQ ID NO: 370653 - RNA, 22 nt, Human
uggggcuggcacagucucuauu

SEQ ID NO: 370654 - RNA, 22 nt, Human
gaggggaaagugugaggcugcg

SEQ ID NO: 370655 - RNA, 22 nt, Human
gugcagggcuggcaccggaggc

SEQ ID NO: 370656 - RNA, 22 nt, Human
aaucagucucauuuagcaggga

SEQ ID NO: 370657 - RNA, 21 nt, Human
ccuucucuugcuucagcuuca

SEQ ID NO: 370658 - RNA, 22 nt, Human
guuuauuauacaacaaaagcua

SEQ ID NO: 370659 - RNA, 22 nt, Human
uuucuguaaggacuuaaugcaa

SEQ ID NO: 370660 - RNA, 22 nt, Human
uggcauuuggcuuacuuauguu

SEQ ID NO: 370661 - RNA, 22 nt, Human
gggcguggauggucagugcagg

SEQ ID NO: 370662 - RNA, 22 nt, Human
ucauaauacaaagaguucugca

SEQ ID NO: 370663 - RNA, 22 nt, Human
uauuauuaaauggcagaauuuu

SEQ ID NO: 370664 - RNA, 21 nt, Human
ugagagccuccaaccggcuac

SEQ ID NO: 370665 - RNA, 22 nt, Human
ccaggagguggagauugcagug

SEQ ID NO: 370666 - RNA, 22 nt, Human
aggagaaguaaggcuagaugau

SEQ ID NO: 370667 - RNA, 22 nt, Human
aggagaggucucccuuccccag

SEQ ID NO: 370668 - RNA, 22 nt, Human
gcaggcagagucaauuugaucc

SEQ ID NO: 370669 - RNA, 22 nt, Human
cugcugugcagacagacucucu

SEQ ID NO: 370670 - RNA, 22 nt, Human
uguuccuaaauaugaauggaga

SEQ ID NO: 370671 - RNA, 22 nt, Human
uggagcaggacugcugcccuca

SEQ ID NO: 370672 - RNA, 22 nt, Human
ggcugcagaggcgaucugaggu

SEQ ID NO: 370673 - RNA, 22 nt, Human
gaauuucauuuguuuccuacca

SEQ ID NO: 370674 - RNA, 22 nt, Human
ugggcugcagagcccggccuuc

SEQ ID NO: 370675 - RNA, 22 nt, Human
uuauguauggauggcugaaagu

SEQ ID NO: 370676 - RNA, 22 nt, Human
cagggagaggcaucauagggaa

SEQ ID NO: 370677 - RNA, 22 nt, Human
ucacugcucagucuguacuaca

SEQ ID NO: 370678 - RNA, 22 nt, Human
gaggggcuugaggcccugaugg

SEQ ID NO: 370679 - RNA, 22 nt, Human
ggcugccuugacccuggcuccg

SEQ ID NO: 370680 - RNA, 22 nt, Human
aggcucauucuugccucugagc

SEQ ID NO: 370681 - RNA, 22 nt, Human
cuguaugaggaucagacuggac

SEQ ID NO: 370682 - RNA, 22 nt, Human
uaggaaaaauacagaauuauau

SEQ ID NO: 370683 - RNA, 22 nt, Human
ggagccaggggaccuucacaga

SEQ ID NO: 370684 - RNA, 22 nt, Human
cagggcagggauguugcggcag

SEQ ID NO: 370685 - RNA, 22 nt, Human
ugaggggagcuagcaugccuug

SEQ ID NO: 370686 - RNA, 22 nt, Human
ucagcugccuuucccaugcuag

SEQ ID NO: 370687 - RNA, 22 nt, Human
gccagaaagaggaggaccuggg

SEQ ID NO: 370688 - RNA, 22 nt, Human
cacugcaggucugagauggggg

SEQ ID NO: 370689 - RNA, 22 nt, Human
gcagcuggggaggucgugggga

SEQ ID NO: 370690 - RNA, 22 nt, Human
agauuuacugagaacugauuac

SEQ ID NO: 370691 - RNA, 20 nt, Human
agccaggcucaagcuccccc

SEQ ID NO: 370692 - RNA, 22 nt, Human
cagccagccucucaaccaugca

SEQ ID NO: 370693 - RNA, 22 nt, Human
cuucuaggcuucucagggggca

SEQ ID NO: 370694 - RNA, 22 nt, Human
uccugcagaccucagucagguc

SEQ ID NO: 370695 - RNA, 22 nt, Human
caggccuggcugcagcucgccu

SEQ ID NO: 370696 - RNA, 22 nt, Human
auacuuucugaccaauuaauug

SEQ ID NO: 370697 - RNA, 22 nt, Human
aggcucuguuauucuagagggc

SEQ ID NO: 370698 - RNA, 22 nt, Human
aggcacugguccauuuucugca

SEQ ID NO: 370699 - RNA, 22 nt, Human
ggcuggaaguccaagaucaaga

SEQ ID NO: 370700 - RNA, 21 nt, Human
gggcagcucuguuuuauuuuc

SEQ ID NO: 370701 - RNA, 22 nt, Human
gcugcaggcgccugcggucucu

SEQ ID NO: 370702 - RNA, 22 nt, Human
ugcagggaaaacccaggaugcu

SEQ ID NO: 370703 - RNA, 22 nt, Human
uccauuggucucugugcccagg

SEQ ID NO: 370704 - RNA, 22 nt, Human
uggaggaauaacagcaaccuua

SEQ ID NO: 370705 - RNA, 22 nt, Human
gaggcagcugaagcuucaaaga

SEQ ID NO: 370706 - RNA, 22 nt, Human
cucugcauuuuaacagaugauu

SEQ ID NO: 370707 - RNA, 22 nt, Human
cagcuggccccacaguagaggc

SEQ ID NO: 370708 - RNA, 22 nt, Human
ugaugcugagccugggacugac

SEQ ID NO: 370709 - RNA, 22 nt, Human
aaaaagauguccugaaguuuag

SEQ ID NO: 370710 - RNA, 22 nt, Human
acagauauaugauuguguaaau

SEQ ID NO: 370711 - RNA, 22 nt, Human
gccccuggcuggccagcuccuc

SEQ ID NO: 370712 - RNA, 22 nt, Human
uguguuuugaacucaucuacug

SEQ ID NO: 370713 - RNA, 22 nt, Human
aggagaggaaucauuauuacaa

SEQ ID NO: 370714 - RNA, 22 nt, Human
aagacagagggaagcaaugaug

SEQ ID NO: 370715 - RNA, 22 nt, Human
cccaggaggacauuccauaccc

SEQ ID NO: 370716 - RNA, 22 nt, Human
cuucuucauguauugauagucu

SEQ ID NO: 370717 - RNA, 22 nt, Human
ggaggaagugcaguucuacuac

SEQ ID NO: 370718 - RNA, 22 nt, Human
uuuuucauugcagccucucucc

SEQ ID NO: 370719 - RNA, 22 nt, Human
gcagccaggaaagcuggacccu

SEQ ID NO: 370720 - RNA, 22 nt, Human
ucccagaguuuccuguguccca

SEQ ID NO: 370721 - RNA, 22 nt, Human
ggcagaguugguggagucaguu

SEQ ID NO: 370722 - RNA, 22 nt, Human
ggcagagcugcaugagcacuca

SEQ ID NO: 370723 - RNA, 21 nt, Human
uaagccaccaugugaaaccag

SEQ ID NO: 370724 - RNA, 22 nt, Human
ugugaaggcagcagcucugucc

SEQ ID NO: 370725 - RNA, 22 nt, Human
cucacaguuggcucauuaauga

SEQ ID NO: 370726 - RNA, 22 nt, Human
caagaaaugggauuugacugcc

SEQ ID NO: 370727 - RNA, 22 nt, Human
ccagagucuuuauauuccugaa

SEQ ID NO: 370728 - RNA, 22 nt, Human
ggcugaguugagaggauuacuu

SEQ ID NO: 370729 - RNA, 22 nt, Human
ccucugccugcacaucauccug

SEQ ID NO: 370730 - RNA, 22 nt, Human
agagauaugaguaguugugaca

SEQ ID NO: 370731 - RNA, 22 nt, Human
ugaggcaguucuuacuuguauu

SEQ ID NO: 370732 - RNA, 22 nt, Human
uuucagaaaacuuaucaucagu

SEQ ID NO: 370733 - RNA, 23 nt, Human
aggauguaggauguauggcagag

SEQ ID NO: 370734 - RNA, 22 nt, Human
uggcucugggaaucuguugcuu

SEQ ID NO: 370735 - RNA, 22 nt, Human
cuuucacacacauacauuugga

SEQ ID NO: 370736 - RNA, 22 nt, Human
ucucuggguuuuuguccuguac

SEQ ID NO: 370737 - RNA, 22 nt, Human
aggacagagggaccagagccca

SEQ ID NO: 370738 - RNA, 22 nt, Human
uuugacauggaauaacucauuu

SEQ ID NO: 370739 - RNA, 22 nt, Human
auaagcauguuagaauauuuga

SEQ ID NO: 370740 - RNA, 22 nt, Human
uguagggaggaaggguuggaaa

SEQ ID NO: 370741 - RNA, 22 nt, Human
aggaguguggccagggcucugg

SEQ ID NO: 370742 - RNA, 22 nt, Human
gggcugagugggccucuuacuu

SEQ ID NO: 370743 - RNA, 22 nt, Human
uggcugccuagucccucagccu

SEQ ID NO: 370744 - RNA, 22 nt, Human
cuccaguggcaaguccgggcgg

SEQ ID NO: 370745 - RNA, 22 nt, Human
cuauagaaaauuguaucacacg

SEQ ID NO: 370746 - RNA, 22 nt, Human
cuacauuuugugauuaugaaau

SEQ ID NO: 370747 - RNA, 22 nt, Human
ccauggagcgggugagugagug

SEQ ID NO: 370748 - RNA, 22 nt, Human
ugucaccaugcgaggcuaauuu

SEQ ID NO: 370749 - RNA, 22 nt, Human
ccugagugcuuccagagucaug

SEQ ID NO: 370750 - RNA, 22 nt, Human
caucagaaccagcugggugagg

SEQ ID NO: 370751 - RNA, 22 nt, Human
acaugcuuuucccacaauuaua

SEQ ID NO: 370752 - RNA, 22 nt, Human
aaggucauugguucugaauucu

SEQ ID NO: 370753 - RNA, 22 nt, Human
gccaggcuggugcaaggauauu

SEQ ID NO: 370754 - RNA, 22 nt, Human
agagggcccauguugggcugcu

SEQ ID NO: 370755 - RNA, 22 nt, Human
auggguuucccucugaaauuau

SEQ ID NO: 370756 - RNA, 22 nt, Human
gggagggacacaaagaguuccc

SEQ ID NO: 370757 - RNA, 22 nt, Human
uguccuuaaggagcuuaauguc

SEQ ID NO: 370758 - RNA, 22 nt, Human
gcugccugaagugucuacacug

SEQ ID NO: 370759 - RNA, 22 nt, Human
acacugcagaugaaagcauaag

SEQ ID NO: 370760 - RNA, 22 nt, Human
gggccaugagagguucaucaac

SEQ ID NO: 370761 - RNA, 22 nt, Human
ugcauguuaagaaaauauugag

SEQ ID NO: 370762 - RNA, 22 nt, Human
ucugugcucuucucaguaucac

SEQ ID NO: 370763 - RNA, 22 nt, Human
ccaccaggacagcccugagggg

SEQ ID NO: 370764 - RNA, 22 nt, Human
aaauuaguacauugcaaagucc

SEQ ID NO: 370765 - RNA, 22 nt, Human
gaagcagcgaaguggaagggac

SEQ ID NO: 370766 - RNA, 22 nt, Human
cuuugaauuccaguacaauaac

SEQ ID NO: 370767 - RNA, 21 nt, Human
cucuugugucagagccagagg

SEQ ID NO: 370768 - RNA, 22 nt, Human
gagucacauuaauuuaauuuua

SEQ ID NO: 370769 - RNA, 22 nt, Human
caaggccacguucugcaugcgg

SEQ ID NO: 370770 - RNA, 22 nt, Human
agugaaauagcauuuaugaagc

SEQ ID NO: 370771 - RNA, 19 nt, Human
uccaaaggacccaccucca

SEQ ID NO: 370772 - RNA, 22 nt, Human
gauggcuucagucuccuugggu

SEQ ID NO: 370773 - RNA, 23 nt, Human
uugaaggagaaagcuuucuuggu

SEQ ID NO: 370774 - RNA, 22 nt, Human
uguacauacauagauauacaca

SEQ ID NO: 370775 - RNA, 22 nt, Human
accagagcuggcucugagcacc

SEQ ID NO: 370776 - RNA, 22 nt, Human
ucucaggguuuccugggggcug

SEQ ID NO: 370777 - RNA, 23 nt, Human
ugcuucucugcuugacaguucug

SEQ ID NO: 370778 - RNA, 22 nt, Human
ucagggacuuacaaaccagaag

SEQ ID NO: 370779 - RNA, 22 nt, Human
ucuuuaaucauaaccaagaugg

SEQ ID NO: 370780 - RNA, 17 nt, Human
gucugggcuuuagagac

SEQ ID NO: 370781 - RNA, 22 nt, Human
cugggagcuagcucugagcuga

SEQ ID NO: 370782 - RNA, 22 nt, Human
ugacagaaauaguucuuaauuu

SEQ ID NO: 370783 - RNA, 22 nt, Human
ccaggacccugcaaacccuguu

SEQ ID NO: 370784 - RNA, 22 nt, Human
caacauauaauauuugaguucu

SEQ ID NO: 370785 - RNA, 22 nt, Human
acaguggagaaggcaugaggcu

SEQ ID NO: 370786 - RNA, 22 nt, Human
gggaggugauggcaagcagcgg

SEQ ID NO: 370787 - RNA, 22 nt, Human
accacccucagcagagcugaaa

SEQ ID NO: 370788 - RNA, 22 nt, Human
caguugcuggaugugcagcucu

SEQ ID NO: 370789 - RNA, 22 nt, Human
ggcuuuauuaacucauccguaa

SEQ ID NO: 370790 - RNA, 22 nt, Human
cacaugaugguggaagccauag

SEQ ID NO: 370791 - RNA, 22 nt, Human
cuggcuuccaugcuguaguggc

SEQ ID NO: 370792 - RNA, 22 nt, Human
uuauaacaacaguuuacuuuaa

SEQ ID NO: 370793 - RNA, 22 nt, Human
aauuugauuuucuuaaaccaua

SEQ ID NO: 370794 - RNA, 22 nt, Human
gacagcaggagaucaugauaga

SEQ ID NO: 370795 - RNA, 22 nt, Human
ggggggugcugaucaguggagc

SEQ ID NO: 370796 - RNA, 22 nt, Human
cacacaggagagugcuggaggu

SEQ ID NO: 370797 - RNA, 22 nt, Human
cuggagugauacucagaaugug

SEQ ID NO: 370798 - RNA, 22 nt, Human
uuucuuagcgaugcuugauaaa

SEQ ID NO: 370799 - RNA, 22 nt, Human
gagagggcucuguguggguacu

SEQ ID NO: 370800 - RNA, 22 nt, Human
agcagaaccugcagaccugucu

SEQ ID NO: 370801 - RNA, 23 nt, Human
auugaugacuugauuacacuuuu

SEQ ID NO: 370802 - RNA, 22 nt, Human
accaugaugcauccuuaaggaa

SEQ ID NO: 370803 - RNA, 22 nt, Human
caugcugugugguuagaacugu

SEQ ID NO: 370804 - RNA, 22 nt, Human
aacaugauggggaagaacaaga

SEQ ID NO: 370805 - RNA, 22 nt, Human
caagagcuagacuuugucagga

SEQ ID NO: 370806 - RNA, 22 nt, Human
ugggcagauuaaugcaguggcu

SEQ ID NO: 370807 - RNA, 22 nt, Human
uugggguguuggauggagcaag

SEQ ID NO: 370808 - RNA, 22 nt, Human
guguguuuagcauuagcagggg

SEQ ID NO: 370809 - RNA, 22 nt, Human
gaggggcuggcacgauggcugc

SEQ ID NO: 370810 - RNA, 22 nt, Human
gcacaauaauucuuguuuugcu

SEQ ID NO: 370811 - RNA, 22 nt, Human
aagggugggcaccgccagguca

SEQ ID NO: 370812 - RNA, 22 nt, Human
ccugaggggcugcaggccagcu

SEQ ID NO: 370813 - RNA, 22 nt, Human
agggcagcacagcugugcuccu

SEQ ID NO: 370814 - RNA, 22 nt, Human
uucccaugccuggccccuaucc

SEQ ID NO: 370815 - RNA, 22 nt, Human
aacagacaacuccuguggcuca

SEQ ID NO: 370816 - RNA, 22 nt, Human
ggcccuguuagagcucccacaa

SEQ ID NO: 370817 - RNA, 22 nt, Human
gagagcuggccagcuucaguau

SEQ ID NO: 370818 - RNA, 22 nt, Human
ccucuguccuggggaguggagc

SEQ ID NO: 370819 - RNA, 21 nt, Human
cagagcagcguucugcugugg

SEQ ID NO: 370820 - RNA, 22 nt, Human
gggcuucuagaccagcagugag

SEQ ID NO: 370821 - RNA, 23 nt, Human
agucuucauuguauuuccagacc

SEQ ID NO: 370822 - RNA, 22 nt, Human
cccaggagaugcacuccauugg

SEQ ID NO: 370823 - RNA, 22 nt, Human
aucugccugagucuagguuuuc

SEQ ID NO: 370824 - RNA, 22 nt, Human
ucaggagagaguuggguaggcu

SEQ ID NO: 370825 - RNA, 22 nt, Human
caggauagaaaggccauggagu

SEQ ID NO: 370826 - RNA, 22 nt, Human
aauaauaagauacuaagggagu

SEQ ID NO: 370827 - RNA, 22 nt, Human
ugaguccaauaggggccuggaa

SEQ ID NO: 370828 - RNA, 22 nt, Human
uguuuuguuuaugagagcacag

SEQ ID NO: 370829 - RNA, 22 nt, Human
uuucaaaauuuugcagugguaa

SEQ ID NO: 370830 - RNA, 22 nt, Human
ugucccagcacuuugggagucu

SEQ ID NO: 370831 - RNA, 22 nt, Human
aagcuggcaugucaccugagaa

SEQ ID NO: 370832 - RNA, 22 nt, Human
cagaagcauuccagcaaauagu

SEQ ID NO: 370833 - RNA, 20 nt, Human
ucucaggguucagcaaagua

SEQ ID NO: 370834 - RNA, 22 nt, Human
cucuccagaucugcugagccag

SEQ ID NO: 370835 - RNA, 22 nt, Human
gccaggcuccccggaucccugg

SEQ ID NO: 370836 - RNA, 22 nt, Human
ggccccugcggacugccuagag

SEQ ID NO: 370837 - RNA, 22 nt, Human
cagaaggcauagaugaaggccu

SEQ ID NO: 370838 - RNA, 16 nt, Human
aggcucagaggcugga

SEQ ID NO: 370839 - RNA, 22 nt, Human
gaggccaggacaugaaagcuga

SEQ ID NO: 370840 - RNA, 22 nt, Human
cucagggcaguauggcugagag

SEQ ID NO: 370841 - RNA, 22 nt, Human
augcaguauaaaucauuucugg

SEQ ID NO: 370842 - RNA, 22 nt, Human
cagauauuaggagcucaauaau

SEQ ID NO: 370843 - RNA, 23 nt, Human
uccuggugacaugccugagcauc

SEQ ID NO: 370844 - RNA, 22 nt, Human
ucuaaacacgucucuuugaaua

SEQ ID NO: 370845 - RNA, 22 nt, Human
aggacugacuuuugccaugaaa

SEQ ID NO: 370846 - RNA, 22 nt, Human
aacuuaaacccacucauguaga

SEQ ID NO: 370847 - RNA, 22 nt, Human
auaaagcaaauaggacuauugc

SEQ ID NO: 370848 - RNA, 22 nt, Human
cccaguuguugccggcucugga

SEQ ID NO: 370849 - RNA, 22 nt, Human
uuucuuccuuaccuuacuagag

SEQ ID NO: 370850 - RNA, 22 nt, Human
gcugccagccaacuugcugugc

SEQ ID NO: 370851 - RNA, 22 nt, Human
gggcagcuggcuuauagguuug

SEQ ID NO: 370852 - RNA, 22 nt, Human
guccuggggaauacagaagccg

SEQ ID NO: 370853 - RNA, 22 nt, Human
auguaaggcugccuaugacacu

SEQ ID NO: 370854 - RNA, 22 nt, Human
aagaagagaaaugugcugcugg

SEQ ID NO: 370855 - RNA, 22 nt, Human
aggaagcccuugucauuucugu

SEQ ID NO: 370856 - RNA, 22 nt, Human
gcagagccuugcgucaugugcc

SEQ ID NO: 370857 - RNA, 22 nt, Human
aaggucauuguugcauguucuc

SEQ ID NO: 370858 - RNA, 22 nt, Human
gaaggagggugcggaucugagc

SEQ ID NO: 370859 - RNA, 22 nt, Human
aaaaugaggucaauauccuuuu

SEQ ID NO: 370860 - RNA, 22 nt, Human
ucuguggcacgauugcacugca

SEQ ID NO: 370861 - RNA, 22 nt, Human
uugaaaggccuguuuauccagc

SEQ ID NO: 370862 - RNA, 20 nt, Human
uguugauuggugucaucuca

SEQ ID NO: 370863 - RNA, 22 nt, Human
uguacuuccccaaugacagcac

SEQ ID NO: 370864 - RNA, 22 nt, Human
ggucccaggaagugcggcggcg

SEQ ID NO: 370865 - RNA, 22 nt, Human
aaaucaguuguuauauuaaaga

SEQ ID NO: 370866 - RNA, 22 nt, Human
cccugcagagagugcuuuugug

SEQ ID NO: 370867 - RNA, 22 nt, Human
gggcaguguggucgugccuuug

SEQ ID NO: 370868 - RNA, 23 nt, Human
ucagagaggcccccugcagagau

SEQ ID NO: 370869 - RNA, 22 nt, Human
auuucaacagaguuugaaggca

SEQ ID NO: 370870 - RNA, 22 nt, Human
uuccuuccgggcaccaggcacu

SEQ ID NO: 370871 - RNA, 21 nt, Human
aagggagauaggaaucaggcc

SEQ ID NO: 370872 - RNA, 22 nt, Human
gccugaggaaugcuccugacuu

SEQ ID NO: 370873 - RNA, 22 nt, Human
ggggcggggcucugagaagcau

SEQ ID NO: 370874 - RNA, 22 nt, Human
cauuucuguucucuuccuguac

SEQ ID NO: 370875 - RNA, 22 nt, Human
uagggcucgggcacaggacagg

SEQ ID NO: 370876 - RNA, 22 nt, Human
gagaugaauguaaacaaaggca

SEQ ID NO: 370877 - RNA, 22 nt, Human
cacccaggcuagagugcagugg

SEQ ID NO: 370878 - RNA, 22 nt, Human
uucugucacuuaggaggucaua

SEQ ID NO: 370879 - RNA, 22 nt, Human
cuggcugugcugcaggcuuugg

SEQ ID NO: 370880 - RNA, 22 nt, Human
acauuucuaguuguucaucucc

SEQ ID NO: 370881 - RNA, 22 nt, Human
auauuagguuggugcaaaagua

SEQ ID NO: 370882 - RNA, 22 nt, Human
gcagcagaguuugggagauggu

SEQ ID NO: 370883 - RNA, 22 nt, Human
ugagccuggagucguggagggg

SEQ ID NO: 370884 - RNA, 22 nt, Human
cagcaggauuugaaaggaagag

SEQ ID NO: 370885 - RNA, 22 nt, Human
uuaacauuucuuuuccacucau

SEQ ID NO: 370886 - RNA, 22 nt, Human
cacaaaugacugaaacgacugu

SEQ ID NO: 370887 - RNA, 22 nt, Human
accaggggugucaacagcauuu

SEQ ID NO: 370888 - RNA, 22 nt, Human
cagugcagguuuagggcugggg

SEQ ID NO: 370889 - RNA, 21 nt, Human
aggcucagagagaaacucuug

SEQ ID NO: 370890 - RNA, 22 nt, Human
ggcagccuugacuagugacuua

SEQ ID NO: 370891 - RNA, 22 nt, Human
gaauucugggagagaucugaca

SEQ ID NO: 370892 - RNA, 22 nt, Human
gagacacaggugguuccuguca

SEQ ID NO: 370893 - RNA, 22 nt, Human
uaaauguggagacucaggaguc

SEQ ID NO: 370894 - RNA, 22 nt, Human
uucuucuccuaaggagaguccu

SEQ ID NO: 370895 - RNA, 22 nt, Human
uggcucagaagaaaagguaaac

SEQ ID NO: 370896 - RNA, 22 nt, Human
uugcauuugaucuuggguucuc

SEQ ID NO: 370897 - RNA, 22 nt, Human
cucaggaugcaauuccaucaag

SEQ ID NO: 370898 - RNA, 22 nt, Human
ucaagcaggguagcaagcuggu

SEQ ID NO: 370899 - RNA, 19 nt, Human
agcuuccauauucucuagu

SEQ ID NO: 370900 - RNA, 22 nt, Human
aauauugagaaccagcauguuu

SEQ ID NO: 370901 - RNA, 22 nt, Human
ggaggccaucagggagggcauu

SEQ ID NO: 370902 - RNA, 22 nt, Human
cagguacauucguagacccauu

SEQ ID NO: 370903 - RNA, 22 nt, Human
guccucugggagccuugagccu

SEQ ID NO: 370904 - RNA, 22 nt, Human
ucuggcaggucaaucauucuuu

SEQ ID NO: 370905 - RNA, 22 nt, Human
ccagagagggcgccaccuggag

SEQ ID NO: 370906 - RNA, 22 nt, Human
cgggcagauugggaagguucau

SEQ ID NO: 370907 - RNA, 21 nt, Human
acccuggguucuccauacccu

SEQ ID NO: 370908 - RNA, 22 nt, Human
uaauuucuagggacuaaggugc

SEQ ID NO: 370909 - RNA, 22 nt, Human
ucugggcagcagcagcuaguag

SEQ ID NO: 370910 - RNA, 22 nt, Human
ccagcucucagcgggagacuca

SEQ ID NO: 370911 - RNA, 22 nt, Human
uagcugccuaugugauaagaga

SEQ ID NO: 370912 - RNA, 22 nt, Human
cagggccuucguaaguguccgg

SEQ ID NO: 370913 - RNA, 22 nt, Human
uucucugaguacguuucagugu

SEQ ID NO: 370914 - RNA, 22 nt, Human
aggccagccucaggcagggacc

SEQ ID NO: 370915 - RNA, 22 nt, Human
uuacaagugucagguacuggca

SEQ ID NO: 370916 - RNA, 22 nt, Human
aagggcagaaagggacgcuuug

SEQ ID NO: 370917 - RNA, 22 nt, Human
gcagugguggagcuuacauauc

SEQ ID NO: 370918 - RNA, 19 nt, Human
ugcagaggguaggaaggcc

SEQ ID NO: 370919 - RNA, 20 nt, Human
cagagcuguuauggaugaug

SEQ ID NO: 370920 - RNA, 20 nt, Human
ucuuauacagaaaacauuuu

SEQ ID NO: 370921 - RNA, 22 nt, Human
ugauuucaaguagugacaugcu

SEQ ID NO: 370922 - RNA, 22 nt, Human
uuccuaauggcaaaacauguuu

SEQ ID NO: 370923 - RNA, 22 nt, Human
ggcaugcucuuuguccacagua

SEQ ID NO: 370924 - RNA, 23 nt, Human
gggagaauaugaggaugauggug

SEQ ID NO: 370925 - RNA, 22 nt, Human
gcagagcugggucuguauccaa

SEQ ID NO: 370926 - RNA, 22 nt, Human
uaaggcacccauguucauacag

SEQ ID NO: 370927 - RNA, 22 nt, Human
uuagccauggacugaauugacu

SEQ ID NO: 370928 - RNA, 22 nt, Human
uauguacacauacacuuguaau

SEQ ID NO: 370929 - RNA, 21 nt, Human
ucagaacaauuccaugccucc

SEQ ID NO: 370930 - RNA, 22 nt, Human
aggcaauccccugaggauacuu

SEQ ID NO: 370931 - RNA, 21 nt, Human
agcugccacccuagcuucuga

SEQ ID NO: 370932 - RNA, 22 nt, Human
caggagaaauguggcugcuacc

SEQ ID NO: 370933 - RNA, 22 nt, Human
guuuaagaaaauucauguuguu

SEQ ID NO: 370934 - RNA, 18 nt, Human
caggagcaggaguugaac

SEQ ID NO: 370935 - RNA, 22 nt, Human
gaggaaaagagacagguuauug

SEQ ID NO: 370936 - RNA, 22 nt, Human
aaaugguguuucuaaugcuaga

SEQ ID NO: 370937 - RNA, 21 nt, Human
agcagcugggcaacauggagg

SEQ ID NO: 370938 - RNA, 22 nt, Human
cuuuaacaaaugacucuugucu

SEQ ID NO: 370939 - RNA, 22 nt, Human
uccucagacuucccuuugugua

SEQ ID NO: 370940 - RNA, 22 nt, Human
gcauguuuugcaacaagugacc

SEQ ID NO: 370941 - RNA, 22 nt, Human
uggcugagaaguucugguggga

SEQ ID NO: 370942 - RNA, 21 nt, Human
cugccuugaaugguacuggga

SEQ ID NO: 370943 - RNA, 22 nt, Human
gaacagaagaggcuggugccac

SEQ ID NO: 370944 - RNA, 22 nt, Human
auuauucaaucauauuaaaagu

SEQ ID NO: 370945 - RNA, 18 nt, Human
cucucuggucuggauccc

SEQ ID NO: 370946 - RNA, 22 nt, Human
cccagcuaccucugcuaggaga

SEQ ID NO: 370947 - RNA, 22 nt, Human
ugucacauguguggcauuuuuc

SEQ ID NO: 370948 - RNA, 22 nt, Human
gacaaaggaucagagguuggga

SEQ ID NO: 370949 - RNA, 22 nt, Human
gaaaugcagaaccugagaccau

SEQ ID NO: 370950 - RNA, 22 nt, Human
aagggcagcugacagaugcuua

SEQ ID NO: 370951 - RNA, 22 nt, Human
ugcugcugauggcaccuaggca

SEQ ID NO: 370952 - RNA, 22 nt, Human
agaaaucauugaauuauuugcu

SEQ ID NO: 370953 - RNA, 22 nt, Human
agcccaaggcuucccugcuggc

SEQ ID NO: 370954 - RNA, 22 nt, Human
gaaggcugcgaggggagugccg

SEQ ID NO: 370955 - RNA, 22 nt, Human
cugggcaguaugaauauucaaa

SEQ ID NO: 370956 - RNA, 21 nt, Human
aaugaaguggcuauuuugagg

SEQ ID NO: 370957 - RNA, 19 nt, Human
ccaggagagcuuggagaag

SEQ ID NO: 370958 - RNA, 22 nt, Human
aucaguuuauacuuauaaaucu

SEQ ID NO: 370959 - RNA, 22 nt, Human
acaguggaguugggguagcccu

SEQ ID NO: 370960 - RNA, 22 nt, Human
uuaaaauagccagugccccucu

SEQ ID NO: 370961 - RNA, 22 nt, Human
uuuucaguuccaucucugcucu

SEQ ID NO: 370962 - RNA, 22 nt, Human
aaucaguguguaaaguggcugc

SEQ ID NO: 370963 - RNA, 22 nt, Human
cagggcaguaccgcccucuggc

SEQ ID NO: 370964 - RNA, 22 nt, Human
gcaguggggaaugcuggggaga

SEQ ID NO: 370965 - RNA, 22 nt, Human
ggguggagaggcuaaguccagu

SEQ ID NO: 370966 - RNA, 22 nt, Human
aaggcuuuugggaauuuucaac

SEQ ID NO: 370967 - RNA, 22 nt, Human
acagauuugacugguaccuggc

SEQ ID NO: 370968 - RNA, 22 nt, Human
augcuuaaugaggguauauaug

SEQ ID NO: 370969 - RNA, 22 nt, Human
uccagugguuugaaaggggugu

SEQ ID NO: 370970 - RNA, 22 nt, Human
uuuugaauaauucagaaacagc

SEQ ID NO: 370971 - RNA, 22 nt, Human
gccuggugguauccuggcaaga

SEQ ID NO: 370972 - RNA, 22 nt, Human
uuugacaggacuaacauauggc

SEQ ID NO: 370973 - RNA, 20 nt, Human
ucagaggcugccagcugggg

SEQ ID NO: 370974 - RNA, 22 nt, Human
agagugaagguugacacuucac

SEQ ID NO: 370975 - RNA, 22 nt, Human
aaguuacuggcaagggcugcag

SEQ ID NO: 370976 - RNA, 22 nt, Human
aagggcucugugugccucccca

SEQ ID NO: 370977 - RNA, 18 nt, Human
ggcuguggacaagauuag

SEQ ID NO: 370978 - RNA, 23 nt, Human
uggcaccaggcauucuaggggua

SEQ ID NO: 370979 - RNA, 19 nt, Human
aggacucuggaggcaugag

SEQ ID NO: 370980 - RNA, 22 nt, Human
aaguucaaggcagguccugagg

SEQ ID NO: 370981 - RNA, 22 nt, Human
uagggcuauucugaguaauaau

SEQ ID NO: 370982 - RNA, 22 nt, Human
agugaccauuuucagcuagagg

SEQ ID NO: 370983 - RNA, 22 nt, Human
uccugccucaggcucuggagua

SEQ ID NO: 370984 - RNA, 22 nt, Human
ugcauggaggaagaugaaugca

SEQ ID NO: 370985 - RNA, 22 nt, Human
acagccauagaugcuuauguaa

SEQ ID NO: 370986 - RNA, 22 nt, Human
cauuuuaagaugaccugguuuc

SEQ ID NO: 370987 - RNA, 22 nt, Human
gcaggaguuaggcgucguggau

SEQ ID NO: 370988 - RNA, 22 nt, Human
cucucugaggcaggccuguggg

SEQ ID NO: 370989 - RNA, 22 nt, Human
gcugucucauacaaggcccugc

SEQ ID NO: 370990 - RNA, 22 nt, Human
gauuuacagaucuaagggucac

SEQ ID NO: 370991 - RNA, 22 nt, Human
aaagcugcugccaaucaggcuu

SEQ ID NO: 370992 - RNA, 21 nt, Human
gcucucugcaugguggcucag

SEQ ID NO: 370993 - RNA, 22 nt, Human
ggguccaggucuucaggcagag

SEQ ID NO: 370994 - RNA, 22 nt, Human
uuagucuucuuccuuauauguu

SEQ ID NO: 370995 - RNA, 17 nt, Human
cuuuuaauuuacuuccc

SEQ ID NO: 370996 - RNA, 22 nt, Human
acacagauuuuacauguuaugc

SEQ ID NO: 370997 - RNA, 22 nt, Human
gagggacagcuaaagagaaauu

SEQ ID NO: 370998 - RNA, 23 nt, Human
ucccagggaaggugagcgaggcu

SEQ ID NO: 370999 - RNA, 22 nt, Human
agugagcauucguuuggaaccc

SEQ ID NO: 371000 - RNA, 22 nt, Human
uacugaaaguggucaacagugg

SEQ ID NO: 371001 - RNA, 22 nt, Human
aagacagaccacgugacagggc

SEQ ID NO: 371002 - RNA, 22 nt, Human
acugucugcccugagaugccag

SEQ ID NO: 371003 - RNA, 22 nt, Human
cugccugugugugccugcagaa

SEQ ID NO: 371004 - RNA, 22 nt, Human
gccagcucagugccaggccccu

SEQ ID NO: 371005 - RNA, 22 nt, Human
aaauauagugacacuuauaguc

SEQ ID NO: 371006 - RNA, 22 nt, Human
auguccagagccggccugcuga

SEQ ID NO: 371007 - RNA, 21 nt, Human
gccaccucgucucggagcagc

SEQ ID NO: 371008 - RNA, 22 nt, Human
uagacagauuuaaaggaaugga

SEQ ID NO: 371009 - RNA, 22 nt, Human
ccaggcucugucuggucagaag

SEQ ID NO: 371010 - RNA, 21 nt, Human
ggggcagagcuaggcccugca

SEQ ID NO: 371011 - RNA, 22 nt, Human
aggaagcugccugggaugggaa

SEQ ID NO: 371012 - RNA, 23 nt, Human
agggcuccuuguugauuagcauu

SEQ ID NO: 371013 - RNA, 21 nt, Human
uuuuauugaugaauggccacu

SEQ ID NO: 371014 - RNA, 22 nt, Human
uacugaaauacuaagaaguuaa

SEQ ID NO: 371015 - RNA, 22 nt, Human
acuuugaaucucagauaaccaa

SEQ ID NO: 371016 - RNA, 20 nt, Human
uuucuugucggcuguugcug

SEQ ID NO: 371017 - RNA, 23 nt, Human
ccucccaggcugcgagucccgag

SEQ ID NO: 371018 - RNA, 22 nt, Human
uggcugggagcuggaacugggc

SEQ ID NO: 371019 - RNA, 22 nt, Human
agccuggaggaggaguugagca

SEQ ID NO: 371020 - RNA, 22 nt, Human
accaucagucauugucaguggg

SEQ ID NO: 371021 - RNA, 22 nt, Human
agucccagaucuacaggaggga

SEQ ID NO: 371022 - RNA, 22 nt, Human
cagauuucagcucauauauuau

SEQ ID NO: 371023 - RNA, 22 nt, Human
caggaggcaucauggagcggac

SEQ ID NO: 371024 - RNA, 22 nt, Human
aggagaggcucuaacucugugu

SEQ ID NO: 371025 - RNA, 22 nt, Human
aaucaguguggugacuugucug

SEQ ID NO: 371026 - RNA, 22 nt, Human
aggcagugagugugacuucaca

SEQ ID NO: 371027 - RNA, 19 nt, Human
ugucacugucauggcccag

SEQ ID NO: 371028 - RNA, 22 nt, Human
ugccaggagagugcaugcaggg

SEQ ID NO: 371029 - RNA, 20 nt, Human
uccuggccuucucgggcagu

SEQ ID NO: 371030 - RNA, 22 nt, Human
uuugaaauaugaggcauuauga

SEQ ID NO: 371031 - RNA, 22 nt, Human
acagccuggccugaguuaaggc

SEQ ID NO: 371032 - RNA, 20 nt, Human
uauuuagauucaaguaugga

SEQ ID NO: 371033 - RNA, 21 nt, Human
ugaagccugaggcauagcccc

SEQ ID NO: 371034 - RNA, 22 nt, Human
ugaagcaacuggacaaguuggc

SEQ ID NO: 371035 - RNA, 22 nt, Human
uauuuccaggccccacucuaga

SEQ ID NO: 371036 - RNA, 22 nt, Human
cauagaaacugagacaaggauu

SEQ ID NO: 371037 - RNA, 22 nt, Human
ugcagaagacacaagguaacgu

SEQ ID NO: 371038 - RNA, 22 nt, Human
aaucgguugaacccaggaagug

SEQ ID NO: 371039 - RNA, 22 nt, Human
gcugccucugcgacucugggcg

SEQ ID NO: 371040 - RNA, 22 nt, Human
cagacuugacggcagcugcuuu

SEQ ID NO: 371041 - RNA, 22 nt, Human
gaggcagugcauugucuagggg

SEQ ID NO: 371042 - RNA, 22 nt, Human
aagggcaggugggcauuucugg

SEQ ID NO: 371043 - RNA, 22 nt, Human
agguggagacccagagaaggcg

SEQ ID NO: 371044 - RNA, 22 nt, Human
cugucagguuggucucagagcu

SEQ ID NO: 371045 - RNA, 22 nt, Human
gggcagcucggaagugggaaag

SEQ ID NO: 371046 - RNA, 22 nt, Human
uccaguggagugugggggugaa

SEQ ID NO: 371047 - RNA, 22 nt, Human
aagggcagcuuaaauugguagc

SEQ ID NO: 371048 - RNA, 22 nt, Human
ugccugaggagucagggcaggu

SEQ ID NO: 371049 - RNA, 22 nt, Human
aguugaagguuggcugauccau

SEQ ID NO: 371050 - RNA, 22 nt, Human
gcugucugcaagccaggaaaug

SEQ ID NO: 371051 - RNA, 22 nt, Human
aucuggguucaccaugcuccug

SEQ ID NO: 371052 - RNA, 22 nt, Human
uugcagcuucgagucuaucugu

SEQ ID NO: 371053 - RNA, 22 nt, Human
uguuacacagcagaauagcaag

SEQ ID NO: 371054 - RNA, 22 nt, Human
augcaguagauaggcacuuuua

SEQ ID NO: 371055 - RNA, 19 nt, Human
uguuuuguuaaagcagucc

SEQ ID NO: 371056 - RNA, 22 nt, Human
ccagagagaaauggauuugagu

SEQ ID NO: 371057 - RNA, 22 nt, Human
ggugaggcccagugaucugugu

SEQ ID NO: 371058 - RNA, 23 nt, Human
uagaauucaaucuguuccacauc

SEQ ID NO: 371059 - RNA, 22 nt, Human
cagagaaagaagcccauucauu

SEQ ID NO: 371060 - RNA, 20 nt, Human
ugacucugcaaccgucucuc

SEQ ID NO: 371061 - RNA, 22 nt, Human
uuccaugugaguacacugugau

SEQ ID NO: 371062 - RNA, 22 nt, Human
gccugccuucggugcgcagcgg

SEQ ID NO: 371063 - RNA, 22 nt, Human
cuuccuucugaagcauagaagc

SEQ ID NO: 371064 - RNA, 22 nt, Human
ugcagcugguuuagaacuagau

SEQ ID NO: 371065 - RNA, 22 nt, Human
cagaauuuuucgaauguacugu

SEQ ID NO: 371066 - RNA, 22 nt, Human
acuuugcaaugggcagaaccca

SEQ ID NO: 371067 - RNA, 22 nt, Human
cagauaaaggcuuacuaguagu

SEQ ID NO: 371068 - RNA, 22 nt, Human
uagacacaucaaguauaguuaa

SEQ ID NO: 371069 - RNA, 22 nt, Human
ggccuuggggaggauggugucc

SEQ ID NO: 371070 - RNA, 22 nt, Human
cuggacuuuggcccaucugcca

SEQ ID NO: 371071 - RNA, 22 nt, Human
aggccugggcaagaaggggcgu

SEQ ID NO: 371072 - RNA, 21 nt, Human
ugcuuuaugggaaaaauguca

SEQ ID NO: 371073 - RNA, 22 nt, Human
gccacucaugggaggugugcaa

SEQ ID NO: 371074 - RNA, 22 nt, Human
ucugucugacaggguaugaacu

SEQ ID NO: 371075 - RNA, 22 nt, Human
ccagaggaaaaauaucucccua

SEQ ID NO: 371076 - RNA, 22 nt, Human
cugugucucuccuuacaagacu

SEQ ID NO: 371077 - RNA, 22 nt, Human
cagcuucuggcguggagccuga

SEQ ID NO: 371078 - RNA, 22 nt, Human
caguuuauuuccaagaugacaa

SEQ ID NO: 371079 - RNA, 22 nt, Human
agaaauguauucuguauguuuu

SEQ ID NO: 371080 - RNA, 22 nt, Human
uuguuucaaauauuucagaaua

SEQ ID NO: 371081 - RNA, 22 nt, Human
aaagcucuuuuccaaguauuga

SEQ ID NO: 371082 - RNA, 22 nt, Human
ucagucucuggggcuucuguuu

SEQ ID NO: 371083 - RNA, 22 nt, Human
ucacauacacuaggauauuuuu

SEQ ID NO: 371084 - RNA, 22 nt, Human
uucuuucacucaagaaggaucu

SEQ ID NO: 371085 - RNA, 22 nt, Human
gcacacacaugugaguacaugc

SEQ ID NO: 371086 - RNA, 22 nt, Human
cucccugguguccccuccagga

SEQ ID NO: 371087 - RNA, 22 nt, Human
cauucuuauauuuacucauuca

SEQ ID NO: 371088 - RNA, 22 nt, Human
aauaaauguuaagauugucuca

SEQ ID NO: 371089 - RNA, 22 nt, Human
ucugucugagggagugacauuu

SEQ ID NO: 371090 - RNA, 22 nt, Human
ccucccaccauuuagagagagc

SEQ ID NO: 371091 - RNA, 22 nt, Human
augggcagagcuggugggaggc

SEQ ID NO: 371092 - RNA, 22 nt, Human
ugugaauacagcaugugcuucu

SEQ ID NO: 371093 - RNA, 22 nt, Human
ucagagugcagcgggaggcugg

SEQ ID NO: 371094 - RNA, 22 nt, Human
caagauggaguccgggaaugug

SEQ ID NO: 371095 - RNA, 23 nt, Human
cuuuuaacuugaucugagaccag

SEQ ID NO: 371096 - RNA, 22 nt, Human
cugaggcaguuuaauuuuugaa

SEQ ID NO: 371097 - RNA, 22 nt, Human
ccugagggaggguauaggcugu

SEQ ID NO: 371098 - RNA, 21 nt, Human
accaaaaccuauacuuucugu

SEQ ID NO: 371099 - RNA, 22 nt, Human
gaucuucuauguaaugaagugu

SEQ ID NO: 371100 - RNA, 21 nt, Human
ugggcacugagggugcugcuc

SEQ ID NO: 371101 - RNA, 21 nt, Human
cugugcuucuuccuaagccag

SEQ ID NO: 371102 - RNA, 22 nt, Human
uagggcagccacccaggcugcu

SEQ ID NO: 371103 - RNA, 18 nt, Human
ggagccagucugucucug

SEQ ID NO: 371104 - RNA, 22 nt, Human
aucaggauccaccuugagccug

SEQ ID NO: 371105 - RNA, 22 nt, Human
ucuagaaauuuugccuuguauu

SEQ ID NO: 371106 - RNA, 22 nt, Human
gaaucucaaggcuugugaggau

SEQ ID NO: 371107 - RNA, 22 nt, Human
cugccugcaugcugccauagcu

SEQ ID NO: 371108 - RNA, 22 nt, Human
cagggugacugcccuggccacu

SEQ ID NO: 371109 - RNA, 22 nt, Human
cagcauggcuugaguguuuccu

SEQ ID NO: 371110 - RNA, 22 nt, Human
aggcaagcauuuaaccacucau

SEQ ID NO: 371111 - RNA, 22 nt, Human
ucuggcucuccagugcucuuag

SEQ ID NO: 371112 - RNA, 22 nt, Human
acauuaucccuggcacaacugc

SEQ ID NO: 371113 - RNA, 22 nt, Human
auuccaaacgccucgcggacuu

SEQ ID NO: 371114 - RNA, 22 nt, Human
gaggccugguagccgagcccca

SEQ ID NO: 371115 - RNA, 22 nt, Human
caagagcuacccugugccauau

SEQ ID NO: 371116 - RNA, 22 nt, Human
auggaaaggcuguggaaacuua

SEQ ID NO: 371117 - RNA, 22 nt, Human
acauuuaggauguuuugagaga

SEQ ID NO: 371118 - RNA, 22 nt, Human
ggaggccuagccagcuccaguu

SEQ ID NO: 371119 - RNA, 22 nt, Human
auaaacaguagagaaagguggu

SEQ ID NO: 371120 - RNA, 20 nt, Human
aagagaggaaguuauacuag

SEQ ID NO: 371121 - RNA, 22 nt, Human
cugcccuguuuggacagcccgg

SEQ ID NO: 371122 - RNA, 22 nt, Human
cagggcugcuggccgugcccuc

SEQ ID NO: 371123 - RNA, 22 nt, Human
agagccagagaccuggguucac

SEQ ID NO: 371124 - RNA, 21 nt, Human
augaagucuaugcuucugugu

SEQ ID NO: 371125 - RNA, 22 nt, Human
cugagguggaacagaggugaag

SEQ ID NO: 371126 - RNA, 22 nt, Human
ucucucagggggaaggcugaag

SEQ ID NO: 371127 - RNA, 22 nt, Human
ugagcccuaagggucaagcagg

SEQ ID NO: 371128 - RNA, 22 nt, Human
auaucacaaacaagucuguacu

SEQ ID NO: 371129 - RNA, 22 nt, Human
ccagcucccugaagccuggucu

SEQ ID NO: 371130 - RNA, 22 nt, Human
gucugucaucugagauggagug

SEQ ID NO: 371131 - RNA, 22 nt, Human
uaaagcacauaucuuacaauaa

SEQ ID NO: 371132 - RNA, 23 nt, Human
guuuucaacacaauaaauguaac

SEQ ID NO: 371133 - RNA, 22 nt, Human
cccugcagagaccacugaccuu

SEQ ID NO: 371134 - RNA, 22 nt, Human
auaaacagaguaguugcuacug

SEQ ID NO: 371135 - RNA, 22 nt, Human
gucacaggccuggaugaggggc

SEQ ID NO: 371136 - RNA, 22 nt, Human
ucaaauaccagcuuuuccagaa

SEQ ID NO: 371137 - RNA, 22 nt, Human
aggccuagaggaauggccaggg

SEQ ID NO: 371138 - RNA, 20 nt, Human
ggcugugcccuuccguggcc

SEQ ID NO: 371139 - RNA, 22 nt, Human
aggugcagaaaaaaguccuuua

SEQ ID NO: 371140 - RNA, 21 nt, Human
ucuugaaaauuguagcaguuu

SEQ ID NO: 371141 - RNA, 21 nt, Human
ucaguaaaccuaaagauugua

SEQ ID NO: 371142 - RNA, 22 nt, Human
uagaaacagcauauauuagccc

SEQ ID NO: 371143 - RNA, 18 nt, Human
ucugucucuguccuugcu

SEQ ID NO: 371144 - RNA, 22 nt, Human
caaauguauaaauguacuuucu

SEQ ID NO: 371145 - RNA, 22 nt, Human
gggaucagcaagccacugcacc

SEQ ID NO: 371146 - RNA, 22 nt, Human
cugagagcagggacuugagcca

SEQ ID NO: 371147 - RNA, 22 nt, Human
ugcuucaggaagaaacgccagg

SEQ ID NO: 371148 - RNA, 22 nt, Human
uuugacauugccaauuugcuca

SEQ ID NO: 371149 - RNA, 22 nt, Human
acgagagguccuuagaaucugu

SEQ ID NO: 371150 - RNA, 22 nt, Human
aaagcagcagcaccugcauuuc

SEQ ID NO: 371151 - RNA, 22 nt, Human
uucaagauaauaggaaugaaaa

SEQ ID NO: 371152 - RNA, 22 nt, Human
gugccagcaguuauggugauuu

SEQ ID NO: 371153 - RNA, 22 nt, Human
gagcagugguugaacagaggca

SEQ ID NO: 371154 - RNA, 22 nt, Human
cccaggcagggacgugcucugg

SEQ ID NO: 371155 - RNA, 22 nt, Human
gaggcucaguuaugucaucagg

SEQ ID NO: 371156 - RNA, 22 nt, Human
aggcccaguccucugccgucug

SEQ ID NO: 371157 - RNA, 22 nt, Human
agggccugggccagcacccuuu

SEQ ID NO: 371158 - RNA, 19 nt, Human
cagaaauagcgaaguguaa

SEQ ID NO: 371159 - RNA, 22 nt, Human
aagauuauggcagauaacaauu

SEQ ID NO: 371160 - RNA, 22 nt, Human
cagcagggcccccgggugcgcc

SEQ ID NO: 371161 - RNA, 22 nt, Human
acaggcuggugguccuggccau

SEQ ID NO: 371162 - RNA, 22 nt, Human
aauauaugagggagcuauuuga

SEQ ID NO: 371163 - RNA, 22 nt, Human
cccagccucugggcucacccaa

SEQ ID NO: 371164 - RNA, 22 nt, Human
gaagcucucaaacucuccccuu

SEQ ID NO: 371165 - RNA, 19 nt, Human
cucuccagcuccaguagcu

SEQ ID NO: 371166 - RNA, 22 nt, Human
auacaugugggucuaaacauau

SEQ ID NO: 371167 - RNA, 22 nt, Human
agcugcucugauaaaccuacuu

SEQ ID NO: 371168 - RNA, 22 nt, Human
aagucagagcaacugagacauu

SEQ ID NO: 371169 - RNA, 22 nt, Human
uucccaggcugugcuaccagag

SEQ ID NO: 371170 - RNA, 22 nt, Human
gcccagcaccucucucaggguu

SEQ ID NO: 371171 - RNA, 22 nt, Human
aaggcacugcuuugcugcgccc

SEQ ID NO: 371172 - RNA, 22 nt, Human
uacccagcuccucagaagacca

SEQ ID NO: 371173 - RNA, 22 nt, Human
acucuugucucaacuuuuguau

SEQ ID NO: 371174 - RNA, 18 nt, Human
acccucuggcuucugagc

SEQ ID NO: 371175 - RNA, 22 nt, Human
gaggccagaguuccccgaguca

SEQ ID NO: 371176 - RNA, 22 nt, Human
caaacugagcaucagaaaguuu

SEQ ID NO: 371177 - RNA, 22 nt, Human
cucaugauguagcgaaugagaa

SEQ ID NO: 371178 - RNA, 22 nt, Human
ccuuagagaguacugggcugcc

SEQ ID NO: 371179 - RNA, 22 nt, Human
aucagcaagauguaauuucuau

SEQ ID NO: 371180 - RNA, 22 nt, Human
ugucucaguucccuucucugga

SEQ ID NO: 371181 - RNA, 22 nt, Human
cacagccugcugcacucaagaa

SEQ ID NO: 371182 - RNA, 22 nt, Human
aaagccacguggccuggggagc

SEQ ID NO: 371183 - RNA, 22 nt, Human
ucccaggguccucuucuggaau

SEQ ID NO: 371184 - RNA, 20 nt, Human
caauuucaucauuuccugug

SEQ ID NO: 371185 - RNA, 22 nt, Human
ggcugccaggagggaggccagu

SEQ ID NO: 371186 - RNA, 22 nt, Human
uagaaucuaguucauucauuug

SEQ ID NO: 371187 - RNA, 22 nt, Human
uaacagaagagcaggcagcccu

SEQ ID NO: 371188 - RNA, 22 nt, Human
ucccacugugccuguuguaauc

SEQ ID NO: 371189 - RNA, 22 nt, Human
uuuccuaugauauucuaugugu

SEQ ID NO: 371190 - RNA, 22 nt, Human
ggacagcugcuuucaggccaca

SEQ ID NO: 371191 - RNA, 22 nt, Human
ugaggccaaugacccugggcag

SEQ ID NO: 371192 - RNA, 22 nt, Human
auaugaaaagaagucaccauug

SEQ ID NO: 371193 - RNA, 22 nt, Human
uuuccucuucuucccaugucau

SEQ ID NO: 371194 - RNA, 22 nt, Human
cagaauuuaaguggauuauucu

SEQ ID NO: 371195 - RNA, 22 nt, Human
guacagaaggagcuuuggauuc

SEQ ID NO: 371196 - RNA, 22 nt, Human
uuuccaaaguugccauaagcuu

SEQ ID NO: 371197 - RNA, 22 nt, Human
ugaguucucacccauucuucuu

SEQ ID NO: 371198 - RNA, 19 nt, Human
acaagucacuuacuuagua

SEQ ID NO: 371199 - RNA, 22 nt, Human
cuuagggagaaugccucugcag

SEQ ID NO: 371200 - RNA, 22 nt, Human
ggcugccuggaccuccucuuuc

SEQ ID NO: 371201 - RNA, 22 nt, Human
ccaucagcuccaguaucuucug

SEQ ID NO: 371202 - RNA, 22 nt, Human
ucuggauccuaugcacuggacu

SEQ ID NO: 371203 - RNA, 19 nt, Human
ccaggccaucccaguuccc

SEQ ID NO: 371204 - RNA, 22 nt, Human
cauuugaaccuggauguucuua

SEQ ID NO: 371205 - RNA, 22 nt, Human
uauguguacaucugguugagca

SEQ ID NO: 371206 - RNA, 22 nt, Human
cccaggagguuggggcuacagu

SEQ ID NO: 371207 - RNA, 22 nt, Human
gggcugaguuccugccucacuc

SEQ ID NO: 371208 - RNA, 22 nt, Human
cugugcagcuggcuuccuggaa

SEQ ID NO: 371209 - RNA, 22 nt, Human
ucuuuccuagaggcugaugagu

SEQ ID NO: 371210 - RNA, 22 nt, Human
cugaaagaauaagauguuuaca

SEQ ID NO: 371211 - RNA, 22 nt, Human
cggagggguuugaacagaggag

SEQ ID NO: 371212 - RNA, 18 nt, Human
aggccugggaagcugagg

SEQ ID NO: 371213 - RNA, 22 nt, Human
uccuggccgccgcguggggccg

SEQ ID NO: 371214 - RNA, 22 nt, Human
cucugcugcccaggccugcuag

SEQ ID NO: 371215 - RNA, 22 nt, Human
uauggcuugucuuuauaccagg

SEQ ID NO: 371216 - RNA, 22 nt, Human
ggauuuacaaguuuaacucuca

SEQ ID NO: 371217 - RNA, 22 nt, Human
aaggugucaccagauuggcagg

SEQ ID NO: 371218 - RNA, 21 nt, Human
ugaaagaaggugcagucugaa

SEQ ID NO: 371219 - RNA, 22 nt, Human
acuauacagaagaggauaggaa

SEQ ID NO: 371220 - RNA, 22 nt, Human
cuccagggagcuuggaaagacc

SEQ ID NO: 371221 - RNA, 22 nt, Human
guuccaaauuuggaucuuuagg

SEQ ID NO: 371222 - RNA, 22 nt, Human
cuucuuuacuuucuagaaauaa

SEQ ID NO: 371223 - RNA, 22 nt, Human
cugcuguggccagccaggucaa

SEQ ID NO: 371224 - RNA, 22 nt, Human
uaaaggcuucugcagggacuga

SEQ ID NO: 371225 - RNA, 18 nt, Human
uuucacaaccuccagagg

SEQ ID NO: 371226 - RNA, 22 nt, Human
gggagggaaagcuugaucuguc

SEQ ID NO: 371227 - RNA, 22 nt, Human
agggagguaggagcuucuagcu

SEQ ID NO: 371228 - RNA, 22 nt, Human
ggcagugguuagaaacaugagc

SEQ ID NO: 371229 - RNA, 22 nt, Human
caggaagcugagcugcacugca

SEQ ID NO: 371230 - RNA, 22 nt, Human
guacagaaauggggccccaggu

SEQ ID NO: 371231 - RNA, 22 nt, Human
uggagccaugccuggccuuucc

SEQ ID NO: 371232 - RNA, 22 nt, Human
uuguuaaaaugcauauucuggu

SEQ ID NO: 371233 - RNA, 22 nt, Human
acaugcuucauauuauaaccaa

SEQ ID NO: 371234 - RNA, 22 nt, Human
aacaugaaguuuucuauaguga

SEQ ID NO: 371235 - RNA, 22 nt, Human
uagggaggaggguuuucaaauc

SEQ ID NO: 371236 - RNA, 22 nt, Human
cuggccuuuuguuucuggagaa

SEQ ID NO: 371237 - RNA, 22 nt, Human
aaggcagcccuggcucagccug

SEQ ID NO: 371238 - RNA, 22 nt, Human
aaagggaggggcgauaagccgg

SEQ ID NO: 371239 - RNA, 23 nt, Human
cagaggcaucggauucaacauca

SEQ ID NO: 371240 - RNA, 22 nt, Human
cugugauuguuaguuccuauac

SEQ ID NO: 371241 - RNA, 22 nt, Human
gaggcugaggguuagagaguca

SEQ ID NO: 371242 - RNA, 22 nt, Human
caucacagauguuguguggagu

SEQ ID NO: 371243 - RNA, 23 nt, Human
uggcucugagcuuccugguggcc

SEQ ID NO: 371244 - RNA, 22 nt, Human
agauuucaauggauauugcaag

SEQ ID NO: 371245 - RNA, 22 nt, Human
aaagcagcagcacguggaagag

SEQ ID NO: 371246 - RNA, 22 nt, Human
ucgagcucuggagccaaggaug

SEQ ID NO: 371247 - RNA, 22 nt, Human
guuaggcaauaccucuuacacc

SEQ ID NO: 371248 - RNA, 22 nt, Human
cuggagcuggcuuccuuccacu

SEQ ID NO: 371249 - RNA, 23 nt, Human
gggaccugguaggaggugauugg

SEQ ID NO: 371250 - RNA, 22 nt, Human
aauguguguauuucuaggcgag

SEQ ID NO: 371251 - RNA, 22 nt, Human
gacagcagacagaacuaccugc

SEQ ID NO: 371252 - RNA, 22 nt, Human
ucagaagguggagguugcagug

SEQ ID NO: 371253 - RNA, 22 nt, Human
cagggcuccccgcaccgcagcc

SEQ ID NO: 371254 - RNA, 21 nt, Human
auuuccaaggguaccuaagau

SEQ ID NO: 371255 - RNA, 22 nt, Human
acuuccaaauaccaucacauug

SEQ ID NO: 371256 - RNA, 22 nt, Human
ggcagcuaggggcagggaauuc

SEQ ID NO: 371257 - RNA, 22 nt, Human
ugcugucaguuggcaggaugag

SEQ ID NO: 371258 - RNA, 22 nt, Human
acagaauuugcuugggcaaugg

SEQ ID NO: 371259 - RNA, 22 nt, Human
gcugcaggcauuuuccugggca

SEQ ID NO: 371260 - RNA, 19 nt, Human
cugugcuuuaaacuccuau

SEQ ID NO: 371261 - RNA, 22 nt, Human
cacaggcuccggccuugcagcc

SEQ ID NO: 371262 - RNA, 22 nt, Human
gguggccaggccagcucuggcc

SEQ ID NO: 371263 - RNA, 22 nt, Human
cauaacaguggcuucagcaagu

SEQ ID NO: 371264 - RNA, 22 nt, Human
ugaggcaggagaaucaccggaa

SEQ ID NO: 371265 - RNA, 22 nt, Human
caggacagcucaacaccuccuc

SEQ ID NO: 371266 - RNA, 22 nt, Human
aaagaaggaugggagaaauccu

SEQ ID NO: 371267 - RNA, 22 nt, Human
agccaacuaggagauuaaggua

SEQ ID NO: 371268 - RNA, 17 nt, Human
ccagagaguaguuagga

SEQ ID NO: 371269 - RNA, 22 nt, Human
cgcugccaggauccccugccgg

SEQ ID NO: 371270 - RNA, 20 nt, Human
ccugucuccucuuaccuggc

SEQ ID NO: 371271 - RNA, 22 nt, Human
acaacacagcaaaaccccaucu

SEQ ID NO: 371272 - RNA, 22 nt, Human
uagggcugccuauggcuagaua

SEQ ID NO: 371273 - RNA, 22 nt, Human
ggaggccaguccuggccgggcu

SEQ ID NO: 371274 - RNA, 22 nt, Human
aguccuuaugugguggagagag

SEQ ID NO: 371275 - RNA, 22 nt, Human
cauuguuaauugguaucuuaca

SEQ ID NO: 371276 - RNA, 22 nt, Human
ggcagauggaagaggcuggguc

SEQ ID NO: 371277 - RNA, 22 nt, Human
uugaaagggauauaucuuucug

SEQ ID NO: 371278 - RNA, 22 nt, Human
ggaggaugccaagcugugcaca

SEQ ID NO: 371279 - RNA, 22 nt, Human
gcuauacacauuucuugguagu

SEQ ID NO: 371280 - RNA, 22 nt, Human
ucugucacugagcucaggauuc

SEQ ID NO: 371281 - RNA, 22 nt, Human
ggcagaggugaaguucacaagg

SEQ ID NO: 371282 - RNA, 21 nt, Human
gccucugcugucuuauuguga

SEQ ID NO: 371283 - RNA, 22 nt, Human
uugucugaaagaucauuacauu

SEQ ID NO: 371284 - RNA, 22 nt, Human
uuucagggagccuagaagagcu

SEQ ID NO: 371285 - RNA, 22 nt, Human
ccugucacgaugacugcacucu

SEQ ID NO: 371286 - RNA, 22 nt, Human
agcugcugugugcucaggcagg

SEQ ID NO: 371287 - RNA, 22 nt, Human
uucaugugaucacagauuguaa

SEQ ID NO: 371288 - RNA, 21 nt, Human
agaagccaugugguggagaac

SEQ ID NO: 371289 - RNA, 22 nt, Human
gugucauggaaaauugcaaugg

SEQ ID NO: 371290 - RNA, 22 nt, Human
guaggaaagggagugaagggaa

SEQ ID NO: 371291 - RNA, 22 nt, Human
cucugugccucaguuuucuucu

SEQ ID NO: 371292 - RNA, 20 nt, Human
agauuauuccuaagauuucu

SEQ ID NO: 371293 - RNA, 22 nt, Human
aagcagccuggcaugaugcuuu

SEQ ID NO: 371294 - RNA, 22 nt, Human
gagccaggcccguacuugcugu

SEQ ID NO: 371295 - RNA, 17 nt, Human
cccacggaggugugaaa

SEQ ID NO: 371296 - RNA, 22 nt, Human
cagcccugagagaaccaucuau

SEQ ID NO: 371297 - RNA, 22 nt, Human
agccaaggacacggagccuccu

SEQ ID NO: 371298 - RNA, 20 nt, Human
ucugaggcugagcucuacuu

SEQ ID NO: 371299 - RNA, 22 nt, Human
uguagaaagaauauguuucaua

SEQ ID NO: 371300 - RNA, 22 nt, Human
aaauacuguagauaauagaguu

SEQ ID NO: 371301 - RNA, 22 nt, Human
augaaggauggcuggcugcccu

SEQ ID NO: 371302 - RNA, 22 nt, Human
gcagggccuuagcagcggcugc

SEQ ID NO: 371303 - RNA, 22 nt, Human
gcuccaggagagggaagcagau

SEQ ID NO: 371304 - RNA, 20 nt, Human
ucucugcuguccacauuugc

SEQ ID NO: 371305 - RNA, 22 nt, Human
ccuggaaggugaugguacagca

SEQ ID NO: 371306 - RNA, 22 nt, Human
aauaacaggcucaucagaugcu

SEQ ID NO: 371307 - RNA, 22 nt, Human
aaugcuguauaucuuagcuaau

SEQ ID NO: 371308 - RNA, 22 nt, Human
ggcuccuguccccucagcugcu

SEQ ID NO: 371309 - RNA, 22 nt, Human
ccagcagguguagggcucaugg

SEQ ID NO: 371310 - RNA, 22 nt, Human
aaccugcaguuuuuauucugag

SEQ ID NO: 371311 - RNA, 22 nt, Human
gaggcaguguuuacugcccugu

SEQ ID NO: 371312 - RNA, 22 nt, Human
ccugccagugaagcugacgggc

SEQ ID NO: 371313 - RNA, 22 nt, Human
uggauuuaccacagggccacag

SEQ ID NO: 371314 - RNA, 22 nt, Human
uguggccaccagagcugcuauu

SEQ ID NO: 371315 - RNA, 22 nt, Human
ggcugccuucccugagccccgg

SEQ ID NO: 371316 - RNA, 22 nt, Human
auuuguagugaagugaaaauaa

SEQ ID NO: 371317 - RNA, 22 nt, Human
guuagaaagugucugcuugggu

SEQ ID NO: 371318 - RNA, 22 nt, Human
ggcugucucugugacugccacc

SEQ ID NO: 371319 - RNA, 22 nt, Human
ccacguccagcuaauuuucgua

SEQ ID NO: 371320 - RNA, 21 nt, Human
ucaggggcuguguuuuccauc

SEQ ID NO: 371321 - RNA, 22 nt, Human
ggccaggagaggagggcacuga

SEQ ID NO: 371322 - RNA, 21 nt, Human
uucuuuccccagaggacuaaa

SEQ ID NO: 371323 - RNA, 22 nt, Human
ugccucugggugaccaaggagc

SEQ ID NO: 371324 - RNA, 20 nt, Human
augccucuaauuuugcaaac

SEQ ID NO: 371325 - RNA, 22 nt, Human
acagcugugaagcaagcacucu

SEQ ID NO: 371326 - RNA, 22 nt, Human
uuuguuaauucuuauguuagag

SEQ ID NO: 371327 - RNA, 22 nt, Human
gaagcuucguggcucuucaaau

SEQ ID NO: 371328 - RNA, 19 nt, Human
ggccaccucucuucccagg

SEQ ID NO: 371329 - RNA, 22 nt, Human
gcaccugggcaaggauucagag

SEQ ID NO: 371330 - RNA, 22 nt, Human
gagagcugggcuuugggugaag

SEQ ID NO: 371331 - RNA, 22 nt, Human
cuucucucccuggcacucagac

SEQ ID NO: 371332 - RNA, 22 nt, Human
ucagggcagaauccaaagaauu

SEQ ID NO: 371333 - RNA, 22 nt, Human
acagaauuuaaagcucuagacu

SEQ ID NO: 371334 - RNA, 22 nt, Human
ccaggagauuuuuccauagcac

SEQ ID NO: 371335 - RNA, 22 nt, Human
ggagggacccacucuagaggug

SEQ ID NO: 371336 - RNA, 22 nt, Human
ucauuauuuuggacuggagugu

SEQ ID NO: 371337 - RNA, 22 nt, Human
aggcagaugggagcuggaaguu

SEQ ID NO: 371338 - RNA, 22 nt, Human
uaagugcaauguuuuacuuaaa

SEQ ID NO: 371339 - RNA, 22 nt, Human
gggauggacuuggggacuccag

SEQ ID NO: 371340 - RNA, 22 nt, Human
cuuauaaaguccaucugaacaa

SEQ ID NO: 371341 - RNA, 22 nt, Human
uggcgugcccuccagacuuggc

SEQ ID NO: 371342 - RNA, 21 nt, Human
gccugcagaccccaccaggcu

SEQ ID NO: 371343 - RNA, 22 nt, Human
uuucacaucagagguagauuag

SEQ ID NO: 371344 - RNA, 22 nt, Human
ccugagggaaggaugcuaccca

SEQ ID NO: 371345 - RNA, 22 nt, Human
gcaggagagccagcaggcuucc

SEQ ID NO: 371346 - RNA, 22 nt, Human
ucagaggacgcacuaggguugu

SEQ ID NO: 371347 - RNA, 22 nt, Human
cccaguccuaaagcagacgcca

SEQ ID NO: 371348 - RNA, 22 nt, Human
gcguuaauaacauuaauaaugc

SEQ ID NO: 371349 - RNA, 23 nt, Human
cuggccuccgacacuggccaaga

SEQ ID NO: 371350 - RNA, 22 nt, Human
uugggcugaaguagagggcaga

SEQ ID NO: 371351 - RNA, 20 nt, Human
cagggcucugggccuggccu

SEQ ID NO: 371352 - RNA, 22 nt, Human
uggaaagaaaaacaggccauga

SEQ ID NO: 371353 - RNA, 22 nt, Human
ugcagucuuccagcugcacaaa

SEQ ID NO: 371354 - RNA, 22 nt, Human
cugccuugaaaaugaagcuuua

SEQ ID NO: 371355 - RNA, 22 nt, Human
ccugucuggaacauggccuguu

SEQ ID NO: 371356 - RNA, 22 nt, Human
cagcuggcauaccugggcccgg

SEQ ID NO: 371357 - RNA, 22 nt, Human
gcccagagagaugcuguagacc

SEQ ID NO: 371358 - RNA, 22 nt, Human
cugagcgcaugguugcugggga

SEQ ID NO: 371359 - RNA, 21 nt, Human
auaagcaugcugauuacauuu

SEQ ID NO: 371360 - RNA, 22 nt, Human
gcagggcaugggcccugucugc

SEQ ID NO: 371361 - RNA, 22 nt, Human
cugcagcuguagaggacagugg

SEQ ID NO: 371362 - RNA, 22 nt, Human
ugugaccucaucuuaacuggaa

SEQ ID NO: 371363 - RNA, 22 nt, Human
ucauuuuucacacagggucacc

SEQ ID NO: 371364 - RNA, 19 nt, Human
agugguagaugagcaggag

SEQ ID NO: 371365 - RNA, 22 nt, Human
uacaguaagaugaaauagcaau

SEQ ID NO: 371366 - RNA, 22 nt, Human
ggccucugcaacuggcuguggc

SEQ ID NO: 371367 - RNA, 22 nt, Human
acuguguguuugucuagcacag

SEQ ID NO: 371368 - RNA, 22 nt, Human
ucauccagccucaucaggagcu

SEQ ID NO: 371369 - RNA, 22 nt, Human
acuuucuaggucucaguccuuu

SEQ ID NO: 371370 - RNA, 16 nt, Human
ugggaccuguggccaa

SEQ ID NO: 371371 - RNA, 22 nt, Human
ggcagaaggccucccagcuccu

SEQ ID NO: 371372 - RNA, 18 nt, Human
uccugccugugccccagg

SEQ ID NO: 371373 - RNA, 22 nt, Human
ucucucagucagaugcuaaaga

SEQ ID NO: 371374 - RNA, 22 nt, Human
cagagccaggccugcccucuuu

SEQ ID NO: 371375 - RNA, 22 nt, Human
gcacagggcaacaggucuguua

SEQ ID NO: 371376 - RNA, 22 nt, Human
gcucugaggcugugaggugcug

SEQ ID NO: 371377 - RNA, 22 nt, Human
gggcuggcaucaguugccgaga

SEQ ID NO: 371378 - RNA, 22 nt, Human
uauguuaagugggauaaucaaa

SEQ ID NO: 371379 - RNA, 22 nt, Human
gaaagaagcuuuagauggcuau

SEQ ID NO: 371380 - RNA, 22 nt, Human
ggcugagccuggagcaucuggu

SEQ ID NO: 371381 - RNA, 22 nt, Human
ucaguuuucauuucaugagcag

SEQ ID NO: 371382 - RNA, 22 nt, Human
gugacagucaaagacaugacuu

SEQ ID NO: 371383 - RNA, 22 nt, Human
uguaugcaaauuuauuagcaca

SEQ ID NO: 371384 - RNA, 22 nt, Human
aagaagaugguuaacuuucagu

SEQ ID NO: 371385 - RNA, 22 nt, Human
ggucagcagugcagggcagagc

SEQ ID NO: 371386 - RNA, 22 nt, Human
uuuuccagauuggacuuagucc

SEQ ID NO: 371387 - RNA, 20 nt, Human
ucagaugggagugagccauc

SEQ ID NO: 371388 - RNA, 22 nt, Human
ugugccugaguuggcugaguac

SEQ ID NO: 371389 - RNA, 22 nt, Human
caaagccaggcuuucuaaugua

SEQ ID NO: 371390 - RNA, 22 nt, Human
ugcacauuuguuauuuugaggu

SEQ ID NO: 371391 - RNA, 23 nt, Human
uuguuuuuagagguggcaugaga

SEQ ID NO: 371392 - RNA, 22 nt, Human
auaaaauuugcuacuguuaaau

SEQ ID NO: 371393 - RNA, 22 nt, Human
aguggccagugcugcucugggg

SEQ ID NO: 371394 - RNA, 22 nt, Human
cagucccaguuugagacucugg

SEQ ID NO: 371395 - RNA, 22 nt, Human
ggaaccaguggaaugauaugcu

SEQ ID NO: 371396 - RNA, 22 nt, Human
uucagaaaaaacuucaauaagu

SEQ ID NO: 371397 - RNA, 22 nt, Human
gcucacugcaaccucugcuucc

SEQ ID NO: 371398 - RNA, 22 nt, Human
aagcugcccaagacugaagcau

SEQ ID NO: 371399 - RNA, 22 nt, Human
auucuuaauugccaugcuguau

SEQ ID NO: 371400 - RNA, 22 nt, Human
aaugaaauguagcuuauccaua

SEQ ID NO: 371401 - RNA, 22 nt, Human
uguaauauuguagugacaguac

SEQ ID NO: 371402 - RNA, 22 nt, Human
ucuucaaguuccaaagugcagg

SEQ ID NO: 371403 - RNA, 22 nt, Human
ugagcccaggaguuggagaccg

SEQ ID NO: 371404 - RNA, 22 nt, Human
aggguggccaugagggagagau

SEQ ID NO: 371405 - RNA, 22 nt, Human
aggaggcacucacucucagggu

SEQ ID NO: 371406 - RNA, 22 nt, Human
uuaaauauuuucagcaggguca

SEQ ID NO: 371407 - RNA, 22 nt, Human
cacacaugagucuccccauugg

SEQ ID NO: 371408 - RNA, 22 nt, Human
uaagucauaagucaugauguua

SEQ ID NO: 371409 - RNA, 22 nt, Human
ggaggggaacuaaucccgugac

SEQ ID NO: 371410 - RNA, 22 nt, Human
accugcagguguuuccacacuu

SEQ ID NO: 371411 - RNA, 22 nt, Human
uagcuuuagaaauauucucaga

SEQ ID NO: 371412 - RNA, 22 nt, Human
ucaaacaggacuacauucucau

SEQ ID NO: 371413 - RNA, 22 nt, Human
ggucucaggagacuggagagca

SEQ ID NO: 371414 - RNA, 22 nt, Human
aauguuuuaaaagagauugaga

SEQ ID NO: 371415 - RNA, 22 nt, Human
gacauuucaaucucauuauggg

SEQ ID NO: 371416 - RNA, 22 nt, Human
agagucuuccaggcagccugag

SEQ ID NO: 371417 - RNA, 22 nt, Human
uuucuucucacccaggacagag

SEQ ID NO: 371418 - RNA, 22 nt, Human
uaucaaaguuguccugugaagu

SEQ ID NO: 371419 - RNA, 22 nt, Human
uuucagaaagcugaacauauga

SEQ ID NO: 371420 - RNA, 22 nt, Human
uccugcagagacagaggccuca

SEQ ID NO: 371421 - RNA, 22 nt, Human
gaggcucagggaguauaugaau

SEQ ID NO: 371422 - RNA, 22 nt, Human
aaguguguauuguuuaugcugc

SEQ ID NO: 371423 - RNA, 22 nt, Human
ggccccuggcaccaggcugauu

SEQ ID NO: 371424 - RNA, 22 nt, Human
aggcagacugugcgggaagagu

SEQ ID NO: 371425 - RNA, 19 nt, Human
gccacuccugaugcugccc

SEQ ID NO: 371426 - RNA, 20 nt, Human
agugugcauuuagagucugc

SEQ ID NO: 371427 - RNA, 22 nt, Human
guuaggcaaauaacuguggagc

SEQ ID NO: 371428 - RNA, 22 nt, Human
acauucuuaacaguuaaaaacu

SEQ ID NO: 371429 - RNA, 22 nt, Human
cccaccaguacagaugguagau

SEQ ID NO: 371430 - RNA, 22 nt, Human
ccuggccucuccgaguaaccug

SEQ ID NO: 371431 - RNA, 22 nt, Human
agggccaguaccaggugggugg

SEQ ID NO: 371432 - RNA, 22 nt, Human
ucaguuucuaaaucuuaccaau

SEQ ID NO: 371433 - RNA, 22 nt, Human
uugagaagaggcuuuguaggaa

SEQ ID NO: 371434 - RNA, 22 nt, Human
acuuccuggcguagcugacauu

SEQ ID NO: 371435 - RNA, 22 nt, Human
uauaauccauucauugauuucu

SEQ ID NO: 371436 - RNA, 22 nt, Human
agcucacagaaauccugcagga

SEQ ID NO: 371437 - RNA, 22 nt, Human
uggcagagcccagaacugagca

SEQ ID NO: 371438 - RNA, 22 nt, Human
gggagggauuaguucugccugg

SEQ ID NO: 371439 - RNA, 23 nt, Human
ucugucaccuauggcugcucuuc

SEQ ID NO: 371440 - RNA, 22 nt, Human
gcuggugcauuagcugcaguuc

SEQ ID NO: 371441 - RNA, 22 nt, Human
uuugaagauaaauauggagaaa

SEQ ID NO: 371442 - RNA, 22 nt, Human
uuuccaaauaaggucacacuca

SEQ ID NO: 371443 - RNA, 22 nt, Human
uggagccugagucagcggaggc

SEQ ID NO: 371444 - RNA, 22 nt, Human
gucugagaaucuugcauaucau

SEQ ID NO: 371445 - RNA, 22 nt, Human
agcagagaagacacaggcuuca

SEQ ID NO: 371446 - RNA, 22 nt, Human
ggcccucccugagccagguggg

SEQ ID NO: 371447 - RNA, 22 nt, Human
aaucuggcucagaagaagauga

SEQ ID NO: 371448 - RNA, 22 nt, Human
gagcucccuggagguucagaua

SEQ ID NO: 371449 - RNA, 22 nt, Human
ugagccagauaagggcucacgc

SEQ ID NO: 371450 - RNA, 22 nt, Human
uaccugcacagccagccaugug

SEQ ID NO: 371451 - RNA, 22 nt, Human
ugcauuucagaagaaaauucgg

SEQ ID NO: 371452 - RNA, 22 nt, Human
auagugggaauuacgauauacu

SEQ ID NO: 371453 - RNA, 22 nt, Human
caaugugugcuuacaggccagu

SEQ ID NO: 371454 - RNA, 22 nt, Human
accucaggauguggacacagaa

SEQ ID NO: 371455 - RNA, 19 nt, Human
agcagagcagggccguggg

SEQ ID NO: 371456 - RNA, 22 nt, Human
guucuucaucauuuuagauagg

SEQ ID NO: 371457 - RNA, 22 nt, Human
ccauguggugggaaggagaaug

SEQ ID NO: 371458 - RNA, 18 nt, Human
cauuaugugguuauagaa

SEQ ID NO: 371459 - RNA, 22 nt, Human
agcugagcauuugauccaccuc

SEQ ID NO: 371460 - RNA, 22 nt, Human
auacaucuaugccuuucugaca

SEQ ID NO: 371461 - RNA, 23 nt, Human
ucacagggcacuggcugggguug

SEQ ID NO: 371462 - RNA, 22 nt, Human
gaggccuggguuggaggugcau

SEQ ID NO: 371463 - RNA, 22 nt, Human
agggcccaggacagcaucaggg

SEQ ID NO: 371464 - RNA, 22 nt, Human
gaaacuguauguaguuuuuggg

SEQ ID NO: 371465 - RNA, 22 nt, Human
agcuggccuguuagagcugagu

SEQ ID NO: 371466 - RNA, 22 nt, Human
uucuacaugguugcucagaggg

SEQ ID NO: 371467 - RNA, 22 nt, Human
caguggucugugcuucuguaca

SEQ ID NO: 371468 - RNA, 22 nt, Human
agcugcccuggcggagcugcuc

SEQ ID NO: 371469 - RNA, 22 nt, Human
uuuauuguuaucaugggugagu

SEQ ID NO: 371470 - RNA, 22 nt, Human
ucugucacccaggcuggagugc

SEQ ID NO: 371471 - RNA, 22 nt, Human
cuggggaggcagggcugccccu

SEQ ID NO: 371472 - RNA, 22 nt, Human
gagcuuaggccagggacaggga

SEQ ID NO: 371473 - RNA, 22 nt, Human
agcaggggcaggguuuugugcu

SEQ ID NO: 371474 - RNA, 22 nt, Human
agaacagaugugggcagaccug

SEQ ID NO: 371475 - RNA, 15 nt, Human
cagucccagggaccc

SEQ ID NO: 371476 - RNA, 22 nt, Human
gagugcaguaugagaggcugcu

SEQ ID NO: 371477 - RNA, 22 nt, Human
gcaaaggcuagagacacaggga

SEQ ID NO: 371478 - RNA, 22 nt, Human
agcugcucaggagagccagguc

SEQ ID NO: 371479 - RNA, 20 nt, Human
uaaggcuguuuuguauuccu

SEQ ID NO: 371480 - RNA, 22 nt, Human
acaugcauacaagcacauguag

SEQ ID NO: 371481 - RNA, 22 nt, Human
auggcaagcaagcugaagagau

SEQ ID NO: 371482 - RNA, 22 nt, Human
caagaaauguuuacugagcauc

SEQ ID NO: 371483 - RNA, 21 nt, Human
uuguucuuccagaagcaaagu

SEQ ID NO: 371484 - RNA, 22 nt, Human
caauuucuggaacuaauucuga

SEQ ID NO: 371485 - RNA, 17 nt, Human
ccagagcuacugagacu

SEQ ID NO: 371486 - RNA, 22 nt, Human
aagaugauaggacuugcuuaag

SEQ ID NO: 371487 - RNA, 22 nt, Human
gugcugucaauugcuuucagua

SEQ ID NO: 371488 - RNA, 22 nt, Human
aagugauuuguacaaaaugucg

SEQ ID NO: 371489 - RNA, 22 nt, Human
aagccgaggccacacagcagga

SEQ ID NO: 371490 - RNA, 22 nt, Human
ggagccuggcaaugcugcgucc

SEQ ID NO: 371491 - RNA, 22 nt, Human
uuacagaaggaacacuacucag

SEQ ID NO: 371492 - RNA, 22 nt, Human
gggcuggugaggcugcccugca

SEQ ID NO: 371493 - RNA, 22 nt, Human
agaaauguuuauggcugccuau

SEQ ID NO: 371494 - RNA, 22 nt, Human
aggcugagcugaccugguuugg

SEQ ID NO: 371495 - RNA, 19 nt, Human
cugcugggugcugagggag

SEQ ID NO: 371496 - RNA, 23 nt, Human
agggguggucaguacccgcagug

SEQ ID NO: 371497 - RNA, 22 nt, Human
gagagugaaggcuucccagcaa

SEQ ID NO: 371498 - RNA, 17 nt, Human
guccugggaggagagag

SEQ ID NO: 371499 - RNA, 22 nt, Human
ccaggagaugggaaaguagcag

SEQ ID NO: 371500 - RNA, 22 nt, Human
uaaaggcucguauuguugugug

SEQ ID NO: 371501 - RNA, 23 nt, Human
ucagagagcuguugagagcugcc

SEQ ID NO: 371502 - RNA, 22 nt, Human
ucauaaaguuacccaaauuuua

SEQ ID NO: 371503 - RNA, 22 nt, Human
auguucuguuuuguaauucaua

SEQ ID NO: 371504 - RNA, 21 nt, Human
uggcagggguaguaguacagc

SEQ ID NO: 371505 - RNA, 22 nt, Human
cagcugcccaggccaccuggag

SEQ ID NO: 371506 - RNA, 22 nt, Human
ggucaggguauaaucaagugag

SEQ ID NO: 371507 - RNA, 22 nt, Human
ugccaggccacguagcuucaag

SEQ ID NO: 371508 - RNA, 22 nt, Human
cugugucccccucagccaggug

SEQ ID NO: 371509 - RNA, 22 nt, Human
gcaggugggggucggugcaucu

SEQ ID NO: 371510 - RNA, 22 nt, Human
uggcuggcaguaggcuaguggc

SEQ ID NO: 371511 - RNA, 22 nt, Human
ucucagaggugcccuggcaucu

SEQ ID NO: 371512 - RNA, 22 nt, Human
ucaaaugcggucauggcuuuua

SEQ ID NO: 371513 - RNA, 22 nt, Human
cauggcuuuguucuguuagaug

SEQ ID NO: 371514 - RNA, 22 nt, Human
gaauuucaaagagguuaagagg

SEQ ID NO: 371515 - RNA, 22 nt, Human
aaaacuuucagggauacagaaa

SEQ ID NO: 371516 - RNA, 22 nt, Human
uaggagaggugaauggcacacu

SEQ ID NO: 371517 - RNA, 22 nt, Human
acauaccauacauggugagaug

SEQ ID NO: 371518 - RNA, 22 nt, Human
ccuggagcuuggucacgcugcg

SEQ ID NO: 371519 - RNA, 22 nt, Human
uauauucaaugauuaguaucag

SEQ ID NO: 371520 - RNA, 22 nt, Human
uuuauguuugacaaugaucugg

SEQ ID NO: 371521 - RNA, 21 nt, Human
uggcaggcagcuggaagcuug

SEQ ID NO: 371522 - RNA, 22 nt, Human
agggagaaugaccaagguauau

SEQ ID NO: 371523 - RNA, 22 nt, Human
auuccaaagccugaauaaugga

SEQ ID NO: 371524 - RNA, 19 nt, Human
accaggagacagugagcuu

SEQ ID NO: 371525 - RNA, 22 nt, Human
aggcucccaagcacugacccca

SEQ ID NO: 371526 - RNA, 22 nt, Human
caggguccaucuuucaucacug

SEQ ID NO: 371527 - RNA, 22 nt, Human
uucaggauggaguaccuuuuau

SEQ ID NO: 371528 - RNA, 22 nt, Human
gcucccagcaauugaggcagcc

SEQ ID NO: 371529 - RNA, 22 nt, Human
cucuggacagcaggugcugugg

SEQ ID NO: 371530 - RNA, 22 nt, Human
guucauauuacuuugagugcag

SEQ ID NO: 371531 - RNA, 22 nt, Human
gagaggaguagacacuuugguu

SEQ ID NO: 371532 - RNA, 22 nt, Human
acccaggguagaaccucagagc

SEQ ID NO: 371533 - RNA, 22 nt, Human
gcugagcucccagcaguaucug

SEQ ID NO: 371534 - RNA, 22 nt, Human
cuggaaugccucccugucagag

SEQ ID NO: 371535 - RNA, 22 nt, Human
ugugugccagccuacgaggagc

SEQ ID NO: 371536 - RNA, 22 nt, Human
uagggcuauaagagaauaagac

SEQ ID NO: 371537 - RNA, 22 nt, Human
gccagcagggcccaaaugcugg

SEQ ID NO: 371538 - RNA, 23 nt, Human
cagugcagggcaacucagacucc

SEQ ID NO: 371539 - RNA, 22 nt, Human
agugucauuuuguccaucuucu

SEQ ID NO: 371540 - RNA, 19 nt, Human
uugcauuguaguuggacug

SEQ ID NO: 371541 - RNA, 22 nt, Human
auccaugaucaauuuauuacua

SEQ ID NO: 371542 - RNA, 22 nt, Human
uggcucugagacacaggcucuc

SEQ ID NO: 371543 - RNA, 22 nt, Human
cugcugugaguuuggaggucua

SEQ ID NO: 371544 - RNA, 22 nt, Human
gcacccaggcuugggcagcaac

SEQ ID NO: 371545 - RNA, 22 nt, Human
uauguuuuucaagugcacacua

SEQ ID NO: 371546 - RNA, 22 nt, Human
ugcaaacuauugguagagaugg

SEQ ID NO: 371547 - RNA, 22 nt, Human
auacauuagcucauaugauuaa

SEQ ID NO: 371548 - RNA, 16 nt, Human
cuacccagugagaagg

SEQ ID NO: 371549 - RNA, 22 nt, Human
gagggaggcaucaugaauccag

SEQ ID NO: 371550 - RNA, 22 nt, Human
uauaauuuaucaugucacaguu

SEQ ID NO: 371551 - RNA, 22 nt, Human
ugaagcaggugaauggaugucg

SEQ ID NO: 371552 - RNA, 22 nt, Human
gcuuccuucuaccacaucaugc

SEQ ID NO: 371553 - RNA, 22 nt, Human
gcagggucgcucuaggagauca

SEQ ID NO: 371554 - RNA, 22 nt, Human
agaaaaaucuuggcgcuugucu

SEQ ID NO: 371555 - RNA, 22 nt, Human
uucagucagugacuaagcaguu

SEQ ID NO: 371556 - RNA, 22 nt, Human
cagagacagggcagggagugug

SEQ ID NO: 371557 - RNA, 22 nt, Human
cugagcugguggaagcaugcag

SEQ ID NO: 371558 - RNA, 20 nt, Human
gcugaggucauuaugccuca

SEQ ID NO: 371559 - RNA, 22 nt, Human
cauugcugugggcauuugcugc

SEQ ID NO: 371560 - RNA, 22 nt, Human
gaugcacuuucuuuucaacagu

SEQ ID NO: 371561 - RNA, 22 nt, Human
ugcauuauaacugaauguuguu

SEQ ID NO: 371562 - RNA, 19 nt, Human
aucugaaguaggugcagcu

SEQ ID NO: 371563 - RNA, 22 nt, Human
gcucugcuggagggaaagagaa

SEQ ID NO: 371564 - RNA, 22 nt, Human
aucugcaggaaugugugcagag

SEQ ID NO: 371565 - RNA, 22 nt, Human
uccugagagcagcugcuuugga

SEQ ID NO: 371566 - RNA, 22 nt, Human
uaucaauacauguuaucagugu

SEQ ID NO: 371567 - RNA, 23 nt, Human
uggcagcuguguaagagaaagca

SEQ ID NO: 371568 - RNA, 22 nt, Human
uguacauugucacucaucaagu

SEQ ID NO: 371569 - RNA, 22 nt, Human
gcaaaugcuaaaguguagagac

SEQ ID NO: 371570 - RNA, 22 nt, Human
ugcaggugguuuggacacugcu

SEQ ID NO: 371571 - RNA, 22 nt, Human
uaaugucaaggugauagauuug

SEQ ID NO: 371572 - RNA, 22 nt, Human
ugggcagagucauacaggagac

SEQ ID NO: 371573 - RNA, 22 nt, Human
gggcacuguguucagagugcag

SEQ ID NO: 371574 - RNA, 22 nt, Human
uagucccauuuugagguauuug

SEQ ID NO: 371575 - RNA, 22 nt, Human
ucagcaguggcucucaugcagu

SEQ ID NO: 371576 - RNA, 22 nt, Human
ggaggagacaguaaaaagcacg

SEQ ID NO: 371577 - RNA, 22 nt, Human
aagcaccuggguuauaucuuag

SEQ ID NO: 371578 - RNA, 22 nt, Human
cucuggaguucucaugaggaac

SEQ ID NO: 371579 - RNA, 22 nt, Human
aggcuggcgacaucuggcgggc

SEQ ID NO: 371580 - RNA, 22 nt, Human
acagggcaugugcaagagacau

SEQ ID NO: 371581 - RNA, 22 nt, Human
cauaagaagguaacauccuuaa

SEQ ID NO: 371582 - RNA, 19 nt, Human
caccacuucuuuuugcauc

SEQ ID NO: 371583 - RNA, 22 nt, Human
ggcaguggaggacccugugucu

SEQ ID NO: 371584 - RNA, 22 nt, Human
cugggccagggaggugucugua

SEQ ID NO: 371585 - RNA, 22 nt, Human
agggaaauuaaugugagcaaug

SEQ ID NO: 371586 - RNA, 19 nt, Human
uccucaggggcucacagac

SEQ ID NO: 371587 - RNA, 22 nt, Human
guccucugaaguugugcaaugc

SEQ ID NO: 371588 - RNA, 22 nt, Human
gcccacagcucguuccucuccu

SEQ ID NO: 371589 - RNA, 22 nt, Human
auuugcaugcuucuauugugaa

SEQ ID NO: 371590 - RNA, 22 nt, Human
cccagccaaggugcugguguug

SEQ ID NO: 371591 - RNA, 22 nt, Human
guguuuccucuagaagccaugg

SEQ ID NO: 371592 - RNA, 22 nt, Human
ugucagaggcucagggucucag

SEQ ID NO: 371593 - RNA, 22 nt, Human
aaaagucugcucucauuucaga

SEQ ID NO: 371594 - RNA, 22 nt, Human
gggcagaggggcgcuucccucu

SEQ ID NO: 371595 - RNA, 22 nt, Human
ggaccugcccuggcucagaugc

SEQ ID NO: 371596 - RNA, 22 nt, Human
uuaguuaguggggcugucaguc

SEQ ID NO: 371597 - RNA, 22 nt, Human
gcccugucggaacugcgaccuc

SEQ ID NO: 371598 - RNA, 22 nt, Human
uuaugauuugccacagauuggu

SEQ ID NO: 371599 - RNA, 22 nt, Human
uuccuuagugacuucuagcuac

SEQ ID NO: 371600 - RNA, 18 nt, Human
ccucacagacuuccaugu

SEQ ID NO: 371601 - RNA, 22 nt, Human
cugcuuuagacaacugcuggga

SEQ ID NO: 371602 - RNA, 22 nt, Human
ucuacagacagagcagguggga

SEQ ID NO: 371603 - RNA, 22 nt, Human
agugaaaacacuaguucuugcc

SEQ ID NO: 371604 - RNA, 22 nt, Human
caggcugcggucggcucugguc

SEQ ID NO: 371605 - RNA, 19 nt, Human
acuggcaguuucugcaugg

SEQ ID NO: 371606 - RNA, 22 nt, Human
cccugcagaucagugagaacuu

SEQ ID NO: 371607 - RNA, 22 nt, Human
uucuuaacuggaaaaugucaga

SEQ ID NO: 371608 - RNA, 22 nt, Human
ugcugcugaucauuuauagucu

SEQ ID NO: 371609 - RNA, 23 nt, Human
agugcugaauugaaagcuccagg

SEQ ID NO: 371610 - RNA, 22 nt, Human
ugaggcagcuuuuucugugugu

SEQ ID NO: 371611 - RNA, 22 nt, Human
caggcagcucuaauggaaagug

SEQ ID NO: 371612 - RNA, 22 nt, Human
ccagggcagcagaauuggggca

SEQ ID NO: 371613 - RNA, 22 nt, Human
uuggcagggccaggcucucucu

SEQ ID NO: 371614 - RNA, 22 nt, Human
guaggcagucucucaggugauc

SEQ ID NO: 371615 - RNA, 22 nt, Human
gaggccuggcucugcccuccug

SEQ ID NO: 371616 - RNA, 22 nt, Human
uaauuucaauagcuugcauaau

SEQ ID NO: 371617 - RNA, 22 nt, Human
cuggagccggaccagggacggu

SEQ ID NO: 371618 - RNA, 22 nt, Human
uuugcauuaucucacuuauaua

SEQ ID NO: 371619 - RNA, 22 nt, Human
gccugagauucccggagccgug

SEQ ID NO: 371620 - RNA, 22 nt, Human
aaucuucauuuugacaagauuc

SEQ ID NO: 371621 - RNA, 22 nt, Human
ccagccaguccagcauuggugu

SEQ ID NO: 371622 - RNA, 22 nt, Human
ccugccugcuuucugcuuugca

SEQ ID NO: 371623 - RNA, 22 nt, Human
acaggugggcuuaagagucggc

SEQ ID NO: 371624 - RNA, 22 nt, Human
augguuuaguuagggcuuuuca

SEQ ID NO: 371625 - RNA, 21 nt, Human
aaauguguuccauaaugcuuu

SEQ ID NO: 371626 - RNA, 22 nt, Human
aaggggaauagaguggguugug

SEQ ID NO: 371627 - RNA, 22 nt, Human
gagggcagaaaauuaugcggug

SEQ ID NO: 371628 - RNA, 22 nt, Human
ggaggagcacuucugagcucag

SEQ ID NO: 371629 - RNA, 19 nt, Human
cugcucaggucagucuguc

SEQ ID NO: 371630 - RNA, 22 nt, Human
uucaugaauggaaucaaugcuc

SEQ ID NO: 371631 - RNA, 22 nt, Human
auguuuuauauuuugcagcagu

SEQ ID NO: 371632 - RNA, 22 nt, Human
cuggcucaccuccgcuccagca

SEQ ID NO: 371633 - RNA, 22 nt, Human
ucccaaggcacagggcagggac

SEQ ID NO: 371634 - RNA, 22 nt, Human
ggccugcugcuaugacuuccug

SEQ ID NO: 371635 - RNA, 19 nt, Human
uguguaaagucugugguca

SEQ ID NO: 371636 - RNA, 22 nt, Human
uggcucaggagggaucuuugcu

SEQ ID NO: 371637 - RNA, 22 nt, Human
ugcuuuaucaaagcuauaguga

SEQ ID NO: 371638 - RNA, 22 nt, Human
gcaggccuccccugcuggagcu

SEQ ID NO: 371639 - RNA, 22 nt, Human
cuggagaggccccaagauauuu

SEQ ID NO: 371640 - RNA, 22 nt, Human
gugaaaauaaggcugguucuug

SEQ ID NO: 371641 - RNA, 22 nt, Human
caagcuggaguuccucagagug

SEQ ID NO: 371642 - RNA, 22 nt, Human
ccugccugauuccaggauggcu

SEQ ID NO: 371643 - RNA, 22 nt, Human
gagcucauccccaugguccguc

SEQ ID NO: 371644 - RNA, 20 nt, Human
cugagcugagcuccaugggu

SEQ ID NO: 371645 - RNA, 22 nt, Human
ucauuuaauaauuuuugaguag

SEQ ID NO: 371646 - RNA, 22 nt, Human
cuuacauugugugcaugagggg

SEQ ID NO: 371647 - RNA, 22 nt, Human
cggcagcaaaggaagccagguc

SEQ ID NO: 371648 - RNA, 22 nt, Human
cugugcuggcagaccuggaguu

SEQ ID NO: 371649 - RNA, 22 nt, Human
agacaucaaugaucagagguag

SEQ ID NO: 371650 - RNA, 22 nt, Human
auucauaaguaaaugauuaccu

SEQ ID NO: 371651 - RNA, 22 nt, Human
gaaggccacggaauggagcugg

SEQ ID NO: 371652 - RNA, 22 nt, Human
gccucucucuacccaguaugau

SEQ ID NO: 371653 - RNA, 22 nt, Human
ggcccagccggcgagucucgcg

SEQ ID NO: 371654 - RNA, 21 nt, Human
uagcacuucgcuguaauuggg

SEQ ID NO: 371655 - RNA, 19 nt, Human
aaaagucuauucaauuaca

SEQ ID NO: 371656 - RNA, 22 nt, Human
uggcagcugaggggaggcuuug

SEQ ID NO: 371657 - RNA, 22 nt, Human
gaauucugguccuguccaaggu

SEQ ID NO: 371658 - RNA, 22 nt, Human
cggggcugcgcucuuccugccg

SEQ ID NO: 371659 - RNA, 22 nt, Human
uuucucuguucucuaacuguaa

SEQ ID NO: 371660 - RNA, 22 nt, Human
ggcacugauaauguccucucuc

SEQ ID NO: 371661 - RNA, 19 nt, Human
ccagcagacacagcugccc

SEQ ID NO: 371662 - RNA, 22 nt, Human
aaguuguauauaccgcuuuaag

SEQ ID NO: 371663 - RNA, 22 nt, Human
cccaggcuggauuucgguggca

SEQ ID NO: 371664 - RNA, 22 nt, Human
acaggcuucucacagaaaaggg

SEQ ID NO: 371665 - RNA, 22 nt, Human
ggcugcuugcuguuucuuggau

SEQ ID NO: 371666 - RNA, 22 nt, Human
cugcaggauucucccaguugga

SEQ ID NO: 371667 - RNA, 22 nt, Human
ucacaucaacauuauagcauga

SEQ ID NO: 371668 - RNA, 22 nt, Human
uugaaauaucaaguuauuagug

SEQ ID NO: 371669 - RNA, 20 nt, Human
ugcaggaauuugcauuccuu

SEQ ID NO: 371670 - RNA, 22 nt, Human
gauggcagcauauugacagcau

SEQ ID NO: 371671 - RNA, 22 nt, Human
acgcagaagggccuggcgugcc

SEQ ID NO: 371672 - RNA, 22 nt, Human
aagcugcccucauucccagugc

SEQ ID NO: 371673 - RNA, 22 nt, Human
acaagccaauuacugugccagg

SEQ ID NO: 371674 - RNA, 21 nt, Human
uguaugcacgcacaugcacac

SEQ ID NO: 371675 - RNA, 22 nt, Human
cugagcuuggccaggaaugaau

SEQ ID NO: 371676 - RNA, 22 nt, Human
ggguuccuccaguuccuagagc

SEQ ID NO: 371677 - RNA, 22 nt, Human
aaggaagggaaauagugauguc

SEQ ID NO: 371678 - RNA, 22 nt, Human
gagggcugauaaaugcgcaugg

SEQ ID NO: 371679 - RNA, 21 nt, Human
aggcugcuggcucaggguccu

SEQ ID NO: 371680 - RNA, 16 nt, Human
gggcugggggauucug

SEQ ID NO: 371681 - RNA, 22 nt, Human
uuugaauguuuuagguacuuaa

SEQ ID NO: 371682 - RNA, 22 nt, Human
cuucaguuuaucccaucaucca

SEQ ID NO: 371683 - RNA, 22 nt, Human
guuucauuuacaucuguaggua

SEQ ID NO: 371684 - RNA, 22 nt, Human
cuauacagagcauccuuaacuu

SEQ ID NO: 371685 - RNA, 19 nt, Human
gcaggaaaugagugauugc

SEQ ID NO: 371686 - RNA, 22 nt, Human
ugucucugugagaucugacgau

SEQ ID NO: 371687 - RNA, 20 nt, Human
aggcaccugucacaggugag

SEQ ID NO: 371688 - RNA, 22 nt, Human
uaaguucaaugaacucaguucu

SEQ ID NO: 371689 - RNA, 22 nt, Human
ucccagagaagagcuggaugga

SEQ ID NO: 371690 - RNA, 20 nt, Human
ccugccugccucggcucauu

SEQ ID NO: 371691 - RNA, 23 nt, Human
aggcagcagguuguccaggguga

SEQ ID NO: 371692 - RNA, 22 nt, Human
gcccagaguucaaggcugcagu

SEQ ID NO: 371693 - RNA, 23 nt, Human
aauaucaaggugauguucccaga

SEQ ID NO: 371694 - RNA, 22 nt, Human
uccaaaguaauuucacuucugu

SEQ ID NO: 371695 - RNA, 22 nt, Human
cauucugcauuuggaaggggca

SEQ ID NO: 371696 - RNA, 22 nt, Human
caggccuggcccccggcacacc

SEQ ID NO: 371697 - RNA, 23 nt, Human
cagaggguuccauggagcauggu

SEQ ID NO: 371698 - RNA, 22 nt, Human
uucuggaguauuccuggcaccu

SEQ ID NO: 371699 - RNA, 20 nt, Human
gggcaguggcgcuaucucag

SEQ ID NO: 371700 - RNA, 22 nt, Human
augaguugaagcuacaagaggc

SEQ ID NO: 371701 - RNA, 22 nt, Human
gguguccucaugauuuucuaga

SEQ ID NO: 371702 - RNA, 22 nt, Human
uaaagcaguguugggucggacg

SEQ ID NO: 371703 - RNA, 22 nt, Human
agagggagcccagucauagcug

SEQ ID NO: 371704 - RNA, 22 nt, Human
auuuaagauugcguauucaugu

SEQ ID NO: 371705 - RNA, 22 nt, Human
acauuucucauaggagagccac

SEQ ID NO: 371706 - RNA, 22 nt, Human
uucaacuauuaugaauaaaauu

SEQ ID NO: 371707 - RNA, 18 nt, Human
ggcucaggcuauccuaac

SEQ ID NO: 371708 - RNA, 22 nt, Human
uggcagcucccagagcuuccaa

SEQ ID NO: 371709 - RNA, 22 nt, Human
gguccccagcaguggcugcuuc

SEQ ID NO: 371710 - RNA, 22 nt, Human
gaggggaaaguucugcacaagg

SEQ ID NO: 371711 - RNA, 22 nt, Human
uuuaacagaugugaaauuuuca

SEQ ID NO: 371712 - RNA, 22 nt, Human
ccuggaucgaugccgagggaaa

SEQ ID NO: 371713 - RNA, 22 nt, Human
ccuggccucagacagagggugg

SEQ ID NO: 371714 - RNA, 22 nt, Human
acugggccggugcagaguaguu

SEQ ID NO: 371715 - RNA, 23 nt, Human
uucuuucaagaaguucacagugc

SEQ ID NO: 371716 - RNA, 20 nt, Human
agaggccaguuaggagucua

SEQ ID NO: 371717 - RNA, 22 nt, Human
aagggcugaaugaaggguugaa

SEQ ID NO: 371718 - RNA, 22 nt, Human
uaucagaaggaagugccuuuaa

SEQ ID NO: 371719 - RNA, 22 nt, Human
cugcagcuuuggaaaccuguuu

SEQ ID NO: 371720 - RNA, 18 nt, Human
cuuguucuucucuuggcg

SEQ ID NO: 371721 - RNA, 22 nt, Human
cuggaagagcauuugcauaggg

SEQ ID NO: 371722 - RNA, 21 nt, Human
gguugguguguccaguggcca

SEQ ID NO: 371723 - RNA, 22 nt, Human
ccagaagagaucacaguucuug

SEQ ID NO: 371724 - RNA, 22 nt, Human
ccacaggcugcugcaggucccg

SEQ ID NO: 371725 - RNA, 22 nt, Human
ucacagaaauaagauaguuauu

SEQ ID NO: 371726 - RNA, 22 nt, Human
gagucacaaagccuuucuuauu

SEQ ID NO: 371727 - RNA, 22 nt, Human
gggcugacaaccaucugacaag

SEQ ID NO: 371728 - RNA, 22 nt, Human
uauuucuuguuauucucguuga

SEQ ID NO: 371729 - RNA, 22 nt, Human
cugucccaggagcuguaagaca

SEQ ID NO: 371730 - RNA, 22 nt, Human
ccagcuggugggucuuucucug

SEQ ID NO: 371731 - RNA, 22 nt, Human
aucagcaagacuaggggaauac

SEQ ID NO: 371732 - RNA, 19 nt, Human
cugccuguuauggagagaa

SEQ ID NO: 371733 - RNA, 22 nt, Human
aaggccaucuacuuacggaauu

SEQ ID NO: 371734 - RNA, 22 nt, Human
auggccuggggagcaugggaag

SEQ ID NO: 371735 - RNA, 22 nt, Human
ucaacugcaaguuugcuuaguu

SEQ ID NO: 371736 - RNA, 22 nt, Human
ggaggaccugcuggcccugcaa

SEQ ID NO: 371737 - RNA, 22 nt, Human
aggcuucacgaugggugaggug

SEQ ID NO: 371738 - RNA, 22 nt, Human
cccaggagagagacuugaaucu

SEQ ID NO: 371739 - RNA, 18 nt, Human
gccagagggaagcaggug

SEQ ID NO: 371740 - RNA, 22 nt, Human
aagagccagcuagugaagaggc

SEQ ID NO: 371741 - RNA, 22 nt, Human
ggcaggagaaaggucucuucuu

SEQ ID NO: 371742 - RNA, 22 nt, Human
gcugggcagccuggccgcugcc

SEQ ID NO: 371743 - RNA, 21 nt, Human
ugacauuuccaauauaaagcc

SEQ ID NO: 371744 - RNA, 22 nt, Human
ucuucaaaaaauauccaucagu

SEQ ID NO: 371745 - RNA, 22 nt, Human
ccugggcaacauagggagaccc

SEQ ID NO: 371746 - RNA, 21 nt, Human
cugugcuuuuuaagugugaug

SEQ ID NO: 371747 - RNA, 22 nt, Human
uguuuauucauggcuaaugaaa

SEQ ID NO: 371748 - RNA, 22 nt, Human
guaacagaaagucaugcucauu

SEQ ID NO: 371749 - RNA, 22 nt, Human
ucaauucaacacaugcacauug

SEQ ID NO: 371750 - RNA, 23 nt, Human
uaugaacugcauugcuggugugu

SEQ ID NO: 371751 - RNA, 22 nt, Human
ccaaaauuaagccucuuauguu

SEQ ID NO: 371752 - RNA, 19 nt, Human
aggacccuuauccuggcuu

SEQ ID NO: 371753 - RNA, 22 nt, Human
cugaggugagcuucccugggcu

SEQ ID NO: 371754 - RNA, 23 nt, Human
cuuuucauugccuuagcgcagag

SEQ ID NO: 371755 - RNA, 22 nt, Human
auaugaaaauguuuuagcugua

SEQ ID NO: 371756 - RNA, 22 nt, Human
cagagcucagagcagggcacuc

SEQ ID NO: 371757 - RNA, 22 nt, Human
ggacagcccauacacaugucug

SEQ ID NO: 371758 - RNA, 22 nt, Human
cucuccuugcagauggcugccu

SEQ ID NO: 371759 - RNA, 22 nt, Human
agcugcccugggucuugcugcu

SEQ ID NO: 371760 - RNA, 22 nt, Human
cacaaagucugcagcugcugua

SEQ ID NO: 371761 - RNA, 22 nt, Human
uacacauguuuggcaaguaugu

SEQ ID NO: 371762 - RNA, 22 nt, Human
gcuggccugggcucaagaccag

SEQ ID NO: 371763 - RNA, 22 nt, Human
uccuucagcuacucaguuucca

SEQ ID NO: 371764 - RNA, 22 nt, Human
uggggagugaugccucggauaa

SEQ ID NO: 371765 - RNA, 22 nt, Human
gcaguggaagccucuuuaagca

SEQ ID NO: 371766 - RNA, 22 nt, Human
ucaggcugcuguacugugaaug

SEQ ID NO: 371767 - RNA, 22 nt, Human
cucuugggagugcucuggagaa

SEQ ID NO: 371768 - RNA, 22 nt, Human
cagggccagccgcagcauccac

SEQ ID NO: 371769 - RNA, 22 nt, Human
ugggcacaggggaauggaugaa

SEQ ID NO: 371770 - RNA, 22 nt, Human
ggcaugggccgaggugccuccu

SEQ ID NO: 371771 - RNA, 22 nt, Human
ugcaggugccucuugagcuugu

SEQ ID NO: 371772 - RNA, 22 nt, Human
augacaguucuacacuuaaucu

SEQ ID NO: 371773 - RNA, 23 nt, Human
ugcucugggaggcccuggagagc

SEQ ID NO: 371774 - RNA, 22 nt, Human
ucugcgcugccuugauccuugg

SEQ ID NO: 371775 - RNA, 22 nt, Human
cacugaagccugggaguaagac

SEQ ID NO: 371776 - RNA, 22 nt, Human
caaggcaggcaguucacuugag

SEQ ID NO: 371777 - RNA, 22 nt, Human
uagcauuuauggucaugugucc

SEQ ID NO: 371778 - RNA, 19 nt, Human
ucaguggaugaacauguuu

SEQ ID NO: 371779 - RNA, 22 nt, Human
cagggcugagaauuuagagaca

SEQ ID NO: 371780 - RNA, 22 nt, Human
ugugaggagaggcccagcuccc

SEQ ID NO: 371781 - RNA, 22 nt, Human
uuguaaaugaccuuuucuaauu

SEQ ID NO: 371782 - RNA, 19 nt, Human
ucauaaggagagaggaaau

SEQ ID NO: 371783 - RNA, 20 nt, Human
uacagaaugcaauaaaaugg

SEQ ID NO: 371784 - RNA, 22 nt, Human
ucccaggguuacagccagggca

SEQ ID NO: 371785 - RNA, 22 nt, Human
gcuguuccugcuuagaggucgg

SEQ ID NO: 371786 - RNA, 22 nt, Human
ccagcuggagcucgcagauagg

SEQ ID NO: 371787 - RNA, 22 nt, Human
uuggccuuaaccucucugugcc

SEQ ID NO: 371788 - RNA, 22 nt, Human
gugucccacucuggaggugaag

SEQ ID NO: 371789 - RNA, 22 nt, Human
uuccucaggcuucccuuugucc

SEQ ID NO: 371790 - RNA, 22 nt, Human
ucuggcucucucaucacccaau

SEQ ID NO: 371791 - RNA, 22 nt, Human
acuugcugguggcauuuacagu

SEQ ID NO: 371792 - RNA, 21 nt, Human
gggcaggucucugaugucaac

SEQ ID NO: 371793 - RNA, 22 nt, Human
aguauugugacucaaguauucu

SEQ ID NO: 371794 - RNA, 22 nt, Human
acuucacacagcaaauuuaucu

SEQ ID NO: 371795 - RNA, 22 nt, Human
agaccauggccauccuaggaaa

SEQ ID NO: 371796 - RNA, 22 nt, Human
cuggguggcuguccagccagcc

SEQ ID NO: 371797 - RNA, 22 nt, Human
aaaggcuaugagauagaagaua

SEQ ID NO: 371798 - RNA, 22 nt, Human
caguggaaacuaugcugcugga

SEQ ID NO: 371799 - RNA, 22 nt, Human
ggaggccauaguuugggaguca

SEQ ID NO: 371800 - RNA, 22 nt, Human
ggcagugagcuggagggaagga

SEQ ID NO: 371801 - RNA, 22 nt, Human
aggguggcugaguagauggaag

SEQ ID NO: 371802 - RNA, 21 nt, Human
ucuuccuccacagcgugccac

SEQ ID NO: 371803 - RNA, 22 nt, Human
uaguggaggguguagcugcugg

SEQ ID NO: 371804 - RNA, 22 nt, Human
aagcagcauaauugcuauuuua

SEQ ID NO: 371805 - RNA, 19 nt, Human
auuccucaaggacagaaau

SEQ ID NO: 371806 - RNA, 22 nt, Human
uggucgaccaguuggaaaguaa

SEQ ID NO: 371807 - RNA, 18 nt, Human
cugcugcaggcacucagg

SEQ ID NO: 371808 - RNA, 22 nt, Human
gaggcagaggaagguggucucu

SEQ ID NO: 371809 - RNA, 22 nt, Human
ugagguaggugguaagagauac

SEQ ID NO: 371810 - RNA, 22 nt, Human
ugcuucugggcaaaugugugug

SEQ ID NO: 371811 - RNA, 22 nt, Human
accugccucuaagcagcaggug

SEQ ID NO: 371812 - RNA, 22 nt, Human
acacauuuacauguuuacguau

SEQ ID NO: 371813 - RNA, 22 nt, Human
ucugggaacacacgucacuuca

SEQ ID NO: 371814 - RNA, 22 nt, Human
guuuaauaauguugaauuacua

SEQ ID NO: 371815 - RNA, 22 nt, Human
cauucucaauaguagaugagua

SEQ ID NO: 371816 - RNA, 22 nt, Human
uucugugaaucuuuuuucccac

SEQ ID NO: 371817 - RNA, 22 nt, Human
cagcaggaggcauggcuucccu

SEQ ID NO: 371818 - RNA, 22 nt, Human
gaaggcugucagagaggagggc

SEQ ID NO: 371819 - RNA, 22 nt, Human
cuggcccuucucuugcuuccug

SEQ ID NO: 371820 - RNA, 22 nt, Human
uugcuuuguggugguucuucca

SEQ ID NO: 371821 - RNA, 22 nt, Human
gcugcuucucugauggagucca

SEQ ID NO: 371822 - RNA, 22 nt, Human
uaccauuucauucuuuccucau

SEQ ID NO: 371823 - RNA, 22 nt, Human
auaaacucaugccaagaaauga

SEQ ID NO: 371824 - RNA, 22 nt, Human
caugcacaaagguaagaugcgu

SEQ ID NO: 371825 - RNA, 22 nt, Human
ugucucagggcagcagcagggg

SEQ ID NO: 371826 - RNA, 22 nt, Human
ccucccucuuucagucccacag

SEQ ID NO: 371827 - RNA, 22 nt, Human
cucuggagaugguucucaauug

SEQ ID NO: 371828 - RNA, 22 nt, Human
cagaaauggagcccaggaaucu

SEQ ID NO: 371829 - RNA, 23 nt, Human
acacauuuuucccguucugaggu

SEQ ID NO: 371830 - RNA, 22 nt, Human
caaaugcauagaaagaugaaac

SEQ ID NO: 371831 - RNA, 22 nt, Human
aagcauuugugaaauucagaug

SEQ ID NO: 371832 - RNA, 22 nt, Human
gcagggccagggcucaggcugu

SEQ ID NO: 371833 - RNA, 22 nt, Human
acugucacuccaacugagucgu

SEQ ID NO: 371834 - RNA, 22 nt, Human
ggccaggcacugugugagauau

SEQ ID NO: 371835 - RNA, 19 nt, Human
cugguccugacugaggggu

SEQ ID NO: 371836 - RNA, 19 nt, Human
aagaagcaauaagcuguga

SEQ ID NO: 371837 - RNA, 22 nt, Human
acaaagugcacaagaugagaac

SEQ ID NO: 371838 - RNA, 22 nt, Human
cuguggaauugaugcuuagugu

SEQ ID NO: 371839 - RNA, 22 nt, Human
uuuaagaugguauuuuauaaag

SEQ ID NO: 371840 - RNA, 22 nt, Human
augggcagcugcagcaguggug

SEQ ID NO: 371841 - RNA, 22 nt, Human
agagccuggggauuggcaaggg

SEQ ID NO: 371842 - RNA, 22 nt, Human
ugaggcagugcugggaagccug

SEQ ID NO: 371843 - RNA, 22 nt, Human
uaaguccuagcuuugguaggaa

SEQ ID NO: 371844 - RNA, 22 nt, Human
acagccuggacuggcucucugc

SEQ ID NO: 371845 - RNA, 22 nt, Human
ccugggcauucuuugaguucuc

SEQ ID NO: 371846 - RNA, 22 nt, Human
uagggcuccacucccagagauu

SEQ ID NO: 371847 - RNA, 22 nt, Human
aaugugaucgcuuuagaagcuu

SEQ ID NO: 371848 - RNA, 22 nt, Human
gaagcagcuuucuggugaggag

SEQ ID NO: 371849 - RNA, 19 nt, Human
agggaaggauucugucauu

SEQ ID NO: 371850 - RNA, 22 nt, Human
aguucucauugcaugagacaga

SEQ ID NO: 371851 - RNA, 22 nt, Human
uguacaaugcugagguuugggg

SEQ ID NO: 371852 - RNA, 22 nt, Human
gauggcagucaaccaggugagg

SEQ ID NO: 371853 - RNA, 22 nt, Human
agagcuuagaauuucagaugau

SEQ ID NO: 371854 - RNA, 22 nt, Human
ucagggcaaaagggaaaccauu

SEQ ID NO: 371855 - RNA, 22 nt, Human
aggccuggugaaugaaguaucu

SEQ ID NO: 371856 - RNA, 22 nt, Human
aggcagcauuucugcuuaucca

SEQ ID NO: 371857 - RNA, 20 nt, Human
gggaguggugguagccugug

SEQ ID NO: 371858 - RNA, 22 nt, Human
agaagggccagcuggacaccug

SEQ ID NO: 371859 - RNA, 22 nt, Human
gcugguccacucccuggaggcu

SEQ ID NO: 371860 - RNA, 22 nt, Human
cuacagaaacacuggacaugug

SEQ ID NO: 371861 - RNA, 22 nt, Human
aucagcaaggcaaucacugcag

SEQ ID NO: 371862 - RNA, 19 nt, Human
gucacauuugucucccagg

SEQ ID NO: 371863 - RNA, 22 nt, Human
ggcucuggucagugaggggccu

SEQ ID NO: 371864 - RNA, 22 nt, Human
gagagcugugguuugaccaggc

SEQ ID NO: 371865 - RNA, 22 nt, Human
agcugcccagauaggaggaggc

SEQ ID NO: 371866 - RNA, 22 nt, Human
uuauuccauagaagucaaggaa

SEQ ID NO: 371867 - RNA, 22 nt, Human
gaggcagcagaacauggaagag

SEQ ID NO: 371868 - RNA, 22 nt, Human
uuuagggaugucagaacaggga

SEQ ID NO: 371869 - RNA, 22 nt, Human
ucaguguccggagccugagugc

SEQ ID NO: 371870 - RNA, 22 nt, Human
auccaggguguggagagagcuc

SEQ ID NO: 371871 - RNA, 22 nt, Human
uucuuucccagaagauauguuu

SEQ ID NO: 371872 - RNA, 22 nt, Human
cugcuguguuucugcuagaaaa

SEQ ID NO: 371873 - RNA, 22 nt, Human
agcugguucauucauucauggu

SEQ ID NO: 371874 - RNA, 22 nt, Human
caggagcuacucagguuggguu

SEQ ID NO: 371875 - RNA, 22 nt, Human
gacuucaaaggucaaacaucgc

SEQ ID NO: 371876 - RNA, 20 nt, Human
aagagaagaagucuuugaaa

SEQ ID NO: 371877 - RNA, 22 nt, Human
auuugcuuuaagguauaaaagg

SEQ ID NO: 371878 - RNA, 22 nt, Human
ggcuccuguggcaagacagcuu

SEQ ID NO: 371879 - RNA, 22 nt, Human
ccugccugcagaaaguaucucc

SEQ ID NO: 371880 - RNA, 22 nt, Human
uuaaagaugcagcuuuagagaa

SEQ ID NO: 371881 - RNA, 22 nt, Human
cagaaugagauaacccagauug

SEQ ID NO: 371882 - RNA, 22 nt, Human
aggagugagcuuuggggucaga

SEQ ID NO: 371883 - RNA, 22 nt, Human
ccuuuggguucaaucucggucu

SEQ ID NO: 371884 - RNA, 22 nt, Human
ugauuuccuaggucuggagaag

SEQ ID NO: 371885 - RNA, 22 nt, Human
uuguaacagcugcuuaauagag

SEQ ID NO: 371886 - RNA, 22 nt, Human
uuuaagaaguuauguuauaaau

SEQ ID NO: 371887 - RNA, 22 nt, Human
cccuggagcaucucugcugucu

SEQ ID NO: 371888 - RNA, 23 nt, Human
aggcagagccaaggucaaaaccc

SEQ ID NO: 371889 - RNA, 22 nt, Human
cccaggagguagagguugcagu

SEQ ID NO: 371890 - RNA, 22 nt, Human
auaagagcuagucuuuuccuug

SEQ ID NO: 371891 - RNA, 22 nt, Human
cauuucugauuacagaauacua

SEQ ID NO: 371892 - RNA, 22 nt, Human
agcaaaguagcugcuguucuua

SEQ ID NO: 371893 - RNA, 22 nt, Human
aggcagacaaggacacaguggg

SEQ ID NO: 371894 - RNA, 22 nt, Human
gugcuuccugccuggugccuuu

SEQ ID NO: 371895 - RNA, 22 nt, Human
cccagagcugagucugauauau

SEQ ID NO: 371896 - RNA, 22 nt, Human
aaaagagguuaaccaggugugu

SEQ ID NO: 371897 - RNA, 22 nt, Human
gaagccacaacuuuuucuuagc

SEQ ID NO: 371898 - RNA, 23 nt, Human
ccuccugggcacaggccugaugg

SEQ ID NO: 371899 - RNA, 22 nt, Human
ugggcaggagagaagcuaaaga

SEQ ID NO: 371900 - RNA, 22 nt, Human
caagagcugcaaauagcgugac

SEQ ID NO: 371901 - RNA, 22 nt, Human
ugguggcuguugcagaacugag

SEQ ID NO: 371902 - RNA, 23 nt, Human
aaggucacagaacuuagcaagcc

SEQ ID NO: 371903 - RNA, 22 nt, Human
uaaggccagccagcaaaucugu

SEQ ID NO: 371904 - RNA, 23 nt, Human
gggcagcuuaagcuuguuuuucu

SEQ ID NO: 371905 - RNA, 22 nt, Human
uggcagcugagugcacccccuc

SEQ ID NO: 371906 - RNA, 22 nt, Human
uggauuaaagauuaaaaugaca

SEQ ID NO: 371907 - RNA, 22 nt, Human
ggccuuuaagcaauugaaaaga

SEQ ID NO: 371908 - RNA, 22 nt, Human
cagagccagcaguggggacagg

SEQ ID NO: 371909 - RNA, 22 nt, Human
uugcaauagccuuauuuccaaa

SEQ ID NO: 371910 - RNA, 22 nt, Human
accaaaaauuguggggcugaau

SEQ ID NO: 371911 - RNA, 22 nt, Human
gcugccaugguccaggcuccag

SEQ ID NO: 371912 - RNA, 18 nt, Human
guucaaggucaagagaga

SEQ ID NO: 371913 - RNA, 22 nt, Human
uucuacagacuauaacugugau

SEQ ID NO: 371914 - RNA, 22 nt, Human
cccagguggguuggccucuguc

SEQ ID NO: 371915 - RNA, 21 nt, Human
aagagcugucaggaaggcugc

SEQ ID NO: 371916 - RNA, 22 nt, Human
ggugccaggcuguagucagggu

SEQ ID NO: 371917 - RNA, 22 nt, Human
agguacaguagacagacaguua

SEQ ID NO: 371918 - RNA, 22 nt, Human
uuuccuuccuugcuagccugag

SEQ ID NO: 371919 - RNA, 22 nt, Human
ccaggccuggccaggggaugcc

SEQ ID NO: 371920 - RNA, 22 nt, Human
aaauauaguaaaugcauaguuc

SEQ ID NO: 371921 - RNA, 22 nt, Human
gucauaaagcuuguugcauuua

SEQ ID NO: 371922 - RNA, 19 nt, Human
uggaccugugcccauggcu

SEQ ID NO: 371923 - RNA, 23 nt, Human
caggacaugggaggaaguauggc

SEQ ID NO: 371924 - RNA, 22 nt, Human
cagggccaagcugcagcaucug

SEQ ID NO: 371925 - RNA, 22 nt, Human
ugggaggacuugugggcuucau

SEQ ID NO: 371926 - RNA, 22 nt, Human
gcaguaggagaagaggaugcuu

SEQ ID NO: 371927 - RNA, 22 nt, Human
agucccagcucugccacuuacu

SEQ ID NO: 371928 - RNA, 22 nt, Human
caggcacuagcagaaugaggcu

SEQ ID NO: 371929 - RNA, 22 nt, Human
uggcagagguaauucaaauccc

SEQ ID NO: 371930 - RNA, 22 nt, Human
aauaguguuguucacucaggag

SEQ ID NO: 371931 - RNA, 22 nt, Human
uuccuuccauagcaaaacaugc

SEQ ID NO: 371932 - RNA, 22 nt, Human
uuaacagagugccuggcaugua

SEQ ID NO: 371933 - RNA, 22 nt, Human
uccucagaaaccccugugaggu

SEQ ID NO: 371934 - RNA, 22 nt, Human
aaaggucagacuuaggcugggc

SEQ ID NO: 371935 - RNA, 22 nt, Human
gugaagagcuguugcagagauu

SEQ ID NO: 371936 - RNA, 20 nt, Human
uccugggguaagccaugguc

SEQ ID NO: 371937 - RNA, 22 nt, Human
ggaggccaccugaccugcuguu

SEQ ID NO: 371938 - RNA, 22 nt, Human
accaggcagcacuuuccuugca

SEQ ID NO: 371939 - RNA, 22 nt, Human
auuuaaauuuucugauggagag

SEQ ID NO: 371940 - RNA, 22 nt, Human
ucaaauaaugccauucaucauc

SEQ ID NO: 371941 - RNA, 22 nt, Human
uaauagaauaguggaaacauug

SEQ ID NO: 371942 - RNA, 22 nt, Human
cagcuucugcuaucgaacaucu

SEQ ID NO: 371943 - RNA, 22 nt, Human
ugcagcccuuccuuccucuggg

SEQ ID NO: 371944 - RNA, 22 nt, Human
agccuauuccaggaugagcuca

SEQ ID NO: 371945 - RNA, 18 nt, Human
cuucagugacagucuggc

SEQ ID NO: 371946 - RNA, 20 nt, Human
ucugugugccaucaccuaac

SEQ ID NO: 371947 - RNA, 22 nt, Human
uggcagagccuugccaaacucc

SEQ ID NO: 371948 - RNA, 22 nt, Human
acaggcugacuuccugccaugu

SEQ ID NO: 371949 - RNA, 22 nt, Human
cauuuagagucuugcaauuuua

SEQ ID NO: 371950 - RNA, 20 nt, Human
uuucaguugguuaauggcau

SEQ ID NO: 371951 - RNA, 22 nt, Human
agccacagcgaaccucucuucc

SEQ ID NO: 371952 - RNA, 22 nt, Human
agaaaucagaacccugaaguuc

SEQ ID NO: 371953 - RNA, 22 nt, Human
agucauaaagccagugggaggc

SEQ ID NO: 371954 - RNA, 19 nt, Human
gcucugugaugcugagggg

SEQ ID NO: 371955 - RNA, 22 nt, Human
cuuguacaggaauccaugguau

SEQ ID NO: 371956 - RNA, 22 nt, Human
agugaaauugcuguaagaggaa

SEQ ID NO: 371957 - RNA, 22 nt, Human
ggagagaauuccauggacaugu

SEQ ID NO: 371958 - RNA, 22 nt, Human
aggucagaagugccagggaauu

SEQ ID NO: 371959 - RNA, 22 nt, Human
aaaaguguccagauuaugaaga

SEQ ID NO: 371960 - RNA, 22 nt, Human
gagcccuccauggagccaggca

SEQ ID NO: 371961 - RNA, 22 nt, Human
gaaaacacuuugaucugaaagu

SEQ ID NO: 371962 - RNA, 21 nt, Human
ucucugguuggaguugugcca

SEQ ID NO: 371963 - RNA, 22 nt, Human
cugcugugcaacauugcaccua

SEQ ID NO: 371964 - RNA, 22 nt, Human
uuuaauuuguauuucuagaggg

SEQ ID NO: 371965 - RNA, 22 nt, Human
ugagagagccugaaucucuuac

SEQ ID NO: 371966 - RNA, 22 nt, Human
aaggccagccugagagcuaaca

SEQ ID NO: 371967 - RNA, 22 nt, Human
gccugucaauuuuguguacaau

SEQ ID NO: 371968 - RNA, 22 nt, Human
uagggcagauucgguggaguuu

SEQ ID NO: 371969 - RNA, 22 nt, Human
uggcuucugcuuucaguggagg

SEQ ID NO: 371970 - RNA, 22 nt, Human
uggcacugggacagaugcucuc

SEQ ID NO: 371971 - RNA, 22 nt, Human
aggcaggugcuuaugacuugcu

SEQ ID NO: 371972 - RNA, 22 nt, Human
augggcugugagguccggcagg

SEQ ID NO: 371973 - RNA, 22 nt, Human
augauggugagguugagcacag

SEQ ID NO: 371974 - RNA, 23 nt, Human
gggaccagcuagggcugugaccu

SEQ ID NO: 371975 - RNA, 22 nt, Human
gcaaggcugugcacuuugcauu

SEQ ID NO: 371976 - RNA, 22 nt, Human
gcucugggaacugacugccuuc

SEQ ID NO: 371977 - RNA, 22 nt, Human
ucagagucauugcaaguagaag

SEQ ID NO: 371978 - RNA, 22 nt, Human
ucuuuucuggacucugcaugga

SEQ ID NO: 371979 - RNA, 22 nt, Human
auguguauacuugugcuuacuc

SEQ ID NO: 371980 - RNA, 20 nt, Human
agauggugaaggccagggag

SEQ ID NO: 371981 - RNA, 22 nt, Human
agaggccaguggcugugcuguc

SEQ ID NO: 371982 - RNA, 22 nt, Human
acacaugcauaagccuucccuu

SEQ ID NO: 371983 - RNA, 22 nt, Human
uccaggcugggcugaagggugc

SEQ ID NO: 371984 - RNA, 22 nt, Human
aaaucauguuggcacaauaaaa

SEQ ID NO: 371985 - RNA, 22 nt, Human
aguucacauuccgagguacugg

SEQ ID NO: 371986 - RNA, 22 nt, Human
aaggucauuuuuuccucuguug

SEQ ID NO: 371987 - RNA, 22 nt, Human
acagguuugucugauguaauga

SEQ ID NO: 371988 - RNA, 22 nt, Human
aauuuccagaccccauccacag

SEQ ID NO: 371989 - RNA, 22 nt, Human
gcuggccacacugcugauggag

SEQ ID NO: 371990 - RNA, 22 nt, Human
agaaaucaugucuuauuucuau

SEQ ID NO: 371991 - RNA, 22 nt, Human
acauaauagcauuucuaauuug

SEQ ID NO: 371992 - RNA, 22 nt, Human
ggagagugggagcaacuguugc

SEQ ID NO: 371993 - RNA, 22 nt, Human
gucccaggaguugcugggccuu

SEQ ID NO: 371994 - RNA, 22 nt, Human
uaucagaacacauguuuugcag

SEQ ID NO: 371995 - RNA, 22 nt, Human
uauacagauggaaagauacaca

SEQ ID NO: 371996 - RNA, 22 nt, Human
uggaauaaagugcuuugaucag

SEQ ID NO: 371997 - RNA, 22 nt, Human
gggaucagaaacauagcccuga

SEQ ID NO: 371998 - RNA, 22 nt, Human
gaaguuuauuucaaucuauuca

SEQ ID NO: 371999 - RNA, 22 nt, Human
auuauuagacuuauaugguagu

SEQ ID NO: 372000 - RNA, 22 nt, Human
uauuuugacuauuaaaccaaca

SEQ ID NO: 372001 - RNA, 22 nt, Human
cccugcagaaccacagacaaac

SEQ ID NO: 372002 - RNA, 22 nt, Human
aaugaugguauugaugagcuaa

SEQ ID NO: 372003 - RNA, 22 nt, Human
uuugacagacauuuacuacauu

SEQ ID NO: 372004 - RNA, 22 nt, Human
ccaaaguccuuucuccaccugc

SEQ ID NO: 372005 - RNA, 22 nt, Human
cuggccagguuuugaacaguug

SEQ ID NO: 372006 - RNA, 22 nt, Human
gcuuugaagacuuuuccagggu

SEQ ID NO: 372007 - RNA, 22 nt, Human
uugucuuaaauggauggacaau

SEQ ID NO: 372008 - RNA, 18 nt, Human
aguaguggguuuagcuuc

SEQ ID NO: 372009 - RNA, 22 nt, Human
agcaccauugcaaauauggcag

SEQ ID NO: 372010 - RNA, 22 nt, Human
cccaggcacaccccgaacggaa

SEQ ID NO: 372011 - RNA, 23 nt, Human
uacagaaggaguagucacuaaga

SEQ ID NO: 372012 - RNA, 22 nt, Human
gggagccaaggagagaggccuu

SEQ ID NO: 372013 - RNA, 22 nt, Human
ugaagugaccuggggcagugua

SEQ ID NO: 372014 - RNA, 22 nt, Human
aaaguuacuaucacaaugaaau

SEQ ID NO: 372015 - RNA, 22 nt, Human
gcagcugggacacugaggccag

SEQ ID NO: 372016 - RNA, 22 nt, Human
cgaggcagaggcugaaacggcu

SEQ ID NO: 372017 - RNA, 22 nt, Human
uggaguucucaggugagggcuu

SEQ ID NO: 372018 - RNA, 22 nt, Human
uucauaaucaccaaaaacugga

SEQ ID NO: 372019 - RNA, 22 nt, Human
aaggguggauuucugagcucua

SEQ ID NO: 372020 - RNA, 22 nt, Human
acacagggcggaaagcaugaga

SEQ ID NO: 372021 - RNA, 22 nt, Human
uaucuuguaauagguccacuug

SEQ ID NO: 372022 - RNA, 22 nt, Human
uugaaaaaauugguagaggaug

SEQ ID NO: 372023 - RNA, 22 nt, Human
cagucuuuguucccauuacuga

SEQ ID NO: 372024 - RNA, 21 nt, Human
agggucaggaaccaggguacc

SEQ ID NO: 372025 - RNA, 22 nt, Human
ugggcagguuguuauuugacau

SEQ ID NO: 372026 - RNA, 22 nt, Human
cagcuuugauucuuucugccau

SEQ ID NO: 372027 - RNA, 22 nt, Human
aggcaccuugcgguccagugaa

SEQ ID NO: 372028 - RNA, 22 nt, Human
cuggcagucugccucuucacug

SEQ ID NO: 372029 - RNA, 22 nt, Human
uucauuaguucugaagaugucu

SEQ ID NO: 372030 - RNA, 22 nt, Human
uccaggcaagggaggagcaugg

SEQ ID NO: 372031 - RNA, 19 nt, Human
ugcagggcugcgccugggg

SEQ ID NO: 372032 - RNA, 22 nt, Human
cugaagaugucugagaugcuca

SEQ ID NO: 372033 - RNA, 21 nt, Human
uagggcucucugugucaggug

SEQ ID NO: 372034 - RNA, 22 nt, Human
ccugcagggugcugccacagau

SEQ ID NO: 372035 - RNA, 22 nt, Human
gcagggacaucuucagaucacu

SEQ ID NO: 372036 - RNA, 22 nt, Human
gcauuucuuccuggugugagcc

SEQ ID NO: 372037 - RNA, 22 nt, Human
guugaaagaugucuugguuccc

SEQ ID NO: 372038 - RNA, 19 nt, Human
aaagcagaggagcaucuga

SEQ ID NO: 372039 - RNA, 22 nt, Human
cucaggauauugggcuggagca

SEQ ID NO: 372040 - RNA, 22 nt, Human
uggggugguaauacaccguucu

SEQ ID NO: 372041 - RNA, 22 nt, Human
aguuuagaguucaaauuaguuc

SEQ ID NO: 372042 - RNA, 22 nt, Human
uuaugacaggaaaaucacagaa

SEQ ID NO: 372043 - RNA, 22 nt, Human
aucaggauagucuguaaauugu

SEQ ID NO: 372044 - RNA, 22 nt, Human
aggcaacuguuugauaauguug

SEQ ID NO: 372045 - RNA, 22 nt, Human
gacaauacagaaagggacaugc

SEQ ID NO: 372046 - RNA, 22 nt, Human
cuacauaaauauuuaugugucu

SEQ ID NO: 372047 - RNA, 22 nt, Human
ccucacucugcacccugcagca

SEQ ID NO: 372048 - RNA, 22 nt, Human
cuuguccccagcagguugguuu

SEQ ID NO: 372049 - RNA, 22 nt, Human
gguuuaauggagauauuucaga

SEQ ID NO: 372050 - RNA, 22 nt, Human
auagaaaacagauguccuuaaa

SEQ ID NO: 372051 - RNA, 22 nt, Human
uagggcagccuuauagcuccca

SEQ ID NO: 372052 - RNA, 22 nt, Human
ucuaauccuugcuaccugggug

SEQ ID NO: 372053 - RNA, 22 nt, Human
gacagacauuuccugauccaau

SEQ ID NO: 372054 - RNA, 22 nt, Human
cagagguaccagcagccucugg

SEQ ID NO: 372055 - RNA, 22 nt, Human
aauuaacagagggcuuauuacu

SEQ ID NO: 372056 - RNA, 22 nt, Human
ggccuguguccuccuugcccug

SEQ ID NO: 372057 - RNA, 22 nt, Human
gcagaggcucuuuaaugcuuag

SEQ ID NO: 372058 - RNA, 22 nt, Human
uccagugguacauggagacacu

SEQ ID NO: 372059 - RNA, 22 nt, Human
cuacccaggcuggagugcagua

SEQ ID NO: 372060 - RNA, 22 nt, Human
aaaugcagauugucauucagga

SEQ ID NO: 372061 - RNA, 22 nt, Human
cugaggcacagugaacuucucc

SEQ ID NO: 372062 - RNA, 21 nt, Human
ucagggcagugggagguuccu

SEQ ID NO: 372063 - RNA, 23 nt, Human
aaacugcuuccaauuccugccau

SEQ ID NO: 372064 - RNA, 22 nt, Human
gcauuuguguucuuccuagagc

SEQ ID NO: 372065 - RNA, 22 nt, Human
ccugcagaccacacucaguccu

SEQ ID NO: 372066 - RNA, 22 nt, Human
ccacccugagccgcaagagcag

SEQ ID NO: 372067 - RNA, 22 nt, Human
gcucugggugaacuuggagcaa

SEQ ID NO: 372068 - RNA, 22 nt, Human
uugaaguuguaguucagugaag

SEQ ID NO: 372069 - RNA, 17 nt, Human
gaauuucuuggucaaaa

SEQ ID NO: 372070 - RNA, 22 nt, Human
cacaauuuggugcuaaagaaag

SEQ ID NO: 372071 - RNA, 22 nt, Human
ugcuuuaaaauggacuguuuug

SEQ ID NO: 372072 - RNA, 20 nt, Human
aaguuuucuccaaauacagu

SEQ ID NO: 372073 - RNA, 22 nt, Human
ucugucacuuuuauuuacugaa

SEQ ID NO: 372074 - RNA, 22 nt, Human
auaaauuuauaauuguuuccug

SEQ ID NO: 372075 - RNA, 22 nt, Human
uguuuucagucauauagcaggu

SEQ ID NO: 372076 - RNA, 22 nt, Human
caggaugguggcaugaucagaa

SEQ ID NO: 372077 - RNA, 20 nt, Human
aagggagaauaaugauugua

SEQ ID NO: 372078 - RNA, 22 nt, Human
ccaggagucaauaaaggaagcu

SEQ ID NO: 372079 - RNA, 22 nt, Human
gguggccucucaugcaagguag

SEQ ID NO: 372080 - RNA, 22 nt, Human
uuugcaguuucauugcugaaau

SEQ ID NO: 372081 - RNA, 22 nt, Human
aggcccagagagccaguuagug

SEQ ID NO: 372082 - RNA, 22 nt, Human
ugcagggcuaagucagagccug

SEQ ID NO: 372083 - RNA, 22 nt, Human
uuuucauuagaaugacugagaa

SEQ ID NO: 372084 - RNA, 19 nt, Human
ggcucucccuugagagagc

SEQ ID NO: 372085 - RNA, 21 nt, Human
agcuggugucagagcucuggg

SEQ ID NO: 372086 - RNA, 22 nt, Human
uccuguguuacugccuggagcg

SEQ ID NO: 372087 - RNA, 22 nt, Human
cucuggaguggguggccgggag

SEQ ID NO: 372088 - RNA, 22 nt, Human
gggugcugacuggggccugaaa

SEQ ID NO: 372089 - RNA, 22 nt, Human
gagcagggagacaacucuggug

SEQ ID NO: 372090 - RNA, 22 nt, Human
cauuuucagcacccaucugaaa

SEQ ID NO: 372091 - RNA, 22 nt, Human
ggagccagagucugcaguguaa

SEQ ID NO: 372092 - RNA, 22 nt, Human
gcuggcagucccaucagcuggg

SEQ ID NO: 372093 - RNA, 22 nt, Human
uccugcugagcgucugucauuu

SEQ ID NO: 372094 - RNA, 22 nt, Human
uaucuacuccucuuucagaugc

SEQ ID NO: 372095 - RNA, 22 nt, Human
gagccucguggcggccacugcg

SEQ ID NO: 372096 - RNA, 18 nt, Human
aggcagcagcaucuucuc

SEQ ID NO: 372097 - RNA, 22 nt, Human
gggacuggcacagggcugggag

SEQ ID NO: 372098 - RNA, 22 nt, Human
cugggcuggagugcaauggcgc

SEQ ID NO: 372099 - RNA, 22 nt, Human
caaaauuguugaugcugcuuug

SEQ ID NO: 372100 - RNA, 22 nt, Human
guggccaggccgacugccaggc

SEQ ID NO: 372101 - RNA, 22 nt, Human
agcucauggugcuaucucaggg

SEQ ID NO: 372102 - RNA, 22 nt, Human
gcagaggaggacccaggaauua

SEQ ID NO: 372103 - RNA, 16 nt, Human
uccaggcauaucugag

SEQ ID NO: 372104 - RNA, 22 nt, Human
caguagcauguaauaaagacag

SEQ ID NO: 372105 - RNA, 22 nt, Human
auuaaaauuccaagguaugcca

SEQ ID NO: 372106 - RNA, 22 nt, Human
uguggugagaaacugguagauu

SEQ ID NO: 372107 - RNA, 22 nt, Human
uugcauaaaagaguauaucuua

SEQ ID NO: 372108 - RNA, 22 nt, Human
uggagccuguguuucugcccag

SEQ ID NO: 372109 - RNA, 22 nt, Human
auuuucugguugagguuuaaca

SEQ ID NO: 372110 - RNA, 22 nt, Human
uucuuucccuuccagcagcucc

SEQ ID NO: 372111 - RNA, 22 nt, Human
cagggccauaucuugugcacca

SEQ ID NO: 372112 - RNA, 22 nt, Human
cagucaccauagaauaaaacau

SEQ ID NO: 372113 - RNA, 22 nt, Human
acacugaagagcacuuucaaag

SEQ ID NO: 372114 - RNA, 22 nt, Human
guaggcagguggaggagugaag

SEQ ID NO: 372115 - RNA, 22 nt, Human
agauuucucuuucccuggcuga

SEQ ID NO: 372116 - RNA, 22 nt, Human
gggcauggaggucugucugcag

SEQ ID NO: 372117 - RNA, 19 nt, Human
cugagcagcggcagcacuu

SEQ ID NO: 372118 - RNA, 22 nt, Human
agaaacagcauuagcaucaauu

SEQ ID NO: 372119 - RNA, 22 nt, Human
cagaguguugaccauaagccca

SEQ ID NO: 372120 - RNA, 22 nt, Human
cuucuucaauagcaagcgcaua

SEQ ID NO: 372121 - RNA, 22 nt, Human
aggaaucccgcaccagcugcug

SEQ ID NO: 372122 - RNA, 22 nt, Human
gugccugccccacuccucagca

SEQ ID NO: 372123 - RNA, 22 nt, Human
ugguaauuaauuugauagguuc

SEQ ID NO: 372124 - RNA, 22 nt, Human
uagcauaacagguaagagugag

SEQ ID NO: 372125 - RNA, 22 nt, Human
cugucauuuaagacauucugga

SEQ ID NO: 372126 - RNA, 22 nt, Human
ugaggaagccaaacagcuacac

SEQ ID NO: 372127 - RNA, 22 nt, Human
aaggcacuagcaagcugccugg

SEQ ID NO: 372128 - RNA, 22 nt, Human
uucauguguauggaacauuuuu

SEQ ID NO: 372129 - RNA, 22 nt, Human
ucuuuauuuaagucuguuguaa

SEQ ID NO: 372130 - RNA, 22 nt, Human
uuaaagaauagugccccuauug

SEQ ID NO: 372131 - RNA, 22 nt, Human
agggccaccagagcagggcagu

SEQ ID NO: 372132 - RNA, 22 nt, Human
uacagagaguacagcauccaca

SEQ ID NO: 372133 - RNA, 22 nt, Human
uugaaggacaucuuguuucuag

SEQ ID NO: 372134 - RNA, 22 nt, Human
cugggagucaccaggagcaagg

SEQ ID NO: 372135 - RNA, 23 nt, Human
aucaaaggauguagagaagaagc

SEQ ID NO: 372136 - RNA, 22 nt, Human
gaugagggccugguggcugugc

SEQ ID NO: 372137 - RNA, 22 nt, Human
gaauacaaacuuaaggcuuuac

SEQ ID NO: 372138 - RNA, 22 nt, Human
uccuguggaagacaguguuggg

SEQ ID NO: 372139 - RNA, 22 nt, Human
ugggcugcacccucagccucug

SEQ ID NO: 372140 - RNA, 22 nt, Human
gcucccagcauugcugcugaau

SEQ ID NO: 372141 - RNA, 17 nt, Human
aaucuguuuacagucag

SEQ ID NO: 372142 - RNA, 22 nt, Human
ugcagcuguuacggacccuguc

SEQ ID NO: 372143 - RNA, 22 nt, Human
cagaagagaugaaauaguauua

SEQ ID NO: 372144 - RNA, 22 nt, Human
aaaugcacaggagaaccaauuc

SEQ ID NO: 372145 - RNA, 20 nt, Human
cagggcacacugcagccucg

SEQ ID NO: 372146 - RNA, 22 nt, Human
aagucauugguagcuugauagg

SEQ ID NO: 372147 - RNA, 22 nt, Human
ucuggcuccaggaccgggcaca

SEQ ID NO: 372148 - RNA, 22 nt, Human
uagggcucagagaaguggggcc

SEQ ID NO: 372149 - RNA, 21 nt, Human
aacauuucugggagaacucac

SEQ ID NO: 372150 - RNA, 22 nt, Human
cccagccucuggguucugccgg

SEQ ID NO: 372151 - RNA, 22 nt, Human
ucagcugccucucccuggaaga

SEQ ID NO: 372152 - RNA, 22 nt, Human
ucauuuguaccauuuuuuaaga

SEQ ID NO: 372153 - RNA, 22 nt, Human
agucacccuccaacucuccacu

SEQ ID NO: 372154 - RNA, 22 nt, Human
accagagcagacuacuggaggu

SEQ ID NO: 372155 - RNA, 22 nt, Human
ucugucacuauuggccagaaca

SEQ ID NO: 372156 - RNA, 22 nt, Human
aggaggccgggauucuggagau

SEQ ID NO: 372157 - RNA, 22 nt, Human
ugggugcuucgucagcucugag

SEQ ID NO: 372158 - RNA, 19 nt, Human
caaggccaccauuucuccg

SEQ ID NO: 372159 - RNA, 22 nt, Human
cagcccugagaaggaggaucuc

SEQ ID NO: 372160 - RNA, 22 nt, Human
uugaagcagcucaggaggcuua

SEQ ID NO: 372161 - RNA, 22 nt, Human
guggcucuaggugagcauggag

SEQ ID NO: 372162 - RNA, 22 nt, Human
uccaggcuagaagucacaggcc

SEQ ID NO: 372163 - RNA, 22 nt, Human
accaggcuggagugcaguggcg

SEQ ID NO: 372164 - RNA, 22 nt, Human
aaaauugaggcucauguuaaau

SEQ ID NO: 372165 - RNA, 18 nt, Human
auuguuaauagaguacuu

SEQ ID NO: 372166 - RNA, 23 nt, Human
agaagcagcuucuggaguaucgg

SEQ ID NO: 372167 - RNA, 20 nt, Human
ugugcccaauguccagguuc

SEQ ID NO: 372168 - RNA, 22 nt, Human
guaaacauuacugugcuguaua

SEQ ID NO: 372169 - RNA, 22 nt, Human
caccugagugucaguauucuca

SEQ ID NO: 372170 - RNA, 22 nt, Human
auuccaaagguuaaugcccauu

SEQ ID NO: 372171 - RNA, 22 nt, Human
ugccugucagggggagugggaa

SEQ ID NO: 372172 - RNA, 22 nt, Human
gcagcagagaacacaaugaugg

SEQ ID NO: 372173 - RNA, 22 nt, Human
cuuugcaaacugucacacuuuc

SEQ ID NO: 372174 - RNA, 22 nt, Human
gccugcagggugaugggcugcc

SEQ ID NO: 372175 - RNA, 22 nt, Human
gaggcacuggaggaaaggagaa

SEQ ID NO: 372176 - RNA, 22 nt, Human
agccaggccuuuucucaagguu

SEQ ID NO: 372177 - RNA, 22 nt, Human
uacauguuuacuccaagucagg

SEQ ID NO: 372178 - RNA, 22 nt, Human
uacagaauuagauuauuagaga

SEQ ID NO: 372179 - RNA, 20 nt, Human
aagauucauuguaauuaggg

SEQ ID NO: 372180 - RNA, 21 nt, Human
uuucaauguguucuuuguagu

SEQ ID NO: 372181 - RNA, 22 nt, Human
uuucaguuguccuguuaauagc

SEQ ID NO: 372182 - RNA, 22 nt, Human
ccacugggggcugcaggcacuc

SEQ ID NO: 372183 - RNA, 22 nt, Human
gcacaauuauuuaugcaguaug

SEQ ID NO: 372184 - RNA, 22 nt, Human
guuuucuuugaaugcuucuaga

SEQ ID NO: 372185 - RNA, 22 nt, Human
aaaggcaugauuaauucugugu

SEQ ID NO: 372186 - RNA, 22 nt, Human
cagaaauggaauuuuccaucac

SEQ ID NO: 372187 - RNA, 22 nt, Human
ccccaccugugcgucugccgca

SEQ ID NO: 372188 - RNA, 22 nt, Human
uccucagacacccugcuggcuu

SEQ ID NO: 372189 - RNA, 22 nt, Human
uccaagggcagccauagaacuu

SEQ ID NO: 372190 - RNA, 22 nt, Human
uccuggcccacuaugccagcau

SEQ ID NO: 372191 - RNA, 22 nt, Human
gggcacugcuggaggcucccug

SEQ ID NO: 372192 - RNA, 22 nt, Human
gagcacaggcuuugguggacac

SEQ ID NO: 372193 - RNA, 21 nt, Human
uggcugcuggcccucucucca

SEQ ID NO: 372194 - RNA, 20 nt, Human
caucagaaauccugacccac

SEQ ID NO: 372195 - RNA, 22 nt, Human
ugcugagcgcauccggcggccg

SEQ ID NO: 372196 - RNA, 22 nt, Human
aggcucagucuguucaugcacu

SEQ ID NO: 372197 - RNA, 22 nt, Human
acaggugaccugcucauaugaa

SEQ ID NO: 372198 - RNA, 22 nt, Human
aaucagaacgcucgaucuucgg

SEQ ID NO: 372199 - RNA, 22 nt, Human
uugcagagagguuaggaacuca

SEQ ID NO: 372200 - RNA, 22 nt, Human
ucugcuggccuuagcaggucua

SEQ ID NO: 372201 - RNA, 22 nt, Human
cuuuuccacugagccucacaaa

SEQ ID NO: 372202 - RNA, 21 nt, Human
aaggccugcuuacugcuaguu

SEQ ID NO: 372203 - RNA, 20 nt, Human
aggaaaaggguggugguaga

SEQ ID NO: 372204 - RNA, 22 nt, Human
cugcuguguuggcauuggauag

SEQ ID NO: 372205 - RNA, 22 nt, Human
cuggagccuucaccaggggaaa

SEQ ID NO: 372206 - RNA, 21 nt, Human
gagagggcauuauaggaagug

SEQ ID NO: 372207 - RNA, 16 nt, Human
gagaagagcccggcag

SEQ ID NO: 372208 - RNA, 22 nt, Human
uaugcacaguuacaagaauauc

SEQ ID NO: 372209 - RNA, 22 nt, Human
ucagaauugucuggggaauguu

SEQ ID NO: 372210 - RNA, 22 nt, Human
caggcagcucugcuuuuccuaa

SEQ ID NO: 372211 - RNA, 22 nt, Human
ucuuggagaauggcagagaagc

SEQ ID NO: 372212 - RNA, 22 nt, Human
uggagaagauuggucaccauuc

SEQ ID NO: 372213 - RNA, 22 nt, Human
gcagcuggaagugacacucugu

SEQ ID NO: 372214 - RNA, 22 nt, Human
uaaugcacagaauugacauggg

SEQ ID NO: 372215 - RNA, 22 nt, Human
augcacagcagugaguucagug

SEQ ID NO: 372216 - RNA, 22 nt, Human
ccagcugguuaaaauagagaaa

SEQ ID NO: 372217 - RNA, 22 nt, Human
agaauuagucacaauuauagga

SEQ ID NO: 372218 - RNA, 22 nt, Human
ccucagcugcuucccuggagcc

SEQ ID NO: 372219 - RNA, 22 nt, Human
agaaacuucagcuauucuuuug

SEQ ID NO: 372220 - RNA, 22 nt, Human
gcaggcaguugcaguuuucuag

SEQ ID NO: 372221 - RNA, 22 nt, Human
gggagccacaguuuauagugau

SEQ ID NO: 372222 - RNA, 22 nt, Human
uggcagggaauacagauguuua

SEQ ID NO: 372223 - RNA, 22 nt, Human
gcccaggaaagauagggccuca

SEQ ID NO: 372224 - RNA, 22 nt, Human
cugggagauugcuagagaugca

SEQ ID NO: 372225 - RNA, 22 nt, Human
cuucucaaaguugugaaucagg

SEQ ID NO: 372226 - RNA, 18 nt, Human
uuccauaauguauguaac

SEQ ID NO: 372227 - RNA, 23 nt, Human
aguaaagcaauuguuggcgagag

SEQ ID NO: 372228 - RNA, 22 nt, Human
augaagucugcacaugcaugug

SEQ ID NO: 372229 - RNA, 21 nt, Human
aaugugugcuauuuaucuuuu

SEQ ID NO: 372230 - RNA, 21 nt, Human
aggcagcaggauccagggaca

SEQ ID NO: 372231 - RNA, 22 nt, Human
augggaggaaggaggcccuuga

SEQ ID NO: 372232 - RNA, 18 nt, Human
ucagcuggggcugcagcc

SEQ ID NO: 372233 - RNA, 22 nt, Human
gggagcuguaguccagauaccg

SEQ ID NO: 372234 - RNA, 22 nt, Human
uggcugagccuuuggggcuuuc

SEQ ID NO: 372235 - RNA, 19 nt, Human
ucauuguugguuugucggg

SEQ ID NO: 372236 - RNA, 22 nt, Human
agaggaaguaaucaggaccugc

SEQ ID NO: 372237 - RNA, 22 nt, Human
agcugguucagaaauuagaugg

SEQ ID NO: 372238 - RNA, 22 nt, Human
uagcugccaaaagggugggcua

SEQ ID NO: 372239 - RNA, 22 nt, Human
cagaauaaaagucccaaggcau

SEQ ID NO: 372240 - RNA, 22 nt, Human
gcuggcagguccaagauagagc

SEQ ID NO: 372241 - RNA, 22 nt, Human
uguagcucuccagccagcaagg

SEQ ID NO: 372242 - RNA, 22 nt, Human
caugaagcacagcucucuuuuu

SEQ ID NO: 372243 - RNA, 19 nt, Human
ucugccucuggucaggcuc

SEQ ID NO: 372244 - RNA, 22 nt, Human
caguggguggcuaaguggcuga

SEQ ID NO: 372245 - RNA, 22 nt, Human
augauauuugcaaugugcuugc

SEQ ID NO: 372246 - RNA, 22 nt, Human
ccagcuccaggacugggagcug

SEQ ID NO: 372247 - RNA, 22 nt, Human
gcagcuggggccacacuuaggc

SEQ ID NO: 372248 - RNA, 22 nt, Human
gcuguucauuagaaauagaaug

SEQ ID NO: 372249 - RNA, 22 nt, Human
uggcagagugcagaagaggcau

SEQ ID NO: 372250 - RNA, 22 nt, Human
uggcugaguguuccaaggagca

SEQ ID NO: 372251 - RNA, 22 nt, Human
cagcuguguaugagagcaugcu

SEQ ID NO: 372252 - RNA, 22 nt, Human
uccuuguugcugcagucaccug

SEQ ID NO: 372253 - RNA, 22 nt, Human
cagccugggcuccagagucccu

SEQ ID NO: 372254 - RNA, 22 nt, Human
ucagggcaaugucccucagaag

SEQ ID NO: 372255 - RNA, 22 nt, Human
ugaaggcccagccacagaaugg

SEQ ID NO: 372256 - RNA, 22 nt, Human
uccgccaggacugagggcccau

SEQ ID NO: 372257 - RNA, 23 nt, Human
ugaugggaaggaacgacuaccac

SEQ ID NO: 372258 - RNA, 22 nt, Human
ucagaggauagaaauacuuauu

SEQ ID NO: 372259 - RNA, 22 nt, Human
aaacucuguagcuaaacauaau

SEQ ID NO: 372260 - RNA, 22 nt, Human
ccuucuucuguguggcccaaga

SEQ ID NO: 372261 - RNA, 22 nt, Human
ucccugggcaucacguugcuuc

SEQ ID NO: 372262 - RNA, 22 nt, Human
aaccauuugcaguuacugagac

SEQ ID NO: 372263 - RNA, 21 nt, Human
gcacagggacagaucaucaca

SEQ ID NO: 372264 - RNA, 22 nt, Human
cuuaggaacgcucugccuagug

SEQ ID NO: 372265 - RNA, 22 nt, Human
ugggcugaguggcagccagagu

SEQ ID NO: 372266 - RNA, 22 nt, Human
gcagagugagauaugaacccag

SEQ ID NO: 372267 - RNA, 22 nt, Human
agaauuagaggccauguacuug

SEQ ID NO: 372268 - RNA, 22 nt, Human
auaggcuuauauaaaaacaucu

SEQ ID NO: 372269 - RNA, 22 nt, Human
cucuucuugcuagacugagugc

SEQ ID NO: 372270 - RNA, 22 nt, Human
aaguucaagagugacauauuag

SEQ ID NO: 372271 - RNA, 22 nt, Human
cagggagggaggaaaauuugcu

SEQ ID NO: 372272 - RNA, 22 nt, Human
ucuggccacccgaggccccugc

SEQ ID NO: 372273 - RNA, 22 nt, Human
cuucccacagaauucaaucagu

SEQ ID NO: 372274 - RNA, 19 nt, Human
auuugaaagcugugcuugc

SEQ ID NO: 372275 - RNA, 22 nt, Human
ccauaaggagccagacauucca

SEQ ID NO: 372276 - RNA, 19 nt, Human
uaguggagugacaaguucu

SEQ ID NO: 372277 - RNA, 22 nt, Human
uuauuugcccauguuuagcaga

SEQ ID NO: 372278 - RNA, 22 nt, Human
ucagggcagccuaaggcaccuc

SEQ ID NO: 372279 - RNA, 22 nt, Human
ggucacaggggagaagagugau

SEQ ID NO: 372280 - RNA, 22 nt, Human
cuggcagcauggagccugugcu

SEQ ID NO: 372281 - RNA, 22 nt, Human
ugagcuucuuuauuuggccaga

SEQ ID NO: 372282 - RNA, 22 nt, Human
ucuguuccaguagaaaggugca

SEQ ID NO: 372283 - RNA, 17 nt, Human
agaggcagauacuugga

SEQ ID NO: 372284 - RNA, 22 nt, Human
auagaacagaaacagaugcaca

SEQ ID NO: 372285 - RNA, 22 nt, Human
cuuauauuuuaggaacagacaa

SEQ ID NO: 372286 - RNA, 22 nt, Human
cauuuacauaacaguaacgcug

SEQ ID NO: 372287 - RNA, 21 nt, Human
ccaaaggcuauguaucuucug

SEQ ID NO: 372288 - RNA, 22 nt, Human
uuaauucugccuuucauguaac

SEQ ID NO: 372289 - RNA, 22 nt, Human
aaaucaguuagugguaggauug

SEQ ID NO: 372290 - RNA, 22 nt, Human
cucugugggggagaggcagcug

SEQ ID NO: 372291 - RNA, 22 nt, Human
agcauggggcuccgcaaugaac

SEQ ID NO: 372292 - RNA, 22 nt, Human
uuauuuucuccucagaaagugg

SEQ ID NO: 372293 - RNA, 19 nt, Human
uuccuuagaggaggcggug

SEQ ID NO: 372294 - RNA, 23 nt, Human
agagcuuucuaaaauguaaaucu

SEQ ID NO: 372295 - RNA, 22 nt, Human
gcaggaguguggugggacaucc

SEQ ID NO: 372296 - RNA, 22 nt, Human
uguacaauagcuauuaucucca

SEQ ID NO: 372297 - RNA, 22 nt, Human
aacuucuugguccugagcuguu

SEQ ID NO: 372298 - RNA, 22 nt, Human
uggagcuggaauuugagcugga

SEQ ID NO: 372299 - RNA, 21 nt, Human
acaggagaccgccuggcaguc

SEQ ID NO: 372300 - RNA, 22 nt, Human
auguguaggugaaucgaggcug

SEQ ID NO: 372301 - RNA, 22 nt, Human
gcaggcuggucugaccaucccu

SEQ ID NO: 372302 - RNA, 22 nt, Human
ugagcuguagcagaugcuguug

SEQ ID NO: 372303 - RNA, 22 nt, Human
augcagcugugggcaagaaaug

SEQ ID NO: 372304 - RNA, 22 nt, Human
ugaggcucagagaagugcuguu

SEQ ID NO: 372305 - RNA, 18 nt, Human
agcuggggccucuggucc

SEQ ID NO: 372306 - RNA, 20 nt, Human
uauuuacaacuuagagccuc

SEQ ID NO: 372307 - RNA, 22 nt, Human
agucaguguucuccggagaggc

SEQ ID NO: 372308 - RNA, 22 nt, Human
ugagccuguggggugacaacca

SEQ ID NO: 372309 - RNA, 22 nt, Human
ucauugcagacuaacaaucuca

SEQ ID NO: 372310 - RNA, 22 nt, Human
gugcagguguuuuggcugccag

SEQ ID NO: 372311 - RNA, 22 nt, Human
ggugaaggaggaagcugaugga

SEQ ID NO: 372312 - RNA, 22 nt, Human
agggcuccaggggcugggugac

SEQ ID NO: 372313 - RNA, 22 nt, Human
ggcauuuaguuuucauauucug

SEQ ID NO: 372314 - RNA, 22 nt, Human
cacaggcucuucucacuugauu

SEQ ID NO: 372315 - RNA, 22 nt, Human
ccaguggaauuaaaaauaagug

SEQ ID NO: 372316 - RNA, 22 nt, Human
cuuguaauuauaauguacuguu

SEQ ID NO: 372317 - RNA, 22 nt, Human
uugaaaggguuaaagugguaaa

SEQ ID NO: 372318 - RNA, 22 nt, Human
gugguaaucggauucuuaccgg

SEQ ID NO: 372319 - RNA, 22 nt, Human
ugccaggcaggacccuagaacc

SEQ ID NO: 372320 - RNA, 22 nt, Human
gcugcccugugguccagcaggu

SEQ ID NO: 372321 - RNA, 22 nt, Human
cugccuggaccggcagcccucc

SEQ ID NO: 372322 - RNA, 22 nt, Human
gccucccuguagaggccagccu

SEQ ID NO: 372323 - RNA, 22 nt, Human
ugcgcaggagcucugccaggag

SEQ ID NO: 372324 - RNA, 22 nt, Human
aauucauccaugaacaauucca

SEQ ID NO: 372325 - RNA, 22 nt, Human
uaagacacaugcguacaagaua

SEQ ID NO: 372326 - RNA, 22 nt, Human
auccuucaaggggcugacagcu

SEQ ID NO: 372327 - RNA, 22 nt, Human
guuuuccuucucagccauugcc

SEQ ID NO: 372328 - RNA, 22 nt, Human
ugguggcuucugaggauggcga

SEQ ID NO: 372329 - RNA, 22 nt, Human
cuggcucccucgcugaggugcu

SEQ ID NO: 372330 - RNA, 22 nt, Human
gcacaauaauuuuuuuaagagg

SEQ ID NO: 372331 - RNA, 22 nt, Human
uucaagaugcacaguggcauuc

SEQ ID NO: 372332 - RNA, 22 nt, Human
uggaggagggcuggugucugua

SEQ ID NO: 372333 - RNA, 22 nt, Human
ugcauuuuuaacaaggcuaauu

SEQ ID NO: 372334 - RNA, 23 nt, Human
uggagaugccccacucccugucu

SEQ ID NO: 372335 - RNA, 22 nt, Human
ccuauacagccucagcugagau

SEQ ID NO: 372336 - RNA, 22 nt, Human
cagacacaccaggcccauucug

SEQ ID NO: 372337 - RNA, 22 nt, Human
uugcagcagggugaauucacuc

SEQ ID NO: 372338 - RNA, 22 nt, Human
ucuuccucuagaucugaggccc

SEQ ID NO: 372339 - RNA, 22 nt, Human
cugagacuuucaugugcuuuua

SEQ ID NO: 372340 - RNA, 22 nt, Human
gaggaggcuaagugggcucugg

SEQ ID NO: 372341 - RNA, 22 nt, Human
cucccagguuccgacgccucuu

SEQ ID NO: 372342 - RNA, 22 nt, Human
acacagaaccucauagccucuc

SEQ ID NO: 372343 - RNA, 22 nt, Human
cagaaauaaacuucucacaucg

SEQ ID NO: 372344 - RNA, 22 nt, Human
aauguacaauaagacaaagagg

SEQ ID NO: 372345 - RNA, 21 nt, Human
uuagcaaagcaaacacaugcu

SEQ ID NO: 372346 - RNA, 22 nt, Human
ugugucagaaggcaauggggau

SEQ ID NO: 372347 - RNA, 22 nt, Human
ucugaacagaaaagaugcacaa

SEQ ID NO: 372348 - RNA, 22 nt, Human
acaguguccuuguggucccugu

SEQ ID NO: 372349 - RNA, 22 nt, Human
aucuacccacugaacacaauau

SEQ ID NO: 372350 - RNA, 22 nt, Human
cacccagcuuuugcauccuccg

SEQ ID NO: 372351 - RNA, 22 nt, Human
gagggucccugcucagggccag

SEQ ID NO: 372352 - RNA, 22 nt, Human
ugcuuccuucccguucuucucc

SEQ ID NO: 372353 - RNA, 22 nt, Human
aauauuucuccuucguuauagc

SEQ ID NO: 372354 - RNA, 22 nt, Human
auuccaaagcacaucagaacua

SEQ ID NO: 372355 - RNA, 22 nt, Human
guggcugcagcccagcggcacg

SEQ ID NO: 372356 - RNA, 22 nt, Human
ugcauauuauguguaucugucu

SEQ ID NO: 372357 - RNA, 22 nt, Human
cugagccagcuggcaugugcua

SEQ ID NO: 372358 - RNA, 22 nt, Human
ugcacacaaaugugaacgugcc

SEQ ID NO: 372359 - RNA, 19 nt, Human
cugucaggggcuggauguu

SEQ ID NO: 372360 - RNA, 22 nt, Human
cucugggcaggaccaguggacc

SEQ ID NO: 372361 - RNA, 22 nt, Human
aacucagcauccugcacagaga

SEQ ID NO: 372362 - RNA, 22 nt, Human
ccaaggagcucauauucuuguu

SEQ ID NO: 372363 - RNA, 22 nt, Human
uagcagcugugaguaaaagcca

SEQ ID NO: 372364 - RNA, 22 nt, Human
cagcuucugagcaagccagggg

SEQ ID NO: 372365 - RNA, 22 nt, Human
caguacuuaguucucaugguuu

SEQ ID NO: 372366 - RNA, 19 nt, Human
cagucccaaauucuuguca

SEQ ID NO: 372367 - RNA, 22 nt, Human
caaagugcuaggauuacaggcc

SEQ ID NO: 372368 - RNA, 22 nt, Human
gccaaagcagucuugccucugc

SEQ ID NO: 372369 - RNA, 21 nt, Human
cagcagaguaaugcauucgua

SEQ ID NO: 372370 - RNA, 22 nt, Human
auuguguaauuuucagcucaua

SEQ ID NO: 372371 - RNA, 22 nt, Human
ucucagaguuuacggggcugaa

SEQ ID NO: 372372 - RNA, 22 nt, Human
ucacuuagauggggaucaucac

SEQ ID NO: 372373 - RNA, 22 nt, Human
ugcuggcccaguauggacugca

SEQ ID NO: 372374 - RNA, 22 nt, Human
aggaggcuguggagcacuccau

SEQ ID NO: 372375 - RNA, 22 nt, Human
uguucuugggaaucuuacaguu

SEQ ID NO: 372376 - RNA, 22 nt, Human
augcuuaaccuugguguacaau

SEQ ID NO: 372377 - RNA, 20 nt, Human
cugcugugauucccuccucc

SEQ ID NO: 372378 - RNA, 22 nt, Human
uggagccaaugaacauuugcug

SEQ ID NO: 372379 - RNA, 22 nt, Human
ugugaaggcagagccagugaaa

SEQ ID NO: 372380 - RNA, 22 nt, Human
caggcacuggggaugcugggau

SEQ ID NO: 372381 - RNA, 22 nt, Human
ugcuuuauggagcccaucucau

SEQ ID NO: 372382 - RNA, 18 nt, Human
gucauugcaacauacugu

SEQ ID NO: 372383 - RNA, 18 nt, Human
ugaaacaagaauggugca

SEQ ID NO: 372384 - RNA, 22 nt, Human
uagaggcauuaaugaauaaaca

SEQ ID NO: 372385 - RNA, 22 nt, Human
agauuuccuaugguaauuauag

SEQ ID NO: 372386 - RNA, 22 nt, Human
cccuggcauaaaacuucuccag

SEQ ID NO: 372387 - RNA, 22 nt, Human
uguauacaauucacacuuccca

SEQ ID NO: 372388 - RNA, 22 nt, Human
uuguuucaugaguguaaaggga

SEQ ID NO: 372389 - RNA, 22 nt, Human
auacaaugaaguauagaugaaa

SEQ ID NO: 372390 - RNA, 22 nt, Human
caaugucaugauuuuccauuag

SEQ ID NO: 372391 - RNA, 22 nt, Human
uggaaggcaacggagugagcug

SEQ ID NO: 372392 - RNA, 22 nt, Human
agaagucaaguggucuaugaaa

SEQ ID NO: 372393 - RNA, 22 nt, Human
gaggcuggugguuaguuccauu

SEQ ID NO: 372394 - RNA, 22 nt, Human
aggauuuaaauccuuaaccacu

SEQ ID NO: 372395 - RNA, 22 nt, Human
ccugggcuugcaucugugcugg

SEQ ID NO: 372396 - RNA, 22 nt, Human
uacacaugaucauuuaguagca

SEQ ID NO: 372397 - RNA, 22 nt, Human
gcagggaagaucuuggagcugc

SEQ ID NO: 372398 - RNA, 22 nt, Human
cacugucuuuugugaagacaau

SEQ ID NO: 372399 - RNA, 22 nt, Human
agcaccaucagaugcaauaucu

SEQ ID NO: 372400 - RNA, 22 nt, Human
cucuggaguuagugaucugggc

SEQ ID NO: 372401 - RNA, 22 nt, Human
uggcagcagacaaaaggccauu

SEQ ID NO: 372402 - RNA, 22 nt, Human
agggcagcuagcuguagaaaga

SEQ ID NO: 372403 - RNA, 22 nt, Human
cagcauuggguuaccuuuguuu

SEQ ID NO: 372404 - RNA, 22 nt, Human
agcaggaacgaguucaugggga

SEQ ID NO: 372405 - RNA, 22 nt, Human
cugccuggagcauucugaaggu

SEQ ID NO: 372406 - RNA, 18 nt, Human
uacaggaaaaguguuaca

SEQ ID NO: 372407 - RNA, 22 nt, Human
caguggggaggccaggauagaa

SEQ ID NO: 372408 - RNA, 22 nt, Human
ggagccuggucagguuggcucc

SEQ ID NO: 372409 - RNA, 22 nt, Human
acauuuaaccaaacuguuuaau

SEQ ID NO: 372410 - RNA, 22 nt, Human
uuuuaaucaugcuucuaugucc

SEQ ID NO: 372411 - RNA, 22 nt, Human
uaacaagucauuuuaaauuaug

SEQ ID NO: 372412 - RNA, 22 nt, Human
aaaauccucuaauucuagaaua

SEQ ID NO: 372413 - RNA, 22 nt, Human
augccacugacauggacaauuu

SEQ ID NO: 372414 - RNA, 22 nt, Human
aaguuugagagccuuuaguaua

SEQ ID NO: 372415 - RNA, 23 nt, Human
cugcagccgcguggggacgugga

SEQ ID NO: 372416 - RNA, 22 nt, Human
cuugaaucuucugaguauuugc

SEQ ID NO: 372417 - RNA, 22 nt, Human
gagccuggagcuggaacgaagc

SEQ ID NO: 372418 - RNA, 23 nt, Human
aggaggaaaaguuaucugcugag

SEQ ID NO: 372419 - RNA, 18 nt, Human
gaagggagcuggaaugca

SEQ ID NO: 372420 - RNA, 22 nt, Human
cagcagcaaaucuagaagagga

SEQ ID NO: 372421 - RNA, 17 nt, Human
uggcuucccugggccac

SEQ ID NO: 372422 - RNA, 22 nt, Human
agggccagcacuccuggcagga

SEQ ID NO: 372423 - RNA, 22 nt, Human
uggagcagggcaucacugugcg

SEQ ID NO: 372424 - RNA, 22 nt, Human
cagcagagcuuauguuggguca

SEQ ID NO: 372425 - RNA, 22 nt, Human
ugcuggcuguauaugugagagu

SEQ ID NO: 372426 - RNA, 22 nt, Human
aucagagaaauggagggcgcuu

SEQ ID NO: 372427 - RNA, 20 nt, Human
cuggcaggagcgagucuacc

SEQ ID NO: 372428 - RNA, 22 nt, Human
acauacauaugacaacuuuccu

SEQ ID NO: 372429 - RNA, 22 nt, Human
guaaacaacacaaaucauuuga

SEQ ID NO: 372430 - RNA, 22 nt, Human
guuauuuuaacuucucaguaau

SEQ ID NO: 372431 - RNA, 22 nt, Human
ggcaggaggaagaguuagcacc

SEQ ID NO: 372432 - RNA, 22 nt, Human
gagccuggccuccugccucagc

SEQ ID NO: 372433 - RNA, 22 nt, Human
aucuucucauguguaaugaggu

SEQ ID NO: 372434 - RNA, 22 nt, Human
gccaggcuccaggcccuccuga

SEQ ID NO: 372435 - RNA, 22 nt, Human
cagcuuuuuagaaucuagggca

SEQ ID NO: 372436 - RNA, 22 nt, Human
gcaguccucucauuggccuccu

SEQ ID NO: 372437 - RNA, 22 nt, Human
gcugucugacuccaaguuggag

SEQ ID NO: 372438 - RNA, 22 nt, Human
guaaacaucgacccaacagggg

SEQ ID NO: 372439 - RNA, 22 nt, Human
ccaugagcuuccuauauagggu

SEQ ID NO: 372440 - RNA, 22 nt, Human
acagaauuaaaguguuugugga

SEQ ID NO: 372441 - RNA, 22 nt, Human
ggucucagcccucgccagcagc

SEQ ID NO: 372442 - RNA, 20 nt, Human
accaauguuagcuuaguacu

SEQ ID NO: 372443 - RNA, 22 nt, Human
uuugggaaacuuaggggucaga

SEQ ID NO: 372444 - RNA, 22 nt, Human
caguggguaggaaaggcucuuc

SEQ ID NO: 372445 - RNA, 22 nt, Human
gcagcccaauggacugagacag

SEQ ID NO: 372446 - RNA, 22 nt, Human
cugagccaugagccugcgccca

SEQ ID NO: 372447 - RNA, 22 nt, Human
ggccucggcccacugcugcggu

SEQ ID NO: 372448 - RNA, 22 nt, Human
agcccucauggaacagcuccua

SEQ ID NO: 372449 - RNA, 22 nt, Human
ggcccugugguuuugcaaaguc

SEQ ID NO: 372450 - RNA, 20 nt, Human
cacagcuugccuuuuaugac

SEQ ID NO: 372451 - RNA, 22 nt, Human
ucagcuggcaguucagaggcug

SEQ ID NO: 372452 - RNA, 22 nt, Human
gcucucuuuuuccagugguggu

SEQ ID NO: 372453 - RNA, 22 nt, Human
guuauuuucauuggcucagacu

SEQ ID NO: 372454 - RNA, 22 nt, Human
agaggacaaaaugagaagugcu

SEQ ID NO: 372455 - RNA, 22 nt, Human
agcccagcagaaaguccagccu

SEQ ID NO: 372456 - RNA, 22 nt, Human
acaaagaucuugcuuuccuacu

SEQ ID NO: 372457 - RNA, 22 nt, Human
cagcugacccgugggaggcggg

SEQ ID NO: 372458 - RNA, 22 nt, Human
uucaagaugacccagucacacg

SEQ ID NO: 372459 - RNA, 22 nt, Human
aaggccugggaggccucucuuc

SEQ ID NO: 372460 - RNA, 22 nt, Human
gggcagcucuggcugugggaag

SEQ ID NO: 372461 - RNA, 22 nt, Human
acauacauauguuuaaaugcau

SEQ ID NO: 372462 - RNA, 22 nt, Human
cugggagaugacucagagcagg

SEQ ID NO: 372463 - RNA, 22 nt, Human
acucugaggagugacuagaggu

SEQ ID NO: 372464 - RNA, 22 nt, Human
cagcuggggcagccacgugcgg

SEQ ID NO: 372465 - RNA, 20 nt, Human
aguacaauguaugauucaga

SEQ ID NO: 372466 - RNA, 22 nt, Human
caggagcccguugcuccggcgg

SEQ ID NO: 372467 - RNA, 20 nt, Human
agucccuuuggucagguauu

SEQ ID NO: 372468 - RNA, 22 nt, Human
ugcuucagaggaaaggcaaaag

SEQ ID NO: 372469 - RNA, 17 nt, Human
uccaggcauaucuccua

SEQ ID NO: 372470 - RNA, 16 nt, Human
ccuggauccccugugg

SEQ ID NO: 372471 - RNA, 22 nt, Human
uccugugccuccaccugcuccg

SEQ ID NO: 372472 - RNA, 22 nt, Human
auauaauacaaccugcuaagug

SEQ ID NO: 372473 - RNA, 22 nt, Human
cgggcuccgggucuuugcaguc

SEQ ID NO: 372474 - RNA, 20 nt, Human
agaauucuuacccuuugaug

SEQ ID NO: 372475 - RNA, 22 nt, Human
cagggcacggagaagucacccc

SEQ ID NO: 372476 - RNA, 17 nt, Human
agagagagcaugccacc

SEQ ID NO: 372477 - RNA, 22 nt, Human
ggagaugguggaagcuggugca

SEQ ID NO: 372478 - RNA, 22 nt, Human
agugcagcaugcuggggaggcu

SEQ ID NO: 372479 - RNA, 22 nt, Human
aggcuucccagcugagcucagc

SEQ ID NO: 372480 - RNA, 22 nt, Human
ucaggcagguggcuggcuaugg

SEQ ID NO: 372481 - RNA, 22 nt, Human
gagacacaaacauuuauuccac

SEQ ID NO: 372482 - RNA, 22 nt, Human
agguacagaugaaagucuaguu

SEQ ID NO: 372483 - RNA, 23 nt, Human
uuaagacuggcugaacuuaguag

SEQ ID NO: 372484 - RNA, 22 nt, Human
gcaguggcaugaugugggcuca

SEQ ID NO: 372485 - RNA, 23 nt, Human
aucauucuccaaucuggagcagg

SEQ ID NO: 372486 - RNA, 22 nt, Human
aucagagaaguuucacuggcau

SEQ ID NO: 372487 - RNA, 22 nt, Human
ccaggaguuggagguugcagug

SEQ ID NO: 372488 - RNA, 22 nt, Human
cugccuggguucaaguccuguu

SEQ ID NO: 372489 - RNA, 22 nt, Human
uuuauuuaaagucguguguuaa

SEQ ID NO: 372490 - RNA, 22 nt, Human
gccuucaggaaaucaguccuug

SEQ ID NO: 372491 - RNA, 22 nt, Human
aggcugagacugugcauuagug

SEQ ID NO: 372492 - RNA, 22 nt, Human
uggaggaaaaaaccaggcagag

SEQ ID NO: 372493 - RNA, 22 nt, Human
gcaggggcuaaggacacagaga

SEQ ID NO: 372494 - RNA, 22 nt, Human
uucauauauaugcacuacguac

SEQ ID NO: 372495 - RNA, 22 nt, Human
gccuccugaaaggaagagcucc

SEQ ID NO: 372496 - RNA, 22 nt, Human
caggaucccuggccuccgccca

SEQ ID NO: 372497 - RNA, 22 nt, Human
ugcucccaggcucuguggucug

SEQ ID NO: 372498 - RNA, 23 nt, Human
aggaggccugaaacugaggcuga

SEQ ID NO: 372499 - RNA, 22 nt, Human
guuugaaaaaagcaguauguaa

SEQ ID NO: 372500 - RNA, 22 nt, Human
gauucuuacuucuaagcaagcu

SEQ ID NO: 372501 - RNA, 22 nt, Human
gaaaggagggaaacagagcggu

SEQ ID NO: 372502 - RNA, 22 nt, Human
caaauaguaugagcaaugauuc

SEQ ID NO: 372503 - RNA, 18 nt, Human
aggccagcccugcuacug

SEQ ID NO: 372504 - RNA, 22 nt, Human
aagaacauguuaaaagauucac

SEQ ID NO: 372505 - RNA, 22 nt, Human
ucccaggcuggggccaggugac

SEQ ID NO: 372506 - RNA, 22 nt, Human
caaauauuccagguacaucccu

SEQ ID NO: 372507 - RNA, 22 nt, Human
ucugaggccccugggcaggaug

SEQ ID NO: 372508 - RNA, 23 nt, Human
agggcugaugccauugcagcucu

SEQ ID NO: 372509 - RNA, 22 nt, Human
agaggucagauuucuccuggug

SEQ ID NO: 372510 - RNA, 22 nt, Human
cuggggcucucuggaaugcuug

SEQ ID NO: 372511 - RNA, 22 nt, Human
uauuuugagguauuuuugagcu

SEQ ID NO: 372512 - RNA, 22 nt, Human
uuugacaucuaagaauucuuac

SEQ ID NO: 372513 - RNA, 18 nt, Human
acaaauguagugucuuaa

SEQ ID NO: 372514 - RNA, 22 nt, Human
uaauuucaaauuucuuagcgug

SEQ ID NO: 372515 - RNA, 22 nt, Human
auacauuagaaucugguacuca

SEQ ID NO: 372516 - RNA, 22 nt, Human
ggaggccaaggagggcggauca

SEQ ID NO: 372517 - RNA, 22 nt, Human
ucagagagcagaacuuuuuuac

SEQ ID NO: 372518 - RNA, 22 nt, Human
guggcuucugcggugugcgcag

SEQ ID NO: 372519 - RNA, 22 nt, Human
ggcagcuggccuccucgcccac

SEQ ID NO: 372520 - RNA, 22 nt, Human
cuguaaauaugaagaauauaug

SEQ ID NO: 372521 - RNA, 22 nt, Human
ucuccuuuaagauuuccucagg

SEQ ID NO: 372522 - RNA, 20 nt, Human
ugcagggcugccucccagcu

SEQ ID NO: 372523 - RNA, 22 nt, Human
cuguggaaaauuuguauguaau

SEQ ID NO: 372524 - RNA, 22 nt, Human
augggaugcauggcuguggcca

SEQ ID NO: 372525 - RNA, 22 nt, Human
uucaaagcugcagacuccuggg

SEQ ID NO: 372526 - RNA, 22 nt, Human
aaaugucuuuaucucauguaac

SEQ ID NO: 372527 - RNA, 22 nt, Human
auaauuuacuaagcucuaccuu

SEQ ID NO: 372528 - RNA, 22 nt, Human
ggcaggcucagcagccaaggag

SEQ ID NO: 372529 - RNA, 18 nt, Human
agccuggaggguugaagu

SEQ ID NO: 372530 - RNA, 22 nt, Human
ugggcugcuucuauuggugguc

SEQ ID NO: 372531 - RNA, 22 nt, Human
ucucaccauggugcuugcuuau

SEQ ID NO: 372532 - RNA, 22 nt, Human
uguugauuaguguuuagacuua

SEQ ID NO: 372533 - RNA, 22 nt, Human
acagcuuuucugauagauccug

SEQ ID NO: 372534 - RNA, 22 nt, Human
uagaaacucaggauacucuucc

SEQ ID NO: 372535 - RNA, 22 nt, Human
cagagugagggccugcaccugc

SEQ ID NO: 372536 - RNA, 22 nt, Human
caguaaauuugagggaucuaau

SEQ ID NO: 372537 - RNA, 22 nt, Human
cagagcuggagaaguggauuua

SEQ ID NO: 372538 - RNA, 22 nt, Human
gccuguuggguaacagaguuca

SEQ ID NO: 372539 - RNA, 22 nt, Human
agugugugcaugcauucgugca

SEQ ID NO: 372540 - RNA, 22 nt, Human
acagagcacauagauuggaguu

SEQ ID NO: 372541 - RNA, 22 nt, Human
gcagagaaaguuuuguccucag

SEQ ID NO: 372542 - RNA, 21 nt, Human
auggcuuuuuuaaagcuugug

SEQ ID NO: 372543 - RNA, 22 nt, Human
uaggggaacuggcacagggcag

SEQ ID NO: 372544 - RNA, 22 nt, Human
ugucccagaucacaggagggga

SEQ ID NO: 372545 - RNA, 22 nt, Human
uaggauuuaggcuuuaacaucu

SEQ ID NO: 372546 - RNA, 22 nt, Human
ggcugccucaaagcucaagcuc

SEQ ID NO: 372547 - RNA, 22 nt, Human
cagauggaacacagaaaggaga

SEQ ID NO: 372548 - RNA, 22 nt, Human
ggcucuggugaggguaggagau

SEQ ID NO: 372549 - RNA, 20 nt, Human
uggcuccucuuggcuguggc

SEQ ID NO: 372550 - RNA, 22 nt, Human
augcaguacagauaauucuaca

SEQ ID NO: 372551 - RNA, 22 nt, Human
ccuguucacgguguguuguuag

SEQ ID NO: 372552 - RNA, 22 nt, Human
uggcagagaauaaaucuugacu

SEQ ID NO: 372553 - RNA, 22 nt, Human
auguucaaacuuuuuacacacc

SEQ ID NO: 372554 - RNA, 19 nt, Human
cucagagaggggcagugcc

SEQ ID NO: 372555 - RNA, 22 nt, Human
uacauguuauuucacuauuggu

SEQ ID NO: 372556 - RNA, 22 nt, Human
aggcaggcuggucugaagagug

SEQ ID NO: 372557 - RNA, 22 nt, Human
cagggccugcuuccuucuuguu

SEQ ID NO: 372558 - RNA, 22 nt, Human
aagccagggucaggggccuccu

SEQ ID NO: 372559 - RNA, 22 nt, Human
cagcaggauagguuucuuugga

SEQ ID NO: 372560 - RNA, 22 nt, Human
ucaauaaaauuguuuuccuauc

SEQ ID NO: 372561 - RNA, 22 nt, Human
acaaaaguguaggaauuccuua

SEQ ID NO: 372562 - RNA, 22 nt, Human
uaggcagcugcaaacuucgguc

SEQ ID NO: 372563 - RNA, 22 nt, Human
uggaggaaguggacaguugugu

SEQ ID NO: 372564 - RNA, 22 nt, Human
acaggcagguccugucccagcu

SEQ ID NO: 372565 - RNA, 22 nt, Human
ccugucucuuucaaucugagag

SEQ ID NO: 372566 - RNA, 18 nt, Human
cugaggcuggcaggagcc

SEQ ID NO: 372567 - RNA, 22 nt, Human
uggcuuuaaaucuguauucaua

SEQ ID NO: 372568 - RNA, 22 nt, Human
agauuuagugguggaauuuugg

SEQ ID NO: 372569 - RNA, 22 nt, Human
uuaauuuuaaccuguuuguguc

SEQ ID NO: 372570 - RNA, 22 nt, Human
ucauuuguacuugugugcuugu

SEQ ID NO: 372571 - RNA, 22 nt, Human
agcaugaagacuucagagcuag

SEQ ID NO: 372572 - RNA, 22 nt, Human
uucauaguguuuccuuccagug

SEQ ID NO: 372573 - RNA, 22 nt, Human
ggaagccaggcugggggaucug

SEQ ID NO: 372574 - RNA, 22 nt, Human
uccaggcacuauauauacuuuu

SEQ ID NO: 372575 - RNA, 22 nt, Human
agaggcccucucucuccugaug

SEQ ID NO: 372576 - RNA, 22 nt, Human
uacaggaggauuaucaaaggau

SEQ ID NO: 372577 - RNA, 22 nt, Human
cuccagggagcuguggagguuu

SEQ ID NO: 372578 - RNA, 23 nt, Human
uggccucuccccaccuggcagaa

SEQ ID NO: 372579 - RNA, 22 nt, Human
gucuccugagacugcagucacc

SEQ ID NO: 372580 - RNA, 21 nt, Human
aguuugaugcaauuucugaga

SEQ ID NO: 372581 - RNA, 22 nt, Human
uggcuggggccugaauccugca

SEQ ID NO: 372582 - RNA, 22 nt, Human
augugcuuuauuaaguaaaaau

SEQ ID NO: 372583 - RNA, 22 nt, Human
ccagagagucgaugggggacac

SEQ ID NO: 372584 - RNA, 22 nt, Human
aagggcuggaauaucucuuaga

SEQ ID NO: 372585 - RNA, 22 nt, Human
gccucacugcagccccaggaag

SEQ ID NO: 372586 - RNA, 22 nt, Human
auggggcuguucucugcccugc

SEQ ID NO: 372587 - RNA, 22 nt, Human
aaagcccauguggaaguacagg

SEQ ID NO: 372588 - RNA, 22 nt, Human
gugggagcuuuggcaucaggcu

SEQ ID NO: 372589 - RNA, 22 nt, Human
auggcuuugaaguaauguaauu

SEQ ID NO: 372590 - RNA, 23 nt, Human
acagcugcaccuggccgccuggc

SEQ ID NO: 372591 - RNA, 22 nt, Human
uuuccaagagcuuauuucugaa

SEQ ID NO: 372592 - RNA, 17 nt, Human
cagucgaggaggaccug

SEQ ID NO: 372593 - RNA, 22 nt, Human
agcaguggccuggggcucugug

SEQ ID NO: 372594 - RNA, 22 nt, Human
acagcagccuuguugguuucga

SEQ ID NO: 372595 - RNA, 22 nt, Human
ugucuuuaaaauuaaacacauc

SEQ ID NO: 372596 - RNA, 22 nt, Human
gccaggcacaguucuaggugcu

SEQ ID NO: 372597 - RNA, 22 nt, Human
aggcccaguagugcugccuuua

SEQ ID NO: 372598 - RNA, 19 nt, Human
uuucagacucaucuccagc

SEQ ID NO: 372599 - RNA, 23 nt, Human
aaacaugcagcacaugaaugcua

SEQ ID NO: 372600 - RNA, 22 nt, Human
guuuagaauucuaacuuuaagg

SEQ ID NO: 372601 - RNA, 23 nt, Human
agucucagcuggaaacauguguc

SEQ ID NO: 372602 - RNA, 22 nt, Human
agccugguguggggcugcagag

SEQ ID NO: 372603 - RNA, 22 nt, Human
aaagcaaugaugguagacacgu

SEQ ID NO: 372604 - RNA, 22 nt, Human
augaagauaagaccaggcugga

SEQ ID NO: 372605 - RNA, 22 nt, Human
gccuggagcucuccacuugggg

SEQ ID NO: 372606 - RNA, 22 nt, Human
aagggacccuggaucaaaugga

SEQ ID NO: 372607 - RNA, 22 nt, Human
agggcccuccccgcucagggca

SEQ ID NO: 372608 - RNA, 22 nt, Human
gcuggcaccugcaccaagcagg

SEQ ID NO: 372609 - RNA, 22 nt, Human
gggcugccuuucuucugggagc

SEQ ID NO: 372610 - RNA, 22 nt, Human
caguccuucuccauuaaggcuc

SEQ ID NO: 372611 - RNA, 22 nt, Human
uuguccaaggucccacaguuag

SEQ ID NO: 372612 - RNA, 22 nt, Human
aucagagauggcuccagugcuc

SEQ ID NO: 372613 - RNA, 22 nt, Human
ccagagcccagggucaugcagg

SEQ ID NO: 372614 - RNA, 22 nt, Human
ucacugcucucuaagcaucgcc

SEQ ID NO: 372615 - RNA, 22 nt, Human
uuacuuuggauggucaagaaag

SEQ ID NO: 372616 - RNA, 22 nt, Human
ugcauauugugaaaauguagau

SEQ ID NO: 372617 - RNA, 22 nt, Human
gccagucugcucccacaaguuc

SEQ ID NO: 372618 - RNA, 22 nt, Human
uucauuugccaucaguguaaug

SEQ ID NO: 372619 - RNA, 22 nt, Human
cauuacauuucaaaauguuucc

SEQ ID NO: 372620 - RNA, 22 nt, Human
ccucuccuugcacccgucccgc

SEQ ID NO: 372621 - RNA, 22 nt, Human
cacaaaaguaggaggcaggcgg

SEQ ID NO: 372622 - RNA, 22 nt, Human
cccaccccuggacaggugagug

SEQ ID NO: 372623 - RNA, 22 nt, Human
ucaaaaguggccuguaaaaucu

SEQ ID NO: 372624 - RNA, 22 nt, Human
aaauguauccuacuuccugagu

SEQ ID NO: 372625 - RNA, 22 nt, Human
uagcuuuccuuguugccugugc

SEQ ID NO: 372626 - RNA, 22 nt, Human
auggacagugugucuguuucca

SEQ ID NO: 372627 - RNA, 22 nt, Human
gaggcagcggcucacagagaaa

SEQ ID NO: 372628 - RNA, 22 nt, Human
uuuccucugagugagcugggag

SEQ ID NO: 372629 - RNA, 22 nt, Human
ugugugaaggaauauauacuca

SEQ ID NO: 372630 - RNA, 22 nt, Human
acacaaauuguaggauaauugc

SEQ ID NO: 372631 - RNA, 23 nt, Human
cagcaggagggugccugggcugc

SEQ ID NO: 372632 - RNA, 22 nt, Human
cagugggugaugaguccugggg

SEQ ID NO: 372633 - RNA, 22 nt, Human
caguccuuggcuucauccgagu

SEQ ID NO: 372634 - RNA, 22 nt, Human
ucaccugggagggcugugguag

SEQ ID NO: 372635 - RNA, 22 nt, Human
guggagcccugguagggacccc

SEQ ID NO: 372636 - RNA, 22 nt, Human
uggggaagggcacccuggagac

SEQ ID NO: 372637 - RNA, 22 nt, Human
ucucagggagggcgagucagcg

SEQ ID NO: 372638 - RNA, 22 nt, Human
aaaggucaagcuggacucaggu

SEQ ID NO: 372639 - RNA, 22 nt, Human
aaauuucuguuguuuugagcca

SEQ ID NO: 372640 - RNA, 22 nt, Human
auugucugaauccaaagcucug

SEQ ID NO: 372641 - RNA, 22 nt, Human
cuugaaagcacuccuuugacug

SEQ ID NO: 372642 - RNA, 22 nt, Human
cacauguaguaagcaggcaaug

SEQ ID NO: 372643 - RNA, 22 nt, Human
ucucagagaggggccgggccuu

SEQ ID NO: 372644 - RNA, 21 nt, Human
ggucuuccaaauaaggagaaa

SEQ ID NO: 372645 - RNA, 22 nt, Human
cuggggcucacuuuggucaggc

SEQ ID NO: 372646 - RNA, 22 nt, Human
cauguuaauaugcauugaguac

SEQ ID NO: 372647 - RNA, 22 nt, Human
uucuucaaccaucuacauaaac

SEQ ID NO: 372648 - RNA, 22 nt, Human
agaaagcacucugucuuuuacc

SEQ ID NO: 372649 - RNA, 23 nt, Human
cuggcuccgaagacuccaggauc

SEQ ID NO: 372650 - RNA, 22 nt, Human
guuuuucuuugugugaagacaa

SEQ ID NO: 372651 - RNA, 22 nt, Human
acagggccagccugggaccugg

SEQ ID NO: 372652 - RNA, 22 nt, Human
gccugccuguuggcugaggugc

SEQ ID NO: 372653 - RNA, 22 nt, Human
guuuucugauuagcaaaucuga

SEQ ID NO: 372654 - RNA, 22 nt, Human
guacagaauuaugccaugaggg

SEQ ID NO: 372655 - RNA, 19 nt, Human
ggcccaaguacugagugcc

SEQ ID NO: 372656 - RNA, 22 nt, Human
gccagggcugugcagguuuguu

SEQ ID NO: 372657 - RNA, 22 nt, Human
agagggcaugcuugguggccug

SEQ ID NO: 372658 - RNA, 22 nt, Human
augugguugaagaauuacaucu

SEQ ID NO: 372659 - RNA, 22 nt, Human
ucacagggcauuauggcuccag

SEQ ID NO: 372660 - RNA, 22 nt, Human
aggccagcgcugcuagcucccg

SEQ ID NO: 372661 - RNA, 22 nt, Human
gcagcuggcccugacacgcaga

SEQ ID NO: 372662 - RNA, 22 nt, Human
augugaaacugaagcauccaua

SEQ ID NO: 372663 - RNA, 22 nt, Human
gcuggagccauuggcuuggccu

SEQ ID NO: 372664 - RNA, 22 nt, Human
aagaaugucguugguauuuuaa

SEQ ID NO: 372665 - RNA, 22 nt, Human
cauccugguuaccccauaguca

SEQ ID NO: 372666 - RNA, 22 nt, Human
aaauuucuggaagugucagagu

SEQ ID NO: 372667 - RNA, 22 nt, Human
ggggcagcucccgagggcagga

SEQ ID NO: 372668 - RNA, 22 nt, Human
uccuuucccuuuccauccuggc

SEQ ID NO: 372669 - RNA, 22 nt, Human
ugcugcuguuuccuacaucuca

SEQ ID NO: 372670 - RNA, 22 nt, Human
aacuuuauuguuaggggcuaaa

SEQ ID NO: 372671 - RNA, 22 nt, Human
ugaauaauuaugggaguccuaa

SEQ ID NO: 372672 - RNA, 22 nt, Human
agagggauggccccguaacuca

SEQ ID NO: 372673 - RNA, 22 nt, Human
auucagugugagguuuucaagu

SEQ ID NO: 372674 - RNA, 22 nt, Human
ucacauuucgcaucaguccgau

SEQ ID NO: 372675 - RNA, 22 nt, Human
ugccuggguucccaccccaaag

SEQ ID NO: 372676 - RNA, 22 nt, Human
uauuaguagcuugaaauuggug

SEQ ID NO: 372677 - RNA, 22 nt, Human
auggggcugggauucuccucgg

SEQ ID NO: 372678 - RNA, 22 nt, Human
uccagggguaccggccaggcag

SEQ ID NO: 372679 - RNA, 22 nt, Human
ggccugaggcgucccagcugug

SEQ ID NO: 372680 - RNA, 22 nt, Human
cccaggugggcaccucgaggaa

SEQ ID NO: 372681 - RNA, 22 nt, Human
gaguccaguuguucacagaggc

SEQ ID NO: 372682 - RNA, 22 nt, Human
cagccagcuggcacugugagua

SEQ ID NO: 372683 - RNA, 22 nt, Human
ugaggaaacuuacaaggcagaa

SEQ ID NO: 372684 - RNA, 22 nt, Human
uggcucagcauucacuggucuu

SEQ ID NO: 372685 - RNA, 22 nt, Human
agggccagaggcaccuugcagc

SEQ ID NO: 372686 - RNA, 22 nt, Human
ugaggcaggaauggggaaaagu

SEQ ID NO: 372687 - RNA, 22 nt, Human
caggguggcaggcaccauggcc

SEQ ID NO: 372688 - RNA, 22 nt, Human
gcagcuuuguggagaggcccau

SEQ ID NO: 372689 - RNA, 22 nt, Human
ucaggcugcaucuguaagggug

SEQ ID NO: 372690 - RNA, 22 nt, Human
cccagguggcagaagcugcagu

SEQ ID NO: 372691 - RNA, 22 nt, Human
ccuggcagcaggugggcccgug

SEQ ID NO: 372692 - RNA, 22 nt, Human
uccaggcauaaugcccaguggu

SEQ ID NO: 372693 - RNA, 22 nt, Human
gcugugcuauaucucugagugu

SEQ ID NO: 372694 - RNA, 22 nt, Human
gugaauaagaccuaaggaugaa

SEQ ID NO: 372695 - RNA, 22 nt, Human
ucuggcccagccccugagguca

SEQ ID NO: 372696 - RNA, 22 nt, Human
ccagucccaucucugucgcuua

SEQ ID NO: 372697 - RNA, 22 nt, Human
agggcgaggagacggaggcaca

SEQ ID NO: 372698 - RNA, 22 nt, Human
ugucucagaggcaggaagagcc

SEQ ID NO: 372699 - RNA, 22 nt, Human
caugggcaguuggcagggcuca

SEQ ID NO: 372700 - RNA, 21 nt, Human
gcucccugcucagcuccuggg

SEQ ID NO: 372701 - RNA, 22 nt, Human
cucuuaaagaauguuccagcug

SEQ ID NO: 372702 - RNA, 22 nt, Human
cagauggccagaggcagcugca

SEQ ID NO: 372703 - RNA, 22 nt, Human
gaaacaaucaucaugugauuug

SEQ ID NO: 372704 - RNA, 22 nt, Human
ccaggacagugaacauguaaga

SEQ ID NO: 372705 - RNA, 22 nt, Human
aggaagccuggcauuaaaaagc

SEQ ID NO: 372706 - RNA, 22 nt, Human
cuggagagaccgaaagaggcug

SEQ ID NO: 372707 - RNA, 22 nt, Human
cuaucaaacagccauuaauaua

SEQ ID NO: 372708 - RNA, 22 nt, Human
agcagcuucuuucacuccugga

SEQ ID NO: 372709 - RNA, 22 nt, Human
ugaauaugugacuuugauuuca

SEQ ID NO: 372710 - RNA, 22 nt, Human
agagaauuacagaagaauguca

SEQ ID NO: 372711 - RNA, 22 nt, Human
acugccuugucucuugccuguu

SEQ ID NO: 372712 - RNA, 22 nt, Human
acauaugcucaucugcauuccc

SEQ ID NO: 372713 - RNA, 22 nt, Human
caggggaagaugccaagggaga

SEQ ID NO: 372714 - RNA, 21 nt, Human
ggacagcugcgcgcagggcuc

SEQ ID NO: 372715 - RNA, 22 nt, Human
uagcuuuaaaaaucaucaaagc

SEQ ID NO: 372716 - RNA, 22 nt, Human
gcucccaggaugaggagccagg

SEQ ID NO: 372717 - RNA, 22 nt, Human
ggccaccuuccaguugccugca

SEQ ID NO: 372718 - RNA, 22 nt, Human
guucagggagggacagaugaag

SEQ ID NO: 372719 - RNA, 22 nt, Human
gggacaggcugagacuugagcu

SEQ ID NO: 372720 - RNA, 23 nt, Human
ggucccaguggagaggccucacc

SEQ ID NO: 372721 - RNA, 22 nt, Human
agcugcugcgccucacccuggc

SEQ ID NO: 372722 - RNA, 22 nt, Human
agagauguucauucagcauguu

SEQ ID NO: 372723 - RNA, 22 nt, Human
caaauccagaucccagucguag

SEQ ID NO: 372724 - RNA, 22 nt, Human
uuugcauucuagaaaaauuucu

SEQ ID NO: 372725 - RNA, 22 nt, Human
cugcagagaccuaggucagguu

SEQ ID NO: 372726 - RNA, 22 nt, Human
uaggcagcauggauucugaaua

SEQ ID NO: 372727 - RNA, 22 nt, Human
gcugcugguccucagagcucau

SEQ ID NO: 372728 - RNA, 17 nt, Human
auuuccucagggcugag

SEQ ID NO: 372729 - RNA, 22 nt, Human
ugggcugcugagaaugagagag

SEQ ID NO: 372730 - RNA, 20 nt, Human
agacccucuggacugggccc

SEQ ID NO: 372731 - RNA, 22 nt, Human
gcugaagggagugcugagucug

SEQ ID NO: 372732 - RNA, 22 nt, Human
auuuucuauucugcugguuuag

SEQ ID NO: 372733 - RNA, 22 nt, Human
agcaccugcuuaaugugcagug

SEQ ID NO: 372734 - RNA, 22 nt, Human
cccaaggcauggcaugguggca

SEQ ID NO: 372735 - RNA, 22 nt, Human
cugaggcuuugugugcaugccu

SEQ ID NO: 372736 - RNA, 22 nt, Human
aucauucuagcuguuguguuga

SEQ ID NO: 372737 - RNA, 22 nt, Human
guauuagggccaaaggcaggaa

SEQ ID NO: 372738 - RNA, 22 nt, Human
cucuuaaaaacuugauauauuu

SEQ ID NO: 372739 - RNA, 23 nt, Human
acagaaaucauuuguaagguacc

SEQ ID NO: 372740 - RNA, 21 nt, Human
aucauucuggaaaauucaagc

SEQ ID NO: 372741 - RNA, 22 nt, Human
gauuucuucauuuguggugaau

SEQ ID NO: 372742 - RNA, 22 nt, Human
gucccagaggcuuuggccacag

SEQ ID NO: 372743 - RNA, 22 nt, Human
ucagggcucaccagccucugcc

SEQ ID NO: 372744 - RNA, 22 nt, Human
uuuugagauggugucucgcucc

SEQ ID NO: 372745 - RNA, 22 nt, Human
ucugcagcuuuuugguggggug

SEQ ID NO: 372746 - RNA, 20 nt, Human
agucccagaucaaauuucug

SEQ ID NO: 372747 - RNA, 22 nt, Human
gaaguccuccuaucuugcucuu

SEQ ID NO: 372748 - RNA, 22 nt, Human
gugaaggacuagcauggagggc

SEQ ID NO: 372749 - RNA, 22 nt, Human
ugcagcauugcaaagcagucuu

SEQ ID NO: 372750 - RNA, 22 nt, Human
ccaaaauuauuacauuuguagg

SEQ ID NO: 372751 - RNA, 22 nt, Human
ugcuaucucuauauccauuuau

SEQ ID NO: 372752 - RNA, 22 nt, Human
gcuggccauagaagccaaagag

SEQ ID NO: 372753 - RNA, 22 nt, Human
aguauacauauauuagccuucg

SEQ ID NO: 372754 - RNA, 22 nt, Human
aggccuuccucggagacaggga

SEQ ID NO: 372755 - RNA, 22 nt, Human
auuuagcaaaaaaugaugaagc

SEQ ID NO: 372756 - RNA, 22 nt, Human
uccaaauucuagggccuugguu

SEQ ID NO: 372757 - RNA, 22 nt, Human
cagagcagguaucuuuggugaa

SEQ ID NO: 372758 - RNA, 22 nt, Human
aaacaggcuuccauuagagcaa

SEQ ID NO: 372759 - RNA, 22 nt, Human
uaugagaaaauaaauaucuguu

SEQ ID NO: 372760 - RNA, 22 nt, Human
ucucagagugacaaugagaauu

SEQ ID NO: 372761 - RNA, 22 nt, Human
uuucuagggcucuugucuucug

SEQ ID NO: 372762 - RNA, 22 nt, Human
caggaaagagcugccaggcagg

SEQ ID NO: 372763 - RNA, 22 nt, Human
ugggccuggcccuguggaggag

SEQ ID NO: 372764 - RNA, 22 nt, Human
auuuauuaccucggaguuucug

SEQ ID NO: 372765 - RNA, 22 nt, Human
guggcccaggcuuggcgcuggc

SEQ ID NO: 372766 - RNA, 22 nt, Human
cacagaauuaagggagaaauau

SEQ ID NO: 372767 - RNA, 22 nt, Human
cccagcuccaagggacagcgaa

SEQ ID NO: 372768 - RNA, 22 nt, Human
uguggcagcuggagguggagaa

SEQ ID NO: 372769 - RNA, 23 nt, Human
ccugucugugcuggguggacaca

SEQ ID NO: 372770 - RNA, 22 nt, Human
aguagaaagaaggcacugggcc

SEQ ID NO: 372771 - RNA, 22 nt, Human
aucauaaagugcuaucugauug

SEQ ID NO: 372772 - RNA, 22 nt, Human
gcugagguggagauugcaguga

SEQ ID NO: 372773 - RNA, 22 nt, Human
guagaaauauuuaucucugaga

SEQ ID NO: 372774 - RNA, 22 nt, Human
uauuggugggggcagagagaga

SEQ ID NO: 372775 - RNA, 22 nt, Human
aauauuuguuaguguuuuaaug

SEQ ID NO: 372776 - RNA, 22 nt, Human
ccagucccaggcagaaauccag

SEQ ID NO: 372777 - RNA, 22 nt, Human
cccagcuugcaaauggguugcu

SEQ ID NO: 372778 - RNA, 22 nt, Human
caaguccucaaagggcucugcu

SEQ ID NO: 372779 - RNA, 22 nt, Human
ugaaccagagucuccagugguu

SEQ ID NO: 372780 - RNA, 22 nt, Human
aagauuuaccacuuuauucaag

SEQ ID NO: 372781 - RNA, 22 nt, Human
aggagccaagauggggcaagua

SEQ ID NO: 372782 - RNA, 21 nt, Human
ccaagacucccaucuaguggu

SEQ ID NO: 372783 - RNA, 22 nt, Human
gggcaaguccggugcccagagc

SEQ ID NO: 372784 - RNA, 21 nt, Human
ucauuuauugagaaaugacug

SEQ ID NO: 372785 - RNA, 22 nt, Human
ucaggcagaggauggggagcgu

SEQ ID NO: 372786 - RNA, 22 nt, Human
uauuccaagcacagcaacccag

SEQ ID NO: 372787 - RNA, 22 nt, Human
aucugccuccaaguccaugugu

SEQ ID NO: 372788 - RNA, 22 nt, Human
gacccuggaguuaguccugugu

SEQ ID NO: 372789 - RNA, 18 nt, Human
ugagaggcuauuuuuugc

SEQ ID NO: 372790 - RNA, 22 nt, Human
cccauugugguuguugaggaua

SEQ ID NO: 372791 - RNA, 19 nt, Human
gucagcaccauggacaggg

SEQ ID NO: 372792 - RNA, 22 nt, Human
ugaagcagcaaaugaugggaga

SEQ ID NO: 372793 - RNA, 22 nt, Human
augaggcagucuggccugaggg

SEQ ID NO: 372794 - RNA, 22 nt, Human
uccauuuuagagaugaagaaac

SEQ ID NO: 372795 - RNA, 22 nt, Human
gagagggccgggggccagcucc

SEQ ID NO: 372796 - RNA, 22 nt, Human
ggcucugggucuguggggagcg

SEQ ID NO: 372797 - RNA, 22 nt, Human
cggcagagcuuccugcucagcg

SEQ ID NO: 372798 - RNA, 22 nt, Human
ccuggguggcagagguugcagu

SEQ ID NO: 372799 - RNA, 22 nt, Human
uucuagaugauaaaccagcagc

SEQ ID NO: 372800 - RNA, 22 nt, Human
aggcaguuuaggcagcgauuua

SEQ ID NO: 372801 - RNA, 22 nt, Human
aaaguccuuuuugccaugcaag

SEQ ID NO: 372802 - RNA, 22 nt, Human
cagggcugaaaucaagguguag

SEQ ID NO: 372803 - RNA, 21 nt, Human
ugaggcucaucuuauguggcu

SEQ ID NO: 372804 - RNA, 22 nt, Human
guaggaaaguaaaugaaauaca

SEQ ID NO: 372805 - RNA, 22 nt, Human
ucucuggaauuggcugaggcaa

SEQ ID NO: 372806 - RNA, 22 nt, Human
uucuaacaaguggcuuguuagu

SEQ ID NO: 372807 - RNA, 23 nt, Human
gccaggcuccggucuguggccac

SEQ ID NO: 372808 - RNA, 22 nt, Human
cuguuaauugugaauuuuacau

SEQ ID NO: 372809 - RNA, 22 nt, Human
acagcauugagagcuaaauuua

SEQ ID NO: 372810 - RNA, 22 nt, Human
ucuuuacaaucuaagcauaguu

SEQ ID NO: 372811 - RNA, 22 nt, Human
cuuaacagagagaaguguugcu

SEQ ID NO: 372812 - RNA, 22 nt, Human
uggagaugcacgagcaggugga

SEQ ID NO: 372813 - RNA, 22 nt, Human
ccagccuccauguagauagcug

SEQ ID NO: 372814 - RNA, 22 nt, Human
ugguccuggggaucugcaguga

SEQ ID NO: 372815 - RNA, 22 nt, Human
ucagggcaucaucaugaauaua

SEQ ID NO: 372816 - RNA, 22 nt, Human
aucagaaacucuuagagcaggg

SEQ ID NO: 372817 - RNA, 22 nt, Human
auauuaggugcucaauacaugc

SEQ ID NO: 372818 - RNA, 22 nt, Human
ucugucccugagagcucaggag

SEQ ID NO: 372819 - RNA, 22 nt, Human
gagcucagcacuaaaaucaugu

SEQ ID NO: 372820 - RNA, 22 nt, Human
acagaaugggauuugaauauuu

SEQ ID NO: 372821 - RNA, 22 nt, Human
gagagcacaugaacauggagga

SEQ ID NO: 372822 - RNA, 22 nt, Human
agugcugaagacuggcuaggga

SEQ ID NO: 372823 - RNA, 22 nt, Human
agaggaggcucugggaucgucc

SEQ ID NO: 372824 - RNA, 22 nt, Human
uuugaaagccuggcuuuucucu

SEQ ID NO: 372825 - RNA, 22 nt, Human
aaagccaucaguaaaaugauuu

SEQ ID NO: 372826 - RNA, 22 nt, Human
gaauuucuggacccuuugagaa

SEQ ID NO: 372827 - RNA, 22 nt, Human
gagaaagggauaauuugaagag

SEQ ID NO: 372828 - RNA, 16 nt, Human
gcagaggaaaggggag

SEQ ID NO: 372829 - RNA, 22 nt, Human
agucccagagaggucggggcca

SEQ ID NO: 372830 - RNA, 22 nt, Human
aauucucagguaaaaguuaagu

SEQ ID NO: 372831 - RNA, 22 nt, Human
uuuccucuccggggccuccagg

SEQ ID NO: 372832 - RNA, 22 nt, Human
gcacacaggcaguuuccagcca

SEQ ID NO: 372833 - RNA, 22 nt, Human
cauuuacagcagacugaugaaa

SEQ ID NO: 372834 - RNA, 22 nt, Human
aauauuucugcagaaugguuuu

SEQ ID NO: 372835 - RNA, 22 nt, Human
ggcucugcuucagaaggcucau

SEQ ID NO: 372836 - RNA, 22 nt, Human
gggcugccaagccugccugccu

SEQ ID NO: 372837 - RNA, 22 nt, Human
cucagagagggcaccagggcca

SEQ ID NO: 372838 - RNA, 22 nt, Human
ccaguggccaugcacgagcagc

SEQ ID NO: 372839 - RNA, 22 nt, Human
ucccugcacagccgagccaugc

SEQ ID NO: 372840 - RNA, 22 nt, Human
auacaaauuuauagaugcauuu

SEQ ID NO: 372841 - RNA, 22 nt, Human
uucuucaauuauuggaaagaaa

SEQ ID NO: 372842 - RNA, 22 nt, Human
aaugcacagcuaaagugguucc

SEQ ID NO: 372843 - RNA, 17 nt, Human
gaaagguccuagaaauc

SEQ ID NO: 372844 - RNA, 22 nt, Human
auaauucagguuuucuggcaca

SEQ ID NO: 372845 - RNA, 22 nt, Human
guuuuccauggaggucugaccu

SEQ ID NO: 372846 - RNA, 22 nt, Human
ugggcacuggaagccugcugug

SEQ ID NO: 372847 - RNA, 22 nt, Human
gaggcagaaguugcagugagca

SEQ ID NO: 372848 - RNA, 22 nt, Human
cucuggccugcuuccucaggua

SEQ ID NO: 372849 - RNA, 22 nt, Human
uuugcaauuugugcugcaaaug

SEQ ID NO: 372850 - RNA, 22 nt, Human
guccacauaggaacccagcuuc

SEQ ID NO: 372851 - RNA, 22 nt, Human
gaagccaacauuccaaguagaa

SEQ ID NO: 372852 - RNA, 22 nt, Human
cccagcucuuuuagcggcaucu

SEQ ID NO: 372853 - RNA, 18 nt, Human
aggcuucccaggcaggcc

SEQ ID NO: 372854 - RNA, 22 nt, Human
uaccaaaaccaagccauuaucu

SEQ ID NO: 372855 - RNA, 22 nt, Human
auuguacaaugccuggaacauu

SEQ ID NO: 372856 - RNA, 22 nt, Human
cagcaguggcugcaggcagcug

SEQ ID NO: 372857 - RNA, 22 nt, Human
cccccaaggccaggcugagacc

SEQ ID NO: 372858 - RNA, 20 nt, Human
aaagucuguuuaucucugga

SEQ ID NO: 372859 - RNA, 20 nt, Human
aucuucuuggccagcuugcu

SEQ ID NO: 372860 - RNA, 22 nt, Human
aggaccugaaauucuugcuuuu

SEQ ID NO: 372861 - RNA, 19 nt, Human
ugccuggacaaaugugggg

SEQ ID NO: 372862 - RNA, 22 nt, Human
aggcaguggcugagaccagggg

SEQ ID NO: 372863 - RNA, 22 nt, Human
agagggcugcugcacagugcuc

SEQ ID NO: 372864 - RNA, 22 nt, Human
ugucccaguuuaucugggacug

SEQ ID NO: 372865 - RNA, 22 nt, Human
gaaauauucuugucuuguuuuc

SEQ ID NO: 372866 - RNA, 22 nt, Human
ggggccagcacugugccuuugu

SEQ ID NO: 372867 - RNA, 22 nt, Human
ugaagcagagaauuugacaguc

SEQ ID NO: 372868 - RNA, 22 nt, Human
uuucuguagggauuucacaguu

SEQ ID NO: 372869 - RNA, 22 nt, Human
uggccugggcaugaagcaucgu

SEQ ID NO: 372870 - RNA, 22 nt, Human
agccacagcaacaagugcaauu

SEQ ID NO: 372871 - RNA, 22 nt, Human
gacccaggagugcagagagugg

SEQ ID NO: 372872 - RNA, 22 nt, Human
aaacuuuaagacaguccucaag

SEQ ID NO: 372873 - RNA, 22 nt, Human
aagcauuuuguuuuaagaauga

SEQ ID NO: 372874 - RNA, 22 nt, Human
ggacagcucugccaggagcuca

SEQ ID NO: 372875 - RNA, 21 nt, Human
ucuguacaucauugagucccc

SEQ ID NO: 372876 - RNA, 22 nt, Human
agggcagugggaaagccugcuc

SEQ ID NO: 372877 - RNA, 22 nt, Human
agugcuuuaccuagauaauguu

SEQ ID NO: 372878 - RNA, 22 nt, Human
ucuuugcaaaauacaacaaugg

SEQ ID NO: 372879 - RNA, 22 nt, Human
gagauuggauuuaauggccaaa

SEQ ID NO: 372880 - RNA, 22 nt, Human
uucugaaccauugagcacugcc

SEQ ID NO: 372881 - RNA, 22 nt, Human
acccagggaccccgcugacgcc

SEQ ID NO: 372882 - RNA, 22 nt, Human
ccacagcaugcaggccugacac

SEQ ID NO: 372883 - RNA, 22 nt, Human
caugcuuaugauuugcuaagcc

SEQ ID NO: 372884 - RNA, 22 nt, Human
ucuagacacuacuaguaaccgg

SEQ ID NO: 372885 - RNA, 22 nt, Human
gugaauaauauuguuuauaaaa

SEQ ID NO: 372886 - RNA, 22 nt, Human
uacgacacaucugaucucaaaa

SEQ ID NO: 372887 - RNA, 22 nt, Human
uauuucaagaacuucuauccau

SEQ ID NO: 372888 - RNA, 22 nt, Human
uagggauguaaacauaguaauu

SEQ ID NO: 372889 - RNA, 22 nt, Human
uacauggguagguuaagucaua

SEQ ID NO: 372890 - RNA, 22 nt, Human
agccaggcagacucucuuucuu

SEQ ID NO: 372891 - RNA, 22 nt, Human
agggcaugaagcaguggacagc

SEQ ID NO: 372892 - RNA, 22 nt, Human
aaagccaugggucuuuggcaua

SEQ ID NO: 372893 - RNA, 22 nt, Human
ucucagggugaggaaagaauuu

SEQ ID NO: 372894 - RNA, 22 nt, Human
agucccagcucagaaccacuag

SEQ ID NO: 372895 - RNA, 22 nt, Human
uacaaagugagcaaccucuuuu

SEQ ID NO: 372896 - RNA, 22 nt, Human
aggaggaggcuggaguacaccc

SEQ ID NO: 372897 - RNA, 21 nt, Human
ucacaucuauguuaagcaaac

SEQ ID NO: 372898 - RNA, 22 nt, Human
uggccaggggaguuccccucca

SEQ ID NO: 372899 - RNA, 22 nt, Human
ucaaggaggugcuuggcuucac

SEQ ID NO: 372900 - RNA, 22 nt, Human
cuggcagccaagugggauacuc

SEQ ID NO: 372901 - RNA, 22 nt, Human
agcugccauggccugaauuuac

SEQ ID NO: 372902 - RNA, 22 nt, Human
cccugaggggaguggugaggug

SEQ ID NO: 372903 - RNA, 22 nt, Human
cauguuaaugaauuuuugcagu

SEQ ID NO: 372904 - RNA, 22 nt, Human
caguggaauauauaggggauuu

SEQ ID NO: 372905 - RNA, 22 nt, Human
acaaagucuuuuacaacaguca

SEQ ID NO: 372906 - RNA, 22 nt, Human
cugaauaauauuccauuaugag

SEQ ID NO: 372907 - RNA, 22 nt, Human
aggcagcaugggccccagcucc

SEQ ID NO: 372908 - RNA, 22 nt, Human
acagaguucccacuccagaagc

SEQ ID NO: 372909 - RNA, 22 nt, Human
gucagaggaggcugaguaggaa

SEQ ID NO: 372910 - RNA, 22 nt, Human
aggccagggucccacacucgca

SEQ ID NO: 372911 - RNA, 22 nt, Human
ucaaaugcaggucuggucuugg

SEQ ID NO: 372912 - RNA, 22 nt, Human
cugaggcugcccagggccaggu

SEQ ID NO: 372913 - RNA, 22 nt, Human
aguguuuauauuauggaaauau

SEQ ID NO: 372914 - RNA, 22 nt, Human
cagcgucucguugugggccucg

SEQ ID NO: 372915 - RNA, 17 nt, Human
cagugcagagcccuuuc

SEQ ID NO: 372916 - RNA, 22 nt, Human
acucugcuuauugcugcaggca

SEQ ID NO: 372917 - RNA, 22 nt, Human
gcuggagccuucugcucuguug

SEQ ID NO: 372918 - RNA, 20 nt, Human
ugcuccaucuaaagugauua

SEQ ID NO: 372919 - RNA, 22 nt, Human
auuucuacaguacacaugcauu

SEQ ID NO: 372920 - RNA, 22 nt, Human
gcagaggcauuucugacgcugc

SEQ ID NO: 372921 - RNA, 22 nt, Human
aggagguggcugaacuugaggg

SEQ ID NO: 372922 - RNA, 22 nt, Human
aguggcagagccaagauaugau

SEQ ID NO: 372923 - RNA, 22 nt, Human
ugcaucuuacguuuugaaaggg

SEQ ID NO: 372924 - RNA, 22 nt, Human
auguaacaggugaagcucugag

SEQ ID NO: 372925 - RNA, 22 nt, Human
uggccuggcucacagugagauu

SEQ ID NO: 372926 - RNA, 22 nt, Human
gcugccugauuuacauagugaa

SEQ ID NO: 372927 - RNA, 23 nt, Human
agcaauaagaagggauacaugug

SEQ ID NO: 372928 - RNA, 20 nt, Human
caguagcaauaauuagaagc

SEQ ID NO: 372929 - RNA, 22 nt, Human
accacugggcgggcagccugcu

SEQ ID NO: 372930 - RNA, 22 nt, Human
agcugcccuucucuugcccuug

SEQ ID NO: 372931 - RNA, 22 nt, Human
cagggcucgcugccagcuucag

SEQ ID NO: 372932 - RNA, 22 nt, Human
agccauuuuccugaaauauaac

SEQ ID NO: 372933 - RNA, 22 nt, Human
uucaaugauuuuuagggaucau

SEQ ID NO: 372934 - RNA, 22 nt, Human
ggaaagccaggugcucuggugu

SEQ ID NO: 372935 - RNA, 22 nt, Human
ucagaagagcuggugcugccug

SEQ ID NO: 372936 - RNA, 22 nt, Human
ugugugaauggauuauucuauu

SEQ ID NO: 372937 - RNA, 22 nt, Human
cagggccuccccggcagucuuu

SEQ ID NO: 372938 - RNA, 22 nt, Human
cuuugaagagauuacugugcuc

SEQ ID NO: 372939 - RNA, 21 nt, Human
aggcacuguuugugguuuggg

SEQ ID NO: 372940 - RNA, 22 nt, Human
cccaggaaaguggaggcggcug

SEQ ID NO: 372941 - RNA, 18 nt, Human
uccucucuuuccccaggg

SEQ ID NO: 372942 - RNA, 22 nt, Human
aaggcagcucagcucauggcag

SEQ ID NO: 372943 - RNA, 22 nt, Human
cggcagagcccugagucagccu

SEQ ID NO: 372944 - RNA, 22 nt, Human
ugcauugcaguuaacucaguau

SEQ ID NO: 372945 - RNA, 22 nt, Human
gaugcacuugccccuccucaga

SEQ ID NO: 372946 - RNA, 22 nt, Human
aaaucucaauuugaauuguagc

SEQ ID NO: 372947 - RNA, 22 nt, Human
caguucuuaauaccaugugguu

SEQ ID NO: 372948 - RNA, 22 nt, Human
cuuugcaauagaggcacacaug

SEQ ID NO: 372949 - RNA, 22 nt, Human
gaguuauuaauggcugaguuug

SEQ ID NO: 372950 - RNA, 22 nt, Human
cauggacucugguuuggggagc

SEQ ID NO: 372951 - RNA, 23 nt, Human
ucuggcuccauccuuggggaucc

SEQ ID NO: 372952 - RNA, 22 nt, Human
cagcuggacuuuugauagaagu

SEQ ID NO: 372953 - RNA, 22 nt, Human
cugauuccugauucaugcucuu

SEQ ID NO: 372954 - RNA, 22 nt, Human
cacagcagaaauaugaaggcag

SEQ ID NO: 372955 - RNA, 22 nt, Human
aaggcucccucuucucgagugu

SEQ ID NO: 372956 - RNA, 21 nt, Human
uuaagagcuuagcaguaggcc

SEQ ID NO: 372957 - RNA, 22 nt, Human
cugcccuggucccauggcugau

SEQ ID NO: 372958 - RNA, 22 nt, Human
ccuuuaauuuacaauguuaauu

SEQ ID NO: 372959 - RNA, 22 nt, Human
auguuucauuuagauaucaggc

SEQ ID NO: 372960 - RNA, 22 nt, Human
gcugcccagcaggccccagggg

SEQ ID NO: 372961 - RNA, 22 nt, Human
ucccccacucuaaaggagccuu

SEQ ID NO: 372962 - RNA, 20 nt, Human
ucccuggaggugguggcauc

SEQ ID NO: 372963 - RNA, 21 nt, Human
agaaaaaccagcauguuuuca

SEQ ID NO: 372964 - RNA, 22 nt, Human
aaggcuuuuguuccuauuuagu

SEQ ID NO: 372965 - RNA, 22 nt, Human
uggcagagacuccuccugggag

SEQ ID NO: 372966 - RNA, 20 nt, Human
uucuuaaagaccucacuuug

SEQ ID NO: 372967 - RNA, 22 nt, Human
caucagucuagauucuaguacc

SEQ ID NO: 372968 - RNA, 22 nt, Human
agagcugcaauuucauguggug

SEQ ID NO: 372969 - RNA, 22 nt, Human
cagcagcugcgugcccaggccg

SEQ ID NO: 372970 - RNA, 22 nt, Human
uggggacauagccagucuggcu

SEQ ID NO: 372971 - RNA, 22 nt, Human
gggcugcugcugccagcgacac

SEQ ID NO: 372972 - RNA, 22 nt, Human
cuuccuguugucacagucugcg

SEQ ID NO: 372973 - RNA, 22 nt, Human
aguguccaacucagcuugucaa

SEQ ID NO: 372974 - RNA, 22 nt, Human
gaggcaccucgcgggaggaggc

SEQ ID NO: 372975 - RNA, 22 nt, Human
cacaggcuugucagcaugaggc

SEQ ID NO: 372976 - RNA, 22 nt, Human
uaauuuuuccacguacacuggg

SEQ ID NO: 372977 - RNA, 22 nt, Human
gcaggcugaugacuggaguugg

SEQ ID NO: 372978 - RNA, 22 nt, Human
ucugggaauuuauuggcacuuu

SEQ ID NO: 372979 - RNA, 22 nt, Human
auuuuucucuccacuccauuaa

SEQ ID NO: 372980 - RNA, 22 nt, Human
cucccuggaggcccagaccugg

SEQ ID NO: 372981 - RNA, 22 nt, Human
uccaggagggggagccgugccg

SEQ ID NO: 372982 - RNA, 22 nt, Human
ucccuggccauuccucuaggcc

SEQ ID NO: 372983 - RNA, 22 nt, Human
uguggcugacuccuggucccca

SEQ ID NO: 372984 - RNA, 18 nt, Human
gcaggagauggguggggu

SEQ ID NO: 372985 - RNA, 22 nt, Human
aaagaguucuaugaucuuucca

SEQ ID NO: 372986 - RNA, 17 nt, Human
gagccacccugugcgag

SEQ ID NO: 372987 - RNA, 22 nt, Human
aaagguaguacuucuagaaggg

SEQ ID NO: 372988 - RNA, 22 nt, Human
aaugcacacauuugguacugaa

SEQ ID NO: 372989 - RNA, 17 nt, Human
gagaguguauuggaugc

SEQ ID NO: 372990 - RNA, 22 nt, Human
augggcaguuaggaggccagga

SEQ ID NO: 372991 - RNA, 21 nt, Human
aauuagggugccucuuauaau

SEQ ID NO: 372992 - RNA, 22 nt, Human
gcagcauuucucaaaggguggu

SEQ ID NO: 372993 - RNA, 22 nt, Human
uauuuugucuucugcucaucac

SEQ ID NO: 372994 - RNA, 22 nt, Human
agcaccuguggcucaugcucgu

SEQ ID NO: 372995 - RNA, 22 nt, Human
uuagauaaauugcaacuugauu

SEQ ID NO: 372996 - RNA, 22 nt, Human
ugggcucucuggcaggaaggcu

SEQ ID NO: 372997 - RNA, 22 nt, Human
uggcagcuagcuguuuucaugc

SEQ ID NO: 372998 - RNA, 22 nt, Human
cuggcucuaucuccaaggcugg

SEQ ID NO: 372999 - RNA, 22 nt, Human
auauuguugacuauaagaguaa

SEQ ID NO: 373000 - RNA, 22 nt, Human
agaagcuuccuacauuguucuu

SEQ ID NO: 373001 - RNA, 22 nt, Human
acuguccaagcaugccuggcuu

SEQ ID NO: 373002 - RNA, 22 nt, Human
gaggccugcuuuggcacucugg

SEQ ID NO: 373003 - RNA, 22 nt, Human
ugcagggcaguuuguuucggca

SEQ ID NO: 373004 - RNA, 22 nt, Human
uucaaacaguguagaauauaug

SEQ ID NO: 373005 - RNA, 19 nt, Human
ccuggaggugaagguucuc

SEQ ID NO: 373006 - RNA, 22 nt, Human
ccuggaggagcgcugaccagcu

SEQ ID NO: 373007 - RNA, 22 nt, Human
agagcuggcugguagcccugau

SEQ ID NO: 373008 - RNA, 22 nt, Human
gagcuggcaggaggcuccccga

SEQ ID NO: 373009 - RNA, 22 nt, Human
gagaaaugcaugcaugucauca

SEQ ID NO: 373010 - RNA, 23 nt, Human
ucagucuucccugucaguaauag

SEQ ID NO: 373011 - RNA, 22 nt, Human
uccagagccuauauguucaacu

SEQ ID NO: 373012 - RNA, 19 nt, Human
agccacagaacuugcagga

SEQ ID NO: 373013 - RNA, 22 nt, Human
agggccacaguggggccugaga

SEQ ID NO: 373014 - RNA, 22 nt, Human
aaggaagaagacucuuuacucc

SEQ ID NO: 373015 - RNA, 22 nt, Human
gcucuccacugaccacggggca

SEQ ID NO: 373016 - RNA, 22 nt, Human
agaaugcaguuugaaauaaggu

SEQ ID NO: 373017 - RNA, 22 nt, Human
aggauccuuuuucugcuguuug

SEQ ID NO: 373018 - RNA, 22 nt, Human
ugcagaggagucagccugggca

SEQ ID NO: 373019 - RNA, 22 nt, Human
ugcagagagauauggcaagagg

SEQ ID NO: 373020 - RNA, 20 nt, Human
ggcaggcuuuauauggaggg

SEQ ID NO: 373021 - RNA, 22 nt, Human
cugggcucagaugagaggaagg

SEQ ID NO: 373022 - RNA, 22 nt, Human
uguguccauucaggcacugacc

SEQ ID NO: 373023 - RNA, 22 nt, Human
acuguacuguguauuguagaau

SEQ ID NO: 373024 - RNA, 20 nt, Human
ccagguggugccuggagagg

SEQ ID NO: 373025 - RNA, 22 nt, Human
ugcagggcagauaugacuguag

SEQ ID NO: 373026 - RNA, 22 nt, Human
gaugaucaucuguaaaguuaga

SEQ ID NO: 373027 - RNA, 22 nt, Human
cugagaggaugcugcaguggag

SEQ ID NO: 373028 - RNA, 22 nt, Human
aggagucaggaccaaauggaaa

SEQ ID NO: 373029 - RNA, 22 nt, Human
ucagaaaauaacuguuaguuug

SEQ ID NO: 373030 - RNA, 20 nt, Human
aaaagcagccagagauggua

SEQ ID NO: 373031 - RNA, 22 nt, Human
ugcucagacaagcugaacagua

SEQ ID NO: 373032 - RNA, 22 nt, Human
gcugucaggccaugugggccuu

SEQ ID NO: 373033 - RNA, 22 nt, Human
aaguuugagaagcuuauagaua

SEQ ID NO: 373034 - RNA, 22 nt, Human
cagucaccaccagguggcagua

SEQ ID NO: 373035 - RNA, 22 nt, Human
ccugacucuggccaggccagcu

SEQ ID NO: 373036 - RNA, 22 nt, Human
uagcacauacauaauagauaga

SEQ ID NO: 373037 - RNA, 22 nt, Human
gaaaugugggucaugacccauu

SEQ ID NO: 373038 - RNA, 17 nt, Human
ggugaguguccaggugg

SEQ ID NO: 373039 - RNA, 22 nt, Human
uaaauuuacccaaggaacaugu

SEQ ID NO: 373040 - RNA, 22 nt, Human
gggcccagcgugguuccaucug

SEQ ID NO: 373041 - RNA, 22 nt, Human
ggaggccuugaggccaggagcu

SEQ ID NO: 373042 - RNA, 22 nt, Human
ggcagcaucucuggcagcagcu

SEQ ID NO: 373043 - RNA, 22 nt, Human
uaaggccagcaugaaugcagca

SEQ ID NO: 373044 - RNA, 22 nt, Human
agugcuuugagcguuugaaaag

SEQ ID NO: 373045 - RNA, 22 nt, Human
ucugggcucuuaguguacccuc

SEQ ID NO: 373046 - RNA, 22 nt, Human
agugauggagcuuccucugcua

SEQ ID NO: 373047 - RNA, 22 nt, Human
agcugcuaugacaacaccagcc

SEQ ID NO: 373048 - RNA, 22 nt, Human
uggcagcuguguccagguagaa

SEQ ID NO: 373049 - RNA, 22 nt, Human
ucacuucacacccacuaucaug

SEQ ID NO: 373050 - RNA, 22 nt, Human
ugcuggcucaguuugcagacuc

SEQ ID NO: 373051 - RNA, 22 nt, Human
ugcugucugcaacaguacuaca

SEQ ID NO: 373052 - RNA, 22 nt, Human
acccaggacaugggcacccgug

SEQ ID NO: 373053 - RNA, 22 nt, Human
acuuuguauaagacaauaaaga

SEQ ID NO: 373054 - RNA, 22 nt, Human
ccugucuguauugguuugcuau

SEQ ID NO: 373055 - RNA, 22 nt, Human
auaucaaagcuaguggaaauuu

SEQ ID NO: 373056 - RNA, 22 nt, Human
uggcagcacuugaacuugagcc

SEQ ID NO: 373057 - RNA, 22 nt, Human
ggcaaaaaguucccaucagugu

SEQ ID NO: 373058 - RNA, 22 nt, Human
uaugaaaauuuagcugaagcau

SEQ ID NO: 373059 - RNA, 22 nt, Human
ugaacaacugcaaaaaucucca

SEQ ID NO: 373060 - RNA, 20 nt, Human
cccaggugucugaagcucug

SEQ ID NO: 373061 - RNA, 22 nt, Human
gcugucugucucugugacuuaa

SEQ ID NO: 373062 - RNA, 22 nt, Human
aucuggcuauuucuggucgggg

SEQ ID NO: 373063 - RNA, 22 nt, Human
agcagcauaucagagaaaguca

SEQ ID NO: 373064 - RNA, 19 nt, Human
uacuaaacaugcauauugg

SEQ ID NO: 373065 - RNA, 22 nt, Human
ggccugagcucuggggaggcaa

SEQ ID NO: 373066 - RNA, 22 nt, Human
cugugugugucugcagcauacu

SEQ ID NO: 373067 - RNA, 22 nt, Human
ggcugagacuagagugaggcau

SEQ ID NO: 373068 - RNA, 22 nt, Human
ggagccaguuuagaccucaguu

SEQ ID NO: 373069 - RNA, 22 nt, Human
accgggaaguccugcacugggc

SEQ ID NO: 373070 - RNA, 22 nt, Human
uuucaacuagccccuaaguccu

SEQ ID NO: 373071 - RNA, 22 nt, Human
gcuggggucugugaggagggcu

SEQ ID NO: 373072 - RNA, 22 nt, Human
ccugagaggcccucucacuguc

SEQ ID NO: 373073 - RNA, 22 nt, Human
ggcuuggaaauugcaggacaca

SEQ ID NO: 373074 - RNA, 22 nt, Human
cugaggcucaagggcagguggg

SEQ ID NO: 373075 - RNA, 22 nt, Human
cuuaggcaagcagagcccaucc

SEQ ID NO: 373076 - RNA, 22 nt, Human
cagacacagcaauucuguguug

SEQ ID NO: 373077 - RNA, 22 nt, Human
acagcauucaauaaauaauaac

SEQ ID NO: 373078 - RNA, 22 nt, Human
agggcacaucugcugggaaugg

SEQ ID NO: 373079 - RNA, 22 nt, Human
gcuucauuacugacagucugug

SEQ ID NO: 373080 - RNA, 22 nt, Human
ggagccaguauuuaguggucuu

SEQ ID NO: 373081 - RNA, 22 nt, Human
cggcuggguucggcugcaggcc

SEQ ID NO: 373082 - RNA, 22 nt, Human
cagagggagcccuccaggagca

SEQ ID NO: 373083 - RNA, 22 nt, Human
gcugccuggaauaacggcuggc

SEQ ID NO: 373084 - RNA, 22 nt, Human
acagccugcagccccaggucgc

SEQ ID NO: 373085 - RNA, 22 nt, Human
aggugcuggaguagaagaaaaa

SEQ ID NO: 373086 - RNA, 19 nt, Human
gcuggggccugaccagaca

SEQ ID NO: 373087 - RNA, 22 nt, Human
cuagaaaucucuguuuacauca

SEQ ID NO: 373088 - RNA, 22 nt, Human
gagcugcugguugcuggugccu

SEQ ID NO: 373089 - RNA, 22 nt, Human
caugucuuauauccugucuuca

SEQ ID NO: 373090 - RNA, 22 nt, Human
gagggugguggcuuaaggugcu

SEQ ID NO: 373091 - RNA, 22 nt, Human
cacacacaguuuuguauucugu

SEQ ID NO: 373092 - RNA, 22 nt, Human
ugugcccauuacacagaggcau

SEQ ID NO: 373093 - RNA, 20 nt, Human
acuuucucgguuucucaccu

SEQ ID NO: 373094 - RNA, 22 nt, Human
cugggggcaauggucagagugu

SEQ ID NO: 373095 - RNA, 22 nt, Human
gaagagcugcucagaacaugau

SEQ ID NO: 373096 - RNA, 22 nt, Human
aaguucaagucugcaucuuuuu

SEQ ID NO: 373097 - RNA, 22 nt, Human
cugcgcagcaaucagagaggag

SEQ ID NO: 373098 - RNA, 22 nt, Human
ugggcagaauugugguaguuaa

SEQ ID NO: 373099 - RNA, 22 nt, Human
uuacaagauuaauuauuggagu

SEQ ID NO: 373100 - RNA, 22 nt, Human
aguuauauaacuaucuagaugc

SEQ ID NO: 373101 - RNA, 22 nt, Human
ggccugucucacccccgggugc

SEQ ID NO: 373102 - RNA, 18 nt, Human
uccuccuuuggccuuuuc

SEQ ID NO: 373103 - RNA, 22 nt, Human
ggcaguggguuccccaaggcac

SEQ ID NO: 373104 - RNA, 22 nt, Human
aguacuuugcacuuugcucaga

SEQ ID NO: 373105 - RNA, 22 nt, Human
auauacugaggagacuuuauau

SEQ ID NO: 373106 - RNA, 18 nt, Human
agaguguucucagugaaa

SEQ ID NO: 373107 - RNA, 22 nt, Human
auguuucaaauauauagaguug

SEQ ID NO: 373108 - RNA, 22 nt, Human
auuucaacguuagauguaauag

SEQ ID NO: 373109 - RNA, 22 nt, Human
agcagggccugagugaccuaac

SEQ ID NO: 373110 - RNA, 22 nt, Human
agguaggggguuugggaacugc

SEQ ID NO: 373111 - RNA, 22 nt, Human
cucuuucugauucgcugggacc

SEQ ID NO: 373112 - RNA, 22 nt, Human
uaguacaguuuaaauauuaaua

SEQ ID NO: 373113 - RNA, 22 nt, Human
caggugggagcggagacugauu

SEQ ID NO: 373114 - RNA, 22 nt, Human
gucccuggaauggacucugcgc

SEQ ID NO: 373115 - RNA, 22 nt, Human
aaaugcuuauuagugucacaaa

SEQ ID NO: 373116 - RNA, 22 nt, Human
uuggaucagaugauaucuuugu

SEQ ID NO: 373117 - RNA, 18 nt, Human
aggcccuggccucgaaca

SEQ ID NO: 373118 - RNA, 22 nt, Human
ccagcccugaacccugcugcau

SEQ ID NO: 373119 - RNA, 22 nt, Human
uucuuauagaagcaaccauugu

SEQ ID NO: 373120 - RNA, 22 nt, Human
augaacaaguauuugcaugagc

SEQ ID NO: 373121 - RNA, 23 nt, Human
uccugcagauaagcugguugaca

SEQ ID NO: 373122 - RNA, 22 nt, Human
ucaggagacuggcagugcccac

SEQ ID NO: 373123 - RNA, 22 nt, Human
agagccugaggaugucccagcu

SEQ ID NO: 373124 - RNA, 22 nt, Human
ccaguggguaggccauggugag

SEQ ID NO: 373125 - RNA, 22 nt, Human
caaagucauggggaugcagguc

SEQ ID NO: 373126 - RNA, 22 nt, Human
cauugcaacuucaaacuccugg

SEQ ID NO: 373127 - RNA, 22 nt, Human
ucucucuuuuuaaucauguaau

SEQ ID NO: 373128 - RNA, 22 nt, Human
gcugucuuccuugcuccaaggg

SEQ ID NO: 373129 - RNA, 22 nt, Human
agaucucaccucuguguauuau

SEQ ID NO: 373130 - RNA, 22 nt, Human
uguaagauauucagcuuauuga

SEQ ID NO: 373131 - RNA, 21 nt, Human
ccuggccaaucugauaggguu

SEQ ID NO: 373132 - RNA, 22 nt, Human
aggauccugcgcuuugggggag

SEQ ID NO: 373133 - RNA, 22 nt, Human
ucaggagaaggcaauguggaaa

SEQ ID NO: 373134 - RNA, 22 nt, Human
gcaggcagaucaccugucagga

SEQ ID NO: 373135 - RNA, 22 nt, Human
cacucugcgcugggcgccagcg

SEQ ID NO: 373136 - RNA, 20 nt, Human
aguaggggaaugcaagagca

SEQ ID NO: 373137 - RNA, 22 nt, Human
uggagugaaguaaagaggacaa

SEQ ID NO: 373138 - RNA, 22 nt, Human
cugugcugauucagcacaggcc

SEQ ID NO: 373139 - RNA, 20 nt, Human
ggcucuggaaucuggugggc

SEQ ID NO: 373140 - RNA, 22 nt, Human
cagcagugcuucagugugagau

SEQ ID NO: 373141 - RNA, 21 nt, Human
ggcagccucuguggaagggga

SEQ ID NO: 373142 - RNA, 22 nt, Human
agucagcagugaaagcacagcc

SEQ ID NO: 373143 - RNA, 22 nt, Human
acaggugauucaggcucuggga

SEQ ID NO: 373144 - RNA, 22 nt, Human
cguuggagacacuugaggacuu

SEQ ID NO: 373145 - RNA, 22 nt, Human
acuguguggaaauuugugaggg

SEQ ID NO: 373146 - RNA, 22 nt, Human
ucucugggaaugggccugggua

SEQ ID NO: 373147 - RNA, 22 nt, Human
aguuuauguagaauuggcaaua

SEQ ID NO: 373148 - RNA, 22 nt, Human
uggaguucauccaugacagcuu

SEQ ID NO: 373149 - RNA, 22 nt, Human
ucucuccuuaucauuguguuua

SEQ ID NO: 373150 - RNA, 22 nt, Human
gagucccaugaugauagccaca

SEQ ID NO: 373151 - RNA, 22 nt, Human
uuauuagguuuacauaaagguu

SEQ ID NO: 373152 - RNA, 22 nt, Human
uaucaucuuguugucaugcagc

SEQ ID NO: 373153 - RNA, 22 nt, Human
agagaaaacucauugagguguc

SEQ ID NO: 373154 - RNA, 22 nt, Human
gcaggcaggagcccaacugccu

SEQ ID NO: 373155 - RNA, 22 nt, Human
cacugaaggaaggacuacugca

SEQ ID NO: 373156 - RNA, 22 nt, Human
gaggagagagggacugucugca

SEQ ID NO: 373157 - RNA, 22 nt, Human
aggccaggaccauuagcccaga

SEQ ID NO: 373158 - RNA, 22 nt, Human
ucccaggaagaucccagggacc

SEQ ID NO: 373159 - RNA, 22 nt, Human
acccagcaugacaccugcacau

SEQ ID NO: 373160 - RNA, 22 nt, Human
acuguggaugccaaaggggagg

SEQ ID NO: 373161 - RNA, 22 nt, Human
cccaggaauuggaggcugcagu

SEQ ID NO: 373162 - RNA, 22 nt, Human
ugacacaggcagcucccagcac

SEQ ID NO: 373163 - RNA, 22 nt, Human
cccuugcacauuugucuuuaau

SEQ ID NO: 373164 - RNA, 22 nt, Human
agccaggaauuggacaacacau

SEQ ID NO: 373165 - RNA, 22 nt, Human
aaagucugagcagaauuucuca

SEQ ID NO: 373166 - RNA, 22 nt, Human
cuggcccagagagcagagcuua

SEQ ID NO: 373167 - RNA, 22 nt, Human
ugggcuggcccaccacaccucg

SEQ ID NO: 373168 - RNA, 22 nt, Human
ucucagaguuuuuuuccaggac

SEQ ID NO: 373169 - RNA, 19 nt, Human
agcagagcccugaagaucc

SEQ ID NO: 373170 - RNA, 22 nt, Human
cucccaggguagggagagacua

SEQ ID NO: 373171 - RNA, 22 nt, Human
ucuggagaacuugcaagaggau

SEQ ID NO: 373172 - RNA, 22 nt, Human
cagccagugguugaagaugcag

SEQ ID NO: 373173 - RNA, 22 nt, Human
ucccagaaaaaggaggcuauga

SEQ ID NO: 373174 - RNA, 22 nt, Human
ugcaauaaagugcuauaaaucc

SEQ ID NO: 373175 - RNA, 22 nt, Human
agcgggugcugugucagcccuc

SEQ ID NO: 373176 - RNA, 22 nt, Human
caccagggcucugagcucugaa

SEQ ID NO: 373177 - RNA, 22 nt, Human
gggcucagacaucccuccugga

SEQ ID NO: 373178 - RNA, 22 nt, Human
aaacugcuuuccacaguggcua

SEQ ID NO: 373179 - RNA, 19 nt, Human
caagugaagccugggaugg

SEQ ID NO: 373180 - RNA, 22 nt, Human
agcagggcucacauuaguggau

SEQ ID NO: 373181 - RNA, 22 nt, Human
agucccagcuacucaagaggcu

SEQ ID NO: 373182 - RNA, 22 nt, Human
acccaggggcagccuugcugug

SEQ ID NO: 373183 - RNA, 22 nt, Human
uggagggaacccaggcugcucu

SEQ ID NO: 373184 - RNA, 22 nt, Human
cagaggcaggauaagaacugcg

SEQ ID NO: 373185 - RNA, 22 nt, Human
ugccaggcagugucagauugag

SEQ ID NO: 373186 - RNA, 22 nt, Human
aaacuuuggauugugauugugc

SEQ ID NO: 373187 - RNA, 22 nt, Human
cugccuuugcccuugacacugu

SEQ ID NO: 373188 - RNA, 22 nt, Human
cucacugugccuuuucccaaac

SEQ ID NO: 373189 - RNA, 22 nt, Human
agcagaugagccucaugacugg

SEQ ID NO: 373190 - RNA, 22 nt, Human
ugccucagaguugucccuacca

SEQ ID NO: 373191 - RNA, 22 nt, Human
ccagguggacggcgaguacagg

SEQ ID NO: 373192 - RNA, 22 nt, Human
ugcacccucaucagucaaaugg

SEQ ID NO: 373193 - RNA, 22 nt, Human
uacuuucuagcucuccccaguu

SEQ ID NO: 373194 - RNA, 22 nt, Human
agacucaagacugcagaagacg

SEQ ID NO: 373195 - RNA, 22 nt, Human
gcucuggacccuggaguggcug

SEQ ID NO: 373196 - RNA, 22 nt, Human
ucacacacauaaucuaagauua

SEQ ID NO: 373197 - RNA, 22 nt, Human
gagaagcaaucgugacaucucc

SEQ ID NO: 373198 - RNA, 22 nt, Human
acagagauggcacagagaaggu

SEQ ID NO: 373199 - RNA, 22 nt, Human
cacagggccacuuucccaguaa

SEQ ID NO: 373200 - RNA, 22 nt, Human
ccuggccuccuggccuucucau

SEQ ID NO: 373201 - RNA, 22 nt, Human
ugaaaauggccugaagaagcaa

SEQ ID NO: 373202 - RNA, 22 nt, Human
agaaacauuuagauuauauguc

SEQ ID NO: 373203 - RNA, 22 nt, Human
gguggcagaauaauugaagguc

SEQ ID NO: 373204 - RNA, 22 nt, Human
cugagcugggaguagagacucu

SEQ ID NO: 373205 - RNA, 22 nt, Human
uugauccaguugaaagugauga

SEQ ID NO: 373206 - RNA, 22 nt, Human
gcaggagagucugugccagguu

SEQ ID NO: 373207 - RNA, 22 nt, Human
gagggaccuuuacacagacauu

SEQ ID NO: 373208 - RNA, 22 nt, Human
aaggcugagggcuguaccuggc

SEQ ID NO: 373209 - RNA, 22 nt, Human
guaaaugugcuucuuuuaacuu

SEQ ID NO: 373210 - RNA, 22 nt, Human
caagucauuacugaaaugucac

SEQ ID NO: 373211 - RNA, 22 nt, Human
guggccuggauagacuccaucu

SEQ ID NO: 373212 - RNA, 22 nt, Human
uuugaaagacagaauauuuuug

SEQ ID NO: 373213 - RNA, 22 nt, Human
uaaaggcucacuggcuuggggu

SEQ ID NO: 373214 - RNA, 22 nt, Human
auguacauuuagaucauuucug

SEQ ID NO: 373215 - RNA, 22 nt, Human
caggagacaauggcuguggggc

SEQ ID NO: 373216 - RNA, 22 nt, Human
caggggcucccugggugccagu

SEQ ID NO: 373217 - RNA, 22 nt, Human
gaggaguguauuccacaccacu

SEQ ID NO: 373218 - RNA, 22 nt, Human
gacccagcuuaagucacauguu

SEQ ID NO: 373219 - RNA, 22 nt, Human
aguguuuaaacugaagugauga

SEQ ID NO: 373220 - RNA, 22 nt, Human
ugggugagugggaaaagcccag

SEQ ID NO: 373221 - RNA, 22 nt, Human
guuuauuaacugucaagugauu

SEQ ID NO: 373222 - RNA, 22 nt, Human
ugggagcccaagggagcugccg

SEQ ID NO: 373223 - RNA, 22 nt, Human
uguacaaucugaugauguaugg

SEQ ID NO: 373224 - RNA, 22 nt, Human
cagucccaggguugguucagcu

SEQ ID NO: 373225 - RNA, 23 nt, Human
cagggccaggcagcagcugucac

SEQ ID NO: 373226 - RNA, 22 nt, Human
aguguuucccaguaggaugaaa

SEQ ID NO: 373227 - RNA, 21 nt, Human
ggccucugucauccugggaag

SEQ ID NO: 373228 - RNA, 22 nt, Human
aggagagaauguuccaggcuug

SEQ ID NO: 373229 - RNA, 22 nt, Human
uuagggcuuuucugaauaggcc

SEQ ID NO: 373230 - RNA, 22 nt, Human
acagcuuuaucucagggaucag

SEQ ID NO: 373231 - RNA, 22 nt, Human
acuagaaauuacucagaauaaa

SEQ ID NO: 373232 - RNA, 18 nt, Human
gggcaucauucacaaagu

SEQ ID NO: 373233 - RNA, 18 nt, Human
uguuccaaggaaggaauc

SEQ ID NO: 373234 - RNA, 21 nt, Human
uuacaaagcaagugcuguguc

SEQ ID NO: 373235 - RNA, 22 nt, Human
augauugaaaaugacauugcca

SEQ ID NO: 373236 - RNA, 22 nt, Human
auauacaaagggcaaccucgcu

SEQ ID NO: 373237 - RNA, 22 nt, Human
aagagcauauuaauaguggaga

SEQ ID NO: 373238 - RNA, 22 nt, Human
ccagcagccaccuucucgaaau

SEQ ID NO: 373239 - RNA, 22 nt, Human
auaaagucuaccguauuaaaga

SEQ ID NO: 373240 - RNA, 22 nt, Human
uucuucuucaagugcugcauuc

SEQ ID NO: 373241 - RNA, 22 nt, Human
cagagcuguuacuauucaugaa

SEQ ID NO: 373242 - RNA, 22 nt, Human
cuucaguucuaaaguagaaugu

SEQ ID NO: 373243 - RNA, 22 nt, Human
cagaggcacaagaaagcaaggc

SEQ ID NO: 373244 - RNA, 22 nt, Human
gcagcagcccagggcucucaga

SEQ ID NO: 373245 - RNA, 22 nt, Human
aagagcugcacauauuuauauc

SEQ ID NO: 373246 - RNA, 22 nt, Human
uggccugguccuugucaaggca

SEQ ID NO: 373247 - RNA, 22 nt, Human
uuuauuaugauggacaccuucg

SEQ ID NO: 373248 - RNA, 22 nt, Human
caggcagcagaggaguguggga

SEQ ID NO: 373249 - RNA, 22 nt, Human
ggagugaaucacuagaugcaga

SEQ ID NO: 373250 - RNA, 22 nt, Human
gaggcaacacauuuggaaagca

SEQ ID NO: 373251 - RNA, 22 nt, Human
ggccaggagcaagccaggcucu

SEQ ID NO: 373252 - RNA, 22 nt, Human
ugucagagcaaugagguucagc

SEQ ID NO: 373253 - RNA, 22 nt, Human
gucagugucuuaacagagauua

SEQ ID NO: 373254 - RNA, 22 nt, Human
ccauuguaaauucuguggaagu

SEQ ID NO: 373255 - RNA, 22 nt, Human
ugaggcaggaugcuugcacagg

SEQ ID NO: 373256 - RNA, 22 nt, Human
aucagcaagcaugguuaggugu

SEQ ID NO: 373257 - RNA, 22 nt, Human
cagguccccuccccuaccaggc

SEQ ID NO: 373258 - RNA, 22 nt, Human
uggcucugaucagauguccagu

SEQ ID NO: 373259 - RNA, 22 nt, Human
ugggaggaaugucacugagcca

SEQ ID NO: 373260 - RNA, 22 nt, Human
uuccuuagcagaccugguaucc

SEQ ID NO: 373261 - RNA, 22 nt, Human
ggcauuuaucuaauauaguuua

SEQ ID NO: 373262 - RNA, 22 nt, Human
gggagggaucugcuaggcaaug

SEQ ID NO: 373263 - RNA, 22 nt, Human
acauuucugucuuagggacugu

SEQ ID NO: 373264 - RNA, 23 nt, Human
aggcugagcucucccagcuucag

SEQ ID NO: 373265 - RNA, 22 nt, Human
uaucuguuguaguacagaugau

SEQ ID NO: 373266 - RNA, 22 nt, Human
accagagcgcucaagccuuccc

SEQ ID NO: 373267 - RNA, 22 nt, Human
gugaccaucagagaauaacaaa

SEQ ID NO: 373268 - RNA, 22 nt, Human
cagagccugccucuggcugugg

SEQ ID NO: 373269 - RNA, 22 nt, Human
acuuaaaaccagacagcgucau

SEQ ID NO: 373270 - RNA, 22 nt, Human
gggaggucagggugccugcugg

SEQ ID NO: 373271 - RNA, 22 nt, Human
gcucaagggaugggagugggug

SEQ ID NO: 373272 - RNA, 22 nt, Human
uccucacauggugagccacaca

SEQ ID NO: 373273 - RNA, 22 nt, Human
ucauagaaugaguuaaugaacu

SEQ ID NO: 373274 - RNA, 22 nt, Human
acaacuuuagucuggagggaaa

SEQ ID NO: 373275 - RNA, 22 nt, Human
cuuuaagacucugcucuuggug

SEQ ID NO: 373276 - RNA, 22 nt, Human
cauuagaagaacaguuauauua

SEQ ID NO: 373277 - RNA, 22 nt, Human
cagcugcccugccuugcccuua

SEQ ID NO: 373278 - RNA, 22 nt, Human
ccugcagcuccggauuucuggg

SEQ ID NO: 373279 - RNA, 22 nt, Human
cuuaaacugaaagcuacaagau

SEQ ID NO: 373280 - RNA, 22 nt, Human
guacuuccagccaagugagaca

SEQ ID NO: 373281 - RNA, 22 nt, Human
gccugcagaacugugaggcaau

SEQ ID NO: 373282 - RNA, 22 nt, Human
ccagucacuggaaaaugggaau

SEQ ID NO: 373283 - RNA, 21 nt, Human
aggugggagaccauguagguc

SEQ ID NO: 373284 - RNA, 22 nt, Human
acauauuuccaugcagcauguc

SEQ ID NO: 373285 - RNA, 22 nt, Human
gagauuuagcugcuuaacuccu

SEQ ID NO: 373286 - RNA, 22 nt, Human
cuucccagaccuuagagugcag

SEQ ID NO: 373287 - RNA, 22 nt, Human
ugaggaugacgauggcaauggc

SEQ ID NO: 373288 - RNA, 22 nt, Human
aggagcagaacugauucugacu

SEQ ID NO: 373289 - RNA, 22 nt, Human
cugcaucaguggauaugauggu

SEQ ID NO: 373290 - RNA, 22 nt, Human
aggcacaguuucauccccgggc

SEQ ID NO: 373291 - RNA, 22 nt, Human
ucacaucauuaagacuucuccu

SEQ ID NO: 373292 - RNA, 19 nt, Human
uccccagcaccucugaguc

SEQ ID NO: 373293 - RNA, 22 nt, Human
aaacugaauucccaagggcaug

SEQ ID NO: 373294 - RNA, 22 nt, Human
agccucugguccucccucagcu

SEQ ID NO: 373295 - RNA, 22 nt, Human
uuuauccaguguuggaauuuuu

SEQ ID NO: 373296 - RNA, 22 nt, Human
guggcagugugaggauccugcu

SEQ ID NO: 373297 - RNA, 22 nt, Human
ggaaggaggggcaaagcaguuc

SEQ ID NO: 373298 - RNA, 22 nt, Human
uaaaggcuuuuagugaugguaa

SEQ ID NO: 373299 - RNA, 22 nt, Human
caaugaaauugagauccagaga

SEQ ID NO: 373300 - RNA, 22 nt, Human
agggagaagguuuagcugugag

SEQ ID NO: 373301 - RNA, 22 nt, Human
uucaaagugcauguuccucaga

SEQ ID NO: 373302 - RNA, 22 nt, Human
gauuuagagaauguuuuguaag

SEQ ID NO: 373303 - RNA, 22 nt, Human
ugaaagguuauuuaggucugcu

SEQ ID NO: 373304 - RNA, 22 nt, Human
agcagggguaacagaaggaaag

SEQ ID NO: 373305 - RNA, 22 nt, Human
uucuucaguuugguaaauguaa

SEQ ID NO: 373306 - RNA, 22 nt, Human
ccuggccugcucggcucuuaag

SEQ ID NO: 373307 - RNA, 22 nt, Human
gggcagguuauuggaguaggga

SEQ ID NO: 373308 - RNA, 22 nt, Human
cuggaggcacccuuagagaggc

SEQ ID NO: 373309 - RNA, 20 nt, Human
aggcagcugggaaaugaggg

SEQ ID NO: 373310 - RNA, 22 nt, Human
aagacuuucucccaaauccuca

SEQ ID NO: 373311 - RNA, 22 nt, Human
guggggcaguggccugggagca

SEQ ID NO: 373312 - RNA, 22 nt, Human
uguggaaaagaauaagggagau

SEQ ID NO: 373313 - RNA, 22 nt, Human
acagagcauauaaagugcuuug

SEQ ID NO: 373314 - RNA, 22 nt, Human
caggccugaguguggaagucuu

SEQ ID NO: 373315 - RNA, 23 nt, Human
aguuccagaaaaaugcucaagca

SEQ ID NO: 373316 - RNA, 22 nt, Human
caauuucacugacacccuggaa

SEQ ID NO: 373317 - RNA, 22 nt, Human
ucagaagacuacuaggacacau

SEQ ID NO: 373318 - RNA, 22 nt, Human
gcucccagguucuugggccuug

SEQ ID NO: 373319 - RNA, 22 nt, Human
cagcaauaagguaagcuucucc

SEQ ID NO: 373320 - RNA, 22 nt, Human
ugucccaguuuugcagguuaga

SEQ ID NO: 373321 - RNA, 18 nt, Human
gugccaggaggcgcagcc

SEQ ID NO: 373322 - RNA, 22 nt, Human
gcucccuccaugaggcagaccg

SEQ ID NO: 373323 - RNA, 22 nt, Human
gagaggcauggaacagauucuu

SEQ ID NO: 373324 - RNA, 22 nt, Human
aaggcacuagcagaauuaguga

SEQ ID NO: 373325 - RNA, 22 nt, Human
gggcagcagaggaucccuuaau

SEQ ID NO: 373326 - RNA, 21 nt, Human
agcagaggcagaauguaugca

SEQ ID NO: 373327 - RNA, 22 nt, Human
ugcaggaacauagguuccuugg

SEQ ID NO: 373328 - RNA, 22 nt, Human
acaguuucuccauuuacaccuu

SEQ ID NO: 373329 - RNA, 22 nt, Human
caggagaggaggcuacuucuua

SEQ ID NO: 373330 - RNA, 22 nt, Human
agauacaugucaagagacuuau

SEQ ID NO: 373331 - RNA, 22 nt, Human
ccucuucugcuucaggagcacu

SEQ ID NO: 373332 - RNA, 17 nt, Human
cccaugagcccacuccc

SEQ ID NO: 373333 - RNA, 22 nt, Human
ugaaagggguugaguuacagcu

SEQ ID NO: 373334 - RNA, 22 nt, Human
ugcaauaaggaguaauaguaaa

SEQ ID NO: 373335 - RNA, 22 nt, Human
cuggccagaguuggagggugug

SEQ ID NO: 373336 - RNA, 19 nt, Human
cauaauacaguggaucuga

SEQ ID NO: 373337 - RNA, 22 nt, Human
ucagcuuucucagaggccuaac

SEQ ID NO: 373338 - RNA, 23 nt, Human
ucugagagaacaaugccuccuau

SEQ ID NO: 373339 - RNA, 22 nt, Human
ccucugcagcagagagccagag

SEQ ID NO: 373340 - RNA, 22 nt, Human
accauuugacucucuaaggaua

SEQ ID NO: 373341 - RNA, 22 nt, Human
ccugggagggcaagugcugaug

SEQ ID NO: 373342 - RNA, 22 nt, Human
cuccuucccuucaaguguuccu

SEQ ID NO: 373343 - RNA, 22 nt, Human
uacaguucacaguaucauaaau

SEQ ID NO: 373344 - RNA, 22 nt, Human
ccuggcaggcuggggacagugc

SEQ ID NO: 373345 - RNA, 22 nt, Human
uuaaaauuauggcccauuugga

SEQ ID NO: 373346 - RNA, 22 nt, Human
auccuuagaagggagugaggac

SEQ ID NO: 373347 - RNA, 21 nt, Human
agcuggcagauauggugucug

SEQ ID NO: 373348 - RNA, 23 nt, Human
uuuuccagaaucgacucuguaga

SEQ ID NO: 373349 - RNA, 19 nt, Human
uggcagggagugauauuag

SEQ ID NO: 373350 - RNA, 22 nt, Human
agccaggaaccagcuacagucu

SEQ ID NO: 373351 - RNA, 17 nt, Human
gugcagggaugaaggau

SEQ ID NO: 373352 - RNA, 22 nt, Human
ucuguucaucucaugggagaau

SEQ ID NO: 373353 - RNA, 22 nt, Human
ccuggcuggcaagaucgugaag

SEQ ID NO: 373354 - RNA, 22 nt, Human
agcccuccucacaucagcgucc

SEQ ID NO: 373355 - RNA, 22 nt, Human
acugggaguucuccaugucccu

SEQ ID NO: 373356 - RNA, 22 nt, Human
ugaaaugaagggcuuguucugg

SEQ ID NO: 373357 - RNA, 22 nt, Human
uucuaacucuguuauguguuuc

SEQ ID NO: 373358 - RNA, 22 nt, Human
cugugagcuggguggccaggac

SEQ ID NO: 373359 - RNA, 22 nt, Human
ccucuggggugagugggccacu

SEQ ID NO: 373360 - RNA, 23 nt, Human
ugggggugcacgggccacaucuu

SEQ ID NO: 373361 - RNA, 22 nt, Human
guguccuuauuucugucucuca

SEQ ID NO: 373362 - RNA, 22 nt, Human
acccaggagcucugggguccuc

SEQ ID NO: 373363 - RNA, 23 nt, Human
aguguuccaguugguugagagug

SEQ ID NO: 373364 - RNA, 22 nt, Human
uccuucagauuccugcuucugg

SEQ ID NO: 373365 - RNA, 22 nt, Human
aaaaaugucauuauggaacuga

SEQ ID NO: 373366 - RNA, 22 nt, Human
ucauugcagugauguuguaugu

SEQ ID NO: 373367 - RNA, 22 nt, Human
aaaggugacugcagcagcuauu

SEQ ID NO: 373368 - RNA, 22 nt, Human
ggcacugaauuucuuggcaucu

SEQ ID NO: 373369 - RNA, 22 nt, Human
ucauccaguaccauggaaggca

SEQ ID NO: 373370 - RNA, 22 nt, Human
ggggagugacgcagggccauag

SEQ ID NO: 373371 - RNA, 22 nt, Human
aagauuucucuccuggaaagca

SEQ ID NO: 373372 - RNA, 22 nt, Human
uucaagauggccccagugagcc

SEQ ID NO: 373373 - RNA, 22 nt, Human
acuuuaucaggaaucacacagc

SEQ ID NO: 373374 - RNA, 23 nt, Human
acaguuauagcugugaauaacau

SEQ ID NO: 373375 - RNA, 22 nt, Human
gugaggcagcaggagccucugu

SEQ ID NO: 373376 - RNA, 22 nt, Human
ugcuuuggaucuauuugcugag

SEQ ID NO: 373377 - RNA, 22 nt, Human
uaugaagaaguucugugaaaug

SEQ ID NO: 373378 - RNA, 22 nt, Human
cuaugacacaggccauuauaua

SEQ ID NO: 373379 - RNA, 22 nt, Human
gagggccagcagccucagcaug

SEQ ID NO: 373380 - RNA, 22 nt, Human
uuggcuuccaggaucucagcag

SEQ ID NO: 373381 - RNA, 22 nt, Human
gagccaaggguugccauggaga

SEQ ID NO: 373382 - RNA, 22 nt, Human
uuuauguaguuacggacuauca

SEQ ID NO: 373383 - RNA, 22 nt, Human
caggcagaaauuuuguuucauu

SEQ ID NO: 373384 - RNA, 22 nt, Human
cauuuguacagaacagcuuuau

SEQ ID NO: 373385 - RNA, 22 nt, Human
cagaggcugaugugggaugggc

SEQ ID NO: 373386 - RNA, 22 nt, Human
gaggcugcuuugaugacaggag

SEQ ID NO: 373387 - RNA, 22 nt, Human
cugcagggaccacaagcagguu

SEQ ID NO: 373388 - RNA, 22 nt, Human
ucccuggcuguguucaggugcg

SEQ ID NO: 373389 - RNA, 22 nt, Human
ugagguggcuagggaggcacuc

SEQ ID NO: 373390 - RNA, 22 nt, Human
aaggugaaacuggaagcuggcc

SEQ ID NO: 373391 - RNA, 22 nt, Human
acucugaaugugcauguaaauc

SEQ ID NO: 373392 - RNA, 22 nt, Human
acagaaguuggaauuagauacu

SEQ ID NO: 373393 - RNA, 22 nt, Human
auggacagugugaagcagauag

SEQ ID NO: 373394 - RNA, 20 nt, Human
aggagcugaauuagaggguu

SEQ ID NO: 373395 - RNA, 22 nt, Human
cagcugccccuccagggcuggg

SEQ ID NO: 373396 - RNA, 22 nt, Human
aaauuagucgguuuaggaauuu

SEQ ID NO: 373397 - RNA, 22 nt, Human
ucuauacaaguuucacuuugac

SEQ ID NO: 373398 - RNA, 22 nt, Human
auggcauuccaagucuucuuuu

SEQ ID NO: 373399 - RNA, 22 nt, Human
gcugcuuccuuuccugcugacc

SEQ ID NO: 373400 - RNA, 22 nt, Human
agagccaguuacaacuguggag

SEQ ID NO: 373401 - RNA, 22 nt, Human
ugcugccacauuuaaagagggg

SEQ ID NO: 373402 - RNA, 22 nt, Human
gggaggagugaagauucaccug

SEQ ID NO: 373403 - RNA, 22 nt, Human
uuguaacacuuuucuauuaaua

SEQ ID NO: 373404 - RNA, 20 nt, Human
gugggcagaugugugcaugg

SEQ ID NO: 373405 - RNA, 22 nt, Human
gcagggacgccagggacagcaa

SEQ ID NO: 373406 - RNA, 22 nt, Human
ccacaggggucucuguagcuga

SEQ ID NO: 373407 - RNA, 22 nt, Human
aggcuggcuuggcucuccugug

SEQ ID NO: 373408 - RNA, 22 nt, Human
cacagggcagugauuguccaca

SEQ ID NO: 373409 - RNA, 22 nt, Human
cucuucaauagauuguugaggg

SEQ ID NO: 373410 - RNA, 22 nt, Human
ugcuuuauaucucucuucuuag

SEQ ID NO: 373411 - RNA, 20 nt, Human
augugucuguaaacaacucu

SEQ ID NO: 373412 - RNA, 22 nt, Human
ucagggacgugagcucagaguc

SEQ ID NO: 373413 - RNA, 22 nt, Human
uuggcagugucugcaaaaugga

SEQ ID NO: 373414 - RNA, 22 nt, Human
uugaauaaaugagcagugaauu

SEQ ID NO: 373415 - RNA, 22 nt, Human
gauaccagacagggagggagaa

SEQ ID NO: 373416 - RNA, 22 nt, Human
auaucuuuuagagcaagcuugu

SEQ ID NO: 373417 - RNA, 23 nt, Human
cucugcaggagagugggcagggc

SEQ ID NO: 373418 - RNA, 22 nt, Human
cagggcaguuuuacuucucucu

SEQ ID NO: 373419 - RNA, 22 nt, Human
aaauacugggcucaaaaggguu

SEQ ID NO: 373420 - RNA, 22 nt, Human
ugggcuccagcaccugugcucu

SEQ ID NO: 373421 - RNA, 22 nt, Human
cccagggaagggcuaccugagg

SEQ ID NO: 373422 - RNA, 22 nt, Human
cuauuucugccuaaugaccugu

SEQ ID NO: 373423 - RNA, 22 nt, Human
cagagagcaugggaggcccgag

SEQ ID NO: 373424 - RNA, 22 nt, Human
aaggcucucugauggcagcagu

SEQ ID NO: 373425 - RNA, 22 nt, Human
ggucagccuuggauuugguagc

SEQ ID NO: 373426 - RNA, 22 nt, Human
uuccucaguuagugccugaggc

SEQ ID NO: 373427 - RNA, 22 nt, Human
cuucuuaacuguauauacuaug

SEQ ID NO: 373428 - RNA, 22 nt, Human
uaagaacaagauguuccuguuu

SEQ ID NO: 373429 - RNA, 22 nt, Human
uucaagaugccagggacgcggc

SEQ ID NO: 373430 - RNA, 22 nt, Human
gaaaggagaggguuaaggagcu

SEQ ID NO: 373431 - RNA, 22 nt, Human
aaugauuuccccuacacagaag

SEQ ID NO: 373432 - RNA, 22 nt, Human
ucuggagcaacagagcaggaca

SEQ ID NO: 373433 - RNA, 22 nt, Human
cugggagucuggccucuggucc

SEQ ID NO: 373434 - RNA, 22 nt, Human
aagcuuuagagaugaguuccuu

SEQ ID NO: 373435 - RNA, 21 nt, Human
uguucacauggagcagaaugu

SEQ ID NO: 373436 - RNA, 22 nt, Human
gguacaaugguucauuuuaugu

SEQ ID NO: 373437 - RNA, 22 nt, Human
aggcaggggagcuggaagggua

SEQ ID NO: 373438 - RNA, 22 nt, Human
ccagaggcauguucaaagcaau

SEQ ID NO: 373439 - RNA, 22 nt, Human
aggcugugcacagggcaccugc

SEQ ID NO: 373440 - RNA, 22 nt, Human
uuaagauagaacccaguagucu

SEQ ID NO: 373441 - RNA, 22 nt, Human
aaguccaguuucauuugagguc

SEQ ID NO: 373442 - RNA, 22 nt, Human
aaaguguugggauuacaggugu

SEQ ID NO: 373443 - RNA, 22 nt, Human
uaguccauuuucacacugcuga

SEQ ID NO: 373444 - RNA, 22 nt, Human
cagagguacaagcuaaguuggg

SEQ ID NO: 373445 - RNA, 22 nt, Human
uuuaggcaauagauggcagugu

SEQ ID NO: 373446 - RNA, 22 nt, Human
auggcuuucucuaaugugguau

SEQ ID NO: 373447 - RNA, 22 nt, Human
aucuucaaagggauguccaugg

SEQ ID NO: 373448 - RNA, 22 nt, Human
gccuggccgcuccgagcuccgc

SEQ ID NO: 373449 - RNA, 22 nt, Human
acauucacuauguccaaacucu

SEQ ID NO: 373450 - RNA, 22 nt, Human
agccucugauggcucccaagga

SEQ ID NO: 373451 - RNA, 22 nt, Human
auacuuuggucacuauuauugg

SEQ ID NO: 373452 - RNA, 22 nt, Human
ccagcagaagcucccgcugggu

SEQ ID NO: 373453 - RNA, 22 nt, Human
gggcugagggccaauuccuacu

SEQ ID NO: 373454 - RNA, 22 nt, Human
agggaagagcuugcaagaaacc

SEQ ID NO: 373455 - RNA, 22 nt, Human
auuuccagcagcauauuugucu

SEQ ID NO: 373456 - RNA, 22 nt, Human
ugagccugaguucaaggcugca

SEQ ID NO: 373457 - RNA, 22 nt, Human
cccagacuccucuggcuggugg

SEQ ID NO: 373458 - RNA, 22 nt, Human
ucuuuaaugugauuguaauuau

SEQ ID NO: 373459 - RNA, 18 nt, Human
uucagcagcagacacacu

SEQ ID NO: 373460 - RNA, 22 nt, Human
uggccugccugggagcagcagg

SEQ ID NO: 373461 - RNA, 22 nt, Human
uauuccagaugaaaucauucag

SEQ ID NO: 373462 - RNA, 22 nt, Human
cagggcucaucugugugaccag

SEQ ID NO: 373463 - RNA, 22 nt, Human
agucucuuauucccuauugcug

SEQ ID NO: 373464 - RNA, 22 nt, Human
auucaguucuaaggucagugcc

SEQ ID NO: 373465 - RNA, 22 nt, Human
uccaggcagcccuuccugacuc

SEQ ID NO: 373466 - RNA, 22 nt, Human
ugagcuggucuugaguguagcu

SEQ ID NO: 373467 - RNA, 22 nt, Human
ucaguuuucucaucuguaauuu

SEQ ID NO: 373468 - RNA, 22 nt, Human
ucagugcuucggcgagcaccua

SEQ ID NO: 373469 - RNA, 22 nt, Human
cauccugcggggagcagagggc

SEQ ID NO: 373470 - RNA, 22 nt, Human
uccagcagcccgaaggcccauc

SEQ ID NO: 373471 - RNA, 22 nt, Human
cuuucacauaauugaccuugaa

SEQ ID NO: 373472 - RNA, 22 nt, Human
auggauaagucaaagaguaucc

SEQ ID NO: 373473 - RNA, 22 nt, Human
uaugcacauauaaccugcacug

SEQ ID NO: 373474 - RNA, 22 nt, Human
uaaggcacgcauaagagggggc

SEQ ID NO: 373475 - RNA, 22 nt, Human
agcugccugggcuuguacaccu

SEQ ID NO: 373476 - RNA, 22 nt, Human
gcaggagaaaugaagauugggu

SEQ ID NO: 373477 - RNA, 22 nt, Human
aggcagggugaugauaaugauu

SEQ ID NO: 373478 - RNA, 22 nt, Human
uugucugucccagcuugugcau

SEQ ID NO: 373479 - RNA, 22 nt, Human
aggucauuuccuuagaggcaga

SEQ ID NO: 373480 - RNA, 22 nt, Human
uuacagaaaagggcuuuaagag

SEQ ID NO: 373481 - RNA, 20 nt, Human
gcugccuuguccugcuuggu

SEQ ID NO: 373482 - RNA, 22 nt, Human
ugcagucuggauguccucagau

SEQ ID NO: 373483 - RNA, 22 nt, Human
ucuguucagacacuuuacaugu

SEQ ID NO: 373484 - RNA, 22 nt, Human
ccucccuggccagagcagcagc

SEQ ID NO: 373485 - RNA, 23 nt, Human
ugagcugguauuguccaucucca

SEQ ID NO: 373486 - RNA, 22 nt, Human
aaggcagccauagcaccaucca

SEQ ID NO: 373487 - RNA, 22 nt, Human
uuuaagagcuaguaugucauuu

SEQ ID NO: 373488 - RNA, 22 nt, Human
aggcagucuaucucuggagccu

SEQ ID NO: 373489 - RNA, 22 nt, Human
ugcucuguauucuauggcaguu

SEQ ID NO: 373490 - RNA, 22 nt, Human
aaucagugguucccagcccagg

SEQ ID NO: 373491 - RNA, 19 nt, Human
aaaugugaugguacaauuc

SEQ ID NO: 373492 - RNA, 22 nt, Human
uccaucagauucccuccugaga

SEQ ID NO: 373493 - RNA, 22 nt, Human
uugcucugaacccagggcacca

SEQ ID NO: 373494 - RNA, 22 nt, Human
agggacugagcuaggaucuagu

SEQ ID NO: 373495 - RNA, 21 nt, Human
uccaaaucccauucuguaguc

SEQ ID NO: 373496 - RNA, 21 nt, Human
aucccagcacccaggagugca

SEQ ID NO: 373497 - RNA, 22 nt, Human
caggaaggcgcggcugugccug

SEQ ID NO: 373498 - RNA, 19 nt, Human
ggcugucuggcguguggau

SEQ ID NO: 373499 - RNA, 22 nt, Human
cuguccucuguccucagcagga

SEQ ID NO: 373500 - RNA, 22 nt, Human
acagagcugggaucugaaccca

SEQ ID NO: 373501 - RNA, 22 nt, Human
gcagugauuggaucagagaugg

SEQ ID NO: 373502 - RNA, 22 nt, Human
gagcagugacuggagcaugaga

SEQ ID NO: 373503 - RNA, 22 nt, Human
acacacaacucauuguguaaua

SEQ ID NO: 373504 - RNA, 22 nt, Human
augguuuaagggagaauauuga

SEQ ID NO: 373505 - RNA, 22 nt, Human
ucagguggcuucggggaguggc

SEQ ID NO: 373506 - RNA, 22 nt, Human
gccugcagccucaagggcugag

SEQ ID NO: 373507 - RNA, 22 nt, Human
gggcagguguuuccaaggugag

SEQ ID NO: 373508 - RNA, 22 nt, Human
ugggcagacugagcccuguccc

SEQ ID NO: 373509 - RNA, 22 nt, Human
gccugugcuuaacugacgugag

SEQ ID NO: 373510 - RNA, 22 nt, Human
uuuauuguuuagaagggggcug

SEQ ID NO: 373511 - RNA, 22 nt, Human
augcuaaauggccaguaccaaa

SEQ ID NO: 373512 - RNA, 22 nt, Human
cucuaacaccacagugugguuu

SEQ ID NO: 373513 - RNA, 22 nt, Human
gcagcaggcuuuucauaccuug

SEQ ID NO: 373514 - RNA, 22 nt, Human
gcagcugcuggagggaggcagg

SEQ ID NO: 373515 - RNA, 19 nt, Human
acauggcaucccaggaggu

SEQ ID NO: 373516 - RNA, 22 nt, Human
uggcuuuaggagcuauauaccu

SEQ ID NO: 373517 - RNA, 22 nt, Human
gggcugagugucccaggccgaa

SEQ ID NO: 373518 - RNA, 22 nt, Human
uuuuagauugggaaauguaaag

SEQ ID NO: 373519 - RNA, 22 nt, Human
cugggaugucuauagaacacuu

SEQ ID NO: 373520 - RNA, 22 nt, Human
uagaggcagaagaaauugacaa

SEQ ID NO: 373521 - RNA, 22 nt, Human
agagaauuggagcagugacagg

SEQ ID NO: 373522 - RNA, 19 nt, Human
aucugccuuagugcugcug

SEQ ID NO: 373523 - RNA, 22 nt, Human
cuuugaaaacuuaaauaacagc

SEQ ID NO: 373524 - RNA, 22 nt, Human
gcagauggcugagccugcagau

SEQ ID NO: 373525 - RNA, 22 nt, Human
uugaggaguguuuagggugagg

SEQ ID NO: 373526 - RNA, 22 nt, Human
caauuucaugccauguauugcu

SEQ ID NO: 373527 - RNA, 19 nt, Human
ggaaacaggggccagagga

SEQ ID NO: 373528 - RNA, 22 nt, Human
caggaugagaggcccagggaag

SEQ ID NO: 373529 - RNA, 22 nt, Human
ccaggagcaacuugaaggcaag

SEQ ID NO: 373530 - RNA, 22 nt, Human
aaagucaugcaguugaacuuuu

SEQ ID NO: 373531 - RNA, 22 nt, Human
auauaaguuaguggucauguuu

SEQ ID NO: 373532 - RNA, 22 nt, Human
uggccucuuaggacauccucua

SEQ ID NO: 373533 - RNA, 22 nt, Human
ggcuuuauguuuuucauguggu

SEQ ID NO: 373534 - RNA, 22 nt, Human
ugucagaacucuauugaugucc

SEQ ID NO: 373535 - RNA, 21 nt, Human
agauuguauggaggugagagg

SEQ ID NO: 373536 - RNA, 22 nt, Human
cagggcuggcucaugaaaaguu

SEQ ID NO: 373537 - RNA, 22 nt, Human
ucugggggcgaccagggacugc

SEQ ID NO: 373538 - RNA, 22 nt, Human
gcccacacaccagcucaggagg

SEQ ID NO: 373539 - RNA, 22 nt, Human
gggagaaguggaaaucucauua

SEQ ID NO: 373540 - RNA, 22 nt, Human
gagcugcagcggcugacgcaac

SEQ ID NO: 373541 - RNA, 22 nt, Human
aguccagugucaaggugccauu

SEQ ID NO: 373542 - RNA, 20 nt, Human
gcuguugccaguacagaugg

SEQ ID NO: 373543 - RNA, 21 nt, Human
gcacagcaugaguguuggcau

SEQ ID NO: 373544 - RNA, 22 nt, Human
acugugugcccugacgccaggg

SEQ ID NO: 373545 - RNA, 22 nt, Human
cuggccuguccugacccagccu

SEQ ID NO: 373546 - RNA, 22 nt, Human
gcucccugcagcugagaguucc

SEQ ID NO: 373547 - RNA, 22 nt, Human
guuauuagaagugaaggauugu

SEQ ID NO: 373548 - RNA, 22 nt, Human
uuugaaguaccugguucugacu

SEQ ID NO: 373549 - RNA, 22 nt, Human
gguggguauugaauacaggugu

SEQ ID NO: 373550 - RNA, 19 nt, Human
uggcuuccaucucucucau

SEQ ID NO: 373551 - RNA, 22 nt, Human
auuuugaaaagcauuugaguaa

SEQ ID NO: 373552 - RNA, 22 nt, Human
cuugccuucuguuccuauagaa

SEQ ID NO: 373553 - RNA, 22 nt, Human
ccagcugucacucagaaaggcc

SEQ ID NO: 373554 - RNA, 22 nt, Human
uuuguuagagugugggaggcug

SEQ ID NO: 373555 - RNA, 23 nt, Human
aagcugccagucugaagccuggg

SEQ ID NO: 373556 - RNA, 22 nt, Human
augcuuuagugucaaguuuggg

SEQ ID NO: 373557 - RNA, 22 nt, Human
cuugcugggguaagucugugcu

SEQ ID NO: 373558 - RNA, 20 nt, Human
ccuccaggcacacccaugug

SEQ ID NO: 373559 - RNA, 22 nt, Human
gaggagcaugggaaggcucugg

SEQ ID NO: 373560 - RNA, 22 nt, Human
gcugaguugaaagcagaggaua

SEQ ID NO: 373561 - RNA, 22 nt, Human
cccagcauccucagggagcggg

SEQ ID NO: 373562 - RNA, 22 nt, Human
uuuaggcaaacucauugucaga

SEQ ID NO: 373563 - RNA, 22 nt, Human
ccagggugcucuguggcgucgc

SEQ ID NO: 373564 - RNA, 22 nt, Human
ugcaccugagaggucucugagg

SEQ ID NO: 373565 - RNA, 22 nt, Human
ccuuguccucugguuuccuguu

SEQ ID NO: 373566 - RNA, 22 nt, Human
uuauuucauguaaaauuuaugu

SEQ ID NO: 373567 - RNA, 22 nt, Human
ugccagcacaaguuaagagauc

SEQ ID NO: 373568 - RNA, 22 nt, Human
gaggccugcagcguggucccug

SEQ ID NO: 373569 - RNA, 21 nt, Human
aggcuguccuuugccagcccu

SEQ ID NO: 373570 - RNA, 22 nt, Human
ccaaaggccaagcucagguaaa

SEQ ID NO: 373571 - RNA, 17 nt, Human
uagcugccccgaaugcu

SEQ ID NO: 373572 - RNA, 22 nt, Human
ggagaccagaaggaagcuucga

SEQ ID NO: 373573 - RNA, 22 nt, Human
gaugaaaaaagacgagcauaua

SEQ ID NO: 373574 - RNA, 22 nt, Human
ccagcuuguuugaagcucguca

SEQ ID NO: 373575 - RNA, 22 nt, Human
acagggucaagggugcuacaag

SEQ ID NO: 373576 - RNA, 22 nt, Human
ggcuuuauuuugcaugaaugcu

SEQ ID NO: 373577 - RNA, 22 nt, Human
uuuaggcaaauuucagaugugc

SEQ ID NO: 373578 - RNA, 22 nt, Human
guggcucuccauugacauggaa

SEQ ID NO: 373579 - RNA, 22 nt, Human
cuuggcagcuuuuggaggagcc

SEQ ID NO: 373580 - RNA, 22 nt, Human
ugaaggccagggauuugcagcc

SEQ ID NO: 373581 - RNA, 22 nt, Human
gagcagcuggacaggccucccu

SEQ ID NO: 373582 - RNA, 22 nt, Human
gggcugagucaucuggggccuc

SEQ ID NO: 373583 - RNA, 21 nt, Human
auacauucuauuaagcauuua

SEQ ID NO: 373584 - RNA, 22 nt, Human
ucccaguuuuucuccacuaagg

SEQ ID NO: 373585 - RNA, 22 nt, Human
ucugggagacguguguugucag

SEQ ID NO: 373586 - RNA, 22 nt, Human
ugauuuccaugaagcugaaggc

SEQ ID NO: 373587 - RNA, 22 nt, Human
augauuucuauauaaacuuaaa

SEQ ID NO: 373588 - RNA, 22 nt, Human
uccaggcuccccugcgugcucc

SEQ ID NO: 373589 - RNA, 22 nt, Human
ccuauugacaauucucuucucc

SEQ ID NO: 373590 - RNA, 19 nt, Human
accugcaguaauaauuccu

SEQ ID NO: 373591 - RNA, 22 nt, Human
caucugcuguuccuuggacuca

SEQ ID NO: 373592 - RNA, 22 nt, Human
caaauguguaaggaaguguuag

SEQ ID NO: 373593 - RNA, 22 nt, Human
ggagccuguggccgucacgacu

SEQ ID NO: 373594 - RNA, 22 nt, Human
ccaggugucaugcgugugaccc

SEQ ID NO: 373595 - RNA, 22 nt, Human
aguacaacauuagaguaucuua

SEQ ID NO: 373596 - RNA, 22 nt, Human
agagggcagggcgguaaguccu

SEQ ID NO: 373597 - RNA, 23 nt, Human
ugcagccacucaggagcucagug

SEQ ID NO: 373598 - RNA, 22 nt, Human
acacuucucccaucuccuguug

SEQ ID NO: 373599 - RNA, 22 nt, Human
cuuauuagaguuguguucuguu

SEQ ID NO: 373600 - RNA, 22 nt, Human
uuaguacugauagggucaauca

SEQ ID NO: 373601 - RNA, 22 nt, Human
ccugugcauccgguggucauug

SEQ ID NO: 373602 - RNA, 22 nt, Human
ucucagagugguggucccucug

SEQ ID NO: 373603 - RNA, 22 nt, Human
gccugggagugcacagugaggu

SEQ ID NO: 373604 - RNA, 19 nt, Human
gggcuuggggcugaagccu

SEQ ID NO: 373605 - RNA, 22 nt, Human
uuucuuaggcucuaaaaugacu

SEQ ID NO: 373606 - RNA, 22 nt, Human
aagggcagagggaaucccacau

SEQ ID NO: 373607 - RNA, 22 nt, Human
cagcugaggucaaagaagcagg

SEQ ID NO: 373608 - RNA, 22 nt, Human
uugcagcuucuaccacuguuuc

SEQ ID NO: 373609 - RNA, 22 nt, Human
ugacauuucgguguaugugaug

SEQ ID NO: 373610 - RNA, 22 nt, Human
ucaguaaaguucuuucuugcug

SEQ ID NO: 373611 - RNA, 22 nt, Human
uuagauaauguuauuguaauuu

SEQ ID NO: 373612 - RNA, 22 nt, Human
guggaggguuugcaaugugcag

SEQ ID NO: 373613 - RNA, 22 nt, Human
uagaagcaguaauagaaauagg

SEQ ID NO: 373614 - RNA, 22 nt, Human
cuucaagauccauagauauugc

SEQ ID NO: 373615 - RNA, 22 nt, Human
cauacauugcucauucaguauc

SEQ ID NO: 373616 - RNA, 22 nt, Human
cagcuuggaggaggaucuaaga

SEQ ID NO: 373617 - RNA, 20 nt, Human
gucaggauuaguaaacucug

SEQ ID NO: 373618 - RNA, 22 nt, Human
ucuguuccauguuuuguuccau

SEQ ID NO: 373619 - RNA, 22 nt, Human
gcagcuggauuucaagagggag

SEQ ID NO: 373620 - RNA, 22 nt, Human
cagcaggaagguuuccccugca

SEQ ID NO: 373621 - RNA, 22 nt, Human
uccuugaaugaauguucucucc

SEQ ID NO: 373622 - RNA, 22 nt, Human
uugaagaggacuuugcagcugu

SEQ ID NO: 373623 - RNA, 22 nt, Human
aauuugauucccugcaccuguu

SEQ ID NO: 373624 - RNA, 22 nt, Human
agggcagccauugagggauucu

SEQ ID NO: 373625 - RNA, 22 nt, Human
aaaauccugcugacucgagaug

SEQ ID NO: 373626 - RNA, 22 nt, Human
cuccugagcucugaggaagcuu

SEQ ID NO: 373627 - RNA, 22 nt, Human
uggcagcuguuaauguuuuguu

SEQ ID NO: 373628 - RNA, 22 nt, Human
agacaacaucacuaaagcugag

SEQ ID NO: 373629 - RNA, 20 nt, Human
cguaaggcaagugcugcauc

SEQ ID NO: 373630 - RNA, 22 nt, Human
agauaucaccaguuuuacauac

SEQ ID NO: 373631 - RNA, 22 nt, Human
agaggucagaacaggaaagugu

SEQ ID NO: 373632 - RNA, 21 nt, Human
agcagcagaucuggugagggc

SEQ ID NO: 373633 - RNA, 22 nt, Human
uuuucauuguuacuaugagcua

SEQ ID NO: 373634 - RNA, 21 nt, Human
ggcagcguguggacaggaagg

SEQ ID NO: 373635 - RNA, 23 nt, Human
ugcaugugaauucauacuuguuu

SEQ ID NO: 373636 - RNA, 22 nt, Human
uucugagacaauugagagucua

SEQ ID NO: 373637 - RNA, 22 nt, Human
gaaugcacuuccaacaucuauu

SEQ ID NO: 373638 - RNA, 22 nt, Human
gaagaagguggcccagggguag

SEQ ID NO: 373639 - RNA, 22 nt, Human
aaguuucauguggagguagacu

SEQ ID NO: 373640 - RNA, 22 nt, Human
gacuucuauuaauaccucuacu

SEQ ID NO: 373641 - RNA, 22 nt, Human
ucuggcucuauaacuccuagcu

SEQ ID NO: 373642 - RNA, 22 nt, Human
ggcagcuccucucagcaaaaga

SEQ ID NO: 373643 - RNA, 22 nt, Human
aaaaguguucaggaagaauaau

SEQ ID NO: 373644 - RNA, 22 nt, Human
gccuggaguucagccaaguccc

SEQ ID NO: 373645 - RNA, 22 nt, Human
ucaggaauccagacagggcaca

SEQ ID NO: 373646 - RNA, 22 nt, Human
uagcugucaccagaaauggcca

SEQ ID NO: 373647 - RNA, 22 nt, Human
uuuaggcauugggugcucaagu

SEQ ID NO: 373648 - RNA, 22 nt, Human
ggcuuccuaauacucccuacac

SEQ ID NO: 373649 - RNA, 19 nt, Human
uggcagcauugguaccuug

SEQ ID NO: 373650 - RNA, 22 nt, Human
uugaaaggcacaggcaccuggg

SEQ ID NO: 373651 - RNA, 22 nt, Human
aaauguguuucgaaaacuggug

SEQ ID NO: 373652 - RNA, 22 nt, Human
gccaggggacgcggagcgacga

SEQ ID NO: 373653 - RNA, 22 nt, Human
cauuucugucacguucuuuuau

SEQ ID NO: 373654 - RNA, 22 nt, Human
uguaauggaagugggauugcau

SEQ ID NO: 373655 - RNA, 22 nt, Human
ucaccaggcaacuauguacucc

SEQ ID NO: 373656 - RNA, 22 nt, Human
caauuuuuuccaugcucuuaca

SEQ ID NO: 373657 - RNA, 22 nt, Human
gaaaagcuaggccaguucagcu

SEQ ID NO: 373658 - RNA, 22 nt, Human
uuauuuaauuuucucacucaga

SEQ ID NO: 373659 - RNA, 22 nt, Human
ucagagaguuacacaaauuguu

SEQ ID NO: 373660 - RNA, 22 nt, Human
gcugccuggagcucagccugcc

SEQ ID NO: 373661 - RNA, 22 nt, Human
uccguauuugacuauugcaccg

SEQ ID NO: 373662 - RNA, 22 nt, Human
caaggccaaagggccacuguca

SEQ ID NO: 373663 - RNA, 22 nt, Human
aaaaaugcuuggacuuaauaaa

SEQ ID NO: 373664 - RNA, 22 nt, Human
gagcucaggagcaucagaagaa

SEQ ID NO: 373665 - RNA, 22 nt, Human
uaguuaggaauagcagcgacuc

SEQ ID NO: 373666 - RNA, 20 nt, Human
ugugaaagcaguagaaugac

SEQ ID NO: 373667 - RNA, 18 nt, Human
ucaaagucuggcuccacu

SEQ ID NO: 373668 - RNA, 22 nt, Human
uuuaaauuuguguuuagagggu

SEQ ID NO: 373669 - RNA, 22 nt, Human
agagggcauuaacucugucuug

SEQ ID NO: 373670 - RNA, 22 nt, Human
aagagggcugcaaucuuauugc

SEQ ID NO: 373671 - RNA, 22 nt, Human
uggcucaguuucaguccugguu

SEQ ID NO: 373672 - RNA, 22 nt, Human
gccuggaguacuccuugaagug

SEQ ID NO: 373673 - RNA, 22 nt, Human
ccugugugcacacgaggccaug

SEQ ID NO: 373674 - RNA, 22 nt, Human
acugucugcaaaacucauacuc

SEQ ID NO: 373675 - RNA, 22 nt, Human
uacuuguagcagguggcauuua

SEQ ID NO: 373676 - RNA, 22 nt, Human
guuacacaggaaaacauuagca

SEQ ID NO: 373677 - RNA, 19 nt, Human
uaucuguuuccugcuuguc

SEQ ID NO: 373678 - RNA, 22 nt, Human
agguuuucagcuguauccugag

SEQ ID NO: 373679 - RNA, 22 nt, Human
ucaggagauggucuuuauaggc

SEQ ID NO: 373680 - RNA, 22 nt, Human
aaagucauuguaauauaugcua

SEQ ID NO: 373681 - RNA, 22 nt, Human
aggugcagcugacaccaugugg

SEQ ID NO: 373682 - RNA, 22 nt, Human
gccuucugaucgcuggacugac

SEQ ID NO: 373683 - RNA, 22 nt, Human
uuauuauagauuaugcaagauu

SEQ ID NO: 373684 - RNA, 22 nt, Human
uuuucagaggccuaagagguuu

SEQ ID NO: 373685 - RNA, 22 nt, Human
uacaggcauguagcauggugau

SEQ ID NO: 373686 - RNA, 22 nt, Human
caaauuccucagaaucagaaaa

SEQ ID NO: 373687 - RNA, 22 nt, Human
ggggcagggagguuaucgccga

SEQ ID NO: 373688 - RNA, 22 nt, Human
gcaggcagagaaggaacauuua

SEQ ID NO: 373689 - RNA, 22 nt, Human
gauuuccuagacauggggcaga

SEQ ID NO: 373690 - RNA, 22 nt, Human
ucaguauccacaaaugcucaaa

SEQ ID NO: 373691 - RNA, 21 nt, Human
uagggcucuauuuuuauuuca

SEQ ID NO: 373692 - RNA, 22 nt, Human
ccuggcaguggugaagaagagg

SEQ ID NO: 373693 - RNA, 21 nt, Human
ccugggccaaauucccuggac

SEQ ID NO: 373694 - RNA, 22 nt, Human
cugagcuuccaguuccuccagg

SEQ ID NO: 373695 - RNA, 22 nt, Human
cuguggcuaggaagcuguggga

SEQ ID NO: 373696 - RNA, 22 nt, Human
aguggcaggcggagauguagga

SEQ ID NO: 373697 - RNA, 22 nt, Human
ugacacagaaauuaagcuguca

SEQ ID NO: 373698 - RNA, 22 nt, Human
acccaggagacagguugcagug

SEQ ID NO: 373699 - RNA, 22 nt, Human
caucagcagucacaugaugcug

SEQ ID NO: 373700 - RNA, 22 nt, Human
aggaagugcuaagagaacauca

SEQ ID NO: 373701 - RNA, 22 nt, Human
ucagcuuugcaaguuagaaaau

SEQ ID NO: 373702 - RNA, 18 nt, Human
uucaccagugugaugggu

SEQ ID NO: 373703 - RNA, 22 nt, Human
ucagcagucacauguuguccca

SEQ ID NO: 373704 - RNA, 22 nt, Human
cccagcucaagcagagagcuaa

SEQ ID NO: 373705 - RNA, 20 nt, Human
gcagcugaaaguaugacacc

SEQ ID NO: 373706 - RNA, 19 nt, Human
ugcucauggggacuucucc

SEQ ID NO: 373707 - RNA, 21 nt, Human
aagaaguuuggauuuuguccu

SEQ ID NO: 373708 - RNA, 22 nt, Human
aaugauugcaaacauugagaac

SEQ ID NO: 373709 - RNA, 22 nt, Human
uugaaucauuacaauagauaag

SEQ ID NO: 373710 - RNA, 22 nt, Human
gggcaguggcucacgccuguaa

SEQ ID NO: 373711 - RNA, 22 nt, Human
ggugaaggucagagcaggaaaa

SEQ ID NO: 373712 - RNA, 22 nt, Human
ccugugccauccugagcauccc

SEQ ID NO: 373713 - RNA, 22 nt, Human
caggagacaaguuagcagcuga

SEQ ID NO: 373714 - RNA, 22 nt, Human
gugugcaggccacaggccaggg

SEQ ID NO: 373715 - RNA, 22 nt, Human
uuucuagucucgaucucuuaau

SEQ ID NO: 373716 - RNA, 20 nt, Human
gcaaggcacagugaggaggg

SEQ ID NO: 373717 - RNA, 22 nt, Human
acagauuuaggacuguagcgau

SEQ ID NO: 373718 - RNA, 20 nt, Human
uccagcugucuuucagagac

SEQ ID NO: 373719 - RNA, 22 nt, Human
cuggcaaguacugggccagcuc

SEQ ID NO: 373720 - RNA, 22 nt, Human
ggagggcugccagguggagcgg

SEQ ID NO: 373721 - RNA, 22 nt, Human
ugggcuccaauuuguccuuuca

SEQ ID NO: 373722 - RNA, 22 nt, Human
agaacagaagggaggaaggccu

SEQ ID NO: 373723 - RNA, 22 nt, Human
cucccagguuacaucugagccu

SEQ ID NO: 373724 - RNA, 22 nt, Human
ugcagaaguauuccaggcccca

SEQ ID NO: 373725 - RNA, 20 nt, Human
aggcacuggauuucuuauau

SEQ ID NO: 373726 - RNA, 22 nt, Human
caugagaaguggccuucaaaaa

SEQ ID NO: 373727 - RNA, 22 nt, Human
ugccagaguuacaugaggguca

SEQ ID NO: 373728 - RNA, 22 nt, Human
auuugucuagugguauucacgu

SEQ ID NO: 373729 - RNA, 20 nt, Human
cugcaggguuagaggcucca

SEQ ID NO: 373730 - RNA, 22 nt, Human
cugcugugagugguucuugccu

SEQ ID NO: 373731 - RNA, 21 nt, Human
ugccagcauuaaacagucauu

SEQ ID NO: 373732 - RNA, 22 nt, Human
cggucaggugcagcguuggcac

SEQ ID NO: 373733 - RNA, 22 nt, Human
cuuggcugucuauaggaaagag

SEQ ID NO: 373734 - RNA, 23 nt, Human
uucaaaacuggaaaaucagaugc

SEQ ID NO: 373735 - RNA, 22 nt, Human
guguggcugccagccaagaggc

SEQ ID NO: 373736 - RNA, 22 nt, Human
gaggcaugucuggccuguccca

SEQ ID NO: 373737 - RNA, 22 nt, Human
uaaagucagauaucuggguuga

SEQ ID NO: 373738 - RNA, 22 nt, Human
aaauuucaagcaaaguagcuau

SEQ ID NO: 373739 - RNA, 18 nt, Human
cacaggcaggugauaggu

SEQ ID NO: 373740 - RNA, 22 nt, Human
gccugggaagacuaagugggag

SEQ ID NO: 373741 - RNA, 19 nt, Human
gguaaaagugagcuucagg

SEQ ID NO: 373742 - RNA, 22 nt, Human
aagugacacauggcacuucuau

SEQ ID NO: 373743 - RNA, 22 nt, Human
ucugggaaugaauaagaccugu

SEQ ID NO: 373744 - RNA, 22 nt, Human
uuuauucugugcuacaugaaga

SEQ ID NO: 373745 - RNA, 22 nt, Human
cucugagcuccuggaagcgugc

SEQ ID NO: 373746 - RNA, 22 nt, Human
uuuucucuacaaaauaaccagc

SEQ ID NO: 373747 - RNA, 22 nt, Human
guccugggccugcugaggcuga

SEQ ID NO: 373748 - RNA, 22 nt, Human
gagcccaggcagagguugcagu

SEQ ID NO: 373749 - RNA, 22 nt, Human
aauuucaaguggcaucuuugau

SEQ ID NO: 373750 - RNA, 22 nt, Human
uuaggaaauuaugguuucagau

SEQ ID NO: 373751 - RNA, 22 nt, Human
aagccaguguccagaaugggca

SEQ ID NO: 373752 - RNA, 22 nt, Human
caguccagcccccugcuaaaag

SEQ ID NO: 373753 - RNA, 22 nt, Human
aaauguguuccuuugcuacaga

SEQ ID NO: 373754 - RNA, 22 nt, Human
uauuucuguaugcauaaaagga

SEQ ID NO: 373755 - RNA, 22 nt, Human
cauuugugugggaacccaucag

SEQ ID NO: 373756 - RNA, 22 nt, Human
cccucugcucaggugcauaggc

SEQ ID NO: 373757 - RNA, 22 nt, Human
gcaggcagguggcaucuuguga

SEQ ID NO: 373758 - RNA, 20 nt, Human
gacauucauaguuauuacca

SEQ ID NO: 373759 - RNA, 22 nt, Human
ucuuugcaaauguuauuaucuu

SEQ ID NO: 373760 - RNA, 22 nt, Human
cagagcugggcauggugaaagg

SEQ ID NO: 373761 - RNA, 22 nt, Human
agggagcuuccgaacuacagcu

SEQ ID NO: 373762 - RNA, 22 nt, Human
gcagaagcugggcagcgaggug

SEQ ID NO: 373763 - RNA, 22 nt, Human
uggcuucugggacuugugagca

SEQ ID NO: 373764 - RNA, 22 nt, Human
gugucauuaaccaccaugcaaa

SEQ ID NO: 373765 - RNA, 22 nt, Human
ucugucuccucugaggugccag

SEQ ID NO: 373766 - RNA, 22 nt, Human
uugauacaggcucuauuucauc

SEQ ID NO: 373767 - RNA, 22 nt, Human
augcagcugucagggagaacau

SEQ ID NO: 373768 - RNA, 22 nt, Human
ccagccuggagggcaguggugg

SEQ ID NO: 373769 - RNA, 22 nt, Human
cccugcagagggaugggggcag

SEQ ID NO: 373770 - RNA, 22 nt, Human
cagaggcagugggguugcuccu

SEQ ID NO: 373771 - RNA, 22 nt, Human
acccucccauuuccauguagca

SEQ ID NO: 373772 - RNA, 21 nt, Human
cagugagguccccagccuagg

SEQ ID NO: 373773 - RNA, 22 nt, Human
cuggcucauagagcagcuccaa

SEQ ID NO: 373774 - RNA, 22 nt, Human
aggagcugcagauucugccuug

SEQ ID NO: 373775 - RNA, 22 nt, Human
acccugggcuuggccugcucag

SEQ ID NO: 373776 - RNA, 22 nt, Human
uggggccugagguggagcugca

SEQ ID NO: 373777 - RNA, 22 nt, Human
gggcccacuggcugucugaccc

SEQ ID NO: 373778 - RNA, 18 nt, Human
gagcccugagucugcaca

SEQ ID NO: 373779 - RNA, 22 nt, Human
gcugccugggcaggaggcgcug

SEQ ID NO: 373780 - RNA, 22 nt, Human
gaggcaugcagagcuggagcag

SEQ ID NO: 373781 - RNA, 22 nt, Human
ucagagaaauaauugcugaguu

SEQ ID NO: 373782 - RNA, 22 nt, Human
cagacuuucaaggagugaaggc

SEQ ID NO: 373783 - RNA, 22 nt, Human
augcagguugggcaaguguggg

SEQ ID NO: 373784 - RNA, 22 nt, Human
ggggaccugggcuucaaggguu

SEQ ID NO: 373785 - RNA, 22 nt, Human
gucaaguuaagauaaggucaug

SEQ ID NO: 373786 - RNA, 22 nt, Human
uaugaaagaaucucagagcaca

SEQ ID NO: 373787 - RNA, 22 nt, Human
ccagcuuuucagaaucugccug

SEQ ID NO: 373788 - RNA, 22 nt, Human
ccugagcugaacuaagcaguuu

SEQ ID NO: 373789 - RNA, 22 nt, Human
uguccucuaauuggccucuugc

SEQ ID NO: 373790 - RNA, 22 nt, Human
ucagaggaaaggucagauggcu

SEQ ID NO: 373791 - RNA, 22 nt, Human
gugugcagcagagacaggacuc

SEQ ID NO: 373792 - RNA, 22 nt, Human
ggagugaaguggcgcgaucucg

SEQ ID NO: 373793 - RNA, 22 nt, Human
cagaccucaguccucaguagga

SEQ ID NO: 373794 - RNA, 22 nt, Human
agcagggggaguuagacuagau

SEQ ID NO: 373795 - RNA, 22 nt, Human
acauccagaucucagcauggcu

SEQ ID NO: 373796 - RNA, 22 nt, Human
cuguacaaguccuucaucaggg

SEQ ID NO: 373797 - RNA, 22 nt, Human
agccaggcuaaaugagccauga

SEQ ID NO: 373798 - RNA, 23 nt, Human
cuuuccuuucuuugacacccagc

SEQ ID NO: 373799 - RNA, 22 nt, Human
uauuugauagagauaaaugaua

SEQ ID NO: 373800 - RNA, 19 nt, Human
ugggcagguucaguaaugg

SEQ ID NO: 373801 - RNA, 22 nt, Human
aucaggaagaagaauguguugg

SEQ ID NO: 373802 - RNA, 22 nt, Human
cagggagaagucuggucagucc

SEQ ID NO: 373803 - RNA, 22 nt, Human
gcagcugcagguggucccaugc

SEQ ID NO: 373804 - RNA, 19 nt, Human
gugauuucuuuccacaagc

SEQ ID NO: 373805 - RNA, 22 nt, Human
ggcagccuugagggaggccugg

SEQ ID NO: 373806 - RNA, 21 nt, Human
ugcagcagaguaagcagggga

SEQ ID NO: 373807 - RNA, 22 nt, Human
guugaaugaaucauucuaugua

SEQ ID NO: 373808 - RNA, 22 nt, Human
ugcccagcugucaaaguagaua

SEQ ID NO: 373809 - RNA, 23 nt, Human
ucuuuacauacugaugaguucuc

SEQ ID NO: 373810 - RNA, 22 nt, Human
gggcaugccugcgcagugcaug

SEQ ID NO: 373811 - RNA, 22 nt, Human
uggcagggaguugcaggauuuc

SEQ ID NO: 373812 - RNA, 22 nt, Human
aucaauucuuaggaaaauagcu

SEQ ID NO: 373813 - RNA, 23 nt, Human
gccaggcacaugguggacacgca

SEQ ID NO: 373814 - RNA, 22 nt, Human
uguacaugugucuguauaucuu

SEQ ID NO: 373815 - RNA, 21 nt, Human
cuacagaagcucuccuaucca

SEQ ID NO: 373816 - RNA, 20 nt, Human
gcacugaagguuccagggga

SEQ ID NO: 373817 - RNA, 21 nt, Human
ucauuuuuauugcuaccuugc

SEQ ID NO: 373818 - RNA, 22 nt, Human
gaaugcagauggcugguguaug

SEQ ID NO: 373819 - RNA, 22 nt, Human
ccuccuggcccugggccuggaa

SEQ ID NO: 373820 - RNA, 22 nt, Human
uccuggaggcaaaugaagacuc

SEQ ID NO: 373821 - RNA, 22 nt, Human
uuaaaaugcagauucugauuca

SEQ ID NO: 373822 - RNA, 23 nt, Human
uccaggagcaugcuggcuggcga

SEQ ID NO: 373823 - RNA, 21 nt, Human
cacaggugggucagugaggcc

SEQ ID NO: 373824 - RNA, 22 nt, Human
cugaggaggggccugagugaga

SEQ ID NO: 373825 - RNA, 22 nt, Human
auucaaguucuucugucuuugc

SEQ ID NO: 373826 - RNA, 22 nt, Human
agcucccagaagccagagucgg

SEQ ID NO: 373827 - RNA, 18 nt, Human
caugucugcgccacaagg

SEQ ID NO: 373828 - RNA, 22 nt, Human
gcagggacaccuuugugaagcu

SEQ ID NO: 373829 - RNA, 19 nt, Human
ugccuggcaccagcuccac

SEQ ID NO: 373830 - RNA, 22 nt, Human
uggagcuggcuuguggaaguug

SEQ ID NO: 373831 - RNA, 21 nt, Human
gagacagcccagugccagggc

SEQ ID NO: 373832 - RNA, 19 nt, Human
ucaguggagaaaggggaag

SEQ ID NO: 373833 - RNA, 22 nt, Human
aggggcucaguuacuuuggcag

SEQ ID NO: 373834 - RNA, 22 nt, Human
uucuucuuuaucucaguauccu

SEQ ID NO: 373835 - RNA, 22 nt, Human
accaugaucugcucugguguuu

SEQ ID NO: 373836 - RNA, 22 nt, Human
caggagugcagguggugaggca

SEQ ID NO: 373837 - RNA, 22 nt, Human
uaaaucuccuguuuuucaucua

SEQ ID NO: 373838 - RNA, 22 nt, Human
cuguggaccugcucuuagagac

SEQ ID NO: 373839 - RNA, 22 nt, Human
agccaggcuacuccuugcugac

SEQ ID NO: 373840 - RNA, 22 nt, Human
acuagaaacuaauggauuauua

SEQ ID NO: 373841 - RNA, 22 nt, Human
auggggugaccaugagcauuua

SEQ ID NO: 373842 - RNA, 22 nt, Human
aauauuguuucaagaucacaga

SEQ ID NO: 373843 - RNA, 22 nt, Human
uacuuuggauccuuacaauagc

SEQ ID NO: 373844 - RNA, 22 nt, Human
caagccucagaaucuucuccau

SEQ ID NO: 373845 - RNA, 22 nt, Human
ugcagggcaguggagguugagu

SEQ ID NO: 373846 - RNA, 19 nt, Human
ccugugacuaucuuuguaa

SEQ ID NO: 373847 - RNA, 22 nt, Human
ggcauggcuggguucuggugag

SEQ ID NO: 373848 - RNA, 19 nt, Human
uucacauuggaagaaguag

SEQ ID NO: 373849 - RNA, 22 nt, Human
cccaggcagccugcagggaagg

SEQ ID NO: 373850 - RNA, 22 nt, Human
uagcuaucuguguccagaucca

SEQ ID NO: 373851 - RNA, 22 nt, Human
ccaaaggcggaacugagucucu

SEQ ID NO: 373852 - RNA, 22 nt, Human
auuucaggagcaguuucagugg

SEQ ID NO: 373853 - RNA, 22 nt, Human
gcccagcuccucugcagacccu

SEQ ID NO: 373854 - RNA, 17 nt, Human
cucagaguugcuuuguc

SEQ ID NO: 373855 - RNA, 22 nt, Human
uuuacuuugugucaagucaaga

SEQ ID NO: 373856 - RNA, 20 nt, Human
ucccaggcuccacccuagac

SEQ ID NO: 373857 - RNA, 22 nt, Human
acaaaagugagugugucucaga

SEQ ID NO: 373858 - RNA, 22 nt, Human
gcacugaaugccaaaguguagg

SEQ ID NO: 373859 - RNA, 23 nt, Human
ggguccagagacaggcaugggug

SEQ ID NO: 373860 - RNA, 22 nt, Human
ggcagccauacucagaccuggg

SEQ ID NO: 373861 - RNA, 20 nt, Human
uucuucucuaguuaucuuca

SEQ ID NO: 373862 - RNA, 22 nt, Human
cauguuaaaauauacauucuga

SEQ ID NO: 373863 - RNA, 22 nt, Human
aagauggaguaguguaaugguu

SEQ ID NO: 373864 - RNA, 22 nt, Human
gccagggggucagcaggcacuu

SEQ ID NO: 373865 - RNA, 22 nt, Human
cagcuguggagauggggugcau

SEQ ID NO: 373866 - RNA, 22 nt, Human
agucuucacucuucacuacuau

SEQ ID NO: 373867 - RNA, 19 nt, Human
cagaggcaccagguauaga

SEQ ID NO: 373868 - RNA, 22 nt, Human
ugcugccagagagacagggacu

SEQ ID NO: 373869 - RNA, 22 nt, Human
ucccaggcaaaggcagcucauu

SEQ ID NO: 373870 - RNA, 23 nt, Human
ccaggccucucagagggugugcc

SEQ ID NO: 373871 - RNA, 23 nt, Human
uucuucucaauuaguugauucag

SEQ ID NO: 373872 - RNA, 22 nt, Human
augagcuucccagacaggaugg

SEQ ID NO: 373873 - RNA, 22 nt, Human
aacaaaugauaccaguucucaa

SEQ ID NO: 373874 - RNA, 22 nt, Human
ucuucagauggccaguuguccc

SEQ ID NO: 373875 - RNA, 22 nt, Human
cagcaagauuuuuaaagcaagg

SEQ ID NO: 373876 - RNA, 22 nt, Human
aagaaaugcagaaaugugcugg

SEQ ID NO: 373877 - RNA, 22 nt, Human
agcugcugaaugacacugcaag

SEQ ID NO: 373878 - RNA, 22 nt, Human
gcccaggccggagagcagugcu

SEQ ID NO: 373879 - RNA, 22 nt, Human
uauuccaguucaccuuuucauc

SEQ ID NO: 373880 - RNA, 22 nt, Human
gcugcagcucgccuuccggccu

SEQ ID NO: 373881 - RNA, 22 nt, Human
ugauuuccccagucuugcugcu

SEQ ID NO: 373882 - RNA, 22 nt, Human
cuggagggggaaauguucauug

SEQ ID NO: 373883 - RNA, 22 nt, Human
ggcagcuuccugagccagcagc

SEQ ID NO: 373884 - RNA, 22 nt, Human
cagagcugauuggauccagaga

SEQ ID NO: 373885 - RNA, 22 nt, Human
cagaguggcacucugcuggaug

SEQ ID NO: 373886 - RNA, 22 nt, Human
uggaggaugagugugggcucug

SEQ ID NO: 373887 - RNA, 22 nt, Human
ucucaagagggaggcaaucaug

SEQ ID NO: 373888 - RNA, 22 nt, Human
aggacaggauugagcugaacug

SEQ ID NO: 373889 - RNA, 22 nt, Human
uccaggagauucauuaggucau

SEQ ID NO: 373890 - RNA, 22 nt, Human
ucauuugugugagugauuugac

SEQ ID NO: 373891 - RNA, 22 nt, Human
aguuuuaugcaguguucugaua

SEQ ID NO: 373892 - RNA, 21 nt, Human
guggcucugccaggacugaaa

SEQ ID NO: 373893 - RNA, 22 nt, Human
caaaucuauauguugauauucu

SEQ ID NO: 373894 - RNA, 22 nt, Human
ugauuuccaaaaggcuucuaag

SEQ ID NO: 373895 - RNA, 22 nt, Human
gcaggcucuucuuucugcccag

SEQ ID NO: 373896 - RNA, 22 nt, Human
agcaggguauguuagagcugua

SEQ ID NO: 373897 - RNA, 22 nt, Human
aguauaauuagauaucaaaagu

SEQ ID NO: 373898 - RNA, 22 nt, Human
gugccagggaguggaggagcuu

SEQ ID NO: 373899 - RNA, 22 nt, Human
aagggcuguaagccaaguaaag

SEQ ID NO: 373900 - RNA, 22 nt, Human
gagcuguccgccccugggccga

SEQ ID NO: 373901 - RNA, 22 nt, Human
gagugugucggucagcguggcg

SEQ ID NO: 373902 - RNA, 22 nt, Human
caagaugccccugguagggauc

SEQ ID NO: 373903 - RNA, 22 nt, Human
gcaggcuggaggcuguucuggg

SEQ ID NO: 373904 - RNA, 22 nt, Human
uccugggcugugugccacucug

SEQ ID NO: 373905 - RNA, 22 nt, Human
ugugacaugugucaucuuuucu

SEQ ID NO: 373906 - RNA, 22 nt, Human
acacagccaggguaguaaggcu

SEQ ID NO: 373907 - RNA, 19 nt, Human
uauuucaaagugccgucua

SEQ ID NO: 373908 - RNA, 22 nt, Human
caggagcaaggagcagugggau

SEQ ID NO: 373909 - RNA, 22 nt, Human
uggcagcuagauaguguguuua

SEQ ID NO: 373910 - RNA, 22 nt, Human
gugagcagaacagguggcuucu

SEQ ID NO: 373911 - RNA, 22 nt, Human
ucacugcaaucucugccuucca

SEQ ID NO: 373912 - RNA, 22 nt, Human
ugguaaauauguccauucucuu

SEQ ID NO: 373913 - RNA, 22 nt, Human
ucccagcauaacaaacugcccg

SEQ ID NO: 373914 - RNA, 22 nt, Human
aaagccagcaaggugaguuuca

SEQ ID NO: 373915 - RNA, 22 nt, Human
uccuugaaaagaaugucuccau

SEQ ID NO: 373916 - RNA, 22 nt, Human
uuccaggauggcaauaaugaau

SEQ ID NO: 373917 - RNA, 22 nt, Human
aaggccugaacaugaggagaug

SEQ ID NO: 373918 - RNA, 22 nt, Human
ggcagccuccagggcacuggug

SEQ ID NO: 373919 - RNA, 22 nt, Human
gcaaaucaccaccuagcuggau

SEQ ID NO: 373920 - RNA, 22 nt, Human
uguaccuuuuucugugcaugcu

SEQ ID NO: 373921 - RNA, 22 nt, Human
cccucugcugccuggcuggguc

SEQ ID NO: 373922 - RNA, 22 nt, Human
ugccaggcugucaauucaccca

SEQ ID NO: 373923 - RNA, 22 nt, Human
agcuuccuguugagagagggag

SEQ ID NO: 373924 - RNA, 22 nt, Human
gccagagccggcuucacaggau

SEQ ID NO: 373925 - RNA, 22 nt, Human
agcacagguacggagaugcuac

SEQ ID NO: 373926 - RNA, 22 nt, Human
ccagagccggcucccucagcuu

SEQ ID NO: 373927 - RNA, 22 nt, Human
cugcugggaaggucugcucagu

SEQ ID NO: 373928 - RNA, 22 nt, Human
cagugcaguuucccagaugcug

SEQ ID NO: 373929 - RNA, 22 nt, Human
cccuggaagguucucuggcuca

SEQ ID NO: 373930 - RNA, 22 nt, Human
ccugggugaaaucucuccugca

SEQ ID NO: 373931 - RNA, 22 nt, Human
uagacacaagagaaggguauaa

SEQ ID NO: 373932 - RNA, 22 nt, Human
cugaggccucucuccugggcuu

SEQ ID NO: 373933 - RNA, 22 nt, Human
uggacucagugcugccauuccc

SEQ ID NO: 373934 - RNA, 22 nt, Human
aggaagagcuggaccagaggac

SEQ ID NO: 373935 - RNA, 22 nt, Human
uugaagcagagaaauacuugaa

SEQ ID NO: 373936 - RNA, 22 nt, Human
ucuuagaaguucauguuccagc

SEQ ID NO: 373937 - RNA, 22 nt, Human
gcaggaagcauagaagaaugcc

SEQ ID NO: 373938 - RNA, 22 nt, Human
aggcagccaguucagguuucuu

SEQ ID NO: 373939 - RNA, 22 nt, Human
gggugcagggucuccagcagcu

SEQ ID NO: 373940 - RNA, 21 nt, Human
cauuucaaagagcuggaaauc

SEQ ID NO: 373941 - RNA, 22 nt, Human
ccaggcaggcuagaauguaaau

SEQ ID NO: 373942 - RNA, 22 nt, Human
uuagaaaugauuucaccucuuu

SEQ ID NO: 373943 - RNA, 22 nt, Human
uagggcaggugaagaaaagcua

SEQ ID NO: 373944 - RNA, 22 nt, Human
gagggugggccagauaugaggg

SEQ ID NO: 373945 - RNA, 23 nt, Human
acucacaaagcaggaucauguug

SEQ ID NO: 373946 - RNA, 22 nt, Human
ugagccugguugcagugucugg

SEQ ID NO: 373947 - RNA, 22 nt, Human
uaagacauuugaaaugugaucc

SEQ ID NO: 373948 - RNA, 22 nt, Human
acaauacaggcuucuggacuua

SEQ ID NO: 373949 - RNA, 22 nt, Human
caggaaccuaaugaaggcucac

SEQ ID NO: 373950 - RNA, 22 nt, Human
aauacugucuuucacagauauu

SEQ ID NO: 373951 - RNA, 22 nt, Human
uuccauaaucaccuuauucuuu

SEQ ID NO: 373952 - RNA, 22 nt, Human
ucuuguccuaagagcuggauuc

SEQ ID NO: 373953 - RNA, 22 nt, Human
gugguaauagagcuccaaacua

SEQ ID NO: 373954 - RNA, 22 nt, Human
gcugucacaucaaggcacuaaa

SEQ ID NO: 373955 - RNA, 22 nt, Human
aggcugagccacggggcuggcu

SEQ ID NO: 373956 - RNA, 23 nt, Human
ugccucugccucccuagucugca

SEQ ID NO: 373957 - RNA, 22 nt, Human
gccaucacauccaggcuaccuc

SEQ ID NO: 373958 - RNA, 22 nt, Human
guggccugccagcagauggcgc

SEQ ID NO: 373959 - RNA, 22 nt, Human
ugggcugccggcaggcucugcc

SEQ ID NO: 373960 - RNA, 22 nt, Human
uuauugccugauugaggucauu

SEQ ID NO: 373961 - RNA, 22 nt, Human
gcaggagugacauggaugugga

SEQ ID NO: 373962 - RNA, 21 nt, Human
auugaaagucaacaaucaguu

SEQ ID NO: 373963 - RNA, 22 nt, Human
cagaagcacuaggaggaaacgu

SEQ ID NO: 373964 - RNA, 22 nt, Human
caggugcccagcuccugcugug

SEQ ID NO: 373965 - RNA, 22 nt, Human
ucacacgugagguucuauccug

SEQ ID NO: 373966 - RNA, 22 nt, Human
gcaggagcccuggcauguucuu

SEQ ID NO: 373967 - RNA, 21 nt, Human
ugaaaucugaugggacaaaug

SEQ ID NO: 373968 - RNA, 22 nt, Human
gaaauauacaugaagucggcug

SEQ ID NO: 373969 - RNA, 22 nt, Human
ugcagaagcugcaggucagugg

SEQ ID NO: 373970 - RNA, 22 nt, Human
ccagcccugccucucagggccc

SEQ ID NO: 373971 - RNA, 22 nt, Human
aauguucaaacagaucacuuag

SEQ ID NO: 373972 - RNA, 22 nt, Human
cuccuuagugccucugcacgag

SEQ ID NO: 373973 - RNA, 22 nt, Human
aggggaugauccucccgcagcg

SEQ ID NO: 373974 - RNA, 20 nt, Human
gcaggcagggaaugggggug

SEQ ID NO: 373975 - RNA, 22 nt, Human
gagacacacacaggagguggca

SEQ ID NO: 373976 - RNA, 22 nt, Human
gcccaggaugguguguaguggu

SEQ ID NO: 373977 - RNA, 22 nt, Human
caggaggaacaagagguucugg

SEQ ID NO: 373978 - RNA, 22 nt, Human
caaggccugccucuggcagaaa

SEQ ID NO: 373979 - RNA, 22 nt, Human
aaguuugcauagauuaagcauu

SEQ ID NO: 373980 - RNA, 22 nt, Human
gcagaauuuggggguaaccuuu

SEQ ID NO: 373981 - RNA, 22 nt, Human
auuugucuuugagugcccugcu

SEQ ID NO: 373982 - RNA, 20 nt, Human
gaaguccuuucacucuuccc

SEQ ID NO: 373983 - RNA, 22 nt, Human
guacccagaggcaugaucccag

SEQ ID NO: 373984 - RNA, 22 nt, Human
agacgagggcccccaggacagc

SEQ ID NO: 373985 - RNA, 22 nt, Human
uagaugaccuuguguuaggcaa

SEQ ID NO: 373986 - RNA, 22 nt, Human
agcuucucaggagucugaggca

SEQ ID NO: 373987 - RNA, 22 nt, Human
aaguccuuuaauaucacauagu

SEQ ID NO: 373988 - RNA, 22 nt, Human
cacaaaugugcagaaaugugag

SEQ ID NO: 373989 - RNA, 22 nt, Human
agugcuguccaguuucacaggu

SEQ ID NO: 373990 - RNA, 21 nt, Human
cgggcuggccgggcccucacc

SEQ ID NO: 373991 - RNA, 22 nt, Human
ucagcuuuccuugcuuuagauu

SEQ ID NO: 373992 - RNA, 22 nt, Human
uacagauauagagauuuauaga

SEQ ID NO: 373993 - RNA, 22 nt, Human
aggugccagugcuguggucccc

SEQ ID NO: 373994 - RNA, 22 nt, Human
ugggaggaucgcuugagcccag

SEQ ID NO: 373995 - RNA, 22 nt, Human
ccaggcugcagucaaggggcau

SEQ ID NO: 373996 - RNA, 22 nt, Human
acuccagggcuccaucccuugu

SEQ ID NO: 373997 - RNA, 22 nt, Human
aaugcugcaagaggugaaaaga

SEQ ID NO: 373998 - RNA, 22 nt, Human
agggaccugucaaugacaguua

SEQ ID NO: 373999 - RNA, 22 nt, Human
agcuguguggugucugacagcu

SEQ ID NO: 374000 - RNA, 22 nt, Human
ucucuggccgagagucccuggg

SEQ ID NO: 374001 - RNA, 20 nt, Human
guugaaaguaauaugaugcu

SEQ ID NO: 374002 - RNA, 22 nt, Human
cugugccuaagaugcaugucuc

SEQ ID NO: 374003 - RNA, 22 nt, Human
uuuauucaucaucuguucauau

SEQ ID NO: 374004 - RNA, 22 nt, Human
uggcagcaauuagcuagagcug

SEQ ID NO: 374005 - RNA, 22 nt, Human
uucagaaugugaccuuauuugg

SEQ ID NO: 374006 - RNA, 22 nt, Human
gucuucuuuaaccuacuaaagc

SEQ ID NO: 374007 - RNA, 22 nt, Human
uggcucugcaccucaguguacc

SEQ ID NO: 374008 - RNA, 22 nt, Human
guucuucaguaaaauuaaaugu

SEQ ID NO: 374009 - RNA, 22 nt, Human
agacuucucaguuuuauuagua

SEQ ID NO: 374010 - RNA, 22 nt, Human
gagagcugucagcguagcaccg

SEQ ID NO: 374011 - RNA, 22 nt, Human
caggccagguggcaggcaaaac

SEQ ID NO: 374012 - RNA, 22 nt, Human
uagauauaagguccuuagaaca

SEQ ID NO: 374013 - RNA, 22 nt, Human
cuuuccaacucuagugaaauuu

SEQ ID NO: 374014 - RNA, 22 nt, Human
aaccccgcucaggcugggugag

SEQ ID NO: 374015 - RNA, 20 nt, Human
uagauuucauacuucucuuu

SEQ ID NO: 374016 - RNA, 22 nt, Human
aaggaaccauuugugugcaugg

SEQ ID NO: 374017 - RNA, 22 nt, Human
cagcuggaugggagaccauguu

SEQ ID NO: 374018 - RNA, 22 nt, Human
gcaguggcaccgcuggcucugg

SEQ ID NO: 374019 - RNA, 21 nt, Human
agaagccuggguggagguggg

SEQ ID NO: 374020 - RNA, 22 nt, Human
uuagggacagcucuguagguga

SEQ ID NO: 374021 - RNA, 20 nt, Human
cuucaggacccauccucccc

SEQ ID NO: 374022 - RNA, 22 nt, Human
cagguaaaaauaaauuugugag

SEQ ID NO: 374023 - RNA, 22 nt, Human
gcccagcagcugguggagaagg

SEQ ID NO: 374024 - RNA, 22 nt, Human
acagcagcauaaacugacuaag

SEQ ID NO: 374025 - RNA, 22 nt, Human
auagaauucuuugaaauuuaug

SEQ ID NO: 374026 - RNA, 22 nt, Human
uggcauuuagaaaacaacaugu

SEQ ID NO: 374027 - RNA, 21 nt, Human
uggaccuguccuucucgcugu

SEQ ID NO: 374028 - RNA, 22 nt, Human
aaaaacuguaauuacuuuugca

SEQ ID NO: 374029 - RNA, 22 nt, Human
ggaaagagcuaaaagggugaga

SEQ ID NO: 374030 - RNA, 22 nt, Human
cugccaggccuccgcugucccc

SEQ ID NO: 374031 - RNA, 22 nt, Human
ggcacucagagauucaggcugu

SEQ ID NO: 374032 - RNA, 22 nt, Human
acuggcucagaguuccuagaga

SEQ ID NO: 374033 - RNA, 22 nt, Human
uugggacagaaaaggagaagau

SEQ ID NO: 374034 - RNA, 22 nt, Human
uccugcagagucccacugauuu

SEQ ID NO: 374035 - RNA, 22 nt, Human
aaacauguaauucugcuuaaga

SEQ ID NO: 374036 - RNA, 21 nt, Human
uucuucaaagaagaaggcaca

SEQ ID NO: 374037 - RNA, 22 nt, Human
cugggcugucaauggcccucug

SEQ ID NO: 374038 - RNA, 22 nt, Human
agaaugcaagauaaacuuuauu

SEQ ID NO: 374039 - RNA, 22 nt, Human
caggaggagcauuagcgucuca

SEQ ID NO: 374040 - RNA, 20 nt, Human
agaaggcuccuuuugccaag

SEQ ID NO: 374041 - RNA, 22 nt, Human
uucacaggaauguaggggucuu

SEQ ID NO: 374042 - RNA, 22 nt, Human
uuuauguacauauccacaagga

SEQ ID NO: 374043 - RNA, 22 nt, Human
gggcagguggcagggucucugg

SEQ ID NO: 374044 - RNA, 22 nt, Human
caaggccaguuucuccuaguca

SEQ ID NO: 374045 - RNA, 22 nt, Human
acuuagaacaggcagaauucca

SEQ ID NO: 374046 - RNA, 22 nt, Human
accagccugucugagucguggg

SEQ ID NO: 374047 - RNA, 22 nt, Human
uuuccucugacugcuccccugc

SEQ ID NO: 374048 - RNA, 22 nt, Human
gaugugggguugagggaccagc

SEQ ID NO: 374049 - RNA, 22 nt, Human
gggacaggccccucgcuagcuu

SEQ ID NO: 374050 - RNA, 19 nt, Human
aauguaguguuaugucaac

SEQ ID NO: 374051 - RNA, 22 nt, Human
cugacucuccucaagcauaaau

SEQ ID NO: 374052 - RNA, 22 nt, Human
uucauucccaagaguaaacaua

SEQ ID NO: 374053 - RNA, 22 nt, Human
gugggggcaggcagugcuagga

SEQ ID NO: 374054 - RNA, 23 nt, Human
ggcugagacuacaggcgcuugcc

SEQ ID NO: 374055 - RNA, 22 nt, Human
ggcauuaagaauaucauuaaaa

SEQ ID NO: 374056 - RNA, 22 nt, Human
gcagacagcauguugggcuauu

SEQ ID NO: 374057 - RNA, 20 nt, Human
uaugaagauaugugaacagc

SEQ ID NO: 374058 - RNA, 22 nt, Human
gagcaggcuugcagagaagggg

SEQ ID NO: 374059 - RNA, 22 nt, Human
acauuucucagggaguuuugcu

SEQ ID NO: 374060 - RNA, 22 nt, Human
ggccuagggaguggccaugccu

SEQ ID NO: 374061 - RNA, 22 nt, Human
cugccagcaaugugaccaugcu

SEQ ID NO: 374062 - RNA, 22 nt, Human
aggcagcuggcaaauucuagag

SEQ ID NO: 374063 - RNA, 22 nt, Human
agcaggugagcacagccaggcu

SEQ ID NO: 374064 - RNA, 22 nt, Human
acaaagucaaauugcagccgcc

SEQ ID NO: 374065 - RNA, 22 nt, Human
ugaggcucaagaaagauuuguu

SEQ ID NO: 374066 - RNA, 22 nt, Human
auacacagcgaugagaggaggc

SEQ ID NO: 374067 - RNA, 21 nt, Human
cuacagaaucgagcauucugg

SEQ ID NO: 374068 - RNA, 22 nt, Human
acaacuuuucuaucauguggaa

SEQ ID NO: 374069 - RNA, 20 nt, Human
uuucacagucccuguuuccu

SEQ ID NO: 374070 - RNA, 22 nt, Human
cagagccaggguugcaccccug

SEQ ID NO: 374071 - RNA, 22 nt, Human
uuugaaaggaaguuaauacuuu

SEQ ID NO: 374072 - RNA, 22 nt, Human
ugguccagacauuucugaggua

SEQ ID NO: 374073 - RNA, 22 nt, Human
uccauuuagcuggcaaacaaug

SEQ ID NO: 374074 - RNA, 22 nt, Human
gcugccacgaucucugcuguag

SEQ ID NO: 374075 - RNA, 22 nt, Human
auucuucagcaggggacacuau

SEQ ID NO: 374076 - RNA, 22 nt, Human
uuucaaagguggaagagugaau

SEQ ID NO: 374077 - RNA, 22 nt, Human
caggccuccacuccacgcagac

SEQ ID NO: 374078 - RNA, 22 nt, Human
cccucugccugggaccaagucc

SEQ ID NO: 374079 - RNA, 22 nt, Human
auucuucacaccuguuccuguu

SEQ ID NO: 374080 - RNA, 22 nt, Human
cagagcagugaggaguugugua

SEQ ID NO: 374081 - RNA, 22 nt, Human
ggucagagggugggcugccugu

SEQ ID NO: 374082 - RNA, 22 nt, Human
ucugucacccgagcaggcgaga

SEQ ID NO: 374083 - RNA, 22 nt, Human
ucuggagccacaaaccucagcu

SEQ ID NO: 374084 - RNA, 22 nt, Human
agagcugagcaccaagcauggu

SEQ ID NO: 374085 - RNA, 22 nt, Human
guaggcagggcuguggggagaa

SEQ ID NO: 374086 - RNA, 22 nt, Human
agaaaugcucaggucaacuuaa

SEQ ID NO: 374087 - RNA, 22 nt, Human
uccugcagcugaagcucaugug

SEQ ID NO: 374088 - RNA, 22 nt, Human
accaucaguacuggaugcugac

SEQ ID NO: 374089 - RNA, 22 nt, Human
cuuagggaaucuuagagcugga

SEQ ID NO: 374090 - RNA, 22 nt, Human
uagaaacccauguuuauucagu

SEQ ID NO: 374091 - RNA, 22 nt, Human
uaaggcaccuguccaggcuggg

SEQ ID NO: 374092 - RNA, 22 nt, Human
cccuggugguacggcacuggca

SEQ ID NO: 374093 - RNA, 22 nt, Human
agauuucccaaauacuuguuau

SEQ ID NO: 374094 - RNA, 22 nt, Human
agugcuuuagcauccaacuguc

SEQ ID NO: 374095 - RNA, 22 nt, Human
uucaugugaauauauuugucuu

SEQ ID NO: 374096 - RNA, 22 nt, Human
uguuuauaccugcaaccuguca

SEQ ID NO: 374097 - RNA, 22 nt, Human
uuccagaauuuuguucugcuug

SEQ ID NO: 374098 - RNA, 22 nt, Human
gcucuggagauggagccuugag

SEQ ID NO: 374099 - RNA, 22 nt, Human
cagucccaccaggaucgcucuu

SEQ ID NO: 374100 - RNA, 22 nt, Human
ggggcagaaguagugccccuga

SEQ ID NO: 374101 - RNA, 19 nt, Human
ucccagagucuagagguug

SEQ ID NO: 374102 - RNA, 22 nt, Human
uccucaggcugccuggaagacu

SEQ ID NO: 374103 - RNA, 22 nt, Human
aguguuccuugcuuucccagag

SEQ ID NO: 374104 - RNA, 22 nt, Human
ucagagagguuggugauaagaa

SEQ ID NO: 374105 - RNA, 22 nt, Human
gggcugacucaaccuugcaaag

SEQ ID NO: 374106 - RNA, 20 nt, Human
ugccaggcacggagugcaug

SEQ ID NO: 374107 - RNA, 22 nt, Human
uggcucucagcucccagcagcc

SEQ ID NO: 374108 - RNA, 21 nt, Human
cacucaggguaugugccaggc

SEQ ID NO: 374109 - RNA, 22 nt, Human
cugagccaaccacagcaggagc

SEQ ID NO: 374110 - RNA, 22 nt, Human
gcucuggcuacuguggcuaccg

SEQ ID NO: 374111 - RNA, 22 nt, Human
ccagcuuuauagcuucaaagga

SEQ ID NO: 374112 - RNA, 22 nt, Human
gcagcuguguaaugagcccaca

SEQ ID NO: 374113 - RNA, 22 nt, Human
auuagagguacaaaccuucacu

SEQ ID NO: 374114 - RNA, 22 nt, Human
acaguggaagcaugaugcuauc

SEQ ID NO: 374115 - RNA, 22 nt, Human
cuugcaggccuuucuagcucua

SEQ ID NO: 374116 - RNA, 22 nt, Human
gagcuggcuccgccaugcugcu

SEQ ID NO: 374117 - RNA, 19 nt, Human
cccaaggcccugggcaggc

SEQ ID NO: 374118 - RNA, 22 nt, Human
uggccuuggcagugagaagagu

SEQ ID NO: 374119 - RNA, 22 nt, Human
ugugcagggaagggcaugcuau

SEQ ID NO: 374120 - RNA, 22 nt, Human
aacucagucauaaagcgaaugc

SEQ ID NO: 374121 - RNA, 23 nt, Human
ccugcagcugcuggggcuccacc

SEQ ID NO: 374122 - RNA, 22 nt, Human
ccagugcccagucucccugguc

SEQ ID NO: 374123 - RNA, 22 nt, Human
ucucugaguaagugacaguuca

SEQ ID NO: 374124 - RNA, 22 nt, Human
acacccagagcgccagugccga

SEQ ID NO: 374125 - RNA, 22 nt, Human
agauuucaaugugagcauuagu

SEQ ID NO: 374126 - RNA, 21 nt, Human
ccugagggugguugugaagau

SEQ ID NO: 374127 - RNA, 23 nt, Human
cagaaaucugaaaucuagaaaug

SEQ ID NO: 374128 - RNA, 22 nt, Human
cugaaaauguuacacaggaaga

SEQ ID NO: 374129 - RNA, 22 nt, Human
cccucccaagcacucugacaua

SEQ ID NO: 374130 - RNA, 22 nt, Human
uacuuagagcgauaauuuauac

SEQ ID NO: 374131 - RNA, 22 nt, Human
caggaugcacuaggaaccaggg

SEQ ID NO: 374132 - RNA, 22 nt, Human
ugaaaugagauagauaaucagg

SEQ ID NO: 374133 - RNA, 18 nt, Human
cccagugcucacugccuc

SEQ ID NO: 374134 - RNA, 22 nt, Human
aacaugcugccuuucuacgagu

SEQ ID NO: 374135 - RNA, 22 nt, Human
gcugugugaaaacugggccugg

SEQ ID NO: 374136 - RNA, 22 nt, Human
ccugagagagaagcgaccuggu

SEQ ID NO: 374137 - RNA, 22 nt, Human
gcuguucaagacuaggaaauuu

SEQ ID NO: 374138 - RNA, 22 nt, Human
uucaaacacagacagcagcaug

SEQ ID NO: 374139 - RNA, 22 nt, Human
cugggcuucucccccuggcaga

SEQ ID NO: 374140 - RNA, 22 nt, Human
uguacauuuagagcucaauaga

SEQ ID NO: 374141 - RNA, 22 nt, Human
ucuaaacagccucuuaccaacu

SEQ ID NO: 374142 - RNA, 19 nt, Human
ucucagaggaaaaauugcu

SEQ ID NO: 374143 - RNA, 22 nt, Human
ccucaggauacaggagccacag

SEQ ID NO: 374144 - RNA, 22 nt, Human
aggagugcaaauaguccagaga

SEQ ID NO: 374145 - RNA, 22 nt, Human
ucauagaagcaccagaagauau

SEQ ID NO: 374146 - RNA, 22 nt, Human
caggccucuccuuagucuggca

SEQ ID NO: 374147 - RNA, 22 nt, Human
uugggaaggcguggaagcagaa

SEQ ID NO: 374148 - RNA, 22 nt, Human
cugccugggccggccacccucu

SEQ ID NO: 374149 - RNA, 22 nt, Human
cauuucaauacuaucugagaau

SEQ ID NO: 374150 - RNA, 22 nt, Human
ucuguucagaagaggugaaagu

SEQ ID NO: 374151 - RNA, 22 nt, Human
uuucugaagggcagcagacucu

SEQ ID NO: 374152 - RNA, 22 nt, Human
ucccagagauuuccucuccuuc

SEQ ID NO: 374153 - RNA, 20 nt, Human
ugucauuguuucuaggaccu

SEQ ID NO: 374154 - RNA, 22 nt, Human
uauguacacacacaugcaugua

SEQ ID NO: 374155 - RNA, 22 nt, Human
agugcagaguacauuuguggca

SEQ ID NO: 374156 - RNA, 22 nt, Human
gccaguggcccucuggagaagg

SEQ ID NO: 374157 - RNA, 22 nt, Human
ccuggcagcuccuccccggcgg

SEQ ID NO: 374158 - RNA, 22 nt, Human
cuggagagauccuccugaaaaa

SEQ ID NO: 374159 - RNA, 22 nt, Human
uuaaaaccaucagcuguaagau

SEQ ID NO: 374160 - RNA, 22 nt, Human
cagaacauuccaugugcccugc

SEQ ID NO: 374161 - RNA, 22 nt, Human
gcuuucucuucacugauguuca

SEQ ID NO: 374162 - RNA, 22 nt, Human
uguaacaauuucuuacuauugu

SEQ ID NO: 374163 - RNA, 22 nt, Human
uugaaaggaauacagaggccua

SEQ ID NO: 374164 - RNA, 15 nt, Human
aaucagaaguguggc

SEQ ID NO: 374165 - RNA, 20 nt, Human
auacaaagagauugauguau

SEQ ID NO: 374166 - RNA, 22 nt, Human
caugaguuuuuuaguucaugca

SEQ ID NO: 374167 - RNA, 22 nt, Human
gcugccuuugugagccaagggg

SEQ ID NO: 374168 - RNA, 22 nt, Human
gcacaugguaggcauuugaugu

SEQ ID NO: 374169 - RNA, 20 nt, Human
agcaccagugggggcagccc

SEQ ID NO: 374170 - RNA, 22 nt, Human
caagauggguguugugaugguu

SEQ ID NO: 374171 - RNA, 23 nt, Human
agcccagcagagaaccuaggucc

SEQ ID NO: 374172 - RNA, 22 nt, Human
cuggaaguauaggggagaugau

SEQ ID NO: 374173 - RNA, 22 nt, Human
gauuuacagguuagguccugua

SEQ ID NO: 374174 - RNA, 22 nt, Human
gagcagugagugaauguugccu

SEQ ID NO: 374175 - RNA, 22 nt, Human
gcacagguugcaaaaguucaca

SEQ ID NO: 374176 - RNA, 22 nt, Human
gcugcagcuguaggacacaauu

SEQ ID NO: 374177 - RNA, 22 nt, Human
gcagcuuucuacuuccuacagc

SEQ ID NO: 374178 - RNA, 22 nt, Human
uuguuucagcuguaugcuaugu

SEQ ID NO: 374179 - RNA, 22 nt, Human
caacagcugaucuuugaugaag

SEQ ID NO: 374180 - RNA, 22 nt, Human
gcagacaauuuauuagcagauu

SEQ ID NO: 374181 - RNA, 22 nt, Human
uuccaugacaccgagggaaguc

SEQ ID NO: 374182 - RNA, 19 nt, Human
gccugcagaaaaggcaggg

SEQ ID NO: 374183 - RNA, 22 nt, Human
uuuuuggguccaggcuguaucu

SEQ ID NO: 374184 - RNA, 22 nt, Human
uugaacuguaagcaugucugcc

SEQ ID NO: 374185 - RNA, 22 nt, Human
ugauuuccuagcugacaugaaa

SEQ ID NO: 374186 - RNA, 19 nt, Human
uccugggcugggccagguc

SEQ ID NO: 374187 - RNA, 19 nt, Human
gggcaguggcacuagggag

SEQ ID NO: 374188 - RNA, 22 nt, Human
aaaucaguucacguucugaggu

SEQ ID NO: 374189 - RNA, 22 nt, Human
aucuguaaaugcaaauguagcu

SEQ ID NO: 374190 - RNA, 22 nt, Human
aguggcagacacaaugugggca

SEQ ID NO: 374191 - RNA, 22 nt, Human
cuucagaggggacucaaaguca

SEQ ID NO: 374192 - RNA, 22 nt, Human
auguccagccaaccacuggauu

SEQ ID NO: 374193 - RNA, 22 nt, Human
agacaggcuuugcuguauauca

SEQ ID NO: 374194 - RNA, 23 nt, Human
aaauaggaguaucuggaucauga

SEQ ID NO: 374195 - RNA, 22 nt, Human
caggaaagggaugggcugccac

SEQ ID NO: 374196 - RNA, 22 nt, Human
gucccugcaucaccacgggacu

SEQ ID NO: 374197 - RNA, 22 nt, Human
agagccaggcggcugggcaccu

SEQ ID NO: 374198 - RNA, 19 nt, Human
ggaccagguccugggcagc

SEQ ID NO: 374199 - RNA, 22 nt, Human
uccuuuuuauaguuagagaaac

SEQ ID NO: 374200 - RNA, 18 nt, Human
cuguucuagaacuccugu

SEQ ID NO: 374201 - RNA, 22 nt, Human
ccuggcucuucagagguuccua

SEQ ID NO: 374202 - RNA, 22 nt, Human
aggagcugaagucucugcacuc

SEQ ID NO: 374203 - RNA, 22 nt, Human
uucaauaggaugcaugauauaa

SEQ ID NO: 374204 - RNA, 22 nt, Human
gccaggagugucccacucauuu

SEQ ID NO: 374205 - RNA, 22 nt, Human
aaggcacugaacuuaaauucug

SEQ ID NO: 374206 - RNA, 22 nt, Human
acugcagagguggggugcagag

SEQ ID NO: 374207 - RNA, 22 nt, Human
ccugaagaugcuguggccuggu

SEQ ID NO: 374208 - RNA, 22 nt, Human
cugaaggagaaggccacuguuc

SEQ ID NO: 374209 - RNA, 22 nt, Human
gcagggcugggugggagacaga

SEQ ID NO: 374210 - RNA, 22 nt, Human
augcaguaaaauaggagguaau

SEQ ID NO: 374211 - RNA, 22 nt, Human
uucaaauacauucuuugccacu

SEQ ID NO: 374212 - RNA, 22 nt, Human
uuauuauuccccaagucauuau

SEQ ID NO: 374213 - RNA, 22 nt, Human
gggcucuguccauuccuucaua

SEQ ID NO: 374214 - RNA, 20 nt, Human
ggagagcagggaagacagua

SEQ ID NO: 374215 - RNA, 22 nt, Human
aauuccaggcagaaaugugagu

SEQ ID NO: 374216 - RNA, 22 nt, Human
gagccagccgcaagagcuguga

SEQ ID NO: 374217 - RNA, 19 nt, Human
agaaucaggucaggugaca

SEQ ID NO: 374218 - RNA, 22 nt, Human
ggccagaaguuggaaaagagcc

SEQ ID NO: 374219 - RNA, 22 nt, Human
ggcucaccauggccucccugcu

SEQ ID NO: 374220 - RNA, 22 nt, Human
ugucagggcaugcgguccagcc

SEQ ID NO: 374221 - RNA, 22 nt, Human
gccuggagugcaguggcgugau

SEQ ID NO: 374222 - RNA, 23 nt, Human
uggcccugugcaugcugcuuccc

SEQ ID NO: 374223 - RNA, 22 nt, Human
aaaguccagagggcacacugaa

SEQ ID NO: 374224 - RNA, 22 nt, Human
auuaagggccaauccuccagcc

SEQ ID NO: 374225 - RNA, 22 nt, Human
cucacuguccaacaggcuuuac

SEQ ID NO: 374226 - RNA, 22 nt, Human
acuuccugcaaucguccacucc

SEQ ID NO: 374227 - RNA, 22 nt, Human
guuugcauuccaauuuagggga

SEQ ID NO: 374228 - RNA, 22 nt, Human
ccugggcuggaguacagcagug

SEQ ID NO: 374229 - RNA, 22 nt, Human
auauauaaccuggauaaggcuu

SEQ ID NO: 374230 - RNA, 22 nt, Human
uaugcauacaaugagauauucc

SEQ ID NO: 374231 - RNA, 22 nt, Human
cuguccugauggugccacuggu

SEQ ID NO: 374232 - RNA, 22 nt, Human
ccaggagcagggcuggcugcac

SEQ ID NO: 374233 - RNA, 22 nt, Human
aucuaggauuugaaugcacagu

SEQ ID NO: 374234 - RNA, 22 nt, Human
aaagucaugaugaaccaccgua

SEQ ID NO: 374235 - RNA, 22 nt, Human
uggaagaauaggauagaagaac

SEQ ID NO: 374236 - RNA, 22 nt, Human
cuauugaaaguguacaauucaa

SEQ ID NO: 374237 - RNA, 22 nt, Human
cuucccagacgggguggcagcc

SEQ ID NO: 374238 - RNA, 22 nt, Human
ucuacuguagugaugcugcagu

SEQ ID NO: 374239 - RNA, 22 nt, Human
aggcucaggucucaggucuggc

SEQ ID NO: 374240 - RNA, 22 nt, Human
aauuuagauugauaaacaugga

SEQ ID NO: 374241 - RNA, 22 nt, Human
ugccacacagcuguaugaggga

SEQ ID NO: 374242 - RNA, 19 nt, Human
ucucuggggacacuuucac

SEQ ID NO: 374243 - RNA, 22 nt, Human
uccagggagagccgcugcucca

SEQ ID NO: 374244 - RNA, 22 nt, Human
ggcugaaacagauuucaagaca

SEQ ID NO: 374245 - RNA, 22 nt, Human
gcacccaguuugucucaggguu

SEQ ID NO: 374246 - RNA, 22 nt, Human
auuauuucucacucacauaaua

SEQ ID NO: 374247 - RNA, 22 nt, Human
aggggcuggaguucgagguuac

SEQ ID NO: 374248 - RNA, 22 nt, Human
agggaaagguagugaggucaca

SEQ ID NO: 374249 - RNA, 22 nt, Human
acaccagggccuagccagggcg

SEQ ID NO: 374250 - RNA, 22 nt, Human
uucacaggugacuggggauaac

SEQ ID NO: 374251 - RNA, 22 nt, Human
gcuucuggaggagcugggcuga

SEQ ID NO: 374252 - RNA, 22 nt, Human
ucugaaaugcaaauuugacuga

SEQ ID NO: 374253 - RNA, 22 nt, Human
cucccaagcugugcugaacugu

SEQ ID NO: 374254 - RNA, 22 nt, Human
aaaguguaaggaauuuaaguaa

SEQ ID NO: 374255 - RNA, 22 nt, Human
ucagaggauugccucagcgagc

SEQ ID NO: 374256 - RNA, 22 nt, Human
caggcugcagaggccuuucaug

SEQ ID NO: 374257 - RNA, 22 nt, Human
caagacaagaucuaagcaugcu

SEQ ID NO: 374258 - RNA, 22 nt, Human
caaguaaagaaucacauuucuu

SEQ ID NO: 374259 - RNA, 22 nt, Human
guacauuuugagguuaaaacaa

SEQ ID NO: 374260 - RNA, 22 nt, Human
cugcuggccuagcccauccucu

SEQ ID NO: 374261 - RNA, 22 nt, Human
ccugccugcguccucugagggc

SEQ ID NO: 374262 - RNA, 22 nt, Human
ucucccacuggccuuguaugau

SEQ ID NO: 374263 - RNA, 22 nt, Human
gaaaggugccccauaggcagga

SEQ ID NO: 374264 - RNA, 23 nt, Human
agcagggccagaauacuugcugu

SEQ ID NO: 374265 - RNA, 22 nt, Human
ugcuggaggauuaaacaaguca

SEQ ID NO: 374266 - RNA, 22 nt, Human
caauuucauuaauagauauaga

SEQ ID NO: 374267 - RNA, 22 nt, Human
aguauggggcugugugugcaca

SEQ ID NO: 374268 - RNA, 22 nt, Human
ucagaauucugaccuuggguca

SEQ ID NO: 374269 - RNA, 22 nt, Human
aaagaaucacauccuucagcaa

SEQ ID NO: 374270 - RNA, 22 nt, Human
ggcuggcuggcugguagacaag

SEQ ID NO: 374271 - RNA, 22 nt, Human
ccagcaggguugguuucuucug

SEQ ID NO: 374272 - RNA, 22 nt, Human
uaauuauagccgcuauuuugcu

SEQ ID NO: 374273 - RNA, 21 nt, Human
agucccaggggugagugaugu

SEQ ID NO: 374274 - RNA, 22 nt, Human
gugucccaggccucuggaauua

SEQ ID NO: 374275 - RNA, 22 nt, Human
cuguugucuccucucagauuau

SEQ ID NO: 374276 - RNA, 22 nt, Human
cagaaguaagauuacugugagu

SEQ ID NO: 374277 - RNA, 22 nt, Human
uauauagaaaagcagauguugg

SEQ ID NO: 374278 - RNA, 22 nt, Human
auccaaagauggaaagaacuuu

SEQ ID NO: 374279 - RNA, 22 nt, Human
aucaaaguuucccagaaguugu

SEQ ID NO: 374280 - RNA, 22 nt, Human
agucagugaaggcauugcucaa

SEQ ID NO: 374281 - RNA, 21 nt, Human
aaugcauuaacauaaagcuga

SEQ ID NO: 374282 - RNA, 22 nt, Human
gccucugcgccucagccgaccu

SEQ ID NO: 374283 - RNA, 22 nt, Human
ccugagagcauuccacacugaa

SEQ ID NO: 374284 - RNA, 22 nt, Human
auuagggaaggauuuggccuga

SEQ ID NO: 374285 - RNA, 22 nt, Human
acucaggaaaugagaggcucuc

SEQ ID NO: 374286 - RNA, 22 nt, Human
augcauaauguauguauugacu

SEQ ID NO: 374287 - RNA, 22 nt, Human
ucccaggacccaggcauucaca

SEQ ID NO: 374288 - RNA, 22 nt, Human
ggcuucccagcagagggcgcac

SEQ ID NO: 374289 - RNA, 21 nt, Human
agcucagccgggcacaguggc

SEQ ID NO: 374290 - RNA, 22 nt, Human
auucuccacacauccagaccuu

SEQ ID NO: 374291 - RNA, 22 nt, Human
cccaggagacagaaacagaggu

SEQ ID NO: 374292 - RNA, 23 nt, Human
agcagccagagauccucggcccu

SEQ ID NO: 374293 - RNA, 22 nt, Human
augcuguguauuuuacucuuuc

SEQ ID NO: 374294 - RNA, 22 nt, Human
aggcgcagacauacagggucug

SEQ ID NO: 374295 - RNA, 22 nt, Human
uuaaaugaggcugauguagauu

SEQ ID NO: 374296 - RNA, 22 nt, Human
cccagagcuccgguccugccca

SEQ ID NO: 374297 - RNA, 22 nt, Human
ucccaguguggcaggccaugga

SEQ ID NO: 374298 - RNA, 22 nt, Human
ucaguuuccucaucuacaaaag

SEQ ID NO: 374299 - RNA, 22 nt, Human
cacaggagguuaggaagugguc

SEQ ID NO: 374300 - RNA, 22 nt, Human
cuggccuagcucucugcuugaa

SEQ ID NO: 374301 - RNA, 22 nt, Human
uccagggaugguaaugagcagu

SEQ ID NO: 374302 - RNA, 22 nt, Human
cagcagugaugugugaggguuc

SEQ ID NO: 374303 - RNA, 22 nt, Human
ccucugagaccagcucugcacc

SEQ ID NO: 374304 - RNA, 22 nt, Human
agaaggcacucacacuggcacg

SEQ ID NO: 374305 - RNA, 22 nt, Human
cucuggaauuaaggaagccugu

SEQ ID NO: 374306 - RNA, 22 nt, Human
guuauguaugggggccuuauga

SEQ ID NO: 374307 - RNA, 22 nt, Human
caguauuuauggcuugaguauu

SEQ ID NO: 374308 - RNA, 22 nt, Human
acagugcuaaacacuucuugaa

SEQ ID NO: 374309 - RNA, 20 nt, Human
acuggagccaucucagccua

SEQ ID NO: 374310 - RNA, 22 nt, Human
aacaugaaaagcccagagaggu

SEQ ID NO: 374311 - RNA, 22 nt, Human
auuucacucuuaauugcuuccu

SEQ ID NO: 374312 - RNA, 22 nt, Human
uucucuuaucuggcauuauugg

SEQ ID NO: 374313 - RNA, 22 nt, Human
gcauguguuauuuuauguauga

SEQ ID NO: 374314 - RNA, 22 nt, Human
guuguauagagggcaugaaucu

SEQ ID NO: 374315 - RNA, 22 nt, Human
auguaauaggguaacauaacau

SEQ ID NO: 374316 - RNA, 22 nt, Human
gcuguucacauuuugggccaaa

SEQ ID NO: 374317 - RNA, 22 nt, Human
agcagggcucuguggagggugg

SEQ ID NO: 374318 - RNA, 23 nt, Human
ccuucagaagaaguaacaggggc

SEQ ID NO: 374319 - RNA, 22 nt, Human
uagaaacauguucuguucuguu

SEQ ID NO: 374320 - RNA, 22 nt, Human
ugcagcauucuuggccacuacu

SEQ ID NO: 374321 - RNA, 22 nt, Human
uugucccaggacuugcauagau

SEQ ID NO: 374322 - RNA, 23 nt, Human
ucagaggaucaucaaacguuuuc

SEQ ID NO: 374323 - RNA, 22 nt, Human
gccuggcuccuaagagcacaac

SEQ ID NO: 374324 - RNA, 22 nt, Human
aggccugaaguguggagugggg

SEQ ID NO: 374325 - RNA, 22 nt, Human
aucaggaucugggagccugaaa

SEQ ID NO: 374326 - RNA, 22 nt, Human
uccaugagaacccuuggagaua

SEQ ID NO: 374327 - RNA, 21 nt, Human
uguccuuaaugcaauguccuu

SEQ ID NO: 374328 - RNA, 22 nt, Human
cuggaaggcucugcugccuguc

SEQ ID NO: 374329 - RNA, 21 nt, Human
ccagcugucuguccuuaggca

SEQ ID NO: 374330 - RNA, 22 nt, Human
uugaggagucaggggcacggaa

SEQ ID NO: 374331 - RNA, 17 nt, Human
agcugaccagauggacu

SEQ ID NO: 374332 - RNA, 22 nt, Human
guacauaaaggaggcucuuugc

SEQ ID NO: 374333 - RNA, 22 nt, Human
ucucucuucaacccuuaacuag

SEQ ID NO: 374334 - RNA, 22 nt, Human
uuaauucagucaaagaaaccau

SEQ ID NO: 374335 - RNA, 22 nt, Human
acagccugagaguggagcuggc

SEQ ID NO: 374336 - RNA, 22 nt, Human
ccagggaguuuccaaucugaga

SEQ ID NO: 374337 - RNA, 22 nt, Human
cagcucugggugacaggagggc

SEQ ID NO: 374338 - RNA, 22 nt, Human
ucacacguccuugcuacuccuc

SEQ ID NO: 374339 - RNA, 22 nt, Human
ucucuuucuauaugugagucuu

SEQ ID NO: 374340 - RNA, 22 nt, Human
ucccagagguugagucacuuau

SEQ ID NO: 374341 - RNA, 22 nt, Human
ugccugucuuggaguccuggcc

SEQ ID NO: 374342 - RNA, 22 nt, Human
cagcucccuauggugaggcgac

SEQ ID NO: 374343 - RNA, 23 nt, Human
ccugggcauuggcugcagcuucu

SEQ ID NO: 374344 - RNA, 22 nt, Human
cuguuucaagugaagucagaca

SEQ ID NO: 374345 - RNA, 22 nt, Human
aaguggugguaugaaccgaggg

SEQ ID NO: 374346 - RNA, 22 nt, Human
cccagggaagccauuucugacu

SEQ ID NO: 374347 - RNA, 22 nt, Human
ucuggaucgccggcgccugggc

SEQ ID NO: 374348 - RNA, 22 nt, Human
aggcuccaugcaaaggcuguuu

SEQ ID NO: 374349 - RNA, 22 nt, Human
cugagauggccacugggucuca

SEQ ID NO: 374350 - RNA, 22 nt, Human
aagauuucuuacuuauugaugc

SEQ ID NO: 374351 - RNA, 17 nt, Human
gccuuccuuccuccaca

SEQ ID NO: 374352 - RNA, 22 nt, Human
gugaauaauuuuuuaguauaag

SEQ ID NO: 374353 - RNA, 20 nt, Human
agugcaagaaagcacagcug

SEQ ID NO: 374354 - RNA, 22 nt, Human
cucuggagguugagcccagcaa

SEQ ID NO: 374355 - RNA, 22 nt, Human
gggcugugggacccggcacuuu

SEQ ID NO: 374356 - RNA, 22 nt, Human
cagcagagcugugugggaaggg

SEQ ID NO: 374357 - RNA, 22 nt, Human
cauuugcauaugaagaaguaag

SEQ ID NO: 374358 - RNA, 22 nt, Human
gcugucuggguugagggcccug

SEQ ID NO: 374359 - RNA, 22 nt, Human
uaugcacgucuauuuaugaaga

SEQ ID NO: 374360 - RNA, 22 nt, Human
aagugguaggaagagagcacug

SEQ ID NO: 374361 - RNA, 22 nt, Human
guguccaucagcagccacugug

SEQ ID NO: 374362 - RNA, 22 nt, Human
uccuugaagagugggcggucga

SEQ ID NO: 374363 - RNA, 22 nt, Human
uccaggcaggguuaaggguccu

SEQ ID NO: 374364 - RNA, 22 nt, Human
cagagcugggaucccaugggcg

SEQ ID NO: 374365 - RNA, 22 nt, Human
gugccuggagcuaauguguaua

SEQ ID NO: 374366 - RNA, 22 nt, Human
cucagaguccauaguuuacagu

SEQ ID NO: 374367 - RNA, 22 nt, Human
aagagcuggcucuugcagcagc

SEQ ID NO: 374368 - RNA, 22 nt, Human
uaaggccauuauggugggcccg

SEQ ID NO: 374369 - RNA, 22 nt, Human
cugcugugauugggagaaaccg

SEQ ID NO: 374370 - RNA, 22 nt, Human
gcuggaucaaguccuucaccca

SEQ ID NO: 374371 - RNA, 22 nt, Human
gcaggaaagguugagacuuugc

SEQ ID NO: 374372 - RNA, 22 nt, Human
ccagcuggugacauccccaacc

SEQ ID NO: 374373 - RNA, 22 nt, Human
gcagcugcaauaggcaucaagc

SEQ ID NO: 374374 - RNA, 22 nt, Human
cccugcagugugaccucaccua

SEQ ID NO: 374375 - RNA, 22 nt, Human
aguuccagcugugaccagaaaa

SEQ ID NO: 374376 - RNA, 22 nt, Human
aguguccccuacagaggcauuc

SEQ ID NO: 374377 - RNA, 22 nt, Human
uaauuauuaugacaacaauugc

SEQ ID NO: 374378 - RNA, 22 nt, Human
uuugcaaauaccaugaaacuug

SEQ ID NO: 374379 - RNA, 22 nt, Human
ugagcuuacgugggaacagacu

SEQ ID NO: 374380 - RNA, 22 nt, Human
uuagacaagggcuccuuaaaag

SEQ ID NO: 374381 - RNA, 22 nt, Human
ugaauaaucauguccauagugu

SEQ ID NO: 374382 - RNA, 22 nt, Human
uucaggaucacuaaacccucca

SEQ ID NO: 374383 - RNA, 22 nt, Human
ggaggaagcacacggcuuguau

SEQ ID NO: 374384 - RNA, 22 nt, Human
aaugcacaugccacauguggua

SEQ ID NO: 374385 - RNA, 22 nt, Human
gccaggaggucagccccucaac

SEQ ID NO: 374386 - RNA, 22 nt, Human
ugaagacagaccaaggagaaug

SEQ ID NO: 374387 - RNA, 22 nt, Human
gcucccacaaccuucuugcucc

SEQ ID NO: 374388 - RNA, 22 nt, Human
ugaagaauaagauagauggagc

SEQ ID NO: 374389 - RNA, 22 nt, Human
aggcccuguuaugagccacugu

SEQ ID NO: 374390 - RNA, 22 nt, Human
ggggauggaggcgugugguccu

SEQ ID NO: 374391 - RNA, 22 nt, Human
ggguggggcccaggaaaucuau

SEQ ID NO: 374392 - RNA, 22 nt, Human
gugcucaggaagcuguuccugc

SEQ ID NO: 374393 - RNA, 22 nt, Human
aagggcaggaaaagauggaugu

SEQ ID NO: 374394 - RNA, 22 nt, Human
gccuggguccacugaucaugcu

SEQ ID NO: 374395 - RNA, 22 nt, Human
auucuucauguugaagcuguca

SEQ ID NO: 374396 - RNA, 22 nt, Human
ugggcuggagcuuguugcuucc

SEQ ID NO: 374397 - RNA, 22 nt, Human
guuccaaagcaaaggaggugag

SEQ ID NO: 374398 - RNA, 22 nt, Human
gcaggaugaaggcagaggcuga

SEQ ID NO: 374399 - RNA, 22 nt, Human
ugaaauagaaaaacaggcuucu

SEQ ID NO: 374400 - RNA, 22 nt, Human
ugcuagaauaccuaccuggagg

SEQ ID NO: 374401 - RNA, 19 nt, Human
aaggcagcaguagcaucca

SEQ ID NO: 374402 - RNA, 22 nt, Human
ugcauauuuguaugauguuuag

SEQ ID NO: 374403 - RNA, 22 nt, Human
guuauaaaggugauaaugguca

SEQ ID NO: 374404 - RNA, 22 nt, Human
ucagccagugccuugaucuugc

SEQ ID NO: 374405 - RNA, 22 nt, Human
ccacugcccaccccgacgucua

SEQ ID NO: 374406 - RNA, 19 nt, Human
ccagagcccgccagauggg

SEQ ID NO: 374407 - RNA, 22 nt, Human
gggcugcugcccaggaggcacc

SEQ ID NO: 374408 - RNA, 17 nt, Human
agcagaagucagaggga

SEQ ID NO: 374409 - RNA, 20 nt, Human
agcuggagaagggcccuucc

SEQ ID NO: 374410 - RNA, 22 nt, Human
ggugacuggagggacccaggcc

SEQ ID NO: 374411 - RNA, 22 nt, Human
gccugccuagaauugcagcuuu

SEQ ID NO: 374412 - RNA, 22 nt, Human
uccugggagagugggacuguau

SEQ ID NO: 374413 - RNA, 22 nt, Human
gcugucuugcucacucuugcag

SEQ ID NO: 374414 - RNA, 22 nt, Human
uuuguacauccuaauucugagu

SEQ ID NO: 374415 - RNA, 22 nt, Human
cucucccagucaggcucaggau

SEQ ID NO: 374416 - RNA, 22 nt, Human
aaguccuuucucauggaggaau

SEQ ID NO: 374417 - RNA, 22 nt, Human
guccuggggauacagaagugaa

SEQ ID NO: 374418 - RNA, 22 nt, Human
gagcagcucgagaaggaagcag

SEQ ID NO: 374419 - RNA, 22 nt, Human
aggcagcccugugcuggaugcu

SEQ ID NO: 374420 - RNA, 22 nt, Human
cuauacaguaaccacagugauu

SEQ ID NO: 374421 - RNA, 22 nt, Human
cggcagagugugugcgugcaug

SEQ ID NO: 374422 - RNA, 22 nt, Human
aaguuuaagguggaaguggugg

SEQ ID NO: 374423 - RNA, 22 nt, Human
cuucauuaaccaaaaugcaaua

SEQ ID NO: 374424 - RNA, 22 nt, Human
aaaucugggucaagguggagug

SEQ ID NO: 374425 - RNA, 22 nt, Human
gccuggcaggccucaugagggg

SEQ ID NO: 374426 - RNA, 22 nt, Human
ucagaacagaagcuggcuauaa

SEQ ID NO: 374427 - RNA, 22 nt, Human
uggaggcaccacuggcugcccg

SEQ ID NO: 374428 - RNA, 21 nt, Human
ccagcuuucccaagucccuuu

SEQ ID NO: 374429 - RNA, 22 nt, Human
gcauucaucuuccuccaugcag

SEQ ID NO: 374430 - RNA, 22 nt, Human
gaauacauuggaaaucagaaua

SEQ ID NO: 374431 - RNA, 22 nt, Human
uugcccagaguccacagcguac

SEQ ID NO: 374432 - RNA, 20 nt, Human
ugggagcuggugaggucuca

SEQ ID NO: 374433 - RNA, 22 nt, Human
ucucuucuagcuucuugugguu

SEQ ID NO: 374434 - RNA, 22 nt, Human
uggcucaguaaucgagucuccu

SEQ ID NO: 374435 - RNA, 22 nt, Human
ugucaccaaguugaugaaugca

SEQ ID NO: 374436 - RNA, 22 nt, Human
ugcugccagccaggccauggag

SEQ ID NO: 374437 - RNA, 22 nt, Human
gaaaggaaauauucuaagcacu

SEQ ID NO: 374438 - RNA, 22 nt, Human
uccaggagguugagacugcagu

SEQ ID NO: 374439 - RNA, 22 nt, Human
ucccaaggauaagagagucuga

SEQ ID NO: 374440 - RNA, 22 nt, Human
aucagaaaguucaucauguuug

SEQ ID NO: 374441 - RNA, 22 nt, Human
agaugcuucaguguuuaauuua

SEQ ID NO: 374442 - RNA, 22 nt, Human
ucccagccacagguguagcccu

SEQ ID NO: 374443 - RNA, 22 nt, Human
gaggcagugaacaauuccugug

SEQ ID NO: 374444 - RNA, 21 nt, Human
ggcagugaugugaagugcauc

SEQ ID NO: 374445 - RNA, 22 nt, Human
ggaggggagucucccaaagccg

SEQ ID NO: 374446 - RNA, 22 nt, Human
uggaagaaggcagagaggcauu

SEQ ID NO: 374447 - RNA, 22 nt, Human
gaugggcguggcgcguuuggug

SEQ ID NO: 374448 - RNA, 22 nt, Human
cugcugugugcuuacuuggguu

SEQ ID NO: 374449 - RNA, 22 nt, Human
gcuggcagaauuucuucuugcu

SEQ ID NO: 374450 - RNA, 22 nt, Human
cugagaaggaagccuccacucu

SEQ ID NO: 374451 - RNA, 22 nt, Human
ccagucagccaagcugcagcgg

SEQ ID NO: 374452 - RNA, 22 nt, Human
uggcugaguuucaugcaucaug

SEQ ID NO: 374453 - RNA, 19 nt, Human
uacauuuguguacacuugu

SEQ ID NO: 374454 - RNA, 22 nt, Human
ucagaggagggacucagaccca

SEQ ID NO: 374455 - RNA, 22 nt, Human
uccuggagcuuccuucauggua

SEQ ID NO: 374456 - RNA, 22 nt, Human
ugcagagacuugugugcauuug

SEQ ID NO: 374457 - RNA, 22 nt, Human
aaggcacugacugugcagggga

SEQ ID NO: 374458 - RNA, 22 nt, Human
gggcagugguuacacagcugag

SEQ ID NO: 374459 - RNA, 22 nt, Human
agauggagaccuuggaugaacu

SEQ ID NO: 374460 - RNA, 22 nt, Human
uacaugaaguugucuaaacugg

SEQ ID NO: 374461 - RNA, 22 nt, Human
auucuccagcucacuguccaua

SEQ ID NO: 374462 - RNA, 22 nt, Human
ucagggcagguuaacuugggug

SEQ ID NO: 374463 - RNA, 22 nt, Human
aaaucaaaagacauguguuuua

SEQ ID NO: 374464 - RNA, 22 nt, Human
cagggcaggacagauacauuac

SEQ ID NO: 374465 - RNA, 22 nt, Human
cuucagggugacgcaggcugca

SEQ ID NO: 374466 - RNA, 17 nt, Human
cugaggcccagggccca

SEQ ID NO: 374467 - RNA, 22 nt, Human
uucuuuccccauggaguucgga

SEQ ID NO: 374468 - RNA, 22 nt, Human
cucucugaggaaggagcaucug

SEQ ID NO: 374469 - RNA, 22 nt, Human
auuguacaugcagugagucauc

SEQ ID NO: 374470 - RNA, 22 nt, Human
aaaaguaauugaugcaaucgua

SEQ ID NO: 374471 - RNA, 22 nt, Human
agggccagcccauaaugccaaa

SEQ ID NO: 374472 - RNA, 22 nt, Human
cccaaggccuucaagccagcuc

SEQ ID NO: 374473 - RNA, 22 nt, Human
uggcagcugauuagauggugcc

SEQ ID NO: 374474 - RNA, 22 nt, Human
agaaaucaugacuaagagcagu

SEQ ID NO: 374475 - RNA, 22 nt, Human
agcccucugcaaacaccugaua

SEQ ID NO: 374476 - RNA, 22 nt, Human
gaaaauguuagcuucauaguca

SEQ ID NO: 374477 - RNA, 22 nt, Human
uccuucaggccucauucucaua

SEQ ID NO: 374478 - RNA, 22 nt, Human
caccuggcuggaagugcuccgg

SEQ ID NO: 374479 - RNA, 22 nt, Human
uggggcaguuaauaaacauucu

SEQ ID NO: 374480 - RNA, 22 nt, Human
aaaggccaauaaagacaagcug

SEQ ID NO: 374481 - RNA, 22 nt, Human
ccagcagagucuaggaaggagg

SEQ ID NO: 374482 - RNA, 18 nt, Human
ggagagugacagagucgu

SEQ ID NO: 374483 - RNA, 22 nt, Human
gcaaauucuuaacuggacugug

SEQ ID NO: 374484 - RNA, 22 nt, Human
cuugcacacauguacaugugua

SEQ ID NO: 374485 - RNA, 22 nt, Human
uuucacauuagauaugucauuu

SEQ ID NO: 374486 - RNA, 22 nt, Human
gcugcagcagaaguucucagag

SEQ ID NO: 374487 - RNA, 19 nt, Human
ugccagcauuaggcugaag

SEQ ID NO: 374488 - RNA, 17 nt, Human
gcacugaacaauccugu

SEQ ID NO: 374489 - RNA, 22 nt, Human
ucccagagucuucuccuguaau

SEQ ID NO: 374490 - RNA, 22 nt, Human
aaauugugcucacacugauauu

SEQ ID NO: 374491 - RNA, 22 nt, Human
uggcuucaucugcagcacugcc

SEQ ID NO: 374492 - RNA, 22 nt, Human
uaaucacaucaggguaaauggg

SEQ ID NO: 374493 - RNA, 22 nt, Human
ucaugacaucuguuuaucucaa

SEQ ID NO: 374494 - RNA, 22 nt, Human
agcagcugcagagggcuccccc

SEQ ID NO: 374495 - RNA, 22 nt, Human
ucacugcucuccaauguggagu

SEQ ID NO: 374496 - RNA, 22 nt, Human
aguugaaauuagaguccuggcu

SEQ ID NO: 374497 - RNA, 22 nt, Human
gagcaccucaauuugcuauuug

SEQ ID NO: 374498 - RNA, 22 nt, Human
uccaaagggaagcgcuuucugu

SEQ ID NO: 374499 - RNA, 22 nt, Human
agggcugagcccaggcauguag

SEQ ID NO: 374500 - RNA, 22 nt, Human
ccaaacaaauccccauucuuag

SEQ ID NO: 374501 - RNA, 22 nt, Human
acagagcacugcccugugccgc

SEQ ID NO: 374502 - RNA, 22 nt, Human
aggcuuccuggaggaagaggua

SEQ ID NO: 374503 - RNA, 22 nt, Human
aguugacauccagagacauucu

SEQ ID NO: 374504 - RNA, 22 nt, Human
uuuaggcacagaguugagggac

SEQ ID NO: 374505 - RNA, 22 nt, Human
uugcauugaaugcacauuuuua

SEQ ID NO: 374506 - RNA, 22 nt, Human
guggcaggucccauuggagcag

SEQ ID NO: 374507 - RNA, 22 nt, Human
gaaugaauagguguccagaugg

SEQ ID NO: 374508 - RNA, 22 nt, Human
cuggguaaguuccuaaggcuca

SEQ ID NO: 374509 - RNA, 22 nt, Human
agcagggcuguguagguaauga

SEQ ID NO: 374510 - RNA, 22 nt, Human
uggcagcucuguucaacaugag

SEQ ID NO: 374511 - RNA, 22 nt, Human
uaaaucacuccuaauaaucagu

SEQ ID NO: 374512 - RNA, 22 nt, Human
agccagcuggugggucagcugg

SEQ ID NO: 374513 - RNA, 22 nt, Human
uccugguggcuuucccugccuu

SEQ ID NO: 374514 - RNA, 22 nt, Human
ggaggcagaacuucccgucagu

SEQ ID NO: 374515 - RNA, 22 nt, Human
ccccaggacacauggaccaagu

SEQ ID NO: 374516 - RNA, 22 nt, Human
gggagccacagugaggugcaug

SEQ ID NO: 374517 - RNA, 22 nt, Human
uuuccaauaaagugucauuguu

SEQ ID NO: 374518 - RNA, 22 nt, Human
aggcagcaugggcccagagucc

SEQ ID NO: 374519 - RNA, 22 nt, Human
ucagaguguuuuacuaaacaag

SEQ ID NO: 374520 - RNA, 22 nt, Human
aaugaugggaaggagaaaagca

SEQ ID NO: 374521 - RNA, 22 nt, Human
uccagaggcuccaaagggagau

SEQ ID NO: 374522 - RNA, 22 nt, Human
cuccagggaaaggggcguccgc

SEQ ID NO: 374523 - RNA, 19 nt, Human
uuccaaaaucaggauuuga

SEQ ID NO: 374524 - RNA, 22 nt, Human
ugcugugcuggcggcagaggcc

SEQ ID NO: 374525 - RNA, 22 nt, Human
guuccaaagucucugagcugag

SEQ ID NO: 374526 - RNA, 22 nt, Human
augcuguggggagugaggguag

SEQ ID NO: 374527 - RNA, 22 nt, Human
aagcugaggcccauggcaaggu

SEQ ID NO: 374528 - RNA, 22 nt, Human
gcccugucccuuggcuucuagg

SEQ ID NO: 374529 - RNA, 22 nt, Human
ugcuuaaaauaguucauuuuug

SEQ ID NO: 374530 - RNA, 22 nt, Human
gugaaggcuacaagagaucaag

SEQ ID NO: 374531 - RNA, 22 nt, Human
aagugaaacauguaucucuuua

SEQ ID NO: 374532 - RNA, 21 nt, Human
acagacagggccagugucccc

SEQ ID NO: 374533 - RNA, 22 nt, Human
agggcgacaauggagagcguuu

SEQ ID NO: 374534 - RNA, 22 nt, Human
augugaaauauuaagccgagga

SEQ ID NO: 374535 - RNA, 22 nt, Human
ucucagagauucagggagaagu

SEQ ID NO: 374536 - RNA, 22 nt, Human
ggucccugcugaagccuuggug

SEQ ID NO: 374537 - RNA, 22 nt, Human
agccaguguuaagugacugguu

SEQ ID NO: 374538 - RNA, 22 nt, Human
uuauagugggcccaacauggcg

SEQ ID NO: 374539 - RNA, 22 nt, Human
uacagcuaggcaaaaaugacau

SEQ ID NO: 374540 - RNA, 22 nt, Human
auaaaaacugacccauccuuug

SEQ ID NO: 374541 - RNA, 22 nt, Human
gugucaugggagucagaaguga

SEQ ID NO: 374542 - RNA, 19 nt, Human
ggagaggcuggagggaugc

SEQ ID NO: 374543 - RNA, 22 nt, Human
ggaugcaggggcagcagagccu

SEQ ID NO: 374544 - RNA, 22 nt, Human
ucuccucucuuaccugguacaa

SEQ ID NO: 374545 - RNA, 22 nt, Human
cagggagcuggcuggcugugcc

SEQ ID NO: 374546 - RNA, 22 nt, Human
acagguggagugguuagcaggc

SEQ ID NO: 374547 - RNA, 22 nt, Human
agcaauaugacauugcuacauc

SEQ ID NO: 374548 - RNA, 22 nt, Human
gugcaggggaucagguugcagc

SEQ ID NO: 374549 - RNA, 22 nt, Human
aggcaggcucaaugcccagucu

SEQ ID NO: 374550 - RNA, 22 nt, Human
aucacaaaggcugcuucaugau

SEQ ID NO: 374551 - RNA, 22 nt, Human
ggccuguccagccugccuggcu

SEQ ID NO: 374552 - RNA, 22 nt, Human
ggugcagaucuuucucuucagg

SEQ ID NO: 374553 - RNA, 22 nt, Human
cccuggaggcuggaggcaguag

SEQ ID NO: 374554 - RNA, 22 nt, Human
aagcuuuaugacuuggagacag

SEQ ID NO: 374555 - RNA, 22 nt, Human
uuauuuauggcccucaccugau

SEQ ID NO: 374556 - RNA, 22 nt, Human
cuggagaggcugggaacagguu

SEQ ID NO: 374557 - RNA, 22 nt, Human
ucuccucuauuucuguauguau

SEQ ID NO: 374558 - RNA, 22 nt, Human
guuugcauaucugugaaaugga

SEQ ID NO: 374559 - RNA, 22 nt, Human
ugcaggagcugugcggugaggg

SEQ ID NO: 374560 - RNA, 22 nt, Human
ccucugaguccucccugguugc

SEQ ID NO: 374561 - RNA, 22 nt, Human
ggugggcaacauuuggccugag

SEQ ID NO: 374562 - RNA, 22 nt, Human
cugagcugcucccgcugcagcg

SEQ ID NO: 374563 - RNA, 20 nt, Human
gacaucauguacacauugcc

SEQ ID NO: 374564 - RNA, 22 nt, Human
cugagcaggauauucacagcag

SEQ ID NO: 374565 - RNA, 22 nt, Human
gagcagcuagauaaagcccuuc

SEQ ID NO: 374566 - RNA, 22 nt, Human
gaggcagagguuguugcaguga

SEQ ID NO: 374567 - RNA, 22 nt, Human
ccagagagauugcuucuaaaga

SEQ ID NO: 374568 - RNA, 22 nt, Human
gugcuuccaucuagagggucac

SEQ ID NO: 374569 - RNA, 22 nt, Human
ccagcucuuuuggcugagugag

SEQ ID NO: 374570 - RNA, 22 nt, Human
cuuaaagaguauuuaauauaau

SEQ ID NO: 374571 - RNA, 22 nt, Human
caucaaauggcaagugaaagcu

SEQ ID NO: 374572 - RNA, 22 nt, Human
aguuugaauugaaaugcagaug

SEQ ID NO: 374573 - RNA, 22 nt, Human
uuauacauguguuuugagauga

SEQ ID NO: 374574 - RNA, 19 nt, Human
auggaaaaugccagacuga

SEQ ID NO: 374575 - RNA, 22 nt, Human
uggcugagagcaauugacucug

SEQ ID NO: 374576 - RNA, 22 nt, Human
aauauaaauuccugggcccagc

SEQ ID NO: 374577 - RNA, 17 nt, Human
uguagcuucuccuucuc

SEQ ID NO: 374578 - RNA, 22 nt, Human
ugucucagauacgccaucaagg

SEQ ID NO: 374579 - RNA, 18 nt, Human
ugucauugccagggaagc

SEQ ID NO: 374580 - RNA, 23 nt, Human
ugugaagguggguccaagggcug

SEQ ID NO: 374581 - RNA, 22 nt, Human
ugucauugaggaaaacuaggug

SEQ ID NO: 374582 - RNA, 22 nt, Human
guucuucaucuuaaccaucugu

SEQ ID NO: 374583 - RNA, 22 nt, Human
uaacacugauuuguucucaggg

SEQ ID NO: 374584 - RNA, 23 nt, Human
aagaauaaaugacauuaaaggug

SEQ ID NO: 374585 - RNA, 22 nt, Human
cagcuuuauuaaugauugucuu

SEQ ID NO: 374586 - RNA, 22 nt, Human
aggacagcaguuggugagguuc

SEQ ID NO: 374587 - RNA, 22 nt, Human
cagagccccccuucugaucaca

SEQ ID NO: 374588 - RNA, 22 nt, Human
gcuggccucgcaggcaggaugu

SEQ ID NO: 374589 - RNA, 22 nt, Human
ugccuacauuccuugcuuaugg

SEQ ID NO: 374590 - RNA, 21 nt, Human
cccaggaggagcuccggcucc

SEQ ID NO: 374591 - RNA, 22 nt, Human
acguuuucagugacugugcuuc

SEQ ID NO: 374592 - RNA, 22 nt, Human
acagcagagugugagauagcca

SEQ ID NO: 374593 - RNA, 22 nt, Human
agagaggcgaguuaccugugcu

SEQ ID NO: 374594 - RNA, 22 nt, Human
ucccugggcuucuccagacuug

SEQ ID NO: 374595 - RNA, 22 nt, Human
gaggggcugggcagucccugga

SEQ ID NO: 374596 - RNA, 22 nt, Human
ccuccugggacaggcuggcaca

SEQ ID NO: 374597 - RNA, 18 nt, Human
aggagccuuugcacugga

SEQ ID NO: 374598 - RNA, 22 nt, Human
gggagccaugcuggucuucuuu

SEQ ID NO: 374599 - RNA, 22 nt, Human
agucauuuugccagucuucagg

SEQ ID NO: 374600 - RNA, 22 nt, Human
ggcaccagccaccuauuucuag

SEQ ID NO: 374601 - RNA, 22 nt, Human
uguucccauuuucugcauaauc

SEQ ID NO: 374602 - RNA, 22 nt, Human
cguguggucccggcaaggcaag

SEQ ID NO: 374603 - RNA, 23 nt, Human
gcagaggagcaagcuggacacca

SEQ ID NO: 374604 - RNA, 21 nt, Human
acaugucucuaaucucaguga

SEQ ID NO: 374605 - RNA, 22 nt, Human
aagaugcacaauguggcaauua

SEQ ID NO: 374606 - RNA, 22 nt, Human
aaaagguuuugaguacaaauau

SEQ ID NO: 374607 - RNA, 22 nt, Human
agcauuuaugacuaauguaaaa

SEQ ID NO: 374608 - RNA, 20 nt, Human
cagaggcaaggagacuugga

SEQ ID NO: 374609 - RNA, 22 nt, Human
auaugcuugggacugauacagu

SEQ ID NO: 374610 - RNA, 22 nt, Human
gcagcauuaccaagacauggca

SEQ ID NO: 374611 - RNA, 22 nt, Human
gcucccaggcauggagguaauu

SEQ ID NO: 374612 - RNA, 22 nt, Human
ccugucugcaugagugagcaua

SEQ ID NO: 374613 - RNA, 22 nt, Human
aucugguuuggggauccuugug

SEQ ID NO: 374614 - RNA, 22 nt, Human
acaggacaggcugggcuagacu

SEQ ID NO: 374615 - RNA, 22 nt, Human
gggcuguaggagcuggaauggg

SEQ ID NO: 374616 - RNA, 22 nt, Human
gggccugugcacaguucuguua

SEQ ID NO: 374617 - RNA, 22 nt, Human
caguacuugggaaugcugggga

SEQ ID NO: 374618 - RNA, 22 nt, Human
cuccaggaaagccugaggcccg

SEQ ID NO: 374619 - RNA, 22 nt, Human
acugugugggccgcucacuggg

SEQ ID NO: 374620 - RNA, 22 nt, Human
aaucaguuguucacucugaaaa

SEQ ID NO: 374621 - RNA, 22 nt, Human
uggcaugauaggaggugcagaa

SEQ ID NO: 374622 - RNA, 20 nt, Human
acagccagaggaggcagaca

SEQ ID NO: 374623 - RNA, 22 nt, Human
aaaugcauuuuuaauuagaccc

SEQ ID NO: 374624 - RNA, 22 nt, Human
augcagcaguuuacaaagcaau

SEQ ID NO: 374625 - RNA, 20 nt, Human
uccagcugggaacagcugau

SEQ ID NO: 374626 - RNA, 22 nt, Human
cugcugugcuuguggccacccg

SEQ ID NO: 374627 - RNA, 18 nt, Human
guaggucaguaccaagca

SEQ ID NO: 374628 - RNA, 22 nt, Human
ugaaaguugcacauaagagaau

SEQ ID NO: 374629 - RNA, 22 nt, Human
ggccagcucuuguccacggagg

SEQ ID NO: 374630 - RNA, 22 nt, Human
caggagggcccgagacucuucc

SEQ ID NO: 374631 - RNA, 22 nt, Human
cccccaggcucugacacaggag

SEQ ID NO: 374632 - RNA, 22 nt, Human
cucaggauguacuacagaaggc

SEQ ID NO: 374633 - RNA, 22 nt, Human
gcagcccagguguagcucuuug

SEQ ID NO: 374634 - RNA, 22 nt, Human
aaacuuuguagagaaugcuggc

SEQ ID NO: 374635 - RNA, 22 nt, Human
uuaauuaugcaaaaggccccau

SEQ ID NO: 374636 - RNA, 22 nt, Human
cugcucuguuucuuagcugggu

SEQ ID NO: 374637 - RNA, 22 nt, Human
uugcacauuuccuagaauuuca

SEQ ID NO: 374638 - RNA, 20 nt, Human
gauuucaaagcagaguggcc

SEQ ID NO: 374639 - RNA, 17 nt, Human
gcuuccugugcugggga

SEQ ID NO: 374640 - RNA, 22 nt, Human
uccagccuaauguucuucccac

SEQ ID NO: 374641 - RNA, 20 nt, Human
ucucagcauaagaacccuuc

SEQ ID NO: 374642 - RNA, 22 nt, Human
gcagggcagcucacugugguuc

SEQ ID NO: 374643 - RNA, 22 nt, Human
cugaacuuauugagugcuugcu

SEQ ID NO: 374644 - RNA, 22 nt, Human
aggcagaaaauagucauccaaa

SEQ ID NO: 374645 - RNA, 22 nt, Human
gccugggagggcagcagugugg

SEQ ID NO: 374646 - RNA, 22 nt, Human
gggacuucauagcuaggcacuu

SEQ ID NO: 374647 - RNA, 22 nt, Human
gacaucauagggugggaggaaa

SEQ ID NO: 374648 - RNA, 22 nt, Human
acagcugugagggucacuugua

SEQ ID NO: 374649 - RNA, 22 nt, Human
ucagaauugcagggagggcagg

SEQ ID NO: 374650 - RNA, 22 nt, Human
agaggauguucuaggcacucau

SEQ ID NO: 374651 - RNA, 22 nt, Human
accaaagggcagaacaugagca

SEQ ID NO: 374652 - RNA, 22 nt, Human
ugucauguguucuuaaauacau

SEQ ID NO: 374653 - RNA, 22 nt, Human
gggcagauggggcacaggcuga

SEQ ID NO: 374654 - RNA, 22 nt, Human
gaggcugcggggaggagccugc

SEQ ID NO: 374655 - RNA, 22 nt, Human
ucaggagcugcacugggcccac

SEQ ID NO: 374656 - RNA, 22 nt, Human
cacauuuagagguuagcauggu

SEQ ID NO: 374657 - RNA, 22 nt, Human
ugugggcacuaaugacaugcag

SEQ ID NO: 374658 - RNA, 22 nt, Human
uauuaaagggaaguuaugcaug

SEQ ID NO: 374659 - RNA, 22 nt, Human
uagaugcuacaauuuuguacuc

SEQ ID NO: 374660 - RNA, 21 nt, Human
aagaagcaauuuauuggaagg

SEQ ID NO: 374661 - RNA, 22 nt, Human
aggccaggcaacauucugaagu

SEQ ID NO: 374662 - RNA, 22 nt, Human
gcccucagcuccuggacacaug

SEQ ID NO: 374663 - RNA, 22 nt, Human
auucuucaucagagaugcacua

SEQ ID NO: 374664 - RNA, 22 nt, Human
cccaggagagggaaccaaaugu

SEQ ID NO: 374665 - RNA, 22 nt, Human
guuccaaaguuagaguguauug

SEQ ID NO: 374666 - RNA, 22 nt, Human
cagcccugccauggagccuccu

SEQ ID NO: 374667 - RNA, 22 nt, Human
ggcagaggaggggugaauuugc

SEQ ID NO: 374668 - RNA, 22 nt, Human
cugggaguguucuaggucacau

SEQ ID NO: 374669 - RNA, 22 nt, Human
cugccacuuacuaggcauggug

SEQ ID NO: 374670 - RNA, 18 nt, Human
agaggggagguaagucug

SEQ ID NO: 374671 - RNA, 22 nt, Human
agucucagccacacagaccuau

SEQ ID NO: 374672 - RNA, 22 nt, Human
aggcgcaggguuuggacccagg

SEQ ID NO: 374673 - RNA, 22 nt, Human
acagcuuuuaugggaccagcca

SEQ ID NO: 374674 - RNA, 22 nt, Human
caggagaggcuguacguuucuc

SEQ ID NO: 374675 - RNA, 22 nt, Human
auugaaagaguuuucugcugca

SEQ ID NO: 374676 - RNA, 22 nt, Human
uggcucaguuucugcccagcug

SEQ ID NO: 374677 - RNA, 22 nt, Human
aaaugccucugcuguacacaau

SEQ ID NO: 374678 - RNA, 22 nt, Human
uggcacugagcagccgcggcag

SEQ ID NO: 374679 - RNA, 22 nt, Human
augcaacaaaugcuacgaaucg

SEQ ID NO: 374680 - RNA, 22 nt, Human
cagcugccugucuggaggcaau

SEQ ID NO: 374681 - RNA, 22 nt, Human
ucagggacugcagagggaagcu

SEQ ID NO: 374682 - RNA, 16 nt, Human
uuuccaaagggcagcu

SEQ ID NO: 374683 - RNA, 22 nt, Human
uccucuggcucuuucccuagga

SEQ ID NO: 374684 - RNA, 22 nt, Human
caaaugcagauucaggaguucu

SEQ ID NO: 374685 - RNA, 22 nt, Human
acuuccuguguuggucuugcug

SEQ ID NO: 374686 - RNA, 18 nt, Human
aggcaggcuggagugacu

SEQ ID NO: 374687 - RNA, 22 nt, Human
uuggcaggaauauugcagaggu

SEQ ID NO: 374688 - RNA, 23 nt, Human
uugugggcagauuccauggggag

SEQ ID NO: 374689 - RNA, 22 nt, Human
agaagccaaaugccagugaccu

SEQ ID NO: 374690 - RNA, 19 nt, Human
ggcugccuggagcgagggc

SEQ ID NO: 374691 - RNA, 22 nt, Human
aggauuuaccgucauuuagucu

SEQ ID NO: 374692 - RNA, 19 nt, Human
ugaaauggcaguugcuaaa

SEQ ID NO: 374693 - RNA, 22 nt, Human
uuccaggaauucagcucucagu

SEQ ID NO: 374694 - RNA, 22 nt, Human
caguccuuucaauggugaccuu

SEQ ID NO: 374695 - RNA, 22 nt, Human
agaguuaagacguacaugagug

SEQ ID NO: 374696 - RNA, 22 nt, Human
agaucaaagccaugagagauuu

SEQ ID NO: 374697 - RNA, 22 nt, Human
gcagccagaagacucagaacaa

SEQ ID NO: 374698 - RNA, 22 nt, Human
ugggagaugguucugagacuuu

SEQ ID NO: 374699 - RNA, 22 nt, Human
gcccauggcagaacugugagca

SEQ ID NO: 374700 - RNA, 22 nt, Human
ucauuuaauagcuuuugucuuu

SEQ ID NO: 374701 - RNA, 22 nt, Human
guacucucuugaaggccuuucu

SEQ ID NO: 374702 - RNA, 22 nt, Human
ugcagaagaaugagcuuggagu

SEQ ID NO: 374703 - RNA, 22 nt, Human
uuauggcauauuccucauugua

SEQ ID NO: 374704 - RNA, 22 nt, Human
cagguggcaugacugccuacaa

SEQ ID NO: 374705 - RNA, 20 nt, Human
caucaucacaugagccaauu

SEQ ID NO: 374706 - RNA, 22 nt, Human
ugggcagacgcuguuggaaggc

SEQ ID NO: 374707 - RNA, 22 nt, Human
ugaagccacacuagcuuguccu

SEQ ID NO: 374708 - RNA, 22 nt, Human
gagcagggccacuucuguaccu

SEQ ID NO: 374709 - RNA, 22 nt, Human
augggagugacagggccacugg

SEQ ID NO: 374710 - RNA, 22 nt, Human
guucuucaaagugacaacuaaa

SEQ ID NO: 374711 - RNA, 22 nt, Human
ccugcagguaaggcuaacugcc

SEQ ID NO: 374712 - RNA, 22 nt, Human
caagaaggcuauaugggccagg

SEQ ID NO: 374713 - RNA, 22 nt, Human
ugagugccugaacauagaguag

SEQ ID NO: 374714 - RNA, 22 nt, Human
auggaaagccaguguuccauca

SEQ ID NO: 374715 - RNA, 20 nt, Human
agaaaucagaccacacacua

SEQ ID NO: 374716 - RNA, 22 nt, Human
uugaacauuggcaauuucauau

SEQ ID NO: 374717 - RNA, 22 nt, Human
uugccuugauucuucucaugug

SEQ ID NO: 374718 - RNA, 22 nt, Human
uucaacccaaguucuccauuuu

SEQ ID NO: 374719 - RNA, 22 nt, Human
agugucugccaacugcaugguc

SEQ ID NO: 374720 - RNA, 22 nt, Human
cuccagugagcgcggggcaugg

SEQ ID NO: 374721 - RNA, 22 nt, Human
cuauuagguuggugcaaaagua

SEQ ID NO: 374722 - RNA, 22 nt, Human
agugucugaaccaccggggcau

SEQ ID NO: 374723 - RNA, 22 nt, Human
ccuggggagaagagcuuccccc

SEQ ID NO: 374724 - RNA, 22 nt, Human
uuagaaaauuugcuucuuugga

SEQ ID NO: 374725 - RNA, 21 nt, Human
gugucaugguugacuuuggca

SEQ ID NO: 374726 - RNA, 22 nt, Human
ucuuugaauuucugacugucuu

SEQ ID NO: 374727 - RNA, 22 nt, Human
gucauucuuaacaacucaguag

SEQ ID NO: 374728 - RNA, 22 nt, Human
agagcugggugaagugccauca

SEQ ID NO: 374729 - RNA, 22 nt, Human
uucagaaagguaaauggauuuc

SEQ ID NO: 374730 - RNA, 22 nt, Human
uccuccucuaucagacagugcc

SEQ ID NO: 374731 - RNA, 22 nt, Human
ccaguugguuucaaugggacag

SEQ ID NO: 374732 - RNA, 20 nt, Human
uugauaggcagcuugucagg

SEQ ID NO: 374733 - RNA, 22 nt, Human
ucacaggcuugugaacauugca

SEQ ID NO: 374734 - RNA, 22 nt, Human
gagccugaauuugaccugcuua

SEQ ID NO: 374735 - RNA, 22 nt, Human
auauacugauagcugcacuucu

SEQ ID NO: 374736 - RNA, 22 nt, Human
cccacaggcuagggguagggca

SEQ ID NO: 374737 - RNA, 22 nt, Human
accuugaugccuuuccaagaug

SEQ ID NO: 374738 - RNA, 22 nt, Human
uggcagcuauuacaaggaaguc

SEQ ID NO: 374739 - RNA, 22 nt, Human
ugaguagcggcuauguguaacu

SEQ ID NO: 374740 - RNA, 22 nt, Human
cagacccucgggugaguuggcc

SEQ ID NO: 374741 - RNA, 22 nt, Human
auuugucugcuugcugccuucc

SEQ ID NO: 374742 - RNA, 22 nt, Human
aggcagugcugugcccugaacc

SEQ ID NO: 374743 - RNA, 22 nt, Human
gcccaggcuagcguagagugca

SEQ ID NO: 374744 - RNA, 22 nt, Human
ugugaaagagucuuauaguuuc

SEQ ID NO: 374745 - RNA, 22 nt, Human
ggaucugauuaauaagguggac

SEQ ID NO: 374746 - RNA, 20 nt, Human
cugccuggaggccucuaccu

SEQ ID NO: 374747 - RNA, 22 nt, Human
uguuuaaucuauaaaauggaga

SEQ ID NO: 374748 - RNA, 22 nt, Human
aggcgcagaaggccaggggccu

SEQ ID NO: 374749 - RNA, 22 nt, Human
uuuccaaagguggcaggaacaa

SEQ ID NO: 374750 - RNA, 22 nt, Human
uuacagaaucuacucgugguga

SEQ ID NO: 374751 - RNA, 16 nt, Human
cagaguguaaacagga

SEQ ID NO: 374752 - RNA, 22 nt, Human
uauuuucuggacagucuugcuu

SEQ ID NO: 374753 - RNA, 22 nt, Human
agggaguguaaauggugcucag

SEQ ID NO: 374754 - RNA, 22 nt, Human
gcagccacugggagugcuuaua

SEQ ID NO: 374755 - RNA, 22 nt, Human
uguucucacuggaugcuucaca

SEQ ID NO: 374756 - RNA, 22 nt, Human
aggccuggccuuuauguucaag

SEQ ID NO: 374757 - RNA, 20 nt, Human
gucagugucuucaguaguga

SEQ ID NO: 374758 - RNA, 18 nt, Human
cacaggcucccagugagg

SEQ ID NO: 374759 - RNA, 22 nt, Human
uuuuaauacugcuauuguagga

SEQ ID NO: 374760 - RNA, 22 nt, Human
uuggagcccugaggaucuggau

SEQ ID NO: 374761 - RNA, 22 nt, Human
ucuuuaauauaaaggaaugaau

SEQ ID NO: 374762 - RNA, 22 nt, Human
aaaggucagcugccaucguucu

SEQ ID NO: 374763 - RNA, 22 nt, Human
uacuaucucuucuaacuucaga

SEQ ID NO: 374764 - RNA, 22 nt, Human
agggauggaagcucgucugcaa

SEQ ID NO: 374765 - RNA, 22 nt, Human
agagcugcccacacagcagauu

SEQ ID NO: 374766 - RNA, 18 nt, Human
gagcugggagaaggaagg

SEQ ID NO: 374767 - RNA, 22 nt, Human
cacaguggauugggugaugccc

SEQ ID NO: 374768 - RNA, 22 nt, Human
ccagcuuucucagaggcuucua

SEQ ID NO: 374769 - RNA, 22 nt, Human
gcacccagcccagggcgugaug

SEQ ID NO: 374770 - RNA, 22 nt, Human
agaaaucacaggaggcagaagg

SEQ ID NO: 374771 - RNA, 22 nt, Human
acuggcugaaguuuacuuuuug

SEQ ID NO: 374772 - RNA, 22 nt, Human
agaggcugggaaggguccccgg

SEQ ID NO: 374773 - RNA, 22 nt, Human
ugccugucuucaggagugucac

SEQ ID NO: 374774 - RNA, 22 nt, Human
aggcagauuacuugaggccagg

SEQ ID NO: 374775 - RNA, 22 nt, Human
caugggcuacagaagcaugcug

SEQ ID NO: 374776 - RNA, 22 nt, Human
caggauggucucgaucuccuga

SEQ ID NO: 374777 - RNA, 20 nt, Human
cuguggcaucugucauggug

SEQ ID NO: 374778 - RNA, 22 nt, Human
ggcagcaggagccaucugguag

SEQ ID NO: 374779 - RNA, 22 nt, Human
uuucacaaugcaauccuacuuc

SEQ ID NO: 374780 - RNA, 22 nt, Human
ggaggugguggcagugacaauu

SEQ ID NO: 374781 - RNA, 21 nt, Human
uuuauguacuucauagaguag

SEQ ID NO: 374782 - RNA, 22 nt, Human
ucaugcuuauugcauauuugga

SEQ ID NO: 374783 - RNA, 22 nt, Human
aggcaggagugacccugacagg

SEQ ID NO: 374784 - RNA, 22 nt, Human
cuaaaugcccuacaaugacugg

SEQ ID NO: 374785 - RNA, 22 nt, Human
ggcucugcuggauugaggccag

SEQ ID NO: 374786 - RNA, 22 nt, Human
acagggcagaaauguugcaucu

SEQ ID NO: 374787 - RNA, 23 nt, Human
uacuuaggguuuagaucugacug

SEQ ID NO: 374788 - RNA, 22 nt, Human
uaauuuuaacugugcuguuugg

SEQ ID NO: 374789 - RNA, 22 nt, Human
agcagcuggggccugugacgau

SEQ ID NO: 374790 - RNA, 22 nt, Human
gaggccaaucaauagggcaaua

SEQ ID NO: 374791 - RNA, 22 nt, Human
aauuauauuguggugugaaugu

SEQ ID NO: 374792 - RNA, 22 nt, Human
gcugccuccugaaagcgcucug

SEQ ID NO: 374793 - RNA, 22 nt, Human
ugucccaggcugaaguacagug

SEQ ID NO: 374794 - RNA, 22 nt, Human
uagcccagagucccaauuccag

SEQ ID NO: 374795 - RNA, 22 nt, Human
uauguacauguuaaagggcaaa

SEQ ID NO: 374796 - RNA, 22 nt, Human
cugggccugggaggccaggucu

SEQ ID NO: 374797 - RNA, 22 nt, Human
caggaggaaaugugacccugcu

SEQ ID NO: 374798 - RNA, 22 nt, Human
aggcucagaggugagcaucugc

SEQ ID NO: 374799 - RNA, 22 nt, Human
gucacacuagggccaaguggag

SEQ ID NO: 374800 - RNA, 22 nt, Human
uuucuaggcacagugucuuccc

SEQ ID NO: 374801 - RNA, 22 nt, Human
ucaguggauuguagaaggcuua

SEQ ID NO: 374802 - RNA, 22 nt, Human
caggugccgggaaugcagcaau

SEQ ID NO: 374803 - RNA, 22 nt, Human
cauggcuuuuuagcauauucaa

SEQ ID NO: 374804 - RNA, 22 nt, Human
ucaggauguuaauauagcauua

SEQ ID NO: 374805 - RNA, 17 nt, Human
ugcauuguaggcuagcc

SEQ ID NO: 374806 - RNA, 22 nt, Human
aaagaucagucugaagcaacau

SEQ ID NO: 374807 - RNA, 22 nt, Human
aaaguccugacugcaggggaug

SEQ ID NO: 374808 - RNA, 22 nt, Human
caggauggagaguuguugguug

SEQ ID NO: 374809 - RNA, 22 nt, Human
ugagcccaggaguaugaggcug

SEQ ID NO: 374810 - RNA, 22 nt, Human
gaacagcuucuugggagcuggg

SEQ ID NO: 374811 - RNA, 22 nt, Human
agcagcaucuucuguucuccgc

SEQ ID NO: 374812 - RNA, 22 nt, Human
aggaccuguaccucagcaucua

SEQ ID NO: 374813 - RNA, 22 nt, Human
gccagagguaucaaagauagua

SEQ ID NO: 374814 - RNA, 22 nt, Human
uggagcauauucuggagcuugg

SEQ ID NO: 374815 - RNA, 22 nt, Human
agcugugggauuugggugugcc

SEQ ID NO: 374816 - RNA, 20 nt, Human
cacguuuuuccacuagcaaa

SEQ ID NO: 374817 - RNA, 22 nt, Human
uggcacuggcgcaggauggcgg

SEQ ID NO: 374818 - RNA, 19 nt, Human
ucugugcugggaggcagca

SEQ ID NO: 374819 - RNA, 22 nt, Human
gcuggaucccugugggaguggu

SEQ ID NO: 374820 - RNA, 22 nt, Human
agaccuggauuccaauccuacc

SEQ ID NO: 374821 - RNA, 22 nt, Human
agaaaugaagagagucaagguu

SEQ ID NO: 374822 - RNA, 22 nt, Human
gucacagaguuauuaauugugu

SEQ ID NO: 374823 - RNA, 22 nt, Human
aaaauuauagaucuagugccug

SEQ ID NO: 374824 - RNA, 18 nt, Human
cagggccccagaauuauc

SEQ ID NO: 374825 - RNA, 22 nt, Human
auucaacggguagaagggucuu

SEQ ID NO: 374826 - RNA, 22 nt, Human
agagccuggacuuuucugagcc

SEQ ID NO: 374827 - RNA, 22 nt, Human
uugacagcuauuuugcuuugau

SEQ ID NO: 374828 - RNA, 22 nt, Human
ggggaccuucccagagcaguug

SEQ ID NO: 374829 - RNA, 23 nt, Human
uggaaagcggaccuggggcagag

SEQ ID NO: 374830 - RNA, 22 nt, Human
auggcagccugagcagaggaau

SEQ ID NO: 374831 - RNA, 22 nt, Human
cauauucuuuaagcaaugcucu

SEQ ID NO: 374832 - RNA, 22 nt, Human
cuggcuuccucaggagcagugg

SEQ ID NO: 374833 - RNA, 22 nt, Human
caggacagaaauaaggaauaua

SEQ ID NO: 374834 - RNA, 22 nt, Human
agggcagaaaccaccuugaugg

SEQ ID NO: 374835 - RNA, 22 nt, Human
ccucugaggucauggacuuggc

SEQ ID NO: 374836 - RNA, 22 nt, Human
agaugaagacucaggagcaggu

SEQ ID NO: 374837 - RNA, 22 nt, Human
uagaaaggauauugagaugaau

SEQ ID NO: 374838 - RNA, 22 nt, Human
aucuggcuggauucuuagcguu

SEQ ID NO: 374839 - RNA, 22 nt, Human
cugcagagguugguucuaagau

SEQ ID NO: 374840 - RNA, 22 nt, Human
cagccugcauuuguaucuguau

SEQ ID NO: 374841 - RNA, 22 nt, Human
aguugcagacgcagagauguug

SEQ ID NO: 374842 - RNA, 22 nt, Human
guuagguagaaguuuacuuuga

SEQ ID NO: 374843 - RNA, 22 nt, Human
auaaggcagucccuuaacaagg

SEQ ID NO: 374844 - RNA, 22 nt, Human
aggauccuuuggccacuucuua

SEQ ID NO: 374845 - RNA, 22 nt, Human
cuccuugguguaguacugagca

SEQ ID NO: 374846 - RNA, 22 nt, Human
ggauccuuaacuaucacaguga

SEQ ID NO: 374847 - RNA, 18 nt, Human
gcaggcuuuuccuggguc

SEQ ID NO: 374848 - RNA, 22 nt, Human
uuucugaauaacucuaugauau

SEQ ID NO: 374849 - RNA, 20 nt, Human
ucauccaggacaggaguggc

SEQ ID NO: 374850 - RNA, 22 nt, Human
gaaucauuggaaccacauccaa

SEQ ID NO: 374851 - RNA, 21 nt, Human
gccacguuucagucuucucag

SEQ ID NO: 374852 - RNA, 18 nt, Human
gcaaggcucaggccaggc

SEQ ID NO: 374853 - RNA, 22 nt, Human
ucuggcucaggucagacaggga

SEQ ID NO: 374854 - RNA, 22 nt, Human
aggccagaugucgggcuagaag

SEQ ID NO: 374855 - RNA, 22 nt, Human
aggacuuagaacauuauguacu

SEQ ID NO: 374856 - RNA, 22 nt, Human
ccuggcagcgccgaagcuggcc

SEQ ID NO: 374857 - RNA, 22 nt, Human
aaugcuguaaagaugcuaucug

SEQ ID NO: 374858 - RNA, 22 nt, Human
augaggcagauguugcaugagg

SEQ ID NO: 374859 - RNA, 22 nt, Human
caaaaguucucacccagacaug

SEQ ID NO: 374860 - RNA, 22 nt, Human
guuauuaguaagacucgcacau

SEQ ID NO: 374861 - RNA, 22 nt, Human
uugcauugugauuacagaggug

SEQ ID NO: 374862 - RNA, 22 nt, Human
gucccugcccuccugggacuca

SEQ ID NO: 374863 - RNA, 22 nt, Human
gugugcaugcauagacaccaca

SEQ ID NO: 374864 - RNA, 22 nt, Human
cauagaaaguauuauggaauuu

SEQ ID NO: 374865 - RNA, 21 nt, Human
uggccaaaaccauauuauuaa

SEQ ID NO: 374866 - RNA, 22 nt, Human
cuguccagucuuuagcaagcug

SEQ ID NO: 374867 - RNA, 22 nt, Human
cagggcccagucccugcuguca

SEQ ID NO: 374868 - RNA, 22 nt, Human
uuaucauugucgcagucuaauu

SEQ ID NO: 374869 - RNA, 22 nt, Human
gcaccaggcagcugagcaggcc

SEQ ID NO: 374870 - RNA, 19 nt, Human
ccuuggaguuccaggugga

SEQ ID NO: 374871 - RNA, 22 nt, Human
aggaccugcuaaugugccaagu

SEQ ID NO: 374872 - RNA, 22 nt, Human
gaggagaagcuaagaaacacag

SEQ ID NO: 374873 - RNA, 22 nt, Human
acuccuggguugcaguccucaa

SEQ ID NO: 374874 - RNA, 22 nt, Human
cagagcauugagggucugccaa

SEQ ID NO: 374875 - RNA, 22 nt, Human
ugcuuuauuggaaccucauccu

SEQ ID NO: 374876 - RNA, 22 nt, Human
auuucugugcaguaaaugguga

SEQ ID NO: 374877 - RNA, 19 nt, Human
uuucaauggcuuagagaaa

SEQ ID NO: 374878 - RNA, 22 nt, Human
ugguuuuagaugccuuuacugc

SEQ ID NO: 374879 - RNA, 19 nt, Human
uucaggauugacccuacug

SEQ ID NO: 374880 - RNA, 22 nt, Human
ggucaggggcugcucuacagag

SEQ ID NO: 374881 - RNA, 22 nt, Human
ugggcagggaucucuuuugcaa

SEQ ID NO: 374882 - RNA, 22 nt, Human
agaggucauaucucagaagaga

SEQ ID NO: 374883 - RNA, 22 nt, Human
gggcagguggcaaagccagagg

SEQ ID NO: 374884 - RNA, 22 nt, Human
acaaagugaauugcaucgaguu

SEQ ID NO: 374885 - RNA, 22 nt, Human
agcugcccagcuaggaagaagg

SEQ ID NO: 374886 - RNA, 22 nt, Human
aaagccagugguaugagagaaa

SEQ ID NO: 374887 - RNA, 22 nt, Human
aucuauacccaucaugauuuaa

SEQ ID NO: 374888 - RNA, 22 nt, Human
uccuguggcguuaucaugugau

SEQ ID NO: 374889 - RNA, 22 nt, Human
uuucacauuuaggcgugaauug

SEQ ID NO: 374890 - RNA, 18 nt, Human
uauauuucacacauauuc

SEQ ID NO: 374891 - RNA, 20 nt, Human
ggccuuggccucuuugcagc

SEQ ID NO: 374892 - RNA, 22 nt, Human
ugaacccaggagguugcaguga

SEQ ID NO: 374893 - RNA, 22 nt, Human
cugcagcuccccugagaucaag

SEQ ID NO: 374894 - RNA, 22 nt, Human
ugugaaggagcaugcagagggg

SEQ ID NO: 374895 - RNA, 18 nt, Human
agcagagcccaugcauuc

SEQ ID NO: 374896 - RNA, 19 nt, Human
cuuuucaucaacagccaau

SEQ ID NO: 374897 - RNA, 22 nt, Human
cuggccagcauuuuugcuuuag

SEQ ID NO: 374898 - RNA, 22 nt, Human
cagugucuuauuuguagcucag

SEQ ID NO: 374899 - RNA, 22 nt, Human
cuuauuuuaagucaguuugggu

SEQ ID NO: 374900 - RNA, 22 nt, Human
uggucucugacucugaagaccc

SEQ ID NO: 374901 - RNA, 22 nt, Human
cacacagaugguaagggaggga

SEQ ID NO: 374902 - RNA, 22 nt, Human
aguauuuagcauagugguuagu

SEQ ID NO: 374903 - RNA, 22 nt, Human
uuccagggcuaauuccugugga

SEQ ID NO: 374904 - RNA, 22 nt, Human
cugaggugcuagggucccugcu

SEQ ID NO: 374905 - RNA, 23 nt, Human
uuucaaauuacucugcagaugac

SEQ ID NO: 374906 - RNA, 22 nt, Human
uccuggcccuguggccugcagu

SEQ ID NO: 374907 - RNA, 22 nt, Human
aaggaggagcggaggcuuguug

SEQ ID NO: 374908 - RNA, 22 nt, Human
uuguccuuaccucaaucuggaa

SEQ ID NO: 374909 - RNA, 22 nt, Human
caugcuuugggucagaaaugcc

SEQ ID NO: 374910 - RNA, 22 nt, Human
cacaugggugugccuggaggaa

SEQ ID NO: 374911 - RNA, 21 nt, Human
uaauaauuccacuacagagua

SEQ ID NO: 374912 - RNA, 22 nt, Human
cuuaaccagaaaaugcacuugu

SEQ ID NO: 374913 - RNA, 22 nt, Human
ugagccagccuugcagcugugc

SEQ ID NO: 374914 - RNA, 22 nt, Human
gaccauuuuuacagagcauuca

SEQ ID NO: 374915 - RNA, 22 nt, Human
aaggugucacugggacaggaaa

SEQ ID NO: 374916 - RNA, 22 nt, Human
uggcugaauaaaauaugguguu

SEQ ID NO: 374917 - RNA, 22 nt, Human
cuuccugcaggacagccaucug

SEQ ID NO: 374918 - RNA, 22 nt, Human
aauuuagaauucgcuagcuaau

SEQ ID NO: 374919 - RNA, 22 nt, Human
gggauggcucaaaggagucagg

SEQ ID NO: 374920 - RNA, 22 nt, Human
uccaggagguugagugaguucc

SEQ ID NO: 374921 - RNA, 22 nt, Human
uugaaaggugaacaugaugcac

SEQ ID NO: 374922 - RNA, 22 nt, Human
gaugaagccugacuucucggug

SEQ ID NO: 374923 - RNA, 22 nt, Human
gcaaguacaaacgcaucggcug

SEQ ID NO: 374924 - RNA, 22 nt, Human
uuuaucuguuguacauuuaugc

SEQ ID NO: 374925 - RNA, 22 nt, Human
ucaaaugcacguagagaaaaua

SEQ ID NO: 374926 - RNA, 22 nt, Human
gcaggcaggcuuccuugaacug

SEQ ID NO: 374927 - RNA, 22 nt, Human
caugguuuugagccuauuaugc

SEQ ID NO: 374928 - RNA, 21 nt, Human
ucucuggaguuagcagagaga

SEQ ID NO: 374929 - RNA, 22 nt, Human
caucacccggaacugugucugc

SEQ ID NO: 374930 - RNA, 22 nt, Human
ucuuaauucugugucuucacua

SEQ ID NO: 374931 - RNA, 22 nt, Human
cuuguacauagagaagaagccu

SEQ ID NO: 374932 - RNA, 22 nt, Human
uccuccaggucuaggguggcuu

SEQ ID NO: 374933 - RNA, 22 nt, Human
uccagccaacugccuagggagc

SEQ ID NO: 374934 - RNA, 22 nt, Human
agggugccuggaagccacucac

SEQ ID NO: 374935 - RNA, 22 nt, Human
cugccuggaaggagcaagggga

SEQ ID NO: 374936 - RNA, 22 nt, Human
uucuguguggguagcuccuguu

SEQ ID NO: 374937 - RNA, 22 nt, Human
agccugguuuaagcauuuuaua

SEQ ID NO: 374938 - RNA, 22 nt, Human
agccuguccagaggacagggcu

SEQ ID NO: 374939 - RNA, 22 nt, Human
uuauuuaaugugaucugaagag

SEQ ID NO: 374940 - RNA, 21 nt, Human
uuuaauuugcauguaugacgc

SEQ ID NO: 374941 - RNA, 22 nt, Human
ucuauacacacaaagaaugcuu

SEQ ID NO: 374942 - RNA, 19 nt, Human
ucucuacacuacauuucua

SEQ ID NO: 374943 - RNA, 22 nt, Human
aauuuacaggugcacucgccau

SEQ ID NO: 374944 - RNA, 20 nt, Human
ggaagccagggugcagggga

SEQ ID NO: 374945 - RNA, 22 nt, Human
agcagaacauuuucagggcugu

SEQ ID NO: 374946 - RNA, 22 nt, Human
ggguggcacaggugcagagggu

SEQ ID NO: 374947 - RNA, 22 nt, Human
uaccugagcccagugcagcaua

SEQ ID NO: 374948 - RNA, 18 nt, Human
agcagcugucagaaugcc

SEQ ID NO: 374949 - RNA, 22 nt, Human
ggucagggggaucugugaggua

SEQ ID NO: 374950 - RNA, 22 nt, Human
agccuggaguucccaggagaag

SEQ ID NO: 374951 - RNA, 22 nt, Human
guaagcaucugucucuucugca

SEQ ID NO: 374952 - RNA, 22 nt, Human
gugaggugguacaauauuaacu

SEQ ID NO: 374953 - RNA, 22 nt, Human
aggagcugaaacuucucauaug

SEQ ID NO: 374954 - RNA, 22 nt, Human
acccaggagccgugagagguua

SEQ ID NO: 374955 - RNA, 22 nt, Human
ggaaagaccugagauaggaaua

SEQ ID NO: 374956 - RNA, 22 nt, Human
ccuaagaauuaaugaauacacc

SEQ ID NO: 374957 - RNA, 22 nt, Human
caaagucccagcugcuuagaga

SEQ ID NO: 374958 - RNA, 22 nt, Human
uuccaggacuggguguuugaag

SEQ ID NO: 374959 - RNA, 22 nt, Human
uggaaggggagcuggaaagggg

SEQ ID NO: 374960 - RNA, 23 nt, Human
cuugcagggcuggaggcuuagaa

SEQ ID NO: 374961 - RNA, 22 nt, Human
acccaggaggcagagguugcag

SEQ ID NO: 374962 - RNA, 22 nt, Human
aaaaaucacuuuuauaggcagc

SEQ ID NO: 374963 - RNA, 22 nt, Human
uggcagcugcaggccuccugag

SEQ ID NO: 374964 - RNA, 23 nt, Human
uggcagugaucaaaagcuuacau

SEQ ID NO: 374965 - RNA, 22 nt, Human
cagcugccccgcuggcugacca

SEQ ID NO: 374966 - RNA, 22 nt, Human
gccugguggugugcucaagugg

SEQ ID NO: 374967 - RNA, 22 nt, Human
ucccaaggugcucggcaacagg

SEQ ID NO: 374968 - RNA, 22 nt, Human
uggcagagcccagacuccaguc

SEQ ID NO: 374969 - RNA, 22 nt, Human
ccagaauagaaggcagcuguca

SEQ ID NO: 374970 - RNA, 22 nt, Human
acaugucuuuuaaagucuaaua

SEQ ID NO: 374971 - RNA, 22 nt, Human
uuucacagcuggguggcagagu

SEQ ID NO: 374972 - RNA, 22 nt, Human
ugccaggcucaggaugucccug

SEQ ID NO: 374973 - RNA, 22 nt, Human
uuuaauuuucugggcccagcag

SEQ ID NO: 374974 - RNA, 22 nt, Human
uugcaucuagggcaacccagag

SEQ ID NO: 374975 - RNA, 22 nt, Human
ccagagcccagcacacggugcu

SEQ ID NO: 374976 - RNA, 22 nt, Human
uggcccugugugcaggcugcac

SEQ ID NO: 374977 - RNA, 22 nt, Human
uucacagggccacuggcaggag

SEQ ID NO: 374978 - RNA, 22 nt, Human
ccaaggcuucccagagaugcuc

SEQ ID NO: 374979 - RNA, 22 nt, Human
cuggauuuaauuaacuguugcu

SEQ ID NO: 374980 - RNA, 17 nt, Human
uucaaugauuaaugcau

SEQ ID NO: 374981 - RNA, 22 nt, Human
cuggagccuagguugaccuggg

SEQ ID NO: 374982 - RNA, 21 nt, Human
uccugccuuaguccagagcag

SEQ ID NO: 374983 - RNA, 22 nt, Human
ucucugaaggggagcuguuuaa

SEQ ID NO: 374984 - RNA, 22 nt, Human
ggcugagcaauuuugaugacau

SEQ ID NO: 374985 - RNA, 22 nt, Human
agggucagagaucggccaugug

SEQ ID NO: 374986 - RNA, 22 nt, Human
accagcuguguccuggcugcag

SEQ ID NO: 374987 - RNA, 22 nt, Human
ugaagaaucccagggaauuugg

SEQ ID NO: 374988 - RNA, 22 nt, Human
cugcccaggaaggagaggaugg

SEQ ID NO: 374989 - RNA, 22 nt, Human
gccucugcaacuccgccuuggu

SEQ ID NO: 374990 - RNA, 22 nt, Human
uccuuuuuaagucguuguggua

SEQ ID NO: 374991 - RNA, 22 nt, Human
uuuugugagcccauaaaugcca

SEQ ID NO: 374992 - RNA, 22 nt, Human
gagcucagcccaaagagcagug

SEQ ID NO: 374993 - RNA, 22 nt, Human
gagaggagguggcuaugacagc

SEQ ID NO: 374994 - RNA, 22 nt, Human
gccuaggagacaagcgugaaag

SEQ ID NO: 374995 - RNA, 22 nt, Human
gcucugagauugagccuuuggu

SEQ ID NO: 374996 - RNA, 22 nt, Human
accaggagucuagccuagucaa

SEQ ID NO: 374997 - RNA, 22 nt, Human
gcagggugccgacuucagggau

SEQ ID NO: 374998 - RNA, 19 nt, Human
gccaggagggcucuggcug

SEQ ID NO: 374999 - RNA, 20 nt, Human
aggagaaauucgggacaccu

SEQ ID NO: 375000 - RNA, 21 nt, Human
uuacagaauccaugggaaguc

SEQ ID NO: 375001 - RNA, 22 nt, Human
ucugcaggaaaaaagugccugg

SEQ ID NO: 375002 - RNA, 22 nt, Human
agcugccaccucugccuuuggg

SEQ ID NO: 375003 - RNA, 22 nt, Human
agcugccacaugcccaagggca

SEQ ID NO: 375004 - RNA, 22 nt, Human
uaccugcagcgggaauccauua

SEQ ID NO: 375005 - RNA, 22 nt, Human
agcuguggaguaggggguugga

SEQ ID NO: 375006 - RNA, 22 nt, Human
uuguucaugguuguaaguuuga

SEQ ID NO: 375007 - RNA, 21 nt, Human
uggcucuguucaauauaugga

SEQ ID NO: 375008 - RNA, 22 nt, Human
acaguaccugcucucaagcaaa

SEQ ID NO: 375009 - RNA, 22 nt, Human
gggugggacugaagucugaggg

SEQ ID NO: 375010 - RNA, 22 nt, Human
cagaaaucauugugaugacagg

SEQ ID NO: 375011 - RNA, 22 nt, Human
cuucuucaucuguaaaacuugg

SEQ ID NO: 375012 - RNA, 22 nt, Human
gaggcaggguguugauuacaga

SEQ ID NO: 375013 - RNA, 22 nt, Human
acugucuguccugcucuccgug

SEQ ID NO: 375014 - RNA, 22 nt, Human
caguggauuagccagagcugga

SEQ ID NO: 375015 - RNA, 22 nt, Human
cugggcucagcccaugcugucc

SEQ ID NO: 375016 - RNA, 22 nt, Human
aacauuggauauuuauuaaaag

SEQ ID NO: 375017 - RNA, 21 nt, Human
aguucauacugaguaacaaaa

SEQ ID NO: 375018 - RNA, 22 nt, Human
caauuucugggccucacacaag

SEQ ID NO: 375019 - RNA, 22 nt, Human
cagggacccgcacagguagcau

SEQ ID NO: 375020 - RNA, 22 nt, Human
aggcaguguauugcuagcggcu

SEQ ID NO: 375021 - RNA, 22 nt, Human
caaucaguuucuguuguauaau

SEQ ID NO: 375022 - RNA, 22 nt, Human
aguuuuuccguggcuacgauaa

SEQ ID NO: 375023 - RNA, 22 nt, Human
auuuauuaugggauuuggcaca

SEQ ID NO: 375024 - RNA, 22 nt, Human
agggaggauaguagucaguuua

SEQ ID NO: 375025 - RNA, 22 nt, Human
uuuaaauuauaguuaaugucug

SEQ ID NO: 375026 - RNA, 22 nt, Human
acagaacugggggcacagauag

SEQ ID NO: 375027 - RNA, 22 nt, Human
aguggggacuuaugccagcauu

SEQ ID NO: 375028 - RNA, 22 nt, Human
agggcagagcugucuaaauggc

SEQ ID NO: 375029 - RNA, 22 nt, Human
caagagagaugcagcucacuca

SEQ ID NO: 375030 - RNA, 22 nt, Human
cugcuuugggcagcuuuguggc

SEQ ID NO: 375031 - RNA, 18 nt, Human
gggaagaggaucuggccc

SEQ ID NO: 375032 - RNA, 22 nt, Human
acaguccuuguguggaacauua

SEQ ID NO: 375033 - RNA, 22 nt, Human
aucaaguuuucuuaguugacug

SEQ ID NO: 375034 - RNA, 22 nt, Human
uuaaagucccugccuuaauucc

SEQ ID NO: 375035 - RNA, 22 nt, Human
gacauaauccuccucaccuacu

SEQ ID NO: 375036 - RNA, 22 nt, Human
gcagggugauagugaggcucag

SEQ ID NO: 375037 - RNA, 22 nt, Human
uuccagaaaucuuucagcucaa

SEQ ID NO: 375038 - RNA, 22 nt, Human
ccacccuggacaggccucugag

SEQ ID NO: 375039 - RNA, 22 nt, Human
uggcuuccuggacagaugcggu

SEQ ID NO: 375040 - RNA, 22 nt, Human
uccucacaagcaagcacaggua

SEQ ID NO: 375041 - RNA, 22 nt, Human
cagcaggcugcgauugcucauu

SEQ ID NO: 375042 - RNA, 22 nt, Human
gcucagaaaagugaggcucagu

SEQ ID NO: 375043 - RNA, 22 nt, Human
ucacauuuguucuugaaucuaa

SEQ ID NO: 375044 - RNA, 22 nt, Human
ucacagaaggcaucacagaaga

SEQ ID NO: 375045 - RNA, 22 nt, Human
ugaaacagucuccagacuugga

SEQ ID NO: 375046 - RNA, 22 nt, Human
caggugggccgggguuuguucu

SEQ ID NO: 375047 - RNA, 18 nt, Human
gggcuguguucaugccca

SEQ ID NO: 375048 - RNA, 22 nt, Human
aaacugauaaaauaaguacauu

SEQ ID NO: 375049 - RNA, 22 nt, Human
agcccaagcuaugaggugaccu

SEQ ID NO: 375050 - RNA, 22 nt, Human
gggcuggaucuccugcaggcag

SEQ ID NO: 375051 - RNA, 22 nt, Human
uauuucuaagagauaucuguac

SEQ ID NO: 375052 - RNA, 22 nt, Human
gcucuggguagccacugccugg

SEQ ID NO: 375053 - RNA, 22 nt, Human
ugcaggaguccaaucaggagac

SEQ ID NO: 375054 - RNA, 22 nt, Human
cauuuuaaaugauuuaagccaa

SEQ ID NO: 375055 - RNA, 22 nt, Human
acuguggccugcuguaugggcu

SEQ ID NO: 375056 - RNA, 22 nt, Human
auuuggcaacauuaauugaauc

SEQ ID NO: 375057 - RNA, 22 nt, Human
ccugggcagggagaccaggcuc

SEQ ID NO: 375058 - RNA, 22 nt, Human
gcauguuauguaucugcccagc

SEQ ID NO: 375059 - RNA, 22 nt, Human
uugcauguguaauuuuucuaaa

SEQ ID NO: 375060 - RNA, 22 nt, Human
aaaagcagagacucuggagcua

SEQ ID NO: 375061 - RNA, 22 nt, Human
ucaaaugcucuuugcagagagg

SEQ ID NO: 375062 - RNA, 22 nt, Human
ugucccagcagcuggguucucu

SEQ ID NO: 375063 - RNA, 22 nt, Human
aggcuauuuccacucuucucau

SEQ ID NO: 375064 - RNA, 22 nt, Human
augcaguggcagcuccuggugu

SEQ ID NO: 375065 - RNA, 22 nt, Human
cauuacaugguccaggauauau

SEQ ID NO: 375066 - RNA, 22 nt, Human
aagaggcagcccgcugaggcug

SEQ ID NO: 375067 - RNA, 22 nt, Human
ucugccugaaauucacauguaa

SEQ ID NO: 375068 - RNA, 22 nt, Human
ggggcagagaauaaaaaccuaa

SEQ ID NO: 375069 - RNA, 22 nt, Human
guccucagucaguuuggugggg

SEQ ID NO: 375070 - RNA, 22 nt, Human
gggagcugaauggcaauggaga

SEQ ID NO: 375071 - RNA, 22 nt, Human
uggccugucuuguugugcuaga

SEQ ID NO: 375072 - RNA, 22 nt, Human
uguacacaauucuuaacauaca

SEQ ID NO: 375073 - RNA, 22 nt, Human
ugaccugcguaggugguuucug

SEQ ID NO: 375074 - RNA, 23 nt, Human
cagcugaagcagccugggcugga

SEQ ID NO: 375075 - RNA, 22 nt, Human
cugguccuugacgcgugggagg

SEQ ID NO: 375076 - RNA, 22 nt, Human
aggcugcucugcgaagucagcu

SEQ ID NO: 375077 - RNA, 22 nt, Human
acagcuuuuuacuaauagauug

SEQ ID NO: 375078 - RNA, 22 nt, Human
ugaugggaaaaugaggccuggg

SEQ ID NO: 375079 - RNA, 22 nt, Human
caguccuucauuccuccuuuga

SEQ ID NO: 375080 - RNA, 22 nt, Human
ggccugggcccacugucaagag

SEQ ID NO: 375081 - RNA, 22 nt, Human
cugagcccaggcgggagcugag

SEQ ID NO: 375082 - RNA, 20 nt, Human
auccaugagagucuggauuc

SEQ ID NO: 375083 - RNA, 22 nt, Human
gagggcuccauuccccgugccc

SEQ ID NO: 375084 - RNA, 22 nt, Human
gggcgccgugggaaacagccgg

SEQ ID NO: 375085 - RNA, 21 nt, Human
auacagaagguggcaaaguac

SEQ ID NO: 375086 - RNA, 20 nt, Human
cccucccagaugcuucccaa

SEQ ID NO: 375087 - RNA, 22 nt, Human
ugggcccugacuucaagcaucc

SEQ ID NO: 375088 - RNA, 22 nt, Human
ccaguccagugccaugcauggc

SEQ ID NO: 375089 - RNA, 22 nt, Human
ucuggcucaggagcuguguuca

SEQ ID NO: 375090 - RNA, 21 nt, Human
gcugagagguugggaaguuca

SEQ ID NO: 375091 - RNA, 22 nt, Human
ugcagcaggcacaggacggaag

SEQ ID NO: 375092 - RNA, 22 nt, Human
aguggcagaagccaagucugca

SEQ ID NO: 375093 - RNA, 22 nt, Human
gucccaggcuuauguggagcuu

SEQ ID NO: 375094 - RNA, 22 nt, Human
uucagagaagcaaaggcagauu

SEQ ID NO: 375095 - RNA, 22 nt, Human
cuggcugugcagucuuccagaa

SEQ ID NO: 375096 - RNA, 22 nt, Human
uggcagagucucuccuuuccag

SEQ ID NO: 375097 - RNA, 22 nt, Human
uccugccucuccaugcuaacua

SEQ ID NO: 375098 - RNA, 22 nt, Human
cagagcuggagcuugaauggag

SEQ ID NO: 375099 - RNA, 22 nt, Human
gaaggcugaguggguacggagg

SEQ ID NO: 375100 - RNA, 22 nt, Human
uaaaugugggggccacgggcuu

SEQ ID NO: 375101 - RNA, 22 nt, Human
ucuguucuauuggucuaugugu

SEQ ID NO: 375102 - RNA, 22 nt, Human
ugaaaugauaucugauaacaaa

SEQ ID NO: 375103 - RNA, 22 nt, Human
ucaaaguuuuugagaauuacau

SEQ ID NO: 375104 - RNA, 22 nt, Human
ccagcagcccucuuccaagacu

SEQ ID NO: 375105 - RNA, 22 nt, Human
ugggccacacacagaagaauca

SEQ ID NO: 375106 - RNA, 22 nt, Human
accaggaguugggggugggacc

SEQ ID NO: 375107 - RNA, 22 nt, Human
aacauaaauuugaaguggcaaa

SEQ ID NO: 375108 - RNA, 22 nt, Human
aaugcacaugucuuggccucac

SEQ ID NO: 375109 - RNA, 19 nt, Human
auuuacugccuaaaaucuc

SEQ ID NO: 375110 - RNA, 22 nt, Human
uguagaaauuaguaagaucaac

SEQ ID NO: 375111 - RNA, 18 nt, Human
aaggcuucaaagaguaga

SEQ ID NO: 375112 - RNA, 22 nt, Human
aggcagccuauggggagcucag

SEQ ID NO: 375113 - RNA, 22 nt, Human
gcagugcuuuagucuguccuuu

SEQ ID NO: 375114 - RNA, 22 nt, Human
agccccuuccaguucucagauc

SEQ ID NO: 375115 - RNA, 22 nt, Human
aauaugcauguauacaugugua

SEQ ID NO: 375116 - RNA, 22 nt, Human
agggggcaggagagaccugcug

SEQ ID NO: 375117 - RNA, 21 nt, Human
cagaggcugagagggcaaucu

SEQ ID NO: 375118 - RNA, 22 nt, Human
augcccaaugucacaauuuuug

SEQ ID NO: 375119 - RNA, 22 nt, Human
uguguacaagaguguuuacugu

SEQ ID NO: 375120 - RNA, 22 nt, Human
cagcccuuuccuucucagcuuu

SEQ ID NO: 375121 - RNA, 22 nt, Human
uggccacagccucugccaguuc

SEQ ID NO: 375122 - RNA, 22 nt, Human
ugccuuggugcuucuucaugug

SEQ ID NO: 375123 - RNA, 22 nt, Human
ugccaggcuguccugggccugg

SEQ ID NO: 375124 - RNA, 22 nt, Human
gcuuccuagaucugugguacuc

SEQ ID NO: 375125 - RNA, 22 nt, Human
aaucaaaaccuacagagguaau

SEQ ID NO: 375126 - RNA, 22 nt, Human
ucuuugcaugcauuuucccuua

SEQ ID NO: 375127 - RNA, 22 nt, Human
cucaggauugugccuagggaga

SEQ ID NO: 375128 - RNA, 22 nt, Human
ccagcugucagugugaaaauaa

SEQ ID NO: 375129 - RNA, 21 nt, Human
ggcccugguuacgccuccucu

SEQ ID NO: 375130 - RNA, 22 nt, Human
agcuuuaugcuuccuacaagcu

SEQ ID NO: 375131 - RNA, 19 nt, Human
uuacuuggcaaagucaguc

SEQ ID NO: 375132 - RNA, 22 nt, Human
uaaaugugucuuuuuaaggccu

SEQ ID NO: 375133 - RNA, 22 nt, Human
acagagagaaacaaucagcagc

SEQ ID NO: 375134 - RNA, 22 nt, Human
uauguuaaauguuugauguuua

SEQ ID NO: 375135 - RNA, 22 nt, Human
cugguacaaaaugcugauauca

SEQ ID NO: 375136 - RNA, 22 nt, Human
uguccuuuucuuuagugcagcu

SEQ ID NO: 375137 - RNA, 22 nt, Human
caggaaggcccaccuguccugu

SEQ ID NO: 375138 - RNA, 22 nt, Human
aguaacuaugcuugagaaucag

SEQ ID NO: 375139 - RNA, 22 nt, Human
uggggcuguccuuagucugaga

SEQ ID NO: 375140 - RNA, 22 nt, Human
uuucaauguaugucuuucugag

SEQ ID NO: 375141 - RNA, 22 nt, Human
ucugaagauuaccagcuaaaug

SEQ ID NO: 375142 - RNA, 17 nt, Human
uuccucucacauuuuuu

SEQ ID NO: 375143 - RNA, 22 nt, Human
guccagggcuaaaucagguucc

SEQ ID NO: 375144 - RNA, 21 nt, Human
ucagaguguguuacagcaagc

SEQ ID NO: 375145 - RNA, 22 nt, Human
uuucagaaccgcuaaaauaaau

SEQ ID NO: 375146 - RNA, 22 nt, Human
agagugggugaucucuguuguc

SEQ ID NO: 375147 - RNA, 22 nt, Human
uucacaggaggguggaugcaug

SEQ ID NO: 375148 - RNA, 22 nt, Human
agaagcaguuauuuuuugcaca

SEQ ID NO: 375149 - RNA, 22 nt, Human
ggccaagauggaaggagagaug

SEQ ID NO: 375150 - RNA, 23 nt, Human
uuauuuugucagaagggacuuuu

SEQ ID NO: 375151 - RNA, 22 nt, Human
aggaucugugagugcugcagac

SEQ ID NO: 375152 - RNA, 22 nt, Human
uaacacacugaaggugagaugg

SEQ ID NO: 375153 - RNA, 22 nt, Human
aaagaggaaccaagagcacgug

SEQ ID NO: 375154 - RNA, 22 nt, Human
agccagucggggccaugcuggg

SEQ ID NO: 375155 - RNA, 22 nt, Human
uaaggguucagaaugcaguggu

SEQ ID NO: 375156 - RNA, 22 nt, Human
ccagcucuggcuucuugcuggg

SEQ ID NO: 375157 - RNA, 22 nt, Human
agugcuuucccugaaaccuucc

SEQ ID NO: 375158 - RNA, 22 nt, Human
cauuuucucaaugaacccucuu

SEQ ID NO: 375159 - RNA, 22 nt, Human
aauaaacugcucaauugcauca

SEQ ID NO: 375160 - RNA, 22 nt, Human
aguacaauuuaaugaagauagc

SEQ ID NO: 375161 - RNA, 22 nt, Human
gaauuagguaauagaacuagua

SEQ ID NO: 375162 - RNA, 22 nt, Human
gccuaauaugcaaaauugauac

SEQ ID NO: 375163 - RNA, 22 nt, Human
ccagagcagggcagcagggcuc

SEQ ID NO: 375164 - RNA, 22 nt, Human
uggccaggcagguagaacggcc

SEQ ID NO: 375165 - RNA, 22 nt, Human
aaaguuugcaauuuauguuaau

SEQ ID NO: 375166 - RNA, 22 nt, Human
aucacugucgucaucugagauu

SEQ ID NO: 375167 - RNA, 22 nt, Human
uagaaaugauuuugaugcuuca

SEQ ID NO: 375168 - RNA, 22 nt, Human
ccagcuccagguagaugggcag

SEQ ID NO: 375169 - RNA, 19 nt, Human
auagaaaggguuaaagaca

SEQ ID NO: 375170 - RNA, 22 nt, Human
gagggcugcuggaaaaaugcag

SEQ ID NO: 375171 - RNA, 22 nt, Human
ggcugagcccccucugcguagg

SEQ ID NO: 375172 - RNA, 22 nt, Human
agcccaggagguggagguugca

SEQ ID NO: 375173 - RNA, 23 nt, Human
uggauaaagcugugcugcauagg

SEQ ID NO: 375174 - RNA, 22 nt, Human
acagcagcuggguucccaccau

SEQ ID NO: 375175 - RNA, 21 nt, Human
uguggcagauguugggaggca

SEQ ID NO: 375176 - RNA, 22 nt, Human
ccagacccugcucuggggcucu

SEQ ID NO: 375177 - RNA, 23 nt, Human
gcagagcugcccuauugccuugg

SEQ ID NO: 375178 - RNA, 22 nt, Human
gcugucucggggcuuucuccug

SEQ ID NO: 375179 - RNA, 22 nt, Human
gcauggaauucccuuaugggcc

SEQ ID NO: 375180 - RNA, 22 nt, Human
acagugacguuuauuugagacg

SEQ ID NO: 375181 - RNA, 18 nt, Human
uguggcaggggugggaga

SEQ ID NO: 375182 - RNA, 22 nt, Human
ucaaaauuuuauuucucaagga

SEQ ID NO: 375183 - RNA, 22 nt, Human
aaacucuggagauguuuaugca

SEQ ID NO: 375184 - RNA, 22 nt, Human
ccucagggccaucucugucccu

SEQ ID NO: 375185 - RNA, 22 nt, Human
uuuccauauuuaaucaaaauaa

SEQ ID NO: 375186 - RNA, 22 nt, Human
gcagcagaggcccuacucuuug

SEQ ID NO: 375187 - RNA, 22 nt, Human
gaggcucagagggacuuucaag

SEQ ID NO: 375188 - RNA, 21 nt, Human
uccacaaguuagaaggaaauu

SEQ ID NO: 375189 - RNA, 22 nt, Human
aaauccuaaggagaauaugauu

SEQ ID NO: 375190 - RNA, 22 nt, Human
gaggcucaaaccuggacagagc

SEQ ID NO: 375191 - RNA, 22 nt, Human
cagcugccuguauuguccucau

SEQ ID NO: 375192 - RNA, 22 nt, Human
aagcuguucucuaaguuucaug

SEQ ID NO: 375193 - RNA, 22 nt, Human
uccugcagccaagggucaucga

SEQ ID NO: 375194 - RNA, 22 nt, Human
cuccugaguaguagcauuguca

SEQ ID NO: 375195 - RNA, 22 nt, Human
uuccucuagcuucucacuaaca

SEQ ID NO: 375196 - RNA, 22 nt, Human
uccaggcauagaaggcacgcac

SEQ ID NO: 375197 - RNA, 22 nt, Human
accauuuuggguauuuucagag

SEQ ID NO: 375198 - RNA, 22 nt, Human
caguucuuauuuggccaguguc

SEQ ID NO: 375199 - RNA, 22 nt, Human
cuguacauauacauuuuuuucc

SEQ ID NO: 375200 - RNA, 22 nt, Human
accaggcagucaccguccagga

SEQ ID NO: 375201 - RNA, 22 nt, Human
ccagagcccgggaccuggacuu

SEQ ID NO: 375202 - RNA, 22 nt, Human
auucaguuucauggcacagcua

SEQ ID NO: 375203 - RNA, 22 nt, Human
gaggccagaagucugagaucag

SEQ ID NO: 375204 - RNA, 23 nt, Human
ugguucuaggccuauaauuauau

SEQ ID NO: 375205 - RNA, 22 nt, Human
cagggccuccuaaggcaucuaa

SEQ ID NO: 375206 - RNA, 22 nt, Human
gagggcugaagauuguggcccc

SEQ ID NO: 375207 - RNA, 20 nt, Human
ggcaccaggcuaggauugga

SEQ ID NO: 375208 - RNA, 22 nt, Human
aagauaaacucuugauuucuga

SEQ ID NO: 375209 - RNA, 22 nt, Human
ggcugcagggcagcuggugugg

SEQ ID NO: 375210 - RNA, 22 nt, Human
gcugagagcggccagcugggaa

SEQ ID NO: 375211 - RNA, 22 nt, Human
ggguggcuccuaugggcauagc

SEQ ID NO: 375212 - RNA, 22 nt, Human
guuccauaucacagcagacgaa

SEQ ID NO: 375213 - RNA, 22 nt, Human
cuggaaggucuguccccacugc

SEQ ID NO: 375214 - RNA, 21 nt, Human
uucaauacuauuucaauaguc

SEQ ID NO: 375215 - RNA, 22 nt, Human
ugcucagggacaauggagaggg

SEQ ID NO: 375216 - RNA, 22 nt, Human
uuuuuccuaagcaguggagcug

SEQ ID NO: 375217 - RNA, 22 nt, Human
ggcaggcuggcuuuguuccagg

SEQ ID NO: 375218 - RNA, 22 nt, Human
cggcugugucuucacaggagcc

SEQ ID NO: 375219 - RNA, 22 nt, Human
uauucacaggcuggagugaugu

SEQ ID NO: 375220 - RNA, 22 nt, Human
uggagcagcacaagaaagggga

SEQ ID NO: 375221 - RNA, 22 nt, Human
gauuucuugauaauucaaaucc

SEQ ID NO: 375222 - RNA, 22 nt, Human
gagggcugaugcuuacuuauuu

SEQ ID NO: 375223 - RNA, 20 nt, Human
ccugccuguguuugugauga

SEQ ID NO: 375224 - RNA, 22 nt, Human
aggcucagugauguaaaauaua

SEQ ID NO: 375225 - RNA, 22 nt, Human
gugggacucuucuuuggcagug

SEQ ID NO: 375226 - RNA, 22 nt, Human
auugauggcggccucuccauau

SEQ ID NO: 375227 - RNA, 22 nt, Human
gccccucccagucaggagcacu

SEQ ID NO: 375228 - RNA, 22 nt, Human
aaagaacaaaugauauaugguu

SEQ ID NO: 375229 - RNA, 22 nt, Human
caugaaaauaacauuguuguga

SEQ ID NO: 375230 - RNA, 22 nt, Human
gcagagugccgagauggaagcg

SEQ ID NO: 375231 - RNA, 22 nt, Human
cucagagcaaugaacaugcaaa

SEQ ID NO: 375232 - RNA, 22 nt, Human
guccuggguccccgcaggucag

SEQ ID NO: 375233 - RNA, 22 nt, Human
agcccaugcaacaggccuagcg

SEQ ID NO: 375234 - RNA, 22 nt, Human
uugguacaaugugcuagguagg

SEQ ID NO: 375235 - RNA, 22 nt, Human
uuuaaugaauaauucaaaucug

SEQ ID NO: 375236 - RNA, 23 nt, Human
aagucaccaagaggaaggcggag

SEQ ID NO: 375237 - RNA, 19 nt, Human
ccagcagcuuugauucucu

SEQ ID NO: 375238 - RNA, 22 nt, Human
ucaguucugcuagaaaaacagu

SEQ ID NO: 375239 - RNA, 22 nt, Human
aagcaggauggaucuaguguuc

SEQ ID NO: 375240 - RNA, 22 nt, Human
uuugugcagauguauauuugug

SEQ ID NO: 375241 - RNA, 22 nt, Human
agagcugcaggguggacccagg

SEQ ID NO: 375242 - RNA, 22 nt, Human
cagcagcuuugccaagucagcc

SEQ ID NO: 375243 - RNA, 22 nt, Human
ugaagcagagugaaggugaauu

SEQ ID NO: 375244 - RNA, 22 nt, Human
caggccacaaguuggguucaag

SEQ ID NO: 375245 - RNA, 22 nt, Human
aaugcauauguaggcaagcagu

SEQ ID NO: 375246 - RNA, 22 nt, Human
aggcugccaaagcuucugucuc

SEQ ID NO: 375247 - RNA, 22 nt, Human
cugcagagcuuucugaaugaag

SEQ ID NO: 375248 - RNA, 22 nt, Human
gguggcaggcccugagcauccc

SEQ ID NO: 375249 - RNA, 22 nt, Human
ugaggcaggagguugagaacug

SEQ ID NO: 375250 - RNA, 22 nt, Human
cacaauguauauguauaucaaa

SEQ ID NO: 375251 - RNA, 21 nt, Human
ggcagaaguagcauggacggg

SEQ ID NO: 375252 - RNA, 22 nt, Human
uggcugcaguucacaggagcaa

SEQ ID NO: 375253 - RNA, 22 nt, Human
ccagcuccccucagcagguaau

SEQ ID NO: 375254 - RNA, 22 nt, Human
acaguaauauugaugcucguca

SEQ ID NO: 375255 - RNA, 22 nt, Human
aaagagcuucauuuccauuuau

SEQ ID NO: 375256 - RNA, 22 nt, Human
ugacacauuaaaugcucacaaa

SEQ ID NO: 375257 - RNA, 20 nt, Human
agccagaagaaggcuggaga

SEQ ID NO: 375258 - RNA, 22 nt, Human
aguccuuacaccuggaaccuau

SEQ ID NO: 375259 - RNA, 19 nt, Human
caggaugaucccaugacac

SEQ ID NO: 375260 - RNA, 22 nt, Human
guugacagcuggugagcugcua

SEQ ID NO: 375261 - RNA, 22 nt, Human
acagccagggcauugucgccga

SEQ ID NO: 375262 - RNA, 22 nt, Human
aaaacugaaauacgauccaaug

SEQ ID NO: 375263 - RNA, 22 nt, Human
cucaggauuaaggaaucuaaau

SEQ ID NO: 375264 - RNA, 22 nt, Human
gucagaggggacaagacacaga

SEQ ID NO: 375265 - RNA, 22 nt, Human
ggcaccuggauguagcagugaa

SEQ ID NO: 375266 - RNA, 22 nt, Human
ugaaauguuugaagaccacuga

SEQ ID NO: 375267 - RNA, 22 nt, Human
ucaccccuacauuucccuugcu

SEQ ID NO: 375268 - RNA, 22 nt, Human
uuauuagcugggcuucagggug

SEQ ID NO: 375269 - RNA, 22 nt, Human
guguggcugugggagauguuca

SEQ ID NO: 375270 - RNA, 22 nt, Human
cacccacccacugcucauuggc

SEQ ID NO: 375271 - RNA, 22 nt, Human
aauauguucaaaauagaucacu

SEQ ID NO: 375272 - RNA, 22 nt, Human
ucucacuggguauaaaugagua

SEQ ID NO: 375273 - RNA, 22 nt, Human
gaagccacagagauuguggggg

SEQ ID NO: 375274 - RNA, 19 nt, Human
uccaggaggcugccauuga

SEQ ID NO: 375275 - RNA, 22 nt, Human
agagcugugcuuugcaccacgu

SEQ ID NO: 375276 - RNA, 22 nt, Human
uccucugcuguucugguucuuu

SEQ ID NO: 375277 - RNA, 22 nt, Human
uggaggcaucagagugcuuggc

SEQ ID NO: 375278 - RNA, 22 nt, Human
ugaggggagguuggggcacauc

SEQ ID NO: 375279 - RNA, 22 nt, Human
agggaaaguaagcauuucauua

SEQ ID NO: 375280 - RNA, 22 nt, Human
cuuucuuauaccugucagggcc

SEQ ID NO: 375281 - RNA, 22 nt, Human
uuuacaaguuuacagaaugaug

SEQ ID NO: 375282 - RNA, 22 nt, Human
aggucauuacaauuaucauuuu

SEQ ID NO: 375283 - RNA, 22 nt, Human
gagguggugguggaggcauagc

SEQ ID NO: 375284 - RNA, 22 nt, Human
cagugcagaggugcaagcaugu

SEQ ID NO: 375285 - RNA, 22 nt, Human
cauuugaaauaguucauucuug

SEQ ID NO: 375286 - RNA, 22 nt, Human
gaggccagaagugccucgggcu

SEQ ID NO: 375287 - RNA, 22 nt, Human
caguguuccaggcggcagugaa

SEQ ID NO: 375288 - RNA, 22 nt, Human
acagaggaaggcugagcugccc

SEQ ID NO: 375289 - RNA, 22 nt, Human
cagauuuaccuaacuccaaguu

SEQ ID NO: 375290 - RNA, 22 nt, Human
aaggagagguuguccguguugu

SEQ ID NO: 375291 - RNA, 22 nt, Human
ugaggcaggacuugcauaaagu

SEQ ID NO: 375292 - RNA, 22 nt, Human
uagcugccagaccauucuuacu

SEQ ID NO: 375293 - RNA, 22 nt, Human
ucuguggauuuuaguguucaug

SEQ ID NO: 375294 - RNA, 16 nt, Human
uguuagcugugcauua

SEQ ID NO: 375295 - RNA, 22 nt, Human
ugcccaggauugugaggucagg

SEQ ID NO: 375296 - RNA, 22 nt, Human
acauauauuacuaguaaagaca

SEQ ID NO: 375297 - RNA, 22 nt, Human
uuuccagguauuaauacuguau

SEQ ID NO: 375298 - RNA, 22 nt, Human
cccagcaggcauguugggagga

SEQ ID NO: 375299 - RNA, 22 nt, Human
gcuggagccaagcugcucuugg

SEQ ID NO: 375300 - RNA, 22 nt, Human
ugcauuguaggauguuuagcag

SEQ ID NO: 375301 - RNA, 22 nt, Human
ccugggaggcagagguugcagu

SEQ ID NO: 375302 - RNA, 22 nt, Human
ggcagagcuugcagugagccga

SEQ ID NO: 375303 - RNA, 22 nt, Human
auuaaauuuucacuaggcuccc

SEQ ID NO: 375304 - RNA, 22 nt, Human
aagguuaaauagguauuuucca

SEQ ID NO: 375305 - RNA, 22 nt, Human
cccaggaggcagauguugcagu

SEQ ID NO: 375306 - RNA, 22 nt, Human
cucaggaucgcuugcccuaggg

SEQ ID NO: 375307 - RNA, 22 nt, Human
ugaaaugauuauaugguguuug

SEQ ID NO: 375308 - RNA, 22 nt, Human
aagcaucucuauguggagagug

SEQ ID NO: 375309 - RNA, 22 nt, Human
gcagagcacccugcagugguau

SEQ ID NO: 375310 - RNA, 22 nt, Human
uguggcaggaagagcuucugag

SEQ ID NO: 375311 - RNA, 22 nt, Human
ggagccagugcccucuggugga

SEQ ID NO: 375312 - RNA, 22 nt, Human
uuauccuggauuauauauguga

SEQ ID NO: 375313 - RNA, 22 nt, Human
ucugcagcuugcacaggcaggc

SEQ ID NO: 375314 - RNA, 21 nt, Human
uucaaaaugguguguuugucu

SEQ ID NO: 375315 - RNA, 22 nt, Human
ggggcucaguucggacagccug

SEQ ID NO: 375316 - RNA, 20 nt, Human
agcaggaaaagugccagucu

SEQ ID NO: 375317 - RNA, 22 nt, Human
ucucccaggcugcccuguggac

SEQ ID NO: 375318 - RNA, 22 nt, Human
cagugcagguggcagaggacag

SEQ ID NO: 375319 - RNA, 22 nt, Human
aggcugcguuagccucacuccc

SEQ ID NO: 375320 - RNA, 21 nt, Human
gacaggggaagaagcaaggag

SEQ ID NO: 375321 - RNA, 22 nt, Human
gcagggcagugugucugugggg

SEQ ID NO: 375322 - RNA, 22 nt, Human
aucaguuuggugcuuucaguga

SEQ ID NO: 375323 - RNA, 22 nt, Human
caguaaaugcagauauagauac

SEQ ID NO: 375324 - RNA, 22 nt, Human
gaggcagcugggcuggugguuu

SEQ ID NO: 375325 - RNA, 20 nt, Human
ugaaaaggucaggagacaug

SEQ ID NO: 375326 - RNA, 22 nt, Human
ucaggagagagaaauuggggcu

SEQ ID NO: 375327 - RNA, 22 nt, Human
aggcagcagugauaagauagga

SEQ ID NO: 375328 - RNA, 22 nt, Human
uguguauuaccauuuuacagcu

SEQ ID NO: 375329 - RNA, 22 nt, Human
gcugagagaucaaggcaggauu

SEQ ID NO: 375330 - RNA, 21 nt, Human
auacagaaggcagacucucuc

SEQ ID NO: 375331 - RNA, 22 nt, Human
uuccuguauucuaaagggaaag

SEQ ID NO: 375332 - RNA, 22 nt, Human
gccuggucucuuucaugucagu

SEQ ID NO: 375333 - RNA, 22 nt, Human
ggucucugacuuagagauggau

SEQ ID NO: 375334 - RNA, 22 nt, Human
acacuaauuaagcugcuuuacu

SEQ ID NO: 375335 - RNA, 22 nt, Human
uagucaccugugagcugcguag

SEQ ID NO: 375336 - RNA, 22 nt, Human
gcugggagcaaagccaugcaua

SEQ ID NO: 375337 - RNA, 22 nt, Human
aaagaagguagggcuggugacu

SEQ ID NO: 375338 - RNA, 22 nt, Human
agaagccagaggcaguggguac

SEQ ID NO: 375339 - RNA, 22 nt, Human
gauggcuuugugcaccaugauu

SEQ ID NO: 375340 - RNA, 22 nt, Human
gcuggaucauauggugguucua

SEQ ID NO: 375341 - RNA, 21 nt, Human
gagacagacuuucguccccug

SEQ ID NO: 375342 - RNA, 22 nt, Human
cugggccugguagggcuugaaa

SEQ ID NO: 375343 - RNA, 22 nt, Human
uucaggaugcagagguuguagu

SEQ ID NO: 375344 - RNA, 22 nt, Human
ugggccugaguuugggaacugg

SEQ ID NO: 375345 - RNA, 22 nt, Human
aucaguuugagugcugugucaa

SEQ ID NO: 375346 - RNA, 22 nt, Human
ugcagggauuguuggcauccau

SEQ ID NO: 375347 - RNA, 22 nt, Human
uuacagaacugcccuaguuggc

SEQ ID NO: 375348 - RNA, 22 nt, Human
ugcuggcuacugauggcaggcc

SEQ ID NO: 375349 - RNA, 22 nt, Human
gcagaauugauggagaacuuaa

SEQ ID NO: 375350 - RNA, 20 nt, Human
gagauggacagaugaagggg

SEQ ID NO: 375351 - RNA, 23 nt, Human
uuuggacuugugacucuucuccu

SEQ ID NO: 375352 - RNA, 22 nt, Human
auggaucacagugccgugggug

SEQ ID NO: 375353 - RNA, 22 nt, Human
uauuugaaggcauacauuuuga

SEQ ID NO: 375354 - RNA, 22 nt, Human
aucugcuugaaugagcaacagg

SEQ ID NO: 375355 - RNA, 22 nt, Human
cagagacauucaguaaauuauc

SEQ ID NO: 375356 - RNA, 22 nt, Human
cuggcuguauuaguuugauccu

SEQ ID NO: 375357 - RNA, 22 nt, Human
uuuguaaauagcaguacucaug

SEQ ID NO: 375358 - RNA, 22 nt, Human
aggcucugguuggcaaguaaag

SEQ ID NO: 375359 - RNA, 22 nt, Human
aaagccagguugugugcaggaa

SEQ ID NO: 375360 - RNA, 20 nt, Human
cccagagccauagccagaca

SEQ ID NO: 375361 - RNA, 22 nt, Human
gacagggaggagcagagcuucu

SEQ ID NO: 375362 - RNA, 22 nt, Human
ugcccugcagugagugcgucug

SEQ ID NO: 375363 - RNA, 22 nt, Human
agugaguggguuacagauggga

SEQ ID NO: 375364 - RNA, 22 nt, Human
ccugggaggcuguuuccagccu

SEQ ID NO: 375365 - RNA, 22 nt, Human
agcuguucccucacugcaguca

SEQ ID NO: 375366 - RNA, 22 nt, Human
gcacuaaaccaacauguaauaa

SEQ ID NO: 375367 - RNA, 22 nt, Human
gguccagggaacuuugaaggau

SEQ ID NO: 375368 - RNA, 22 nt, Human
aaaguguugggaagaaagugca

SEQ ID NO: 375369 - RNA, 22 nt, Human
uuuauuagauuaucaaagaggu

SEQ ID NO: 375370 - RNA, 22 nt, Human
uaaaguucuggugagagguaag

SEQ ID NO: 375371 - RNA, 22 nt, Human
ggggcagcuaccggaaguaggg

SEQ ID NO: 375372 - RNA, 22 nt, Human
ccagggugaggaggcucccacg

SEQ ID NO: 375373 - RNA, 22 nt, Human
aauguauuccucaugcaagagu

SEQ ID NO: 375374 - RNA, 22 nt, Human
caagagcuuuagaaaugcucau

SEQ ID NO: 375375 - RNA, 22 nt, Human
ggucccagcuggucacugucag

SEQ ID NO: 375376 - RNA, 22 nt, Human
ggugagaggcagaggacagcuu

SEQ ID NO: 375377 - RNA, 22 nt, Human
auacacauauguguguauaugu

SEQ ID NO: 375378 - RNA, 22 nt, Human
gaauuucagaucagagaccauu

SEQ ID NO: 375379 - RNA, 23 nt, Human
cuccucguaacucuguggugggu

SEQ ID NO: 375380 - RNA, 23 nt, Human
cagggcugggcuugguguuaggc

SEQ ID NO: 375381 - RNA, 22 nt, Human
ugaaacauuugaugaucuuugg

SEQ ID NO: 375382 - RNA, 22 nt, Human
cagggagaucuuggcuccuggu

SEQ ID NO: 375383 - RNA, 22 nt, Human
uuuucaucucugcuuuguaccu

SEQ ID NO: 375384 - RNA, 22 nt, Human
ggcugcaggcagaggcugucug

SEQ ID NO: 375385 - RNA, 22 nt, Human
ucacagacacagggagaagcau

SEQ ID NO: 375386 - RNA, 22 nt, Human
ucagagaggcaauacuguuuaa

SEQ ID NO: 375387 - RNA, 19 nt, Human
uggcuccugccugccuucu

SEQ ID NO: 375388 - RNA, 22 nt, Human
gcaaugauauugaagugaugaa

SEQ ID NO: 375389 - RNA, 22 nt, Human
uuauuuugccacaggugaccuu

SEQ ID NO: 375390 - RNA, 22 nt, Human
aggagcugucagagugccagag

SEQ ID NO: 375391 - RNA, 22 nt, Human
agcucugacauugauucucagc

SEQ ID NO: 375392 - RNA, 22 nt, Human
gguuugcauucugaaaggcuca

SEQ ID NO: 375393 - RNA, 22 nt, Human
aggcaagcgcagaagcggagga

SEQ ID NO: 375394 - RNA, 22 nt, Human
aaagaaauagauggcauuuaaa

SEQ ID NO: 375395 - RNA, 22 nt, Human
gguagcagggcugugagucaga

SEQ ID NO: 375396 - RNA, 22 nt, Human
accugagcaugccaggagagug

SEQ ID NO: 375397 - RNA, 22 nt, Human
aagcaaaagguuacacuucugg

SEQ ID NO: 375398 - RNA, 20 nt, Human
ugaaggccagcagcauaggg

SEQ ID NO: 375399 - RNA, 22 nt, Human
auguccuucuccucuuaccugc

SEQ ID NO: 375400 - RNA, 22 nt, Human
ucuuuuggguucuuaugauuua

SEQ ID NO: 375401 - RNA, 22 nt, Human
agcuaggaaauugaggcugaga

SEQ ID NO: 375402 - RNA, 21 nt, Human
auccuugaucagaagagugcu

SEQ ID NO: 375403 - RNA, 22 nt, Human
gagcagaacaggccggguggga

SEQ ID NO: 375404 - RNA, 22 nt, Human
cuuuggcagccucugcuauuga

SEQ ID NO: 375405 - RNA, 22 nt, Human
acaggcagcgucauugcugcuc

SEQ ID NO: 375406 - RNA, 22 nt, Human
ugcuuuauuaagagagaaauuu

SEQ ID NO: 375407 - RNA, 22 nt, Human
uuauccaacaugacuuaugucc

SEQ ID NO: 375408 - RNA, 20 nt, Human
ucaggcaguggggaaaggca

SEQ ID NO: 375409 - RNA, 22 nt, Human
uccuggguccauggcagccgaa

SEQ ID NO: 375410 - RNA, 22 nt, Human
uuucuguuaggcaucauuuuaa

SEQ ID NO: 375411 - RNA, 21 nt, Human
aaagagguuaauauuguaagu

SEQ ID NO: 375412 - RNA, 22 nt, Human
uccaggagaccagauguaggcc

SEQ ID NO: 375413 - RNA, 22 nt, Human
guuuccaaccccaccaaagugc

SEQ ID NO: 375414 - RNA, 22 nt, Human
aaucuucacagaaaaaugucug

SEQ ID NO: 375415 - RNA, 22 nt, Human
uccaaauacauuuacuguauuu

SEQ ID NO: 375416 - RNA, 22 nt, Human
gcuguguuuuauguuagguuaa

SEQ ID NO: 375417 - RNA, 22 nt, Human
cccaggaaugaggggcggaggc

SEQ ID NO: 375418 - RNA, 21 nt, Human
cucaggaucuuauauauuagu

SEQ ID NO: 375419 - RNA, 22 nt, Human
ugcaggagacauaauagggacu

SEQ ID NO: 375420 - RNA, 22 nt, Human
uugugugguagcuucauugaac

SEQ ID NO: 375421 - RNA, 22 nt, Human
aggcaagcugcagagaguccuu

SEQ ID NO: 375422 - RNA, 22 nt, Human
ugaaggaauggaggaucagagc

SEQ ID NO: 375423 - RNA, 22 nt, Human
uuauuuugguaaauguuugccu

SEQ ID NO: 375424 - RNA, 22 nt, Human
caagccugucucaccagugcua

SEQ ID NO: 375425 - RNA, 22 nt, Human
gcaaaugcucuccuuggucagg

SEQ ID NO: 375426 - RNA, 22 nt, Human
ugaaggaagaauaggcaguguu

SEQ ID NO: 375427 - RNA, 22 nt, Human
cauuaggguaauugaacacuua

SEQ ID NO: 375428 - RNA, 22 nt, Human
uugaacauuagaauaaguaauu

SEQ ID NO: 375429 - RNA, 22 nt, Human
ugcugccaccccucaccagagc

SEQ ID NO: 375430 - RNA, 22 nt, Human
ccuugcaggggaacaggcagug

SEQ ID NO: 375431 - RNA, 22 nt, Human
uaaauucugaucaaguuccuuc

SEQ ID NO: 375432 - RNA, 22 nt, Human
uacuacauuaauaaaacauuca

SEQ ID NO: 375433 - RNA, 22 nt, Human
cucuguccuugcacaguuccua

SEQ ID NO: 375434 - RNA, 22 nt, Human
guauuugcaaaucuaaaagaga

SEQ ID NO: 375435 - RNA, 22 nt, Human
aucuggcuuaccuagggugccu

SEQ ID NO: 375436 - RNA, 22 nt, Human
ggaagaagggucauuggcagcc

SEQ ID NO: 375437 - RNA, 22 nt, Human
uuuaaagaaauuccucaucuuu

SEQ ID NO: 375438 - RNA, 22 nt, Human
ugcacacacucugcauauacuu

SEQ ID NO: 375439 - RNA, 22 nt, Human
ugagacaguucugcagcugggu

SEQ ID NO: 375440 - RNA, 22 nt, Human
uuugacaugcaaagcacuuuag

SEQ ID NO: 375441 - RNA, 21 nt, Human
agaugaggauacugaggccua

SEQ ID NO: 375442 - RNA, 22 nt, Human
agaggccuaaccaagauguccu

SEQ ID NO: 375443 - RNA, 22 nt, Human
ccuucaaucuuaagucagccca

SEQ ID NO: 375444 - RNA, 22 nt, Human
uagccaggcgaggucagugucg

SEQ ID NO: 375445 - RNA, 22 nt, Human
ggcuggucacaccacugcaggg

SEQ ID NO: 375446 - RNA, 22 nt, Human
uaaauaucaccuggaauuguua

SEQ ID NO: 375447 - RNA, 22 nt, Human
aggcccugggcaguucuguagc

SEQ ID NO: 375448 - RNA, 22 nt, Human
agacagcaggggagucugguuu

SEQ ID NO: 375449 - RNA, 22 nt, Human
agcagcauuaugauauaucuua

SEQ ID NO: 375450 - RNA, 22 nt, Human
ucuggcucugaauucacuucug

SEQ ID NO: 375451 - RNA, 22 nt, Human
ggccugugucugugccuguccu

SEQ ID NO: 375452 - RNA, 22 nt, Human
ccagcugcccaagaggcauccu

SEQ ID NO: 375453 - RNA, 22 nt, Human
cagaggaugaucuggccucucu

SEQ ID NO: 375454 - RNA, 22 nt, Human
agcuccuccugugccaggccag

SEQ ID NO: 375455 - RNA, 22 nt, Human
gguguagcucugugucccacug

SEQ ID NO: 375456 - RNA, 22 nt, Human
agagaagggccuguauguaauc

SEQ ID NO: 375457 - RNA, 22 nt, Human
augaggcagcugcuggagaacg

SEQ ID NO: 375458 - RNA, 23 nt, Human
cuggggcuuucaaaucugggcag

SEQ ID NO: 375459 - RNA, 22 nt, Human
auaaaaguucaagagaguacag

SEQ ID NO: 375460 - RNA, 22 nt, Human
ugcuucaggagaugucaccaug

SEQ ID NO: 375461 - RNA, 22 nt, Human
agcuacccgaggacaggcuaag

SEQ ID NO: 375462 - RNA, 22 nt, Human
ugcaggaagacuucccaagcca

SEQ ID NO: 375463 - RNA, 23 nt, Human
ucucuuucaagagcuuaaugugc

SEQ ID NO: 375464 - RNA, 22 nt, Human
uucuucucucauagauuaaggu

SEQ ID NO: 375465 - RNA, 22 nt, Human
cccaggaagaaauucugauuug

SEQ ID NO: 375466 - RNA, 22 nt, Human
aguccaggaguugggugacauu

SEQ ID NO: 375467 - RNA, 22 nt, Human
agguaacacuacuuaguauacu

SEQ ID NO: 375468 - RNA, 22 nt, Human
uuaauaaacaggugcagcugaa

SEQ ID NO: 375469 - RNA, 22 nt, Human
agagccagcaagugaauaguga

SEQ ID NO: 375470 - RNA, 17 nt, Human
uuucagauucacuuucu

SEQ ID NO: 375471 - RNA, 22 nt, Human
agagcuguagcuuccuagagcc

SEQ ID NO: 375472 - RNA, 17 nt, Human
uguggccuucugagcuu

SEQ ID NO: 375473 - RNA, 22 nt, Human
acagaauacuacagacugguua

SEQ ID NO: 375474 - RNA, 22 nt, Human
cugcuccacaccuccauuuccu

SEQ ID NO: 375475 - RNA, 22 nt, Human
cugcagggcccgccugagcccu

SEQ ID NO: 375476 - RNA, 22 nt, Human
gcagggaagacccggagcagcg

SEQ ID NO: 375477 - RNA, 22 nt, Human
cugccugugccaaugcuccuuu

SEQ ID NO: 375478 - RNA, 22 nt, Human
gaaguacaguuuuaucuagcca

SEQ ID NO: 375479 - RNA, 22 nt, Human
accaggaguagaauaucuguga

SEQ ID NO: 375480 - RNA, 22 nt, Human
aagcugccagcugagcugaggc

SEQ ID NO: 375481 - RNA, 22 nt, Human
aggacugggugcagagggcauc

SEQ ID NO: 375482 - RNA, 22 nt, Human
acuccugggugcugaccagcgu

SEQ ID NO: 375483 - RNA, 22 nt, Human
ucaggcagaaaaaucacuaauu

SEQ ID NO: 375484 - RNA, 22 nt, Human
cuuauuagaaagaaaagacaug

SEQ ID NO: 375485 - RNA, 22 nt, Human
gcagagugaggaagagcuucca

SEQ ID NO: 375486 - RNA, 22 nt, Human
cagggccaugaggcacaggguc

SEQ ID NO: 375487 - RNA, 22 nt, Human
guggggaaaggaguggggcuca

SEQ ID NO: 375488 - RNA, 20 nt, Human
gcagcugcccccagucccug

SEQ ID NO: 375489 - RNA, 22 nt, Human
gaggccuggaccagccacagag

SEQ ID NO: 375490 - RNA, 22 nt, Human
agcuguggcagcagccguggca

SEQ ID NO: 375491 - RNA, 22 nt, Human
uggaccugaagaauaggaagua

SEQ ID NO: 375492 - RNA, 22 nt, Human
cagcuucccuuggcugagcaga

SEQ ID NO: 375493 - RNA, 22 nt, Human
gaggagagggcugcgggcccac

SEQ ID NO: 375494 - RNA, 22 nt, Human
uuccuuaguuauuugguccccu

SEQ ID NO: 375495 - RNA, 22 nt, Human
ucugggaacucugucauuuccc

SEQ ID NO: 375496 - RNA, 22 nt, Human
cauugcuuugugcauauuuaaa

SEQ ID NO: 375497 - RNA, 22 nt, Human
gccuggagaggaagccggugga

SEQ ID NO: 375498 - RNA, 22 nt, Human
ccuuggaggacugcugcuucuu

SEQ ID NO: 375499 - RNA, 22 nt, Human
aauaaaauggucaguuuucuca

SEQ ID NO: 375500 - RNA, 20 nt, Human
ugcagcugcaggaggguggg

SEQ ID NO: 375501 - RNA, 22 nt, Human
augcugugcuggcuaaccaugg

SEQ ID NO: 375502 - RNA, 22 nt, Human
aaucagcuaaauaaacuaguca

SEQ ID NO: 375503 - RNA, 22 nt, Human
agggcugcuuugcuaaauaugg

SEQ ID NO: 375504 - RNA, 22 nt, Human
ggcagcucugaugaugcucugg

SEQ ID NO: 375505 - RNA, 22 nt, Human
cacugaagaugcgacuagugcu

SEQ ID NO: 375506 - RNA, 22 nt, Human
cagguuuagguggacgugcagg

SEQ ID NO: 375507 - RNA, 22 nt, Human
ucucaggggccuggaguccugg

SEQ ID NO: 375508 - RNA, 22 nt, Human
cuguggcuuucucugccuccuu

SEQ ID NO: 375509 - RNA, 22 nt, Human
aguuuuauuccaaugugcagca

SEQ ID NO: 375510 - RNA, 22 nt, Human
cugaagccaugugcucacuggu

SEQ ID NO: 375511 - RNA, 22 nt, Human
guagaaauguaaccaggagaua

SEQ ID NO: 375512 - RNA, 22 nt, Human
gauaugaaguggcauugugaag

SEQ ID NO: 375513 - RNA, 22 nt, Human
uguuuuaaucucccauugcucu

SEQ ID NO: 375514 - RNA, 22 nt, Human
ccacccagaccagggaucuggg

SEQ ID NO: 375515 - RNA, 22 nt, Human
acagggccucagccagggcaga

SEQ ID NO: 375516 - RNA, 22 nt, Human
ugguuuaccccuguccuauauc

SEQ ID NO: 375517 - RNA, 23 nt, Human
uuccuuaacuguuaagauugucu

SEQ ID NO: 375518 - RNA, 22 nt, Human
aaauagcauaaaauaggaagcu

SEQ ID NO: 375519 - RNA, 22 nt, Human
cccagccugucuuucccaauga

SEQ ID NO: 375520 - RNA, 17 nt, Human
aagauuucauuagcuga

SEQ ID NO: 375521 - RNA, 22 nt, Human
cagggcugucuccaaaggcccc

SEQ ID NO: 375522 - RNA, 22 nt, Human
uacuuucuguccuucuguuaaa

SEQ ID NO: 375523 - RNA, 22 nt, Human
gagagaggccuccauguacuga

SEQ ID NO: 375524 - RNA, 22 nt, Human
gcugagggcuguaacagcagag

SEQ ID NO: 375525 - RNA, 22 nt, Human
ggaaaugacuuggugcuucguu

SEQ ID NO: 375526 - RNA, 19 nt, Human
cugaggcccauguaccaug

SEQ ID NO: 375527 - RNA, 21 nt, Human
auuuccaaauaaggucacauu

SEQ ID NO: 375528 - RNA, 22 nt, Human
caguguccucagccagcagcua

SEQ ID NO: 375529 - RNA, 22 nt, Human
aggcugagggcuccugagggca

SEQ ID NO: 375530 - RNA, 22 nt, Human
uagugcuuggcccuaccagaua

SEQ ID NO: 375531 - RNA, 22 nt, Human
uggcucugaccagguagaggag

SEQ ID NO: 375532 - RNA, 22 nt, Human
gcaguggcuaagcucgcaugca

SEQ ID NO: 375533 - RNA, 22 nt, Human
aucaguuucugugaagaacaca

SEQ ID NO: 375534 - RNA, 22 nt, Human
cucugcuuggaacuggacagaa

SEQ ID NO: 375535 - RNA, 22 nt, Human
cccuggaggcggauguugcagu

SEQ ID NO: 375536 - RNA, 22 nt, Human
auaugugugaugcauggacuaa

SEQ ID NO: 375537 - RNA, 22 nt, Human
auucucaguucacuaguuucuu

SEQ ID NO: 375538 - RNA, 22 nt, Human
gcagggcagaaggugcugagga

SEQ ID NO: 375539 - RNA, 21 nt, Human
aaagaacaggcagauguucuu

SEQ ID NO: 375540 - RNA, 22 nt, Human
ccuggagauuauuugguccaau

SEQ ID NO: 375541 - RNA, 22 nt, Human
uggcccgaccucugcucaugca

SEQ ID NO: 375542 - RNA, 21 nt, Human
ucuguucaaggaacuacggau

SEQ ID NO: 375543 - RNA, 22 nt, Human
cagccucucuguaucucaggau

SEQ ID NO: 375544 - RNA, 22 nt, Human
agcccaggcagagggaugcuug

SEQ ID NO: 375545 - RNA, 22 nt, Human
gggaccugggccagaggacagu

SEQ ID NO: 375546 - RNA, 22 nt, Human
ggcagcugggucacaccgaucu

SEQ ID NO: 375547 - RNA, 20 nt, Human
acauguacuaaugaauacag

SEQ ID NO: 375548 - RNA, 22 nt, Human
caggggcuguuugccucaggcc

SEQ ID NO: 375549 - RNA, 22 nt, Human
aaagaugucauacacauuaaga

SEQ ID NO: 375550 - RNA, 22 nt, Human
uauuuguauguguguacauaua

SEQ ID NO: 375551 - RNA, 22 nt, Human
gugcaugaagacucagaaaguc

SEQ ID NO: 375552 - RNA, 22 nt, Human
cccaggcacucuuggucauuuu

SEQ ID NO: 375553 - RNA, 22 nt, Human
ugucuucaguaaaauacacuau

SEQ ID NO: 375554 - RNA, 22 nt, Human
ccccaggaagccucagauuugc

SEQ ID NO: 375555 - RNA, 22 nt, Human
ucauugucuugauaugauuguc

SEQ ID NO: 375556 - RNA, 22 nt, Human
agcagcucacaggauuccugaa

SEQ ID NO: 375557 - RNA, 22 nt, Human
cuuaaauucuuaaugcccucau

SEQ ID NO: 375558 - RNA, 22 nt, Human
uggagaaggggcagggucucca

SEQ ID NO: 375559 - RNA, 22 nt, Human
guuaauauuuaccugucaagaa

SEQ ID NO: 375560 - RNA, 22 nt, Human
gagagaaaugugcaguuugggc

SEQ ID NO: 375561 - RNA, 22 nt, Human
gccuggcacucacugaagaggc

SEQ ID NO: 375562 - RNA, 22 nt, Human
gucagaggaauggaugagugau

SEQ ID NO: 375563 - RNA, 22 nt, Human
aaauccuuuggaggacaugaug

SEQ ID NO: 375564 - RNA, 22 nt, Human
caagggcagcagccucaagcgg

SEQ ID NO: 375565 - RNA, 22 nt, Human
acagaggcagugugagauacug

SEQ ID NO: 375566 - RNA, 22 nt, Human
cagcuuccaucuccacugcccu

SEQ ID NO: 375567 - RNA, 22 nt, Human
ugcugggggcuuucuggauacc

SEQ ID NO: 375568 - RNA, 22 nt, Human
caggcagaguuagugauuuagg

SEQ ID NO: 375569 - RNA, 22 nt, Human
aaggcaguacuuuauguccaua

SEQ ID NO: 375570 - RNA, 22 nt, Human
gagagcuggauucuggauaggu

SEQ ID NO: 375571 - RNA, 22 nt, Human
ccagcugggauuaagggaaaau

SEQ ID NO: 375572 - RNA, 20 nt, Human
gggcuggcgcauggggaaag

SEQ ID NO: 375573 - RNA, 22 nt, Human
caggaggccaacugugggacuu

SEQ ID NO: 375574 - RNA, 22 nt, Human
cacagguguucuugcagugaaa

SEQ ID NO: 375575 - RNA, 21 nt, Human
guauucuuuaugaagugaaaa

SEQ ID NO: 375576 - RNA, 23 nt, Human
uggcagagacccagaaucuacau

SEQ ID NO: 375577 - RNA, 22 nt, Human
ugggcuggugagggaucauuua

SEQ ID NO: 375578 - RNA, 22 nt, Human
gagacagcagggccagggccug

SEQ ID NO: 375579 - RNA, 22 nt, Human
acagaugauuuuuaugaaaaca

SEQ ID NO: 375580 - RNA, 22 nt, Human
cagaggcuguguaggcagacug

SEQ ID NO: 375581 - RNA, 22 nt, Human
aggagggcaggcuggcugccua

SEQ ID NO: 375582 - RNA, 17 nt, Human
agguggguggaucaccu

SEQ ID NO: 375583 - RNA, 22 nt, Human
aaugcacaaaaauuguauguaa

SEQ ID NO: 375584 - RNA, 22 nt, Human
aaaagguagauucuccuucuau

SEQ ID NO: 375585 - RNA, 22 nt, Human
uccuuugacuucuugcagucca

SEQ ID NO: 375586 - RNA, 22 nt, Human
agacaaagacagcaucucaggu

SEQ ID NO: 375587 - RNA, 21 nt, Human
cacuggaauuuucugugacau

SEQ ID NO: 375588 - RNA, 22 nt, Human
gugugaaaguuccuaagacuau

SEQ ID NO: 375589 - RNA, 22 nt, Human
ucuccugguuuguuaaauaauu

SEQ ID NO: 375590 - RNA, 22 nt, Human
cagccagggucaggcagcuucu

SEQ ID NO: 375591 - RNA, 20 nt, Human
ggggcagguuuuuauggcua

SEQ ID NO: 375592 - RNA, 22 nt, Human
uauguacauaacaugaaaugca

SEQ ID NO: 375593 - RNA, 22 nt, Human
guugaaagcuuuucauuuaguu

SEQ ID NO: 375594 - RNA, 22 nt, Human
ggcccugagcugaaguacugug

SEQ ID NO: 375595 - RNA, 21 nt, Human
ugguuugcggccaaaguuaaa

SEQ ID NO: 375596 - RNA, 22 nt, Human
uggcucagcagguuagaaacua

SEQ ID NO: 375597 - RNA, 22 nt, Human
gagggcagagacagugauucac

SEQ ID NO: 375598 - RNA, 22 nt, Human
gugcucuguguauuaggauguc

SEQ ID NO: 375599 - RNA, 22 nt, Human
gcacagaacagagaaauagcca

SEQ ID NO: 375600 - RNA, 22 nt, Human
cucacaggagaaagucaugguc

SEQ ID NO: 375601 - RNA, 22 nt, Human
gggcaagcacagcgagcgugcg

SEQ ID NO: 375602 - RNA, 17 nt, Human
cagggcugucugccuag

SEQ ID NO: 375603 - RNA, 22 nt, Human
agucucuuccuucaaggcuggu

SEQ ID NO: 375604 - RNA, 22 nt, Human
caucugccuaaguggcccuguu

SEQ ID NO: 375605 - RNA, 22 nt, Human
ggcaaaaacagcaaugacuuuu

SEQ ID NO: 375606 - RNA, 22 nt, Human
ugaaaaggaguccuuguuuuca

SEQ ID NO: 375607 - RNA, 22 nt, Human
cuggcuuucuauuuggugcuau

SEQ ID NO: 375608 - RNA, 22 nt, Human
gaaucauuuauuuuugacagca

SEQ ID NO: 375609 - RNA, 22 nt, Human
uugugucccccuuugagagcca

SEQ ID NO: 375610 - RNA, 22 nt, Human
gaggcacaccagggagucuugu

SEQ ID NO: 375611 - RNA, 22 nt, Human
uguaagaaucagucuuuaaugu

SEQ ID NO: 375612 - RNA, 22 nt, Human
uagcagcucacagccucccauu

SEQ ID NO: 375613 - RNA, 22 nt, Human
agggccagcugcagaauuagca

SEQ ID NO: 375614 - RNA, 22 nt, Human
ugaugcugcugggaguggugcu

SEQ ID NO: 375615 - RNA, 22 nt, Human
uggaaggagacugggaagugug

SEQ ID NO: 375616 - RNA, 22 nt, Human
cauugcacuccacccuaggcaa

SEQ ID NO: 375617 - RNA, 22 nt, Human
ggcagcaggcgacuucccuauu

SEQ ID NO: 375618 - RNA, 22 nt, Human
gcuggggagcuagaccucagca

SEQ ID NO: 375619 - RNA, 22 nt, Human
guaauugacucagcucuguuca

SEQ ID NO: 375620 - RNA, 22 nt, Human
ucagagugggagaaugugccaa

SEQ ID NO: 375621 - RNA, 22 nt, Human
uguuuuaaagccauugccuuuc

SEQ ID NO: 375622 - RNA, 22 nt, Human
auucuucauuuacuguuacuug

SEQ ID NO: 375623 - RNA, 22 nt, Human
acagggcagguggcuacugguc

SEQ ID NO: 375624 - RNA, 22 nt, Human
aggauuuagauuuggaggaacu

SEQ ID NO: 375625 - RNA, 22 nt, Human
cacugugucaguuugguuagac

SEQ ID NO: 375626 - RNA, 22 nt, Human
caaguccuaaauguauuuguug

SEQ ID NO: 375627 - RNA, 22 nt, Human
uuucagaucauuuuuuaaguac

SEQ ID NO: 375628 - RNA, 22 nt, Human
uuuagggaaauugaggguuaag

SEQ ID NO: 375629 - RNA, 22 nt, Human
ucacacagguuugcaaugauuu

SEQ ID NO: 375630 - RNA, 22 nt, Human
ccagggcagugggagaaggugc

SEQ ID NO: 375631 - RNA, 22 nt, Human
gcugucacaagcaucuggggca

SEQ ID NO: 375632 - RNA, 21 nt, Human
aaguaaaucagagaaauaacc

SEQ ID NO: 375633 - RNA, 22 nt, Human
aaaguuugaaugauauauuagu

SEQ ID NO: 375634 - RNA, 22 nt, Human
gcagggcagggcaagaacuggg

SEQ ID NO: 375635 - RNA, 19 nt, Human
gcacugaagaguuggucac

SEQ ID NO: 375636 - RNA, 22 nt, Human
auguaucagaaauagcauuggc

SEQ ID NO: 375637 - RNA, 22 nt, Human
gcugauguuuaguugauguuac

SEQ ID NO: 375638 - RNA, 22 nt, Human
aggguagggcccggagacagac

SEQ ID NO: 375639 - RNA, 22 nt, Human
guccuggcuuaguucgcuguaa

SEQ ID NO: 375640 - RNA, 22 nt, Human
uggccugcuuucauuugaugcu

SEQ ID NO: 375641 - RNA, 22 nt, Human
ugcucugggcaacagccucccu

SEQ ID NO: 375642 - RNA, 22 nt, Human
ccccaccagcacccucucuauc

SEQ ID NO: 375643 - RNA, 22 nt, Human
cuggcucccguuguccuugaag

SEQ ID NO: 375644 - RNA, 22 nt, Human
aaaugcaccuugcugugagacu

SEQ ID NO: 375645 - RNA, 22 nt, Human
ccccagcugcauacuugccaag

SEQ ID NO: 375646 - RNA, 22 nt, Human
ucccaaggccaggcaucuagaa

SEQ ID NO: 375647 - RNA, 22 nt, Human
gcagaagucagaccaucugaau

SEQ ID NO: 375648 - RNA, 22 nt, Human
aaggcuuuuaacuacuguuuua

SEQ ID NO: 375649 - RNA, 18 nt, Human
ggcagcaagaagggaggg

SEQ ID NO: 375650 - RNA, 22 nt, Human
agucaguuaaccucacagcauc

SEQ ID NO: 375651 - RNA, 22 nt, Human
ucucagagcuucagaaagcacc

SEQ ID NO: 375652 - RNA, 22 nt, Human
augucccagcugagagacaacu

SEQ ID NO: 375653 - RNA, 22 nt, Human
uuaugcaacaggugagcagaca

SEQ ID NO: 375654 - RNA, 22 nt, Human
uggaggggcaauggagcgcgga

SEQ ID NO: 375655 - RNA, 19 nt, Human
guaagggcuaauggacuau

SEQ ID NO: 375656 - RNA, 20 nt, Human
ucauuucuugggguuccaag

SEQ ID NO: 375657 - RNA, 22 nt, Human
gacucugcuacaggccgagguu

SEQ ID NO: 375658 - RNA, 22 nt, Human
uggcaggguggcaacuuuuggu

SEQ ID NO: 375659 - RNA, 22 nt, Human
ggggccagguccagcuuccaaa

SEQ ID NO: 375660 - RNA, 22 nt, Human
ccaaaguccacaguuuacauua

SEQ ID NO: 375661 - RNA, 23 nt, Human
uaaagacagccuucaggauucug

SEQ ID NO: 375662 - RNA, 22 nt, Human
gccuuccuuacaccugcucagc

SEQ ID NO: 375663 - RNA, 20 nt, Human
aguguuccggaagacuggca

SEQ ID NO: 375664 - RNA, 22 nt, Human
auuuuaucugcuuacuuucagg

SEQ ID NO: 375665 - RNA, 21 nt, Human
uccaggaguucuaauaggugu

SEQ ID NO: 375666 - RNA, 22 nt, Human
aaggagaguacaggaguuggua

SEQ ID NO: 375667 - RNA, 22 nt, Human
gcugccagcucacucuccugag

SEQ ID NO: 375668 - RNA, 21 nt, Human
ucacaugcccauuacuggagc

SEQ ID NO: 375669 - RNA, 22 nt, Human
agcugucagugcugugccugua

SEQ ID NO: 375670 - RNA, 22 nt, Human
gaaaaaugcuccaaaucugugg

SEQ ID NO: 375671 - RNA, 22 nt, Human
agcuuuauuaacucuccaggug

SEQ ID NO: 375672 - RNA, 22 nt, Human
ugagcccagagaucugagcuau

SEQ ID NO: 375673 - RNA, 22 nt, Human
uccacuuuagcaaugauugaau

SEQ ID NO: 375674 - RNA, 22 nt, Human
ugggcagagucguggggaauag

SEQ ID NO: 375675 - RNA, 22 nt, Human
gagcagagacaguacaacuggc

SEQ ID NO: 375676 - RNA, 22 nt, Human
agucauauguggcauuuucuaa

SEQ ID NO: 375677 - RNA, 22 nt, Human
uguguuccuucgucuucccuuc

SEQ ID NO: 375678 - RNA, 22 nt, Human
ccagaggaugcuggucagccuc

SEQ ID NO: 375679 - RNA, 21 nt, Human
ucauuugugaucugauuucca

SEQ ID NO: 375680 - RNA, 17 nt, Human
ggcagcugugugcaugc

SEQ ID NO: 375681 - RNA, 22 nt, Human
agccuggagguaaugaggaaac

SEQ ID NO: 375682 - RNA, 21 nt, Human
caagccagaccaauagcagcc

SEQ ID NO: 375683 - RNA, 22 nt, Human
uucaagaucuuccaaaggauac

SEQ ID NO: 375684 - RNA, 22 nt, Human
gcuguggccuggcgcagagcug

SEQ ID NO: 375685 - RNA, 22 nt, Human
ggcagcucacugauuagcaauu

SEQ ID NO: 375686 - RNA, 22 nt, Human
agcagggcuccauuucacugcc

SEQ ID NO: 375687 - RNA, 22 nt, Human
agcagcaugaugacagagucuc

SEQ ID NO: 375688 - RNA, 19 nt, Human
ugacaggcuguugccuuga

SEQ ID NO: 375689 - RNA, 22 nt, Human
gaaggaggcguuagcccuagga

SEQ ID NO: 375690 - RNA, 22 nt, Human
uaugaacuuuugaugugacaug

SEQ ID NO: 375691 - RNA, 22 nt, Human
ugucaaaaugacuuuacuacag

SEQ ID NO: 375692 - RNA, 20 nt, Human
ccagcugagccaaggggaga

SEQ ID NO: 375693 - RNA, 22 nt, Human
ucagaggaugcuguucuuuaau

SEQ ID NO: 375694 - RNA, 22 nt, Human
agggagguccaucccugcagag

SEQ ID NO: 375695 - RNA, 22 nt, Human
cuuaaagaaauugaggagagga

SEQ ID NO: 375696 - RNA, 22 nt, Human
guuagggaagcgcuguguucuu

SEQ ID NO: 375697 - RNA, 22 nt, Human
cuuucaacuacauacaggcgau

SEQ ID NO: 375698 - RNA, 22 nt, Human
agccagcugccuuucacaucug

SEQ ID NO: 375699 - RNA, 22 nt, Human
auucuucaaagagugucaaagu

SEQ ID NO: 375700 - RNA, 22 nt, Human
gcugggaggaauuuggggaaua

SEQ ID NO: 375701 - RNA, 22 nt, Human
ugucucugggugauucaguccu

SEQ ID NO: 375702 - RNA, 23 nt, Human
uuaaacuucagugcagaacacuc

SEQ ID NO: 375703 - RNA, 22 nt, Human
agccucuguagaaagcagugug

SEQ ID NO: 375704 - RNA, 22 nt, Human
aucuaacagcaacaccagaaua

SEQ ID NO: 375705 - RNA, 22 nt, Human
caccacuucauaggcuuuaagg

SEQ ID NO: 375706 - RNA, 22 nt, Human
gauggcaggugauagccgaguc

SEQ ID NO: 375707 - RNA, 22 nt, Human
ugggcucauggcccagcacugg

SEQ ID NO: 375708 - RNA, 22 nt, Human
uggggcugucccgguuuggcga

SEQ ID NO: 375709 - RNA, 22 nt, Human
ugccucugaggaagauuguguu

SEQ ID NO: 375710 - RNA, 22 nt, Human
aagaauguucuuguagucauga

SEQ ID NO: 375711 - RNA, 22 nt, Human
aagacauuacuggaaucugacu

SEQ ID NO: 375712 - RNA, 22 nt, Human
cauugucacccaaagcucauag

SEQ ID NO: 375713 - RNA, 22 nt, Human
aaaggaagauugagcuuuucca

SEQ ID NO: 375714 - RNA, 22 nt, Human
cacagcagaaaguguaggagga

SEQ ID NO: 375715 - RNA, 22 nt, Human
gccaggagccagcuucuuagca

SEQ ID NO: 375716 - RNA, 22 nt, Human
aagggcuggcccugggaagagu

SEQ ID NO: 375717 - RNA, 22 nt, Human
cuggaaauuggagaugauguuu

SEQ ID NO: 375718 - RNA, 22 nt, Human
auuucuuccucugucaguaacu

SEQ ID NO: 375719 - RNA, 22 nt, Human
agagccaggaucuguuuugggg

SEQ ID NO: 375720 - RNA, 22 nt, Human
cugagagaaucaugcugcaggu

SEQ ID NO: 375721 - RNA, 22 nt, Human
uuuuuaguagagguggguuuca

SEQ ID NO: 375722 - RNA, 21 nt, Human
gggcgaggccugauguggcuc

SEQ ID NO: 375723 - RNA, 22 nt, Human
ggcagagaugugggucagaauc

SEQ ID NO: 375724 - RNA, 22 nt, Human
gaauuguacgcuuuacauaggu

SEQ ID NO: 375725 - RNA, 22 nt, Human
ugccuggcaagaggggcuggcu

SEQ ID NO: 375726 - RNA, 22 nt, Human
agggccagcugaugagaaugag

SEQ ID NO: 375727 - RNA, 22 nt, Human
gaagccagcaguggagaaagga

SEQ ID NO: 375728 - RNA, 22 nt, Human
guagaaauagugguugacagga

SEQ ID NO: 375729 - RNA, 22 nt, Human
ucacuuaaaaauucuaguuaug

SEQ ID NO: 375730 - RNA, 22 nt, Human
agauuuccugcacugccuuuga

SEQ ID NO: 375731 - RNA, 22 nt, Human
agaggggaaggaugugauguga

SEQ ID NO: 375732 - RNA, 22 nt, Human
uaaaauugcggugaauauuucc

SEQ ID NO: 375733 - RNA, 22 nt, Human
aagugguagacaaagauaauug

SEQ ID NO: 375734 - RNA, 22 nt, Human
aucaguuuggaacauucaggcc

SEQ ID NO: 375735 - RNA, 22 nt, Human
cuccucacacccacugcaacca

SEQ ID NO: 375736 - RNA, 20 nt, Human
gagagcuggggaugaggcug

SEQ ID NO: 375737 - RNA, 22 nt, Human
ucaccagucuuucuuaccauug

SEQ ID NO: 375738 - RNA, 22 nt, Human
aucagaagaaauggaugugacu

SEQ ID NO: 375739 - RNA, 22 nt, Human
ccagggcugcugugggacucca

SEQ ID NO: 375740 - RNA, 22 nt, Human
ucucaggguuuguacaagugua

SEQ ID NO: 375741 - RNA, 22 nt, Human
aauaaccuuacuuauuacaugg

SEQ ID NO: 375742 - RNA, 22 nt, Human
uacuuuagaaggaaauaaguuc

SEQ ID NO: 375743 - RNA, 22 nt, Human
augaaauauuucagagcagagu

SEQ ID NO: 375744 - RNA, 22 nt, Human
caggcacuucugcugcuugucu

SEQ ID NO: 375745 - RNA, 22 nt, Human
aggcaggcaaccaccugggaag

SEQ ID NO: 375746 - RNA, 17 nt, Human
ugaaggccaugaccacg

SEQ ID NO: 375747 - RNA, 22 nt, Human
ucacacauucuagguauguuga

SEQ ID NO: 375748 - RNA, 22 nt, Human
cuugauguauaaguugauaugu

SEQ ID NO: 375749 - RNA, 22 nt, Human
uccugccucuuuucuuauucca

SEQ ID NO: 375750 - RNA, 22 nt, Human
gccaggcugcuccagggaggcc

SEQ ID NO: 375751 - RNA, 22 nt, Human
aacaaauggggccuuguaugaa

SEQ ID NO: 375752 - RNA, 22 nt, Human
ggcccugggaugcucagcagug

SEQ ID NO: 375753 - RNA, 22 nt, Human
aaaguuuuagaacuaggaagca

SEQ ID NO: 375754 - RNA, 22 nt, Human
aaagccuuugucucaggcucug

SEQ ID NO: 375755 - RNA, 22 nt, Human
agagccuggcucccagcuaccg

SEQ ID NO: 375756 - RNA, 22 nt, Human
cuggagcauccaugcccagggu

SEQ ID NO: 375757 - RNA, 22 nt, Human
ccugccugaaggucagccaccc

SEQ ID NO: 375758 - RNA, 22 nt, Human
aggcugaggcuuuccuuggaga

SEQ ID NO: 375759 - RNA, 22 nt, Human
uucauucuugggaucagagagu

SEQ ID NO: 375760 - RNA, 22 nt, Human
ccuccuuuccuguuuuccugag

SEQ ID NO: 375761 - RNA, 22 nt, Human
uccucaggauguggaguagaau

SEQ ID NO: 375762 - RNA, 22 nt, Human
ggcugaaguguaguggcucacu

SEQ ID NO: 375763 - RNA, 22 nt, Human
auacauguaacugcauuguaau

SEQ ID NO: 375764 - RNA, 22 nt, Human
ucuggagcuuguuucagauggu

SEQ ID NO: 375765 - RNA, 22 nt, Human
augcacuugcguguuugcaaau

SEQ ID NO: 375766 - RNA, 22 nt, Human
aggcagcuuucuggugcaccau

SEQ ID NO: 375767 - RNA, 23 nt, Human
uuaggcacuuaguagggccagag

SEQ ID NO: 375768 - RNA, 22 nt, Human
augguuuaaagaguaugacuuu

SEQ ID NO: 375769 - RNA, 22 nt, Human
cagggagaaaucuccaggaggu

SEQ ID NO: 375770 - RNA, 22 nt, Human
cauugaaaccuaacauaggcug

SEQ ID NO: 375771 - RNA, 22 nt, Human
gcugucugagaacaugguggaa

SEQ ID NO: 375772 - RNA, 22 nt, Human
ugacagggugauuaugagagcu

SEQ ID NO: 375773 - RNA, 22 nt, Human
ccagaggugcugggagaggucu

SEQ ID NO: 375774 - RNA, 22 nt, Human
ggacuggccggcgcugaggccc

SEQ ID NO: 375775 - RNA, 22 nt, Human
ugcagcagguuccaaaggguua

SEQ ID NO: 375776 - RNA, 22 nt, Human
aggcagcuggaggcagagacua

SEQ ID NO: 375777 - RNA, 22 nt, Human
ucccagggacucucugccuucc

SEQ ID NO: 375778 - RNA, 22 nt, Human
ugggcuggcguggagaguuuag

SEQ ID NO: 375779 - RNA, 22 nt, Human
gggccuggggugacguaccccu

SEQ ID NO: 375780 - RNA, 22 nt, Human
ugaggcagucacccccuccugc

SEQ ID NO: 375781 - RNA, 22 nt, Human
aggccacaguacuuugcagacc

SEQ ID NO: 375782 - RNA, 22 nt, Human
ucccagaguauuagcaauugcu

SEQ ID NO: 375783 - RNA, 22 nt, Human
gagguggaaggcaggaacaaau

SEQ ID NO: 375784 - RNA, 22 nt, Human
cucacugucuguacuagcugau

SEQ ID NO: 375785 - RNA, 22 nt, Human
uugcugaaaucuaugacauccu

SEQ ID NO: 375786 - RNA, 22 nt, Human
ucucagagauuuauggaaaacu

SEQ ID NO: 375787 - RNA, 18 nt, Human
gccugccuagagcuugcc

SEQ ID NO: 375788 - RNA, 22 nt, Human
auugcuguaaauuaucuuauua

SEQ ID NO: 375789 - RNA, 22 nt, Human
ugaggcagaaaauagcaguuca

SEQ ID NO: 375790 - RNA, 22 nt, Human
ggccugcucugcagccucuaca

SEQ ID NO: 375791 - RNA, 22 nt, Human
cugcuuugauuagaagaguaca

SEQ ID NO: 375792 - RNA, 22 nt, Human
agggcuacugccugccuucagg

SEQ ID NO: 375793 - RNA, 22 nt, Human
aggggcugcuggguccgccccu

SEQ ID NO: 375794 - RNA, 20 nt, Human
ccugucucacguuccgcccc

SEQ ID NO: 375795 - RNA, 21 nt, Human
guagggacagagaguugguga

SEQ ID NO: 375796 - RNA, 22 nt, Human
gagcacagaaucuucccaugca

SEQ ID NO: 375797 - RNA, 22 nt, Human
ggcaggagauaaaauauuaguu

SEQ ID NO: 375798 - RNA, 22 nt, Human
aacugcauuugcauaaguccau

SEQ ID NO: 375799 - RNA, 22 nt, Human
ucuguucagguuucagagaacu

SEQ ID NO: 375800 - RNA, 22 nt, Human
auaaggcacacauagauagggu

SEQ ID NO: 375801 - RNA, 21 nt, Human
uauuucuuugacucucucccu

SEQ ID NO: 375802 - RNA, 22 nt, Human
ggaaggaggaugcucuggccuu

SEQ ID NO: 375803 - RNA, 22 nt, Human
acauuucugagcagggagcugu

SEQ ID NO: 375804 - RNA, 22 nt, Human
acagaccaaguuuccagcaggu

SEQ ID NO: 375805 - RNA, 22 nt, Human
agcaggcuccuuccuucucugg

SEQ ID NO: 375806 - RNA, 22 nt, Human
ugaaggcauugaugaaggaauc

SEQ ID NO: 375807 - RNA, 22 nt, Human
cacaaugugguuugucaucuuu

SEQ ID NO: 375808 - RNA, 22 nt, Human
uggcacugggaugcuacuguua

SEQ ID NO: 375809 - RNA, 22 nt, Human
uuaauacagucuccagaaguaa

SEQ ID NO: 375810 - RNA, 22 nt, Human
aacaugcuuugauaaauaaaag

SEQ ID NO: 375811 - RNA, 22 nt, Human
uggccucugugggagcugagca

SEQ ID NO: 375812 - RNA, 22 nt, Human
gucccuggucuaccguggcuuc

SEQ ID NO: 375813 - RNA, 22 nt, Human
aaauugcaaaaguacuuuuagg

SEQ ID NO: 375814 - RNA, 22 nt, Human
cagucccaugagcccagaacau

SEQ ID NO: 375815 - RNA, 22 nt, Human
gauguguuuccaggauuuguuu

SEQ ID NO: 375816 - RNA, 22 nt, Human
aggguauaaagagcaagcagaa

SEQ ID NO: 375817 - RNA, 22 nt, Human
agucuucagagaaauuaacucu

SEQ ID NO: 375818 - RNA, 22 nt, Human
uggcugagccacuuguucagau

SEQ ID NO: 375819 - RNA, 22 nt, Human
cagagcauuuggaagccacgug

SEQ ID NO: 375820 - RNA, 22 nt, Human
uggcuuccacugugugcccccu

SEQ ID NO: 375821 - RNA, 22 nt, Human
gcuggccuucugcagaguucug

SEQ ID NO: 375822 - RNA, 22 nt, Human
uaaagguaugucuuaaucaaac

SEQ ID NO: 375823 - RNA, 22 nt, Human
ccagucacagguguguuuauau

SEQ ID NO: 375824 - RNA, 23 nt, Human
cccagcagagaugaggagggguc

SEQ ID NO: 375825 - RNA, 22 nt, Human
uaguuaaaauaauggagauguu

SEQ ID NO: 375826 - RNA, 22 nt, Human
ugaagcagcaccauuuuagagc

SEQ ID NO: 375827 - RNA, 22 nt, Human
aggccugggacgggagccguga

SEQ ID NO: 375828 - RNA, 22 nt, Human
uuauuuuuaaaaguucacacag

SEQ ID NO: 375829 - RNA, 22 nt, Human
gaaggcaggcuucugauuaggu

SEQ ID NO: 375830 - RNA, 21 nt, Human
gacaaagugaagcaggcagga

SEQ ID NO: 375831 - RNA, 22 nt, Human
aguucucagcuuaguaugcugu

SEQ ID NO: 375832 - RNA, 22 nt, Human
uuaugcuaaaugaaucaaguca

SEQ ID NO: 375833 - RNA, 22 nt, Human
agcucagcuuccucuccaugcu

SEQ ID NO: 375834 - RNA, 22 nt, Human
cuggcucaggaaaguugcugcu

SEQ ID NO: 375835 - RNA, 22 nt, Human
gaggagagaacauuccuccaua

SEQ ID NO: 375836 - RNA, 22 nt, Human
caaauucacaugauugcuucug

SEQ ID NO: 375837 - RNA, 22 nt, Human
ucccaggaugaagacaguguug

SEQ ID NO: 375838 - RNA, 19 nt, Human
ugcccaggccagguugggc

SEQ ID NO: 375839 - RNA, 22 nt, Human
acacauuucuaaauuuuuaccg

SEQ ID NO: 375840 - RNA, 22 nt, Human
ccagggcaggggcuggaguuca

SEQ ID NO: 375841 - RNA, 22 nt, Human
ucuucucccaucuccaggcagg

SEQ ID NO: 375842 - RNA, 22 nt, Human
aggcucagcaucugauucauau

SEQ ID NO: 375843 - RNA, 22 nt, Human
ugcagauucaaaugaaaugcaa

SEQ ID NO: 375844 - RNA, 22 nt, Human
ccacagggacuguuaaaacccu

SEQ ID NO: 375845 - RNA, 22 nt, Human
cucacugcccugaaguuggguu

SEQ ID NO: 375846 - RNA, 22 nt, Human
uagcagcuuccagagagggcag

SEQ ID NO: 375847 - RNA, 21 nt, Human
auuucagagcacacaaguaaa

SEQ ID NO: 375848 - RNA, 22 nt, Human
cucaggaggaggaaguucauug

SEQ ID NO: 375849 - RNA, 22 nt, Human
caaaagaagcucuuggggcuag

SEQ ID NO: 375850 - RNA, 22 nt, Human
ucucugaagauauuuauuauua

SEQ ID NO: 375851 - RNA, 22 nt, Human
cagggugggcacccagccucca

SEQ ID NO: 375852 - RNA, 22 nt, Human
uccuggccuugcuccugaugcc

SEQ ID NO: 375853 - RNA, 22 nt, Human
aaggaagauauaucaagcuuaa

SEQ ID NO: 375854 - RNA, 22 nt, Human
ugaccuauuagauuuccuugcc

SEQ ID NO: 375855 - RNA, 22 nt, Human
ucagagcuaaggggagagcaaa

SEQ ID NO: 375856 - RNA, 22 nt, Human
cugggaggcggagguuguagug

SEQ ID NO: 375857 - RNA, 22 nt, Human
agggcucuguccccagaggccc

SEQ ID NO: 375858 - RNA, 22 nt, Human
auuauaaaccuuugaggguggg

SEQ ID NO: 375859 - RNA, 22 nt, Human
acagcuugcaauggcuuucaac

SEQ ID NO: 375860 - RNA, 22 nt, Human
ugcuguguucuccugacucacc

SEQ ID NO: 375861 - RNA, 22 nt, Human
ccugcaggggagagacuucuag

SEQ ID NO: 375862 - RNA, 21 nt, Human
gcagagccugagguucuugag

SEQ ID NO: 375863 - RNA, 22 nt, Human
gcagagccccauugcuggcggg

SEQ ID NO: 375864 - RNA, 22 nt, Human
aacauacauauuucagugucca

SEQ ID NO: 375865 - RNA, 22 nt, Human
auggggugagacuaggauuaaa

SEQ ID NO: 375866 - RNA, 22 nt, Human
uggcagggccuaccccaauauc

SEQ ID NO: 375867 - RNA, 22 nt, Human
cagucucuaaaucaaucugaau

SEQ ID NO: 375868 - RNA, 22 nt, Human
gcccaggaguugaagggcugac

SEQ ID NO: 375869 - RNA, 20 nt, Human
gggagaagggcugaugagag

SEQ ID NO: 375870 - RNA, 22 nt, Human
ggccucagugggccgcugcagg

SEQ ID NO: 375871 - RNA, 22 nt, Human
cuuuaagagaucaccaaucaca

SEQ ID NO: 375872 - RNA, 22 nt, Human
acagaacugcaggaggaaaagc

SEQ ID NO: 375873 - RNA, 22 nt, Human
cucuggcuucuaccuugcaguu

SEQ ID NO: 375874 - RNA, 22 nt, Human
uacaaaguauauuucuagcugu

SEQ ID NO: 375875 - RNA, 22 nt, Human
agaagccauucccuguaggcuc

SEQ ID NO: 375876 - RNA, 22 nt, Human
agugggcagugcgcucggaugc

SEQ ID NO: 375877 - RNA, 22 nt, Human
aggugucuuugcggcccgccgc

SEQ ID NO: 375878 - RNA, 21 nt, Human
ccuggcugcacaguugcuggu

SEQ ID NO: 375879 - RNA, 22 nt, Human
aggugucugggcuuuggaguca

SEQ ID NO: 375880 - RNA, 22 nt, Human
ggcugggagcuggacaggccgg

SEQ ID NO: 375881 - RNA, 22 nt, Human
ugcucugugguccaagauggcu

SEQ ID NO: 375882 - RNA, 22 nt, Human
uaagaaacccaggaauuucuua

SEQ ID NO: 375883 - RNA, 22 nt, Human
uugggcuggcagagguggucuu

SEQ ID NO: 375884 - RNA, 23 nt, Human
uacaugcuauaauuucacccuca

SEQ ID NO: 375885 - RNA, 22 nt, Human
agccuggaggccaggagacagu

SEQ ID NO: 375886 - RNA, 22 nt, Human
acuuaaaaagaaucuuuucacg

SEQ ID NO: 375887 - RNA, 22 nt, Human
uggcucagugaagagauaacuu

SEQ ID NO: 375888 - RNA, 22 nt, Human
uccccagccgugaaggagagga

SEQ ID NO: 375889 - RNA, 22 nt, Human
gccucugcaugcucagcaccca

SEQ ID NO: 375890 - RNA, 22 nt, Human
cuguccuggagggcauaggacg

SEQ ID NO: 375891 - RNA, 22 nt, Human
cucccugggccucaguuucucu

SEQ ID NO: 375892 - RNA, 22 nt, Human
gggcugcuuauacugaugauaa

SEQ ID NO: 375893 - RNA, 22 nt, Human
gagccagguuggaggcugcagu

SEQ ID NO: 375894 - RNA, 22 nt, Human
cugcuguggaugcaggaccuca

SEQ ID NO: 375895 - RNA, 22 nt, Human
aguggugcugcgcgcggagcuc

SEQ ID NO: 375896 - RNA, 22 nt, Human
cagagguagaaggcaugcagug

SEQ ID NO: 375897 - RNA, 22 nt, Human
uggaggccagagguacugggac

SEQ ID NO: 375898 - RNA, 22 nt, Human
gagggcaguagccucguacccu

SEQ ID NO: 375899 - RNA, 22 nt, Human
ugccaggaggaggugggacaga

SEQ ID NO: 375900 - RNA, 22 nt, Human
gcccuuccaacccagagggcaa

SEQ ID NO: 375901 - RNA, 22 nt, Human
cuggcucaauaaauauuagcug

SEQ ID NO: 375902 - RNA, 22 nt, Human
augauuuccaguuguugcuaag

SEQ ID NO: 375903 - RNA, 22 nt, Human
auucuucagaauaucuggcacu

SEQ ID NO: 375904 - RNA, 22 nt, Human
gcucucuggaggccauggacag

SEQ ID NO: 375905 - RNA, 22 nt, Human
acgugcaggaucugguuggcga

SEQ ID NO: 375906 - RNA, 19 nt, Human
agcuguggaugugggauuu

SEQ ID NO: 375907 - RNA, 22 nt, Human
uuaaacagguuuuugaauggcc

SEQ ID NO: 375908 - RNA, 22 nt, Human
aaaguucaugguguuauagaaa

SEQ ID NO: 375909 - RNA, 22 nt, Human
aggguccugggugcaguugcuu

SEQ ID NO: 375910 - RNA, 22 nt, Human
uuucauguuuauggaaaaugag

SEQ ID NO: 375911 - RNA, 22 nt, Human
uucauugugauucuuggcuagc

SEQ ID NO: 375912 - RNA, 22 nt, Human
uguacaaugccagggaacacca

SEQ ID NO: 375913 - RNA, 22 nt, Human
ccagggcaucacauccaguguu

SEQ ID NO: 375914 - RNA, 22 nt, Human
cagagccaacgccaccugccca

SEQ ID NO: 375915 - RNA, 22 nt, Human
agaauuuuugauuaucuacucg

SEQ ID NO: 375916 - RNA, 20 nt, Human
ggccugagcauggcuggcag

SEQ ID NO: 375917 - RNA, 22 nt, Human
gaagcagcugccagagaugucu

SEQ ID NO: 375918 - RNA, 22 nt, Human
aaugcugcucucauaauuauag

SEQ ID NO: 375919 - RNA, 22 nt, Human
cuauuacauuucuggacauuca

SEQ ID NO: 375920 - RNA, 22 nt, Human
ugucccagacauaaguggacau

SEQ ID NO: 375921 - RNA, 22 nt, Human
ccucaggauccgcaggugcagu

SEQ ID NO: 375922 - RNA, 22 nt, Human
ugggcucugugccagguuggug

SEQ ID NO: 375923 - RNA, 22 nt, Human
gcaguucuacuuauccauagac

SEQ ID NO: 375924 - RNA, 22 nt, Human
agagggaaugugauugcaccau

SEQ ID NO: 375925 - RNA, 22 nt, Human
gccaguggucacugaggaagaa

SEQ ID NO: 375926 - RNA, 22 nt, Human
cuguagccagaagcagaaggcc

SEQ ID NO: 375927 - RNA, 22 nt, Human
gaugggaggaaccugggucccu

SEQ ID NO: 375928 - RNA, 22 nt, Human
agggcuggcaucucuaaugcug

SEQ ID NO: 375929 - RNA, 22 nt, Human
uuauucugcacuuuuaaaauau

SEQ ID NO: 375930 - RNA, 22 nt, Human
gccuuggcugaugugcgaauga

SEQ ID NO: 375931 - RNA, 22 nt, Human
auccucagaccucagcaaagcc

SEQ ID NO: 375932 - RNA, 22 nt, Human
gaguuauucuagguccuuugua

SEQ ID NO: 375933 - RNA, 22 nt, Human
uugugaaacauucauggauuug

SEQ ID NO: 375934 - RNA, 22 nt, Human
gagacacagagaggcuguguga

SEQ ID NO: 375935 - RNA, 22 nt, Human
agaaaaggauugauggaucaga

SEQ ID NO: 375936 - RNA, 22 nt, Human
ugugcuucagguugucgccacg

SEQ ID NO: 375937 - RNA, 22 nt, Human
cugcucuggcuguguacuucag

SEQ ID NO: 375938 - RNA, 22 nt, Human
aucuggcucgcuaggcucuggg

SEQ ID NO: 375939 - RNA, 22 nt, Human
ccaaagucugcauuuuaacaug

SEQ ID NO: 375940 - RNA, 22 nt, Human
ccagcuugaagaugugcugguu

SEQ ID NO: 375941 - RNA, 22 nt, Human
auauucuucuuguucagacuau

SEQ ID NO: 375942 - RNA, 22 nt, Human
ggagucaccaaguaggagucuu

SEQ ID NO: 375943 - RNA, 22 nt, Human
aucugccucuucuucauugcga

SEQ ID NO: 375944 - RNA, 22 nt, Human
uaucuguuggcuccuaguugua

SEQ ID NO: 375945 - RNA, 22 nt, Human
aaaugguauuuacucuguauua

SEQ ID NO: 375946 - RNA, 22 nt, Human
uacccaggagaaacagcagggc

SEQ ID NO: 375947 - RNA, 22 nt, Human
aauccagguggcggagguugug

SEQ ID NO: 375948 - RNA, 22 nt, Human
ucucucagcuuugagaccugcu

SEQ ID NO: 375949 - RNA, 22 nt, Human
ggucccagguugacagggagac

SEQ ID NO: 375950 - RNA, 22 nt, Human
guccaugauucuguguaguaga

SEQ ID NO: 375951 - RNA, 19 nt, Human
acacagggaucagaggguu

SEQ ID NO: 375952 - RNA, 22 nt, Human
aaugagcuagaccugcuuccuc

SEQ ID NO: 375953 - RNA, 20 nt, Human
accaggagauggaggcaggg

SEQ ID NO: 375954 - RNA, 22 nt, Human
gcagaggcuguagggaagguug

SEQ ID NO: 375955 - RNA, 22 nt, Human
aggggcaguuccaaguuuugug

SEQ ID NO: 375956 - RNA, 22 nt, Human
cagggcccaggccacuggguug

SEQ ID NO: 375957 - RNA, 22 nt, Human
ugccacccagccaggaguggga

SEQ ID NO: 375958 - RNA, 18 nt, Human
ugcucuguuuaaugauuu

SEQ ID NO: 375959 - RNA, 22 nt, Human
cacagaggcaaccuucuggggu

SEQ ID NO: 375960 - RNA, 22 nt, Human
auggcauuugaccgcuuugugg

SEQ ID NO: 375961 - RNA, 22 nt, Human
gccugggugaauuugauccuaa

SEQ ID NO: 375962 - RNA, 22 nt, Human
uaugcacacauuagcacagggu

SEQ ID NO: 375963 - RNA, 22 nt, Human
aauuuccaaauuucugucacac

SEQ ID NO: 375964 - RNA, 18 nt, Human
augggaggggccaagaga

SEQ ID NO: 375965 - RNA, 22 nt, Human
uaugauuuguagacauuugauu

SEQ ID NO: 375966 - RNA, 22 nt, Human
uacuagaaccucacaacaaucc

SEQ ID NO: 375967 - RNA, 22 nt, Human
ucucaggaaauaggauuugagu

SEQ ID NO: 375968 - RNA, 22 nt, Human
agcuggcagcucucagggguac

SEQ ID NO: 375969 - RNA, 22 nt, Human
acugcagcaaagcccgugucuu

SEQ ID NO: 375970 - RNA, 22 nt, Human
ccagagucuaugaguccucauu

SEQ ID NO: 375971 - RNA, 23 nt, Human
gcugcagcuguggauguucucag

SEQ ID NO: 375972 - RNA, 22 nt, Human
ccacaggggcccacgagccgcu

SEQ ID NO: 375973 - RNA, 22 nt, Human
cagccagggagggcaaaugaga

SEQ ID NO: 375974 - RNA, 22 nt, Human
caccugcaaggagcuuucauuu

SEQ ID NO: 375975 - RNA, 22 nt, Human
ucucccaggugggugccuggag

SEQ ID NO: 375976 - RNA, 22 nt, Human
ugugaauagugccgcaauaaac

SEQ ID NO: 375977 - RNA, 22 nt, Human
aaucaagucaaccaucaugugc

SEQ ID NO: 375978 - RNA, 22 nt, Human
augcugugucaccuuaggauuu

SEQ ID NO: 375979 - RNA, 22 nt, Human
cauuuacacacagaggugugcu

SEQ ID NO: 375980 - RNA, 22 nt, Human
cagccccucacagagcuguccu

SEQ ID NO: 375981 - RNA, 23 nt, Human
auguauuuaaauuucagugauga

SEQ ID NO: 375982 - RNA, 22 nt, Human
aggugagugugacugcaagaga

SEQ ID NO: 375983 - RNA, 22 nt, Human
ucuggccuacuggaguccauga

SEQ ID NO: 375984 - RNA, 22 nt, Human
cugagggcccugaagcuuggca

SEQ ID NO: 375985 - RNA, 22 nt, Human
gcuggccuccugcuagauggaa

SEQ ID NO: 375986 - RNA, 22 nt, Human
aagggccuccuggggagccugg

SEQ ID NO: 375987 - RNA, 22 nt, Human
cuggccuggucuggccucucca

SEQ ID NO: 375988 - RNA, 22 nt, Human
aguaaaucagaccucauuaugu

SEQ ID NO: 375989 - RNA, 22 nt, Human
aagaggaacugggggcugaguc

SEQ ID NO: 375990 - RNA, 19 nt, Human
gcuuuggagggagguucua

SEQ ID NO: 375991 - RNA, 22 nt, Human
gagugcaucguggccauuuuaa

SEQ ID NO: 375992 - RNA, 22 nt, Human
agcagcaggcuguguggacuga

SEQ ID NO: 375993 - RNA, 22 nt, Human
agaauucuccuucagggcagga

SEQ ID NO: 375994 - RNA, 22 nt, Human
uucacauuagugguucuauaua

SEQ ID NO: 375995 - RNA, 22 nt, Human
uuccucagacccucauugugag

SEQ ID NO: 375996 - RNA, 22 nt, Human
uguacaaucuuggucccuuuau

SEQ ID NO: 375997 - RNA, 22 nt, Human
augcuuuuaugucacaugguca

SEQ ID NO: 375998 - RNA, 22 nt, Human
auuccaaaaggauguuagaaug

SEQ ID NO: 375999 - RNA, 22 nt, Human
gaguggggcccacugcugggug

SEQ ID NO: 376000 - RNA, 22 nt, Human
ccagagcuccagggcuacagaa

SEQ ID NO: 376001 - RNA, 22 nt, Human
aggugaguugguaggaaguuug

SEQ ID NO: 376002 - RNA, 22 nt, Human
uuuauaaacaguaccacggugc

SEQ ID NO: 376003 - RNA, 22 nt, Human
gccuggagaagauggaacuagc

SEQ ID NO: 376004 - RNA, 22 nt, Human
ggugggugagcccugggagcug

SEQ ID NO: 376005 - RNA, 22 nt, Human
accaggagagauuuuauugaga

SEQ ID NO: 376006 - RNA, 22 nt, Human
agcccagcaaagggagguucag

SEQ ID NO: 376007 - RNA, 22 nt, Human
aggaccauccuaagguaggcaa

SEQ ID NO: 376008 - RNA, 22 nt, Human
uuuuaguguagucaccgugggu

SEQ ID NO: 376009 - RNA, 22 nt, Human
cacugaaucucaaggggagggu

SEQ ID NO: 376010 - RNA, 22 nt, Human
aucagaagcuuguagucucucu

SEQ ID NO: 376011 - RNA, 22 nt, Human
ucauugcauuuauucacuggca

SEQ ID NO: 376012 - RNA, 22 nt, Human
aggagccaguuccaccccagga

SEQ ID NO: 376013 - RNA, 19 nt, Human
gggaugggcccucacccuc

SEQ ID NO: 376014 - RNA, 19 nt, Human
uuagccauccacagugaaa

SEQ ID NO: 376015 - RNA, 20 nt, Human
guaaugaauguaaacaguaa

SEQ ID NO: 376016 - RNA, 22 nt, Human
uggauuuaguucuucacaggcc

SEQ ID NO: 376017 - RNA, 22 nt, Human
aauacaagauuuauaguuguuu

SEQ ID NO: 376018 - RNA, 22 nt, Human
gggauuugugggauggccagug

SEQ ID NO: 376019 - RNA, 22 nt, Human
aguuuucuguucuacaauuuga

SEQ ID NO: 376020 - RNA, 22 nt, Human
ugagccuguccugugcauguga

SEQ ID NO: 376021 - RNA, 22 nt, Human
uucacagacuuuccauagauug

SEQ ID NO: 376022 - RNA, 20 nt, Human
agaaucugacccagagagac

SEQ ID NO: 376023 - RNA, 22 nt, Human
agcugguuagcaaucuaaguga

SEQ ID NO: 376024 - RNA, 22 nt, Human
caucagagugguggccuggugu

SEQ ID NO: 376025 - RNA, 22 nt, Human
aagccagguguuuaggccagcg

SEQ ID NO: 376026 - RNA, 22 nt, Human
cccaggagguggagguugcagu

SEQ ID NO: 376027 - RNA, 22 nt, Human
cugaacucuuuaugacagcuug

SEQ ID NO: 376028 - RNA, 22 nt, Human
augugacaauauuuggucuuau

SEQ ID NO: 376029 - RNA, 22 nt, Human
ccacagggucagccacucugca

SEQ ID NO: 376030 - RNA, 22 nt, Human
agccauccuacuaccucagcau

SEQ ID NO: 376031 - RNA, 20 nt, Human
acaauagauuugagcaaagu

SEQ ID NO: 376032 - RNA, 22 nt, Human
aagagagggguugcauggaaau

SEQ ID NO: 376033 - RNA, 22 nt, Human
ucucagagggaggauuacugcc

SEQ ID NO: 376034 - RNA, 22 nt, Human
ugcaugcauaaauguacacaca

SEQ ID NO: 376035 - RNA, 22 nt, Human
cagccaucccagccugugguuc

SEQ ID NO: 376036 - RNA, 20 nt, Human
ucccaaggaugccugggugu

SEQ ID NO: 376037 - RNA, 22 nt, Human
ugagcaguaacagcucacaggg

SEQ ID NO: 376038 - RNA, 22 nt, Human
ucaaaggcauugccaauaagua

SEQ ID NO: 376039 - RNA, 22 nt, Human
ggcuccacccugcuuccagaag

SEQ ID NO: 376040 - RNA, 22 nt, Human
gcugccugccuaguuccacagu

SEQ ID NO: 376041 - RNA, 22 nt, Human
aucuaaaaggagcucuuuaucu

SEQ ID NO: 376042 - RNA, 22 nt, Human
agcaccuguugcacuucauaau

SEQ ID NO: 376043 - RNA, 22 nt, Human
uggcagcucauuuggaaaugga

SEQ ID NO: 376044 - RNA, 22 nt, Human
uguaucaaggguuuauguaagc

SEQ ID NO: 376045 - RNA, 22 nt, Human
gcagaggauagcauaugaaccu

SEQ ID NO: 376046 - RNA, 22 nt, Human
auacauacauguacacauaaau

SEQ ID NO: 376047 - RNA, 22 nt, Human
ucuccgaucacagguuuucaau

SEQ ID NO: 376048 - RNA, 22 nt, Human
gcagaugguggggcaggaaaau

SEQ ID NO: 376049 - RNA, 22 nt, Human
ucucagaggucuucagccucug

SEQ ID NO: 376050 - RNA, 22 nt, Human
cgcauacauagaaacacacaga

SEQ ID NO: 376051 - RNA, 22 nt, Human
gaacaguaucaguagugccagu

SEQ ID NO: 376052 - RNA, 22 nt, Human
aaagccaucuguauuaagugaa

SEQ ID NO: 376053 - RNA, 22 nt, Human
ggcagcuggguuggccagaaac

SEQ ID NO: 376054 - RNA, 22 nt, Human
aguaaaauuguauuggaaaaca

SEQ ID NO: 376055 - RNA, 22 nt, Human
ugccuguguccccuucuuggca

SEQ ID NO: 376056 - RNA, 22 nt, Human
acaaagguggaccauguggcuu

SEQ ID NO: 376057 - RNA, 22 nt, Human
agccccaguaagggagggccug

SEQ ID NO: 376058 - RNA, 22 nt, Human
gcuggaggaucacuugagccca

SEQ ID NO: 376059 - RNA, 22 nt, Human
uggcucaguggcagccgcagcu

SEQ ID NO: 376060 - RNA, 23 nt, Human
cauguacacacagcuguacagug

SEQ ID NO: 376061 - RNA, 22 nt, Human
uguacaauguggccaguguuaa

SEQ ID NO: 376062 - RNA, 22 nt, Human
ucugggaagcugcgugccuguu

SEQ ID NO: 376063 - RNA, 19 nt, Human
cccucaggucugagcaguc

SEQ ID NO: 376064 - RNA, 22 nt, Human
uuuccaagacuccaguucuccc

SEQ ID NO: 376065 - RNA, 22 nt, Human
gccugagacagugugguccaau

SEQ ID NO: 376066 - RNA, 22 nt, Human
uggaagugcucuucugaccaac

SEQ ID NO: 376067 - RNA, 22 nt, Human
acaaauguggacauggauaaug

SEQ ID NO: 376068 - RNA, 22 nt, Human
uauuucccagggagcaacaagc

SEQ ID NO: 376069 - RNA, 17 nt, Human
gccaggagguuugagcu

SEQ ID NO: 376070 - RNA, 22 nt, Human
uuuauauuucccaggauuggcc

SEQ ID NO: 376071 - RNA, 22 nt, Human
gagggcucaacuacuacuaggc

SEQ ID NO: 376072 - RNA, 22 nt, Human
uuuauuauguacaggcacuaua

SEQ ID NO: 376073 - RNA, 22 nt, Human
uagcagggaagaugaucagaau

SEQ ID NO: 376074 - RNA, 19 nt, Human
gcugugugaccuugggcaa

SEQ ID NO: 376075 - RNA, 22 nt, Human
ggugcugguucaggguggcugu

SEQ ID NO: 376076 - RNA, 21 nt, Human
ucccagagugcuugggacugc

SEQ ID NO: 376077 - RNA, 22 nt, Human
gccagcugcuggaacagcgcga

SEQ ID NO: 376078 - RNA, 22 nt, Human
ugaaaucuacccuauucagggu

SEQ ID NO: 376079 - RNA, 22 nt, Human
uugcaggggaaggagcagagcu

SEQ ID NO: 376080 - RNA, 21 nt, Human
cagaggcagguccugggacgg

SEQ ID NO: 376081 - RNA, 22 nt, Human
uuggaucacucugaagccuuac

SEQ ID NO: 376082 - RNA, 22 nt, Human
uaaaaguauacuuucaaaggag

SEQ ID NO: 376083 - RNA, 22 nt, Human
ugcuggcugggcugcuggagac

SEQ ID NO: 376084 - RNA, 22 nt, Human
uguauuuucugaagauaaucaa

SEQ ID NO: 376085 - RNA, 22 nt, Human
accaggagggacccugguggcc

SEQ ID NO: 376086 - RNA, 22 nt, Human
cagcuuggcuuccgcuuuacug

SEQ ID NO: 376087 - RNA, 22 nt, Human
uggcagaggaaaaagucacugg

SEQ ID NO: 376088 - RNA, 22 nt, Human
aggcuuuaauuaucuacaggag

SEQ ID NO: 376089 - RNA, 22 nt, Human
ggaucauuaacacauccaucac

SEQ ID NO: 376090 - RNA, 22 nt, Human
gcuuuuauugucuuuacgacga

SEQ ID NO: 376091 - RNA, 22 nt, Human
aaagacuuggcuuaugauuugc

SEQ ID NO: 376092 - RNA, 22 nt, Human
cagaggccuauccaguguccau

SEQ ID NO: 376093 - RNA, 22 nt, Human
caaggccacugcucagguuucc

SEQ ID NO: 376094 - RNA, 22 nt, Human
agaaaauuagauuuuacugugu

SEQ ID NO: 376095 - RNA, 22 nt, Human
ccacagaaaguugucuagagua

SEQ ID NO: 376096 - RNA, 22 nt, Human
uucaacuuuaugcauauguauu

SEQ ID NO: 376097 - RNA, 22 nt, Human
cauugcacucuggcuggaacgg

SEQ ID NO: 376098 - RNA, 22 nt, Human
gaguccuugacacauaguaggu

SEQ ID NO: 376099 - RNA, 22 nt, Human
ucaggcagaugcagggauggau

SEQ ID NO: 376100 - RNA, 20 nt, Human
uccagccacuuccgcugguc

SEQ ID NO: 376101 - RNA, 22 nt, Human
uugcauuuaaguagauguuaca

SEQ ID NO: 376102 - RNA, 22 nt, Human
uggcucagugacauuccuccca

SEQ ID NO: 376103 - RNA, 22 nt, Human
gccaggcuguggggaacuugaa

SEQ ID NO: 376104 - RNA, 22 nt, Human
auggauaauggugauaguugca

SEQ ID NO: 376105 - RNA, 22 nt, Human
uccucugcucagcauuccucac

SEQ ID NO: 376106 - RNA, 22 nt, Human
uggcugagugauauuugcaaag

SEQ ID NO: 376107 - RNA, 22 nt, Human
gcagggcuguucaggagggugg

SEQ ID NO: 376108 - RNA, 19 nt, Human
ccaggccugcgggcguugg

SEQ ID NO: 376109 - RNA, 22 nt, Human
ugucccagguccuagaugacca

SEQ ID NO: 376110 - RNA, 22 nt, Human
accagaguaauguguggaaauu

SEQ ID NO: 376111 - RNA, 22 nt, Human
uccauccauguaggaagauggu

SEQ ID NO: 376112 - RNA, 22 nt, Human
gugagcaggauaggggcucccu

SEQ ID NO: 376113 - RNA, 22 nt, Human
uuuccuucaucaucugagagcu

SEQ ID NO: 376114 - RNA, 22 nt, Human
cugugcccuggccaggccucuc

SEQ ID NO: 376115 - RNA, 22 nt, Human
agaguggggaagguguugagaa

SEQ ID NO: 376116 - RNA, 22 nt, Human
agugucauuccagggacccucg

SEQ ID NO: 376117 - RNA, 22 nt, Human
cugguuuagcuguaagguuccc

SEQ ID NO: 376118 - RNA, 22 nt, Human
gcagaggccaucaacuuugcca

SEQ ID NO: 376119 - RNA, 22 nt, Human
ggcugccugccuccaagccggg

SEQ ID NO: 376120 - RNA, 22 nt, Human
uuugcauuuauaaguuggugga

SEQ ID NO: 376121 - RNA, 22 nt, Human
cagcuuucaucagugacacuca

SEQ ID NO: 376122 - RNA, 18 nt, Human
cugagggcagccccuggg

SEQ ID NO: 376123 - RNA, 22 nt, Human
ggcuccagggaguggagagaag

SEQ ID NO: 376124 - RNA, 20 nt, Human
uccaguggccugaaucugga

SEQ ID NO: 376125 - RNA, 19 nt, Human
ugggccugcaucugggucu

SEQ ID NO: 376126 - RNA, 19 nt, Human
auuucaagagguuuauugg

SEQ ID NO: 376127 - RNA, 22 nt, Human
aacugcuguggccuaguacuua

SEQ ID NO: 376128 - RNA, 22 nt, Human
ggauggagaugaccauggugac

SEQ ID NO: 376129 - RNA, 22 nt, Human
ugccaggauggccagggggcca

SEQ ID NO: 376130 - RNA, 22 nt, Human
agggaggaaggauguuccaaag

SEQ ID NO: 376131 - RNA, 22 nt, Human
cuccagggcagcauggcagugg

SEQ ID NO: 376132 - RNA, 22 nt, Human
auaagguaugaaaaguaaaugg

SEQ ID NO: 376133 - RNA, 22 nt, Human
agcagccacagucugggacagg

SEQ ID NO: 376134 - RNA, 22 nt, Human
cccaggcagugugugcaugcgu

SEQ ID NO: 376135 - RNA, 22 nt, Human
agaagccauugaagcagaccuc

SEQ ID NO: 376136 - RNA, 22 nt, Human
ugccagggugucaggagagcua

SEQ ID NO: 376137 - RNA, 22 nt, Human
aguauuucuaguugguucuacu

SEQ ID NO: 376138 - RNA, 22 nt, Human
guuagggagggugcauaugugu

SEQ ID NO: 376139 - RNA, 22 nt, Human
ugcguugcgcuccugcagcagg

SEQ ID NO: 376140 - RNA, 22 nt, Human
cagcagcaaggugaggguggag

SEQ ID NO: 376141 - RNA, 22 nt, Human
uuucaacuugaagaauugauac

SEQ ID NO: 376142 - RNA, 22 nt, Human
gggauggcuuuguggcugacuc

SEQ ID NO: 376143 - RNA, 22 nt, Human
cugcccugagucaugccagaug

SEQ ID NO: 376144 - RNA, 22 nt, Human
ggcucuggcaaggggaggcuac

SEQ ID NO: 376145 - RNA, 22 nt, Human
ucccagcauuaaugccugucag

SEQ ID NO: 376146 - RNA, 22 nt, Human
auaugucgcuacaucauuagau

SEQ ID NO: 376147 - RNA, 22 nt, Human
caaggcugugcaggguccauau

SEQ ID NO: 376148 - RNA, 22 nt, Human
uaacaguguggacuugagaucu

SEQ ID NO: 376149 - RNA, 22 nt, Human
aauucuuguuguuaguauauuu

SEQ ID NO: 376150 - RNA, 20 nt, Human
agccugccagcuggcccaga

SEQ ID NO: 376151 - RNA, 22 nt, Human
gggcucagccccauugaaccag

SEQ ID NO: 376152 - RNA, 22 nt, Human
gccagguggagguugcagugag

SEQ ID NO: 376153 - RNA, 22 nt, Human
cagcauugaucccaggcugugg

SEQ ID NO: 376154 - RNA, 20 nt, Human
cucuggcuccgcgugaccgc

SEQ ID NO: 376155 - RNA, 22 nt, Human
ugaggugaagaguggagcucag

SEQ ID NO: 376156 - RNA, 22 nt, Human
uauauuuaaauccagguugaaa

SEQ ID NO: 376157 - RNA, 22 nt, Human
ugcuuggcuuucugagcuucug

SEQ ID NO: 376158 - RNA, 22 nt, Human
uucuguuuuagaaauaaguagu

SEQ ID NO: 376159 - RNA, 22 nt, Human
ugucucaggggcauugaaauaa

SEQ ID NO: 376160 - RNA, 23 nt, Human
acuuuauccuauaucuuuguucu

SEQ ID NO: 376161 - RNA, 22 nt, Human
agaucaguuagauagcuugaug

SEQ ID NO: 376162 - RNA, 22 nt, Human
ucacauuugcaauugcauuguu

SEQ ID NO: 376163 - RNA, 22 nt, Human
ucuuuccuuagaauaauucuuu

SEQ ID NO: 376164 - RNA, 22 nt, Human
uuucaucucucuaaaagacagu

SEQ ID NO: 376165 - RNA, 22 nt, Human
ugcagccuugccuccucccagc

SEQ ID NO: 376166 - RNA, 20 nt, Human
gcccuggagccuuguccugg

SEQ ID NO: 376167 - RNA, 22 nt, Human
uuucacacaacgugaauauacu

SEQ ID NO: 376168 - RNA, 20 nt, Human
acugccuugguucaguaggu

SEQ ID NO: 376169 - RNA, 22 nt, Human
uuugaacaugcugcaugauaau

SEQ ID NO: 376170 - RNA, 22 nt, Human
agcaucuggugagggccuaguu

SEQ ID NO: 376171 - RNA, 22 nt, Human
aagguacaaaguauuauuuaaa

SEQ ID NO: 376172 - RNA, 22 nt, Human
gcacagggagacagccguggcc

SEQ ID NO: 376173 - RNA, 22 nt, Human
auguaaaucaagcagugcuggu

SEQ ID NO: 376174 - RNA, 22 nt, Human
ucccuggaacagagagacaacg

SEQ ID NO: 376175 - RNA, 22 nt, Human
ggcucuggugcccuggcuccca

SEQ ID NO: 376176 - RNA, 22 nt, Human
cuuacauuaaguaagagauuga

SEQ ID NO: 376177 - RNA, 22 nt, Human
uugcucaggcuuagagcuacua

SEQ ID NO: 376178 - RNA, 22 nt, Human
ggcagcuuguccuggaggaugg

SEQ ID NO: 376179 - RNA, 22 nt, Human
uuuguagaggguaauugacaga

SEQ ID NO: 376180 - RNA, 22 nt, Human
uggcucaguagcagugugguca

SEQ ID NO: 376181 - RNA, 22 nt, Human
ggaaagagcccagcagugcuug

SEQ ID NO: 376182 - RNA, 22 nt, Human
auaaggcagugacuucaucuau

SEQ ID NO: 376183 - RNA, 22 nt, Human
ucugucacccagagugcagugg

SEQ ID NO: 376184 - RNA, 22 nt, Human
gcucucugaggugcuggcagag

SEQ ID NO: 376185 - RNA, 22 nt, Human
agagcagccugugaugaugcac

SEQ ID NO: 376186 - RNA, 21 nt, Human
ucccugcuuucuggcccaguc

SEQ ID NO: 376187 - RNA, 22 nt, Human
gagcacugagcuggaauuggag

SEQ ID NO: 376188 - RNA, 22 nt, Human
aucuagaaaguguugaagauca

SEQ ID NO: 376189 - RNA, 22 nt, Human
accugcaguggccacuccuaau

SEQ ID NO: 376190 - RNA, 22 nt, Human
auuuccuagccucucuugcagu

SEQ ID NO: 376191 - RNA, 21 nt, Human
ucaggcaggcgcagagggaag

SEQ ID NO: 376192 - RNA, 23 nt, Human
ggcucugugcugggccugcagga

SEQ ID NO: 376193 - RNA, 22 nt, Human
ugccugagugauguggcagcca

SEQ ID NO: 376194 - RNA, 22 nt, Human
agucacuguucugucaugucaa

SEQ ID NO: 376195 - RNA, 22 nt, Human
aaaacagacagccaguguagag

SEQ ID NO: 376196 - RNA, 22 nt, Human
cccaggucugccagccuguggg

SEQ ID NO: 376197 - RNA, 22 nt, Human
cagagccagcccacuguucccg

SEQ ID NO: 376198 - RNA, 22 nt, Human
ccaggcagcucugauuuauguc

SEQ ID NO: 376199 - RNA, 22 nt, Human
ccaguacugucuccaauauucc

SEQ ID NO: 376200 - RNA, 21 nt, Human
gcaggggauagaaauggucug

SEQ ID NO: 376201 - RNA, 20 nt, Human
cugccaugauugauagagug

SEQ ID NO: 376202 - RNA, 23 nt, Human
agcuggaggcugucuacucccaa

SEQ ID NO: 376203 - RNA, 22 nt, Human
ucaaugauaguacaaucagccu

SEQ ID NO: 376204 - RNA, 18 nt, Human
aaugcacacauuuacucc

SEQ ID NO: 376205 - RNA, 22 nt, Human
ggaggccaggaaggcucggaga

SEQ ID NO: 376206 - RNA, 22 nt, Human
agagugcaaccgaaacaagcag

SEQ ID NO: 376207 - RNA, 22 nt, Human
uaaaugugcacuuuacuuuuca

SEQ ID NO: 376208 - RNA, 22 nt, Human
ugggcagcauccuccacaguca

SEQ ID NO: 376209 - RNA, 22 nt, Human
ggcagcuguaagaugagugaau

SEQ ID NO: 376210 - RNA, 21 nt, Human
ccucuggcuugugcugugccc

SEQ ID NO: 376211 - RNA, 22 nt, Human
caacagagagaccagaaacagg

SEQ ID NO: 376212 - RNA, 21 nt, Human
cucaggauggcggccuggugg

SEQ ID NO: 376213 - RNA, 22 nt, Human
cauccacuagaaugacagaguu

SEQ ID NO: 376214 - RNA, 22 nt, Human
aggcugagaaagugggaagaug

SEQ ID NO: 376215 - RNA, 22 nt, Human
cugcuguguugccagugucacc

SEQ ID NO: 376216 - RNA, 23 nt, Human
ugcucugugaauaguuggugacu

SEQ ID NO: 376217 - RNA, 22 nt, Human
ggaagccacccagcuuugauag

SEQ ID NO: 376218 - RNA, 22 nt, Human
auuugaauggcuuaacacaacg

SEQ ID NO: 376219 - RNA, 22 nt, Human
ucugucacucccugaugaugaa

SEQ ID NO: 376220 - RNA, 22 nt, Human
gucucagauucagacaucuaca

SEQ ID NO: 376221 - RNA, 22 nt, Human
ugucucugagaugacucccacc

SEQ ID NO: 376222 - RNA, 22 nt, Human
uggcugcagaucaagggcaggc

SEQ ID NO: 376223 - RNA, 22 nt, Human
ccagcccuguaaggaugaggca

SEQ ID NO: 376224 - RNA, 21 nt, Human
uuuagggaggauauuuaacuu

SEQ ID NO: 376225 - RNA, 22 nt, Human
ggccagagagcagccaggauuc

SEQ ID NO: 376226 - RNA, 22 nt, Human
aucagaaauugcuaccagugga

SEQ ID NO: 376227 - RNA, 22 nt, Human
cagagggaaaaggggaguaaua

SEQ ID NO: 376228 - RNA, 22 nt, Human
caucagaauuacuuggggagcu

SEQ ID NO: 376229 - RNA, 22 nt, Human
guucacaucacuucacugaacc

SEQ ID NO: 376230 - RNA, 17 nt, Human
caagagagaugacugga

SEQ ID NO: 376231 - RNA, 22 nt, Human
accugcagcuaaagauguaggg

SEQ ID NO: 376232 - RNA, 22 nt, Human
auuuccauagagcgucucacag

SEQ ID NO: 376233 - RNA, 22 nt, Human
ucauaaaguuaucaccaaaucc

SEQ ID NO: 376234 - RNA, 22 nt, Human
gaagggugcauggagggaaguc

SEQ ID NO: 376235 - RNA, 22 nt, Human
aaagcagggaugaggcuagagg

SEQ ID NO: 376236 - RNA, 22 nt, Human
uuuccagagcaugucugcucag

SEQ ID NO: 376237 - RNA, 22 nt, Human
ugaaagcuguccacuaggcugu

SEQ ID NO: 376238 - RNA, 22 nt, Human
cuuucacagcugugcuuaugau

SEQ ID NO: 376239 - RNA, 22 nt, Human
cugaauaauuuucuguuguaug

SEQ ID NO: 376240 - RNA, 22 nt, Human
ucuguaucacccguucccagaa

SEQ ID NO: 376241 - RNA, 22 nt, Human
uugaauaauaugcuucguucuc

SEQ ID NO: 376242 - RNA, 22 nt, Human
cugccgaguacagccauagaaa

SEQ ID NO: 376243 - RNA, 22 nt, Human
gaggcucagagugguuaaauaa

SEQ ID NO: 376244 - RNA, 19 nt, Human
uggggccuccugucccugg

SEQ ID NO: 376245 - RNA, 22 nt, Human
aguguuguaugggaugacugcu

SEQ ID NO: 376246 - RNA, 22 nt, Human
gggcugagugaccucaggccaa

SEQ ID NO: 376247 - RNA, 22 nt, Human
uaagaauuguguugaauagagu

SEQ ID NO: 376248 - RNA, 22 nt, Human
uucugugacuccucagagauuu

SEQ ID NO: 376249 - RNA, 22 nt, Human
uguaaauaauuccuaggcuuuu

SEQ ID NO: 376250 - RNA, 22 nt, Human
agaggcaguauacaauccgagc

SEQ ID NO: 376251 - RNA, 22 nt, Human
gaggaaccaaucugugauauuc

SEQ ID NO: 376252 - RNA, 20 nt, Human
uucaggauucuagaccacac

SEQ ID NO: 376253 - RNA, 20 nt, Human
ucagggcaugggacagcccc

SEQ ID NO: 376254 - RNA, 22 nt, Human
cccaggagguggagguugcagc

SEQ ID NO: 376255 - RNA, 22 nt, Human
augucuuucgcaucaguagcua

SEQ ID NO: 376256 - RNA, 22 nt, Human
gagggcucuacucaccacccug

SEQ ID NO: 376257 - RNA, 22 nt, Human
auccaguucucagugcuuacag

SEQ ID NO: 376258 - RNA, 22 nt, Human
cacagaaucugugacuccaaga

SEQ ID NO: 376259 - RNA, 22 nt, Human
uggcugaaggaagauucuucua

SEQ ID NO: 376260 - RNA, 18 nt, Human
uggccuggagacaacucu

SEQ ID NO: 376261 - RNA, 22 nt, Human
aaagagcuaacauugccgagau

SEQ ID NO: 376262 - RNA, 22 nt, Human
acagggcccuugccagcacaag

SEQ ID NO: 376263 - RNA, 22 nt, Human
gccuggagcagacgugucccgg

SEQ ID NO: 376264 - RNA, 22 nt, Human
cugugacuguguuggaugcaca

SEQ ID NO: 376265 - RNA, 18 nt, Human
uggcucagauggcuuuaa

SEQ ID NO: 376266 - RNA, 22 nt, Human
uagggcagaguccaggaugggc

SEQ ID NO: 376267 - RNA, 22 nt, Human
ugacagcugagccccaggcaag

SEQ ID NO: 376268 - RNA, 22 nt, Human
ggggccagcuucgcgugcucuu

SEQ ID NO: 376269 - RNA, 22 nt, Human
gaaauuuauuaucuacaucauu

SEQ ID NO: 376270 - RNA, 22 nt, Human
ugagcuuccucccugcauccau

SEQ ID NO: 376271 - RNA, 22 nt, Human
cagagcauaauugacaugaggu

SEQ ID NO: 376272 - RNA, 22 nt, Human
guaugaaaauuguaaaguucuu

SEQ ID NO: 376273 - RNA, 22 nt, Human
gagaggaguuacuauuuccgag

SEQ ID NO: 376274 - RNA, 22 nt, Human
accacuguaucuccagcacauu

SEQ ID NO: 376275 - RNA, 22 nt, Human
aagccagauagaagaacucauu

SEQ ID NO: 376276 - RNA, 22 nt, Human
caucacugacgcugagauucca

SEQ ID NO: 376277 - RNA, 20 nt, Human
cucuccuugccgacuuggca

SEQ ID NO: 376278 - RNA, 22 nt, Human
agagaugucgccuugcccaggg

SEQ ID NO: 376279 - RNA, 22 nt, Human
aucaaaguccaucagaagguag

SEQ ID NO: 376280 - RNA, 22 nt, Human
acuggcagagacccugauggcc

SEQ ID NO: 376281 - RNA, 22 nt, Human
augcuuaauacacuguuaaagg

SEQ ID NO: 376282 - RNA, 22 nt, Human
agggacuuguguccuauguaug

SEQ ID NO: 376283 - RNA, 22 nt, Human
gguucacacuuucaugauuuca

SEQ ID NO: 376284 - RNA, 22 nt, Human
uuuccuguugccaucaagaaug

SEQ ID NO: 376285 - RNA, 22 nt, Human
caggaggcagaggaugcccagu

SEQ ID NO: 376286 - RNA, 22 nt, Human
gugauuucaaauauagagugag

SEQ ID NO: 376287 - RNA, 22 nt, Human
uguaguaagugcgcaauaaaua

SEQ ID NO: 376288 - RNA, 22 nt, Human
agccaggacguugcucagcucc

SEQ ID NO: 376289 - RNA, 22 nt, Human
cuggcucccagcuuucagggag

SEQ ID NO: 376290 - RNA, 22 nt, Human
caagagcucagaaacccuugcu

SEQ ID NO: 376291 - RNA, 22 nt, Human
uggcccugacuuggaggccuga

SEQ ID NO: 376292 - RNA, 22 nt, Human
gcugucacauuuggagcacugg

SEQ ID NO: 376293 - RNA, 22 nt, Human
aaugcaguuucauuuguagaau

SEQ ID NO: 376294 - RNA, 22 nt, Human
aaugauggauuuagacaagcug

SEQ ID NO: 376295 - RNA, 19 nt, Human
ucucugcuucucuuggcau

SEQ ID NO: 376296 - RNA, 22 nt, Human
ucucaagaucucaagauggccc

SEQ ID NO: 376297 - RNA, 22 nt, Human
gucuggggaagucagggcauca

SEQ ID NO: 376298 - RNA, 22 nt, Human
gccuggagaaaggaagguggga

SEQ ID NO: 376299 - RNA, 22 nt, Human
aggcuggcuggcaggggacaca

SEQ ID NO: 376300 - RNA, 22 nt, Human
uuacaguaugaucaacuuuuca

SEQ ID NO: 376301 - RNA, 22 nt, Human
uccucagaugcucuuggacgcc

SEQ ID NO: 376302 - RNA, 22 nt, Human
ggggaggaagcuggaacacggg

SEQ ID NO: 376303 - RNA, 22 nt, Human
caaugguggugucagaagagau

SEQ ID NO: 376304 - RNA, 21 nt, Human
acacugugucauaaugcuuaa

SEQ ID NO: 376305 - RNA, 22 nt, Human
ucacagcaaaagugugcagagc

SEQ ID NO: 376306 - RNA, 22 nt, Human
ucccagagccucugccacucug

SEQ ID NO: 376307 - RNA, 22 nt, Human
uucuuuuacauuaagauuucag

SEQ ID NO: 376308 - RNA, 22 nt, Human
ucaccgucgggggucgcugucu

SEQ ID NO: 376309 - RNA, 22 nt, Human
agccuuguuggucugaguuugg

SEQ ID NO: 376310 - RNA, 22 nt, Human
ucccagagcaguacuccaggag

SEQ ID NO: 376311 - RNA, 22 nt, Human
augauacaagcaaaacuaauca

SEQ ID NO: 376312 - RNA, 22 nt, Human
cucugagcagaggccguggcua

SEQ ID NO: 376313 - RNA, 22 nt, Human
agggcugaagggaggugcucau

SEQ ID NO: 376314 - RNA, 22 nt, Human
uugugcauuucucugagugugu

SEQ ID NO: 376315 - RNA, 22 nt, Human
aucacaggugguaggaaaagaa

SEQ ID NO: 376316 - RNA, 22 nt, Human
acuauaaccuguuagaauagau

SEQ ID NO: 376317 - RNA, 17 nt, Human
ccagguggaaucgugga

SEQ ID NO: 376318 - RNA, 22 nt, Human
uuugaagugggcauuagaaccu

SEQ ID NO: 376319 - RNA, 19 nt, Human
ucaggacugacuugaaguc

SEQ ID NO: 376320 - RNA, 22 nt, Human
ugcuccuuccucauccugugca

SEQ ID NO: 376321 - RNA, 22 nt, Human
gcagaagcccggucagcgcacg

SEQ ID NO: 376322 - RNA, 22 nt, Human
ucccacucccaggcaggccucu

SEQ ID NO: 376323 - RNA, 22 nt, Human
aggcaggaaaaucgcuugaacc

SEQ ID NO: 376324 - RNA, 22 nt, Human
ugccaggcauauggccucuuug

SEQ ID NO: 376325 - RNA, 22 nt, Human
auucucuuuguauaacaucuug

SEQ ID NO: 376326 - RNA, 22 nt, Human
auuucucaguguacauuauguu

SEQ ID NO: 376327 - RNA, 22 nt, Human
aaguugaagcaugaaccaaggu

SEQ ID NO: 376328 - RNA, 22 nt, Human
gaugguuuggaaugaaguagcu

SEQ ID NO: 376329 - RNA, 22 nt, Human
caguagccacuagacacaugua

SEQ ID NO: 376330 - RNA, 22 nt, Human
ccucuggguaucuguggaagua

SEQ ID NO: 376331 - RNA, 22 nt, Human
auaguuugaaggcuguucuacu

SEQ ID NO: 376332 - RNA, 21 nt, Human
uacagaaugcgcuucagucug

SEQ ID NO: 376333 - RNA, 22 nt, Human
ccaggaagcggugagggcugcc

SEQ ID NO: 376334 - RNA, 22 nt, Human
ucagccuacacuccaacagcau

SEQ ID NO: 376335 - RNA, 20 nt, Human
cuuggccuacuuagcuuugu

SEQ ID NO: 376336 - RNA, 22 nt, Human
cauuuaguuauacuaaaacauu

SEQ ID NO: 376337 - RNA, 19 nt, Human
uccaggcauccuucaggcu

SEQ ID NO: 376338 - RNA, 22 nt, Human
gcagggucugaggccacagagg

SEQ ID NO: 376339 - RNA, 22 nt, Human
gcauguguggaggagaugugcu

SEQ ID NO: 376340 - RNA, 22 nt, Human
cugaggcaugaaugugggcuuu

SEQ ID NO: 376341 - RNA, 19 nt, Human
aaaauugcguauuuugagg

SEQ ID NO: 376342 - RNA, 22 nt, Human
uacaaaaguaauuacgguuuuu

SEQ ID NO: 376343 - RNA, 22 nt, Human
uggggcagcuccaucuauucca

SEQ ID NO: 376344 - RNA, 22 nt, Human
ugcagaagugagucaugaggaa

SEQ ID NO: 376345 - RNA, 22 nt, Human
ccauuucacucuuccugaagga

SEQ ID NO: 376346 - RNA, 19 nt, Human
ggcucucuuaaagcuguuu

SEQ ID NO: 376347 - RNA, 22 nt, Human
aaaugcagauuuugaugcagca

SEQ ID NO: 376348 - RNA, 17 nt, Human
agccccucagcgucacc

SEQ ID NO: 376349 - RNA, 22 nt, Human
caggaagagguaucaccgagca

SEQ ID NO: 376350 - RNA, 22 nt, Human
cugcugagcaucagggcugccc

SEQ ID NO: 376351 - RNA, 20 nt, Human
agugucugggccucaggccc

SEQ ID NO: 376352 - RNA, 22 nt, Human
agucucagaguaccugagggac

SEQ ID NO: 376353 - RNA, 22 nt, Human
gccaguggcaugcggcagggac

SEQ ID NO: 376354 - RNA, 20 nt, Human
gcugcucuccacggucugca

SEQ ID NO: 376355 - RNA, 22 nt, Human
aggucauugaaguuauuuucuu

SEQ ID NO: 376356 - RNA, 18 nt, Human
gcuggcugcacuucugcu

SEQ ID NO: 376357 - RNA, 22 nt, Human
uggacucagaaguguucuuuua

SEQ ID NO: 376358 - RNA, 22 nt, Human
ucagcaaugugauacugugcaa

SEQ ID NO: 376359 - RNA, 22 nt, Human
ggcugggcucgcugauuggcug

SEQ ID NO: 376360 - RNA, 22 nt, Human
uccuuccuggggucucugcugc

SEQ ID NO: 376361 - RNA, 22 nt, Human
caugcuuuucaaucuaucuuaa

SEQ ID NO: 376362 - RNA, 22 nt, Human
agauuucagaugcucggcaguu

SEQ ID NO: 376363 - RNA, 22 nt, Human
cagcccaggccgacaguuccuc

SEQ ID NO: 376364 - RNA, 22 nt, Human
uagcugcccaucuuuccuuuag

SEQ ID NO: 376365 - RNA, 22 nt, Human
augcuauacucaaagaaauuca

SEQ ID NO: 376366 - RNA, 22 nt, Human
aaaacucugcaguuaguuucua

SEQ ID NO: 376367 - RNA, 22 nt, Human
acaguggaugugauguccaggu

SEQ ID NO: 376368 - RNA, 22 nt, Human
cagcucugugggagcguaugug

SEQ ID NO: 376369 - RNA, 22 nt, Human
uccugcagucugcacucugccu

SEQ ID NO: 376370 - RNA, 22 nt, Human
uaacagaaauagaaaugagagu

SEQ ID NO: 376371 - RNA, 22 nt, Human
cacagggcaggccccaggccuc

SEQ ID NO: 376372 - RNA, 22 nt, Human
ugaaaucuuagccauucugccu

SEQ ID NO: 376373 - RNA, 22 nt, Human
gccaccagggggcuccagugag

SEQ ID NO: 376374 - RNA, 22 nt, Human
gcucugagagugggugauucug

SEQ ID NO: 376375 - RNA, 23 nt, Human
acagagguccaaacaguauaagc

SEQ ID NO: 376376 - RNA, 22 nt, Human
gaggcucagggaaacagcgcag

SEQ ID NO: 376377 - RNA, 22 nt, Human
acuguucauccuuuuugaacaa

SEQ ID NO: 376378 - RNA, 22 nt, Human
cuggccugaggucggcuguagg

SEQ ID NO: 376379 - RNA, 22 nt, Human
gccucugcccauccaccaucag

SEQ ID NO: 376380 - RNA, 22 nt, Human
ggaagaggcugaggccaugcug

SEQ ID NO: 376381 - RNA, 22 nt, Human
ugucaugcagguuuguuauaga

SEQ ID NO: 376382 - RNA, 22 nt, Human
guuucaaauagguuucagcaaa

SEQ ID NO: 376383 - RNA, 22 nt, Human
agugcuuugaacgaaaggcuga

SEQ ID NO: 376384 - RNA, 22 nt, Human
gaagcagcagcuggggacaguu

SEQ ID NO: 376385 - RNA, 22 nt, Human
gcagcacauauaaacaaagaga

SEQ ID NO: 376386 - RNA, 22 nt, Human
cuggcagcgugagcagcaucca

SEQ ID NO: 376387 - RNA, 22 nt, Human
ucccugggccuccugcuaugca

SEQ ID NO: 376388 - RNA, 22 nt, Human
accuuucauuaaagucuguagu

SEQ ID NO: 376389 - RNA, 22 nt, Human
ggcucagguuuaaagugcuuua

SEQ ID NO: 376390 - RNA, 22 nt, Human
ggcagcuccaaaaggaaacacu

SEQ ID NO: 376391 - RNA, 22 nt, Human
uugacaauugggagauauaaag

SEQ ID NO: 376392 - RNA, 22 nt, Human
uuccggaagguucucuagaauu

SEQ ID NO: 376393 - RNA, 22 nt, Human
ugagcaucuuuuuacagguuua

SEQ ID NO: 376394 - RNA, 22 nt, Human
gagcagcugagcuggaaugaga

SEQ ID NO: 376395 - RNA, 22 nt, Human
aaaaccuucagguuuggaguuu

SEQ ID NO: 376396 - RNA, 22 nt, Human
agaaccucaauuauuuuugcac

SEQ ID NO: 376397 - RNA, 22 nt, Human
ugaagcaggaucguuugcuuca

SEQ ID NO: 376398 - RNA, 17 nt, Human
caaggccagcaucuuca

SEQ ID NO: 376399 - RNA, 22 nt, Human
cugccagcucucuggaggcucu

SEQ ID NO: 376400 - RNA, 22 nt, Human
ggguccagaguugaagagguua

SEQ ID NO: 376401 - RNA, 18 nt, Human
aaaaugcaggcgacaugg

SEQ ID NO: 376402 - RNA, 22 nt, Human
uugagaagaauguguugaguuu

SEQ ID NO: 376403 - RNA, 22 nt, Human
uguacaguaggaacuuguuauu

SEQ ID NO: 376404 - RNA, 22 nt, Human
ggcagcagggcugucucccuac

SEQ ID NO: 376405 - RNA, 22 nt, Human
agacaggacacaagcugcauaa

SEQ ID NO: 376406 - RNA, 17 nt, Human
acagggcagaaacagcu

SEQ ID NO: 376407 - RNA, 22 nt, Human
ccaaagugcugagauuacaggu

SEQ ID NO: 376408 - RNA, 22 nt, Human
aaggcagcaagaauuccagguu

SEQ ID NO: 376409 - RNA, 22 nt, Human
ggcaccaggcugggcauaggcc

SEQ ID NO: 376410 - RNA, 22 nt, Human
aagagcuggucacagguccauu

SEQ ID NO: 376411 - RNA, 22 nt, Human
guccagagauggacgagcagau

SEQ ID NO: 376412 - RNA, 22 nt, Human
gagaggccaaaaucccugcccc

SEQ ID NO: 376413 - RNA, 22 nt, Human
agucugucuacuuaaagucugu

SEQ ID NO: 376414 - RNA, 22 nt, Human
cagggugcgccacucagaugua

SEQ ID NO: 376415 - RNA, 22 nt, Human
cucuggagaacuccuugugucu

SEQ ID NO: 376416 - RNA, 22 nt, Human
gaccuggaggauccucuucuug

SEQ ID NO: 376417 - RNA, 22 nt, Human
agcugagcuaguaguuccagug

SEQ ID NO: 376418 - RNA, 22 nt, Human
uggcaguccccugugccuggaa

SEQ ID NO: 376419 - RNA, 22 nt, Human
ucacuguauuugcugaugcaua

SEQ ID NO: 376420 - RNA, 22 nt, Human
gcauggcauuugaagguagaag

SEQ ID NO: 376421 - RNA, 22 nt, Human
auagaaauguauuuuggacuag

SEQ ID NO: 376422 - RNA, 23 nt, Human
ugaguucucaucuuggcuucuau

SEQ ID NO: 376423 - RNA, 22 nt, Human
guuucauucggcagcucauaag

SEQ ID NO: 376424 - RNA, 22 nt, Human
caauacaauuaccaguuaauca

SEQ ID NO: 376425 - RNA, 22 nt, Human
cagaggccccagaacuagcucu

SEQ ID NO: 376426 - RNA, 21 nt, Human
ggccugagcaccuguccaccu

SEQ ID NO: 376427 - RNA, 18 nt, Human
acagaggcagacauguau

SEQ ID NO: 376428 - RNA, 22 nt, Human
ugacccauggucugaucauagg

SEQ ID NO: 376429 - RNA, 22 nt, Human
auggcuuaagaaugcuuuugug

SEQ ID NO: 376430 - RNA, 22 nt, Human
aagauuucagaguuugggggaa

SEQ ID NO: 376431 - RNA, 22 nt, Human
uuuguuuagaugguaaaucagu

SEQ ID NO: 376432 - RNA, 22 nt, Human
agggcuccaggggaccaucagu

SEQ ID NO: 376433 - RNA, 23 nt, Human
cagcuuucagggcuuuagggaag

SEQ ID NO: 376434 - RNA, 22 nt, Human
gugauugcccagcaccauuguu

SEQ ID NO: 376435 - RNA, 22 nt, Human
gcuuccaaaucuguucaaaaug

SEQ ID NO: 376436 - RNA, 22 nt, Human
cccugcagccggccagcucauu

SEQ ID NO: 376437 - RNA, 23 nt, Human
cuggcucuguagguggcauccuu

SEQ ID NO: 376438 - RNA, 22 nt, Human
acccaggauaaucuguguaucu

SEQ ID NO: 376439 - RNA, 22 nt, Human
augucacagucugacucaguga

SEQ ID NO: 376440 - RNA, 22 nt, Human
ugaguccacuuuaaaaugucag

SEQ ID NO: 376441 - RNA, 22 nt, Human
uggcagaguucgcuccuauuca

SEQ ID NO: 376442 - RNA, 22 nt, Human
ucuucucuacaccagcagcccc

SEQ ID NO: 376443 - RNA, 22 nt, Human
gagaaacuuggaguuauucugg

SEQ ID NO: 376444 - RNA, 22 nt, Human
ucacucagguucaugucuuugu

SEQ ID NO: 376445 - RNA, 22 nt, Human
augaggcauucacagaaggcac

SEQ ID NO: 376446 - RNA, 22 nt, Human
ccagaagaccccguccaccucc

SEQ ID NO: 376447 - RNA, 22 nt, Human
uggauuuauuagguuggugaaa

SEQ ID NO: 376448 - RNA, 23 nt, Human
augcaguauaugucaguaguuua

SEQ ID NO: 376449 - RNA, 22 nt, Human
gaggaagcagggcuuggcugag

SEQ ID NO: 376450 - RNA, 20 nt, Human
agguggcuccugcugggggu

SEQ ID NO: 376451 - RNA, 22 nt, Human
uacuguauuugauaagugaagu

SEQ ID NO: 376452 - RNA, 22 nt, Human
aaugauggucauggcaacuuuu

SEQ ID NO: 376453 - RNA, 22 nt, Human
aggcccuguccauggugcugaa

SEQ ID NO: 376454 - RNA, 22 nt, Human
cagcugaacauguagagcaucu

SEQ ID NO: 376455 - RNA, 22 nt, Human
agcugccagaugacagugcuau

SEQ ID NO: 376456 - RNA, 22 nt, Human
ccaaaggccaggcacugagguu

SEQ ID NO: 376457 - RNA, 22 nt, Human
aauaauuacccaucuuuuugua

SEQ ID NO: 376458 - RNA, 22 nt, Human
ucugccagugguuuggcccuga

SEQ ID NO: 376459 - RNA, 22 nt, Human
ugggcaagucacuucugucuuu

SEQ ID NO: 376460 - RNA, 22 nt, Human
cugggcugagccugggcugugu

SEQ ID NO: 376461 - RNA, 22 nt, Human
ggcugccugugcccaggcacac

SEQ ID NO: 376462 - RNA, 22 nt, Human
ccugagagcgaguggccucaug

SEQ ID NO: 376463 - RNA, 22 nt, Human
agaaguaggcagggcuguauca

SEQ ID NO: 376464 - RNA, 22 nt, Human
agcaccugcuaugugucaggga

SEQ ID NO: 376465 - RNA, 23 nt, Human
aggcagugggggccacuuugcuu

SEQ ID NO: 376466 - RNA, 22 nt, Human
gggcaugguggugcacaccugu

SEQ ID NO: 376467 - RNA, 22 nt, Human
aaugggagguaguaugggaggu

SEQ ID NO: 376468 - RNA, 22 nt, Human
aacaguaaaaaucauuuaguug

SEQ ID NO: 376469 - RNA, 22 nt, Human
cacagagagcuacgugcagcgu

SEQ ID NO: 376470 - RNA, 22 nt, Human
ggagagcaggguccugagauac

SEQ ID NO: 376471 - RNA, 20 nt, Human
guguuucaugugauacaaug

SEQ ID NO: 376472 - RNA, 22 nt, Human
uuucuucauucaccuucacccc

SEQ ID NO: 376473 - RNA, 22 nt, Human
caggcuggaguuaccuuuaggg

SEQ ID NO: 376474 - RNA, 17 nt, Human
accaggcaacacgccca

SEQ ID NO: 376475 - RNA, 22 nt, Human
uauuccuauggccacugcuacu

SEQ ID NO: 376476 - RNA, 22 nt, Human
gagugcagaugccagccccagu

SEQ ID NO: 376477 - RNA, 22 nt, Human
gugaauggggcaggaaggaugg

SEQ ID NO: 376478 - RNA, 22 nt, Human
uccaggcuggccucgcgugaca

SEQ ID NO: 376479 - RNA, 22 nt, Human
ucauaaaaguacucauguucau

SEQ ID NO: 376480 - RNA, 22 nt, Human
aaaauugagagucuugugcaag

SEQ ID NO: 376481 - RNA, 21 nt, Human
ugaaugaggaggauggcauuu

SEQ ID NO: 376482 - RNA, 22 nt, Human
cagcccuggaacagcugacuca

SEQ ID NO: 376483 - RNA, 22 nt, Human
agaauuccucuaggaucugccc

SEQ ID NO: 376484 - RNA, 21 nt, Human
gcagaugggagucaucaggcu

SEQ ID NO: 376485 - RNA, 22 nt, Human
agccaggccagcugucuugagu

SEQ ID NO: 376486 - RNA, 23 nt, Human
aggaaggagguccuaacaguauc

SEQ ID NO: 376487 - RNA, 22 nt, Human
gggcugugcugaguaggaggug

SEQ ID NO: 376488 - RNA, 22 nt, Human
aaagcuaugaggcaugcauuuc

SEQ ID NO: 376489 - RNA, 22 nt, Human
uggguaaacugggucuggagag

SEQ ID NO: 376490 - RNA, 22 nt, Human
acagaguaucuaucaggaguau

SEQ ID NO: 376491 - RNA, 22 nt, Human
ggcugcuggcauugagguaggu

SEQ ID NO: 376492 - RNA, 22 nt, Human
acccaggguagagugcaguggc

SEQ ID NO: 376493 - RNA, 22 nt, Human
gcccaggagguugggcugugca

SEQ ID NO: 376494 - RNA, 22 nt, Human
ugccaggcugcccuccagucug

SEQ ID NO: 376495 - RNA, 22 nt, Human
gguggagcuggaccaggagagg

SEQ ID NO: 376496 - RNA, 22 nt, Human
ugucugugaccucuuuggagcc

SEQ ID NO: 376497 - RNA, 22 nt, Human
cugagccauaagggaggcuggg

SEQ ID NO: 376498 - RNA, 22 nt, Human
ugaggggagacagaguggacuc

SEQ ID NO: 376499 - RNA, 22 nt, Human
uuagcaucugcuguaagcuuau

SEQ ID NO: 376500 - RNA, 22 nt, Human
gucuucuuguguugccugucuu

SEQ ID NO: 376501 - RNA, 22 nt, Human
ucacaguaaaagcauggaagag

SEQ ID NO: 376502 - RNA, 22 nt, Human
gggcucugcgcucagcuccagc

SEQ ID NO: 376503 - RNA, 21 nt, Human
gauuugcagaaacuagacagg

SEQ ID NO: 376504 - RNA, 22 nt, Human
acccagcuggaugcauggaggc

SEQ ID NO: 376505 - RNA, 22 nt, Human
uaugaacucuggagucugagug

SEQ ID NO: 376506 - RNA, 22 nt, Human
uuuucuuauggugaagcacaaa

SEQ ID NO: 376507 - RNA, 22 nt, Human
cagagacagaaaauggaucuag

SEQ ID NO: 376508 - RNA, 22 nt, Human
agcugcugcggaaagaugccac

SEQ ID NO: 376509 - RNA, 22 nt, Human
ccuucaaucagcagucuagcuu

SEQ ID NO: 376510 - RNA, 22 nt, Human
gcucugggauuaccagccuuag

SEQ ID NO: 376511 - RNA, 22 nt, Human
ggaggaugagcuacgaggagcu

SEQ ID NO: 376512 - RNA, 18 nt, Human
ugcuuggagcauuuacca

SEQ ID NO: 376513 - RNA, 22 nt, Human
cccuggaggagcuuagagcuug

SEQ ID NO: 376514 - RNA, 19 nt, Human
agcaaauauaauaguguuc

SEQ ID NO: 376515 - RNA, 22 nt, Human
aucuaaaguguuucaugaaaga

SEQ ID NO: 376516 - RNA, 22 nt, Human
cauuucugugacacuuccaucu

SEQ ID NO: 376517 - RNA, 22 nt, Human
uucagaaacaucaguggaugga

SEQ ID NO: 376518 - RNA, 22 nt, Human
ccagccuucugagcugccugga

SEQ ID NO: 376519 - RNA, 22 nt, Human
acagaacugggaaaugcacaua

SEQ ID NO: 376520 - RNA, 22 nt, Human
gauuuacaaagcucucuagugu

SEQ ID NO: 376521 - RNA, 22 nt, Human
ucagaggacuaccuucuccagu

SEQ ID NO: 376522 - RNA, 22 nt, Human
uccaggaguuugaccugugggc

SEQ ID NO: 376523 - RNA, 19 nt, Human
gaaggagagcugaguuagg

SEQ ID NO: 376524 - RNA, 22 nt, Human
gaagcccaggcuuccuuggcuu

SEQ ID NO: 376525 - RNA, 18 nt, Human
ccagagcuggcuccucgc

SEQ ID NO: 376526 - RNA, 22 nt, Human
ucagagaguuagugucuuagcu

SEQ ID NO: 376527 - RNA, 22 nt, Human
cuuaaauuuucaucuacaagaa

SEQ ID NO: 376528 - RNA, 22 nt, Human
auaaacacuucuagggcacaca

SEQ ID NO: 376529 - RNA, 22 nt, Human
auuuccaaucucugcauauggg

SEQ ID NO: 376530 - RNA, 22 nt, Human
agccccacacucucucugagaa

SEQ ID NO: 376531 - RNA, 22 nt, Human
ugcagggagggcccagcaaucu

SEQ ID NO: 376532 - RNA, 22 nt, Human
ggugaggcuaagugacacaggg

SEQ ID NO: 376533 - RNA, 22 nt, Human
ugggggugugccagggaccucc

SEQ ID NO: 376534 - RNA, 20 nt, Human
aaacauucauguacaaguga

SEQ ID NO: 376535 - RNA, 22 nt, Human
caggccugcaggaaaggcuccc

SEQ ID NO: 376536 - RNA, 22 nt, Human
uuuacauugcauuagguauuau

SEQ ID NO: 376537 - RNA, 23 nt, Human
acugagccagggccugggucagc

SEQ ID NO: 376538 - RNA, 22 nt, Human
acccaggaugauaauguucaca

SEQ ID NO: 376539 - RNA, 22 nt, Human
aggcucagauccuuguguccug

SEQ ID NO: 376540 - RNA, 22 nt, Human
agcugcccugggcuggagaugg

SEQ ID NO: 376541 - RNA, 22 nt, Human
uggcucaguuugggggauugaa

SEQ ID NO: 376542 - RNA, 22 nt, Human
aaggcagcagaggaaaggugcu

SEQ ID NO: 376543 - RNA, 22 nt, Human
gcugagaggcacuaucuccgga

SEQ ID NO: 376544 - RNA, 22 nt, Human
gggcagcugccccucucugggc

SEQ ID NO: 376545 - RNA, 20 nt, Human
ucagagagagggugccacuu

SEQ ID NO: 376546 - RNA, 22 nt, Human
uccuggagaauccugccaccug

SEQ ID NO: 376547 - RNA, 22 nt, Human
uaagauaugguaggaaguuugg

SEQ ID NO: 376548 - RNA, 22 nt, Human
caguacuuggucaaggaagcag

SEQ ID NO: 376549 - RNA, 22 nt, Human
aggguagguguaagauagcccu

SEQ ID NO: 376550 - RNA, 22 nt, Human
aagauauagauaaaacuaugca

SEQ ID NO: 376551 - RNA, 22 nt, Human
ucuaaccuuugaaacugcuuuc

SEQ ID NO: 376552 - RNA, 22 nt, Human
ugauucacagacuucacaaggc

SEQ ID NO: 376553 - RNA, 22 nt, Human
gcuuccucgcugggcagaggca

SEQ ID NO: 376554 - RNA, 22 nt, Human
acagaauucuaguauguggcuu

SEQ ID NO: 376555 - RNA, 22 nt, Human
uaaaaugaucucucauguucuu

SEQ ID NO: 376556 - RNA, 22 nt, Human
ccugggagagccaucuguggcc

SEQ ID NO: 376557 - RNA, 22 nt, Human
ccugaggacacacgcugcagga

SEQ ID NO: 376558 - RNA, 21 nt, Human
ugucagaaauaagcaugugau

SEQ ID NO: 376559 - RNA, 22 nt, Human
uaacagaaacagauaaguguaa

SEQ ID NO: 376560 - RNA, 22 nt, Human
gcuggcaucacuggcuucggug

SEQ ID NO: 376561 - RNA, 22 nt, Human
agucaaagcuacaggcauuuga

SEQ ID NO: 376562 - RNA, 22 nt, Human
acugagcucuugacugggaguu

SEQ ID NO: 376563 - RNA, 22 nt, Human
agccuucauaaucuugggcuuu

SEQ ID NO: 376564 - RNA, 22 nt, Human
cccagcucucucaguucugcuu

SEQ ID NO: 376565 - RNA, 22 nt, Human
acaucuguuugagaaaaagaag

SEQ ID NO: 376566 - RNA, 22 nt, Human
auacaguauuaccuguucagga

SEQ ID NO: 376567 - RNA, 22 nt, Human
auuuccucaugaucauaaugca

SEQ ID NO: 376568 - RNA, 22 nt, Human
ccuggugcuuaccagagcuuuu

SEQ ID NO: 376569 - RNA, 22 nt, Human
acuuucucccacccacccgucu

SEQ ID NO: 376570 - RNA, 22 nt, Human
auggaagguccuacagagcgca

SEQ ID NO: 376571 - RNA, 18 nt, Human
ugcuggcaacuacuauug

SEQ ID NO: 376572 - RNA, 22 nt, Human
caaggccaagguuuugugaacu

SEQ ID NO: 376573 - RNA, 19 nt, Human
ggugugaagugaggaguua

SEQ ID NO: 376574 - RNA, 22 nt, Human
aucuggcugcugugcuuaagcu

SEQ ID NO: 376575 - RNA, 22 nt, Human
cagagccaggucuaggagucuc

SEQ ID NO: 376576 - RNA, 22 nt, Human
ucacauuuguguuuuauuagag

SEQ ID NO: 376577 - RNA, 22 nt, Human
gcagcguggggcugagucagcu

SEQ ID NO: 376578 - RNA, 22 nt, Human
aucccuggacggcgccucccca

SEQ ID NO: 376579 - RNA, 22 nt, Human
cagcuuugugcaaugcagucuc

SEQ ID NO: 376580 - RNA, 19 nt, Human
aggcugugagggaggacuc

SEQ ID NO: 376581 - RNA, 20 nt, Human
gggcaguucaaugccacucu

SEQ ID NO: 376582 - RNA, 22 nt, Human
gcugccuuuugcuccucccacc

SEQ ID NO: 376583 - RNA, 22 nt, Human
acuaaagaagccaaaguuuucu

SEQ ID NO: 376584 - RNA, 22 nt, Human
uuugaaucugauauggcagcau

SEQ ID NO: 376585 - RNA, 22 nt, Human
ccagggcauccucacaucgcag

SEQ ID NO: 376586 - RNA, 19 nt, Human
agaaguuagacauugcaau

SEQ ID NO: 376587 - RNA, 22 nt, Human
ugaggcaguauucuccauucca

SEQ ID NO: 376588 - RNA, 22 nt, Human
ugccucuguugagccuuggcug

SEQ ID NO: 376589 - RNA, 22 nt, Human
cagagcuggguuugggaaaccu

SEQ ID NO: 376590 - RNA, 22 nt, Human
uggcagcaauuugugauguuga

SEQ ID NO: 376591 - RNA, 22 nt, Human
acuauacaccaaaauauuaagg

SEQ ID NO: 376592 - RNA, 22 nt, Human
auaucagaaauaguaagcagag

SEQ ID NO: 376593 - RNA, 22 nt, Human
ucagggacauuuagacacugau

SEQ ID NO: 376594 - RNA, 22 nt, Human
uccucugcuccaucuuuacugu

SEQ ID NO: 376595 - RNA, 22 nt, Human
cuucaucaacucuaacaaaugu

SEQ ID NO: 376596 - RNA, 22 nt, Human
gccugcagcugcuuccacacac

SEQ ID NO: 376597 - RNA, 21 nt, Human
augugaaauaucaucagagca

SEQ ID NO: 376598 - RNA, 22 nt, Human
caguuucagaaucaaaacauca

SEQ ID NO: 376599 - RNA, 22 nt, Human
ggcugagcguggcugccguggg

SEQ ID NO: 376600 - RNA, 22 nt, Human
ucagguguuagaagaaauuuca

SEQ ID NO: 376601 - RNA, 22 nt, Human
cacuuagucucaccaguucagu

SEQ ID NO: 376602 - RNA, 22 nt, Human
aggagagggguaggauuaauuu

SEQ ID NO: 376603 - RNA, 22 nt, Human
uccaggcuagguuuacaggaca

SEQ ID NO: 376604 - RNA, 22 nt, Human
uuugacauuggcuuauucuguu

SEQ ID NO: 376605 - RNA, 22 nt, Human
ucuaggagcaugaagggaaggc

SEQ ID NO: 376606 - RNA, 22 nt, Human
agcugaaggcuagaacagcugg

SEQ ID NO: 376607 - RNA, 22 nt, Human
agggacagucuacuguucacug

SEQ ID NO: 376608 - RNA, 22 nt, Human
agggaagaagcugguaguaggu

SEQ ID NO: 376609 - RNA, 22 nt, Human
aacuuucagaauccuaugcauu

SEQ ID NO: 376610 - RNA, 22 nt, Human
gaggagagaagcuaacggugcu

SEQ ID NO: 376611 - RNA, 22 nt, Human
ugcaucuguucagagcugucga

SEQ ID NO: 376612 - RNA, 22 nt, Human
guccuuugaaggcaaaaggaga

SEQ ID NO: 376613 - RNA, 22 nt, Human
uguaacaguaagccugugagcu

SEQ ID NO: 376614 - RNA, 22 nt, Human
gcaacuuuagggccagcaagua

SEQ ID NO: 376615 - RNA, 22 nt, Human
ucagaagccggaagugcuccuc

SEQ ID NO: 376616 - RNA, 22 nt, Human
auauuugucaauucacuguuca

SEQ ID NO: 376617 - RNA, 22 nt, Human
aguggcagagugcacucaggca

SEQ ID NO: 376618 - RNA, 22 nt, Human
agccucugugacucacagguca

SEQ ID NO: 376619 - RNA, 22 nt, Human
aagggcagggaguuugugucua

SEQ ID NO: 376620 - RNA, 22 nt, Human
ccucagagccuccagaaggaau

SEQ ID NO: 376621 - RNA, 22 nt, Human
caguaaaagauggaaauagaau

SEQ ID NO: 376622 - RNA, 22 nt, Human
uguucagagacagaaauucuaa

SEQ ID NO: 376623 - RNA, 22 nt, Human
cucuaacacuguaaugcuuucu

SEQ ID NO: 376624 - RNA, 22 nt, Human
agaaauguacgauguuaugcag

SEQ ID NO: 376625 - RNA, 21 nt, Human
gaggccacuaauaggggcaga

SEQ ID NO: 376626 - RNA, 22 nt, Human
guacacauuaugcuucucuaaa

SEQ ID NO: 376627 - RNA, 22 nt, Human
cauuucaaguaacagauugcuu

SEQ ID NO: 376628 - RNA, 22 nt, Human
acauaauaaaaauaacagcuca

SEQ ID NO: 376629 - RNA, 22 nt, Human
acacuucuauucccugcacaaa

SEQ ID NO: 376630 - RNA, 22 nt, Human
aucuuucaaucaggaaaaaucu

SEQ ID NO: 376631 - RNA, 22 nt, Human
aguguuugucccguuagaaaug

SEQ ID NO: 376632 - RNA, 22 nt, Human
aggggaggagcuuuucuugccu

SEQ ID NO: 376633 - RNA, 22 nt, Human
aggagggcuaggaaaaccagga

SEQ ID NO: 376634 - RNA, 22 nt, Human
uaugugcaguuugcucuuaaca

SEQ ID NO: 376635 - RNA, 22 nt, Human
cuucagaacuauaaaaaguacu

SEQ ID NO: 376636 - RNA, 22 nt, Human
ucaucaguuuagaaaaaauaug

SEQ ID NO: 376637 - RNA, 22 nt, Human
cagagacauuaagugccaugau

SEQ ID NO: 376638 - RNA, 22 nt, Human
uauucacauucucaggccuggu

SEQ ID NO: 376639 - RNA, 22 nt, Human
gcagauggaaagugcuugaggg

SEQ ID NO: 376640 - RNA, 22 nt, Human
ggcugccugggagcccuccucu

SEQ ID NO: 376641 - RNA, 22 nt, Human
ugccaggcccagcagggcggcc

SEQ ID NO: 376642 - RNA, 22 nt, Human
acaugcuuugcacuuacaucau

SEQ ID NO: 376643 - RNA, 22 nt, Human
uagagaaaagcagggaucagga

SEQ ID NO: 376644 - RNA, 22 nt, Human
uggcucagcgcggccuggucuu

SEQ ID NO: 376645 - RNA, 22 nt, Human
uagaaaucagguuuuuagaaag

SEQ ID NO: 376646 - RNA, 22 nt, Human
uucuuuccucccagccuuugga

SEQ ID NO: 376647 - RNA, 20 nt, Human
ggguggaguugcggucugug

SEQ ID NO: 376648 - RNA, 22 nt, Human
ggaggcucugcuccguguguuc

SEQ ID NO: 376649 - RNA, 22 nt, Human
cccagcuugucugauucagccu

SEQ ID NO: 376650 - RNA, 22 nt, Human
uccaggcugauccaugaagaau

SEQ ID NO: 376651 - RNA, 22 nt, Human
uccaugagacagauacuguaag

SEQ ID NO: 376652 - RNA, 22 nt, Human
uccaggcucucaggugucagca

SEQ ID NO: 376653 - RNA, 22 nt, Human
uacuguuuuuuagacucauggu

SEQ ID NO: 376654 - RNA, 22 nt, Human
uuugcauugccucugacuuaug

SEQ ID NO: 376655 - RNA, 22 nt, Human
cugagcugaaacuugagaggcu

SEQ ID NO: 376656 - RNA, 22 nt, Human
ucacaaaugaggaaaucgagca

SEQ ID NO: 376657 - RNA, 22 nt, Human
augauguugauaaauuacuuua

SEQ ID NO: 376658 - RNA, 22 nt, Human
uggcccugacugauguggaggg

SEQ ID NO: 376659 - RNA, 22 nt, Human
gcugcucuugaggggcucacug

SEQ ID NO: 376660 - RNA, 22 nt, Human
gcagauggcagcccaggcuggg

SEQ ID NO: 376661 - RNA, 22 nt, Human
agcuggagccagugugaggcuu

SEQ ID NO: 376662 - RNA, 17 nt, Human
uauguaguacuuauaaa

SEQ ID NO: 376663 - RNA, 22 nt, Human
aacauguugcuuuaauaauauu

SEQ ID NO: 376664 - RNA, 22 nt, Human
aaggcagccuuuguuugauuga

SEQ ID NO: 376665 - RNA, 22 nt, Human
aaguauaagcuauucuucauga

SEQ ID NO: 376666 - RNA, 23 nt, Human
cugcccugaucuugaucuauugu

SEQ ID NO: 376667 - RNA, 20 nt, Human
uacauucaaaacaaacucug

SEQ ID NO: 376668 - RNA, 22 nt, Human
aaguccagacuccuuugcgugg

SEQ ID NO: 376669 - RNA, 19 nt, Human
aggugcaggucacagggga

SEQ ID NO: 376670 - RNA, 22 nt, Human
aaauauguauggaguucaugaa

SEQ ID NO: 376671 - RNA, 22 nt, Human
aagagagagcauucuucuguua

SEQ ID NO: 376672 - RNA, 22 nt, Human
ucagaaauacuaucagcuuuug

SEQ ID NO: 376673 - RNA, 22 nt, Human
aagcuccccgaaacccaccucu

SEQ ID NO: 376674 - RNA, 22 nt, Human
gagaaggcuggucuuaagucga

SEQ ID NO: 376675 - RNA, 22 nt, Human
cccaggagguggagguugcggu

SEQ ID NO: 376676 - RNA, 22 nt, Human
ggcugccacgucgaggguccaa

SEQ ID NO: 376677 - RNA, 22 nt, Human
gcugauguaagacuuuugguuu

SEQ ID NO: 376678 - RNA, 22 nt, Human
ccagaauucagaaagggcauaa

SEQ ID NO: 376679 - RNA, 22 nt, Human
cagcucugaagaaaggugucua

SEQ ID NO: 376680 - RNA, 22 nt, Human
uauuuccugcauggugauguaa

SEQ ID NO: 376681 - RNA, 22 nt, Human
gcaaagcauucuguggagucua

SEQ ID NO: 376682 - RNA, 22 nt, Human
aaucucuuuggcucaaggaucc

SEQ ID NO: 376683 - RNA, 22 nt, Human
ucugaggcuauguucaggcuaa

SEQ ID NO: 376684 - RNA, 20 nt, Human
ucucccaggcucagggaaga

SEQ ID NO: 376685 - RNA, 22 nt, Human
auugucuucuggucuuaucuuu

SEQ ID NO: 376686 - RNA, 22 nt, Human
uuucaguguaagguuuccagga

SEQ ID NO: 376687 - RNA, 22 nt, Human
ugaggaaacugaggcacagaug

SEQ ID NO: 376688 - RNA, 22 nt, Human
cauguaaaacacucagaacagu

SEQ ID NO: 376689 - RNA, 18 nt, Human
ccugcagcccaggaggcc

SEQ ID NO: 376690 - RNA, 22 nt, Human
aguacuuuacuucuuacaguuu

SEQ ID NO: 376691 - RNA, 22 nt, Human
gacagaggcaagaccagaagcc

SEQ ID NO: 376692 - RNA, 22 nt, Human
gcaguaaaaaaggauaugugca

SEQ ID NO: 376693 - RNA, 22 nt, Human
agugggggccaacgagggcagc

SEQ ID NO: 376694 - RNA, 22 nt, Human
cccaggaguuggaggcuacggu

SEQ ID NO: 376695 - RNA, 22 nt, Human
aaugggaagucacuacuguuac

SEQ ID NO: 376696 - RNA, 22 nt, Human
gagaaccucuccacaagucugg

SEQ ID NO: 376697 - RNA, 22 nt, Human
auuucccuccagggaaagcuua

SEQ ID NO: 376698 - RNA, 22 nt, Human
ugaugaaacugagguuccaaga

SEQ ID NO: 376699 - RNA, 22 nt, Human
ucacguuuuacugagugagaua

SEQ ID NO: 376700 - RNA, 22 nt, Human
gaucauuugcaggaaacauuaa

SEQ ID NO: 376701 - RNA, 22 nt, Human
cuuaagaugaggucaugcuaua

SEQ ID NO: 376702 - RNA, 22 nt, Human
guaacagaggguuugcagauau

SEQ ID NO: 376703 - RNA, 22 nt, Human
uuggcucaggaccccugugacu

SEQ ID NO: 376704 - RNA, 22 nt, Human
auccugugcaaugacugcaucu

SEQ ID NO: 376705 - RNA, 22 nt, Human
agggccuggaacugugggcagg

SEQ ID NO: 376706 - RNA, 22 nt, Human
aggcugaggaucguacuuucca

SEQ ID NO: 376707 - RNA, 22 nt, Human
ccacccagccagaugcaggaag

SEQ ID NO: 376708 - RNA, 22 nt, Human
uuaacaauagaguuucuucagg

SEQ ID NO: 376709 - RNA, 22 nt, Human
uuacaaagaguguucuuuucca

SEQ ID NO: 376710 - RNA, 22 nt, Human
uggcccugcugggucagagcug

SEQ ID NO: 376711 - RNA, 22 nt, Human
caaauguaaauucuuuugaagc

SEQ ID NO: 376712 - RNA, 22 nt, Human
uggcccugcuuaugucucucuu

SEQ ID NO: 376713 - RNA, 22 nt, Human
ccagggugaccagcuggccuag

SEQ ID NO: 376714 - RNA, 22 nt, Human
cauacauaugcauguguguaua

SEQ ID NO: 376715 - RNA, 22 nt, Human
uuguuaaaaauagauuuccagg

SEQ ID NO: 376716 - RNA, 22 nt, Human
ggcuggagugggcuccagaguu

SEQ ID NO: 376717 - RNA, 22 nt, Human
aaauccuaaaaguuugacuuaa

SEQ ID NO: 376718 - RNA, 22 nt, Human
caggcaggagccagggauucca

SEQ ID NO: 376719 - RNA, 20 nt, Human
gccaggcacuguucucaaua

SEQ ID NO: 376720 - RNA, 20 nt, Human
gcauugaguauagacagaug

SEQ ID NO: 376721 - RNA, 22 nt, Human
agcugagcacauucaaacaggu

SEQ ID NO: 376722 - RNA, 22 nt, Human
aauguuaauuuacugucuucau

SEQ ID NO: 376723 - RNA, 22 nt, Human
agauauaauaauuuacaagugu

SEQ ID NO: 376724 - RNA, 22 nt, Human
cagcuugaaauauuaggagaug

SEQ ID NO: 376725 - RNA, 22 nt, Human
cucuucuuauggccguggcuga

SEQ ID NO: 376726 - RNA, 21 nt, Human
aaucauacaaaacaugucagg

SEQ ID NO: 376727 - RNA, 22 nt, Human
ucagcauaucuugagcuucaug

SEQ ID NO: 376728 - RNA, 17 nt, Human
aggccagaugaggcaag

SEQ ID NO: 376729 - RNA, 21 nt, Human
gcucccuggcugugugaccug

SEQ ID NO: 376730 - RNA, 22 nt, Human
ucuuugaacuuggcugaucucu

SEQ ID NO: 376731 - RNA, 18 nt, Human
ugagaggcagguagagga

SEQ ID NO: 376732 - RNA, 22 nt, Human
agagcuguggauaguccuggau

SEQ ID NO: 376733 - RNA, 22 nt, Human
uuucauuuugguuaugccauaa

SEQ ID NO: 376734 - RNA, 22 nt, Human
ucaaaccaccuuguuacugggg

SEQ ID NO: 376735 - RNA, 22 nt, Human
cccaguggaaggaguagaagac

SEQ ID NO: 376736 - RNA, 22 nt, Human
acagggccucagcugauucugg

SEQ ID NO: 376737 - RNA, 22 nt, Human
gcuggagauaguaggauccaua

SEQ ID NO: 376738 - RNA, 22 nt, Human
caggaaagguagucacaaugua

SEQ ID NO: 376739 - RNA, 22 nt, Human
cugagagccuccuguuggcuag

SEQ ID NO: 376740 - RNA, 22 nt, Human
agggcaguucaacuucauagug

SEQ ID NO: 376741 - RNA, 22 nt, Human
ucugggagagcacguggcugac

SEQ ID NO: 376742 - RNA, 22 nt, Human
gcucugcuugcaucaugacugc

SEQ ID NO: 376743 - RNA, 22 nt, Human
auugucuuuggugcuuccagga

SEQ ID NO: 376744 - RNA, 22 nt, Human
uuugaaguguuauuucuaucac

SEQ ID NO: 376745 - RNA, 22 nt, Human
caggaggcuuugggauccaagu

SEQ ID NO: 376746 - RNA, 22 nt, Human
gagggaggugauacugaacgua

SEQ ID NO: 376747 - RNA, 22 nt, Human
gcucccuguucucagccaugau

SEQ ID NO: 376748 - RNA, 21 nt, Human
cccaagggaggcaggauaagg

SEQ ID NO: 376749 - RNA, 22 nt, Human
ugacauuuaucaaagaaauggu

SEQ ID NO: 376750 - RNA, 22 nt, Human
ugaguccaucgcagggaagugg

SEQ ID NO: 376751 - RNA, 22 nt, Human
ugcagugggccggaggccaggg

SEQ ID NO: 376752 - RNA, 22 nt, Human
ugagcugggcugggcugagcug

SEQ ID NO: 376753 - RNA, 22 nt, Human
uggaggaugccauccaggauac

SEQ ID NO: 376754 - RNA, 22 nt, Human
agcuggguggagggcccacggu

SEQ ID NO: 376755 - RNA, 22 nt, Human
agcagcugagaugguaagauuc

SEQ ID NO: 376756 - RNA, 22 nt, Human
uuccucuccucacaugagucac

SEQ ID NO: 376757 - RNA, 22 nt, Human
aaguggagccagggaaacugaa

SEQ ID NO: 376758 - RNA, 22 nt, Human
gccagguggucuggcuccagag

SEQ ID NO: 376759 - RNA, 22 nt, Human
ggcugcagauagccagccacca

SEQ ID NO: 376760 - RNA, 22 nt, Human
ggaggggagguccagcugaucu

SEQ ID NO: 376761 - RNA, 22 nt, Human
gagcucagauucuggugucaga

SEQ ID NO: 376762 - RNA, 22 nt, Human
cuuuuauuuugaauuaagggcu

SEQ ID NO: 376763 - RNA, 22 nt, Human
ccaccagcuuugccacccugcu

SEQ ID NO: 376764 - RNA, 19 nt, Human
auaaggcaggaggaaauuu

SEQ ID NO: 376765 - RNA, 22 nt, Human
uauuuuaaagacugccagccua

SEQ ID NO: 376766 - RNA, 22 nt, Human
ggcagcucugcuccacaugagu

SEQ ID NO: 376767 - RNA, 22 nt, Human
gccagggcaggggagcaucugc

SEQ ID NO: 376768 - RNA, 22 nt, Human
aggaggcugguucaggccauau

SEQ ID NO: 376769 - RNA, 22 nt, Human
aggcagguguuaccucugguuu

SEQ ID NO: 376770 - RNA, 22 nt, Human
uugcugugucugauggcugaga

SEQ ID NO: 376771 - RNA, 22 nt, Human
uuucagaugugugucucugaag

SEQ ID NO: 376772 - RNA, 18 nt, Human
uggacaggguggagaaaa

SEQ ID NO: 376773 - RNA, 22 nt, Human
agccagaggccagccugccuca

SEQ ID NO: 376774 - RNA, 22 nt, Human
caguguggugagauuccaggug

SEQ ID NO: 376775 - RNA, 22 nt, Human
ucugcugugauuugcuaccugu

SEQ ID NO: 376776 - RNA, 22 nt, Human
cacagggcagugcugcccacuc

SEQ ID NO: 376777 - RNA, 22 nt, Human
gcagaggagugauuaugccgug

SEQ ID NO: 376778 - RNA, 22 nt, Human
uagaaauguugguauuaacauu

SEQ ID NO: 376779 - RNA, 22 nt, Human
aaaaaugcugugguagcugugu

SEQ ID NO: 376780 - RNA, 22 nt, Human
ugcucugcaagcaggagcaaga

SEQ ID NO: 376781 - RNA, 22 nt, Human
ccagggugggaggcugaaggcg

SEQ ID NO: 376782 - RNA, 22 nt, Human
ucagggcaaagggcagaguuug

SEQ ID NO: 376783 - RNA, 22 nt, Human
gagccuggggacccuccugagu

SEQ ID NO: 376784 - RNA, 22 nt, Human
ccugggaagagcugacaggagg

SEQ ID NO: 376785 - RNA, 22 nt, Human
uuucuucacaggguauugggug

SEQ ID NO: 376786 - RNA, 23 nt, Human
ucccagccucuucucuugcauac

SEQ ID NO: 376787 - RNA, 22 nt, Human
agagcuggggccagagucaagg

SEQ ID NO: 376788 - RNA, 22 nt, Human
agcugaugccauguggaacagu

SEQ ID NO: 376789 - RNA, 22 nt, Human
gggaaauugucaacacucucaa

SEQ ID NO: 376790 - RNA, 22 nt, Human
uuuuaugugcuggacuggcagu

SEQ ID NO: 376791 - RNA, 22 nt, Human
ugggcaggggcccugcuuccgu

SEQ ID NO: 376792 - RNA, 22 nt, Human
ugcccagcacugugccagucac

SEQ ID NO: 376793 - RNA, 22 nt, Human
augaaggcaguuaaacgucauc

SEQ ID NO: 376794 - RNA, 22 nt, Human
uccuguaguugcuaaguuuguu

SEQ ID NO: 376795 - RNA, 22 nt, Human
ggcagugacuguucagacgucc

SEQ ID NO: 376796 - RNA, 22 nt, Human
gaggcagcugggauacaaggga

SEQ ID NO: 376797 - RNA, 22 nt, Human
agcagcuccugccaugagugcu

SEQ ID NO: 376798 - RNA, 20 nt, Human
ugggccugagccugugggcu

SEQ ID NO: 376799 - RNA, 22 nt, Human
auucugucuuuuuaaaauaaua

SEQ ID NO: 376800 - RNA, 22 nt, Human
gauuuccauuuucaacuccugc

SEQ ID NO: 376801 - RNA, 22 nt, Human
aauuaaauugguuuagagagga

SEQ ID NO: 376802 - RNA, 22 nt, Human
aauuuuauuagaaggcaagggg

SEQ ID NO: 376803 - RNA, 22 nt, Human
gcuggcagagacaagaagacua

SEQ ID NO: 376804 - RNA, 22 nt, Human
agcccaggucucaaaguacagg

SEQ ID NO: 376805 - RNA, 22 nt, Human
uuuaggcauacuuuugggagaa

SEQ ID NO: 376806 - RNA, 22 nt, Human
caaaggcaguuacugaaugaag

SEQ ID NO: 376807 - RNA, 22 nt, Human
caguucacacugugcuaucugc

SEQ ID NO: 376808 - RNA, 22 nt, Human
agcuucuuggcucagcacuugg

SEQ ID NO: 376809 - RNA, 22 nt, Human
cauugcacuccaucuugggcaa

SEQ ID NO: 376810 - RNA, 22 nt, Human
agaggcugaaugaugucaucau

SEQ ID NO: 376811 - RNA, 22 nt, Human
gggugggagucuggcccucaaa

SEQ ID NO: 376812 - RNA, 22 nt, Human
cagaaugcaaauuuuauaauau

SEQ ID NO: 376813 - RNA, 22 nt, Human
cuucucagucaccugugagucu

SEQ ID NO: 376814 - RNA, 22 nt, Human
guuuuauaggugaaauauuacu

SEQ ID NO: 376815 - RNA, 22 nt, Human
gccucugcugacaagauggaca

SEQ ID NO: 376816 - RNA, 22 nt, Human
ugaagccaaucugccaggcaga

SEQ ID NO: 376817 - RNA, 22 nt, Human
ugcugugagguugagaaggaag

SEQ ID NO: 376818 - RNA, 22 nt, Human
aaacuuugguauguagcaaaac

SEQ ID NO: 376819 - RNA, 22 nt, Human
gaaaugugaccuacuuccuugu

SEQ ID NO: 376820 - RNA, 22 nt, Human
ggcagcuccucaaaaaauuaaa

SEQ ID NO: 376821 - RNA, 22 nt, Human
agggugguucuuuuaguggaag

SEQ ID NO: 376822 - RNA, 22 nt, Human
gccauuuagggaggcaagguga

SEQ ID NO: 376823 - RNA, 22 nt, Human
ugucucagaguaucccugaacu

SEQ ID NO: 376824 - RNA, 22 nt, Human
uggccugggugcugcugacauc

SEQ ID NO: 376825 - RNA, 22 nt, Human
uucaggauuguguuuuuccuga

SEQ ID NO: 376826 - RNA, 22 nt, Human
ggcaguggguggaucucaggga

SEQ ID NO: 376827 - RNA, 20 nt, Human
gaaggaagggggcaagguga

SEQ ID NO: 376828 - RNA, 20 nt, Human
cuaucuccuggcgugccuuc

SEQ ID NO: 376829 - RNA, 22 nt, Human
cuuccugaacaaugccaucaau

SEQ ID NO: 376830 - RNA, 21 nt, Human
gccuggcagguggaagggcuc

SEQ ID NO: 376831 - RNA, 22 nt, Human
guucuaauauuuuaaaagccaa

SEQ ID NO: 376832 - RNA, 20 nt, Human
uuucaagucagcaauucuca

SEQ ID NO: 376833 - RNA, 23 nt, Human
uccucccaaauuucagccucauu

SEQ ID NO: 376834 - RNA, 22 nt, Human
aauauaaugcuguuuuaugcca

SEQ ID NO: 376835 - RNA, 22 nt, Human
uccuugaauccuagcauccuau

SEQ ID NO: 376836 - RNA, 22 nt, Human
cuggaguguaaagagcauagaa

SEQ ID NO: 376837 - RNA, 22 nt, Human
aggguagggccguagggccaug

SEQ ID NO: 376838 - RNA, 22 nt, Human
cucagaguccccacaucugggu

SEQ ID NO: 376839 - RNA, 22 nt, Human
cugcucucuguuccccuggauc

SEQ ID NO: 376840 - RNA, 22 nt, Human
ugagggaggcccuuugagcaga

SEQ ID NO: 376841 - RNA, 22 nt, Human
aggcacugauucucagaguuac

SEQ ID NO: 376842 - RNA, 22 nt, Human
agagugcagauaagagaauguu

SEQ ID NO: 376843 - RNA, 22 nt, Human
ucaggcagaauuaucaaaagau

SEQ ID NO: 376844 - RNA, 22 nt, Human
agcugcagucaagcugggccac

SEQ ID NO: 376845 - RNA, 22 nt, Human
gaggccugaaaggggaccuaug

SEQ ID NO: 376846 - RNA, 22 nt, Human
ucaacuuuaguguagcuauuua

SEQ ID NO: 376847 - RNA, 23 nt, Human
agcacacuuguacaaugcccuag

SEQ ID NO: 376848 - RNA, 22 nt, Human
ccaggggcuggugcugagcugg

SEQ ID NO: 376849 - RNA, 17 nt, Human
gguggccugcaguggcu

SEQ ID NO: 376850 - RNA, 22 nt, Human
acagagagaggcccgaggcugc

SEQ ID NO: 376851 - RNA, 22 nt, Human
gcagagccaggcuggggcaggu

SEQ ID NO: 376852 - RNA, 22 nt, Human
ccugugucuuccccacuggugu

SEQ ID NO: 376853 - RNA, 22 nt, Human
ugucagugguagacccagaggu

SEQ ID NO: 376854 - RNA, 22 nt, Human
uuuugaaagccagguuuguaug

SEQ ID NO: 376855 - RNA, 22 nt, Human
uuacuuugaugaucaaugagcg

SEQ ID NO: 376856 - RNA, 22 nt, Human
gcacagggagcaggucucuggu

SEQ ID NO: 376857 - RNA, 22 nt, Human
ccagcugcagguguuccagaug

SEQ ID NO: 376858 - RNA, 23 nt, Human
caugccaguuugugcaggcagau

SEQ ID NO: 376859 - RNA, 20 nt, Human
uggggccuguuucugugguu

SEQ ID NO: 376860 - RNA, 15 nt, Human
caggagaggaagguu

SEQ ID NO: 376861 - RNA, 23 nt, Human
agucaguguaaguuuggaaugca

SEQ ID NO: 376862 - RNA, 22 nt, Human
gacagccaugcacuucugcugu

SEQ ID NO: 376863 - RNA, 22 nt, Human
uuguaaauaguaguaagaugcc

SEQ ID NO: 376864 - RNA, 22 nt, Human
ucuguucacugagcaauggcaa

SEQ ID NO: 376865 - RNA, 22 nt, Human
aggcacugugcugaugucuuau

SEQ ID NO: 376866 - RNA, 22 nt, Human
gccuguccacuaaacagccaag

SEQ ID NO: 376867 - RNA, 22 nt, Human
cauuuguaucugggcugcugug

SEQ ID NO: 376868 - RNA, 16 nt, Human
auuuccagauuaugca

SEQ ID NO: 376869 - RNA, 22 nt, Human
gggcagaggcucuggcccaucc

SEQ ID NO: 376870 - RNA, 21 nt, Human
guuuucaugauagagucugua

SEQ ID NO: 376871 - RNA, 19 nt, Human
cucugccucccuccugggu

SEQ ID NO: 376872 - RNA, 22 nt, Human
ccagggcauguccaagacuuag

SEQ ID NO: 376873 - RNA, 22 nt, Human
cccaggcacacugaagugacau

SEQ ID NO: 376874 - RNA, 22 nt, Human
agaaauacuuuguaaaucucac

SEQ ID NO: 376875 - RNA, 22 nt, Human
agcugucuuucugccuccugau

SEQ ID NO: 376876 - RNA, 22 nt, Human
gauucaauguugcagauggaau

SEQ ID NO: 376877 - RNA, 22 nt, Human
uggcucagcaagacauugaccu

SEQ ID NO: 376878 - RNA, 20 nt, Human
ggaggguggaagaaagcaag

SEQ ID NO: 376879 - RNA, 19 nt, Human
uucacaauuaugaaauuag

SEQ ID NO: 376880 - RNA, 22 nt, Human
uuacugaaaauucuucaggauu

SEQ ID NO: 376881 - RNA, 22 nt, Human
auaugaagucagacaaacuggg

SEQ ID NO: 376882 - RNA, 22 nt, Human
ccuuccaggagucucugcaggu

SEQ ID NO: 376883 - RNA, 22 nt, Human
agaauuuccuaugagagauucc

SEQ ID NO: 376884 - RNA, 18 nt, Human
cagucccaaaccuuagga

SEQ ID NO: 376885 - RNA, 22 nt, Human
ggucccaggcucccucuugucc

SEQ ID NO: 376886 - RNA, 22 nt, Human
gaggagggagcuggaagcucuu

SEQ ID NO: 376887 - RNA, 22 nt, Human
ugcagcuucuuguccugugauu

SEQ ID NO: 376888 - RNA, 22 nt, Human
gauuuucauuauagcuaguuuc

SEQ ID NO: 376889 - RNA, 19 nt, Human
ccugggaggcggagguugc

SEQ ID NO: 376890 - RNA, 22 nt, Human
ccgggcgggggcucucgucacc

SEQ ID NO: 376891 - RNA, 22 nt, Human
cucacagguaccagcacccucc

SEQ ID NO: 376892 - RNA, 22 nt, Human
uuccuucucagcccucgaggau

SEQ ID NO: 376893 - RNA, 22 nt, Human
acaggccuuggcaggcauguga

SEQ ID NO: 376894 - RNA, 22 nt, Human
ggagcugcuuugaucugaagaa

SEQ ID NO: 376895 - RNA, 22 nt, Human
auuauauugaguauaaccagag

SEQ ID NO: 376896 - RNA, 22 nt, Human
ggccucuggcaggcaggcccuc

SEQ ID NO: 376897 - RNA, 22 nt, Human
uguguauucagcaagcgaaaca

SEQ ID NO: 376898 - RNA, 22 nt, Human
acagaagagcacauuuaguaug

SEQ ID NO: 376899 - RNA, 22 nt, Human
aggcaggcuagucgcuugagcc

SEQ ID NO: 376900 - RNA, 22 nt, Human
cagagcaugaauaaaaguuaca

SEQ ID NO: 376901 - RNA, 22 nt, Human
acagcuguggucuccuuagugu

SEQ ID NO: 376902 - RNA, 21 nt, Human
guuugcaugaacaagucagcc

SEQ ID NO: 376903 - RNA, 22 nt, Human
ucagggacuaggugcugccuga

SEQ ID NO: 376904 - RNA, 22 nt, Human
augugaaaccugugaguagagu

SEQ ID NO: 376905 - RNA, 22 nt, Human
ucuucagagacucugagccccu

SEQ ID NO: 376906 - RNA, 22 nt, Human
caagagcauuuaguuagcuggu

SEQ ID NO: 376907 - RNA, 22 nt, Human
ucagagugguagccuauuuucu

SEQ ID NO: 376908 - RNA, 22 nt, Human
gcaggcugugaggcucagaugg

SEQ ID NO: 376909 - RNA, 22 nt, Human
gagaccaggaaguacagcagcc

SEQ ID NO: 376910 - RNA, 21 nt, Human
acagauuuuauaucucugcug

SEQ ID NO: 376911 - RNA, 22 nt, Human
uucuauacaaagauuucucaca

SEQ ID NO: 376912 - RNA, 22 nt, Human
uagcugcugcagcacagggagg

SEQ ID NO: 376913 - RNA, 22 nt, Human
acccuguaugcuauaucccuaa

SEQ ID NO: 376914 - RNA, 20 nt, Human
guccugggagccacagcaca

SEQ ID NO: 376915 - RNA, 22 nt, Human
ugaaggaaugaguauacuguuu

SEQ ID NO: 376916 - RNA, 22 nt, Human
ugcuuuauguuaucagaagggu

SEQ ID NO: 376917 - RNA, 19 nt, Human
agacacacuugauaugugu

SEQ ID NO: 376918 - RNA, 22 nt, Human
ugggcugaaaugcuguggacua

SEQ ID NO: 376919 - RNA, 17 nt, Human
gcagcagagagacccuc

SEQ ID NO: 376920 - RNA, 22 nt, Human
uugaaaacuuucuagaccaaga

SEQ ID NO: 376921 - RNA, 22 nt, Human
uucauugugaacacauucugcc

SEQ ID NO: 376922 - RNA, 22 nt, Human
aacagacagaaaaaugugaucu

SEQ ID NO: 376923 - RNA, 22 nt, Human
cagcagugugcaggugugcugg

SEQ ID NO: 376924 - RNA, 22 nt, Human
uuguuacagcagugauuucaga

SEQ ID NO: 376925 - RNA, 19 nt, Human
gcagccaccgcggcggccg

SEQ ID NO: 376926 - RNA, 22 nt, Human
ccucaggaaaugaauaaauggc

SEQ ID NO: 376927 - RNA, 22 nt, Human
gccugggugucgaucacuagug

SEQ ID NO: 376928 - RNA, 19 nt, Human
gcaugcuugguggcuucug

SEQ ID NO: 376929 - RNA, 22 nt, Human
gagcucccaggccccagcaagg

SEQ ID NO: 376930 - RNA, 22 nt, Human
cuucaagaagacagcagagcau

SEQ ID NO: 376931 - RNA, 22 nt, Human
cuguccauuuucgugccuccuu

SEQ ID NO: 376932 - RNA, 22 nt, Human
uggcucagccagcccuaggaac

SEQ ID NO: 376933 - RNA, 22 nt, Human
uggcccuguggaggucagugag

SEQ ID NO: 376934 - RNA, 22 nt, Human
gugucccaggagaggagacaau

SEQ ID NO: 376935 - RNA, 22 nt, Human
aagcagaaguugaucuaccaua

SEQ ID NO: 376936 - RNA, 22 nt, Human
gcccugugccagucacgcugug

SEQ ID NO: 376937 - RNA, 22 nt, Human
cacagcugccauggcugcacuu

SEQ ID NO: 376938 - RNA, 22 nt, Human
ucugugcaggaagucauuauga

SEQ ID NO: 376939 - RNA, 22 nt, Human
gaaguucaaaagacagauuuga

SEQ ID NO: 376940 - RNA, 22 nt, Human
ucuggcugcugcgugagugcuu

SEQ ID NO: 376941 - RNA, 22 nt, Human
agcagggcuggggcacgagcca

SEQ ID NO: 376942 - RNA, 22 nt, Human
ucuguagcaagugagaggcauu

SEQ ID NO: 376943 - RNA, 22 nt, Human
uuugggcaguagauguaucacu

SEQ ID NO: 376944 - RNA, 22 nt, Human
ggcacugauuccauucaugaag

SEQ ID NO: 376945 - RNA, 23 nt, Human
aucagucuugguagcugugccca

SEQ ID NO: 376946 - RNA, 22 nt, Human
gccuggguuccaugaucuccag

SEQ ID NO: 376947 - RNA, 18 nt, Human
cucugcuaaugggcagcu

SEQ ID NO: 376948 - RNA, 22 nt, Human
gagaagucauuugaccaccuag

SEQ ID NO: 376949 - RNA, 22 nt, Human
uggcugcuagccagagcuucag

SEQ ID NO: 376950 - RNA, 22 nt, Human
gcagaugaggaagcuaaugcug

SEQ ID NO: 376951 - RNA, 23 nt, Human
ggggccugcaccggucugcgcgg

SEQ ID NO: 376952 - RNA, 22 nt, Human
cuucaggauuuaggaagaugaa

SEQ ID NO: 376953 - RNA, 22 nt, Human
ccaggguaccccaagggcaggu

SEQ ID NO: 376954 - RNA, 22 nt, Human
gccaggagaaaaggcgaaugau

SEQ ID NO: 376955 - RNA, 23 nt, Human
aaguaacagggauaauagcaguu

SEQ ID NO: 376956 - RNA, 22 nt, Human
uauugaguuacagaaaauacuu

SEQ ID NO: 376957 - RNA, 22 nt, Human
agaacagaggccuuauguuuca

SEQ ID NO: 376958 - RNA, 22 nt, Human
aaauguauugcauaggauauuu

SEQ ID NO: 376959 - RNA, 22 nt, Human
ccuuggagcggucagcacuggu

SEQ ID NO: 376960 - RNA, 22 nt, Human
guucuucagcauuagaagucau

SEQ ID NO: 376961 - RNA, 22 nt, Human
uauuuguauuucaugcaguaaa

SEQ ID NO: 376962 - RNA, 19 nt, Human
ucugcuggcagaauucccu

SEQ ID NO: 376963 - RNA, 22 nt, Human
cugccagcucaaagcgcagcua

SEQ ID NO: 376964 - RNA, 22 nt, Human
gagguucacaggcuaucacagu

SEQ ID NO: 376965 - RNA, 22 nt, Human
ccagcagacacacaggcguggg

SEQ ID NO: 376966 - RNA, 22 nt, Human
uuccugagggacuuuugagauu

SEQ ID NO: 376967 - RNA, 22 nt, Human
agaaaugacacacaugagacau

SEQ ID NO: 376968 - RNA, 22 nt, Human
gcccaggagaggccagggcuga

SEQ ID NO: 376969 - RNA, 22 nt, Human
ugcagggcuccuggcuccaauc

SEQ ID NO: 376970 - RNA, 15 nt, Human
aggcacugugggacc

SEQ ID NO: 376971 - RNA, 22 nt, Human
cuuaauuucaaacugcuaguga

SEQ ID NO: 376972 - RNA, 22 nt, Human
uuuagaaugugacuguauuuga

SEQ ID NO: 376973 - RNA, 22 nt, Human
uaaauucccaacucugcucuuc

SEQ ID NO: 376974 - RNA, 22 nt, Human
cacaggagauugaucuauuggu

SEQ ID NO: 376975 - RNA, 22 nt, Human
uuuguuaaauauuuauugagug

SEQ ID NO: 376976 - RNA, 22 nt, Human
aucagcugaaaaacaggcagca

SEQ ID NO: 376977 - RNA, 22 nt, Human
cucucuggcuuggcacggagau

SEQ ID NO: 376978 - RNA, 22 nt, Human
gucccagagagcacuaguccau

SEQ ID NO: 376979 - RNA, 22 nt, Human
caggcagcuagauuuauaacaa

SEQ ID NO: 376980 - RNA, 23 nt, Human
agccucuuuucuccugcccugca

SEQ ID NO: 376981 - RNA, 22 nt, Human
aacaguaaagacagaauuuauc

SEQ ID NO: 376982 - RNA, 22 nt, Human
accaggaggccuggagcacaaa

SEQ ID NO: 376983 - RNA, 22 nt, Human
ucgagucauguucucccauuaa

SEQ ID NO: 376984 - RNA, 22 nt, Human
ccagcugcuugggaaaaugucu

SEQ ID NO: 376985 - RNA, 22 nt, Human
ccucucucuccugcacacacac

SEQ ID NO: 376986 - RNA, 22 nt, Human
ugggggaagagcuuguuaaagu

SEQ ID NO: 376987 - RNA, 22 nt, Human
aggacaguccgggguccuccac

SEQ ID NO: 376988 - RNA, 22 nt, Human
gagcucugggaaacaaagugua

SEQ ID NO: 376989 - RNA, 22 nt, Human
cuacagaaaccuuuuucauaca

SEQ ID NO: 376990 - RNA, 22 nt, Human
uggcugaguuccuggcacacgg

SEQ ID NO: 376991 - RNA, 22 nt, Human
guuaggcauuugccuuaauuuu

SEQ ID NO: 376992 - RNA, 22 nt, Human
ucacuuauugcucaucucaugc

SEQ ID NO: 376993 - RNA, 23 nt, Human
ggaguuggauuguacuugcugcu

SEQ ID NO: 376994 - RNA, 21 nt, Human
aucuuuauuacgcagagaaga

SEQ ID NO: 376995 - RNA, 22 nt, Human
ucaggaggccaccaggaccugu

SEQ ID NO: 376996 - RNA, 21 nt, Human
acagcaagccuuccuuucagg

SEQ ID NO: 376997 - RNA, 22 nt, Human
uggggcugugagacuacaggau

SEQ ID NO: 376998 - RNA, 22 nt, Human
auggaguucugccagcgcugcu

SEQ ID NO: 376999 - RNA, 22 nt, Human
ugcugccaagcccgugcuccug

SEQ ID NO: 377000 - RNA, 22 nt, Human
auguccaguuucuacacacaua

SEQ ID NO: 377001 - RNA, 22 nt, Human
cuccugggcucaagugauccuc

SEQ ID NO: 377002 - RNA, 22 nt, Human
cccucugccucugaguaggaca

SEQ ID NO: 377003 - RNA, 22 nt, Human
ccucuggcaacuucacagccca

SEQ ID NO: 377004 - RNA, 22 nt, Human
aagaauguggguggauaugaug

SEQ ID NO: 377005 - RNA, 22 nt, Human
ccacagagacaggguccuugcu

SEQ ID NO: 377006 - RNA, 22 nt, Human
aaggaagagaauccuucucaga

SEQ ID NO: 377007 - RNA, 22 nt, Human
gcagggccagugcagagaggaa

SEQ ID NO: 377008 - RNA, 22 nt, Human
caaauguauucucacuucaggg

SEQ ID NO: 377009 - RNA, 22 nt, Human
uaacagaauuugcuaaacuccg

SEQ ID NO: 377010 - RNA, 22 nt, Human
caggcagccugcggucugcaca

SEQ ID NO: 377011 - RNA, 22 nt, Human
uucucagguagugcugaugcug

SEQ ID NO: 377012 - RNA, 22 nt, Human
aauauucaaguuauucuuucuu

SEQ ID NO: 377013 - RNA, 22 nt, Human
ccagagcugauuccugggacuu

SEQ ID NO: 377014 - RNA, 22 nt, Human
uauucauaguaaacaaaagugg

SEQ ID NO: 377015 - RNA, 22 nt, Human
cagcagcugauggggaagugau

SEQ ID NO: 377016 - RNA, 22 nt, Human
caggcacagaguuauucauuua

SEQ ID NO: 377017 - RNA, 22 nt, Human
augaauaaaacauuuuaaucag

SEQ ID NO: 377018 - RNA, 22 nt, Human
guauccuuugcggaaauuucua

SEQ ID NO: 377019 - RNA, 22 nt, Human
ccagccaggcauugcaaacuga

SEQ ID NO: 377020 - RNA, 22 nt, Human
uccuguuuaucugugugacucg

SEQ ID NO: 377021 - RNA, 22 nt, Human
agguggguccuggcucugccau

SEQ ID NO: 377022 - RNA, 18 nt, Human
uggcucugcagccagaug

SEQ ID NO: 377023 - RNA, 22 nt, Human
gcagggcucauucuaguacaau

SEQ ID NO: 377024 - RNA, 22 nt, Human
ucugggagguaaccaugcugau

SEQ ID NO: 377025 - RNA, 22 nt, Human
cugcaggggcuggaguuggcuu

SEQ ID NO: 377026 - RNA, 22 nt, Human
cucaacagcucugccauacucc

SEQ ID NO: 377027 - RNA, 22 nt, Human
guauucauauuaaacauaucaa

SEQ ID NO: 377028 - RNA, 22 nt, Human
acagggcagugucuugaaaaau

SEQ ID NO: 377029 - RNA, 22 nt, Human
uucugggacaucuggacaguuu

SEQ ID NO: 377030 - RNA, 22 nt, Human
cagagccagcuguccuuggcau

SEQ ID NO: 377031 - RNA, 23 nt, Human
uggcugagauccuacuguuugcu

SEQ ID NO: 377032 - RNA, 20 nt, Human
agagccuggaaaaagacauc

SEQ ID NO: 377033 - RNA, 22 nt, Human
acagauuuuugguaaauaauuu

SEQ ID NO: 377034 - RNA, 22 nt, Human
accugccuaucagcugccugcu

SEQ ID NO: 377035 - RNA, 22 nt, Human
ccaaggagaaaugcugugcuuu

SEQ ID NO: 377036 - RNA, 22 nt, Human
agggccugucagcgguguccug

SEQ ID NO: 377037 - RNA, 22 nt, Human
cccuggcaaaacacucucuuga

SEQ ID NO: 377038 - RNA, 22 nt, Human
ucagugucuugaccugggugug

SEQ ID NO: 377039 - RNA, 22 nt, Human
auaucaguaucuauguauuugu

SEQ ID NO: 377040 - RNA, 22 nt, Human
caccagcuacagacuacugugu

SEQ ID NO: 377041 - RNA, 22 nt, Human
ccaggagcaggagcuggacaga

SEQ ID NO: 377042 - RNA, 22 nt, Human
acagagccacuuuggugccuac

SEQ ID NO: 377043 - RNA, 22 nt, Human
ugcugccauggucgcugguguc

SEQ ID NO: 377044 - RNA, 22 nt, Human
aacaugauuuaguauaaugcag

SEQ ID NO: 377045 - RNA, 22 nt, Human
ugaaauagucuaaaaaaccaga

SEQ ID NO: 377046 - RNA, 22 nt, Human
ccagcagagcauggggaggaag

SEQ ID NO: 377047 - RNA, 22 nt, Human
ggccagggggcuucagacucca

SEQ ID NO: 377048 - RNA, 22 nt, Human
caggccuggagugcaauggcac

SEQ ID NO: 377049 - RNA, 22 nt, Human
uccuuggcuuucuggagcuucu

SEQ ID NO: 377050 - RNA, 22 nt, Human
ugaggcaggagaaucacaugaa

SEQ ID NO: 377051 - RNA, 22 nt, Human
ugcaggagaaaguacggagcgu

SEQ ID NO: 377052 - RNA, 22 nt, Human
auuacaguaacagcuacaaugc

SEQ ID NO: 377053 - RNA, 22 nt, Human
ccugcugugaagccaggccugu

SEQ ID NO: 377054 - RNA, 22 nt, Human
auuugcuucugugaaaucaagu

SEQ ID NO: 377055 - RNA, 22 nt, Human
cuucuugcugggggccucagug

SEQ ID NO: 377056 - RNA, 22 nt, Human
ggagccuguggcugcuugaagc

SEQ ID NO: 377057 - RNA, 22 nt, Human
gggcuggcaggaccugggcuga

SEQ ID NO: 377058 - RNA, 22 nt, Human
gaggugggaugugugugcuacu

SEQ ID NO: 377059 - RNA, 22 nt, Human
uuuacagaaugucaauuucuau

SEQ ID NO: 377060 - RNA, 22 nt, Human
agccaaggagugcagguggcuu

SEQ ID NO: 377061 - RNA, 22 nt, Human
uauuugcaaagaacuacacuag

SEQ ID NO: 377062 - RNA, 22 nt, Human
aaaaaugaaacggcugguuggc

SEQ ID NO: 377063 - RNA, 22 nt, Human
uccaggagaaaacugacggugg

SEQ ID NO: 377064 - RNA, 22 nt, Human
gaggcagcaaaauauaucauaa

SEQ ID NO: 377065 - RNA, 22 nt, Human
auugcuguacacuucuagaucu

SEQ ID NO: 377066 - RNA, 22 nt, Human
cagcagcuggugagacacagcc

SEQ ID NO: 377067 - RNA, 22 nt, Human
uuccauaacugaccgaaugcau

SEQ ID NO: 377068 - RNA, 22 nt, Human
ccaagggaaaccgagaggcugg

SEQ ID NO: 377069 - RNA, 22 nt, Human
caguccuuagucuggauggcuu

SEQ ID NO: 377070 - RNA, 22 nt, Human
uauauacuuucuuccuggguag

SEQ ID NO: 377071 - RNA, 22 nt, Human
auugaaaaauucacaauucugg

SEQ ID NO: 377072 - RNA, 22 nt, Human
caggaaaaaugccaggagucag

SEQ ID NO: 377073 - RNA, 22 nt, Human
aaaucagugcucauuugaaagg

SEQ ID NO: 377074 - RNA, 22 nt, Human
ggaagaggcucucauugagggc

SEQ ID NO: 377075 - RNA, 22 nt, Human
uagaacauaagucauucauuug

SEQ ID NO: 377076 - RNA, 22 nt, Human
ugugcuucuugcagcuccugua

SEQ ID NO: 377077 - RNA, 22 nt, Human
aaaguucagugccuucuauaca

SEQ ID NO: 377078 - RNA, 22 nt, Human
ucacaugcucaccuaagccaca

SEQ ID NO: 377079 - RNA, 20 nt, Human
gaggaaaagcugccaggccu

SEQ ID NO: 377080 - RNA, 18 nt, Human
acagacaaaauggaaaug

SEQ ID NO: 377081 - RNA, 22 nt, Human
agccagcagggcuuagaggaca

SEQ ID NO: 377082 - RNA, 22 nt, Human
augauugaccaucugcugggcu

SEQ ID NO: 377083 - RNA, 22 nt, Human
uccugcagacauuuacaccuuu

SEQ ID NO: 377084 - RNA, 22 nt, Human
cagccuucugaaugaacguacu

SEQ ID NO: 377085 - RNA, 22 nt, Human
uauagaagagacaugugcauag

SEQ ID NO: 377086 - RNA, 22 nt, Human
gagaggcuaugagguucugugu

SEQ ID NO: 377087 - RNA, 21 nt, Human
aggugccaaggagaagcaggc

SEQ ID NO: 377088 - RNA, 22 nt, Human
aaagucauuuuccagaccagua

SEQ ID NO: 377089 - RNA, 22 nt, Human
cucaccacagagccuguccagc

SEQ ID NO: 377090 - RNA, 22 nt, Human
aaacagaaggguagguaaacau

SEQ ID NO: 377091 - RNA, 22 nt, Human
ggccaggcugcugggaccccgc

SEQ ID NO: 377092 - RNA, 22 nt, Human
ccaaugauggugcccacgauga

SEQ ID NO: 377093 - RNA, 22 nt, Human
guucacaagaguuacagacaga

SEQ ID NO: 377094 - RNA, 18 nt, Human
ugaauagggguuugcaga

SEQ ID NO: 377095 - RNA, 22 nt, Human
aaucaguuagaaggaagagaau

SEQ ID NO: 377096 - RNA, 16 nt, Human
gcccaggacgggaggc

SEQ ID NO: 377097 - RNA, 22 nt, Human
gaucuucucuuuaguagaaaca

SEQ ID NO: 377098 - RNA, 22 nt, Human
aagcagaauuuaauagaaaggu

SEQ ID NO: 377099 - RNA, 22 nt, Human
ugauauuuaagcaaaaauaugg

SEQ ID NO: 377100 - RNA, 22 nt, Human
gcagagccaggagcccaggauc

SEQ ID NO: 377101 - RNA, 17 nt, Human
auccccagcaucuagaa

SEQ ID NO: 377102 - RNA, 22 nt, Human
uagauuuccucuuccucauucc

SEQ ID NO: 377103 - RNA, 22 nt, Human
cucucugggggccaugccaaga

SEQ ID NO: 377104 - RNA, 22 nt, Human
ccuggaucccgauggcugugag

SEQ ID NO: 377105 - RNA, 22 nt, Human
cuaaaugccuuuccuaccuaac

SEQ ID NO: 377106 - RNA, 22 nt, Human
ccagaauuuggaucaugauuuu

SEQ ID NO: 377107 - RNA, 22 nt, Human
ugggacuugccucgagggcugc

SEQ ID NO: 377108 - RNA, 22 nt, Human
gaagcagcuggugagauggagc

SEQ ID NO: 377109 - RNA, 22 nt, Human
cagagcugagaauguugaugcu

SEQ ID NO: 377110 - RNA, 22 nt, Human
gcuggccacauugugccguccu

SEQ ID NO: 377111 - RNA, 22 nt, Human
aaggccaggagacuuggaguca

SEQ ID NO: 377112 - RNA, 21 nt, Human
ggugggcacaggagagcagag

SEQ ID NO: 377113 - RNA, 22 nt, Human
cauuaaaauaucucaugguguu

SEQ ID NO: 377114 - RNA, 22 nt, Human
agcagcauacacaucauguuga

SEQ ID NO: 377115 - RNA, 23 nt, Human
acacaauagaguacuauucagcc

SEQ ID NO: 377116 - RNA, 22 nt, Human
aaugggagagaacacaaagucc

SEQ ID NO: 377117 - RNA, 22 nt, Human
ccugcagagccacgugccagcg

SEQ ID NO: 377118 - RNA, 22 nt, Human
agcuggggguuggauaagggua

SEQ ID NO: 377119 - RNA, 22 nt, Human
ggugcucaagagggcauccucu

SEQ ID NO: 377120 - RNA, 22 nt, Human
ucuuaaagagcgcaauuugagg

SEQ ID NO: 377121 - RNA, 22 nt, Human
cccaggcucccaggugggacaa

SEQ ID NO: 377122 - RNA, 22 nt, Human
guggcugguuuccugcaugcaa

SEQ ID NO: 377123 - RNA, 18 nt, Human
aucucccauuggccaagg

SEQ ID NO: 377124 - RNA, 22 nt, Human
uaaaauguuugcaagagaccag

SEQ ID NO: 377125 - RNA, 22 nt, Human
auuucuguaguccacauucuuu

SEQ ID NO: 377126 - RNA, 22 nt, Human
ggucaugcugugaaucagugcu

SEQ ID NO: 377127 - RNA, 22 nt, Human
uugagucaguaauuccauuucu

SEQ ID NO: 377128 - RNA, 22 nt, Human
ugggagcacccugaggagcuuc

SEQ ID NO: 377129 - RNA, 22 nt, Human
ugcugccacugguagucucauu

SEQ ID NO: 377130 - RNA, 22 nt, Human
gccuucccaagacgccugaguu

SEQ ID NO: 377131 - RNA, 21 nt, Human
agccugcaauguagguaccgg

SEQ ID NO: 377132 - RNA, 22 nt, Human
uucauauaaauggaaucagaau

SEQ ID NO: 377133 - RNA, 22 nt, Human
ccaggagacuguacugauauuu

SEQ ID NO: 377134 - RNA, 22 nt, Human
uggcagcuccggguaggggcug

SEQ ID NO: 377135 - RNA, 21 nt, Human
ggcagcugaccgcgcggugca

SEQ ID NO: 377136 - RNA, 22 nt, Human
aaggacagaaacagauugcugg

SEQ ID NO: 377137 - RNA, 22 nt, Human
uuuauccagcagcuauucaaaa

SEQ ID NO: 377138 - RNA, 22 nt, Human
aggccagcaccagagucaagaa

SEQ ID NO: 377139 - RNA, 22 nt, Human
gcagagaccccgcagugaggcc

SEQ ID NO: 377140 - RNA, 22 nt, Human
cugggggcaagcagacagcugu

SEQ ID NO: 377141 - RNA, 22 nt, Human
agcaauauuuaaagguuugcaa

SEQ ID NO: 377142 - RNA, 22 nt, Human
ugaggccagugacauauauuaa

SEQ ID NO: 377143 - RNA, 22 nt, Human
gcagggacgcagcacucuccgu

SEQ ID NO: 377144 - RNA, 22 nt, Human
acauuuuaauaugcuuagugug

SEQ ID NO: 377145 - RNA, 22 nt, Human
aaaguguggagauugaacuaaa

SEQ ID NO: 377146 - RNA, 22 nt, Human
ugcuuuaagacacuaaguuuga

SEQ ID NO: 377147 - RNA, 22 nt, Human
aaacugugaagcaaguacaagg

SEQ ID NO: 377148 - RNA, 22 nt, Human
ucagagugaggcgucaacauga

SEQ ID NO: 377149 - RNA, 22 nt, Human
ugccaggcugaacagggucuua

SEQ ID NO: 377150 - RNA, 22 nt, Human
ucuggagcuuccucauuuacag

SEQ ID NO: 377151 - RNA, 22 nt, Human
auaagaaacauuauucuuucca

SEQ ID NO: 377152 - RNA, 20 nt, Human
aggcugagggugauuguguc

SEQ ID NO: 377153 - RNA, 22 nt, Human
auagauauuugaguuguuucca

SEQ ID NO: 377154 - RNA, 22 nt, Human
ccugcucagccccagcucaccc

SEQ ID NO: 377155 - RNA, 22 nt, Human
ugcuggaauaauuucauguuaa

SEQ ID NO: 377156 - RNA, 22 nt, Human
aaaaauaggucaaccguguaug

SEQ ID NO: 377157 - RNA, 22 nt, Human
uggcuccuucauucuccugcca

SEQ ID NO: 377158 - RNA, 22 nt, Human
ucucccacagccgugcuucaag

SEQ ID NO: 377159 - RNA, 22 nt, Human
gggccccaaaaugccaggcucu

SEQ ID NO: 377160 - RNA, 23 nt, Human
aggaaagcauucauuuuuaccau

SEQ ID NO: 377161 - RNA, 22 nt, Human
uacauuaucuuguuaucuuuca

SEQ ID NO: 377162 - RNA, 17 nt, Human
aggcauggucuggggug

SEQ ID NO: 377163 - RNA, 22 nt, Human
aucuuucaguuucauaccaauu

SEQ ID NO: 377164 - RNA, 22 nt, Human
guauucuugguuaucaaaauac

SEQ ID NO: 377165 - RNA, 18 nt, Human
ggcuuugcugggguuucu

SEQ ID NO: 377166 - RNA, 22 nt, Human
agcugcccuuuaugaugcugaa

SEQ ID NO: 377167 - RNA, 20 nt, Human
ccaagagcaugcaugaggaa

SEQ ID NO: 377168 - RNA, 22 nt, Human
uuguuuuaucuuucuacagacu

SEQ ID NO: 377169 - RNA, 22 nt, Human
ucacagacaauuguuuuggugu

SEQ ID NO: 377170 - RNA, 22 nt, Human
gacagaagaggaacuuggacag

SEQ ID NO: 377171 - RNA, 22 nt, Human
accaggcaacugugaaugggcu

SEQ ID NO: 377172 - RNA, 22 nt, Human
cuggcagcuuagcacucugguu

SEQ ID NO: 377173 - RNA, 19 nt, Human
gcuuuuuguugucaaaggu

SEQ ID NO: 377174 - RNA, 22 nt, Human
uuacaaagagugccagagugug

SEQ ID NO: 377175 - RNA, 22 nt, Human
uugggcaaaguguuucuggagc

SEQ ID NO: 377176 - RNA, 22 nt, Human
uuguggcagaccaugagucuaa

SEQ ID NO: 377177 - RNA, 22 nt, Human
ugucacauugaauaugauuuau

SEQ ID NO: 377178 - RNA, 22 nt, Human
acaggcacugucaagucaugaa

SEQ ID NO: 377179 - RNA, 22 nt, Human
auguguccacaggugugagaga

SEQ ID NO: 377180 - RNA, 22 nt, Human
ugcuuuauugcaucaguguggg

SEQ ID NO: 377181 - RNA, 22 nt, Human
uauuuagaacagacaauagaaa

SEQ ID NO: 377182 - RNA, 21 nt, Human
acuguucaucuguucagaagc

SEQ ID NO: 377183 - RNA, 22 nt, Human
ugccuugguucucuacuuggag

SEQ ID NO: 377184 - RNA, 20 nt, Human
gccuggaggcaaugggaaga

SEQ ID NO: 377185 - RNA, 22 nt, Human
uaaguccuggcugguuugaagc

SEQ ID NO: 377186 - RNA, 22 nt, Human
ccucagagguguggcaucucug

SEQ ID NO: 377187 - RNA, 20 nt, Human
aggacagcagcugccacuug

SEQ ID NO: 377188 - RNA, 20 nt, Human
ccaccuggccaaggcugugc

SEQ ID NO: 377189 - RNA, 22 nt, Human
cacauauuugaugaagcuuugu

SEQ ID NO: 377190 - RNA, 22 nt, Human
cacugccuccccaggcuccaca

SEQ ID NO: 377191 - RNA, 22 nt, Human
acaugauauuaaugucuuauuu

SEQ ID NO: 377192 - RNA, 22 nt, Human
ugcccacauggugccauggcca

SEQ ID NO: 377193 - RNA, 22 nt, Human
agcugguggauuaugcuguaca

SEQ ID NO: 377194 - RNA, 22 nt, Human
gcagaagcuguucgaaggccgc

SEQ ID NO: 377195 - RNA, 22 nt, Human
cagcugccugcaacacaagcuu

SEQ ID NO: 377196 - RNA, 16 nt, Human
uagggcugggaaggag

SEQ ID NO: 377197 - RNA, 22 nt, Human
acagugucuccugguacccagu

SEQ ID NO: 377198 - RNA, 22 nt, Human
uagggauguggugagaacugag

SEQ ID NO: 377199 - RNA, 22 nt, Human
acagcagagacacucaggaggc

SEQ ID NO: 377200 - RNA, 22 nt, Human
ccuuucagaugggcauggaccg

SEQ ID NO: 377201 - RNA, 22 nt, Human
cuuccagagauagggccucaag

SEQ ID NO: 377202 - RNA, 22 nt, Human
auuauucuuaugucaucauggc

SEQ ID NO: 377203 - RNA, 22 nt, Human
auccauuugaaagaacagucca

SEQ ID NO: 377204 - RNA, 21 nt, Human
ugcuggccucaagggugacuu

SEQ ID NO: 377205 - RNA, 22 nt, Human
agagacaggguuuugccauguu

SEQ ID NO: 377206 - RNA, 22 nt, Human
agagccugugggagaugcagcu

SEQ ID NO: 377207 - RNA, 22 nt, Human
uggagccaggagccugggaguc

SEQ ID NO: 377208 - RNA, 22 nt, Human
cugcucugaagccaggauucug

SEQ ID NO: 377209 - RNA, 22 nt, Human
gaaugaauucagcacauggaau

SEQ ID NO: 377210 - RNA, 22 nt, Human
gcccagcugucuggcagggaug

SEQ ID NO: 377211 - RNA, 20 nt, Human
cucuuaaauguaaaguaggc

SEQ ID NO: 377212 - RNA, 21 nt, Human
cagagguggccugaccucuga

SEQ ID NO: 377213 - RNA, 22 nt, Human
ggcugcuguacugaugucaguu

SEQ ID NO: 377214 - RNA, 22 nt, Human
uuauacaguuuauacuuagaau

SEQ ID NO: 377215 - RNA, 22 nt, Human
auacagaagaacuauagccacu

SEQ ID NO: 377216 - RNA, 22 nt, Human
agauggaguuaguaccagaguc

SEQ ID NO: 377217 - RNA, 22 nt, Human
ggcagcauauauucagugggca

SEQ ID NO: 377218 - RNA, 22 nt, Human
uucucuuuucaccaguugcuaa

SEQ ID NO: 377219 - RNA, 22 nt, Human
gucagcagugucagcucugggg

SEQ ID NO: 377220 - RNA, 22 nt, Human
cagcugaguguuggcauguuca

SEQ ID NO: 377221 - RNA, 23 nt, Human
gccucuggagccccagugcucag

SEQ ID NO: 377222 - RNA, 22 nt, Human
gaggaagaaagcauaggugggg

SEQ ID NO: 377223 - RNA, 22 nt, Human
cugugccuuuguagcugugccu

SEQ ID NO: 377224 - RNA, 20 nt, Human
acugcuucuuucucugaccu

SEQ ID NO: 377225 - RNA, 22 nt, Human
uuauagaaggagcauucacuua

SEQ ID NO: 377226 - RNA, 22 nt, Human
cucuggcuuugcucaugcaucc

SEQ ID NO: 377227 - RNA, 22 nt, Human
agguaaagacagugaaagaggg

SEQ ID NO: 377228 - RNA, 18 nt, Human
ucacagugcucuugccua

SEQ ID NO: 377229 - RNA, 22 nt, Human
cccaggaguuagagguuguggu

SEQ ID NO: 377230 - RNA, 22 nt, Human
agaagccagaauauucauggau

SEQ ID NO: 377231 - RNA, 22 nt, Human
auugagaauccauuugagauga

SEQ ID NO: 377232 - RNA, 22 nt, Human
cagugauguuucugcaucagag

SEQ ID NO: 377233 - RNA, 22 nt, Human
auugaaagcauggauuuggauu

SEQ ID NO: 377234 - RNA, 22 nt, Human
uacauauagacaguuacucuag

SEQ ID NO: 377235 - RNA, 19 nt, Human
uuugaaagaguuuuauugg

SEQ ID NO: 377236 - RNA, 22 nt, Human
gccaggcauuuguuaggugcug

SEQ ID NO: 377237 - RNA, 22 nt, Human
cccagcagaccgcugugauggc

SEQ ID NO: 377238 - RNA, 22 nt, Human
agcagggcagcuuuuuucagaa

SEQ ID NO: 377239 - RNA, 19 nt, Human
uggcaggcccaggauggac

SEQ ID NO: 377240 - RNA, 22 nt, Human
ucagaguguggugagaugugca

SEQ ID NO: 377241 - RNA, 22 nt, Human
gguuucaacucagcuaguaagg

SEQ ID NO: 377242 - RNA, 22 nt, Human
gggugggaucuguggagccuca

SEQ ID NO: 377243 - RNA, 23 nt, Human
ggccauuucauuugguucaaacu

SEQ ID NO: 377244 - RNA, 21 nt, Human
uccugcaggaggccugagagg

SEQ ID NO: 377245 - RNA, 22 nt, Human
cacagggcagaggguccguggc

SEQ ID NO: 377246 - RNA, 21 nt, Human
aagccucaagcagaagacaga

SEQ ID NO: 377247 - RNA, 22 nt, Human
acuucacagaaauuuuaugagg

SEQ ID NO: 377248 - RNA, 22 nt, Human
gaaauauuacaguggaggggau

SEQ ID NO: 377249 - RNA, 22 nt, Human
ugggaccugcuccuggaaugag

SEQ ID NO: 377250 - RNA, 22 nt, Human
uagggaccuuagaauuguaugu

SEQ ID NO: 377251 - RNA, 22 nt, Human
uucacaggauauaugugcaggg

SEQ ID NO: 377252 - RNA, 22 nt, Human
cagcauuuucuuaauguaggug

SEQ ID NO: 377253 - RNA, 22 nt, Human
ucaguuuuuguuugccagauag

SEQ ID NO: 377254 - RNA, 22 nt, Human
gcugaagcccacguggcuugua

SEQ ID NO: 377255 - RNA, 22 nt, Human
uaaagucauaagaguggauccg

SEQ ID NO: 377256 - RNA, 19 nt, Human
guggccugcgcugggugcg

SEQ ID NO: 377257 - RNA, 22 nt, Human
cagaguguuucuuugggugggu

SEQ ID NO: 377258 - RNA, 22 nt, Human
auauaauuguucugaaguguuu

SEQ ID NO: 377259 - RNA, 22 nt, Human
cccaggcacagauuaucccaau

SEQ ID NO: 377260 - RNA, 22 nt, Human
ggcucagguugggucacaugac

SEQ ID NO: 377261 - RNA, 22 nt, Human
agugcuuugugcucucacugca

SEQ ID NO: 377262 - RNA, 20 nt, Human
ccagagaguagguuagugau

SEQ ID NO: 377263 - RNA, 22 nt, Human
uaauuauucuagucacauagca

SEQ ID NO: 377264 - RNA, 22 nt, Human
cagugcauaaucuaaauggggg

SEQ ID NO: 377265 - RNA, 22 nt, Human
uggcucuggauuaaucuaggaa

SEQ ID NO: 377266 - RNA, 22 nt, Human
ugaaagguuaaaaguaguauug

SEQ ID NO: 377267 - RNA, 23 nt, Human
cuuucauugugguuucacagagc

SEQ ID NO: 377268 - RNA, 22 nt, Human
uugaaggacauccuauuucuag

SEQ ID NO: 377269 - RNA, 22 nt, Human
agucaguggcuccgagccuggu

SEQ ID NO: 377270 - RNA, 22 nt, Human
acagauuuuauuauucagguau

SEQ ID NO: 377271 - RNA, 19 nt, Human
caggccagugucagggggc

SEQ ID NO: 377272 - RNA, 22 nt, Human
ggagggugcauuuuacccugug

SEQ ID NO: 377273 - RNA, 22 nt, Human
ugagguguguccccagggaggu

SEQ ID NO: 377274 - RNA, 22 nt, Human
agccugccuugggcugcuugag

SEQ ID NO: 377275 - RNA, 22 nt, Human
ucacaugcccuguauuuaccag

SEQ ID NO: 377276 - RNA, 22 nt, Human
ggcugugggaugcauaggagcu

SEQ ID NO: 377277 - RNA, 22 nt, Human
agaaaugaauauguagugguua

SEQ ID NO: 377278 - RNA, 22 nt, Human
guggccugccgugugguauggg

SEQ ID NO: 377279 - RNA, 22 nt, Human
uagugcuuuaaguuuacagaga

SEQ ID NO: 377280 - RNA, 22 nt, Human
ucuggcucuguguccucaccca

SEQ ID NO: 377281 - RNA, 22 nt, Human
agcucacaguguccuuccucaa

SEQ ID NO: 377282 - RNA, 21 nt, Human
auuauuauaaagaccacaggg

SEQ ID NO: 377283 - RNA, 22 nt, Human
ccugcuguaaugugucuuuauu

SEQ ID NO: 377284 - RNA, 22 nt, Human
uucuuaaucuguguggguucga

SEQ ID NO: 377285 - RNA, 22 nt, Human
acagcuuuucaauucugcugag

SEQ ID NO: 377286 - RNA, 22 nt, Human
gugugcagggggccagcgcagc

SEQ ID NO: 377287 - RNA, 22 nt, Human
ucaggcugguggucagauggcu

SEQ ID NO: 377288 - RNA, 20 nt, Human
cuguccccgaggucaccagg

SEQ ID NO: 377289 - RNA, 22 nt, Human
guaguucugcagugucaccuga

SEQ ID NO: 377290 - RNA, 22 nt, Human
auguaauuugcccucaaguuaa

SEQ ID NO: 377291 - RNA, 22 nt, Human
ugcaagaggaauucuagaagca

SEQ ID NO: 377292 - RNA, 22 nt, Human
agaaaugugaauuucauuuccu

SEQ ID NO: 377293 - RNA, 22 nt, Human
uuucuggcagcgggacaggggu

SEQ ID NO: 377294 - RNA, 22 nt, Human
gaugcugaagugaagugaucuu

SEQ ID NO: 377295 - RNA, 22 nt, Human
aagcaggcauuccagagacaau

SEQ ID NO: 377296 - RNA, 22 nt, Human
cccuggagggacagcugcucua

SEQ ID NO: 377297 - RNA, 22 nt, Human
ucauuucuccgaccugcugucc

SEQ ID NO: 377298 - RNA, 18 nt, Human
agucucagcggaggagua

SEQ ID NO: 377299 - RNA, 22 nt, Human
gucaggauuaaugggaguaugc

SEQ ID NO: 377300 - RNA, 22 nt, Human
uuauuccauucaguucaacaag

SEQ ID NO: 377301 - RNA, 22 nt, Human
ugcugccuugaccuccugggcu

SEQ ID NO: 377302 - RNA, 20 nt, Human
uuuuccagaaaguaucauug

SEQ ID NO: 377303 - RNA, 22 nt, Human
aaggaaaggaugagcaugcauu

SEQ ID NO: 377304 - RNA, 22 nt, Human
aaauccuuuucuauacagcaua

SEQ ID NO: 377305 - RNA, 22 nt, Human
gaacccaguccaggugcagccu

SEQ ID NO: 377306 - RNA, 22 nt, Human
agugcauugcaucucugcuuca

SEQ ID NO: 377307 - RNA, 22 nt, Human
agcaggaaggcuuuggggguuc

SEQ ID NO: 377308 - RNA, 22 nt, Human
accugccuaguugguucugccc

SEQ ID NO: 377309 - RNA, 20 nt, Human
ggcagcuugggcagcaguua

SEQ ID NO: 377310 - RNA, 21 nt, Human
ugcagcugacacugguaugcc

SEQ ID NO: 377311 - RNA, 22 nt, Human
ggcugcuggaagacugaacaag

SEQ ID NO: 377312 - RNA, 19 nt, Human
aauucuguuucagcagauc

SEQ ID NO: 377313 - RNA, 22 nt, Human
acagcuguauccccagagcuca

SEQ ID NO: 377314 - RNA, 22 nt, Human
uacauuaacuuacguccacaug

SEQ ID NO: 377315 - RNA, 22 nt, Human
cagagguagccgagugcaaucg

SEQ ID NO: 377316 - RNA, 22 nt, Human
uauacagaaagaauucaagucu

SEQ ID NO: 377317 - RNA, 22 nt, Human
ucuacuuuucccuauacaguuu

SEQ ID NO: 377318 - RNA, 22 nt, Human
acagcuggcaggggggcaugaa

SEQ ID NO: 377319 - RNA, 22 nt, Human
ccagaggaggggggucuuucug

SEQ ID NO: 377320 - RNA, 22 nt, Human
gucccucugugucccugcaguc

SEQ ID NO: 377321 - RNA, 22 nt, Human
ugcugucugauucagggugauu

SEQ ID NO: 377322 - RNA, 21 nt, Human
ugaggcaggggugcuuuuguc

SEQ ID NO: 377323 - RNA, 22 nt, Human
uuugacagauccuuaacucagc

SEQ ID NO: 377324 - RNA, 22 nt, Human
gauuauauaauggaagcucuug

SEQ ID NO: 377325 - RNA, 22 nt, Human
uggaccugagccuggcccugcc

SEQ ID NO: 377326 - RNA, 20 nt, Human
cagcuuuagaucuuugauua

SEQ ID NO: 377327 - RNA, 22 nt, Human
ucagaacaauugggaaccauua

SEQ ID NO: 377328 - RNA, 22 nt, Human
cuguggaaauaaacaaugcuaa

SEQ ID NO: 377329 - RNA, 22 nt, Human
uagggcaggggaggaaucugaa

SEQ ID NO: 377330 - RNA, 22 nt, Human
cccaggaugucgaggcugcagu

SEQ ID NO: 377331 - RNA, 22 nt, Human
gauuuauuuuuaaucagcaggg

SEQ ID NO: 377332 - RNA, 22 nt, Human
cuuccucugcggcgccgggcgc

SEQ ID NO: 377333 - RNA, 19 nt, Human
ugcucaggccaaggagccc

SEQ ID NO: 377334 - RNA, 22 nt, Human
agacaucagcuugugugcaggg

SEQ ID NO: 377335 - RNA, 22 nt, Human
cccagcucucugcucuuagccu

SEQ ID NO: 377336 - RNA, 22 nt, Human
agggcaguguggugggacugac

SEQ ID NO: 377337 - RNA, 22 nt, Human
caaaugauacuguuuuuagucu

SEQ ID NO: 377338 - RNA, 20 nt, Human
uauuuguauuugggaaaguu

SEQ ID NO: 377339 - RNA, 22 nt, Human
uggcucugcugaaccuagugca

SEQ ID NO: 377340 - RNA, 22 nt, Human
uuuccucuuugugacacagcug

SEQ ID NO: 377341 - RNA, 22 nt, Human
uggcuggcuuguucacugacug

SEQ ID NO: 377342 - RNA, 22 nt, Human
aggaaagguagcgugccagcag

SEQ ID NO: 377343 - RNA, 20 nt, Human
cucugcugcccgccggcugc

SEQ ID NO: 377344 - RNA, 19 nt, Human
ucaaaggcuuuuaggagac

SEQ ID NO: 377345 - RNA, 22 nt, Human
gcagcugauggaaguccuauug

SEQ ID NO: 377346 - RNA, 22 nt, Human
gucccaggcagagucaggaggg

SEQ ID NO: 377347 - RNA, 22 nt, Human
uucacacacagcuuccuauugu

SEQ ID NO: 377348 - RNA, 21 nt, Human
uccugcagaaugccuuccuac

SEQ ID NO: 377349 - RNA, 20 nt, Human
agugggagagggcagacugc

SEQ ID NO: 377350 - RNA, 22 nt, Human
cuaugaaaugucagauucugca

SEQ ID NO: 377351 - RNA, 22 nt, Human
caaguccuuagaugguucuuug

SEQ ID NO: 377352 - RNA, 22 nt, Human
ccguggaguugugcugaguaug

SEQ ID NO: 377353 - RNA, 22 nt, Human
ucuggcagggguucugcacuug

SEQ ID NO: 377354 - RNA, 22 nt, Human
uguucacaucgauggauuuugc

SEQ ID NO: 377355 - RNA, 22 nt, Human
ucucacugcaaauauuauguau

SEQ ID NO: 377356 - RNA, 22 nt, Human
agagccagcauuugacacuggc

SEQ ID NO: 377357 - RNA, 22 nt, Human
aucuucaaagcacaucguuugu

SEQ ID NO: 377358 - RNA, 22 nt, Human
agguggagugaaggaaaggcag

SEQ ID NO: 377359 - RNA, 22 nt, Human
cagcuggaucccugcagaacuu

SEQ ID NO: 377360 - RNA, 22 nt, Human
cacccaggcuggagugcagggg

SEQ ID NO: 377361 - RNA, 22 nt, Human
uacaaaguaauguauaauaucg

SEQ ID NO: 377362 - RNA, 22 nt, Human
ugggcugaguguggaacuaguu

SEQ ID NO: 377363 - RNA, 22 nt, Human
aguggcagccgagcaggagaug

SEQ ID NO: 377364 - RNA, 22 nt, Human
guuauaaauaccuaauaggauu

SEQ ID NO: 377365 - RNA, 21 nt, Human
agggcagauuagcuguaagag

SEQ ID NO: 377366 - RNA, 19 nt, Human
aacuagaaagguuuugaga

SEQ ID NO: 377367 - RNA, 22 nt, Human
uggaguuccuuugaaaggcucu

SEQ ID NO: 377368 - RNA, 22 nt, Human
auuauccagcaccaaugucaga

SEQ ID NO: 377369 - RNA, 22 nt, Human
cagcugggugaucuugggcagg

SEQ ID NO: 377370 - RNA, 22 nt, Human
caagaugaucccugaaggcagc

SEQ ID NO: 377371 - RNA, 22 nt, Human
cuuacagagaagaaaauguagu

SEQ ID NO: 377372 - RNA, 22 nt, Human
ugggagaagcagcagccaagug

SEQ ID NO: 377373 - RNA, 20 nt, Human
ggcagagggccugggagaag

SEQ ID NO: 377374 - RNA, 22 nt, Human
uauaauuuggggaaaguggugu

SEQ ID NO: 377375 - RNA, 22 nt, Human
ugugaauaaugccgcaauaaac

SEQ ID NO: 377376 - RNA, 22 nt, Human
uuucacaaguaaaguccuaagu

SEQ ID NO: 377377 - RNA, 21 nt, Human
agcagaacagucgagcacugc

SEQ ID NO: 377378 - RNA, 22 nt, Human
aguuuauagcccagauucaugg

SEQ ID NO: 377379 - RNA, 22 nt, Human
cugcuuccaugcaauggcaguc

SEQ ID NO: 377380 - RNA, 22 nt, Human
cacaggugcuccucggggagcu

SEQ ID NO: 377381 - RNA, 22 nt, Human
aagcugccaccagcccagggca

SEQ ID NO: 377382 - RNA, 22 nt, Human
gagagucuaggaaccucauaua

SEQ ID NO: 377383 - RNA, 22 nt, Human
uacaguaucuucuggcaagcau

SEQ ID NO: 377384 - RNA, 22 nt, Human
uacuuugaagacaauaucugga

SEQ ID NO: 377385 - RNA, 22 nt, Human
gugugccagacaugaugcuaug

SEQ ID NO: 377386 - RNA, 22 nt, Human
cuaucuuucgauucuagcuuaa

SEQ ID NO: 377387 - RNA, 22 nt, Human
uggcuuucucccccagcuucuc

SEQ ID NO: 377388 - RNA, 22 nt, Human
cccaggcaguagaaagaagagg

SEQ ID NO: 377389 - RNA, 22 nt, Human
gcugcccaguucugcugcugcc

SEQ ID NO: 377390 - RNA, 22 nt, Human
acagcugugaaaauccacagga

SEQ ID NO: 377391 - RNA, 18 nt, Human
agaaggagcuaugggcag

SEQ ID NO: 377392 - RNA, 22 nt, Human
uucucagaugauucagauaaac

SEQ ID NO: 377393 - RNA, 22 nt, Human
aauuaacaaauguagcugugau

SEQ ID NO: 377394 - RNA, 22 nt, Human
ugucuuuagaaagaagcagaca

SEQ ID NO: 377395 - RNA, 22 nt, Human
gcuggccugggcagccugucgg

SEQ ID NO: 377396 - RNA, 22 nt, Human
ugcagcucauugguguccuggu

SEQ ID NO: 377397 - RNA, 22 nt, Human
gcugccuucaguucugauucau

SEQ ID NO: 377398 - RNA, 22 nt, Human
gcucaggaaacagcagggcuug

SEQ ID NO: 377399 - RNA, 22 nt, Human
cagguaggauggaagggcucaa

SEQ ID NO: 377400 - RNA, 22 nt, Human
auagcuuucuuaaauauauaaa

SEQ ID NO: 377401 - RNA, 22 nt, Human
ucccuggguccugcuugcucuc

SEQ ID NO: 377402 - RNA, 22 nt, Human
uccuugaacagagggccugggu

SEQ ID NO: 377403 - RNA, 17 nt, Human
agcagcuggcacaggag

SEQ ID NO: 377404 - RNA, 22 nt, Human
accaggagaggcacuugcaaug

SEQ ID NO: 377405 - RNA, 22 nt, Human
uuaauaaaguaugaauuggaaa

SEQ ID NO: 377406 - RNA, 22 nt, Human
ggccuggaagaggacagagaaa

SEQ ID NO: 377407 - RNA, 19 nt, Human
agcuggagauuggagggca

SEQ ID NO: 377408 - RNA, 22 nt, Human
aagaaaagaaaccugaggcuuu

SEQ ID NO: 377409 - RNA, 22 nt, Human
ccaucccuucucuggccagcag

SEQ ID NO: 377410 - RNA, 22 nt, Human
ucuggaucuccagcacuuauca

SEQ ID NO: 377411 - RNA, 17 nt, Human
uuagcaaaauagcacuu

SEQ ID NO: 377412 - RNA, 21 nt, Human
aggucagcccagcucuggaag

SEQ ID NO: 377413 - RNA, 21 nt, Human
ccuccaggagcagagcccuga

SEQ ID NO: 377414 - RNA, 22 nt, Human
aggagcagcccacuccuguccu

SEQ ID NO: 377415 - RNA, 22 nt, Human
cagagccauuauggagacuugc

SEQ ID NO: 377416 - RNA, 22 nt, Human
gcugagucuugagcacugagca

SEQ ID NO: 377417 - RNA, 22 nt, Human
auguagagcaguguuguccaau

SEQ ID NO: 377418 - RNA, 17 nt, Human
cagcuuuaugcuacugu

SEQ ID NO: 377419 - RNA, 22 nt, Human
ggcaucuguccaucucuccagc

SEQ ID NO: 377420 - RNA, 21 nt, Human
ccagacuggccuaugugguag

SEQ ID NO: 377421 - RNA, 22 nt, Human
uguuucaugauugcugucauuu

SEQ ID NO: 377422 - RNA, 22 nt, Human
ccaggguuuaaauucugacuau

SEQ ID NO: 377423 - RNA, 22 nt, Human
cagccaggagcucccccugcuc

SEQ ID NO: 377424 - RNA, 22 nt, Human
gauuuucauuugcacucuagaa

SEQ ID NO: 377425 - RNA, 22 nt, Human
caaagguauucucauuuuggaa

SEQ ID NO: 377426 - RNA, 19 nt, Human
aucugagauuauaaacaga

SEQ ID NO: 377427 - RNA, 22 nt, Human
aaagcuuuucaguauguucaug

SEQ ID NO: 377428 - RNA, 22 nt, Human
accaggcagcaccaaagccggu

SEQ ID NO: 377429 - RNA, 22 nt, Human
aggcugaggaucccuguguucu

SEQ ID NO: 377430 - RNA, 22 nt, Human
uuuccaaaggcuaaacucaguu

SEQ ID NO: 377431 - RNA, 22 nt, Human
caguagcaggcaggugcuuuug

SEQ ID NO: 377432 - RNA, 22 nt, Human
aagcgccacgagaagcuggacc

SEQ ID NO: 377433 - RNA, 22 nt, Human
uccagaccauggauggcugcaa

SEQ ID NO: 377434 - RNA, 22 nt, Human
uggcucaggccacuucuuuuau

SEQ ID NO: 377435 - RNA, 22 nt, Human
ucaccagggcuccagccagccu

SEQ ID NO: 377436 - RNA, 22 nt, Human
aggcaggaacccugugugcgcc

SEQ ID NO: 377437 - RNA, 22 nt, Human
uacacagaggcugaugucuuag

SEQ ID NO: 377438 - RNA, 19 nt, Human
ugagacagagaccaguucu

SEQ ID NO: 377439 - RNA, 20 nt, Human
uguuucuuuuaaugagcggc

SEQ ID NO: 377440 - RNA, 22 nt, Human
caggcugggaacgccacccgcu

SEQ ID NO: 377441 - RNA, 22 nt, Human
gagagugagauccuccugggga

SEQ ID NO: 377442 - RNA, 22 nt, Human
uugaaagaggcaaaguuugauc

SEQ ID NO: 377443 - RNA, 23 nt, Human
cuagggcaguauuucacagacac

SEQ ID NO: 377444 - RNA, 22 nt, Human
aggaauucaagaccagcugggc

SEQ ID NO: 377445 - RNA, 22 nt, Human
cucaggaugucggugacuauug

SEQ ID NO: 377446 - RNA, 22 nt, Human
cagagauuauuauaacuaauua

SEQ ID NO: 377447 - RNA, 22 nt, Human
aggcucagccccugggaggaga

SEQ ID NO: 377448 - RNA, 22 nt, Human
ggucccaguccucucccugcua

SEQ ID NO: 377449 - RNA, 22 nt, Human
cauuucauaguugucacaauaa

SEQ ID NO: 377450 - RNA, 22 nt, Human
acaggccacaguggagucucug

SEQ ID NO: 377451 - RNA, 22 nt, Human
uggccuggugucugcgaggccu

SEQ ID NO: 377452 - RNA, 22 nt, Human
ggugucuguugccuccugguua

SEQ ID NO: 377453 - RNA, 22 nt, Human
ugugcuucaucacuucucaguu

SEQ ID NO: 377454 - RNA, 23 nt, Human
uggccuggagagaaaagaugagu

SEQ ID NO: 377455 - RNA, 22 nt, Human
uucuucaaagaugucuguugga

SEQ ID NO: 377456 - RNA, 22 nt, Human
cauugacaucaggcuuggccaa

SEQ ID NO: 377457 - RNA, 22 nt, Human
uucuucuugucugcccucacau

SEQ ID NO: 377458 - RNA, 22 nt, Human
aagugaagaaauacaugagaau

SEQ ID NO: 377459 - RNA, 22 nt, Human
cuguuuuugugcugugucuccc

SEQ ID NO: 377460 - RNA, 22 nt, Human
cugagcauggccgguccauggu

SEQ ID NO: 377461 - RNA, 22 nt, Human
aggagggagaugcccauccugg

SEQ ID NO: 377462 - RNA, 22 nt, Human
uaacagaaauauuuccagguga

SEQ ID NO: 377463 - RNA, 18 nt, Human
ccucagggagagagacgc

SEQ ID NO: 377464 - RNA, 20 nt, Human
uuuaggcauuacucuuuugu

SEQ ID NO: 377465 - RNA, 22 nt, Human
ugcugccaccugguggcugaag

SEQ ID NO: 377466 - RNA, 22 nt, Human
aaaugcagaucccugaaucuca

SEQ ID NO: 377467 - RNA, 22 nt, Human
auggccugggcccgcuucagau

SEQ ID NO: 377468 - RNA, 22 nt, Human
gucucagaccacccucuuuggc

SEQ ID NO: 377469 - RNA, 22 nt, Human
ggcaggcugcuugggucauguc

SEQ ID NO: 377470 - RNA, 22 nt, Human
gaauuucauugcucugcugugu

SEQ ID NO: 377471 - RNA, 18 nt, Human
auacaagaucaaguguuc

SEQ ID NO: 377472 - RNA, 22 nt, Human
gucuuucuuaauucaagugcuu

SEQ ID NO: 377473 - RNA, 22 nt, Human
ugucccagacacaguaugcgcu

SEQ ID NO: 377474 - RNA, 16 nt, Human
ucagggcagaauggca

SEQ ID NO: 377475 - RNA, 22 nt, Human
cagcaggggaacugugggccag

SEQ ID NO: 377476 - RNA, 22 nt, Human
uucucagagcacugcugacaaa

SEQ ID NO: 377477 - RNA, 20 nt, Human
aacagggggcugcagagggc

SEQ ID NO: 377478 - RNA, 22 nt, Human
aaguccuuauguggaggggcua

SEQ ID NO: 377479 - RNA, 22 nt, Human
augaaacacacacgcgcauacu

SEQ ID NO: 377480 - RNA, 22 nt, Human
ucuuucagccacuuaccugucu

SEQ ID NO: 377481 - RNA, 22 nt, Human
gaguccaguguuuaccaggggu

SEQ ID NO: 377482 - RNA, 22 nt, Human
ucugcaucauuuuucagagccg

SEQ ID NO: 377483 - RNA, 22 nt, Human
cccucagcuucucccugcagcu

SEQ ID NO: 377484 - RNA, 22 nt, Human
ggccagcuuugagcugcaggaa

SEQ ID NO: 377485 - RNA, 22 nt, Human
acuuaaaaacagauccagcagg

SEQ ID NO: 377486 - RNA, 22 nt, Human
cucugguguccuuuagaauuua

SEQ ID NO: 377487 - RNA, 22 nt, Human
gccagacacuccccugggcagg

SEQ ID NO: 377488 - RNA, 22 nt, Human
cagggccaagccccuuuggcug

SEQ ID NO: 377489 - RNA, 22 nt, Human
uccugccuaccuugcggaggug

SEQ ID NO: 377490 - RNA, 18 nt, Human
cccagccucuccuuucua

SEQ ID NO: 377491 - RNA, 22 nt, Human
acagcuguggccacuugcaucc

SEQ ID NO: 377492 - RNA, 22 nt, Human
caagauggagaagcagcaaggg

SEQ ID NO: 377493 - RNA, 22 nt, Human
agggagagguugaaaccucagu

SEQ ID NO: 377494 - RNA, 23 nt, Human
uuugaaaguaucaacucgccuga

SEQ ID NO: 377495 - RNA, 22 nt, Human
ucucacuuuguugcccagacuu

SEQ ID NO: 377496 - RNA, 22 nt, Human
aggcaguggaugucaggaaugg

SEQ ID NO: 377497 - RNA, 22 nt, Human
uaccuugggcuauuaucuuuga

SEQ ID NO: 377498 - RNA, 22 nt, Human
caucaucaaaacaaauggaguc

SEQ ID NO: 377499 - RNA, 21 nt, Human
uccagggaacuucucaggaau

SEQ ID NO: 377500 - RNA, 22 nt, Human
acacaauacagggcucaaaaua

SEQ ID NO: 377501 - RNA, 20 nt, Human
cuuugccuauucucugccug

SEQ ID NO: 377502 - RNA, 22 nt, Human
gggccuggugcuucugacuccu

SEQ ID NO: 377503 - RNA, 22 nt, Human
gucaggauuuacaaacuucagu

SEQ ID NO: 377504 - RNA, 22 nt, Human
accucugcuucccggguucaag

SEQ ID NO: 377505 - RNA, 22 nt, Human
aaagccacugcauguguaguau

SEQ ID NO: 377506 - RNA, 22 nt, Human
cuggcugcaggaaggagugggc

SEQ ID NO: 377507 - RNA, 22 nt, Human
uuugaauaucacaaacuuucaa

SEQ ID NO: 377508 - RNA, 17 nt, Human
agguggcugcugcgccu

SEQ ID NO: 377509 - RNA, 22 nt, Human
uaaagacaauaggaaaguuguu

SEQ ID NO: 377510 - RNA, 22 nt, Human
uuugaaagaaaccagugaguga

SEQ ID NO: 377511 - RNA, 22 nt, Human
aaaugaaaugagugccuggagg

SEQ ID NO: 377512 - RNA, 22 nt, Human
uccaugccaggcagucgaugca

SEQ ID NO: 377513 - RNA, 22 nt, Human
cuacagacccaccuuggaagaa

SEQ ID NO: 377514 - RNA, 22 nt, Human
cccagguguuuguggcagaggu

SEQ ID NO: 377515 - RNA, 21 nt, Human
gcagcagaggcuugacagaca

SEQ ID NO: 377516 - RNA, 22 nt, Human
uaguccuuuaucaaacauuuau

SEQ ID NO: 377517 - RNA, 22 nt, Human
ugccugccaugcagaaagcuga

SEQ ID NO: 377518 - RNA, 20 nt, Human
aauaaacuacugagagaugu

SEQ ID NO: 377519 - RNA, 18 nt, Human
ugacagaaccuggagccu

SEQ ID NO: 377520 - RNA, 22 nt, Human
uauuuaucgagugucuacuaug

SEQ ID NO: 377521 - RNA, 21 nt, Human
agggagcuauuuauaguaagc

SEQ ID NO: 377522 - RNA, 22 nt, Human
gaggucaauaauaugugcuuua

SEQ ID NO: 377523 - RNA, 22 nt, Human
gggaagggagggccuccaguca

SEQ ID NO: 377524 - RNA, 22 nt, Human
aaaaaucuaugacugcuucucc

SEQ ID NO: 377525 - RNA, 22 nt, Human
cauggggagacaccuagggaaa

SEQ ID NO: 377526 - RNA, 22 nt, Human
gaaaccucuuagccucucuuug

SEQ ID NO: 377527 - RNA, 22 nt, Human
cucaguuucuucauauuguagg

SEQ ID NO: 377528 - RNA, 22 nt, Human
cugccgagugggucaugaggca

SEQ ID NO: 377529 - RNA, 22 nt, Human
agaaacauccugcuuuccauuu

SEQ ID NO: 377530 - RNA, 22 nt, Human
uggcucugugcuucuaguaucu

SEQ ID NO: 377531 - RNA, 22 nt, Human
agcauaaaggcacuagaaagag

SEQ ID NO: 377532 - RNA, 22 nt, Human
aagauggagcacgagcagaagc

SEQ ID NO: 377533 - RNA, 22 nt, Human
gcugccugaucauacaccaggg

SEQ ID NO: 377534 - RNA, 22 nt, Human
aagcagaugggacuccaaggca

SEQ ID NO: 377535 - RNA, 22 nt, Human
uaagacuucauuaguaauaugg

SEQ ID NO: 377536 - RNA, 22 nt, Human
gaaguccucaaugcauugucuu

SEQ ID NO: 377537 - RNA, 22 nt, Human
ggucccaggcugcgggcuggug

SEQ ID NO: 377538 - RNA, 22 nt, Human
agcccagaggcugggcgugcau

SEQ ID NO: 377539 - RNA, 21 nt, Human
gagugucuaauccaggcuguc

SEQ ID NO: 377540 - RNA, 22 nt, Human
gcagacuggucuucagccuugg

SEQ ID NO: 377541 - RNA, 22 nt, Human
caggagcagaggguggucagca

SEQ ID NO: 377542 - RNA, 22 nt, Human
ugugugcauucacaugcaugcc

SEQ ID NO: 377543 - RNA, 22 nt, Human
aucuaaacagguguucuuuaga

SEQ ID NO: 377544 - RNA, 22 nt, Human
cugggcagugguggcccuuccc

SEQ ID NO: 377545 - RNA, 20 nt, Human
aauaaaagaagccuucaccc

SEQ ID NO: 377546 - RNA, 22 nt, Human
ccuggccugugaaucugagagc

SEQ ID NO: 377547 - RNA, 22 nt, Human
acccagccuacaaagcucaccu

SEQ ID NO: 377548 - RNA, 19 nt, Human
aucuuacagagcagaguac

SEQ ID NO: 377549 - RNA, 22 nt, Human
uuuguaugugauaagacuauuc

SEQ ID NO: 377550 - RNA, 21 nt, Human
gcagcaguguucuagaauacu

SEQ ID NO: 377551 - RNA, 22 nt, Human
ggccagaaaguuaagcuguggc

SEQ ID NO: 377552 - RNA, 22 nt, Human
guggagaccuccuaggaugugu

SEQ ID NO: 377553 - RNA, 17 nt, Human
uuauuuuuugggcugag

SEQ ID NO: 377554 - RNA, 22 nt, Human
gcagcuuucuuuuugcaugucu

SEQ ID NO: 377555 - RNA, 22 nt, Human
cuggauuugccuauggugcuuu

SEQ ID NO: 377556 - RNA, 22 nt, Human
cugcagggagaggggacagccu

SEQ ID NO: 377557 - RNA, 22 nt, Human
ggcuucugaaaucucugugcgu

SEQ ID NO: 377558 - RNA, 22 nt, Human
gaguggggucugggcaucaguc

SEQ ID NO: 377559 - RNA, 17 nt, Human
uaaauacacaaggguau

SEQ ID NO: 377560 - RNA, 22 nt, Human
uagagcuguaucaaagagccuu

SEQ ID NO: 377561 - RNA, 22 nt, Human
guuucauuaccugacccaugag

SEQ ID NO: 377562 - RNA, 22 nt, Human
gauuuccuugcauauugguaau

SEQ ID NO: 377563 - RNA, 22 nt, Human
ugagcccaggaguuggaggcug

SEQ ID NO: 377564 - RNA, 21 nt, Human
agugaaaugaaguguaugcuc

SEQ ID NO: 377565 - RNA, 22 nt, Human
agcagggcagcugaugcgcacg

SEQ ID NO: 377566 - RNA, 21 nt, Human
ugaggcucuguugugccugca

SEQ ID NO: 377567 - RNA, 22 nt, Human
ggcuucugccacgagagggaag

SEQ ID NO: 377568 - RNA, 22 nt, Human
acagggccaggugagaggugcu

SEQ ID NO: 377569 - RNA, 22 nt, Human
agcagcauguugggaugugaaa

SEQ ID NO: 377570 - RNA, 22 nt, Human
gggaccugaggagggguuucag

SEQ ID NO: 377571 - RNA, 22 nt, Human
uucacauugguucuugauagcu

SEQ ID NO: 377572 - RNA, 22 nt, Human
cagcugacuucauaggaagaca

SEQ ID NO: 377573 - RNA, 22 nt, Human
agcaggugacccaagcaggcug

SEQ ID NO: 377574 - RNA, 22 nt, Human
uuuacagaugaggaaacugaga

SEQ ID NO: 377575 - RNA, 18 nt, Human
ggaaaaggagugucuagc

SEQ ID NO: 377576 - RNA, 22 nt, Human
auaugaaaguaagcaugugugu

SEQ ID NO: 377577 - RNA, 22 nt, Human
uugaagcacaaugucuuuuauc

SEQ ID NO: 377578 - RNA, 22 nt, Human
cagcuggccaaucagggcgccc

SEQ ID NO: 377579 - RNA, 22 nt, Human
uggagacugugcuaagggaguu

SEQ ID NO: 377580 - RNA, 22 nt, Human
aauguguagcauuuaaugcagu

SEQ ID NO: 377581 - RNA, 22 nt, Human
cagcaguguacaaggugucaga

SEQ ID NO: 377582 - RNA, 22 nt, Human
caaggagauaaaauguugagcu

SEQ ID NO: 377583 - RNA, 20 nt, Human
ccugaggguuuguguucuuu

SEQ ID NO: 377584 - RNA, 22 nt, Human
acccaggagguggaggcugcag

SEQ ID NO: 377585 - RNA, 22 nt, Human
uacuucauuccuuuguaaaaug

SEQ ID NO: 377586 - RNA, 22 nt, Human
augaggcagaaaaaagucggag

SEQ ID NO: 377587 - RNA, 17 nt, Human
aaucagauuucugagga

SEQ ID NO: 377588 - RNA, 22 nt, Human
ccucccuuggccauagccagcc

SEQ ID NO: 377589 - RNA, 22 nt, Human
agacccucuccaugcccacugc

SEQ ID NO: 377590 - RNA, 22 nt, Human
ugcauauuguccuugauauuau

SEQ ID NO: 377591 - RNA, 22 nt, Human
auguccagggcacacagcagug

SEQ ID NO: 377592 - RNA, 22 nt, Human
cuggagcccugaaugggcagga

SEQ ID NO: 377593 - RNA, 22 nt, Human
caauuucucuuuauaucucaca

SEQ ID NO: 377594 - RNA, 22 nt, Human
acauuuguaugcguuuuuacug

SEQ ID NO: 377595 - RNA, 22 nt, Human
caaauucagaaaauugguagag

SEQ ID NO: 377596 - RNA, 22 nt, Human
cuuagcaugugguguccuugua

SEQ ID NO: 377597 - RNA, 23 nt, Human
aaccagauaaauggcuccagggc

SEQ ID NO: 377598 - RNA, 22 nt, Human
gaggaaaauggaguguaauuaa

SEQ ID NO: 377599 - RNA, 20 nt, Human
ugcucaggauggagaggugu

SEQ ID NO: 377600 - RNA, 22 nt, Human
ugucagcagcugguuugcuguu

SEQ ID NO: 377601 - RNA, 22 nt, Human
cuggguggcgucuggggccagu

SEQ ID NO: 377602 - RNA, 22 nt, Human
uugauacuauuaagcacugggc

SEQ ID NO: 377603 - RNA, 22 nt, Human
aggagccaggaaaccugcucug

SEQ ID NO: 377604 - RNA, 22 nt, Human
cguggccuuugagugagcuccc

SEQ ID NO: 377605 - RNA, 22 nt, Human
agagcccuuucuccaggcaccu

SEQ ID NO: 377606 - RNA, 22 nt, Human
cagagccaugguaugggcuugu

SEQ ID NO: 377607 - RNA, 22 nt, Human
ugucaugccauuuaaaauguuu

SEQ ID NO: 377608 - RNA, 20 nt, Human
accagguggcugaugacacc

SEQ ID NO: 377609 - RNA, 22 nt, Human
acagauguacacucauauauaa

SEQ ID NO: 377610 - RNA, 22 nt, Human
uccugagauguggagcuccaug

SEQ ID NO: 377611 - RNA, 22 nt, Human
ugaauaauccacagucauucau

SEQ ID NO: 377612 - RNA, 22 nt, Human
cucuucuugucucugguuagaa

SEQ ID NO: 377613 - RNA, 22 nt, Human
aagaugcaugcugaagcuggcu

SEQ ID NO: 377614 - RNA, 22 nt, Human
agggcugacaaauggcagugac

SEQ ID NO: 377615 - RNA, 18 nt, Human
gagacacaagggccugga

SEQ ID NO: 377616 - RNA, 22 nt, Human
ccuggagggcgccgcacagucc

SEQ ID NO: 377617 - RNA, 22 nt, Human
ggcauuuacauaaucuuauuua

SEQ ID NO: 377618 - RNA, 22 nt, Human
agggcagaaauauugauacugu

SEQ ID NO: 377619 - RNA, 19 nt, Human
ggcagaagguguaggggga

SEQ ID NO: 377620 - RNA, 22 nt, Human
agcuaagacuuagugacuuagu

SEQ ID NO: 377621 - RNA, 22 nt, Human
gagagcccugcuccuaucccag

SEQ ID NO: 377622 - RNA, 18 nt, Human
agcagaauucuaggguuc

SEQ ID NO: 377623 - RNA, 22 nt, Human
auuuggaaacaauuauauucuu

SEQ ID NO: 377624 - RNA, 22 nt, Human
aggcuuguggauuggagcgagu

SEQ ID NO: 377625 - RNA, 22 nt, Human
ggagaagcaggugcuuuggguc

SEQ ID NO: 377626 - RNA, 22 nt, Human
uauaaaguuucgaaagauguau

SEQ ID NO: 377627 - RNA, 22 nt, Human
ucauuucuauugcuacugucug

SEQ ID NO: 377628 - RNA, 22 nt, Human
uucagaaagguuaaucuggauu

SEQ ID NO: 377629 - RNA, 22 nt, Human
aauuuuauuaacuggauguagc

SEQ ID NO: 377630 - RNA, 22 nt, Human
aaagccagagcaagcugucaca

SEQ ID NO: 377631 - RNA, 22 nt, Human
agggggcccuugcaggugagcg

SEQ ID NO: 377632 - RNA, 17 nt, Human
aggugcagaggcagagc

SEQ ID NO: 377633 - RNA, 21 nt, Human
caauuucaugggaagauggga

SEQ ID NO: 377634 - RNA, 22 nt, Human
ucgcugugguuucuguacaugg

SEQ ID NO: 377635 - RNA, 17 nt, Human
uccuucagugccucugc

SEQ ID NO: 377636 - RNA, 22 nt, Human
acacaugcugauaagaauauaa

SEQ ID NO: 377637 - RNA, 22 nt, Human
gccugagagucugcauuucuaa

SEQ ID NO: 377638 - RNA, 22 nt, Human
uccugagauucugcauuucuaa

SEQ ID NO: 377639 - RNA, 22 nt, Human
gaggagcuggcagcgucuccgc

SEQ ID NO: 377640 - RNA, 22 nt, Human
accaggagccauagagucaggc

SEQ ID NO: 377641 - RNA, 20 nt, Human
ucaggaugugcugagugaag

SEQ ID NO: 377642 - RNA, 22 nt, Human
ucaguggauugacaugaaaaag

SEQ ID NO: 377643 - RNA, 19 nt, Human
uggcugggugccaauggcc

SEQ ID NO: 377644 - RNA, 22 nt, Human
uaucagaacacagccacagcca

SEQ ID NO: 377645 - RNA, 22 nt, Human
gccaggcauguccucugcagaa

SEQ ID NO: 377646 - RNA, 22 nt, Human
uccacugcagcuucugauggaa

SEQ ID NO: 377647 - RNA, 22 nt, Human
ugagagugguucagcucagaag

SEQ ID NO: 377648 - RNA, 22 nt, Human
ggugucccaggccagcugugug

SEQ ID NO: 377649 - RNA, 22 nt, Human
cugcugugccucuuuucacgug

SEQ ID NO: 377650 - RNA, 22 nt, Human
ucacauuuuaucugagauugac

SEQ ID NO: 377651 - RNA, 22 nt, Human
uauuccagugugaucuuuguag

SEQ ID NO: 377652 - RNA, 22 nt, Human
uggaggaaguugcuggaaguca

SEQ ID NO: 377653 - RNA, 22 nt, Human
acaaauuuauugaagggcauau

SEQ ID NO: 377654 - RNA, 22 nt, Human
ugcagucuccaccuccugggug

SEQ ID NO: 377655 - RNA, 22 nt, Human
aagaauuauugcaauacuagau

SEQ ID NO: 377656 - RNA, 22 nt, Human
agaggccagguccagaguuugu

SEQ ID NO: 377657 - RNA, 22 nt, Human
agcagccauuuaaaaugaauug

SEQ ID NO: 377658 - RNA, 22 nt, Human
uugucugugaaauggaaauagu

SEQ ID NO: 377659 - RNA, 22 nt, Human
gagggaggggagcuccacccuc

SEQ ID NO: 377660 - RNA, 22 nt, Human
cccaggaacagcacagaacagc

SEQ ID NO: 377661 - RNA, 22 nt, Human
ugaggcucagugagcccugcag

SEQ ID NO: 377662 - RNA, 22 nt, Human
gcccuggccuucaucucagaca

SEQ ID NO: 377663 - RNA, 22 nt, Human
aguggacucuucccagugcuug

SEQ ID NO: 377664 - RNA, 22 nt, Human
caccagggcagcagccuagucu

SEQ ID NO: 377665 - RNA, 22 nt, Human
ugggcugcuguuacaggggcug

SEQ ID NO: 377666 - RNA, 22 nt, Human
ggaccugaacauaaaacgaggc

SEQ ID NO: 377667 - RNA, 19 nt, Human
ucuggcuccgccucuuagu

SEQ ID NO: 377668 - RNA, 22 nt, Human
cuucucagcauuuugucagucu

SEQ ID NO: 377669 - RNA, 22 nt, Human
ugaaggccagcagagugaaggc

SEQ ID NO: 377670 - RNA, 22 nt, Human
guacaauagucccuguuuggau

SEQ ID NO: 377671 - RNA, 22 nt, Human
uguauauucugccuaaaagcuu

SEQ ID NO: 377672 - RNA, 21 nt, Human
agcagccauuucacagagacu

SEQ ID NO: 377673 - RNA, 22 nt, Human
ccaggccuccugugaguggacc

SEQ ID NO: 377674 - RNA, 22 nt, Human
cccagccugugacagccguccu

SEQ ID NO: 377675 - RNA, 22 nt, Human
ccagaagaggacacagugugga

SEQ ID NO: 377676 - RNA, 19 nt, Human
gcuucccaccagccagccc

SEQ ID NO: 377677 - RNA, 22 nt, Human
ccacagaggacaacugccuggc

SEQ ID NO: 377678 - RNA, 22 nt, Human
agcugccacauggugucacugu

SEQ ID NO: 377679 - RNA, 22 nt, Human
gagugguaggcaguguuaggaa

SEQ ID NO: 377680 - RNA, 21 nt, Human
ccagcuccaggaccuuggauc

SEQ ID NO: 377681 - RNA, 22 nt, Human
cgaggcaggcaggcggaggaua

SEQ ID NO: 377682 - RNA, 22 nt, Human
ggccucuguucugcauuccucc

SEQ ID NO: 377683 - RNA, 22 nt, Human
gucucccaucguuugugaggaa

SEQ ID NO: 377684 - RNA, 23 nt, Human
uggccugcagaguuucugcuggg

SEQ ID NO: 377685 - RNA, 22 nt, Human
uuucaguucaguuuauuauauc

SEQ ID NO: 377686 - RNA, 22 nt, Human
ugucauuuucuaaucuguuguc

SEQ ID NO: 377687 - RNA, 22 nt, Human
ugcuuaauagugcacugguuuc

SEQ ID NO: 377688 - RNA, 22 nt, Human
aaucuagucuccuuaagucuuu

SEQ ID NO: 377689 - RNA, 22 nt, Human
cauucuuacacaauauuuuaau

SEQ ID NO: 377690 - RNA, 22 nt, Human
ggagccuuccagacugcccaca

SEQ ID NO: 377691 - RNA, 22 nt, Human
ggcugcaggaugcccagccgug

SEQ ID NO: 377692 - RNA, 22 nt, Human
aggcacugaagugguaaaugua

SEQ ID NO: 377693 - RNA, 22 nt, Human
cugggcagguauacaaaaaaug

SEQ ID NO: 377694 - RNA, 20 nt, Human
ccuggcuuugcaucugugau

SEQ ID NO: 377695 - RNA, 22 nt, Human
uaggcagcuuagguuagaagug

SEQ ID NO: 377696 - RNA, 22 nt, Human
gccagcucccaagugagccccu

SEQ ID NO: 377697 - RNA, 22 nt, Human
uucaacucuucaagaucacauc

SEQ ID NO: 377698 - RNA, 22 nt, Human
agucccaggcagccgagccggu

SEQ ID NO: 377699 - RNA, 22 nt, Human
ggcugccuucagacuccagcuu

SEQ ID NO: 377700 - RNA, 19 nt, Human
uagucuuuauucuuaauuu

SEQ ID NO: 377701 - RNA, 22 nt, Human
aacaaaugauuguugguuggag

SEQ ID NO: 377702 - RNA, 22 nt, Human
guggccuggaaaggcuggucug

SEQ ID NO: 377703 - RNA, 22 nt, Human
gggcugggcaugguguucccuc

SEQ ID NO: 377704 - RNA, 22 nt, Human
aucagagauuguaguaugugca

SEQ ID NO: 377705 - RNA, 22 nt, Human
gagggcuguggggcaugaccag

SEQ ID NO: 377706 - RNA, 22 nt, Human
uggcucagauuuuuguaggcuu

SEQ ID NO: 377707 - RNA, 22 nt, Human
auaaggcaucucucaguuagca

SEQ ID NO: 377708 - RNA, 22 nt, Human
uuccauauguauauagcuguua

SEQ ID NO: 377709 - RNA, 22 nt, Human
ucaggagggugacaggcccugg

SEQ ID NO: 377710 - RNA, 22 nt, Human
ugaggggaaggcaugauaaaua

SEQ ID NO: 377711 - RNA, 22 nt, Human
gcaggcagagagggguuuccag

SEQ ID NO: 377712 - RNA, 22 nt, Human
uggcccugaggacccagugugg

SEQ ID NO: 377713 - RNA, 22 nt, Human
aaggcagccuuuugaguugauu

SEQ ID NO: 377714 - RNA, 21 nt, Human
gggccacaccuucugcagacc

SEQ ID NO: 377715 - RNA, 22 nt, Human
agcaauuuucccuuagucuuug

SEQ ID NO: 377716 - RNA, 22 nt, Human
uuucauaauacuguacaugaaa

SEQ ID NO: 377717 - RNA, 22 nt, Human
uauguguuugacacccugcaag

SEQ ID NO: 377718 - RNA, 22 nt, Human
aggggcaggugcugcacuuaga

SEQ ID NO: 377719 - RNA, 22 nt, Human
ggccugcugacccaaguccugu

SEQ ID NO: 377720 - RNA, 22 nt, Human
aggucagcaugaguagaaggua

SEQ ID NO: 377721 - RNA, 22 nt, Human
gcuuggccagcagccgggaugc

SEQ ID NO: 377722 - RNA, 22 nt, Human
gccaggagacuccauucauuug

SEQ ID NO: 377723 - RNA, 22 nt, Human
ugacauuuaagccucugauuuc

SEQ ID NO: 377724 - RNA, 22 nt, Human
ucagaggguggcugggagcauc

SEQ ID NO: 377725 - RNA, 22 nt, Human
auggauuuggaugagauuacuu

SEQ ID NO: 377726 - RNA, 22 nt, Human
ucuucuccagugcuucugcaca

SEQ ID NO: 377727 - RNA, 22 nt, Human
ucugcagaauucgaggaagaaa

SEQ ID NO: 377728 - RNA, 20 nt, Human
ugggcagcacugcuggcugg

SEQ ID NO: 377729 - RNA, 22 nt, Human
acagugugugcuuucccuuacg

SEQ ID NO: 377730 - RNA, 22 nt, Human
ugggcuccggcggccucaggcu

SEQ ID NO: 377731 - RNA, 22 nt, Human
ggcugugcgggcagccguggga

SEQ ID NO: 377732 - RNA, 22 nt, Human
ccagggcagcgccccuccacgc

SEQ ID NO: 377733 - RNA, 22 nt, Human
gcagcuuucuugcccuaaucuu

SEQ ID NO: 377734 - RNA, 22 nt, Human
gaggaguggaguugcuggguug

SEQ ID NO: 377735 - RNA, 22 nt, Human
gagcugugagggacacauugcu

SEQ ID NO: 377736 - RNA, 22 nt, Human
ucaagauaccaccauuauaugu

SEQ ID NO: 377737 - RNA, 22 nt, Human
ccugcagggaaucgaggcagaa

SEQ ID NO: 377738 - RNA, 17 nt, Human
ggcagccucaggcguuu

SEQ ID NO: 377739 - RNA, 17 nt, Human
ucagcaggggccaagcu

SEQ ID NO: 377740 - RNA, 22 nt, Human
uaauaaacugcuacgcuuaguu

SEQ ID NO: 377741 - RNA, 22 nt, Human
cuggguggcagagccugcagug

SEQ ID NO: 377742 - RNA, 22 nt, Human
gcuggcccagggucaccuagga

SEQ ID NO: 377743 - RNA, 22 nt, Human
auuccaguucuccucucuaaag

SEQ ID NO: 377744 - RNA, 20 nt, Human
uggccuuuaaauaguauucc

SEQ ID NO: 377745 - RNA, 22 nt, Human
gaccagagaaaggcacuggaag

SEQ ID NO: 377746 - RNA, 22 nt, Human
aggaugagaagauuggaaucuu

SEQ ID NO: 377747 - RNA, 22 nt, Human
uucacagacauugcagacugaa

SEQ ID NO: 377748 - RNA, 22 nt, Human
ucagaauaugcuaaugacauuu

SEQ ID NO: 377749 - RNA, 22 nt, Human
cugcugugugaccauggacagg

SEQ ID NO: 377750 - RNA, 22 nt, Human
cccuggagggauuucucaauca

SEQ ID NO: 377751 - RNA, 22 nt, Human
acuuuaauuaaugaacuguggc

SEQ ID NO: 377752 - RNA, 22 nt, Human
gcucccacgcaauucuuuucag

SEQ ID NO: 377753 - RNA, 22 nt, Human
aggugcagcaugaguccaacgg

SEQ ID NO: 377754 - RNA, 22 nt, Human
cccugcagccuugcaugccuuc

SEQ ID NO: 377755 - RNA, 22 nt, Human
gcucugcucuaacauuccugac

SEQ ID NO: 377756 - RNA, 22 nt, Human
ugaagcagcuucuuucugucaa

SEQ ID NO: 377757 - RNA, 23 nt, Human
gccauggcugccccacaggccuc

SEQ ID NO: 377758 - RNA, 22 nt, Human
uagagcugcuggacuguaacag

SEQ ID NO: 377759 - RNA, 22 nt, Human
aagggcuggaucucucugagca

SEQ ID NO: 377760 - RNA, 22 nt, Human
gccugcagccccucugcaguag

SEQ ID NO: 377761 - RNA, 22 nt, Human
cagagccaaaccucagggcccg

SEQ ID NO: 377762 - RNA, 22 nt, Human
augaggcaggauuaagcuauca

SEQ ID NO: 377763 - RNA, 22 nt, Human
caugauuuugucuuguguuaau

SEQ ID NO: 377764 - RNA, 22 nt, Human
aggcagcguagcaaggcuagua

SEQ ID NO: 377765 - RNA, 17 nt, Human
cucacggaggaugaauc

SEQ ID NO: 377766 - RNA, 22 nt, Human
gggcucucaugaguguguggua

SEQ ID NO: 377767 - RNA, 22 nt, Human
caaaugugacuuuugggcuucu

SEQ ID NO: 377768 - RNA, 22 nt, Human
ugcuuggccuacuuguccuuug

SEQ ID NO: 377769 - RNA, 18 nt, Human
ggcaucugcacagcagcc

SEQ ID NO: 377770 - RNA, 22 nt, Human
uuucucugcugccugugucgau

SEQ ID NO: 377771 - RNA, 22 nt, Human
gcugagagcaguguggccuuaa

SEQ ID NO: 377772 - RNA, 22 nt, Human
ucagggaccccucugaguggag

SEQ ID NO: 377773 - RNA, 22 nt, Human
uacauuguucaugcaugagaaa

SEQ ID NO: 377774 - RNA, 21 nt, Human
ucccacucuaaauggacugaa

SEQ ID NO: 377775 - RNA, 22 nt, Human
uacaaagugugcccaugcugag

SEQ ID NO: 377776 - RNA, 22 nt, Human
uaagaacaguguuucaucucua

SEQ ID NO: 377777 - RNA, 22 nt, Human
augcugaggacaaagagaucaa

SEQ ID NO: 377778 - RNA, 21 nt, Human
gagcauggcuuacaucagcag

SEQ ID NO: 377779 - RNA, 22 nt, Human
acaugcauacacguacauaccu

SEQ ID NO: 377780 - RNA, 22 nt, Human
ucagcuuuccugcagcuaaggg

SEQ ID NO: 377781 - RNA, 22 nt, Human
gccacaggcacuuaagggcugg

SEQ ID NO: 377782 - RNA, 22 nt, Human
aguguuuaccccaaucaguuua

SEQ ID NO: 377783 - RNA, 19 nt, Human
accucugcagagauguuua

SEQ ID NO: 377784 - RNA, 22 nt, Human
gcaggaagaggcucgaagcccc

SEQ ID NO: 377785 - RNA, 22 nt, Human
ugagaagcagcuuacagguguc

SEQ ID NO: 377786 - RNA, 22 nt, Human
aaagcaaugggucuaagguaaa

SEQ ID NO: 377787 - RNA, 22 nt, Human
ccagcuuuugcacuggacuggg

SEQ ID NO: 377788 - RNA, 22 nt, Human
cagagcaucgcgcagagagccu

SEQ ID NO: 377789 - RNA, 19 nt, Human
gaagaagcuugagaaguag

SEQ ID NO: 377790 - RNA, 22 nt, Human
gcugagagugagcacuggauau

SEQ ID NO: 377791 - RNA, 22 nt, Human
cuguauuuaguuaaaaugcuaa

SEQ ID NO: 377792 - RNA, 22 nt, Human
gacccaggagagaggguugcau

SEQ ID NO: 377793 - RNA, 22 nt, Human
auacaugucaucauauguuugu

SEQ ID NO: 377794 - RNA, 22 nt, Human
aaugugguuaacccauuuaaga

SEQ ID NO: 377795 - RNA, 22 nt, Human
uuucagugcuucuguuuaccgg

SEQ ID NO: 377796 - RNA, 22 nt, Human
uaucagaagacuuacaguaucg

SEQ ID NO: 377797 - RNA, 22 nt, Human
cagagaaacucagauagcugau

SEQ ID NO: 377798 - RNA, 22 nt, Human
acagagaugcaaguguguauuu

SEQ ID NO: 377799 - RNA, 22 nt, Human
augaaacaugagaaauggagag

SEQ ID NO: 377800 - RNA, 21 nt, Human
ccaccaggucuucugcucggg

SEQ ID NO: 377801 - RNA, 22 nt, Human
caagagcuagaaauugguuaga

SEQ ID NO: 377802 - RNA, 22 nt, Human
aaaaugcugggaaaguuggaau

SEQ ID NO: 377803 - RNA, 22 nt, Human
aggagaaggaagugcaucacua

SEQ ID NO: 377804 - RNA, 22 nt, Human
ggcagagguagcuggaaccagg

SEQ ID NO: 377805 - RNA, 22 nt, Human
agcagcauguucauuacauuau

SEQ ID NO: 377806 - RNA, 22 nt, Human
uaguaacagauuuauacagucu

SEQ ID NO: 377807 - RNA, 22 nt, Human
cuguauuuguccucuauuuauu

SEQ ID NO: 377808 - RNA, 22 nt, Human
uguaugcaccauuguauuaccu

SEQ ID NO: 377809 - RNA, 22 nt, Human
agaccugcagggccaggccugc

SEQ ID NO: 377810 - RNA, 22 nt, Human
ucaggcagcauuaaacuucagc

SEQ ID NO: 377811 - RNA, 22 nt, Human
agccccaguccgcugcgggcgg

SEQ ID NO: 377812 - RNA, 22 nt, Human
cugcaggggccucgagcacagg

SEQ ID NO: 377813 - RNA, 21 nt, Human
cccacggaaugaugaggcacu

SEQ ID NO: 377814 - RNA, 22 nt, Human
ucaucugucauccacaaagcug

SEQ ID NO: 377815 - RNA, 22 nt, Human
uggcaggguuggccaccuuacc

SEQ ID NO: 377816 - RNA, 22 nt, Human
gugggcugcccuugaggucagc

SEQ ID NO: 377817 - RNA, 22 nt, Human
cagguggaucucuaaggacuga

SEQ ID NO: 377818 - RNA, 22 nt, Human
uggcugcugagaaggcagcugu

SEQ ID NO: 377819 - RNA, 22 nt, Human
ugcuuuuaagaacaaugcugcu

SEQ ID NO: 377820 - RNA, 22 nt, Human
auugacaaucuacuauguucug

SEQ ID NO: 377821 - RNA, 22 nt, Human
gaggagcuugugagaagauguc

SEQ ID NO: 377822 - RNA, 22 nt, Human
cugaggcuggggaagggaagug

SEQ ID NO: 377823 - RNA, 22 nt, Human
cuuguccuuuacuugagacuca

SEQ ID NO: 377824 - RNA, 22 nt, Human
ugcucacugaacucuugcuguc

SEQ ID NO: 377825 - RNA, 22 nt, Human
agcagggcuuuggcuggcuuuc

SEQ ID NO: 377826 - RNA, 18 nt, Human
agcugcagaccaggaggu

SEQ ID NO: 377827 - RNA, 22 nt, Human
uuauuuauggcacuguuggugg

SEQ ID NO: 377828 - RNA, 22 nt, Human
accugccuucucaaggacauga

SEQ ID NO: 377829 - RNA, 22 nt, Human
ucugggaaguccucugucaugc

SEQ ID NO: 377830 - RNA, 22 nt, Human
augucuuuauaaauguauaaug

SEQ ID NO: 377831 - RNA, 22 nt, Human
aaggccugggaguacugggaca

SEQ ID NO: 377832 - RNA, 22 nt, Human
uuaaauuagucaagcuucucug

SEQ ID NO: 377833 - RNA, 22 nt, Human
ugucauuuaguccucugugugu

SEQ ID NO: 377834 - RNA, 17 nt, Human
agugacuuggaaagagc

SEQ ID NO: 377835 - RNA, 23 nt, Human
uguugaaguaacuguuacauaga

SEQ ID NO: 377836 - RNA, 22 nt, Human
aguguccccuccaagggccugg

SEQ ID NO: 377837 - RNA, 22 nt, Human
ucagagagcuggugggcagagg

SEQ ID NO: 377838 - RNA, 22 nt, Human
aggccugagcagaggaguggac

SEQ ID NO: 377839 - RNA, 22 nt, Human
uugauaaaaugauaucuucuuu

SEQ ID NO: 377840 - RNA, 22 nt, Human
gaagaaucaagcaguaauuugu

SEQ ID NO: 377841 - RNA, 18 nt, Human
ucagcuuuugaaaaccaa

SEQ ID NO: 377842 - RNA, 22 nt, Human
auccccagaaaauaggugccua

SEQ ID NO: 377843 - RNA, 22 nt, Human
uuccaguuaaggaagcuauucu

SEQ ID NO: 377844 - RNA, 22 nt, Human
ugccacacagucugguagaaua

SEQ ID NO: 377845 - RNA, 22 nt, Human
cagcagcaggcgcacggccguc

SEQ ID NO: 377846 - RNA, 22 nt, Human
ccacugcccccugaagaccagg

SEQ ID NO: 377847 - RNA, 22 nt, Human
ucaaggagcccacagucuaaug

SEQ ID NO: 377848 - RNA, 22 nt, Human
ucaagugcuugugagguauuug

SEQ ID NO: 377849 - RNA, 22 nt, Human
agaguccaugaagacagcugag

SEQ ID NO: 377850 - RNA, 22 nt, Human
uuuaaaaaacuagucugagucu

SEQ ID NO: 377851 - RNA, 22 nt, Human
uuugcuuguucaagauuucugu

SEQ ID NO: 377852 - RNA, 22 nt, Human
augugcuucauucuacaugaca

SEQ ID NO: 377853 - RNA, 22 nt, Human
uuccaguucccaugaggauuaa

SEQ ID NO: 377854 - RNA, 18 nt, Human
augaucuuagcaaauauu

SEQ ID NO: 377855 - RNA, 22 nt, Human
cuguuauuucugccaggugagu

SEQ ID NO: 377856 - RNA, 22 nt, Human
acaggugguaaaauggacuguc

SEQ ID NO: 377857 - RNA, 22 nt, Human
agccaggcugcaguuggcuggc

SEQ ID NO: 377858 - RNA, 22 nt, Human
cagcucccagagugaccagcag

SEQ ID NO: 377859 - RNA, 22 nt, Human
gaaggucaccuccccucucugg

SEQ ID NO: 377860 - RNA, 22 nt, Human
aggcuucagaaagaguaauugg

SEQ ID NO: 377861 - RNA, 22 nt, Human
caucagaaggccagaggguagc

SEQ ID NO: 377862 - RNA, 22 nt, Human
ucacaacucuuuccauuuaaua

SEQ ID NO: 377863 - RNA, 22 nt, Human
uagaacagaggguugcccagau

SEQ ID NO: 377864 - RNA, 22 nt, Human
uaaagguagcaugaaacugcaa

SEQ ID NO: 377865 - RNA, 22 nt, Human
uccugaaaauaauuucacaaga

SEQ ID NO: 377866 - RNA, 22 nt, Human
uucagaaacagagugagugagu

SEQ ID NO: 377867 - RNA, 22 nt, Human
gccugcuguuaacugcaggaau

SEQ ID NO: 377868 - RNA, 22 nt, Human
aggcagcaagauuauuuaaucc

SEQ ID NO: 377869 - RNA, 22 nt, Human
aggccuguuggcgugggcucua

SEQ ID NO: 377870 - RNA, 22 nt, Human
ugcauuguugaccaguugugca

SEQ ID NO: 377871 - RNA, 17 nt, Human
agcagcuggguugaucu

SEQ ID NO: 377872 - RNA, 22 nt, Human
ggcagcucacgggcauggggug

SEQ ID NO: 377873 - RNA, 22 nt, Human
agccuggcacugaggcagggcg

SEQ ID NO: 377874 - RNA, 22 nt, Human
uucagugucaauuuuuaaauau

SEQ ID NO: 377875 - RNA, 22 nt, Human
aagggcugcauuugauguguca

SEQ ID NO: 377876 - RNA, 22 nt, Human
cuacccagcaccuaggcugccu

SEQ ID NO: 377877 - RNA, 22 nt, Human
ggaagggccucgggcgugggac

SEQ ID NO: 377878 - RNA, 22 nt, Human
agugguaacuaaguccugcuua

SEQ ID NO: 377879 - RNA, 22 nt, Human
gccuaggaguggggauggcggu

SEQ ID NO: 377880 - RNA, 22 nt, Human
agcucccagaaggcccugcgcc

SEQ ID NO: 377881 - RNA, 22 nt, Human
gcaggcuccaaggccugggaga

SEQ ID NO: 377882 - RNA, 23 nt, Human
uggcccugaaucuguccuggagg

SEQ ID NO: 377883 - RNA, 22 nt, Human
gagagcugcauucucagacaca

SEQ ID NO: 377884 - RNA, 22 nt, Human
caagggcucacggucugcuggg

SEQ ID NO: 377885 - RNA, 22 nt, Human
caggcagcugggucaccguccc

SEQ ID NO: 377886 - RNA, 22 nt, Human
aagcaagacagaaguuacugcc

SEQ ID NO: 377887 - RNA, 22 nt, Human
agaaguuguagguuugcauauu

SEQ ID NO: 377888 - RNA, 22 nt, Human
augaauaaguaaacuccuuugg

SEQ ID NO: 377889 - RNA, 22 nt, Human
caugggagguuggcuuggcaug

SEQ ID NO: 377890 - RNA, 22 nt, Human
caugugguucaaguacuccaca

SEQ ID NO: 377891 - RNA, 22 nt, Human
cugcaucacagcaggaggcaca

SEQ ID NO: 377892 - RNA, 22 nt, Human
aggccucuucagggagcaugga

SEQ ID NO: 377893 - RNA, 22 nt, Human
ucccagagacagagccuccucc

SEQ ID NO: 377894 - RNA, 22 nt, Human
ugaagggcaaccccaggcccag

SEQ ID NO: 377895 - RNA, 22 nt, Human
aaacaccagucccaguauacac

SEQ ID NO: 377896 - RNA, 22 nt, Human
ucaaacauguuagcagucugug

SEQ ID NO: 377897 - RNA, 20 nt, Human
aaagucuuaugguuaauuuu

SEQ ID NO: 377898 - RNA, 22 nt, Human
cagcugccuaugaccuagccuc

SEQ ID NO: 377899 - RNA, 22 nt, Human
uaaaugaagaaauggagauugu

SEQ ID NO: 377900 - RNA, 22 nt, Human
cagaggguugucaggcgccuug

SEQ ID NO: 377901 - RNA, 22 nt, Human
cagaccagaaggaagccgacaa

SEQ ID NO: 377902 - RNA, 22 nt, Human
cccaugagaccugguuuaaggc

SEQ ID NO: 377903 - RNA, 22 nt, Human
gguuucaacuucaaccucucca

SEQ ID NO: 377904 - RNA, 22 nt, Human
uucauuccuucccuaagcaacu

SEQ ID NO: 377905 - RNA, 22 nt, Human
ccuggagcccaaggcagugaga

SEQ ID NO: 377906 - RNA, 22 nt, Human
cuucugugauuugguuaggaua

SEQ ID NO: 377907 - RNA, 22 nt, Human
cugcccugggaguaccuguccu

SEQ ID NO: 377908 - RNA, 22 nt, Human
ucugucacucuagagauggcag

SEQ ID NO: 377909 - RNA, 22 nt, Human
gugcuuucugcaugguuccuac

SEQ ID NO: 377910 - RNA, 22 nt, Human
aaggcuuuaugugaccaaaaga

SEQ ID NO: 377911 - RNA, 22 nt, Human
uaauuucaccguugcuagaaau

SEQ ID NO: 377912 - RNA, 22 nt, Human
ggcuugggagcaggcaugugac

SEQ ID NO: 377913 - RNA, 23 nt, Human
guaaaauacgcagugcaguguga

SEQ ID NO: 377914 - RNA, 17 nt, Human
ucaggauccaggguucu

SEQ ID NO: 377915 - RNA, 22 nt, Human
gaggcagcugaaggagugacag

SEQ ID NO: 377916 - RNA, 22 nt, Human
ucaaguuuaauugagauguuua

SEQ ID NO: 377917 - RNA, 22 nt, Human
agaagcagcuuucaaggugauu

SEQ ID NO: 377918 - RNA, 22 nt, Human
gaaugcacucacccaucacuca

SEQ ID NO: 377919 - RNA, 22 nt, Human
ucaaagucucugcuucuguaac

SEQ ID NO: 377920 - RNA, 22 nt, Human
uguuuucauuugauguaacaaa

SEQ ID NO: 377921 - RNA, 22 nt, Human
uggcugagaccaucagggugua

SEQ ID NO: 377922 - RNA, 22 nt, Human
uuuagggaauagaagaucugaa

SEQ ID NO: 377923 - RNA, 22 nt, Human
aaugaacauauaaagagaucuu

SEQ ID NO: 377924 - RNA, 22 nt, Human
ugccuugcgggcguuucuguug

SEQ ID NO: 377925 - RNA, 17 nt, Human
auuucacuuagcaugag

SEQ ID NO: 377926 - RNA, 20 nt, Human
accccagccccucuaucuga

SEQ ID NO: 377927 - RNA, 18 nt, Human
ucaggagacacagacgca

SEQ ID NO: 377928 - RNA, 22 nt, Human
agggcccuuacgcaggcccuuc

SEQ ID NO: 377929 - RNA, 22 nt, Human
cugaggcuggcguuugaggaag

SEQ ID NO: 377930 - RNA, 23 nt, Human
agcuggguggccugcgugaagcu

SEQ ID NO: 377931 - RNA, 22 nt, Human
ugugucccuuggaaccucagcu

SEQ ID NO: 377932 - RNA, 22 nt, Human
gaggggcagaaugugaucaggg

SEQ ID NO: 377933 - RNA, 22 nt, Human
caggugggagccacagcguaca

SEQ ID NO: 377934 - RNA, 22 nt, Human
aaaaugaauaaguuaacccagg

SEQ ID NO: 377935 - RNA, 22 nt, Human
gauggcagcagcagccagggau

SEQ ID NO: 377936 - RNA, 22 nt, Human
ccuucugcucccuggccagggc

SEQ ID NO: 377937 - RNA, 22 nt, Human
accagggcaaauguuuguacuc

SEQ ID NO: 377938 - RNA, 20 nt, Human
aucuggcucagauccugcag

SEQ ID NO: 377939 - RNA, 22 nt, Human
ucaucacauaugucaugauuug

SEQ ID NO: 377940 - RNA, 22 nt, Human
auauacuuggagacuaucauug

SEQ ID NO: 377941 - RNA, 22 nt, Human
ccugcccagcuucaccucaggc

SEQ ID NO: 377942 - RNA, 22 nt, Human
ccagaccacccuggccaugcac

SEQ ID NO: 377943 - RNA, 22 nt, Human
caggaggaggguacaccaucag

SEQ ID NO: 377944 - RNA, 20 nt, Human
ccuuuauuauuuguaugaug

SEQ ID NO: 377945 - RNA, 22 nt, Human
aaggagcuuguucgccuuccuc

SEQ ID NO: 377946 - RNA, 22 nt, Human
auacauacguacauacguaugu

SEQ ID NO: 377947 - RNA, 22 nt, Human
gugcagcagggggaagacagug

SEQ ID NO: 377948 - RNA, 22 nt, Human
cucuccaggacuuuggcccaau

SEQ ID NO: 377949 - RNA, 22 nt, Human
ccuugcugaccaucaccuuuga

SEQ ID NO: 377950 - RNA, 22 nt, Human
gcuggcuuugcacugggugcau

SEQ ID NO: 377951 - RNA, 22 nt, Human
augcauugucugguuucauuuu

SEQ ID NO: 377952 - RNA, 22 nt, Human
ucuggccagugaaaugcagaau

SEQ ID NO: 377953 - RNA, 21 nt, Human
uacugagaccucacagugugc

SEQ ID NO: 377954 - RNA, 22 nt, Human
accugagaaugggggcaugugu

SEQ ID NO: 377955 - RNA, 22 nt, Human
caggagugucuccacacagcaa

SEQ ID NO: 377956 - RNA, 22 nt, Human
aucaggauucaguaucuccagc

SEQ ID NO: 377957 - RNA, 22 nt, Human
agucccagccuaggcugugcug

SEQ ID NO: 377958 - RNA, 22 nt, Human
aauggcugggaguguauuuugg

SEQ ID NO: 377959 - RNA, 22 nt, Human
ugcaacuuguuuggagagaaag

SEQ ID NO: 377960 - RNA, 18 nt, Human
ucugggcuucccgaggcu

SEQ ID NO: 377961 - RNA, 22 nt, Human
caaauucucaagguuuauccca

SEQ ID NO: 377962 - RNA, 19 nt, Human
uccugcagaccagaccugu

SEQ ID NO: 377963 - RNA, 23 nt, Human
auucuucauuaucuucuagaaaa

SEQ ID NO: 377964 - RNA, 22 nt, Human
cugagccacugcuuguucagug

SEQ ID NO: 377965 - RNA, 22 nt, Human
gcguccagggaaggcccagcug

SEQ ID NO: 377966 - RNA, 22 nt, Human
agauacauuguucuaagcauug

SEQ ID NO: 377967 - RNA, 22 nt, Human
gagggcagagucuaaugaugca

SEQ ID NO: 377968 - RNA, 22 nt, Human
ucccagaggucucugcugguuc

SEQ ID NO: 377969 - RNA, 22 nt, Human
auucauuuagguauucacuuac

SEQ ID NO: 377970 - RNA, 21 nt, Human
ucagggcagcugcucuucaga

SEQ ID NO: 377971 - RNA, 22 nt, Human
gcagggacaacugugcaccuga

SEQ ID NO: 377972 - RNA, 22 nt, Human
ggcuuuaugcacagcagauggu

SEQ ID NO: 377973 - RNA, 22 nt, Human
cagaggcaggaagaugggcagu

SEQ ID NO: 377974 - RNA, 22 nt, Human
aauccugugugacucuggggag

SEQ ID NO: 377975 - RNA, 22 nt, Human
gcugucugcaucucuagagcuu

SEQ ID NO: 377976 - RNA, 22 nt, Human
uaucuaaauggaauauuccaga

SEQ ID NO: 377977 - RNA, 23 nt, Human
agaguccacaagauuuuccagug

SEQ ID NO: 377978 - RNA, 22 nt, Human
aggagcuguuuuguucagcaaa

SEQ ID NO: 377979 - RNA, 20 nt, Human
ccucaagcagacugacagcu

SEQ ID NO: 377980 - RNA, 22 nt, Human
gaggccaaguuggagaccaggu

SEQ ID NO: 377981 - RNA, 22 nt, Human
cccuucagcugagugggacagc

SEQ ID NO: 377982 - RNA, 22 nt, Human
ugcagugccucggcagugcagc

SEQ ID NO: 377983 - RNA, 22 nt, Human
uuuuccucuguuauuaguguga

SEQ ID NO: 377984 - RNA, 22 nt, Human
ccugccuggagcugagugugga

SEQ ID NO: 377985 - RNA, 21 nt, Human
gagauuuagaaggaucaauuu

SEQ ID NO: 377986 - RNA, 22 nt, Human
uggcagcuugaaugcagucuuu

SEQ ID NO: 377987 - RNA, 22 nt, Human
aaacaugcauucaagaaaaucu

SEQ ID NO: 377988 - RNA, 22 nt, Human
gcagguguggaguggggugagc

SEQ ID NO: 377989 - RNA, 20 nt, Human
ucagagucaucaaagauggu

SEQ ID NO: 377990 - RNA, 22 nt, Human
ugccacacucacuucuguggac

SEQ ID NO: 377991 - RNA, 22 nt, Human
gccuggagcucggcugagggcg

SEQ ID NO: 377992 - RNA, 22 nt, Human
aagcugcagacccccugucuca

SEQ ID NO: 377993 - RNA, 21 nt, Human
agagucugcauuucugacaag

SEQ ID NO: 377994 - RNA, 22 nt, Human
ccaggaggcagagguuacagug

SEQ ID NO: 377995 - RNA, 22 nt, Human
gcugcagcuuuaggauccagug

SEQ ID NO: 377996 - RNA, 22 nt, Human
ggcuccugggaugggacugagc

SEQ ID NO: 377997 - RNA, 22 nt, Human
uggcuucagacuucugcuacgu

SEQ ID NO: 377998 - RNA, 22 nt, Human
aaagcaaucagauucagauguc

SEQ ID NO: 377999 - RNA, 19 nt, Human
gagcgcagagggcagggga

SEQ ID NO: 378000 - RNA, 20 nt, Human
cauuaugguugggcacagug

SEQ ID NO: 378001 - RNA, 22 nt, Human
aggacagcccuugagagcacau

SEQ ID NO: 378002 - RNA, 22 nt, Human
ccuggcugggccugauuucuca

SEQ ID NO: 378003 - RNA, 22 nt, Human
caaagguaguauauauauuguu

SEQ ID NO: 378004 - RNA, 22 nt, Human
ccacagagagugucagccuuug

SEQ ID NO: 378005 - RNA, 22 nt, Human
ggagcugggacccugucaucug

SEQ ID NO: 378006 - RNA, 22 nt, Human
uaaauuauggcuggcagagcag

SEQ ID NO: 378007 - RNA, 22 nt, Human
uauguagaagcugcucaaagaa

SEQ ID NO: 378008 - RNA, 23 nt, Human
uagagcagggaaaucugucagag

SEQ ID NO: 378009 - RNA, 22 nt, Human
agccagcaugaagacagaggcc

SEQ ID NO: 378010 - RNA, 22 nt, Human
cucccucugucuuguccagaaa

SEQ ID NO: 378011 - RNA, 21 nt, Human
uggagcugccacuuguccucc

SEQ ID NO: 378012 - RNA, 17 nt, Human
ugaagaugcauggcagc

SEQ ID NO: 378013 - RNA, 22 nt, Human
uagcacauuguugaccagaagg

SEQ ID NO: 378014 - RNA, 22 nt, Human
uuguuucaggaugguuuguuac

SEQ ID NO: 378015 - RNA, 22 nt, Human
agacagcuaauaaaugagugug

SEQ ID NO: 378016 - RNA, 22 nt, Human
gcauagucaguaggauucucaa

SEQ ID NO: 378017 - RNA, 22 nt, Human
ccugggagguggagguugcagc

SEQ ID NO: 378018 - RNA, 22 nt, Human
gucaggauuggggucaugaguc

SEQ ID NO: 378019 - RNA, 22 nt, Human
aaggcucuuggagugaaugcag

SEQ ID NO: 378020 - RNA, 22 nt, Human
cagcacaauuuucaggagucca

SEQ ID NO: 378021 - RNA, 22 nt, Human
aaauauaauuucugccucaaua

SEQ ID NO: 378022 - RNA, 22 nt, Human
aguuauuacucuuuaacauauu

SEQ ID NO: 378023 - RNA, 22 nt, Human
uacuuccuguuuccaugucugu

SEQ ID NO: 378024 - RNA, 22 nt, Human
ccuggagcaaaaaucuaaggag

SEQ ID NO: 378025 - RNA, 22 nt, Human
cagcuguggagggaggaaaugc

SEQ ID NO: 378026 - RNA, 22 nt, Human
ggagccugcgggagcucccauu

SEQ ID NO: 378027 - RNA, 22 nt, Human
uucuaugccauguucagcuacu

SEQ ID NO: 378028 - RNA, 22 nt, Human
aaugaucuacucucauuaucuc

SEQ ID NO: 378029 - RNA, 22 nt, Human
uuuaguaaguucacugcaaagc

SEQ ID NO: 378030 - RNA, 22 nt, Human
gggcugugagaguggggcugcu

SEQ ID NO: 378031 - RNA, 22 nt, Human
ccuggcucuguccucgcgcaaa

SEQ ID NO: 378032 - RNA, 22 nt, Human
uacauaauaaggggcauggugu

SEQ ID NO: 378033 - RNA, 22 nt, Human
gccucccuggcccacagcagcg

SEQ ID NO: 378034 - RNA, 22 nt, Human
cagcagcagccccaggaagguu

SEQ ID NO: 378035 - RNA, 22 nt, Human
uuacagaagagaaagaauucag

SEQ ID NO: 378036 - RNA, 22 nt, Human
cuaaucaucuuucucuuaaagc

SEQ ID NO: 378037 - RNA, 22 nt, Human
ccuggcagacugugagggcagg

SEQ ID NO: 378038 - RNA, 20 nt, Human
cccagccccuaccuguugcc

SEQ ID NO: 378039 - RNA, 22 nt, Human
gcugagaguguaggauguuuac

SEQ ID NO: 378040 - RNA, 22 nt, Human
aaugcacagcguuccaugcuug

SEQ ID NO: 378041 - RNA, 22 nt, Human
caggccugugacaccgugucug

SEQ ID NO: 378042 - RNA, 22 nt, Human
gcagagccccucaagccagccu

SEQ ID NO: 378043 - RNA, 22 nt, Human
guagcuuauuagggauaauagu

SEQ ID NO: 378044 - RNA, 22 nt, Human
aaaaaugugaccacaggguguu

SEQ ID NO: 378045 - RNA, 22 nt, Human
auguucaaacaaguuaaugcca

SEQ ID NO: 378046 - RNA, 22 nt, Human
ggcuggccuguguggccgccac

SEQ ID NO: 378047 - RNA, 22 nt, Human
acuuguguaacacagaaagaac

SEQ ID NO: 378048 - RNA, 22 nt, Human
cccaggacucggcacucuccuu

SEQ ID NO: 378049 - RNA, 19 nt, Human
acauuuaaauucagaucuc

SEQ ID NO: 378050 - RNA, 23 nt, Human
aucaaacuggugagaaugucagu

SEQ ID NO: 378051 - RNA, 22 nt, Human
gggcagcuccuguggaauccac

SEQ ID NO: 378052 - RNA, 22 nt, Human
agggcagcauugccuuucucca

SEQ ID NO: 378053 - RNA, 22 nt, Human
gcccugugcgacucuagagguu

SEQ ID NO: 378054 - RNA, 22 nt, Human
ucaguggagcuaagcaugagau

SEQ ID NO: 378055 - RNA, 22 nt, Human
cagggcacaguuauggaggugg

SEQ ID NO: 378056 - RNA, 22 nt, Human
uuggauccaucucaggcauagg

SEQ ID NO: 378057 - RNA, 22 nt, Human
cagagagcuuagugugcugcau

SEQ ID NO: 378058 - RNA, 22 nt, Human
caucagaauguuagagaaggga

SEQ ID NO: 378059 - RNA, 22 nt, Human
uuucaaagaguuguaaauuacu

SEQ ID NO: 378060 - RNA, 22 nt, Human
uuuaauauucugcauucuccuu

SEQ ID NO: 378061 - RNA, 22 nt, Human
uuuuaucuucauuccuaucuac

SEQ ID NO: 378062 - RNA, 22 nt, Human
cuccaggagggggauggcugua

SEQ ID NO: 378063 - RNA, 22 nt, Human
ugccugggagugaccaagacuc

SEQ ID NO: 378064 - RNA, 22 nt, Human
gggcacuguacacugugcaugg

SEQ ID NO: 378065 - RNA, 22 nt, Human
uccaggcagagcaacaaaauau

SEQ ID NO: 378066 - RNA, 22 nt, Human
ugaagccacagagcaucugccu

SEQ ID NO: 378067 - RNA, 22 nt, Human
augauacaucuucaugucagug

SEQ ID NO: 378068 - RNA, 22 nt, Human
gcagagccugugucugagcaaa

SEQ ID NO: 378069 - RNA, 22 nt, Human
cuggcuuucauuucaagcacgu

SEQ ID NO: 378070 - RNA, 22 nt, Human
agggcagaaaucgauuacaccu

SEQ ID NO: 378071 - RNA, 22 nt, Human
ugcugucuuccaggauggugaa

SEQ ID NO: 378072 - RNA, 22 nt, Human
aggugauguccacagcuugcag

SEQ ID NO: 378073 - RNA, 23 nt, Human
ggccucuguguucugcccacaug

SEQ ID NO: 378074 - RNA, 22 nt, Human
auauuucuugagcaccugguau

SEQ ID NO: 378075 - RNA, 22 nt, Human
uaucuguuaggaucagagcugg

SEQ ID NO: 378076 - RNA, 22 nt, Human
cagcugccacaccucuuucucu

SEQ ID NO: 378077 - RNA, 22 nt, Human
uuguugguggaauugaugcuag

SEQ ID NO: 378078 - RNA, 22 nt, Human
gaggcagcuuaggguacugacu

SEQ ID NO: 378079 - RNA, 19 nt, Human
cagagccucagagcuagaa

SEQ ID NO: 378080 - RNA, 23 nt, Human
cacuccuguuucuaagccagcau

SEQ ID NO: 378081 - RNA, 22 nt, Human
agaggcuccuagccacuggcuu

SEQ ID NO: 378082 - RNA, 22 nt, Human
cugggagguggagguugcauug

SEQ ID NO: 378083 - RNA, 22 nt, Human
agcagcugagccccagcuguga

SEQ ID NO: 378084 - RNA, 22 nt, Human
gggaccuggcaccuuugcucug

SEQ ID NO: 378085 - RNA, 22 nt, Human
cagggcuguaaauuagugcuga

SEQ ID NO: 378086 - RNA, 22 nt, Human
ccagguguggggaggacucaca

SEQ ID NO: 378087 - RNA, 22 nt, Human
aaugggaggauuuucucucuug

SEQ ID NO: 378088 - RNA, 22 nt, Human
gggagagguuacccgagcaacu

SEQ ID NO: 378089 - RNA, 22 nt, Human
ugcagcuucuccaucuccuugu

SEQ ID NO: 378090 - RNA, 22 nt, Human
auguuaaauaaucccuuaaagc

SEQ ID NO: 378091 - RNA, 19 nt, Human
ggccaggcugacugugguc

SEQ ID NO: 378092 - RNA, 22 nt, Human
uaggcagagguaugguaaggac

SEQ ID NO: 378093 - RNA, 22 nt, Human
gggcugaggcuaccacuggucu

SEQ ID NO: 378094 - RNA, 22 nt, Human
aggagccccucuucaguccugg

SEQ ID NO: 378095 - RNA, 22 nt, Human
ucagugaucuaaggguauggcc

SEQ ID NO: 378096 - RNA, 22 nt, Human
uggauuagugcugaaaugaugg

SEQ ID NO: 378097 - RNA, 22 nt, Human
agcagccaagguaaccugugcu

SEQ ID NO: 378098 - RNA, 22 nt, Human
cugcaggcugagcgccugccgg

SEQ ID NO: 378099 - RNA, 22 nt, Human
uuagcugcauuaucaaaguuau

SEQ ID NO: 378100 - RNA, 22 nt, Human
cacagguguaugaauaugucca

SEQ ID NO: 378101 - RNA, 22 nt, Human
gagagcuguguucauucuacca

SEQ ID NO: 378102 - RNA, 22 nt, Human
cagggagcuggcuggcgugagu

SEQ ID NO: 378103 - RNA, 22 nt, Human
gcugucuguggugucagcugac

SEQ ID NO: 378104 - RNA, 22 nt, Human
gcccagaaguugaggcugcagu

SEQ ID NO: 378105 - RNA, 22 nt, Human
gagggggagaugugcacacacu

SEQ ID NO: 378106 - RNA, 20 nt, Human
uguacacaguacuuuacaau

SEQ ID NO: 378107 - RNA, 22 nt, Human
aauucuauguucuugaguaaga

SEQ ID NO: 378108 - RNA, 22 nt, Human
aaagauuugaaauuaggcauca

SEQ ID NO: 378109 - RNA, 22 nt, Human
caucaucaaaagugacagagaa

SEQ ID NO: 378110 - RNA, 22 nt, Human
cucagagaagucuuugcuaaac

SEQ ID NO: 378111 - RNA, 22 nt, Human
aagacugugucuauggcuacuc

SEQ ID NO: 378112 - RNA, 22 nt, Human
cuuauguaugcuacuuuguggu

SEQ ID NO: 378113 - RNA, 18 nt, Human
caauuucaauggucugaa

SEQ ID NO: 378114 - RNA, 22 nt, Human
aagauuucugcuuuuggaggca

SEQ ID NO: 378115 - RNA, 22 nt, Human
cuggccuucagacucggacuga

SEQ ID NO: 378116 - RNA, 22 nt, Human
uggcugggcccccaccugccuc

SEQ ID NO: 378117 - RNA, 22 nt, Human
ugaggcuccagccaggccagca

SEQ ID NO: 378118 - RNA, 19 nt, Human
ccaggccuggcgucuccgc

SEQ ID NO: 378119 - RNA, 22 nt, Human
cccugccuucuuggccuuuaaa

SEQ ID NO: 378120 - RNA, 22 nt, Human
uaagaacagugacagccaacau

SEQ ID NO: 378121 - RNA, 22 nt, Human
gaugcacaugugaguauagaag

SEQ ID NO: 378122 - RNA, 22 nt, Human
guccagugacaaguagcuggcc

SEQ ID NO: 378123 - RNA, 22 nt, Human
cacagcugcacagaggaggugc

SEQ ID NO: 378124 - RNA, 22 nt, Human
aucuggcucucucauuuacaaa

SEQ ID NO: 378125 - RNA, 22 nt, Human
aaauucaauuaacuuucaugcu

SEQ ID NO: 378126 - RNA, 22 nt, Human
ucaucuaagagucuuacauuua

SEQ ID NO: 378127 - RNA, 22 nt, Human
uuugcauuuuagauuuaggccu

SEQ ID NO: 378128 - RNA, 22 nt, Human
uccugucugucuuuggucccuu

SEQ ID NO: 378129 - RNA, 22 nt, Human
ggcagcucaccucugguccagg

SEQ ID NO: 378130 - RNA, 22 nt, Human
ccaaagcaagucacaugaucaa

SEQ ID NO: 378131 - RNA, 20 nt, Human
guggccucucacauucugag

SEQ ID NO: 378132 - RNA, 18 nt, Human
aggcaggugcuggaaguc

SEQ ID NO: 378133 - RNA, 22 nt, Human
gccaaaucacagggccaaaagc

SEQ ID NO: 378134 - RNA, 21 nt, Human
aaaaugugagcgugaugcuua

SEQ ID NO: 378135 - RNA, 22 nt, Human
aaagaaggaccuggaggaggau

SEQ ID NO: 378136 - RNA, 23 nt, Human
auauggcuguuguguguuaacau

SEQ ID NO: 378137 - RNA, 22 nt, Human
agagccugcaucaggcuugggg

SEQ ID NO: 378138 - RNA, 22 nt, Human
gggcagagacucagaaacagaa

SEQ ID NO: 378139 - RNA, 22 nt, Human
aagcuuuaaggaauuuuaugga

SEQ ID NO: 378140 - RNA, 22 nt, Human
auggcagcaaaugucuggcugg

SEQ ID NO: 378141 - RNA, 22 nt, Human
gagagggagccagccaggaacc

SEQ ID NO: 378142 - RNA, 21 nt, Human
aggaaaggccagcacguaggg

SEQ ID NO: 378143 - RNA, 22 nt, Human
guaggcagauaggagugcagcc

SEQ ID NO: 378144 - RNA, 22 nt, Human
ucucuuaauuuuggaauagugu

SEQ ID NO: 378145 - RNA, 22 nt, Human
uccaggaguuugagacugcagu

SEQ ID NO: 378146 - RNA, 22 nt, Human
uuccaaaguuaguuauuagaaa

SEQ ID NO: 378147 - RNA, 22 nt, Human
auuaaauuagcaaacugugaaa

SEQ ID NO: 378148 - RNA, 22 nt, Human
ccauuuguucgcccagcuccaa

SEQ ID NO: 378149 - RNA, 23 nt, Human
ccuggcuggauucucugcauuca

SEQ ID NO: 378150 - RNA, 22 nt, Human
ugagauguaagguaugcuuacu

SEQ ID NO: 378151 - RNA, 22 nt, Human
gccugcagccucagagaauuuu

SEQ ID NO: 378152 - RNA, 22 nt, Human
ugauuuaugcauuauacuguug

SEQ ID NO: 378153 - RNA, 22 nt, Human
aggggagaguuaaugugaaugu

SEQ ID NO: 378154 - RNA, 22 nt, Human
agcugccagcaucccggaaggg

SEQ ID NO: 378155 - RNA, 22 nt, Human
auuacaagaugcauccauauuu

SEQ ID NO: 378156 - RNA, 22 nt, Human
ugcugccuuugggaccuggccu

SEQ ID NO: 378157 - RNA, 22 nt, Human
gccuggagcccaguguggggcu

SEQ ID NO: 378158 - RNA, 22 nt, Human
uggagaugaauauguguaccug

SEQ ID NO: 378159 - RNA, 22 nt, Human
ugggaccugaagcagguuggca

SEQ ID NO: 378160 - RNA, 22 nt, Human
ugcagggaaaguguuggcagca

SEQ ID NO: 378161 - RNA, 17 nt, Human
ugcuuaauuuugacugg

SEQ ID NO: 378162 - RNA, 22 nt, Human
gcugagugauugauauuuuagu

SEQ ID NO: 378163 - RNA, 22 nt, Human
caugucuuuguuaugcucacca

SEQ ID NO: 378164 - RNA, 22 nt, Human
gcagcuuucugcaaugucaucc

SEQ ID NO: 378165 - RNA, 23 nt, Human
uguaacaauuucauauacaugca

SEQ ID NO: 378166 - RNA, 22 nt, Human
caaaugcuggcccugcuacuua

SEQ ID NO: 378167 - RNA, 22 nt, Human
cccagcuccuuggaugggcagg

SEQ ID NO: 378168 - RNA, 20 nt, Human
gcugccuguuucuguaagua

SEQ ID NO: 378169 - RNA, 22 nt, Human
agaggcucugccgccucaggua

SEQ ID NO: 378170 - RNA, 22 nt, Human
uuucuagaggcuccaggggagu

SEQ ID NO: 378171 - RNA, 22 nt, Human
gcuuugaagucugugucuuuug

SEQ ID NO: 378172 - RNA, 22 nt, Human
ugggccaggcaugugaucagca

SEQ ID NO: 378173 - RNA, 22 nt, Human
gagggccaacuagcaccacuuu

SEQ ID NO: 378174 - RNA, 22 nt, Human
aggugccagaugcacagcugaa

SEQ ID NO: 378175 - RNA, 22 nt, Human
aaaggcauuuuaauucuaaaga

SEQ ID NO: 378176 - RNA, 22 nt, Human
gaagaaggugcuacacagggca

SEQ ID NO: 378177 - RNA, 22 nt, Human
ugcaccccauuuuacauuuaca

SEQ ID NO: 378178 - RNA, 22 nt, Human
auuucucacucacaguccaugu

SEQ ID NO: 378179 - RNA, 22 nt, Human
uccagccacucagcagggauug

SEQ ID NO: 378180 - RNA, 22 nt, Human
ucacauuuguuccucugcacuu

SEQ ID NO: 378181 - RNA, 22 nt, Human
gcaccugggacccagaggcacc

SEQ ID NO: 378182 - RNA, 22 nt, Human
uagucuuuugagaaguauaucu

SEQ ID NO: 378183 - RNA, 22 nt, Human
guggccucugugcuccugccua

SEQ ID NO: 378184 - RNA, 22 nt, Human
cacccagcacagagggaggcga

SEQ ID NO: 378185 - RNA, 22 nt, Human
aacauucuauuuugcuaaaaca

SEQ ID NO: 378186 - RNA, 22 nt, Human
aggacccugagcgggcaugccg

SEQ ID NO: 378187 - RNA, 22 nt, Human
aggcucugcagugcuggaggac

SEQ ID NO: 378188 - RNA, 21 nt, Human
uggccaaacuggagcauuuga

SEQ ID NO: 378189 - RNA, 22 nt, Human
ggaaggucgagcugcaucuggc

SEQ ID NO: 378190 - RNA, 22 nt, Human
ucuuugcaugugcuucuuggcc

SEQ ID NO: 378191 - RNA, 20 nt, Human
aguuauaguaucuagccaug

SEQ ID NO: 378192 - RNA, 22 nt, Human
gcugcugugccuggcguccugu

SEQ ID NO: 378193 - RNA, 22 nt, Human
uuucaaguguccugauuaaugg

SEQ ID NO: 378194 - RNA, 22 nt, Human
ugcuauacggagcaucuucagg

SEQ ID NO: 378195 - RNA, 22 nt, Human
cagcaggguauacagggaauuu

SEQ ID NO: 378196 - RNA, 22 nt, Human
cuggagagaaaugacaaagcua

SEQ ID NO: 378197 - RNA, 22 nt, Human
gaggcuggaauauuagaaaugu

SEQ ID NO: 378198 - RNA, 22 nt, Human
ggaggcuccacugcucuuccug

SEQ ID NO: 378199 - RNA, 22 nt, Human
auuauagaggguuacaguuaau

SEQ ID NO: 378200 - RNA, 22 nt, Human
uagugcuuaacacaaagugauu

SEQ ID NO: 378201 - RNA, 22 nt, Human
cagggucuuauaaggccaauuu

SEQ ID NO: 378202 - RNA, 22 nt, Human
ggacacaagcuccggggcugca

SEQ ID NO: 378203 - RNA, 19 nt, Human
agcagcuggagguggagug

SEQ ID NO: 378204 - RNA, 22 nt, Human
cauuagggucucucagcugaau

SEQ ID NO: 378205 - RNA, 22 nt, Human
ugucuuuggaauauuuagcuga

SEQ ID NO: 378206 - RNA, 22 nt, Human
agaggccuaauugcuacccuuu

SEQ ID NO: 378207 - RNA, 22 nt, Human
uggcucagcgguggcagcagac

SEQ ID NO: 378208 - RNA, 22 nt, Human
gcaggggcugagcaccagcggg

SEQ ID NO: 378209 - RNA, 23 nt, Human
uauuacaauuggucuuauuaaga

SEQ ID NO: 378210 - RNA, 22 nt, Human
cagugcaguggcugagcuggag

SEQ ID NO: 378211 - RNA, 22 nt, Human
gagaaggacuacacaucuggcc

SEQ ID NO: 378212 - RNA, 22 nt, Human
cuguauuucccacauucucuau

SEQ ID NO: 378213 - RNA, 22 nt, Human
acccaggaaaacauggugcaga

SEQ ID NO: 378214 - RNA, 22 nt, Human
cuggaucaugggaaagggauca

SEQ ID NO: 378215 - RNA, 22 nt, Human
auacagaauucacuacaguuuc

SEQ ID NO: 378216 - RNA, 22 nt, Human
caugcagugacucagacacagg

SEQ ID NO: 378217 - RNA, 22 nt, Human
aacauauaaacucuuaaguuca

SEQ ID NO: 378218 - RNA, 22 nt, Human
uacugugaauacaaaauaaauu

SEQ ID NO: 378219 - RNA, 22 nt, Human
uuuuccuaguaggccuauuaga

SEQ ID NO: 378220 - RNA, 22 nt, Human
ugaggaagggugugacggcacc

SEQ ID NO: 378221 - RNA, 22 nt, Human
cacauuuaauccuuuauaagua

SEQ ID NO: 378222 - RNA, 22 nt, Human
ucuauacugaugggauacuauu

SEQ ID NO: 378223 - RNA, 22 nt, Human
uuauauaaagauaacuuuucuu

SEQ ID NO: 378224 - RNA, 22 nt, Human
augugaggaagaaagagguaag

SEQ ID NO: 378225 - RNA, 21 nt, Human
ucuuuccugcccaguugcccu

SEQ ID NO: 378226 - RNA, 22 nt, Human
aggagccuccuucucaugugca

SEQ ID NO: 378227 - RNA, 22 nt, Human
uucugggagagaaagggccuug

SEQ ID NO: 378228 - RNA, 22 nt, Human
uguaggaguccaaucaggagac

SEQ ID NO: 378229 - RNA, 22 nt, Human
uaauuucacugauaugaaguca

SEQ ID NO: 378230 - RNA, 22 nt, Human
auuugcaaagucguaucuguga

SEQ ID NO: 378231 - RNA, 22 nt, Human
ugccuuccuggagcugaaggcu

SEQ ID NO: 378232 - RNA, 22 nt, Human
ugccauuuugagauguuaauga

SEQ ID NO: 378233 - RNA, 19 nt, Human
caguggagauuggaggagg

SEQ ID NO: 378234 - RNA, 22 nt, Human
augaggcaggagugcaguggca

SEQ ID NO: 378235 - RNA, 22 nt, Human
ggagaaggaagaaagcuacuau

SEQ ID NO: 378236 - RNA, 22 nt, Human
gagaggcaggcgcugcaauggu

SEQ ID NO: 378237 - RNA, 22 nt, Human
gggcuccaccuagggacacugg

SEQ ID NO: 378238 - RNA, 22 nt, Human
uuaacacuccuaacuacagucu

SEQ ID NO: 378239 - RNA, 22 nt, Human
cagcccugcacgcugccuccgc

SEQ ID NO: 378240 - RNA, 21 nt, Human
agcuuccugcagugggagguc

SEQ ID NO: 378241 - RNA, 22 nt, Human
guccugucccccaaggcugugg

SEQ ID NO: 378242 - RNA, 22 nt, Human
cugcuguggugucaagcaucuc

SEQ ID NO: 378243 - RNA, 22 nt, Human
ugguccugagcaccagccugac

SEQ ID NO: 378244 - RNA, 22 nt, Human
guaauuaggaauaaaaugggaa

SEQ ID NO: 378245 - RNA, 19 nt, Human
ggcugggucuggcagguuc

SEQ ID NO: 378246 - RNA, 22 nt, Human
agccacaccuguccugccagcu

SEQ ID NO: 378247 - RNA, 22 nt, Human
aaagccagaguguguuagagac

SEQ ID NO: 378248 - RNA, 22 nt, Human
gcauugucaaaagugguaugac

SEQ ID NO: 378249 - RNA, 19 nt, Human
gagggcucauuugaacaau

SEQ ID NO: 378250 - RNA, 22 nt, Human
uggcucuggggacaguaagucc

SEQ ID NO: 378251 - RNA, 22 nt, Human
ugagaauuacaaaugagucaca

SEQ ID NO: 378252 - RNA, 22 nt, Human
gcugccacuuggucaugucaug

SEQ ID NO: 378253 - RNA, 22 nt, Human
caauuucucgaacucuaaucca

SEQ ID NO: 378254 - RNA, 22 nt, Human
uuugaaagggaaauaaacuccu

SEQ ID NO: 378255 - RNA, 22 nt, Human
gcugucuucacuuccugguuuc

SEQ ID NO: 378256 - RNA, 22 nt, Human
ucugagaguccaucuccaagcc

SEQ ID NO: 378257 - RNA, 22 nt, Human
ggauggagguucucagaugcuc

SEQ ID NO: 378258 - RNA, 22 nt, Human
agagcaucuaacacauaagccu

SEQ ID NO: 378259 - RNA, 22 nt, Human
agcugcaguaaagcucuccagg

SEQ ID NO: 378260 - RNA, 22 nt, Human
gccugcagaggugcugcuagcu

SEQ ID NO: 378261 - RNA, 17 nt, Human
gcuuccucaugcaguuc

SEQ ID NO: 378262 - RNA, 22 nt, Human
uaugaaaagguggccaauguag

SEQ ID NO: 378263 - RNA, 22 nt, Human
gggcagcuguaucugagcuuau

SEQ ID NO: 378264 - RNA, 19 nt, Human
ccagcagguucauuucagg

SEQ ID NO: 378265 - RNA, 22 nt, Human
caguuuauaugucagagcugua

SEQ ID NO: 378266 - RNA, 20 nt, Human
uuaagaaaagcacauccugc

SEQ ID NO: 378267 - RNA, 22 nt, Human
ccaccagcagugugcaaggauu

SEQ ID NO: 378268 - RNA, 21 nt, Human
acaugucuggucauuuuuagc

SEQ ID NO: 378269 - RNA, 22 nt, Human
ccaggcugggcuacaaguugag

SEQ ID NO: 378270 - RNA, 22 nt, Human
uuacagaaguauugagagaucc

SEQ ID NO: 378271 - RNA, 22 nt, Human
aacauucugguucuaaaaaccu

SEQ ID NO: 378272 - RNA, 22 nt, Human
gaggccugggagccuguccucc

SEQ ID NO: 378273 - RNA, 22 nt, Human
cagcaggaaacuuaaagguaau

SEQ ID NO: 378274 - RNA, 22 nt, Human
ccuggccuggcacucccucugc

SEQ ID NO: 378275 - RNA, 22 nt, Human
cugggaggcccacguugggaag

SEQ ID NO: 378276 - RNA, 22 nt, Human
aaaggagacuucagaucuccuu

SEQ ID NO: 378277 - RNA, 22 nt, Human
agagcuggccagggaucacucu

SEQ ID NO: 378278 - RNA, 22 nt, Human
ugaguacucggagugcuuugga

SEQ ID NO: 378279 - RNA, 22 nt, Human
gggauggggggaagcguccaug

SEQ ID NO: 378280 - RNA, 22 nt, Human
acuaaacugaagcaugaaaagg

SEQ ID NO: 378281 - RNA, 22 nt, Human
cagcuccugcagcugcugccgu

SEQ ID NO: 378282 - RNA, 22 nt, Human
ggcagggguccugguguugacu

SEQ ID NO: 378283 - RNA, 22 nt, Human
ccaggcagcaaauuuucugaau

SEQ ID NO: 378284 - RNA, 22 nt, Human
gcaggagcagucaggggcagcu

SEQ ID NO: 378285 - RNA, 22 nt, Human
guuaaauucgaugauggauaaa

SEQ ID NO: 378286 - RNA, 21 nt, Human
augucaaaugcuuuauuuuau

SEQ ID NO: 378287 - RNA, 23 nt, Human
aggagccaggugcagcccuugug

SEQ ID NO: 378288 - RNA, 18 nt, Human
gcugagguggugucagag

SEQ ID NO: 378289 - RNA, 21 nt, Human
ugauccuuucccccauguugc

SEQ ID NO: 378290 - RNA, 22 nt, Human
uaguaucuuucuauauuuccca

SEQ ID NO: 378291 - RNA, 22 nt, Human
cucagcagugacaagagaguau

SEQ ID NO: 378292 - RNA, 22 nt, Human
auacaucuuccuuuuaaaaugc

SEQ ID NO: 378293 - RNA, 22 nt, Human
uucauugucucuguuugccuuc

SEQ ID NO: 378294 - RNA, 22 nt, Human
uaucagaaaucaacacacagug

SEQ ID NO: 378295 - RNA, 22 nt, Human
aggcugugcaauuaggguaaga

SEQ ID NO: 378296 - RNA, 22 nt, Human
agcagcauggcugacuaaagac

SEQ ID NO: 378297 - RNA, 22 nt, Human
gaggccaggguaccaucaacau

SEQ ID NO: 378298 - RNA, 22 nt, Human
cacuguguaagaagaugggcuu

SEQ ID NO: 378299 - RNA, 22 nt, Human
ucaggagaaaauaucaggaagu

SEQ ID NO: 378300 - RNA, 22 nt, Human
ucuguucaagacugaggugaca

SEQ ID NO: 378301 - RNA, 22 nt, Human
ugagacaguuuuucuauuucca

SEQ ID NO: 378302 - RNA, 22 nt, Human
ugcuuaaacccugaucaugugu

SEQ ID NO: 378303 - RNA, 22 nt, Human
cccagcuccgagcuccgagccg

SEQ ID NO: 378304 - RNA, 22 nt, Human
gcaucuuucuguccauucagca

SEQ ID NO: 378305 - RNA, 22 nt, Human
acugaaggaagcgggcaggggu

SEQ ID NO: 378306 - RNA, 22 nt, Human
uguggccagcagguggcugugu

SEQ ID NO: 378307 - RNA, 22 nt, Human
uaaaugugagugaugcggugaa

SEQ ID NO: 378308 - RNA, 21 nt, Human
gccagagcaguacaaugaggu

SEQ ID NO: 378309 - RNA, 22 nt, Human
gccagcuggagacuggcagggg

SEQ ID NO: 378310 - RNA, 22 nt, Human
cuggcuggccggagcgaggcgg

SEQ ID NO: 378311 - RNA, 22 nt, Human
acauuugucuucuuucagauua

SEQ ID NO: 378312 - RNA, 22 nt, Human
gucuucuuguuuugaaggaaau

SEQ ID NO: 378313 - RNA, 22 nt, Human
cucuuuccucagccacagucua

SEQ ID NO: 378314 - RNA, 22 nt, Human
uugcauugcuuggucuucaaga

SEQ ID NO: 378315 - RNA, 22 nt, Human
cccaggcagugcugaucccuca

SEQ ID NO: 378316 - RNA, 22 nt, Human
aguaugaacggaaggccuggga

SEQ ID NO: 378317 - RNA, 22 nt, Human
ucacaaauagcuauauuaagga

SEQ ID NO: 378318 - RNA, 22 nt, Human
ucugccuggaugauggcagggc

SEQ ID NO: 378319 - RNA, 22 nt, Human
uggcagcaaaaccagaaucaga

SEQ ID NO: 378320 - RNA, 22 nt, Human
cccagcucucgcacuuacuagc

SEQ ID NO: 378321 - RNA, 22 nt, Human
aguggagacaggacagucgaua

SEQ ID NO: 378322 - RNA, 22 nt, Human
uuuauuuggcauccagggagaa

SEQ ID NO: 378323 - RNA, 22 nt, Human
ccacugaaggucaacauagagc

SEQ ID NO: 378324 - RNA, 22 nt, Human
auacuguuuugugacuuaucuu

SEQ ID NO: 378325 - RNA, 22 nt, Human
ucaccagggagcuuguccucug

SEQ ID NO: 378326 - RNA, 20 nt, Human
ccugggguacacuggcaugu

SEQ ID NO: 378327 - RNA, 22 nt, Human
uccaggcauaagccuugagugu

SEQ ID NO: 378328 - RNA, 22 nt, Human
aaauugcauuuuaaagguagau

SEQ ID NO: 378329 - RNA, 22 nt, Human
gugugccaccagucaaggugaa

SEQ ID NO: 378330 - RNA, 22 nt, Human
cagcaggaggugaguagcaggu

SEQ ID NO: 378331 - RNA, 20 nt, Human
uuucaguuaucuugaccuuc

SEQ ID NO: 378332 - RNA, 22 nt, Human
aaccauuugccauuaucuuaag

SEQ ID NO: 378333 - RNA, 22 nt, Human
aauuucagagguagagauucua

SEQ ID NO: 378334 - RNA, 22 nt, Human
gcugggagaggcccugaaguga

SEQ ID NO: 378335 - RNA, 22 nt, Human
uuuuccucaggaaugcuaagcu

SEQ ID NO: 378336 - RNA, 22 nt, Human
aguggagaagaggauggucucc

SEQ ID NO: 378337 - RNA, 22 nt, Human
aaguccagcagugcuuguugau

SEQ ID NO: 378338 - RNA, 22 nt, Human
cuuucauucuuagauauuagug

SEQ ID NO: 378339 - RNA, 22 nt, Human
cgggcagaucacacagggcuug

SEQ ID NO: 378340 - RNA, 22 nt, Human
guucuucagucacaucacagaa

SEQ ID NO: 378341 - RNA, 22 nt, Human
ugugaaaagcaggcuacuuucu

SEQ ID NO: 378342 - RNA, 22 nt, Human
uagucucugcuuugcccuuggc

SEQ ID NO: 378343 - RNA, 19 nt, Human
caaggguugggucugucau

SEQ ID NO: 378344 - RNA, 22 nt, Human
uugaaaggugcugugugcugau

SEQ ID NO: 378345 - RNA, 22 nt, Human
guauuugauagauuucaaagga

SEQ ID NO: 378346 - RNA, 22 nt, Human
ucagggcauacucuucaagguc

SEQ ID NO: 378347 - RNA, 22 nt, Human
gcagaaggauccgcaggugcaa

SEQ ID NO: 378348 - RNA, 22 nt, Human
uccagcagaaaagagguaggga

SEQ ID NO: 378349 - RNA, 22 nt, Human
acaaauaugguacucggagaaa

SEQ ID NO: 378350 - RNA, 22 nt, Human
ccagugcuaagguagccucugc

SEQ ID NO: 378351 - RNA, 22 nt, Human
aaagucauuggaauauuaauga

SEQ ID NO: 378352 - RNA, 22 nt, Human
agucucugcaugaugcagcaca

SEQ ID NO: 378353 - RNA, 22 nt, Human
gggaccuggacaugugugugcu

SEQ ID NO: 378354 - RNA, 22 nt, Human
caggcgagugaacagacucuca

SEQ ID NO: 378355 - RNA, 22 nt, Human
ugggggagccuucacaguagcu

SEQ ID NO: 378356 - RNA, 22 nt, Human
ugucuucaucuccaugcacaga

SEQ ID NO: 378357 - RNA, 22 nt, Human
agcucagggcgaucugucucgg

SEQ ID NO: 378358 - RNA, 22 nt, Human
ccaugagacagcaacugaaagu

SEQ ID NO: 378359 - RNA, 22 nt, Human
auucuucacaaauauauagaag

SEQ ID NO: 378360 - RNA, 22 nt, Human
agcccuggcccggcugugcuuu

SEQ ID NO: 378361 - RNA, 22 nt, Human
cagaguggcagucccaggccca

SEQ ID NO: 378362 - RNA, 22 nt, Human
uaaauuaugucacaugacucug

SEQ ID NO: 378363 - RNA, 22 nt, Human
ugccugcucuuaccacucuccc

SEQ ID NO: 378364 - RNA, 22 nt, Human
gcuccugggcucuaccuugcua

SEQ ID NO: 378365 - RNA, 22 nt, Human
gugcaugugucuuuauaguaga

SEQ ID NO: 378366 - RNA, 22 nt, Human
ucacaccaguuuccuuucaauu

SEQ ID NO: 378367 - RNA, 22 nt, Human
acaggcuuacaggcugcaagua

SEQ ID NO: 378368 - RNA, 22 nt, Human
agaugaaagauuuuuauagaga

SEQ ID NO: 378369 - RNA, 22 nt, Human
ucuggaucaccacuucugccuc

SEQ ID NO: 378370 - RNA, 22 nt, Human
cauuugaaauucuuagaacaaa

SEQ ID NO: 378371 - RNA, 22 nt, Human
ucaguaaaugguugcuguuauu

SEQ ID NO: 378372 - RNA, 22 nt, Human
gagauguacaauguguauuaau

SEQ ID NO: 378373 - RNA, 22 nt, Human
augcaguacugauacaugccac

SEQ ID NO: 378374 - RNA, 22 nt, Human
ucaggcagguuggcugcagguc

SEQ ID NO: 378375 - RNA, 18 nt, Human
auggucucauacugggag

SEQ ID NO: 378376 - RNA, 22 nt, Human
ccuggccucgugcucacggcuc

SEQ ID NO: 378377 - RNA, 22 nt, Human
aggcagccagauggcagccugc

SEQ ID NO: 378378 - RNA, 22 nt, Human
cagugcaggcugggggcccugc

SEQ ID NO: 378379 - RNA, 22 nt, Human
gagagcuguccggcugagcagc

SEQ ID NO: 378380 - RNA, 22 nt, Human
aggcugagguaggaggaucgcu

SEQ ID NO: 378381 - RNA, 22 nt, Human
auucacaauuagaaguagauaa

SEQ ID NO: 378382 - RNA, 22 nt, Human
auuaucuauguagaaugauuuu

SEQ ID NO: 378383 - RNA, 22 nt, Human
agcuuuauuugucauucacggc

SEQ ID NO: 378384 - RNA, 22 nt, Human
auauauuuacucuccuguugca

SEQ ID NO: 378385 - RNA, 22 nt, Human
cauggccucaaaggacugcaga

SEQ ID NO: 378386 - RNA, 22 nt, Human
gggcucuggauggagccugcag

SEQ ID NO: 378387 - RNA, 22 nt, Human
gcccugagggguggugucugua

SEQ ID NO: 378388 - RNA, 22 nt, Human
cucaggacccgguccagguggg

SEQ ID NO: 378389 - RNA, 22 nt, Human
ucaguaacuuacuuauucaccu

SEQ ID NO: 378390 - RNA, 22 nt, Human
uucuaccuacccucugcauaca

SEQ ID NO: 378391 - RNA, 23 nt, Human
ugggcagcuucugcaugcccacc

SEQ ID NO: 378392 - RNA, 22 nt, Human
ggaggcugcugccucacguggg

SEQ ID NO: 378393 - RNA, 22 nt, Human
uccagggaagagcagaggcuac

SEQ ID NO: 378394 - RNA, 22 nt, Human
uggcucaggccuacgacgccuu

SEQ ID NO: 378395 - RNA, 22 nt, Human
gugaauaacuuucuauguuaau

SEQ ID NO: 378396 - RNA, 22 nt, Human
aaggcagcagugcacgacugau

SEQ ID NO: 378397 - RNA, 22 nt, Human
acaugcuuguuuuucacaaccu

SEQ ID NO: 378398 - RNA, 19 nt, Human
ucacaggcaucuccccaga

SEQ ID NO: 378399 - RNA, 22 nt, Human
uuccucaugggguuccuucaga

SEQ ID NO: 378400 - RNA, 22 nt, Human
acugggaggcaaagagcaagga

SEQ ID NO: 378401 - RNA, 22 nt, Human
ugccaggcuuagagcaggggcu

SEQ ID NO: 378402 - RNA, 22 nt, Human
ucugggcuuuacacugugcuua

SEQ ID NO: 378403 - RNA, 22 nt, Human
aacagugagaagguggacagga

SEQ ID NO: 378404 - RNA, 22 nt, Human
acaaaugcaaguuuuaugucaa

SEQ ID NO: 378405 - RNA, 22 nt, Human
gcagggcacaaggacgcacagg

SEQ ID NO: 378406 - RNA, 22 nt, Human
caggagcaugcugaugccagaa

SEQ ID NO: 378407 - RNA, 22 nt, Human
cccaguuucaacuuuccagugg

SEQ ID NO: 378408 - RNA, 22 nt, Human
auuuguugcuagcagcacugau

SEQ ID NO: 378409 - RNA, 22 nt, Human
cagcagcaguggcugcagaaca

SEQ ID NO: 378410 - RNA, 22 nt, Human
cagcagagacgguaagcagaac

SEQ ID NO: 378411 - RNA, 22 nt, Human
ugugacaucgcugugucuguuu

SEQ ID NO: 378412 - RNA, 23 nt, Human
acucagagaccccgggaagugac

SEQ ID NO: 378413 - RNA, 22 nt, Human
aauuucaaacucuugcccucag

SEQ ID NO: 378414 - RNA, 22 nt, Human
agggccuggcuucacuuucuca

SEQ ID NO: 378415 - RNA, 22 nt, Human
auggcaggcccagguguucauu

SEQ ID NO: 378416 - RNA, 22 nt, Human
aggggacacggcuucuccaggg

SEQ ID NO: 378417 - RNA, 22 nt, Human
ucuucacaggagccugccugcc

SEQ ID NO: 378418 - RNA, 22 nt, Human
auacagaaaaugaugcagaguu

SEQ ID NO: 378419 - RNA, 22 nt, Human
uuugcauuucucguaaggaaac

SEQ ID NO: 378420 - RNA, 22 nt, Human
uuacauaacgguaugaaaaaug

SEQ ID NO: 378421 - RNA, 19 nt, Human
uguagcaguuuaaaacaac

SEQ ID NO: 378422 - RNA, 22 nt, Human
ucuuuauuuuaugcuugugcaa

SEQ ID NO: 378423 - RNA, 22 nt, Human
ggggcaggagguguucucuuuu

SEQ ID NO: 378424 - RNA, 22 nt, Human
ugguagggacacuaugcagaaa

SEQ ID NO: 378425 - RNA, 22 nt, Human
agucaaaugaguaaauauauaa

SEQ ID NO: 378426 - RNA, 22 nt, Human
auaaugaggauuugcauauuag

SEQ ID NO: 378427 - RNA, 22 nt, Human
aaaguccuguuaacuguuaaca

SEQ ID NO: 378428 - RNA, 22 nt, Human
agcaugcugguguucauggcag

SEQ ID NO: 378429 - RNA, 22 nt, Human
ugggccuguggcuuggcucuag

SEQ ID NO: 378430 - RNA, 22 nt, Human
guaucuuuugguggaaaaauaa

SEQ ID NO: 378431 - RNA, 22 nt, Human
gcagaaggucuggcacuucagg

SEQ ID NO: 378432 - RNA, 23 nt, Human
auuucuaggggauuuucuggugc

SEQ ID NO: 378433 - RNA, 22 nt, Human
gcagguggagcaguagucuggu

SEQ ID NO: 378434 - RNA, 22 nt, Human
ggccugaggccaccagcagccc

SEQ ID NO: 378435 - RNA, 22 nt, Human
uggcuuccugcauggauccucu

SEQ ID NO: 378436 - RNA, 22 nt, Human
aggccugagguuccugugcuca

SEQ ID NO: 378437 - RNA, 22 nt, Human
caggccucagagaguggcgggg

SEQ ID NO: 378438 - RNA, 22 nt, Human
uauuucugaggcccaggaagug

SEQ ID NO: 378439 - RNA, 22 nt, Human
ugaagacacauacaagggaaug

SEQ ID NO: 378440 - RNA, 22 nt, Human
ucugagagguuaagcaauuuga

SEQ ID NO: 378441 - RNA, 22 nt, Human
aaggccaggacaccaggggacu

SEQ ID NO: 378442 - RNA, 21 nt, Human
ccuccaggugauuccgugcuc

SEQ ID NO: 378443 - RNA, 22 nt, Human
aguguucauuuauucauucacu

SEQ ID NO: 378444 - RNA, 18 nt, Human
ucuuuggacaacuacugg

SEQ ID NO: 378445 - RNA, 22 nt, Human
gcagggcacacaagaaugauaa

SEQ ID NO: 378446 - RNA, 23 nt, Human
ucagagaaguuguaggcugggga

SEQ ID NO: 378447 - RNA, 22 nt, Human
acuugauuuugaaccuuucuac

SEQ ID NO: 378448 - RNA, 22 nt, Human
uggcuuccugcacagugucugc

SEQ ID NO: 378449 - RNA, 22 nt, Human
uacauguaagacaugagacucu

SEQ ID NO: 378450 - RNA, 22 nt, Human
agcaccuugcucuuggccuucc

SEQ ID NO: 378451 - RNA, 22 nt, Human
ucauuucucccggccaaaaacu

SEQ ID NO: 378452 - RNA, 22 nt, Human
uggccugguuauauugcuauca

SEQ ID NO: 378453 - RNA, 22 nt, Human
gagcagcucugggugacccagu

SEQ ID NO: 378454 - RNA, 22 nt, Human
uccuggagccacggagcuuuca

SEQ ID NO: 378455 - RNA, 22 nt, Human
guauuuauaggggaaugagagu

SEQ ID NO: 378456 - RNA, 22 nt, Human
ggcagcucugugucugggaagc

SEQ ID NO: 378457 - RNA, 18 nt, Human
cagaaaucacaccagcac

SEQ ID NO: 378458 - RNA, 22 nt, Human
cugggccagauccagccucaca

SEQ ID NO: 378459 - RNA, 22 nt, Human
ccucccaccguaucucaguggc

SEQ ID NO: 378460 - RNA, 22 nt, Human
auguuacacauaggcauaaaug

SEQ ID NO: 378461 - RNA, 22 nt, Human
ucagcugaaguggagaagcaga

SEQ ID NO: 378462 - RNA, 22 nt, Human
ucaggacagccagggugcagac

SEQ ID NO: 378463 - RNA, 22 nt, Human
ucuuuggauaucgcuagaccgu

SEQ ID NO: 378464 - RNA, 22 nt, Human
aaucuuucccuauuaaaugugg

SEQ ID NO: 378465 - RNA, 22 nt, Human
gccccagccaaggugacacgaa

SEQ ID NO: 378466 - RNA, 22 nt, Human
aguaucaaggaucuccagcacc

SEQ ID NO: 378467 - RNA, 22 nt, Human
ccuaugccugucacucugcgcu

SEQ ID NO: 378468 - RNA, 22 nt, Human
augaguaagaccauaauuuuug

SEQ ID NO: 378469 - RNA, 21 nt, Human
acagcaagccuucacaugagu

SEQ ID NO: 378470 - RNA, 22 nt, Human
aagagcugugggugguaguccu

SEQ ID NO: 378471 - RNA, 22 nt, Human
gaagagcuuaguuguccuagaa

SEQ ID NO: 378472 - RNA, 23 nt, Human
uuucaacuccugccauuauuucu

SEQ ID NO: 378473 - RNA, 22 nt, Human
cucacaguguaauauugaaccc

SEQ ID NO: 378474 - RNA, 22 nt, Human
uccaggaguccuggguggcccc

SEQ ID NO: 378475 - RNA, 22 nt, Human
gcagggcugcugaaacuuguuu

SEQ ID NO: 378476 - RNA, 22 nt, Human
aagagguugucugugaugaguu

SEQ ID NO: 378477 - RNA, 22 nt, Human
ucacagacauggugagguaaca

SEQ ID NO: 378478 - RNA, 22 nt, Human
ccucugggugggaggccgggcg

SEQ ID NO: 378479 - RNA, 22 nt, Human
auuucaacacuuuuggaauuag

SEQ ID NO: 378480 - RNA, 22 nt, Human
acauuuaaugauccuacuguga

SEQ ID NO: 378481 - RNA, 22 nt, Human
ggcuuaaugguucuuuuucuca

SEQ ID NO: 378482 - RNA, 22 nt, Human
aaaacaggugucagcaaacuau

SEQ ID NO: 378483 - RNA, 22 nt, Human
acuuccugcagcuucucagccc

SEQ ID NO: 378484 - RNA, 22 nt, Human
cagagcuggagggaacccuggc

SEQ ID NO: 378485 - RNA, 22 nt, Human
guguuuuaucagacaaaguaua

SEQ ID NO: 378486 - RNA, 21 nt, Human
ccaggcagagcugugaguucu

SEQ ID NO: 378487 - RNA, 21 nt, Human
ugcucacagaugugcucagug

SEQ ID NO: 378488 - RNA, 22 nt, Human
agggcagagaaauguaguugag

SEQ ID NO: 378489 - RNA, 22 nt, Human
caccugcagggggagucaagag

SEQ ID NO: 378490 - RNA, 22 nt, Human
ucccagccuuccagucugguuu

SEQ ID NO: 378491 - RNA, 22 nt, Human
cagaggcauuacugaaaaggug

SEQ ID NO: 378492 - RNA, 22 nt, Human
ggagaggagauuguggcauuuu

SEQ ID NO: 378493 - RNA, 22 nt, Human
gggcagguggagggcccagcca

SEQ ID NO: 378494 - RNA, 22 nt, Human
ggcuuuaugcagggauagaaau

SEQ ID NO: 378495 - RNA, 22 nt, Human
cuuucacagcacaagccugccu

SEQ ID NO: 378496 - RNA, 22 nt, Human
caauuucagaccuuuccuugga

SEQ ID NO: 378497 - RNA, 22 nt, Human
aaggucauggcaaauuacuuuu

SEQ ID NO: 378498 - RNA, 19 nt, Human
ccugcagggaugagagguu

SEQ ID NO: 378499 - RNA, 22 nt, Human
gcccagcugcacccuggugggu

SEQ ID NO: 378500 - RNA, 22 nt, Human
ugcuccagugagcuggccaucc

SEQ ID NO: 378501 - RNA, 22 nt, Human
cagcuugugcaaagguccuggg

SEQ ID NO: 378502 - RNA, 22 nt, Human
uuucaucuaacacuacauaggg

SEQ ID NO: 378503 - RNA, 22 nt, Human
auucagagcacuggguagaauu

SEQ ID NO: 378504 - RNA, 22 nt, Human
gccaggugcuaucccugcgcug

SEQ ID NO: 378505 - RNA, 22 nt, Human
auuaaagacagcagauggaugg

SEQ ID NO: 378506 - RNA, 22 nt, Human
ggcucagguuuccuucccagcu

SEQ ID NO: 378507 - RNA, 22 nt, Human
gagcgggaggaacggcucgggc

SEQ ID NO: 378508 - RNA, 22 nt, Human
acuuuuaaggggccuugauuua

SEQ ID NO: 378509 - RNA, 22 nt, Human
cuggagcagguuuaggaguccc

SEQ ID NO: 378510 - RNA, 22 nt, Human
ggugggcaggcgaggcccaggu

SEQ ID NO: 378511 - RNA, 22 nt, Human
acacugaauauacaaugaauau

SEQ ID NO: 378512 - RNA, 22 nt, Human
agggcccuaaggaaggcacaca

SEQ ID NO: 378513 - RNA, 22 nt, Human
agggcugacagugaggagucaa

SEQ ID NO: 378514 - RNA, 22 nt, Human
acauucuguuuccccaaagaga

SEQ ID NO: 378515 - RNA, 22 nt, Human
augcaaaauuaccauucuguuc

SEQ ID NO: 378516 - RNA, 22 nt, Human
agcuggccuuagugagcaccug

SEQ ID NO: 378517 - RNA, 22 nt, Human
uacauuguuuuuucuugccauc

SEQ ID NO: 378518 - RNA, 22 nt, Human
uggcugaggagggucuucuggu

SEQ ID NO: 378519 - RNA, 22 nt, Human
aauaauauuugaagcuucaaag

SEQ ID NO: 378520 - RNA, 22 nt, Human
cugagcugggcucucuugaggg

SEQ ID NO: 378521 - RNA, 22 nt, Human
ugccgcagugcggggagggccc

SEQ ID NO: 378522 - RNA, 22 nt, Human
ccagggcugagcugugaccaug

SEQ ID NO: 378523 - RNA, 22 nt, Human
gucaaguuuauccgcucauuca

SEQ ID NO: 378524 - RNA, 22 nt, Human
augcugugauuguagaaauauu

SEQ ID NO: 378525 - RNA, 22 nt, Human
gcaagcuggcuguuagaggaug

SEQ ID NO: 378526 - RNA, 18 nt, Human
cugcugugucgucugggc

SEQ ID NO: 378527 - RNA, 22 nt, Human
uagucaccucuuuaaauguccu

SEQ ID NO: 378528 - RNA, 22 nt, Human
uuccaggacaagauguuucagg

SEQ ID NO: 378529 - RNA, 21 nt, Human
uggcugagccaggugugugga

SEQ ID NO: 378530 - RNA, 22 nt, Human
agaaacugaauuauuucugagg

SEQ ID NO: 378531 - RNA, 22 nt, Human
caucuucagguucauggucaua

SEQ ID NO: 378532 - RNA, 22 nt, Human
gcccagcuuuucacuuccacac

SEQ ID NO: 378533 - RNA, 22 nt, Human
ccauuguaguaucuguuuuagu

SEQ ID NO: 378534 - RNA, 22 nt, Human
acaacaaagacacuugaaauga

SEQ ID NO: 378535 - RNA, 22 nt, Human
uguauagaguuggaagaugacu

SEQ ID NO: 378536 - RNA, 22 nt, Human
ccugggugucaugggcagcugg

SEQ ID NO: 378537 - RNA, 22 nt, Human
aggagggugauccgggcugguc

SEQ ID NO: 378538 - RNA, 22 nt, Human
uccuggugucgccuggucaguu

SEQ ID NO: 378539 - RNA, 22 nt, Human
caggggacauuaaagcuccaua

SEQ ID NO: 378540 - RNA, 22 nt, Human
agguggcucugacagcucuggu

SEQ ID NO: 378541 - RNA, 22 nt, Human
cuccaggagcugugucuuucuu

SEQ ID NO: 378542 - RNA, 22 nt, Human
agcuggggcugcagagaacagg

SEQ ID NO: 378543 - RNA, 22 nt, Human
ugggcagaggcucugaagucca

SEQ ID NO: 378544 - RNA, 18 nt, Human
gaggauggaaggagaugc

SEQ ID NO: 378545 - RNA, 20 nt, Human
ggagaugcagcccaggugcc

SEQ ID NO: 378546 - RNA, 22 nt, Human
aggccuguuccaggccccuuuu

SEQ ID NO: 378547 - RNA, 22 nt, Human
aagcaccugcaguugacaaaaa

SEQ ID NO: 378548 - RNA, 22 nt, Human
gaguccagacaccauaccugau

SEQ ID NO: 378549 - RNA, 22 nt, Human
aagcucauuaauuagaagcuaa

SEQ ID NO: 378550 - RNA, 22 nt, Human
ccuugcguuuuacagcuucuag

SEQ ID NO: 378551 - RNA, 22 nt, Human
ccuggaucagagccagagaagc

SEQ ID NO: 378552 - RNA, 22 nt, Human
ggcauccaguucugaucaacaa

SEQ ID NO: 378553 - RNA, 22 nt, Human
auaauuaauuucaguaaucucc

SEQ ID NO: 378554 - RNA, 22 nt, Human
acagcauugcuccaucucaaga

SEQ ID NO: 378555 - RNA, 22 nt, Human
cugaggccuaagacaugaauga

SEQ ID NO: 378556 - RNA, 22 nt, Human
cagucuucuaaccuagcagccu

SEQ ID NO: 378557 - RNA, 22 nt, Human
uuuccucugcugccauugcccc

SEQ ID NO: 378558 - RNA, 20 nt, Human
gccugccucagcuagcugag

SEQ ID NO: 378559 - RNA, 22 nt, Human
ugaaccaggaggcagccagcac

SEQ ID NO: 378560 - RNA, 22 nt, Human
gggcuucucuuaugcuaacugg

SEQ ID NO: 378561 - RNA, 22 nt, Human
ucuggcucaucucuccagguaa

SEQ ID NO: 378562 - RNA, 22 nt, Human
ccucccacauccuagcucugcu

SEQ ID NO: 378563 - RNA, 22 nt, Human
agucugcacucagguggagguc

SEQ ID NO: 378564 - RNA, 21 nt, Human
ggccucugccuugccccacuc

SEQ ID NO: 378565 - RNA, 22 nt, Human
uggagggcucuuucaccuggua

SEQ ID NO: 378566 - RNA, 19 nt, Human
ugggaguggggaagguccu

SEQ ID NO: 378567 - RNA, 22 nt, Human
uacuguuuucuauaauggcugu

SEQ ID NO: 378568 - RNA, 22 nt, Human
ggccagcagucacagggucaga

SEQ ID NO: 378569 - RNA, 21 nt, Human
ggagggcagcccagacuggcu

SEQ ID NO: 378570 - RNA, 22 nt, Human
gcagcaggagaguuuguccugc

SEQ ID NO: 378571 - RNA, 21 nt, Human
agaaauguaucauucuuuucc

SEQ ID NO: 378572 - RNA, 22 nt, Human
acugugcacaauucuaaguccu

SEQ ID NO: 378573 - RNA, 21 nt, Human
cucuggaggcaagggagagug

SEQ ID NO: 378574 - RNA, 19 nt, Human
cuggccaggccaggggccc

SEQ ID NO: 378575 - RNA, 22 nt, Human
auuuucaucgcuagguuggccu

SEQ ID NO: 378576 - RNA, 22 nt, Human
ggcucugccugcccagcagcac

SEQ ID NO: 378577 - RNA, 22 nt, Human
aguaaacauuucagauuuauuu

SEQ ID NO: 378578 - RNA, 22 nt, Human
aagagcugcccaaggugaacag

SEQ ID NO: 378579 - RNA, 22 nt, Human
ucccagggugcgccugcccucg

SEQ ID NO: 378580 - RNA, 21 nt, Human
uggcagagugcagucuauaca

SEQ ID NO: 378581 - RNA, 22 nt, Human
auggauaagaacaaauaucuga

SEQ ID NO: 378582 - RNA, 19 nt, Human
uugguggugguuuugguuc

SEQ ID NO: 378583 - RNA, 22 nt, Human
auaucuuuguuuuugccaagau

SEQ ID NO: 378584 - RNA, 17 nt, Human
aggaaacauuuucuuuc

SEQ ID NO: 378585 - RNA, 22 nt, Human
ugucuuuauauauuuggaaaau

SEQ ID NO: 378586 - RNA, 22 nt, Human
uuccuauuuccaugaaacacaa

SEQ ID NO: 378587 - RNA, 22 nt, Human
ugaaaagacugcaagagagcau

SEQ ID NO: 378588 - RNA, 22 nt, Human
auuuaagacugacuucaccagu

SEQ ID NO: 378589 - RNA, 22 nt, Human
uagagcauuuagaggggcagga

SEQ ID NO: 378590 - RNA, 22 nt, Human
cuuaggcagacugcugaugcag

SEQ ID NO: 378591 - RNA, 22 nt, Human
agucccuucucaaagugugcgg

SEQ ID NO: 378592 - RNA, 22 nt, Human
caggcagcucaaccuugggagc

SEQ ID NO: 378593 - RNA, 22 nt, Human
gauuuauuggucuuucauuggu

SEQ ID NO: 378594 - RNA, 22 nt, Human
gaaaggccauuucugaggguuu

SEQ ID NO: 378595 - RNA, 22 nt, Human
gaugggauuuuuuauguguuca

SEQ ID NO: 378596 - RNA, 22 nt, Human
acauaaguuauggauaaaaugu

SEQ ID NO: 378597 - RNA, 22 nt, Human
uugaucaucuaagaguaauagu

SEQ ID NO: 378598 - RNA, 22 nt, Human
uucugugauugacauguggcuu

SEQ ID NO: 378599 - RNA, 22 nt, Human
cugagaggcggagcuugcagug

SEQ ID NO: 378600 - RNA, 22 nt, Human
auuuaguuuaggaaaaguaggu

SEQ ID NO: 378601 - RNA, 22 nt, Human
caacuuugugugaccuagauag

SEQ ID NO: 378602 - RNA, 22 nt, Human
uuucaugugcaauuagcaauau

SEQ ID NO: 378603 - RNA, 22 nt, Human
gagaggugaaggcugcccuggg

SEQ ID NO: 378604 - RNA, 22 nt, Human
ccucaggguggcaucagaucuu

SEQ ID NO: 378605 - RNA, 22 nt, Human
cagggguggcugcagcagaggu

SEQ ID NO: 378606 - RNA, 22 nt, Human
guggccagaagacugcaaugcu

SEQ ID NO: 378607 - RNA, 22 nt, Human
guuugaaugcaguaugcauuuu

SEQ ID NO: 378608 - RNA, 22 nt, Human
gaagccacccuccuuccagccc

SEQ ID NO: 378609 - RNA, 22 nt, Human
ucccagcagcauagcucagaau

SEQ ID NO: 378610 - RNA, 22 nt, Human
cugaaggagcauagucaguuuu

SEQ ID NO: 378611 - RNA, 21 nt, Human
aagccagcccacagugguuug

SEQ ID NO: 378612 - RNA, 22 nt, Human
gcagccugaugaucuggguugu

SEQ ID NO: 378613 - RNA, 22 nt, Human
ugcuuuauucagucucugccau

SEQ ID NO: 378614 - RNA, 22 nt, Human
uucaacuuuggagauuuaauaa

SEQ ID NO: 378615 - RNA, 18 nt, Human
auuuugaacaaugcugua

SEQ ID NO: 378616 - RNA, 22 nt, Human
ggcugcuuuaucggcugcugaa

SEQ ID NO: 378617 - RNA, 22 nt, Human
uucauguaauuccauaagguaa

SEQ ID NO: 378618 - RNA, 22 nt, Human
cauaacuagagugaaauguuga

SEQ ID NO: 378619 - RNA, 22 nt, Human
caggaugggugucggccagcac

SEQ ID NO: 378620 - RNA, 22 nt, Human
agggccaggaucacagccaaga

SEQ ID NO: 378621 - RNA, 22 nt, Human
acucucucacagcuuggcugau

SEQ ID NO: 378622 - RNA, 22 nt, Human
gaaggaaaggucucaugccuuu

SEQ ID NO: 378623 - RNA, 22 nt, Human
ccaggugcucuugccagggcug

SEQ ID NO: 378624 - RNA, 20 nt, Human
ccagcuuucccugcagcauc

SEQ ID NO: 378625 - RNA, 22 nt, Human
gcugaggcuccucgggaggaca

SEQ ID NO: 378626 - RNA, 22 nt, Human
ggcuuuauuaagcaggguaagu

SEQ ID NO: 378627 - RNA, 21 nt, Human
gauuuauaagccuuaagccua

SEQ ID NO: 378628 - RNA, 22 nt, Human
uuaguuagucccugguaccuuu

SEQ ID NO: 378629 - RNA, 22 nt, Human
ucugaacauccagcaaugcaca

SEQ ID NO: 378630 - RNA, 22 nt, Human
ccucaggaaccacauugcugcu

SEQ ID NO: 378631 - RNA, 22 nt, Human
gggccacacagaaccuccuggu

SEQ ID NO: 378632 - RNA, 22 nt, Human
gaggaaugucagcacaggccuc

SEQ ID NO: 378633 - RNA, 22 nt, Human
aguaaacauuuucauauuuucu

SEQ ID NO: 378634 - RNA, 23 nt, Human
uuucuucagaagccuugcgaggc

SEQ ID NO: 378635 - RNA, 22 nt, Human
caaaagucuguccuuuaacuuc

SEQ ID NO: 378636 - RNA, 22 nt, Human
cccuccagccauggacccaggu

SEQ ID NO: 378637 - RNA, 22 nt, Human
ucccacugcuuugcucugcuca

SEQ ID NO: 378638 - RNA, 22 nt, Human
uccauuuuagaagaaaauccac

SEQ ID NO: 378639 - RNA, 22 nt, Human
gagucacaaaagaugcccaggg

SEQ ID NO: 378640 - RNA, 22 nt, Human
ugucaccucuuuggcugcagcu

SEQ ID NO: 378641 - RNA, 22 nt, Human
auccagcuuugucuggucuucg

SEQ ID NO: 378642 - RNA, 22 nt, Human
acuuauuagcugugugaccuug

SEQ ID NO: 378643 - RNA, 22 nt, Human
ugccaaauugcccuauaaauga

SEQ ID NO: 378644 - RNA, 22 nt, Human
aaucagaaccuugggucauaac

SEQ ID NO: 378645 - RNA, 22 nt, Human
uaauuuaugaugcaaagaaaag

SEQ ID NO: 378646 - RNA, 22 nt, Human
ucagcugccccaguggccccag

SEQ ID NO: 378647 - RNA, 22 nt, Human
agguaaagacugcaaggagaau

SEQ ID NO: 378648 - RNA, 22 nt, Human
uaaggcacacaguugcugcaug

SEQ ID NO: 378649 - RNA, 22 nt, Human
uuugaaaguguuuacuugggaa

SEQ ID NO: 378650 - RNA, 22 nt, Human
ucagagguaagggcugagagga

SEQ ID NO: 378651 - RNA, 19 nt, Human
gaggaggaaaacuagugua

SEQ ID NO: 378652 - RNA, 20 nt, Human
ggcagagcuaugucuguugc

SEQ ID NO: 378653 - RNA, 22 nt, Human
uccuucaguucaauuaguccgu

SEQ ID NO: 378654 - RNA, 22 nt, Human
aagaacuuccuaauauauuuuc

SEQ ID NO: 378655 - RNA, 22 nt, Human
aaguuugacagaaguuucuaau

SEQ ID NO: 378656 - RNA, 22 nt, Human
gaggcagcucuucugaaugggg

SEQ ID NO: 378657 - RNA, 22 nt, Human
agcagagucugugugcacuuua

SEQ ID NO: 378658 - RNA, 22 nt, Human
ggcagcaguccauggcccaagg

SEQ ID NO: 378659 - RNA, 17 nt, Human
gggcagggacuccuggg

SEQ ID NO: 378660 - RNA, 21 nt, Human
gcugccaccgcgugcuccagg

SEQ ID NO: 378661 - RNA, 22 nt, Human
uaugcauaugaccccaagcuug

SEQ ID NO: 378662 - RNA, 22 nt, Human
agaugguguuuccccaggugga

SEQ ID NO: 378663 - RNA, 19 nt, Human
ggaugagggucaggcauag

SEQ ID NO: 378664 - RNA, 22 nt, Human
cugguccuccuugccuucagau

SEQ ID NO: 378665 - RNA, 22 nt, Human
ucagugucuugggcuugaaugc

SEQ ID NO: 378666 - RNA, 22 nt, Human
uauuucagacacugaucuugca

SEQ ID NO: 378667 - RNA, 22 nt, Human
ucagggcacaggccuguggguu

SEQ ID NO: 378668 - RNA, 19 nt, Human
cuccucagucccagagguc

SEQ ID NO: 378669 - RNA, 22 nt, Human
uuucacacuagucagaauacca

SEQ ID NO: 378670 - RNA, 22 nt, Human
uuaugcuaguauaguccuuaga

SEQ ID NO: 378671 - RNA, 22 nt, Human
auguuacagaaagcaaagauga

SEQ ID NO: 378672 - RNA, 22 nt, Human
agcuuuaugggagcuuagauaa

SEQ ID NO: 378673 - RNA, 22 nt, Human
auacaagacucagcacagacgg

SEQ ID NO: 378674 - RNA, 22 nt, Human
cccucagcuccacccucagcag

SEQ ID NO: 378675 - RNA, 22 nt, Human
uagagugguuaacaguuuagaa

SEQ ID NO: 378676 - RNA, 20 nt, Human
cugcucugcuuugcaggugg

SEQ ID NO: 378677 - RNA, 22 nt, Human
gaggcccuccagcugucagcug

SEQ ID NO: 378678 - RNA, 22 nt, Human
ccacagggccuuuccugcuggc

SEQ ID NO: 378679 - RNA, 22 nt, Human
ucuaaagccuuccauauaacgc

SEQ ID NO: 378680 - RNA, 22 nt, Human
agaaaacauuacauaggugugu

SEQ ID NO: 378681 - RNA, 22 nt, Human
uuucaaagaccauuaacuauca

SEQ ID NO: 378682 - RNA, 22 nt, Human
auguaucaugcaggguccauga

SEQ ID NO: 378683 - RNA, 22 nt, Human
uggccucucuaccaggcagccu

SEQ ID NO: 378684 - RNA, 22 nt, Human
guuugauucaagaacaaagagu

SEQ ID NO: 378685 - RNA, 22 nt, Human
agccuccuguagcccucaccca

SEQ ID NO: 378686 - RNA, 22 nt, Human
aaaugaccagaauacaggcuuc

SEQ ID NO: 378687 - RNA, 22 nt, Human
gagagaagaauguuccgaggcc

SEQ ID NO: 378688 - RNA, 22 nt, Human
aauuccagcuaggaaaagcuuc

SEQ ID NO: 378689 - RNA, 22 nt, Human
acugccauuggucaaaugagug

SEQ ID NO: 378690 - RNA, 22 nt, Human
uagcaucuggagaaacaagucc

SEQ ID NO: 378691 - RNA, 22 nt, Human
uuuuucagccaugaauuacacu

SEQ ID NO: 378692 - RNA, 22 nt, Human
uggccugggccugccggugcaa

SEQ ID NO: 378693 - RNA, 23 nt, Human
agacagaggcugaggcuggccgc

SEQ ID NO: 378694 - RNA, 22 nt, Human
uuccucagaaaauacuguccaa

SEQ ID NO: 378695 - RNA, 22 nt, Human
ucagaauuuuuguuacccuuga

SEQ ID NO: 378696 - RNA, 22 nt, Human
ucccuggacagccuugccuggg

SEQ ID NO: 378697 - RNA, 21 nt, Human
gcugugcacauaguagaagug

SEQ ID NO: 378698 - RNA, 20 nt, Human
ugccagggccagcagaggcu

SEQ ID NO: 378699 - RNA, 22 nt, Human
agcagggcuugccgcuuguccu

SEQ ID NO: 378700 - RNA, 22 nt, Human
agggcugaguggugcagucaaa

SEQ ID NO: 378701 - RNA, 22 nt, Human
ccugggaggcggagguugcagu

SEQ ID NO: 378702 - RNA, 22 nt, Human
cccaggaggcggagguuguggu

SEQ ID NO: 378703 - RNA, 22 nt, Human
ugaagcaguucucagaaguggg

SEQ ID NO: 378704 - RNA, 22 nt, Human
cugugcuuaccugcccagguga

SEQ ID NO: 378705 - RNA, 22 nt, Human
ugucugucugcaagccagaaag

SEQ ID NO: 378706 - RNA, 19 nt, Human
augagcuggcauuucaggu

SEQ ID NO: 378707 - RNA, 22 nt, Human
ccaggaaauagugcugugaucu

SEQ ID NO: 378708 - RNA, 22 nt, Human
ccugacgaaaggcgugcuggag

SEQ ID NO: 378709 - RNA, 22 nt, Human
ggcuguggcauuaggugaggcc

SEQ ID NO: 378710 - RNA, 22 nt, Human
ugcaguggaaucuggagagcag

SEQ ID NO: 378711 - RNA, 22 nt, Human
uaccaaaagcuuguuucauaca

SEQ ID NO: 378712 - RNA, 22 nt, Human
cucccuggcacagcgagagguu

SEQ ID NO: 378713 - RNA, 21 nt, Human
gagcugggcgaggcuccgggg

SEQ ID NO: 378714 - RNA, 22 nt, Human
uugcaggaaacugagugugagc

SEQ ID NO: 378715 - RNA, 19 nt, Human
uguguguuuauauauguau

SEQ ID NO: 378716 - RNA, 22 nt, Human
uccugccuuagagcaaggaaaa

SEQ ID NO: 378717 - RNA, 22 nt, Human
ccugggcuuucaaaaccagccu

SEQ ID NO: 378718 - RNA, 20 nt, Human
uuccaacucacaucucuaca

SEQ ID NO: 378719 - RNA, 22 nt, Human
ugaggggauacgguacacauug

SEQ ID NO: 378720 - RNA, 22 nt, Human
uaagaacauuuucggaaagaua

SEQ ID NO: 378721 - RNA, 22 nt, Human
ugucccauggacacaacuucuu

SEQ ID NO: 378722 - RNA, 22 nt, Human
acaugauuaaaagauuuuaaag

SEQ ID NO: 378723 - RNA, 22 nt, Human
gaagcagcucagauugacugaa

SEQ ID NO: 378724 - RNA, 22 nt, Human
cagaggaggccaccgcauaggc

SEQ ID NO: 378725 - RNA, 22 nt, Human
ucaucacucauuggacaacaga

SEQ ID NO: 378726 - RNA, 22 nt, Human
agcugccaaguuucucaguuua

SEQ ID NO: 378727 - RNA, 22 nt, Human
cuguccuguagcuccaucaguc

SEQ ID NO: 378728 - RNA, 22 nt, Human
agggagcuucuggccucagccu

SEQ ID NO: 378729 - RNA, 22 nt, Human
caaugugguggcagaugucagu

SEQ ID NO: 378730 - RNA, 22 nt, Human
cagcugcccauccugggaaaug

SEQ ID NO: 378731 - RNA, 22 nt, Human
ucccagauuguugauggcuuaa

SEQ ID NO: 378732 - RNA, 22 nt, Human
uucuccucuguuggccuucccu

SEQ ID NO: 378733 - RNA, 22 nt, Human
gagguggucgaggagggguacc

SEQ ID NO: 378734 - RNA, 19 nt, Human
aauuagggagucgguuaag

SEQ ID NO: 378735 - RNA, 22 nt, Human
gccagagcaugcacugccugca

SEQ ID NO: 378736 - RNA, 17 nt, Human
aagagaggcugagcugg

SEQ ID NO: 378737 - RNA, 22 nt, Human
ugcagggaauccagucuagggu

SEQ ID NO: 378738 - RNA, 22 nt, Human
aaggcugaguaaaacagagaac

SEQ ID NO: 378739 - RNA, 22 nt, Human
ccugucaguugcugucagggau

SEQ ID NO: 378740 - RNA, 22 nt, Human
ggcucuggcguccaauggagcg

SEQ ID NO: 378741 - RNA, 20 nt, Human
agacaaaaugacuucaugca

SEQ ID NO: 378742 - RNA, 22 nt, Human
aucuggcuugacuuugcgacuu

SEQ ID NO: 378743 - RNA, 20 nt, Human
cauauauaccuagaagugga

SEQ ID NO: 378744 - RNA, 22 nt, Human
cacccagccuucacacaggagu

SEQ ID NO: 378745 - RNA, 22 nt, Human
ucaaaggcuugugguucuggga

SEQ ID NO: 378746 - RNA, 20 nt, Human
ggccuuggguuucgccuguu

SEQ ID NO: 378747 - RNA, 22 nt, Human
agagggcagucucagauuggga

SEQ ID NO: 378748 - RNA, 22 nt, Human
gcagagccugacgggauuuuuc

SEQ ID NO: 378749 - RNA, 22 nt, Human
caagagcucaccggagagcauu

SEQ ID NO: 378750 - RNA, 22 nt, Human
uggcugagguaacuaugaauaa

SEQ ID NO: 378751 - RNA, 22 nt, Human
cugcccugacugaccuuuugaa

SEQ ID NO: 378752 - RNA, 22 nt, Human
agaaaucauucccaaacccaua

SEQ ID NO: 378753 - RNA, 22 nt, Human
uauauuaaaugaccaguuuuaa

SEQ ID NO: 378754 - RNA, 22 nt, Human
uguuauugagguuacuuauaag

SEQ ID NO: 378755 - RNA, 22 nt, Human
agcuccugcacccagccuugag

SEQ ID NO: 378756 - RNA, 22 nt, Human
guggccugaugccagcccugug

SEQ ID NO: 378757 - RNA, 22 nt, Human
aggcucagucccggcccgcgcc

SEQ ID NO: 378758 - RNA, 22 nt, Human
ccagagccucaacacagguccu

SEQ ID NO: 378759 - RNA, 22 nt, Human
aggagcugcuuaaaugguuggu

SEQ ID NO: 378760 - RNA, 22 nt, Human
aagccucuggggccucaucugu

SEQ ID NO: 378761 - RNA, 22 nt, Human
ugccaggcauguaguagacuug

SEQ ID NO: 378762 - RNA, 22 nt, Human
uccagaaacuuuuccagucuca

SEQ ID NO: 378763 - RNA, 23 nt, Human
cuccccaguguccucaugcaucu

SEQ ID NO: 378764 - RNA, 22 nt, Human
agaggccuccgaaaggugggcu

SEQ ID NO: 378765 - RNA, 22 nt, Human
cugggaggauacacaagaucag

SEQ ID NO: 378766 - RNA, 20 nt, Human
ugcagaagaacguucugguu

SEQ ID NO: 378767 - RNA, 22 nt, Human
gcacugaaugcuuuuacuguaa

SEQ ID NO: 378768 - RNA, 21 nt, Human
uguguaaaguugaaauccugu

SEQ ID NO: 378769 - RNA, 22 nt, Human
gaauuaguguugaaaucagggc

SEQ ID NO: 378770 - RNA, 22 nt, Human
cagcuggcugcaugaugccaaa

SEQ ID NO: 378771 - RNA, 22 nt, Human
gaggccuggcugucagucccca

SEQ ID NO: 378772 - RNA, 22 nt, Human
uaagaacauaaauucauacggg

SEQ ID NO: 378773 - RNA, 22 nt, Human
gugucccaaucuacuuuucccu

SEQ ID NO: 378774 - RNA, 22 nt, Human
cagggccagccauccugcuggg

SEQ ID NO: 378775 - RNA, 22 nt, Human
ucuuuaauucagcaugaugcgg

SEQ ID NO: 378776 - RNA, 22 nt, Human
cccaggcugauguucagcgggu

SEQ ID NO: 378777 - RNA, 22 nt, Human
uggcagaguggaccauacucaa

SEQ ID NO: 378778 - RNA, 22 nt, Human
cugaggaagacagcagcugugu

SEQ ID NO: 378779 - RNA, 22 nt, Human
uccuggccucacaguccugggu

SEQ ID NO: 378780 - RNA, 22 nt, Human
cagcagcucccauccgcugagc

SEQ ID NO: 378781 - RNA, 22 nt, Human
aaugguuugauggacaaaauga

SEQ ID NO: 378782 - RNA, 22 nt, Human
cagggaguuuuuguuccucuag

SEQ ID NO: 378783 - RNA, 22 nt, Human
caauguaucaaccagaaaguuc

SEQ ID NO: 378784 - RNA, 17 nt, Human
uggacccuugggccucc

SEQ ID NO: 378785 - RNA, 22 nt, Human
accagggcccgggagagcucuc

SEQ ID NO: 378786 - RNA, 23 nt, Human
gugugccaagcacugugccagga

SEQ ID NO: 378787 - RNA, 22 nt, Human
ggccuucacgugaccuggcgug

SEQ ID NO: 378788 - RNA, 22 nt, Human
agaggcagcagucauacuacag

SEQ ID NO: 378789 - RNA, 22 nt, Human
cugccaggcgauggauuggcug

SEQ ID NO: 378790 - RNA, 22 nt, Human
caguguggagggagagagccug

SEQ ID NO: 378791 - RNA, 22 nt, Human
ugcaccauuaauuuaugugaga

SEQ ID NO: 378792 - RNA, 22 nt, Human
cagggccaguucucgcagcagu

SEQ ID NO: 378793 - RNA, 22 nt, Human
acuucuggugucauacugcauu

SEQ ID NO: 378794 - RNA, 23 nt, Human
ucuaauacaugaaaccuagaugu

SEQ ID NO: 378795 - RNA, 20 nt, Human
uggaccugucucuuuaggga

SEQ ID NO: 378796 - RNA, 22 nt, Human
agcuggugcugaagcucuugag

SEQ ID NO: 378797 - RNA, 22 nt, Human
cucucuucccgugaguguugca

SEQ ID NO: 378798 - RNA, 22 nt, Human
acucaguacaucuggaguuggc

SEQ ID NO: 378799 - RNA, 22 nt, Human
agccaggcagggcucucgcucu

SEQ ID NO: 378800 - RNA, 22 nt, Human
gcagaggcuccauuuuacagau

SEQ ID NO: 378801 - RNA, 22 nt, Human
cagcacagggacaauagcagau

SEQ ID NO: 378802 - RNA, 22 nt, Human
ucagaggaggcauuuaaacaga

SEQ ID NO: 378803 - RNA, 22 nt, Human
uggaaguggcagaaaaugaaca

SEQ ID NO: 378804 - RNA, 22 nt, Human
uucuccccugacccugaugagg

SEQ ID NO: 378805 - RNA, 20 nt, Human
gucucaaguaucucacaguc

SEQ ID NO: 378806 - RNA, 22 nt, Human
uaagcauucaaugcuuagcacu

SEQ ID NO: 378807 - RNA, 22 nt, Human
gggcacagaagucuaagacauc

SEQ ID NO: 378808 - RNA, 22 nt, Human
caggcagccugagggaucuggg

SEQ ID NO: 378809 - RNA, 22 nt, Human
ugggccacaagccaugggacca

SEQ ID NO: 378810 - RNA, 22 nt, Human
uuuaauauuucuuuccugaagc

SEQ ID NO: 378811 - RNA, 22 nt, Human
gcugagagaaaagugagguucu

SEQ ID NO: 378812 - RNA, 22 nt, Human
aucuggcucccuuggaauccgu

SEQ ID NO: 378813 - RNA, 22 nt, Human
ucucaggaagugauauugagac

SEQ ID NO: 378814 - RNA, 22 nt, Human
aggcucagagaugaguaagcac

SEQ ID NO: 378815 - RNA, 22 nt, Human
uucauucuuugaaucugaggua

SEQ ID NO: 378816 - RNA, 19 nt, Human
ugaggccaaggucacagau

SEQ ID NO: 378817 - RNA, 22 nt, Human
aggaggggcaaugauagucugg

SEQ ID NO: 378818 - RNA, 23 nt, Human
uaagaacagacaagcauuuacau

SEQ ID NO: 378819 - RNA, 22 nt, Human
cucagggccaaggaugcuguug

SEQ ID NO: 378820 - RNA, 22 nt, Human
agggaucaaaaaauguacaugc

SEQ ID NO: 378821 - RNA, 22 nt, Human
uccagccaagggagguuacuag

SEQ ID NO: 378822 - RNA, 22 nt, Human
ugggauaguggccaggaccccc

SEQ ID NO: 378823 - RNA, 22 nt, Human
acaugcaugucuaugggcaggu

SEQ ID NO: 378824 - RNA, 22 nt, Human
ugagccuggguggucgaggcug

SEQ ID NO: 378825 - RNA, 23 nt, Human
ccagcucccaggucugaggacug

SEQ ID NO: 378826 - RNA, 22 nt, Human
acccagcuguuucccgugucau

SEQ ID NO: 378827 - RNA, 22 nt, Human
ccaggacuuauuacaguauaac

SEQ ID NO: 378828 - RNA, 22 nt, Human
agcagcagaagggagacccagg

SEQ ID NO: 378829 - RNA, 22 nt, Human
gagcuggaagucuguggucaga

SEQ ID NO: 378830 - RNA, 22 nt, Human
cugagaggcacaaggcauuucg

SEQ ID NO: 378831 - RNA, 22 nt, Human
uguccuuacaaggucccuuucg

SEQ ID NO: 378832 - RNA, 22 nt, Human
uucuucuuucccccugugguac

SEQ ID NO: 378833 - RNA, 22 nt, Human
cgcagggccgcgagcgggacca

SEQ ID NO: 378834 - RNA, 22 nt, Human
agugugggugagggaggcccuc

SEQ ID NO: 378835 - RNA, 22 nt, Human
ggcaggcugggugucauggagu

SEQ ID NO: 378836 - RNA, 22 nt, Human
ccagcauggcaccugagaugag

SEQ ID NO: 378837 - RNA, 22 nt, Human
agggcagcucucaccucuggcc

SEQ ID NO: 378838 - RNA, 22 nt, Human
aauuuacacuucauuuggaggg

SEQ ID NO: 378839 - RNA, 22 nt, Human
uggggcucaccuaggcuggaag

SEQ ID NO: 378840 - RNA, 22 nt, Human
caauuucuuguuaauucucagg

SEQ ID NO: 378841 - RNA, 22 nt, Human
accugggagucacaccugagaa

SEQ ID NO: 378842 - RNA, 22 nt, Human
guaagggauuugaacauagguu

SEQ ID NO: 378843 - RNA, 19 nt, Human
cuggggcuuugguacugcc

SEQ ID NO: 378844 - RNA, 22 nt, Human
cuacccagagugaaucucuuaa

SEQ ID NO: 378845 - RNA, 19 nt, Human
aggaaagguggccuuagca

SEQ ID NO: 378846 - RNA, 22 nt, Human
uccauguguuuuccuguccaca

SEQ ID NO: 378847 - RNA, 21 nt, Human
gcagagccggggcgagaaggc

SEQ ID NO: 378848 - RNA, 22 nt, Human
cacaggaggaggugcccgggcc

SEQ ID NO: 378849 - RNA, 22 nt, Human
ggaagagggaaccacgacugua

SEQ ID NO: 378850 - RNA, 20 nt, Human
caggaugauuggacacgaug

SEQ ID NO: 378851 - RNA, 21 nt, Human
ccuggcagaagccugauaugc

SEQ ID NO: 378852 - RNA, 22 nt, Human
uuucuuaguccuagagugauuu

SEQ ID NO: 378853 - RNA, 22 nt, Human
cauuucaauuauuugcucuucu

SEQ ID NO: 378854 - RNA, 17 nt, Human
agauggcaggaggcaga

SEQ ID NO: 378855 - RNA, 22 nt, Human
gggcacagagggucuugaagaa

SEQ ID NO: 378856 - RNA, 22 nt, Human
ucugucacuuauuaagauggau

SEQ ID NO: 378857 - RNA, 22 nt, Human
aguucacauaucuguuuuauuu

SEQ ID NO: 378858 - RNA, 22 nt, Human
ugcugcacaauuggaaaguauc

SEQ ID NO: 378859 - RNA, 22 nt, Human
ucagcagaggggaaggcaucug

SEQ ID NO: 378860 - RNA, 22 nt, Human
ucuucauuccguagauauuuau

SEQ ID NO: 378861 - RNA, 22 nt, Human
uaguccaguaaaacagcuaacg

SEQ ID NO: 378862 - RNA, 22 nt, Human
ugauuauauucuaacuucauaa

SEQ ID NO: 378863 - RNA, 22 nt, Human
ucaaagcuuagauaauuucuuu

SEQ ID NO: 378864 - RNA, 22 nt, Human
agcaguggcuggauggugugcu

SEQ ID NO: 378865 - RNA, 22 nt, Human
agcucccagucuccucuccaug

SEQ ID NO: 378866 - RNA, 22 nt, Human
ugcuguguggaugugaagaauc

SEQ ID NO: 378867 - RNA, 22 nt, Human
ccaggagcauuaagagaacaua

SEQ ID NO: 378868 - RNA, 18 nt, Human
gguggcaggucagaugcc

SEQ ID NO: 378869 - RNA, 22 nt, Human
ggcucaagcagucugccugccu

SEQ ID NO: 378870 - RNA, 22 nt, Human
uggugcugauaauggcaggauu

SEQ ID NO: 378871 - RNA, 22 nt, Human
gaaggccauugcguccugggau

SEQ ID NO: 378872 - RNA, 17 nt, Human
uuccccugaccaagccu

SEQ ID NO: 378873 - RNA, 22 nt, Human
cacagguggcuccaaguuagag

SEQ ID NO: 378874 - RNA, 22 nt, Human
aaaugguaagacaacacauuau

SEQ ID NO: 378875 - RNA, 22 nt, Human
cccugccuugggguccacaccg

SEQ ID NO: 378876 - RNA, 22 nt, Human
aucaggaaugaauacuuuugga

SEQ ID NO: 378877 - RNA, 22 nt, Human
ucuacccagagcuaugaccuga

SEQ ID NO: 378878 - RNA, 21 nt, Human
gugcucugggcagcagagggc

SEQ ID NO: 378879 - RNA, 22 nt, Human
cugggcugcaucaaagaggcau

SEQ ID NO: 378880 - RNA, 22 nt, Human
gcagauggugggggaggaguac

SEQ ID NO: 378881 - RNA, 22 nt, Human
uggccugccuucgcugagcuga

SEQ ID NO: 378882 - RNA, 22 nt, Human
aaugccaacuuggauauacauu

SEQ ID NO: 378883 - RNA, 22 nt, Human
ccuguucacccuccaugcacag

SEQ ID NO: 378884 - RNA, 22 nt, Human
uggaccugggguggccuccucu

SEQ ID NO: 378885 - RNA, 21 nt, Human
auggagccuaagaguggaggu

SEQ ID NO: 378886 - RNA, 22 nt, Human
cagcuuugccaaguaaggucuu

SEQ ID NO: 378887 - RNA, 18 nt, Human
auagaaaccuuuaaucag

SEQ ID NO: 378888 - RNA, 22 nt, Human
gcacugaaaauguuggauucca

SEQ ID NO: 378889 - RNA, 22 nt, Human
uauauuaacacccacuugccuc

SEQ ID NO: 378890 - RNA, 22 nt, Human
aauuuauauguaauuaggcaca

SEQ ID NO: 378891 - RNA, 22 nt, Human
accaggagcauuuuuuauuagu

SEQ ID NO: 378892 - RNA, 22 nt, Human
acagggcauuuccucuaugugu

SEQ ID NO: 378893 - RNA, 22 nt, Human
gggugggccugucuggccaugu

SEQ ID NO: 378894 - RNA, 22 nt, Human
uccaggcuggaaaugucaaacu

SEQ ID NO: 378895 - RNA, 22 nt, Human
uagugcuuaauaaauuucagaa

SEQ ID NO: 378896 - RNA, 22 nt, Human
ugcauaaacagauacuucaugu

SEQ ID NO: 378897 - RNA, 22 nt, Human
aaagcagguugcaauuacagug

SEQ ID NO: 378898 - RNA, 22 nt, Human
gaguccuuggcaucaucaguac

SEQ ID NO: 378899 - RNA, 22 nt, Human
ucccaggugaugcugaggccac

SEQ ID NO: 378900 - RNA, 22 nt, Human
cucagggggaaucaggucacag

SEQ ID NO: 378901 - RNA, 22 nt, Human
cugggcacaaguggcccuggau

SEQ ID NO: 378902 - RNA, 22 nt, Human
gaggagcuugaggcuaggagcc

SEQ ID NO: 378903 - RNA, 22 nt, Human
gucagcaccucuuuggggagcu

SEQ ID NO: 378904 - RNA, 22 nt, Human
aggcagaugguaacugugauau

SEQ ID NO: 378905 - RNA, 22 nt, Human
uccugcaggggcugaggaacca

SEQ ID NO: 378906 - RNA, 22 nt, Human
ggagugggcagcacugcccugu

SEQ ID NO: 378907 - RNA, 22 nt, Human
aggucacauggauaaugaucag

SEQ ID NO: 378908 - RNA, 22 nt, Human
ucaucacuguaucauugauaga

SEQ ID NO: 378909 - RNA, 22 nt, Human
ccaggguggcguagaugcuggg

SEQ ID NO: 378910 - RNA, 17 nt, Human
uccuggcucugccacug

SEQ ID NO: 378911 - RNA, 22 nt, Human
gggagaagaaugugucaauugu

SEQ ID NO: 378912 - RNA, 22 nt, Human
uacagaaaucacaucgcuuuga

SEQ ID NO: 378913 - RNA, 22 nt, Human
cagcugccacaggacuuucuga

SEQ ID NO: 378914 - RNA, 22 nt, Human
ggccugcuccgggggcugagcu

SEQ ID NO: 378915 - RNA, 22 nt, Human
aucugacuucacgcccaugcca

SEQ ID NO: 378916 - RNA, 22 nt, Human
cuccucuuuggggauuuacaca

SEQ ID NO: 378917 - RNA, 22 nt, Human
cucugaccauucccuugauuuu

SEQ ID NO: 378918 - RNA, 22 nt, Human
caccaucagcagcaggugucaa

SEQ ID NO: 378919 - RNA, 22 nt, Human
uucccucucacuuaaagcuugg

SEQ ID NO: 378920 - RNA, 22 nt, Human
cagugcagucaaggaagaacca

SEQ ID NO: 378921 - RNA, 20 nt, Human
uaggcagagcugugcagccu

SEQ ID NO: 378922 - RNA, 22 nt, Human
aggcuucugugagcucauacaa

SEQ ID NO: 378923 - RNA, 22 nt, Human
gaaugcacacgugugugcaugc

SEQ ID NO: 378924 - RNA, 22 nt, Human
ccauaagguuuggggccaugca

SEQ ID NO: 378925 - RNA, 22 nt, Human
gccaguuccuguggagucagag

SEQ ID NO: 378926 - RNA, 22 nt, Human
uaaauaugcauguauccuuauc

SEQ ID NO: 378927 - RNA, 22 nt, Human
auuauguagcuaaaaauugugu

SEQ ID NO: 378928 - RNA, 22 nt, Human
uagaucugauacaauucaucug

SEQ ID NO: 378929 - RNA, 21 nt, Human
aacauuucaggauccaaauug

SEQ ID NO: 378930 - RNA, 22 nt, Human
cagcaggauuggauacaucuca

SEQ ID NO: 378931 - RNA, 22 nt, Human
uucucuggaacugaaacaagau

SEQ ID NO: 378932 - RNA, 22 nt, Human
ucauugcaggcauuccccugcc

SEQ ID NO: 378933 - RNA, 22 nt, Human
aggggcagccucacaauccucu

SEQ ID NO: 378934 - RNA, 22 nt, Human
uggguagaggaauugggcuacc

SEQ ID NO: 378935 - RNA, 22 nt, Human
ggagugacucacagcugggaca

SEQ ID NO: 378936 - RNA, 22 nt, Human
cucccuggaggugagcuggcac

SEQ ID NO: 378937 - RNA, 21 nt, Human
agaagucaauugaacugaaau

SEQ ID NO: 378938 - RNA, 22 nt, Human
agaaggggagaagcuaccagga

SEQ ID NO: 378939 - RNA, 22 nt, Human
auuauuuuaugugcggccugau

SEQ ID NO: 378940 - RNA, 22 nt, Human
uuugacauuauccuguuacugg

SEQ ID NO: 378941 - RNA, 22 nt, Human
uauaauccugcuucacauugaa

SEQ ID NO: 378942 - RNA, 22 nt, Human
ccuuaaaagaacuaucucuucu

SEQ ID NO: 378943 - RNA, 22 nt, Human
aguaaaauuucugcugaggaga

SEQ ID NO: 378944 - RNA, 22 nt, Human
cacuggggaaaacaggcuucuu

SEQ ID NO: 378945 - RNA, 22 nt, Human
agggcugcugcuccgggcccag

SEQ ID NO: 378946 - RNA, 23 nt, Human
gggcaguuauguuguccuuggcu

SEQ ID NO: 378947 - RNA, 22 nt, Human
ggagcagccgcgucucagggca

SEQ ID NO: 378948 - RNA, 22 nt, Human
uagggaggcuacuucuuguagg

SEQ ID NO: 378949 - RNA, 22 nt, Human
augggggccugaacaggcaaaa

SEQ ID NO: 378950 - RNA, 22 nt, Human
cuauugaauagcccaaaucauu

SEQ ID NO: 378951 - RNA, 22 nt, Human
acaguggaauuuguagaugugu

SEQ ID NO: 378952 - RNA, 22 nt, Human
agggaagcuuguuacugagaag

SEQ ID NO: 378953 - RNA, 22 nt, Human
ccagagaguaucauggagagua

SEQ ID NO: 378954 - RNA, 22 nt, Human
aaagccaaaugaaagaugguuc

SEQ ID NO: 378955 - RNA, 22 nt, Human
aaagaaucagaagucucaaaca

SEQ ID NO: 378956 - RNA, 22 nt, Human
gcuggccugggcagaggcuaug

SEQ ID NO: 378957 - RNA, 22 nt, Human
auccacagucuuagccaucaaa

SEQ ID NO: 378958 - RNA, 23 nt, Human
auuuccuacuauaaaagagguaa

SEQ ID NO: 378959 - RNA, 22 nt, Human
cucucugguacauagaguuugg

SEQ ID NO: 378960 - RNA, 22 nt, Human
agagaugaaaaguggagacugg

SEQ ID NO: 378961 - RNA, 22 nt, Human
ccucagggucugaggagaccgu

SEQ ID NO: 378962 - RNA, 22 nt, Human
ggcacugagcugccuuggggca

SEQ ID NO: 378963 - RNA, 20 nt, Human
cugcugugguccuuuauuuu

SEQ ID NO: 378964 - RNA, 22 nt, Human
cagcagaggcacgucugugaau

SEQ ID NO: 378965 - RNA, 22 nt, Human
agagccagcaacucuagcccug

SEQ ID NO: 378966 - RNA, 22 nt, Human
gggcugcugccaccagguggau

SEQ ID NO: 378967 - RNA, 22 nt, Human
aggauuuaggagcuggcuaacg

SEQ ID NO: 378968 - RNA, 22 nt, Human
uaaaugagggcugacaugauug

SEQ ID NO: 378969 - RNA, 22 nt, Human
gcagccacacuguuacagaaug

SEQ ID NO: 378970 - RNA, 22 nt, Human
gugccaaaagcuauaauuuggu

SEQ ID NO: 378971 - RNA, 22 nt, Human
uccaggaggccucauuuccugu

SEQ ID NO: 378972 - RNA, 22 nt, Human
ccugggcauaaaucacuccaag

SEQ ID NO: 378973 - RNA, 22 nt, Human
uauguacauggagagcaauuga

SEQ ID NO: 378974 - RNA, 22 nt, Human
aaaugcuguaacugauauucug

SEQ ID NO: 378975 - RNA, 22 nt, Human
gguuucaacuuuugugaggaau

SEQ ID NO: 378976 - RNA, 22 nt, Human
gagacagcacaggccacuggga

SEQ ID NO: 378977 - RNA, 22 nt, Human
cucugcaggggaggcaugcacu

SEQ ID NO: 378978 - RNA, 22 nt, Human
ugccaggcgugguggugcgcac

SEQ ID NO: 378979 - RNA, 22 nt, Human
auuugcuugugcuaugaaaguu

SEQ ID NO: 378980 - RNA, 22 nt, Human
aaagaacagauguguggugcau

SEQ ID NO: 378981 - RNA, 22 nt, Human
gggcuagaaauucugcagugga

SEQ ID NO: 378982 - RNA, 22 nt, Human
ugcagggccuuguugaugugcu

SEQ ID NO: 378983 - RNA, 22 nt, Human
uuacagaacugucuugaaauuu

SEQ ID NO: 378984 - RNA, 22 nt, Human
gcucuguccagcgugcacagaa

SEQ ID NO: 378985 - RNA, 22 nt, Human
gaaggagagagacaucgucccu

SEQ ID NO: 378986 - RNA, 22 nt, Human
gacauucacaguuuccgauggu

SEQ ID NO: 378987 - RNA, 22 nt, Human
gcaccacaucaaugaggggagc

SEQ ID NO: 378988 - RNA, 22 nt, Human
uuauuagggugguuuauguucu

SEQ ID NO: 378989 - RNA, 22 nt, Human
agcccaagcauaggagggaggc

SEQ ID NO: 378990 - RNA, 22 nt, Human
ucuaggagaaccaucagggagg

SEQ ID NO: 378991 - RNA, 21 nt, Human
cuccugggcuaagauauagug

SEQ ID NO: 378992 - RNA, 22 nt, Human
ucagaggaacacuguuucaugc

SEQ ID NO: 378993 - RNA, 22 nt, Human
augaugguaaauucaguauccg

SEQ ID NO: 378994 - RNA, 22 nt, Human
gagguuagaggucagugcaguc

SEQ ID NO: 378995 - RNA, 22 nt, Human
gauagaaagagugguucuuuuu

SEQ ID NO: 378996 - RNA, 22 nt, Human
uggcagcauguuauguaaggaa

SEQ ID NO: 378997 - RNA, 22 nt, Human
aaagucauccaaauuuuuaugu

SEQ ID NO: 378998 - RNA, 22 nt, Human
uauuacugagguuuuauggagu

SEQ ID NO: 378999 - RNA, 22 nt, Human
augcaguacauacaaacacuga

SEQ ID NO: 379000 - RNA, 22 nt, Human
agcucuccacacauaggacuag

SEQ ID NO: 379001 - RNA, 22 nt, Human
ugaggccacuuccccacagccc

SEQ ID NO: 379002 - RNA, 22 nt, Human
uccuggagauaauugcagugaa

SEQ ID NO: 379003 - RNA, 19 nt, Human
guggccucggagcgcgcgg

SEQ ID NO: 379004 - RNA, 22 nt, Human
uccucuggauauaagccucacc

SEQ ID NO: 379005 - RNA, 22 nt, Human
cugucagcacucuacuacagau

SEQ ID NO: 379006 - RNA, 20 nt, Human
agugccagggcaggugagag

SEQ ID NO: 379007 - RNA, 22 nt, Human
acagagcuguacaugugccaug

SEQ ID NO: 379008 - RNA, 22 nt, Human
gaguuauuuguagggauuauau

SEQ ID NO: 379009 - RNA, 22 nt, Human
uuuaggcacagggaguugguuu

SEQ ID NO: 379010 - RNA, 22 nt, Human
ugcugccaggucuugcugucca

SEQ ID NO: 379011 - RNA, 22 nt, Human
uuucauugaacuaaagaaucug

SEQ ID NO: 379012 - RNA, 22 nt, Human
agaucacagcccccagaugcca

SEQ ID NO: 379013 - RNA, 22 nt, Human
ucaguuuuuacggucacaggga

SEQ ID NO: 379014 - RNA, 22 nt, Human
agaguguaauaagggcaagggc

SEQ ID NO: 379015 - RNA, 22 nt, Human
gaagagcuuagacagaaucaaa

SEQ ID NO: 379016 - RNA, 22 nt, Human
gggcagggguagcauuccaagu

SEQ ID NO: 379017 - RNA, 22 nt, Human
augagacuaccuguaauguggc

SEQ ID NO: 379018 - RNA, 22 nt, Human
ucugaggcuucagacuguacug

SEQ ID NO: 379019 - RNA, 22 nt, Human
ggcuuucuagaucuagcucugu

SEQ ID NO: 379020 - RNA, 22 nt, Human
uuccaagagcuuuaauuguuga

SEQ ID NO: 379021 - RNA, 22 nt, Human
uggcuaggcuccaagagcugga

SEQ ID NO: 379022 - RNA, 22 nt, Human
acuggcagcuguaggaugcaug

SEQ ID NO: 379023 - RNA, 22 nt, Human
ucccuggagauaacuucuggga

SEQ ID NO: 379024 - RNA, 22 nt, Human
ccagucacucugugagagcuac

SEQ ID NO: 379025 - RNA, 22 nt, Human
cagaggcacagcuucuuuuaau

SEQ ID NO: 379026 - RNA, 22 nt, Human
agcccagggaaccaggaagugg

SEQ ID NO: 379027 - RNA, 22 nt, Human
ggcagcugauuagcaucaagga

SEQ ID NO: 379028 - RNA, 22 nt, Human
cuuauaguaugauguugagaau

SEQ ID NO: 379029 - RNA, 22 nt, Human
ccaugcacaccagcaggcagac

SEQ ID NO: 379030 - RNA, 22 nt, Human
uagaaaauagggccuguggagc

SEQ ID NO: 379031 - RNA, 22 nt, Human
cagggcucugccuugagggaug

SEQ ID NO: 379032 - RNA, 22 nt, Human
uggcugaggucuggggcuucug

SEQ ID NO: 379033 - RNA, 22 nt, Human
ggagaugcuuuccaguggggau

SEQ ID NO: 379034 - RNA, 22 nt, Human
cugccugcuucugagccagagg

SEQ ID NO: 379035 - RNA, 20 nt, Human
aucaaaggcugauucagucc

SEQ ID NO: 379036 - RNA, 22 nt, Human
aaguucaagcucugccuaaaau

SEQ ID NO: 379037 - RNA, 21 nt, Human
ugcucaugcaaugcaugucca

SEQ ID NO: 379038 - RNA, 22 nt, Human
caggaagcugugaaggagacgg

SEQ ID NO: 379039 - RNA, 22 nt, Human
guccugggaaggaagccaggga

SEQ ID NO: 379040 - RNA, 19 nt, Human
ccugucugucuucagcuag

SEQ ID NO: 379041 - RNA, 22 nt, Human
cccuggaguagcacugggucgc

SEQ ID NO: 379042 - RNA, 22 nt, Human
gcugguuaggugagggugcgcc

SEQ ID NO: 379043 - RNA, 22 nt, Human
ugaaagaacuagcaucuucaag

SEQ ID NO: 379044 - RNA, 22 nt, Human
aaguccagguccucauuccauc

SEQ ID NO: 379045 - RNA, 20 nt, Human
cugaacacagaauaagcaca

SEQ ID NO: 379046 - RNA, 22 nt, Human
gcugcccaggguggagccggcu

SEQ ID NO: 379047 - RNA, 22 nt, Human
gcagagcaguacucucuugacu

SEQ ID NO: 379048 - RNA, 22 nt, Human
gugccuuccccgguggucuguu

SEQ ID NO: 379049 - RNA, 22 nt, Human
gcagugaagccagaucugaaau

SEQ ID NO: 379050 - RNA, 22 nt, Human
ccuggcagcuaagugcuuugag

SEQ ID NO: 379051 - RNA, 22 nt, Human
auggcuuaugaauaacaguagg

SEQ ID NO: 379052 - RNA, 22 nt, Human
cuuuauguccuugaagaguugu

SEQ ID NO: 379053 - RNA, 22 nt, Human
agccuccacagaugcaaagggc

SEQ ID NO: 379054 - RNA, 22 nt, Human
uguccacaucacucacuuguca

SEQ ID NO: 379055 - RNA, 20 nt, Human
ccagagcagccacugaaguu

SEQ ID NO: 379056 - RNA, 22 nt, Human
uggcugagcugcagcguggcuu

SEQ ID NO: 379057 - RNA, 22 nt, Human
agcagugggggaguguuaguuu

SEQ ID NO: 379058 - RNA, 22 nt, Human
cugccuggaaugccagcuucuc

SEQ ID NO: 379059 - RNA, 22 nt, Human
ccaaagugcugggguuacaggc

SEQ ID NO: 379060 - RNA, 22 nt, Human
agggagccuuccuggcuguggu

SEQ ID NO: 379061 - RNA, 21 nt, Human
auagaacaccaggcauauaua

SEQ ID NO: 379062 - RNA, 22 nt, Human
ugcauacacaagcauacaugua

SEQ ID NO: 379063 - RNA, 22 nt, Human
uccucagggcggccuccgucuu

SEQ ID NO: 379064 - RNA, 22 nt, Human
ccucagagaaagguauggcuga

SEQ ID NO: 379065 - RNA, 22 nt, Human
ccaguuuuuccagugcuuucug

SEQ ID NO: 379066 - RNA, 22 nt, Human
uucugugcccauuuuaaaaugg

SEQ ID NO: 379067 - RNA, 22 nt, Human
gggaccaggugggugcauuccg

SEQ ID NO: 379068 - RNA, 22 nt, Human
acuuugcaauacuuaauacaaa

SEQ ID NO: 379069 - RNA, 22 nt, Human
gccucugcucggacuuugccuc

SEQ ID NO: 379070 - RNA, 22 nt, Human
gcagggcagagggagaaucucu

SEQ ID NO: 379071 - RNA, 22 nt, Human
gcagagaggauauuauugucca

SEQ ID NO: 379072 - RNA, 22 nt, Human
cucugagagagcuggugagcac

SEQ ID NO: 379073 - RNA, 22 nt, Human
uuccauaauaaccugagagaaa

SEQ ID NO: 379074 - RNA, 22 nt, Human
agcuucuguucaucuuccaggc

SEQ ID NO: 379075 - RNA, 22 nt, Human
acaaagucucuaauaaucuucu

SEQ ID NO: 379076 - RNA, 21 nt, Human
acucaggagacuaacuauguc

SEQ ID NO: 379077 - RNA, 20 nt, Human
gguagcagcugcugucaucc

SEQ ID NO: 379078 - RNA, 22 nt, Human
ugaggggagaagcagcagccug

SEQ ID NO: 379079 - RNA, 23 nt, Human
ucagugauguugaaccuagcagu

SEQ ID NO: 379080 - RNA, 22 nt, Human
uauguacaugauuucauuugcu

SEQ ID NO: 379081 - RNA, 22 nt, Human
aagacagugacagucacaauug

SEQ ID NO: 379082 - RNA, 22 nt, Human
aacagcaugcuggguaacauug

SEQ ID NO: 379083 - RNA, 22 nt, Human
agggcagcugugagccacugug

SEQ ID NO: 379084 - RNA, 18 nt, Human
auauguuaauuagguagg

SEQ ID NO: 379085 - RNA, 22 nt, Human
aagugagauuauauguacggga

SEQ ID NO: 379086 - RNA, 19 nt, Human
gcuggcagauguggccgug

SEQ ID NO: 379087 - RNA, 22 nt, Human
ucucagagggaaaggccaauuu

SEQ ID NO: 379088 - RNA, 22 nt, Human
gcugucuguucgagcguguguu

SEQ ID NO: 379089 - RNA, 22 nt, Human
aggcugggcuccgcccaacucc

SEQ ID NO: 379090 - RNA, 22 nt, Human
uugaaaguuuauggagucugca

SEQ ID NO: 379091 - RNA, 22 nt, Human
agcagccaaccuuacauucauc

SEQ ID NO: 379092 - RNA, 22 nt, Human
ucuuugaauccuuuacaucuga

SEQ ID NO: 379093 - RNA, 23 nt, Human
uaguuauuuucucuguaauuugc

SEQ ID NO: 379094 - RNA, 22 nt, Human
ggcagauggagaagcagcaggu

SEQ ID NO: 379095 - RNA, 21 nt, Human
uguaaguuucaucugaauugg

SEQ ID NO: 379096 - RNA, 22 nt, Human
uugcugaaguuaaugcuugcaa

SEQ ID NO: 379097 - RNA, 22 nt, Human
caauauauaaugaguacuuucc

SEQ ID NO: 379098 - RNA, 22 nt, Human
accaggcuugaugauuugcuua

SEQ ID NO: 379099 - RNA, 22 nt, Human
ugccaaggguaugggcaagaua

SEQ ID NO: 379100 - RNA, 22 nt, Human
ggccucucauguccugggcuuc

SEQ ID NO: 379101 - RNA, 17 nt, Human
ugaaggaaggaugaugu

SEQ ID NO: 379102 - RNA, 19 nt, Human
ccucugccagcccgccucu

SEQ ID NO: 379103 - RNA, 22 nt, Human
aaagauuuaugaaguucaauua

SEQ ID NO: 379104 - RNA, 22 nt, Human
augaggcaugugaggagaaggg

SEQ ID NO: 379105 - RNA, 22 nt, Human
gguacaauccacuguggguuag

SEQ ID NO: 379106 - RNA, 22 nt, Human
auucuguauuucuaauaagauc

SEQ ID NO: 379107 - RNA, 23 nt, Human
uccagcagccaagaaggguagaa

SEQ ID NO: 379108 - RNA, 19 nt, Human
ucuguucacauuguuucgc

SEQ ID NO: 379109 - RNA, 22 nt, Human
uugcagggcaggaccauggaca

SEQ ID NO: 379110 - RNA, 22 nt, Human
agccucuggcccuagacugcuu

SEQ ID NO: 379111 - RNA, 22 nt, Human
auggccuggccagagcucugcu

SEQ ID NO: 379112 - RNA, 22 nt, Human
uugaggagcaggaugggaggcu

SEQ ID NO: 379113 - RNA, 22 nt, Human
ccuccuggugggcgcuucuggc

SEQ ID NO: 379114 - RNA, 22 nt, Human
acagccagggucucaggaggcg

SEQ ID NO: 379115 - RNA, 22 nt, Human
gcaaggaccuuugagcgugcca

SEQ ID NO: 379116 - RNA, 22 nt, Human
gugcuucucuucacacccaacu

SEQ ID NO: 379117 - RNA, 22 nt, Human
agcagugggugacagagcugag

SEQ ID NO: 379118 - RNA, 19 nt, Human
agacaaguuuccagaagcc

SEQ ID NO: 379119 - RNA, 22 nt, Human
uuuggacuuagccugcagaauu

SEQ ID NO: 379120 - RNA, 22 nt, Human
gggcugagccacagcuuuuguu

SEQ ID NO: 379121 - RNA, 22 nt, Human
gagccuucaucgcagccuuguu

SEQ ID NO: 379122 - RNA, 22 nt, Human
gggcagcugucuugguucucaa

SEQ ID NO: 379123 - RNA, 21 nt, Human
ugucagcaacaauacuuucuc

SEQ ID NO: 379124 - RNA, 22 nt, Human
agggcccucuggcaggccaggc

SEQ ID NO: 379125 - RNA, 22 nt, Human
uugcagagccaugaggcuggcu

SEQ ID NO: 379126 - RNA, 19 nt, Human
uucuccagccugaccugag

SEQ ID NO: 379127 - RNA, 22 nt, Human
uaaagguacgaagugagggauu

SEQ ID NO: 379128 - RNA, 22 nt, Human
ucccagggcacucacccucccu

SEQ ID NO: 379129 - RNA, 22 nt, Human
gcagcaugagcuauacaaagua

SEQ ID NO: 379130 - RNA, 22 nt, Human
ggugacugguuuaucuggcagu

SEQ ID NO: 379131 - RNA, 22 nt, Human
aagcagcauucagugaaaugug

SEQ ID NO: 379132 - RNA, 22 nt, Human
caugugucaaaugauguagcug

SEQ ID NO: 379133 - RNA, 22 nt, Human
caggaccccauauucacugaac

SEQ ID NO: 379134 - RNA, 21 nt, Human
cuguccaguaauuccuggcac

SEQ ID NO: 379135 - RNA, 22 nt, Human
aggaagcucggagagggcaaau

SEQ ID NO: 379136 - RNA, 22 nt, Human
ugcagaaggccugacauugcac

SEQ ID NO: 379137 - RNA, 22 nt, Human
uuauuaaugaguacaaguuauu

SEQ ID NO: 379138 - RNA, 22 nt, Human
auagacauagccguaauuuauu

SEQ ID NO: 379139 - RNA, 22 nt, Human
cugggaaauggcuucgagcuca

SEQ ID NO: 379140 - RNA, 22 nt, Human
ggcacugggcaccggcugaggg

SEQ ID NO: 379141 - RNA, 22 nt, Human
aaagaaucguguguaguuugaa

SEQ ID NO: 379142 - RNA, 22 nt, Human
augccaggaacaaacaguggug

SEQ ID NO: 379143 - RNA, 17 nt, Human
uugggagagaaagguau

SEQ ID NO: 379144 - RNA, 22 nt, Human
uucuucaaugugcccuguuuuc

SEQ ID NO: 379145 - RNA, 22 nt, Human
cugccucugguuuuggucccug

SEQ ID NO: 379146 - RNA, 22 nt, Human
uuuuaguuuggauuucuaaagc

SEQ ID NO: 379147 - RNA, 22 nt, Human
agggguggccugccuuacuccc

SEQ ID NO: 379148 - RNA, 22 nt, Human
auagacuugguuaguaaauuug

SEQ ID NO: 379149 - RNA, 22 nt, Human
ucauuuccucaaauucaagguu

SEQ ID NO: 379150 - RNA, 22 nt, Human
ugcagggccgcuggaggucaug

SEQ ID NO: 379151 - RNA, 22 nt, Human
uggggcuggcuauugucucccu

SEQ ID NO: 379152 - RNA, 22 nt, Human
cacaagacuuauuuguguagaa

SEQ ID NO: 379153 - RNA, 22 nt, Human
gaagcagcaaaucugcaguauc

SEQ ID NO: 379154 - RNA, 22 nt, Human
gcucaggauuucauccaugugu

SEQ ID NO: 379155 - RNA, 20 nt, Human
ugagugauggaggcggguca

SEQ ID NO: 379156 - RNA, 22 nt, Human
cagaaggcuuuguggaguagac

SEQ ID NO: 379157 - RNA, 22 nt, Human
caagggcagaggcagggccccg

SEQ ID NO: 379158 - RNA, 22 nt, Human
uauacagaaccgccugaagucu

SEQ ID NO: 379159 - RNA, 22 nt, Human
gcagccaccucccauggcgggg

SEQ ID NO: 379160 - RNA, 22 nt, Human
uagggcucagaguccaguuucu

SEQ ID NO: 379161 - RNA, 22 nt, Human
acagugugaugggccugccuga

SEQ ID NO: 379162 - RNA, 22 nt, Human
augcucuggaguacgugaaauu

SEQ ID NO: 379163 - RNA, 19 nt, Human
cuauacagccucugaggaa

SEQ ID NO: 379164 - RNA, 22 nt, Human
gggagggaagguaccuguguga

SEQ ID NO: 379165 - RNA, 16 nt, Human
cuuccucuucacuggc

SEQ ID NO: 379166 - RNA, 22 nt, Human
ggcaugggguguauguggcacg

SEQ ID NO: 379167 - RNA, 17 nt, Human
caggcagacauguaagc

SEQ ID NO: 379168 - RNA, 22 nt, Human
gggacuggaguagaggccggug

SEQ ID NO: 379169 - RNA, 22 nt, Human
cugggcaguuuauucaguucug

SEQ ID NO: 379170 - RNA, 22 nt, Human
aggauuuauuggugggaaguua

SEQ ID NO: 379171 - RNA, 22 nt, Human
caagcugguaucagcuagagcg

SEQ ID NO: 379172 - RNA, 22 nt, Human
ucaaagagcuauucaguugugg

SEQ ID NO: 379173 - RNA, 22 nt, Human
gauagaaagaauauagauucca

SEQ ID NO: 379174 - RNA, 23 nt, Human
uauuagggccaggacuggcaaau

SEQ ID NO: 379175 - RNA, 17 nt, Human
agggucaggugaaguuc

SEQ ID NO: 379176 - RNA, 18 nt, Human
cccagcuggugggucagu

SEQ ID NO: 379177 - RNA, 22 nt, Human
agcagccaguucucugugguag

SEQ ID NO: 379178 - RNA, 22 nt, Human
gaggcugauucggggaacagca

SEQ ID NO: 379179 - RNA, 22 nt, Human
cacugaaggcugcagcucagcc

SEQ ID NO: 379180 - RNA, 22 nt, Human
cuggugggaggcaagguggaag

SEQ ID NO: 379181 - RNA, 22 nt, Human
aggaccagaggccagagucagc

SEQ ID NO: 379182 - RNA, 22 nt, Human
agccauugaguuuuaugugcua

SEQ ID NO: 379183 - RNA, 19 nt, Human
gcauuucucuuuacagcca

SEQ ID NO: 379184 - RNA, 22 nt, Human
uauuuaaaaagaggccagcugg

SEQ ID NO: 379185 - RNA, 21 nt, Human
gcugucucuggcuccugggaa

SEQ ID NO: 379186 - RNA, 22 nt, Human
acucccacuccagaguagaagc

SEQ ID NO: 379187 - RNA, 22 nt, Human
aaacaaguguaaacuagucugu

SEQ ID NO: 379188 - RNA, 22 nt, Human
ccccuuccacagugcuuccuaa

SEQ ID NO: 379189 - RNA, 22 nt, Human
ucagggcacauucugcaguggc

SEQ ID NO: 379190 - RNA, 22 nt, Human
gccuggcccagggcucuuguug

SEQ ID NO: 379191 - RNA, 20 nt, Human
cucaggauacugcaaaguug

SEQ ID NO: 379192 - RNA, 22 nt, Human
aguggcaguagaugagcugguu

SEQ ID NO: 379193 - RNA, 18 nt, Human
ccuggagcuccacagcaa

SEQ ID NO: 379194 - RNA, 22 nt, Human
agcuuguuagaaauguagacuc

SEQ ID NO: 379195 - RNA, 20 nt, Human
cagaccugcacccacuucga

SEQ ID NO: 379196 - RNA, 22 nt, Human
aacaaauguguuuuguaauuaa

SEQ ID NO: 379197 - RNA, 22 nt, Human
uggcaggcagugugggagcugg

SEQ ID NO: 379198 - RNA, 22 nt, Human
uuuguuuacucauucauugaug

SEQ ID NO: 379199 - RNA, 22 nt, Human
ggaccugcauuuuaacaagauc

SEQ ID NO: 379200 - RNA, 22 nt, Human
gcuggcauuacaggagagaacc

SEQ ID NO: 379201 - RNA, 22 nt, Human
caaagcucaugcucuuagccau

SEQ ID NO: 379202 - RNA, 22 nt, Human
agaugcugucacacacacuguu

SEQ ID NO: 379203 - RNA, 22 nt, Human
uuccuuagaguuuccagaaagc

SEQ ID NO: 379204 - RNA, 22 nt, Human
aggcaguguguagcuggaagag

SEQ ID NO: 379205 - RNA, 22 nt, Human
aaacauugcuaaauaaugcugc

SEQ ID NO: 379206 - RNA, 22 nt, Human
ccuguccuccaagagcacaucu

SEQ ID NO: 379207 - RNA, 22 nt, Human
gagggcagugaauuuugaagcu

SEQ ID NO: 379208 - RNA, 22 nt, Human
gccucugcugcaagccugguug

SEQ ID NO: 379209 - RNA, 22 nt, Human
uggagucugugaugcucugggu

SEQ ID NO: 379210 - RNA, 22 nt, Human
cccauucauccucgcuuccuuc

SEQ ID NO: 379211 - RNA, 23 nt, Human
uuccagaguccacaucugccacc

SEQ ID NO: 379212 - RNA, 22 nt, Human
ugugaauaccuugaauucauca

SEQ ID NO: 379213 - RNA, 22 nt, Human
ugugcccauuccacuugaguac

SEQ ID NO: 379214 - RNA, 22 nt, Human
aagacuuucaaguaugcaugca

SEQ ID NO: 379215 - RNA, 22 nt, Human
cagaggaaaguauuucuggaag

SEQ ID NO: 379216 - RNA, 22 nt, Human
caugggagcuaucuccaucacu

SEQ ID NO: 379217 - RNA, 22 nt, Human
aggcagguguuaacccucugag

SEQ ID NO: 379218 - RNA, 22 nt, Human
caggguggcccuguggucucau

SEQ ID NO: 379219 - RNA, 22 nt, Human
agcaaggcagucagcuggcugg

SEQ ID NO: 379220 - RNA, 22 nt, Human
augaggcaucuaacauugcaaa

SEQ ID NO: 379221 - RNA, 22 nt, Human
gucaggaucucccaguacauau

SEQ ID NO: 379222 - RNA, 22 nt, Human
ugcagccaccaccucugcugaa

SEQ ID NO: 379223 - RNA, 22 nt, Human
uaaauguguuagucaugguuuu

SEQ ID NO: 379224 - RNA, 22 nt, Human
accugaggcuguuagucuaggu

SEQ ID NO: 379225 - RNA, 22 nt, Human
aggagggacaccaauauauguu

SEQ ID NO: 379226 - RNA, 22 nt, Human
aggcaguuuauccccagagccu

SEQ ID NO: 379227 - RNA, 22 nt, Human
agcagcuuacauguggccuauc

SEQ ID NO: 379228 - RNA, 22 nt, Human
ccuggcugcuauagcagcaugu

SEQ ID NO: 379229 - RNA, 21 nt, Human
aguguccuugaucuugccuug

SEQ ID NO: 379230 - RNA, 22 nt, Human
ccucagggaggccucuguggcu

SEQ ID NO: 379231 - RNA, 22 nt, Human
gaggcugccccuuccucagcug

SEQ ID NO: 379232 - RNA, 22 nt, Human
gaucuucuagcagaaguaauuu

SEQ ID NO: 379233 - RNA, 22 nt, Human
uuuacagagagagaacuggacu

SEQ ID NO: 379234 - RNA, 22 nt, Human
gagcacagggaauagacagaua

SEQ ID NO: 379235 - RNA, 22 nt, Human
ugcccaggcuccucgcagccuu

SEQ ID NO: 379236 - RNA, 22 nt, Human
cuugaaagucacaugcagcccu

SEQ ID NO: 379237 - RNA, 22 nt, Human
ggacaagccugugaguggguuu

SEQ ID NO: 379238 - RNA, 22 nt, Human
gaagccaagugcaaaugccuua

SEQ ID NO: 379239 - RNA, 22 nt, Human
agccagggagguggagguugca

SEQ ID NO: 379240 - RNA, 22 nt, Human
aggaccuguagggccugcaucc

SEQ ID NO: 379241 - RNA, 22 nt, Human
accaggaguuuugaccaggggc

SEQ ID NO: 379242 - RNA, 22 nt, Human
gcauuauuaauagcugcaugag

SEQ ID NO: 379243 - RNA, 22 nt, Human
ggaggcccagagaggugaagug

SEQ ID NO: 379244 - RNA, 22 nt, Human
gacaggcuuugagucccagaac

SEQ ID NO: 379245 - RNA, 21 nt, Human
cgcagagcgaacuugcggcgc

SEQ ID NO: 379246 - RNA, 22 nt, Human
ccagcuggcaggagagucaggg

SEQ ID NO: 379247 - RNA, 22 nt, Human
ugggccuccaauuccagcggga

SEQ ID NO: 379248 - RNA, 22 nt, Human
gccuggaggaauguagcugagg

SEQ ID NO: 379249 - RNA, 22 nt, Human
aaaauucugucauuaaauugug

SEQ ID NO: 379250 - RNA, 22 nt, Human
aggcugaggcggguagaucacc

SEQ ID NO: 379251 - RNA, 22 nt, Human
uuuauacauggagaauuuuugc

SEQ ID NO: 379252 - RNA, 22 nt, Human
gcagggcuauuggaaggagaug

SEQ ID NO: 379253 - RNA, 22 nt, Human
uuaagucacuuaucuaaagaca

SEQ ID NO: 379254 - RNA, 22 nt, Human
agagucugaggcagcugcagcc

SEQ ID NO: 379255 - RNA, 22 nt, Human
agccacaggaaacagagacagc

SEQ ID NO: 379256 - RNA, 22 nt, Human
gcugugcagccaagugccucug

SEQ ID NO: 379257 - RNA, 22 nt, Human
augucacagcucccauuccucc

SEQ ID NO: 379258 - RNA, 22 nt, Human
uggcuucaaaaucuaguggucu

SEQ ID NO: 379259 - RNA, 22 nt, Human
cagugccaugucugagccccua

SEQ ID NO: 379260 - RNA, 21 nt, Human
aggccucuucauggccaugau

SEQ ID NO: 379261 - RNA, 22 nt, Human
acuuugaaacuaaaauucauua

SEQ ID NO: 379262 - RNA, 23 nt, Human
acagagaucuugacuuguaugga

SEQ ID NO: 379263 - RNA, 22 nt, Human
uccuguggucuggaaggaaugg

SEQ ID NO: 379264 - RNA, 22 nt, Human
aagagggcagcacagguggguc

SEQ ID NO: 379265 - RNA, 22 nt, Human
uuagaaaaaacgucuucuagug

SEQ ID NO: 379266 - RNA, 22 nt, Human
aaaaggcauggagguugauagu

SEQ ID NO: 379267 - RNA, 22 nt, Human
ccagaggacuugggggcugaau

SEQ ID NO: 379268 - RNA, 22 nt, Human
agcuggagaugcccagcaccgg

SEQ ID NO: 379269 - RNA, 22 nt, Human
uuaagaauggaaugaggaauuu

SEQ ID NO: 379270 - RNA, 22 nt, Human
agggcugcaggcaagauauggc

SEQ ID NO: 379271 - RNA, 22 nt, Human
cagcuuuaggacucauaauaaa

SEQ ID NO: 379272 - RNA, 22 nt, Human
agugaccaacaaugcugagaag

SEQ ID NO: 379273 - RNA, 22 nt, Human
ugcugaugaguccuucuaucgc

SEQ ID NO: 379274 - RNA, 22 nt, Human
agggaagugaaugacagauauc

SEQ ID NO: 379275 - RNA, 22 nt, Human
agggaauguagcaagaugccaa

SEQ ID NO: 379276 - RNA, 22 nt, Human
uucuuugcccuuaaugaaauaa

SEQ ID NO: 379277 - RNA, 22 nt, Human
aggagcugggcugcugcuggga

SEQ ID NO: 379278 - RNA, 22 nt, Human
auccuuggaugugucuuuuugu

SEQ ID NO: 379279 - RNA, 22 nt, Human
aggccuuaccauagcuguagca

SEQ ID NO: 379280 - RNA, 22 nt, Human
gcuugcucaacccccgucucuc

SEQ ID NO: 379281 - RNA, 21 nt, Human
ugauuuccagaaaauuggccc

SEQ ID NO: 379282 - RNA, 22 nt, Human
ggccugagcagacagcaugaug

SEQ ID NO: 379283 - RNA, 22 nt, Human
aggcugaggugugcugugaucg

SEQ ID NO: 379284 - RNA, 22 nt, Human
gcagcugggccccagccucucc

SEQ ID NO: 379285 - RNA, 22 nt, Human
uccaggagucagacagauggug

SEQ ID NO: 379286 - RNA, 22 nt, Human
gccugccuuuguaugacccuga

SEQ ID NO: 379287 - RNA, 22 nt, Human
aaauguguuugauaggaauauu

SEQ ID NO: 379288 - RNA, 22 nt, Human
cacaggcugcccgcagcuggga

SEQ ID NO: 379289 - RNA, 22 nt, Human
ugggacugcucuugcugggguc

SEQ ID NO: 379290 - RNA, 22 nt, Human
aggagaaggaggccccucacac

SEQ ID NO: 379291 - RNA, 22 nt, Human
gcuuuggagccuguguucugcc

SEQ ID NO: 379292 - RNA, 22 nt, Human
ccagucccagcucugccaugcu

SEQ ID NO: 379293 - RNA, 22 nt, Human
gaggccuggagccgccuaggcg

SEQ ID NO: 379294 - RNA, 22 nt, Human
auaaggcauauagucacuuuuu

SEQ ID NO: 379295 - RNA, 22 nt, Human
ugcugggggugucucaccaggc

SEQ ID NO: 379296 - RNA, 18 nt, Human
acaaaggucugcaagacc

SEQ ID NO: 379297 - RNA, 22 nt, Human
aggccuggcuuugguuugcuga

SEQ ID NO: 379298 - RNA, 23 nt, Human
uagggcagcugggagggacaugc

SEQ ID NO: 379299 - RNA, 22 nt, Human
aucuauacucagaguuaauauc

SEQ ID NO: 379300 - RNA, 18 nt, Human
cagaugagaugcaaucuc

SEQ ID NO: 379301 - RNA, 19 nt, Human
uucuaccuuacuguaggcu

SEQ ID NO: 379302 - RNA, 22 nt, Human
auuaggcauuauggggauaagg

SEQ ID NO: 379303 - RNA, 22 nt, Human
gcuggagcugcagccugggccu

SEQ ID NO: 379304 - RNA, 22 nt, Human
ucacagaagagauauugacaga

SEQ ID NO: 379305 - RNA, 22 nt, Human
ucugccugcuaacuccugcacc

SEQ ID NO: 379306 - RNA, 22 nt, Human
ugcuuaaacacauacauacaua

SEQ ID NO: 379307 - RNA, 22 nt, Human
cagcaggaaaaucaauucugug

SEQ ID NO: 379308 - RNA, 22 nt, Human
auggggcucugcggcugcuccc

SEQ ID NO: 379309 - RNA, 22 nt, Human
uaacugauauugaaaaacauca

SEQ ID NO: 379310 - RNA, 22 nt, Human
acugggccuugccauggcagcc

SEQ ID NO: 379311 - RNA, 18 nt, Human
gaggcagcuagcaauuuu

SEQ ID NO: 379312 - RNA, 22 nt, Human
uuggaugaagucuagcuuuagu

SEQ ID NO: 379313 - RNA, 22 nt, Human
auguaagguucagaguauguga

SEQ ID NO: 379314 - RNA, 22 nt, Human
cugggcaggagggcucuaugga

SEQ ID NO: 379315 - RNA, 23 nt, Human
agaggccaacuucuugccccucc

SEQ ID NO: 379316 - RNA, 22 nt, Human
agggucuguggaugcaucuggg

SEQ ID NO: 379317 - RNA, 22 nt, Human
uucaacuaauguuuauuuuaug

SEQ ID NO: 379318 - RNA, 22 nt, Human
aggccucaggaagguaaagaag

SEQ ID NO: 379319 - RNA, 22 nt, Human
gacccuguuucuacaaauaauu

SEQ ID NO: 379320 - RNA, 22 nt, Human
gcacccagccagcaucucagag

SEQ ID NO: 379321 - RNA, 22 nt, Human
ugggagcugggguuggacgucu

SEQ ID NO: 379322 - RNA, 22 nt, Human
ugcauaauacguuuccuauaac

SEQ ID NO: 379323 - RNA, 22 nt, Human
uuccaugaaggagacugagaag

SEQ ID NO: 379324 - RNA, 22 nt, Human
gaaggcuggaaggcaaguagga

SEQ ID NO: 379325 - RNA, 22 nt, Human
cagcagagaccaagugauuuga

SEQ ID NO: 379326 - RNA, 22 nt, Human
uguauuuuuaggaaugcgcuau

SEQ ID NO: 379327 - RNA, 22 nt, Human
ucuucagacccuuagcugugau

SEQ ID NO: 379328 - RNA, 22 nt, Human
auuacagaaugcaguuccuuau

SEQ ID NO: 379329 - RNA, 22 nt, Human
agugcagugguuaggagccagg

SEQ ID NO: 379330 - RNA, 21 nt, Human
uccaaaaaggagcguccuucu

SEQ ID NO: 379331 - RNA, 22 nt, Human
gaugcugagagguggagggaac

SEQ ID NO: 379332 - RNA, 22 nt, Human
aaguaugacauuuaagacaauu

SEQ ID NO: 379333 - RNA, 22 nt, Human
aaauucuuucauggcuaauaag

SEQ ID NO: 379334 - RNA, 22 nt, Human
aggcucaguucacgucaacuuu

SEQ ID NO: 379335 - RNA, 22 nt, Human
ucagagcugcccaugcaagggg

SEQ ID NO: 379336 - RNA, 22 nt, Human
uucacagauuucccugcacaug

SEQ ID NO: 379337 - RNA, 22 nt, Human
caguccuugcuaugacccugag

SEQ ID NO: 379338 - RNA, 22 nt, Human
agauauuuguaucuugcuauug

SEQ ID NO: 379339 - RNA, 22 nt, Human
ugcagggauuauguagggguug

SEQ ID NO: 379340 - RNA, 19 nt, Human
agggcugcucuggccuggg

SEQ ID NO: 379341 - RNA, 22 nt, Human
gagguauguaugcuacauucuu

SEQ ID NO: 379342 - RNA, 22 nt, Human
acagcuggaggccccauugucc

SEQ ID NO: 379343 - RNA, 22 nt, Human
cauguacaaaaggcaaaugccu

SEQ ID NO: 379344 - RNA, 22 nt, Human
cauaauuucuguaucagcacca

SEQ ID NO: 379345 - RNA, 18 nt, Human
acagggagggcgcugggg

SEQ ID NO: 379346 - RNA, 22 nt, Human
uucuucaaaacaacacuggccu

SEQ ID NO: 379347 - RNA, 22 nt, Human
guucuugccagcauccucaggu

SEQ ID NO: 379348 - RNA, 22 nt, Human
uuucauaaacaguagaagacua

SEQ ID NO: 379349 - RNA, 19 nt, Human
cccaggaggcggagguugc

SEQ ID NO: 379350 - RNA, 22 nt, Human
gagcuuuaggagaaggagguca

SEQ ID NO: 379351 - RNA, 19 nt, Human
ggcuggaguggccaucugu

SEQ ID NO: 379352 - RNA, 22 nt, Human
gccaccuguuucgcuugcccag

SEQ ID NO: 379353 - RNA, 22 nt, Human
ucucugagaaguuccuuuguga

SEQ ID NO: 379354 - RNA, 22 nt, Human
cccuggcaugcaugucccuggc

SEQ ID NO: 379355 - RNA, 22 nt, Human
ucucucuugucaccccaucugc

SEQ ID NO: 379356 - RNA, 22 nt, Human
guuaaagaagaauaguuccuuu

SEQ ID NO: 379357 - RNA, 22 nt, Human
cuggcucagugccuucagaagu

SEQ ID NO: 379358 - RNA, 22 nt, Human
ccagugcuuccaggaauacggu

SEQ ID NO: 379359 - RNA, 22 nt, Human
aaguuuaacuugaauucuuucu

SEQ ID NO: 379360 - RNA, 22 nt, Human
uuaugcuaagugcaacaagcca

SEQ ID NO: 379361 - RNA, 22 nt, Human
uucuuguaauuuggagaaauga

SEQ ID NO: 379362 - RNA, 22 nt, Human
ucacagcaaaugcugcuucuca

SEQ ID NO: 379363 - RNA, 22 nt, Human
uacauguaggugacauuuuaau

SEQ ID NO: 379364 - RNA, 22 nt, Human
cucagaagaacccaggguccca

SEQ ID NO: 379365 - RNA, 21 nt, Human
ugggcagauggcaguguggcu

SEQ ID NO: 379366 - RNA, 22 nt, Human
ucuucaauuagauuuaccaauu

SEQ ID NO: 379367 - RNA, 22 nt, Human
uaguggaggccuguugugugca

SEQ ID NO: 379368 - RNA, 22 nt, Human
aaaugcuugcucuugauuauuu

SEQ ID NO: 379369 - RNA, 20 nt, Human
ucagugauuaucucugagug

SEQ ID NO: 379370 - RNA, 22 nt, Human
uagggcaguuauaacauuagug

SEQ ID NO: 379371 - RNA, 22 nt, Human
auaguauuuaauaguuagcuca

SEQ ID NO: 379372 - RNA, 22 nt, Human
cuggccuuuaaaaugaccuuau

SEQ ID NO: 379373 - RNA, 22 nt, Human
caggacaguuugcuuugcccug

SEQ ID NO: 379374 - RNA, 22 nt, Human
gcugccucccagagcccugcag

SEQ ID NO: 379375 - RNA, 22 nt, Human
ugaaugaacuaaaucauaguuc

SEQ ID NO: 379376 - RNA, 22 nt, Human
guacuucccugggaggcaagca

SEQ ID NO: 379377 - RNA, 20 nt, Human
caggcacacucauuccugcu

SEQ ID NO: 379378 - RNA, 22 nt, Human
uagagcuauuuagagcauuuua

SEQ ID NO: 379379 - RNA, 22 nt, Human
ccuuuugcucucccauccagaa

SEQ ID NO: 379380 - RNA, 22 nt, Human
ucaggcaggcagagggcaaaug

SEQ ID NO: 379381 - RNA, 22 nt, Human
caagcuccuuacauccacaggg

SEQ ID NO: 379382 - RNA, 22 nt, Human
ggggcagagagaaggaagcuug

SEQ ID NO: 379383 - RNA, 22 nt, Human
agucaggauaugccuugugggc

SEQ ID NO: 379384 - RNA, 22 nt, Human
uuagaaauacaagugagguuga

SEQ ID NO: 379385 - RNA, 22 nt, Human
cauucugugauucuaaaucccu

SEQ ID NO: 379386 - RNA, 22 nt, Human
auuaggcagacaacguagccgg

SEQ ID NO: 379387 - RNA, 22 nt, Human
uaacagaaguuguucauugugg

SEQ ID NO: 379388 - RNA, 21 nt, Human
uuacuuuugcagcaaccuaau

SEQ ID NO: 379389 - RNA, 22 nt, Human
gagagcugcagccgagaggggg

SEQ ID NO: 379390 - RNA, 22 nt, Human
aggcagacucaauggcuagaua

SEQ ID NO: 379391 - RNA, 22 nt, Human
uucuccaacacaagcaugaugu

SEQ ID NO: 379392 - RNA, 22 nt, Human
uuacagaagaguaacuuggcaa

SEQ ID NO: 379393 - RNA, 22 nt, Human
gucacacucagaaugacuagag

SEQ ID NO: 379394 - RNA, 22 nt, Human
cagggccuuuuagcaucuucuc

SEQ ID NO: 379395 - RNA, 22 nt, Human
guuauauauaguauuucucuga

SEQ ID NO: 379396 - RNA, 21 nt, Human
ccaggguccagcugccauggu

SEQ ID NO: 379397 - RNA, 22 nt, Human
ccuggagcacauggcaggaggc

SEQ ID NO: 379398 - RNA, 22 nt, Human
auuauaaagaacaugugugugg

SEQ ID NO: 379399 - RNA, 22 nt, Human
ggagcacccugcucagccaagc

SEQ ID NO: 379400 - RNA, 21 nt, Human
agaugcugugcuccaggagca

SEQ ID NO: 379401 - RNA, 23 nt, Human
gugagcagcccacuaggaaugcc

SEQ ID NO: 379402 - RNA, 19 nt, Human
caggaaugagguaauggcu

SEQ ID NO: 379403 - RNA, 22 nt, Human
ucagagcuuaucucuugcugga

SEQ ID NO: 379404 - RNA, 22 nt, Human
uuguaacagcuguuuauauagu

SEQ ID NO: 379405 - RNA, 22 nt, Human
ucuacugcacuggugucucauc

SEQ ID NO: 379406 - RNA, 22 nt, Human
ugagcccagagcccuuguaggg

SEQ ID NO: 379407 - RNA, 20 nt, Human
accuugaacccgccagccau

SEQ ID NO: 379408 - RNA, 22 nt, Human
acaugauucuugauaggcauug

SEQ ID NO: 379409 - RNA, 22 nt, Human
ccuguucaugaaacugcuuucc

SEQ ID NO: 379410 - RNA, 22 nt, Human
ccucucuguguggccucuccau

SEQ ID NO: 379411 - RNA, 22 nt, Human
guggcagcggugugcaaggagg

SEQ ID NO: 379412 - RNA, 22 nt, Human
agcaggaguguccccuggcugu

SEQ ID NO: 379413 - RNA, 22 nt, Human
uuauucuuuucuccagaauccc

SEQ ID NO: 379414 - RNA, 22 nt, Human
ggccaggagcugcacagggcuc

SEQ ID NO: 379415 - RNA, 19 nt, Human
gaggagcuaucggagacag

SEQ ID NO: 379416 - RNA, 22 nt, Human
aaauagauugcugaggcauuac

SEQ ID NO: 379417 - RNA, 22 nt, Human
ggcgcuggccacgguggcucug

SEQ ID NO: 379418 - RNA, 22 nt, Human
uaaaaucauucuggugucagua

SEQ ID NO: 379419 - RNA, 22 nt, Human
gacacagagauaggccuguguu

SEQ ID NO: 379420 - RNA, 22 nt, Human
aucucagggcuggagcccugga

SEQ ID NO: 379421 - RNA, 22 nt, Human
cccaggaaaagcagugccagca

SEQ ID NO: 379422 - RNA, 20 nt, Human
agagcagcaguuggugaggu

SEQ ID NO: 379423 - RNA, 22 nt, Human
aggcaacuuuuggggaugaugg

SEQ ID NO: 379424 - RNA, 18 nt, Human
aagccagagaccacugcc

SEQ ID NO: 379425 - RNA, 22 nt, Human
ccuggcaggccccuccuggauu

SEQ ID NO: 379426 - RNA, 19 nt, Human
agagaggcugugugaggga

SEQ ID NO: 379427 - RNA, 22 nt, Human
ggcuucaccaggugcaugcaug

SEQ ID NO: 379428 - RNA, 22 nt, Human
agggacuugaugucagggagau

SEQ ID NO: 379429 - RNA, 22 nt, Human
uauaguaaaauuuucauuuaug

SEQ ID NO: 379430 - RNA, 18 nt, Human
uuuuacucauagcaggcc

SEQ ID NO: 379431 - RNA, 20 nt, Human
agggcagcuugaggagccgg

SEQ ID NO: 379432 - RNA, 22 nt, Human
ccuggaguuuuuugguugacuc

SEQ ID NO: 379433 - RNA, 22 nt, Human
aggagucauugagagggguccu

SEQ ID NO: 379434 - RNA, 22 nt, Human
guucuguacuccaagcucuucc

SEQ ID NO: 379435 - RNA, 23 nt, Human
uggcugagcccacuaucuuggcc

SEQ ID NO: 379436 - RNA, 22 nt, Human
gucccuuggcucacaaacagcu

SEQ ID NO: 379437 - RNA, 22 nt, Human
gcauggcaaauaucgagggcag

SEQ ID NO: 379438 - RNA, 22 nt, Human
uguucuugagccuuuagaccua

SEQ ID NO: 379439 - RNA, 22 nt, Human
gcccaggaaguugaggcugccg

SEQ ID NO: 379440 - RNA, 22 nt, Human
gggagggguugcauguuugagu

SEQ ID NO: 379441 - RNA, 18 nt, Human
aggugcagccucugaggc

SEQ ID NO: 379442 - RNA, 22 nt, Human
ccaaguacucucaccaaagcuu

SEQ ID NO: 379443 - RNA, 22 nt, Human
ugcagaguaaaagcagaugcua

SEQ ID NO: 379444 - RNA, 22 nt, Human
cugggguggugcaggccucaug

SEQ ID NO: 379445 - RNA, 22 nt, Human
cccaaggaagacgcuugugaua

SEQ ID NO: 379446 - RNA, 22 nt, Human
auguuauaguuauaaaaugagg

SEQ ID NO: 379447 - RNA, 22 nt, Human
caggagaaacauaauuuucugg

SEQ ID NO: 379448 - RNA, 22 nt, Human
ugucucugaggugagggucagc

SEQ ID NO: 379449 - RNA, 19 nt, Human
agacagagcucaguggguu

SEQ ID NO: 379450 - RNA, 22 nt, Human
uuagccauugucagcacauggc

SEQ ID NO: 379451 - RNA, 18 nt, Human
cagcugugcccuguuugg

SEQ ID NO: 379452 - RNA, 22 nt, Human
auugugcaaauauuaucuguag

SEQ ID NO: 379453 - RNA, 22 nt, Human
agacagggucuugaucagagcu

SEQ ID NO: 379454 - RNA, 22 nt, Human
cagcauggagacaaagugggca

SEQ ID NO: 379455 - RNA, 23 nt, Human
cuuuuaacuagaguaucagcugc

SEQ ID NO: 379456 - RNA, 22 nt, Human
aggcggcugguguccugcaggu

SEQ ID NO: 379457 - RNA, 22 nt, Human
cacugcuuucacaguuuguucc

SEQ ID NO: 379458 - RNA, 21 nt, Human
acaugcauagagagauuucug

SEQ ID NO: 379459 - RNA, 22 nt, Human
ccuuugggugaauuccucucuu

SEQ ID NO: 379460 - RNA, 22 nt, Human
aaaugcacugaacacauguugu

SEQ ID NO: 379461 - RNA, 22 nt, Human
uggaccugcuggaugggcaggu

SEQ ID NO: 379462 - RNA, 22 nt, Human
agcucuggaauaaugaugugau

SEQ ID NO: 379463 - RNA, 22 nt, Human
gagggaccccaggcuggcccuu

SEQ ID NO: 379464 - RNA, 22 nt, Human
auguccaggaucuauccccaga

SEQ ID NO: 379465 - RNA, 22 nt, Human
uuugaacaagagcuucacauua

SEQ ID NO: 379466 - RNA, 22 nt, Human
aggcccaguuauccuacuuguu

SEQ ID NO: 379467 - RNA, 22 nt, Human
ccuggcugccgagugugcagcg

SEQ ID NO: 379468 - RNA, 22 nt, Human
uaaaugugaccuucauuuuaua

SEQ ID NO: 379469 - RNA, 22 nt, Human
aagcugccaaugguaagcugcu

SEQ ID NO: 379470 - RNA, 22 nt, Human
gagccagcugagcugcacuguc

SEQ ID NO: 379471 - RNA, 22 nt, Human
ggucccugguucccucugagcu

SEQ ID NO: 379472 - RNA, 22 nt, Human
uguuguuuucucauggagaaua

SEQ ID NO: 379473 - RNA, 22 nt, Human
uggcuggcaaggcuggagucag

SEQ ID NO: 379474 - RNA, 22 nt, Human
ugcccugugugugcaagcacug

SEQ ID NO: 379475 - RNA, 22 nt, Human
guacaaaguggaccugauagua

SEQ ID NO: 379476 - RNA, 22 nt, Human
augcugugguagacagcauucc

SEQ ID NO: 379477 - RNA, 22 nt, Human
aaagacauuagcuuagauguca

SEQ ID NO: 379478 - RNA, 22 nt, Human
caaacuggcuaugggaaucuug

SEQ ID NO: 379479 - RNA, 22 nt, Human
gaaggcugagcagacaggccaa

SEQ ID NO: 379480 - RNA, 16 nt, Human
ggagagugucugcaaa

SEQ ID NO: 379481 - RNA, 22 nt, Human
acuucucuucauagguggcaau

SEQ ID NO: 379482 - RNA, 21 nt, Human
cagggcacacagaggauggua

SEQ ID NO: 379483 - RNA, 22 nt, Human
uggcagcaaguucuugggaggu

SEQ ID NO: 379484 - RNA, 22 nt, Human
gggcagguuggcaucccgggca

SEQ ID NO: 379485 - RNA, 17 nt, Human
uggcucugaggcugaau

SEQ ID NO: 379486 - RNA, 22 nt, Human
acucugaggcaggucagggcag

SEQ ID NO: 379487 - RNA, 22 nt, Human
uacaugaaccuuuaugugugau

SEQ ID NO: 379488 - RNA, 22 nt, Human
ugcagagguguugcugagauaa

SEQ ID NO: 379489 - RNA, 22 nt, Human
gcagugcugaucccauggcaga

SEQ ID NO: 379490 - RNA, 22 nt, Human
gguguccuugcagaaggcggcg

SEQ ID NO: 379491 - RNA, 22 nt, Human
ccaggugggaggaaagcagaga

SEQ ID NO: 379492 - RNA, 22 nt, Human
augaaaaguucgaucuagaagg

SEQ ID NO: 379493 - RNA, 22 nt, Human
ggcagcaguggcugcuauuguc

SEQ ID NO: 379494 - RNA, 22 nt, Human
cccaggccccagggcuugucag

SEQ ID NO: 379495 - RNA, 22 nt, Human
uucuuuggggaauauucugguu

SEQ ID NO: 379496 - RNA, 22 nt, Human
acaacuuugacccuuguucuua

SEQ ID NO: 379497 - RNA, 22 nt, Human
auuguauuuccagcuugaaugu

SEQ ID NO: 379498 - RNA, 21 nt, Human
agaauaaugguaucauuugcu

SEQ ID NO: 379499 - RNA, 22 nt, Human
guucuaauaggagaaaagacag

SEQ ID NO: 379500 - RNA, 22 nt, Human
agagaagacuuacagccacagu

SEQ ID NO: 379501 - RNA, 22 nt, Human
ugggcagaaggaagagccaccu

SEQ ID NO: 379502 - RNA, 22 nt, Human
uaaaaguuuuaguuguacauaa

SEQ ID NO: 379503 - RNA, 22 nt, Human
cugcaggguuuuucaaggacaa

SEQ ID NO: 379504 - RNA, 22 nt, Human
uguuucagucccuguguucaau

SEQ ID NO: 379505 - RNA, 22 nt, Human
ggagcuguuggcagcuaucuug

SEQ ID NO: 379506 - RNA, 22 nt, Human
aaugggaagccagaagacaagg

SEQ ID NO: 379507 - RNA, 22 nt, Human
aaaugcagguaguauuuauuuu

SEQ ID NO: 379508 - RNA, 22 nt, Human
acuggcaguuugagaaugcauu

SEQ ID NO: 379509 - RNA, 22 nt, Human
aagaacagguucuagaaccauu

SEQ ID NO: 379510 - RNA, 20 nt, Human
gagauuuccaaucaugccca

SEQ ID NO: 379511 - RNA, 22 nt, Human
ugcagggaaagggcacugggcu

SEQ ID NO: 379512 - RNA, 22 nt, Human
cccucuacagggaagcgcuuuc

SEQ ID NO: 379513 - RNA, 17 nt, Human
ggugagaccucccacuc

SEQ ID NO: 379514 - RNA, 22 nt, Human
uggccugacugucaggcuguau

SEQ ID NO: 379515 - RNA, 22 nt, Human
acaggcugcugagccauuugcu

SEQ ID NO: 379516 - RNA, 22 nt, Human
cugggccuagcaacagaggagu

SEQ ID NO: 379517 - RNA, 21 nt, Human
uaucagaagagaaagaaugau

SEQ ID NO: 379518 - RNA, 22 nt, Human
ccagugcccagcugcccaggca

SEQ ID NO: 379519 - RNA, 22 nt, Human
ugauuuaaaagaaacauugucu

SEQ ID NO: 379520 - RNA, 22 nt, Human
cugccaggcagggagauggcug

SEQ ID NO: 379521 - RNA, 22 nt, Human
caaagccucugauuucacuugu

SEQ ID NO: 379522 - RNA, 22 nt, Human
cacagcuuccauuagaaugaga

SEQ ID NO: 379523 - RNA, 22 nt, Human
gcagggcagcugaagcuaggug

SEQ ID NO: 379524 - RNA, 22 nt, Human
cuucucagaggccagaagcuau

SEQ ID NO: 379525 - RNA, 22 nt, Human
ccugcagacacuuguccagcaa

SEQ ID NO: 379526 - RNA, 22 nt, Human
ucccaggaauccguccucuaga

SEQ ID NO: 379527 - RNA, 22 nt, Human
auuuccaguccuaaugaucugg

SEQ ID NO: 379528 - RNA, 22 nt, Human
agccagggacgcugcaggcuac

SEQ ID NO: 379529 - RNA, 22 nt, Human
gcagagugaagcaguauggaaa

SEQ ID NO: 379530 - RNA, 22 nt, Human
uucuucaauuuuccauauacug

SEQ ID NO: 379531 - RNA, 22 nt, Human
gaaggccauuuuuagguagaau

SEQ ID NO: 379532 - RNA, 22 nt, Human
caggucagagucccccuguccu

SEQ ID NO: 379533 - RNA, 22 nt, Human
uaguccuuuaauaguuaaugug

SEQ ID NO: 379534 - RNA, 20 nt, Human
uuguuucugcuauuuucuaa

SEQ ID NO: 379535 - RNA, 22 nt, Human
auggcagggcagccucucagag

SEQ ID NO: 379536 - RNA, 22 nt, Human
ggccacuccgcugcuacuggaa

SEQ ID NO: 379537 - RNA, 22 nt, Human
agagcugggacuuggacucaau

SEQ ID NO: 379538 - RNA, 22 nt, Human
aaauuccagaaacucaguauau

SEQ ID NO: 379539 - RNA, 22 nt, Human
ccaggccucccuuuuccagcca

SEQ ID NO: 379540 - RNA, 22 nt, Human
ucacagugagccaugucagaga

SEQ ID NO: 379541 - RNA, 22 nt, Human
ugcccugucuaagcugucagua

SEQ ID NO: 379542 - RNA, 22 nt, Human
ccacucugcugugcuccaugau

SEQ ID NO: 379543 - RNA, 22 nt, Human
uuucugugguggguaguucaga

SEQ ID NO: 379544 - RNA, 22 nt, Human
ucaggcugguccccacagugga

SEQ ID NO: 379545 - RNA, 22 nt, Human
acccaggagcaggcugggcagu

SEQ ID NO: 379546 - RNA, 22 nt, Human
gcagggcaguaagagcuagagu

SEQ ID NO: 379547 - RNA, 22 nt, Human
ugcaggggcuugucugggccug

SEQ ID NO: 379548 - RNA, 22 nt, Human
auuaugcugguuuacacauuuu

SEQ ID NO: 379549 - RNA, 22 nt, Human
gccuggagaauuaaaaggaagg

SEQ ID NO: 379550 - RNA, 22 nt, Human
ucagccuggcaggauggccugg

SEQ ID NO: 379551 - RNA, 22 nt, Human
ucacugaauacuugucucaucc

SEQ ID NO: 379552 - RNA, 20 nt, Human
cagggccacgcuccaaggca

SEQ ID NO: 379553 - RNA, 22 nt, Human
gccagcccagcuccaggggaaa

SEQ ID NO: 379554 - RNA, 22 nt, Human
ucaggcaguagaauugcuugaa

SEQ ID NO: 379555 - RNA, 19 nt, Human
agugaaauggaguauucaa

SEQ ID NO: 379556 - RNA, 22 nt, Human
agggguggagaguguugccagu

SEQ ID NO: 379557 - RNA, 22 nt, Human
ucucaguguguuuucucucaga

SEQ ID NO: 379558 - RNA, 22 nt, Human
gcuggccugcugggcaccaccg

SEQ ID NO: 379559 - RNA, 22 nt, Human
aggagaguucacacuggucaga

SEQ ID NO: 379560 - RNA, 22 nt, Human
auaccuuuuagacauguaguug

SEQ ID NO: 379561 - RNA, 22 nt, Human
uaagaacaguagaacaguaggu

SEQ ID NO: 379562 - RNA, 22 nt, Human
cauugcuuccuaugucccuucu

SEQ ID NO: 379563 - RNA, 22 nt, Human
agaggcugcacuugcucaugau

SEQ ID NO: 379564 - RNA, 22 nt, Human
cacaugggcguaauguccaugg

SEQ ID NO: 379565 - RNA, 22 nt, Human
ggccuuggugccauggccaguu

SEQ ID NO: 379566 - RNA, 22 nt, Human
uggaaauggaucugaugagucu

SEQ ID NO: 379567 - RNA, 22 nt, Human
cuggccacuggagguggcaccc

SEQ ID NO: 379568 - RNA, 18 nt, Human
agagcagcggcaucacac

SEQ ID NO: 379569 - RNA, 22 nt, Human
gggcuucucuuuagugagcuga

SEQ ID NO: 379570 - RNA, 22 nt, Human
cccagcagauggcuaugugcua

SEQ ID NO: 379571 - RNA, 22 nt, Human
ucagaaaugaucguuauucauu

SEQ ID NO: 379572 - RNA, 22 nt, Human
uuucuucugagaucagggagaa

SEQ ID NO: 379573 - RNA, 22 nt, Human
agcucugcaggcacagcugagg

SEQ ID NO: 379574 - RNA, 22 nt, Human
uaaguccuagaugauucacaga

SEQ ID NO: 379575 - RNA, 22 nt, Human
ggagucccagcaaagccuuccc

SEQ ID NO: 379576 - RNA, 22 nt, Human
uuuuauuaucuuugaaugggac

SEQ ID NO: 379577 - RNA, 22 nt, Human
aagacuguacauuuuccagucu

SEQ ID NO: 379578 - RNA, 22 nt, Human
ggagagcagggaggcugcucug

SEQ ID NO: 379579 - RNA, 22 nt, Human
acugagcugcaagucagggagg

SEQ ID NO: 379580 - RNA, 22 nt, Human
cugggacacccaaggaaagagc

SEQ ID NO: 379581 - RNA, 22 nt, Human
cuggugguucaggagaauggcu

SEQ ID NO: 379582 - RNA, 23 nt, Human
agaugaaagcuucccaucacagu

SEQ ID NO: 379583 - RNA, 22 nt, Human
cucuggagugcagccugguggc

SEQ ID NO: 379584 - RNA, 22 nt, Human
gccaggcaaauuaaggaaugca

SEQ ID NO: 379585 - RNA, 22 nt, Human
cugcucugcagcuuggacuccc

SEQ ID NO: 379586 - RNA, 19 nt, Human
ucaaaugccaaugucacag

SEQ ID NO: 379587 - RNA, 22 nt, Human
ccaggagaagcaucugagugua

SEQ ID NO: 379588 - RNA, 22 nt, Human
ugggauggcauccugggccuug

SEQ ID NO: 379589 - RNA, 22 nt, Human
aaaugcauaucaaagacuugaa

SEQ ID NO: 379590 - RNA, 22 nt, Human
uaaaugcagauuccugagccua

SEQ ID NO: 379591 - RNA, 22 nt, Human
cagguggggcagcugugggagc

SEQ ID NO: 379592 - RNA, 22 nt, Human
ggaggggaugguuugacccugg

SEQ ID NO: 379593 - RNA, 22 nt, Human
accaggaguaacagugaguggu

SEQ ID NO: 379594 - RNA, 22 nt, Human
ucaauucugguccucaggaacu

SEQ ID NO: 379595 - RNA, 22 nt, Human
uauuaggguuuugaagguuugu

SEQ ID NO: 379596 - RNA, 22 nt, Human
aggacccagaggcagaggacgu

SEQ ID NO: 379597 - RNA, 22 nt, Human
caugcuguguguuuuagcucca

SEQ ID NO: 379598 - RNA, 21 nt, Human
ccacaggggcuccccugucag

SEQ ID NO: 379599 - RNA, 22 nt, Human
cuuuauuagauguagacuuucu

SEQ ID NO: 379600 - RNA, 22 nt, Human
caggacagagcccagacugugu

SEQ ID NO: 379601 - RNA, 22 nt, Human
uaaaugugucuauggacccgcc

SEQ ID NO: 379602 - RNA, 22 nt, Human
gaaggaagugcucauacuaguu

SEQ ID NO: 379603 - RNA, 22 nt, Human
ggcagugaaaaaguauguuucc

SEQ ID NO: 379604 - RNA, 22 nt, Human
aucauucugauggucaaugcua

SEQ ID NO: 379605 - RNA, 22 nt, Human
uucaaugagcccggggccauag

SEQ ID NO: 379606 - RNA, 22 nt, Human
uuuaauuugaaaugaguaaccc

SEQ ID NO: 379607 - RNA, 22 nt, Human
uccauggguagcccugguugag

SEQ ID NO: 379608 - RNA, 22 nt, Human
gauggacagccuggaaggaaag

SEQ ID NO: 379609 - RNA, 22 nt, Human
cauggcaggaggcugcuggcag

SEQ ID NO: 379610 - RNA, 22 nt, Human
ggcuuuauuauguggccaugug

SEQ ID NO: 379611 - RNA, 22 nt, Human
uuuuccucugagcuuugaauaa

SEQ ID NO: 379612 - RNA, 22 nt, Human
ugcauguguuugccacagugag

SEQ ID NO: 379613 - RNA, 22 nt, Human
uuuuauuaguggcuagaugggg

SEQ ID NO: 379614 - RNA, 18 nt, Human
aaauguacuguccauggc

SEQ ID NO: 379615 - RNA, 22 nt, Human
cuacauuucccagcugccuucc

SEQ ID NO: 379616 - RNA, 22 nt, Human
uggcaccugaacuuagaggugu

SEQ ID NO: 379617 - RNA, 22 nt, Human
uggggcagggaugggaaacuau

SEQ ID NO: 379618 - RNA, 22 nt, Human
ggguuucaugguucucacaaug

SEQ ID NO: 379619 - RNA, 21 nt, Human
gcaggaugcaucuuggugucu

SEQ ID NO: 379620 - RNA, 22 nt, Human
uaucuugagagacaacacagca

SEQ ID NO: 379621 - RNA, 22 nt, Human
uccaugucuucaugugucuaac

SEQ ID NO: 379622 - RNA, 22 nt, Human
cccagagccucauucuguuggg

SEQ ID NO: 379623 - RNA, 22 nt, Human
ugucaccaccggaagaaacugc

SEQ ID NO: 379624 - RNA, 22 nt, Human
gcauacagagaggauguggcau

SEQ ID NO: 379625 - RNA, 22 nt, Human
uguuuaagcugaugagguaucg

SEQ ID NO: 379626 - RNA, 22 nt, Human
gagaaagcuucuuucccacagg

SEQ ID NO: 379627 - RNA, 22 nt, Human
gaagaaagauuggcaugcuuca

SEQ ID NO: 379628 - RNA, 22 nt, Human
caaauguguagagcuuuugggg

SEQ ID NO: 379629 - RNA, 22 nt, Human
cugccagcucgccacaaugaca

SEQ ID NO: 379630 - RNA, 22 nt, Human
ggaggacaggggcugcagcaca

SEQ ID NO: 379631 - RNA, 22 nt, Human
uuagaaaugcacccaagaccua

SEQ ID NO: 379632 - RNA, 22 nt, Human
aacagcuuugcuucuggagaca

SEQ ID NO: 379633 - RNA, 22 nt, Human
ugcagggcuuccucuuggaguu

SEQ ID NO: 379634 - RNA, 22 nt, Human
ggccuggaaugcuuuccuacca

SEQ ID NO: 379635 - RNA, 21 nt, Human
uucaaaguuugccuaaagauu

SEQ ID NO: 379636 - RNA, 20 nt, Human
caccacagaauuggggacag

SEQ ID NO: 379637 - RNA, 20 nt, Human
cugggcugcccagcuauggg

SEQ ID NO: 379638 - RNA, 22 nt, Human
aguuuuucugcuggucucacua

SEQ ID NO: 379639 - RNA, 22 nt, Human
uagcccagaagagggaagcaac

SEQ ID NO: 379640 - RNA, 22 nt, Human
uuacuacugcuuuacuacuggg

SEQ ID NO: 379641 - RNA, 22 nt, Human
ucugcaggccucgacaaggcca

SEQ ID NO: 379642 - RNA, 22 nt, Human
uccaugagggacacuggaugcu

SEQ ID NO: 379643 - RNA, 22 nt, Human
ugccaggcccugcgggguccca

SEQ ID NO: 379644 - RNA, 22 nt, Human
caagauggacauaaggagagaa

SEQ ID NO: 379645 - RNA, 22 nt, Human
agaggagugggaagcagugcaa

SEQ ID NO: 379646 - RNA, 22 nt, Human
aaauggaucuguggaauacauu

SEQ ID NO: 379647 - RNA, 22 nt, Human
agugcagagagcaauacucuac

SEQ ID NO: 379648 - RNA, 22 nt, Human
uuggcuucuggcagucuggacg

SEQ ID NO: 379649 - RNA, 22 nt, Human
ucaggccacggcucacugagac

SEQ ID NO: 379650 - RNA, 22 nt, Human
gaagccaguguuugaagaauuu

SEQ ID NO: 379651 - RNA, 22 nt, Human
cagagccacugucugccaggca

SEQ ID NO: 379652 - RNA, 22 nt, Human
cugccacuuucacccagugcuc

SEQ ID NO: 379653 - RNA, 22 nt, Human
ugggggagauuagagcuucuua

SEQ ID NO: 379654 - RNA, 22 nt, Human
ugcuuuauguggcugauacuca

SEQ ID NO: 379655 - RNA, 22 nt, Human
uuccauauuuguguggcaaaag

SEQ ID NO: 379656 - RNA, 22 nt, Human
ucuuagcacagcuauauaaguu

SEQ ID NO: 379657 - RNA, 22 nt, Human
cacauguuuggcaugucaccaa

SEQ ID NO: 379658 - RNA, 22 nt, Human
ugggggugaaagucuggacagu

SEQ ID NO: 379659 - RNA, 22 nt, Human
auagauacauuagguaacuugu

SEQ ID NO: 379660 - RNA, 22 nt, Human
agcaggaaggucugugugaguc

SEQ ID NO: 379661 - RNA, 22 nt, Human
auuuaucucuggaaacuaagca

SEQ ID NO: 379662 - RNA, 22 nt, Human
uauguacaucguugaauucaaa

SEQ ID NO: 379663 - RNA, 22 nt, Human
uggcugggggugcuauagcugc

SEQ ID NO: 379664 - RNA, 22 nt, Human
ucaguggaacugucugggugag

SEQ ID NO: 379665 - RNA, 22 nt, Human
ggcugcuggggacgugggagag

SEQ ID NO: 379666 - RNA, 22 nt, Human
ugcagcugcuggcccaggugcu

SEQ ID NO: 379667 - RNA, 22 nt, Human
caaugauguuuagauaaaaucc

SEQ ID NO: 379668 - RNA, 22 nt, Human
cagagccccucagcucucuccc

SEQ ID NO: 379669 - RNA, 22 nt, Human
uguucuagcaacacaguuuugg

SEQ ID NO: 379670 - RNA, 22 nt, Human
cuuaagauuugcgauaccuaau

SEQ ID NO: 379671 - RNA, 22 nt, Human
ucucugguggcuccaucaguag

SEQ ID NO: 379672 - RNA, 22 nt, Human
uggaggugagugugguacagca

SEQ ID NO: 379673 - RNA, 22 nt, Human
cuguaauucacuagggucagcg

SEQ ID NO: 379674 - RNA, 22 nt, Human
aggaagcucaaagccaugaugu

SEQ ID NO: 379675 - RNA, 22 nt, Human
ggcaaaaaccgcaauaacuucu

SEQ ID NO: 379676 - RNA, 22 nt, Human
acauuguagacuuuucauaugu

SEQ ID NO: 379677 - RNA, 22 nt, Human
ucucugagacaguagccucugc

SEQ ID NO: 379678 - RNA, 22 nt, Human
cucagagauauagucccugcuu

SEQ ID NO: 379679 - RNA, 22 nt, Human
aacaacugaaaagcuuuuucug

SEQ ID NO: 379680 - RNA, 22 nt, Human
aaaucucaggccucuauuuacu

SEQ ID NO: 379681 - RNA, 22 nt, Human
caggaggcagagguugcagcga

SEQ ID NO: 379682 - RNA, 22 nt, Human
auuuagaacuuuguuugccaau

SEQ ID NO: 379683 - RNA, 22 nt, Human
aggcacugaauauccaguaaaa

SEQ ID NO: 379684 - RNA, 22 nt, Human
uaagaacaagcuggggguucca

SEQ ID NO: 379685 - RNA, 22 nt, Human
agggcuggcaagggauugaaau

SEQ ID NO: 379686 - RNA, 22 nt, Human
agccauugaauuuagugccuuu

SEQ ID NO: 379687 - RNA, 22 nt, Human
aucaggaugaagcuguagcgaa

SEQ ID NO: 379688 - RNA, 22 nt, Human
ucuggcuccugaguccaugcuc

SEQ ID NO: 379689 - RNA, 22 nt, Human
uuuaggcauugaauuagaauag

SEQ ID NO: 379690 - RNA, 22 nt, Human
gccaggcagcugggagggugcc

SEQ ID NO: 379691 - RNA, 22 nt, Human
uuaaugcagaaaucaaacugac

SEQ ID NO: 379692 - RNA, 22 nt, Human
aaccaggacaauuuugaaagua

SEQ ID NO: 379693 - RNA, 22 nt, Human
cagcagagaaauuaaacuucug

SEQ ID NO: 379694 - RNA, 22 nt, Human
ggaggccaaggaggagcuugcc

SEQ ID NO: 379695 - RNA, 23 nt, Human
gcaguggaaugucucuguuugga

SEQ ID NO: 379696 - RNA, 21 nt, Human
acagcagacaggcuuaggacc

SEQ ID NO: 379697 - RNA, 23 nt, Human
uccaggcacgcauuucuucuagc

SEQ ID NO: 379698 - RNA, 22 nt, Human
aaguucaagucuccugaguaua

SEQ ID NO: 379699 - RNA, 22 nt, Human
gaugaaaaauugcugugucaua

SEQ ID NO: 379700 - RNA, 22 nt, Human
uggcuuuauaaauccacugguu

SEQ ID NO: 379701 - RNA, 22 nt, Human
aaguauuucguucugaaaaagu

SEQ ID NO: 379702 - RNA, 22 nt, Human
uuaaagggccgauuuccaggcc

SEQ ID NO: 379703 - RNA, 22 nt, Human
gaggcaucugggcacagaagug

SEQ ID NO: 379704 - RNA, 22 nt, Human
ugaaugauguauaauauugaga

SEQ ID NO: 379705 - RNA, 22 nt, Human
cugcuuugcauagcugccagag

SEQ ID NO: 379706 - RNA, 22 nt, Human
aggcccugcccagugccacaag

SEQ ID NO: 379707 - RNA, 16 nt, Human
cagccugcagugguca

SEQ ID NO: 379708 - RNA, 23 nt, Human
augcaagaguuucucaaacugga

SEQ ID NO: 379709 - RNA, 22 nt, Human
ccucugcaccauagccuucagc

SEQ ID NO: 379710 - RNA, 22 nt, Human
guuugcauguauuaagucaaua

SEQ ID NO: 379711 - RNA, 22 nt, Human
gcuguucacaucuggaccauuu

SEQ ID NO: 379712 - RNA, 21 nt, Human
gggcagaggggccuccugggu

SEQ ID NO: 379713 - RNA, 23 nt, Human
aaaguguagccagguuaagaacc

SEQ ID NO: 379714 - RNA, 22 nt, Human
ugucccagggaaggcccagcac

SEQ ID NO: 379715 - RNA, 22 nt, Human
uauggcuuuuuauucaucuuac

SEQ ID NO: 379716 - RNA, 22 nt, Human
cagcaucccucaggggccucug

SEQ ID NO: 379717 - RNA, 22 nt, Human
cagcugugggccugacguggca

SEQ ID NO: 379718 - RNA, 22 nt, Human
ugagaggccccagcucuuggcc

SEQ ID NO: 379719 - RNA, 22 nt, Human
cagcagagggagccauugaaau

SEQ ID NO: 379720 - RNA, 22 nt, Human
gucucagagagcuacucucuua

SEQ ID NO: 379721 - RNA, 22 nt, Human
gucccugggaugcccuucuggg

SEQ ID NO: 379722 - RNA, 22 nt, Human
gggagcuggagcuggaagacuc

SEQ ID NO: 379723 - RNA, 22 nt, Human
acaauucuggguauuuauauag

SEQ ID NO: 379724 - RNA, 22 nt, Human
agaggggaguccuaaucugauu

SEQ ID NO: 379725 - RNA, 20 nt, Human
agggucagagagcgugagug

SEQ ID NO: 379726 - RNA, 22 nt, Human
guggguggaucaccugagguca

SEQ ID NO: 379727 - RNA, 21 nt, Human
ugaaacaaucagacagagucu

SEQ ID NO: 379728 - RNA, 22 nt, Human
caaagugcuggaauuacaggug

SEQ ID NO: 379729 - RNA, 22 nt, Human
aggcccagacucagcggggcgg

SEQ ID NO: 379730 - RNA, 22 nt, Human
accaaggaagaaucuauuugag

SEQ ID NO: 379731 - RNA, 22 nt, Human
ucagugcacagagauuuuuguu

SEQ ID NO: 379732 - RNA, 22 nt, Human
gcugugcagucuuuggugugcc

SEQ ID NO: 379733 - RNA, 22 nt, Human
caguccuggggaccaggcugag

SEQ ID NO: 379734 - RNA, 22 nt, Human
cugcugcauuccucuuuaugag

SEQ ID NO: 379735 - RNA, 22 nt, Human
cccaggagacugagcuguaacc

SEQ ID NO: 379736 - RNA, 22 nt, Human
augguuuugaagggaggucaaa

SEQ ID NO: 379737 - RNA, 22 nt, Human
gggcagcucugcccaucagagg

SEQ ID NO: 379738 - RNA, 20 nt, Human
uuugagaccagucugcccaa

SEQ ID NO: 379739 - RNA, 20 nt, Human
acaauauguagaugaauagc

SEQ ID NO: 379740 - RNA, 22 nt, Human
caggauggucagaugcauuguc

SEQ ID NO: 379741 - RNA, 21 nt, Human
aaaugaaugugguagugcaag

SEQ ID NO: 379742 - RNA, 22 nt, Human
ucagagagugcaaaauauagcu

SEQ ID NO: 379743 - RNA, 22 nt, Human
ucucagagaaaugugucaccau

SEQ ID NO: 379744 - RNA, 23 nt, Human
uugucugugcuuuuccaguugcu

SEQ ID NO: 379745 - RNA, 22 nt, Human
auguguaaaaagugcuuaauau

SEQ ID NO: 379746 - RNA, 22 nt, Human
ucaguuucacagucugugcaga

SEQ ID NO: 379747 - RNA, 19 nt, Human
agggccaggauucuggaac

SEQ ID NO: 379748 - RNA, 16 nt, Human
gagccaggugccuuga

SEQ ID NO: 379749 - RNA, 22 nt, Human
caguugaugggacucauguggg

SEQ ID NO: 379750 - RNA, 22 nt, Human
gcaagcugaugugauagugaaa

SEQ ID NO: 379751 - RNA, 22 nt, Human
ugggcagccaucccagccucuc

SEQ ID NO: 379752 - RNA, 22 nt, Human
cugagccuuauucaccagcccu

SEQ ID NO: 379753 - RNA, 22 nt, Human
uaccuuuugcuuauuaugacac

SEQ ID NO: 379754 - RNA, 22 nt, Human
ucugaggcccugcaggcagugu

SEQ ID NO: 379755 - RNA, 22 nt, Human
ggagcuguaacgagccauugcu

SEQ ID NO: 379756 - RNA, 22 nt, Human
agcuucuggaagccuggcagca

SEQ ID NO: 379757 - RNA, 22 nt, Human
ucucaggaagauuagggcuaag

SEQ ID NO: 379758 - RNA, 22 nt, Human
agcuuuauauuuaaugaauucu

SEQ ID NO: 379759 - RNA, 22 nt, Human
ugucugugaccucuuaggcaag

SEQ ID NO: 379760 - RNA, 22 nt, Human
uaaauguaccuucugccuuacu

SEQ ID NO: 379761 - RNA, 22 nt, Human
cccaggaaaugggcucuugccu

SEQ ID NO: 379762 - RNA, 22 nt, Human
cuuugcaaacgauuaccacaug

SEQ ID NO: 379763 - RNA, 22 nt, Human
gguuggggcgagcuggaggccc

SEQ ID NO: 379764 - RNA, 22 nt, Human
ucugccuucgcugcucccugaa

SEQ ID NO: 379765 - RNA, 22 nt, Human
aaguucaagaucaagguuccag

SEQ ID NO: 379766 - RNA, 19 nt, Human
auuuccaagaauuggagag

SEQ ID NO: 379767 - RNA, 22 nt, Human
uuucacauaucaacucuauccu

SEQ ID NO: 379768 - RNA, 22 nt, Human
cucccaggacucagaggagaag

SEQ ID NO: 379769 - RNA, 22 nt, Human
gaggcacaguguuuggucagug

SEQ ID NO: 379770 - RNA, 22 nt, Human
uuggcaguaaaagaaaaugcuu

SEQ ID NO: 379771 - RNA, 21 nt, Human
ccuauugaauauaggaagauu

SEQ ID NO: 379772 - RNA, 22 nt, Human
ggaggccaggguggguggaucg

SEQ ID NO: 379773 - RNA, 22 nt, Human
uucacauuugcccuuaugugug

SEQ ID NO: 379774 - RNA, 22 nt, Human
agccagcaggugagugcagccu

SEQ ID NO: 379775 - RNA, 22 nt, Human
aagaauucacugguagagucaa

SEQ ID NO: 379776 - RNA, 22 nt, Human
cccagggagguagcaggagaaa

SEQ ID NO: 379777 - RNA, 23 nt, Human
gagguacagcaccagugaauagg

SEQ ID NO: 379778 - RNA, 22 nt, Human
aggcaggcacuccggaaguguc

SEQ ID NO: 379779 - RNA, 22 nt, Human
cucugaauggacacuccagugu

SEQ ID NO: 379780 - RNA, 22 nt, Human
ucuggaguccagauccauuugg

SEQ ID NO: 379781 - RNA, 22 nt, Human
aucagugcuaaagcaaaugccc

SEQ ID NO: 379782 - RNA, 22 nt, Human
gccugccugcugucaucugccu

SEQ ID NO: 379783 - RNA, 22 nt, Human
ccacagagcauuagauuucaga

SEQ ID NO: 379784 - RNA, 22 nt, Human
ucaggauguccaaaauccagcc

SEQ ID NO: 379785 - RNA, 22 nt, Human
gugcagcugcaggagucagguc

SEQ ID NO: 379786 - RNA, 21 nt, Human
auacagaacauugauccaaga

SEQ ID NO: 379787 - RNA, 22 nt, Human
uguuuauugagugccuacuaua

SEQ ID NO: 379788 - RNA, 22 nt, Human
cugaaggaagcagguggccugu

SEQ ID NO: 379789 - RNA, 22 nt, Human
caaggccaguccauuuuggaag

SEQ ID NO: 379790 - RNA, 22 nt, Human
cccaggaaaucaggcuuucuag

SEQ ID NO: 379791 - RNA, 22 nt, Human
uaaguccuaauggcagaagucu

SEQ ID NO: 379792 - RNA, 22 nt, Human
uuuaggcagcacgggcagcccu

SEQ ID NO: 379793 - RNA, 22 nt, Human
caguauguacucuuaucaugua

SEQ ID NO: 379794 - RNA, 22 nt, Human
cccagcagaaucugaugagggc

SEQ ID NO: 379795 - RNA, 22 nt, Human
aacauugccaugguuaauuuua

SEQ ID NO: 379796 - RNA, 22 nt, Human
agagcagauggccagggggccu

SEQ ID NO: 379797 - RNA, 22 nt, Human
gaggcacugcaguacagugacu

SEQ ID NO: 379798 - RNA, 22 nt, Human
cccaggaguuugaguucagcau

SEQ ID NO: 379799 - RNA, 22 nt, Human
cugcaggcccccuuccuggagu

SEQ ID NO: 379800 - RNA, 19 nt, Human
ucaaggcucccugagggau

SEQ ID NO: 379801 - RNA, 22 nt, Human
uuggagagaggcugcucaggcu

SEQ ID NO: 379802 - RNA, 22 nt, Human
gaauuacaugacccugaguaga

SEQ ID NO: 379803 - RNA, 22 nt, Human
gaaacaacuacuauugauuucu

SEQ ID NO: 379804 - RNA, 22 nt, Human
ggccagagaagucagacccuug

SEQ ID NO: 379805 - RNA, 22 nt, Human
ugggcagacauugaguuuguuc

SEQ ID NO: 379806 - RNA, 22 nt, Human
cauagaaaucaggugagaaucu

SEQ ID NO: 379807 - RNA, 19 nt, Human
accaggccucagaggcccu

SEQ ID NO: 379808 - RNA, 23 nt, Human
augguuuaugucacacuuuugau

SEQ ID NO: 379809 - RNA, 22 nt, Human
acagcuggaggucugugagcac

SEQ ID NO: 379810 - RNA, 22 nt, Human
uguauaaauuuaaauuccugcu

SEQ ID NO: 379811 - RNA, 22 nt, Human
gcuggcagccaagugaagaggg

SEQ ID NO: 379812 - RNA, 22 nt, Human
caggccugauacacugaacucu

SEQ ID NO: 379813 - RNA, 17 nt, Human
ccuguguuugcuccuuc

SEQ ID NO: 379814 - RNA, 22 nt, Human
ucugagccguauggcuuggcua

SEQ ID NO: 379815 - RNA, 22 nt, Human
ugugugcagccucugucuuugg

SEQ ID NO: 379816 - RNA, 22 nt, Human
uacauaauuaaucuuuaaguuc

SEQ ID NO: 379817 - RNA, 22 nt, Human
agcagccaauuggaggaugaag

SEQ ID NO: 379818 - RNA, 20 nt, Human
ugcccagcaagagugcaguu

SEQ ID NO: 379819 - RNA, 22 nt, Human
aaacaaacaauuaguugugugg

SEQ ID NO: 379820 - RNA, 22 nt, Human
gaggcacaucacuuggugcauu

SEQ ID NO: 379821 - RNA, 22 nt, Human
auucuuauuuaaauagagucug

SEQ ID NO: 379822 - RNA, 22 nt, Human
ucugccuuuucacugccacuaa

SEQ ID NO: 379823 - RNA, 22 nt, Human
agacagaacagaauaauuguug

SEQ ID NO: 379824 - RNA, 22 nt, Human
acugaguguaggacuuugaguu

SEQ ID NO: 379825 - RNA, 19 nt, Human
uggagggguuugaaugugg

SEQ ID NO: 379826 - RNA, 22 nt, Human
ucuucacauggaacaugaagcu

SEQ ID NO: 379827 - RNA, 23 nt, Human
ucugucacuuucugcuguggagu

SEQ ID NO: 379828 - RNA, 22 nt, Human
gacugccagaaugugaggccug

SEQ ID NO: 379829 - RNA, 19 nt, Human
gcagcugcuugaaaagaaa

SEQ ID NO: 379830 - RNA, 22 nt, Human
gaagcccagcaaacugugauca

SEQ ID NO: 379831 - RNA, 22 nt, Human
cagaguaaggagcugucaaacg

SEQ ID NO: 379832 - RNA, 22 nt, Human
ggguggaguagaaagaugaauu

SEQ ID NO: 379833 - RNA, 21 nt, Human
ugaaaugagaaugcugagcac

SEQ ID NO: 379834 - RNA, 22 nt, Human
ugggcaggugcuauuuuccaug

SEQ ID NO: 379835 - RNA, 22 nt, Human
auaugcauuuaccuggcauaua

SEQ ID NO: 379836 - RNA, 19 nt, Human
ugggcuuccccagggcaga

SEQ ID NO: 379837 - RNA, 19 nt, Human
uuagaaacuguugacacug

SEQ ID NO: 379838 - RNA, 22 nt, Human
gccuggagacagcagaggcggc

SEQ ID NO: 379839 - RNA, 22 nt, Human
ggaguucacugugcaggcucug

SEQ ID NO: 379840 - RNA, 22 nt, Human
ccauaagguugaaaacuguaca

SEQ ID NO: 379841 - RNA, 22 nt, Human
uaaagccacgcuggaaaucagg

SEQ ID NO: 379842 - RNA, 22 nt, Human
agcagaggacaguucuuaggaa

SEQ ID NO: 379843 - RNA, 22 nt, Human
cccugcagagccagcccugacc

SEQ ID NO: 379844 - RNA, 22 nt, Human
ucuugggauugcccugcaguuc

SEQ ID NO: 379845 - RNA, 22 nt, Human
uggcugaggagagggcggaagu

SEQ ID NO: 379846 - RNA, 22 nt, Human
caggagaucuuaggaauucuua

SEQ ID NO: 379847 - RNA, 22 nt, Human
agggcugccugcucugcauuga

SEQ ID NO: 379848 - RNA, 22 nt, Human
ucuuccucucuaauugaucaga

SEQ ID NO: 379849 - RNA, 22 nt, Human
ugccuucaaucaggauggucuc

SEQ ID NO: 379850 - RNA, 22 nt, Human
ugaccugcagucaagaggggaa

SEQ ID NO: 379851 - RNA, 22 nt, Human
uguuaacaucuuggacucguga

SEQ ID NO: 379852 - RNA, 22 nt, Human
aauuagggaggacaaagguaca

SEQ ID NO: 379853 - RNA, 22 nt, Human
ucugccugcaguguggcagggc

SEQ ID NO: 379854 - RNA, 22 nt, Human
ucuuuuggaaaugaugugcagg

SEQ ID NO: 379855 - RNA, 22 nt, Human
gcggagggcgagcccgcggagc

SEQ ID NO: 379856 - RNA, 22 nt, Human
ggauggcagucugcaugagaaa

SEQ ID NO: 379857 - RNA, 19 nt, Human
uccuccuuacuuccucuug

SEQ ID NO: 379858 - RNA, 22 nt, Human
ugcuggcuacauuauugcuguc

SEQ ID NO: 379859 - RNA, 22 nt, Human
uaucuguuguccaugcagaaag

SEQ ID NO: 379860 - RNA, 19 nt, Human
cugugcaggccgggcugag

SEQ ID NO: 379861 - RNA, 22 nt, Human
gaucauuuacuuguucuggacu

SEQ ID NO: 379862 - RNA, 22 nt, Human
ccagagagagaggucaauggca

SEQ ID NO: 379863 - RNA, 22 nt, Human
ccagcugcaggggagcagugga

SEQ ID NO: 379864 - RNA, 22 nt, Human
ccucaggggugcccacagcugc

SEQ ID NO: 379865 - RNA, 22 nt, Human
agauuggaucaagcagcaguug

SEQ ID NO: 379866 - RNA, 22 nt, Human
uggcucagccauucguguugcc

SEQ ID NO: 379867 - RNA, 22 nt, Human
agaauuccuccucugggacacu

SEQ ID NO: 379868 - RNA, 22 nt, Human
auaguuugugaaacacagcagu

SEQ ID NO: 379869 - RNA, 22 nt, Human
agcugcagagguuugugcaaca

SEQ ID NO: 379870 - RNA, 22 nt, Human
ggguuggggcccagcagucugc

SEQ ID NO: 379871 - RNA, 22 nt, Human
uccugagaugagacagugcugc

SEQ ID NO: 379872 - RNA, 20 nt, Human
aucaggauucuugcuuuguu

SEQ ID NO: 379873 - RNA, 22 nt, Human
ccaguguucauaauuuuacacu

SEQ ID NO: 379874 - RNA, 21 nt, Human
cccaggaguccuauuuaaaug

SEQ ID NO: 379875 - RNA, 22 nt, Human
gacaauaaaaugaucuuacagu

SEQ ID NO: 379876 - RNA, 22 nt, Human
cuguagcaaguuauucaauaaa

SEQ ID NO: 379877 - RNA, 22 nt, Human
uauuccaaaauaguuaagcacu

SEQ ID NO: 379878 - RNA, 22 nt, Human
caguauguuugggagacaugac

SEQ ID NO: 379879 - RNA, 20 nt, Human
cgugcugugaccuugagcau

SEQ ID NO: 379880 - RNA, 22 nt, Human
agcugccagggacugggcaugg

SEQ ID NO: 379881 - RNA, 22 nt, Human
aaagaacaaauuagcuguuuua

SEQ ID NO: 379882 - RNA, 22 nt, Human
uuucuguagugugguauguagg

SEQ ID NO: 379883 - RNA, 22 nt, Human
uuucacagguacaaacacuccu

SEQ ID NO: 379884 - RNA, 22 nt, Human
acaugcuuucuagguccuucug

SEQ ID NO: 379885 - RNA, 22 nt, Human
cugaaggacacgugaggagcca

SEQ ID NO: 379886 - RNA, 22 nt, Human
uuucaauguaacauuuccaggc

SEQ ID NO: 379887 - RNA, 22 nt, Human
uuguuuuggagaugagcuaaaa

SEQ ID NO: 379888 - RNA, 22 nt, Human
gcugucagaaggugaaggguaa

SEQ ID NO: 379889 - RNA, 22 nt, Human
gcucccucugcucaggcacuug

SEQ ID NO: 379890 - RNA, 22 nt, Human
uauuucuguaacucagggucug

SEQ ID NO: 379891 - RNA, 22 nt, Human
uuguggaaauacagacuccaag

SEQ ID NO: 379892 - RNA, 22 nt, Human
ucccuggcugggggcugccuug

SEQ ID NO: 379893 - RNA, 22 nt, Human
ugucaaauuuuuauugcaguau

SEQ ID NO: 379894 - RNA, 22 nt, Human
uucauacucacuccaauaacug

SEQ ID NO: 379895 - RNA, 22 nt, Human
gggcuggucuggcuuagucagg

SEQ ID NO: 379896 - RNA, 22 nt, Human
ugaaugaugcaguauaaugaua

SEQ ID NO: 379897 - RNA, 22 nt, Human
ggaugcugacuuuggagcaugg

SEQ ID NO: 379898 - RNA, 22 nt, Human
acagugcuggcuacaacccugg

SEQ ID NO: 379899 - RNA, 22 nt, Human
uuugaagacauauuguuacaua

SEQ ID NO: 379900 - RNA, 22 nt, Human
aaggcaguagguguuucaaacu

SEQ ID NO: 379901 - RNA, 22 nt, Human
cccacucccugcacgccugccg

SEQ ID NO: 379902 - RNA, 22 nt, Human
ugcaggcuggaggagggacuaa

SEQ ID NO: 379903 - RNA, 20 nt, Human
cuuguacaugauaaagauuu

SEQ ID NO: 379904 - RNA, 22 nt, Human
ccucagaggugaacaucagugc

SEQ ID NO: 379905 - RNA, 22 nt, Human
uccugucugcucacagagcugg

SEQ ID NO: 379906 - RNA, 22 nt, Human
ucucuguacaguacaugccgug

SEQ ID NO: 379907 - RNA, 22 nt, Human
uuucaaauggagucgugaaaug

SEQ ID NO: 379908 - RNA, 20 nt, Human
aacaguaccauuuaucucag

SEQ ID NO: 379909 - RNA, 22 nt, Human
uaauauauuucugcuaagcuca

SEQ ID NO: 379910 - RNA, 22 nt, Human
aggggccuggacauggacgcgc

SEQ ID NO: 379911 - RNA, 22 nt, Human
uucauuccugagcccauauuua

SEQ ID NO: 379912 - RNA, 19 nt, Human
ggcucagggcgcugccgcc

SEQ ID NO: 379913 - RNA, 22 nt, Human
ccugcagguccccggaugcgca

SEQ ID NO: 379914 - RNA, 22 nt, Human
gaagcccacguuuggugaugua

SEQ ID NO: 379915 - RNA, 22 nt, Human
aaaugcuacauacacaucaggg

SEQ ID NO: 379916 - RNA, 22 nt, Human
agggacacaugugauuauuuau

SEQ ID NO: 379917 - RNA, 22 nt, Human
cauuuccugucuggaggucaaa

SEQ ID NO: 379918 - RNA, 22 nt, Human
cacccagggcugugccugccca

SEQ ID NO: 379919 - RNA, 22 nt, Human
ucagcagggagaggagaaugca

SEQ ID NO: 379920 - RNA, 22 nt, Human
aggcugaggcagguggaucacu

SEQ ID NO: 379921 - RNA, 21 nt, Human
ugcaugcuauguuuuuauuuc

SEQ ID NO: 379922 - RNA, 22 nt, Human
cuucuggaggacacuggcccca

SEQ ID NO: 379923 - RNA, 20 nt, Human
agagugagacuccaucucag

SEQ ID NO: 379924 - RNA, 22 nt, Human
aaugucugagucucuguauccc

SEQ ID NO: 379925 - RNA, 22 nt, Human
gagaaagauggaaucuuacagg

SEQ ID NO: 379926 - RNA, 22 nt, Human
augugugccccuuuuacucuuu

SEQ ID NO: 379927 - RNA, 22 nt, Human
cuguugucuucauugucauauc

SEQ ID NO: 379928 - RNA, 22 nt, Human
gaggcugggaaguccaagacca

SEQ ID NO: 379929 - RNA, 22 nt, Human
acacaggagauauguaauggcu

SEQ ID NO: 379930 - RNA, 22 nt, Human
guggcucucgccagccugcggg

SEQ ID NO: 379931 - RNA, 22 nt, Human
gcacccagaauaaggacaggac

SEQ ID NO: 379932 - RNA, 22 nt, Human
acagcagcgucaacuuaaaauu

SEQ ID NO: 379933 - RNA, 22 nt, Human
cauucacucagcgaugccagua

SEQ ID NO: 379934 - RNA, 22 nt, Human
aagucauagucgggaaagacau

SEQ ID NO: 379935 - RNA, 22 nt, Human
ccagccuuacugcccuucagug

SEQ ID NO: 379936 - RNA, 22 nt, Human
gugaauaaaacaccugccaaga

SEQ ID NO: 379937 - RNA, 22 nt, Human
guguccacggcugagaaugauu

SEQ ID NO: 379938 - RNA, 22 nt, Human
caauacuuccuuguuagaggca

SEQ ID NO: 379939 - RNA, 22 nt, Human
agugaaauccuggucaacaggu

SEQ ID NO: 379940 - RNA, 22 nt, Human
aauuccaaguagcaucccauca

SEQ ID NO: 379941 - RNA, 22 nt, Human
uuguggcucgugagauguuagg

SEQ ID NO: 379942 - RNA, 22 nt, Human
cggagcugccugccaagccugc

SEQ ID NO: 379943 - RNA, 22 nt, Human
cuuauuuugcugaugacccagg

SEQ ID NO: 379944 - RNA, 22 nt, Human
uuauuauuuuguguacagcaaa

SEQ ID NO: 379945 - RNA, 22 nt, Human
uuuucuuaggugcuccaaguag

SEQ ID NO: 379946 - RNA, 22 nt, Human
aguccggggucuggacaccugg

SEQ ID NO: 379947 - RNA, 22 nt, Human
ucugggaagcugguccuguucu

SEQ ID NO: 379948 - RNA, 22 nt, Human
gacagggccgcagauggagacu

SEQ ID NO: 379949 - RNA, 23 nt, Human
auaaggcauaaagguacauugga

SEQ ID NO: 379950 - RNA, 22 nt, Human
cccucugccugcgcccuggugu

SEQ ID NO: 379951 - RNA, 22 nt, Human
cugcucugaguauuaacggagg

SEQ ID NO: 379952 - RNA, 22 nt, Human
ucaggauccauagacucccaaa

SEQ ID NO: 379953 - RNA, 22 nt, Human
cauuuauugaguggccacagug

SEQ ID NO: 379954 - RNA, 22 nt, Human
augacagaaggccucccugaca

SEQ ID NO: 379955 - RNA, 22 nt, Human
aagauuuccuggauguaauucc

SEQ ID NO: 379956 - RNA, 21 nt, Human
aagagcuggaucaaggauaag

SEQ ID NO: 379957 - RNA, 22 nt, Human
agagccaggugcugcuguuuga

SEQ ID NO: 379958 - RNA, 22 nt, Human
cacaggagagcugggaggugcc

SEQ ID NO: 379959 - RNA, 22 nt, Human
ggcagaggagcuggaaacaugg

SEQ ID NO: 379960 - RNA, 22 nt, Human
uggagagguuuaaacaaaaguu

SEQ ID NO: 379961 - RNA, 22 nt, Human
aauguguagggugccuguuuuu

SEQ ID NO: 379962 - RNA, 22 nt, Human
uccagccaccaccuugauugcc

SEQ ID NO: 379963 - RNA, 22 nt, Human
aaguucaaggugauaguggcag

SEQ ID NO: 379964 - RNA, 22 nt, Human
acuacuuugggccauuuguuua

SEQ ID NO: 379965 - RNA, 22 nt, Human
agggcuggaggguacuaguuua

SEQ ID NO: 379966 - RNA, 22 nt, Human
uucaaguuuugccuccccaucc

SEQ ID NO: 379967 - RNA, 22 nt, Human
gggcuggaggaccggccucgga

SEQ ID NO: 379968 - RNA, 22 nt, Human
uaaauuauguuccauguccuuu

SEQ ID NO: 379969 - RNA, 22 nt, Human
ugucuagggagcugcucaggcu

SEQ ID NO: 379970 - RNA, 23 nt, Human
agggcccaagccuggacagcagg

SEQ ID NO: 379971 - RNA, 22 nt, Human
cagugcagaacacauggaaaau

SEQ ID NO: 379972 - RNA, 20 nt, Human
ugcagcugguuucacaggga

SEQ ID NO: 379973 - RNA, 23 nt, Human
gaagccacacaaaggucgccaag

SEQ ID NO: 379974 - RNA, 22 nt, Human
aagcccagaugugagaacugag

SEQ ID NO: 379975 - RNA, 22 nt, Human
guuaauuugcagcuuucgagcu

SEQ ID NO: 379976 - RNA, 22 nt, Human
uggagcugauacagcuggcuuu

SEQ ID NO: 379977 - RNA, 22 nt, Human
uccucucagugugguuguggga

SEQ ID NO: 379978 - RNA, 22 nt, Human
cuaauacacccuauugcuuguu

SEQ ID NO: 379979 - RNA, 22 nt, Human
ggagguggcagggaacauaauu

SEQ ID NO: 379980 - RNA, 23 nt, Human
cccuggaguaaauucuuggaagg

SEQ ID NO: 379981 - RNA, 20 nt, Human
cccagggaccugagcuccau

SEQ ID NO: 379982 - RNA, 22 nt, Human
ugcuuaauauugugauguaaua

SEQ ID NO: 379983 - RNA, 22 nt, Human
gcccccucuuuggagccagcca

SEQ ID NO: 379984 - RNA, 23 nt, Human
cugcagucgccggccugggugcc

SEQ ID NO: 379985 - RNA, 22 nt, Human
agcugcugagagucugccgggc

SEQ ID NO: 379986 - RNA, 22 nt, Human
ccuggccagccagggcuggggu

SEQ ID NO: 379987 - RNA, 22 nt, Human
cccaggaccgcgcggcugagcg

SEQ ID NO: 379988 - RNA, 22 nt, Human
auuguucaaagugcuuugcaug

SEQ ID NO: 379989 - RNA, 22 nt, Human
gggaggugauuaggaccaugua

SEQ ID NO: 379990 - RNA, 22 nt, Human
gcugcugucagugguggcaguu

SEQ ID NO: 379991 - RNA, 22 nt, Human
ccuguggcucucuuuggagguc

SEQ ID NO: 379992 - RNA, 22 nt, Human
uucaggauaugugauaucugaa

SEQ ID NO: 379993 - RNA, 22 nt, Human
agcauuuaagcuucugcaaagc

SEQ ID NO: 379994 - RNA, 22 nt, Human
cuggaucaugcauugcuugucc

SEQ ID NO: 379995 - RNA, 22 nt, Human
gcaaaggccacuggggcgaugg

SEQ ID NO: 379996 - RNA, 22 nt, Human
gcucagagaaucagcagacacc

SEQ ID NO: 379997 - RNA, 22 nt, Human
acaggugugagaacaugccuug

SEQ ID NO: 379998 - RNA, 22 nt, Human
gaggggcucuuuaauaguaaca

SEQ ID NO: 379999 - RNA, 22 nt, Human
caucagaaugaauguucuggag

SEQ ID NO: 380000 - RNA, 22 nt, Human
agcugccauccgaggugucaga

SEQ ID NO: 380001 - RNA, 22 nt, Human
gcgaaaaauguguaaauauguu

SEQ ID NO: 380002 - RNA, 22 nt, Human
auucccaucgucaacuucacug

SEQ ID NO: 380003 - RNA, 22 nt, Human
caaguccuuuucuuggcucagg

SEQ ID NO: 380004 - RNA, 22 nt, Human
cuacagaaggagaaauggguaa

SEQ ID NO: 380005 - RNA, 22 nt, Human
caucagaacaaaucgguuaaga

SEQ ID NO: 380006 - RNA, 22 nt, Human
gggcagcagcaggaggucucug

SEQ ID NO: 380007 - RNA, 22 nt, Human
ccaggugugauuuggcaguguc

SEQ ID NO: 380008 - RNA, 22 nt, Human
agcagagcgccugcucagaggg

SEQ ID NO: 380009 - RNA, 21 nt, Human
ucagcuuugcaacugcacauc

SEQ ID NO: 380010 - RNA, 22 nt, Human
ugguggccuugauggcaucugc

SEQ ID NO: 380011 - RNA, 22 nt, Human
accugccuauggagccacaugg

SEQ ID NO: 380012 - RNA, 22 nt, Human
gcagagcauguccucaggacag

SEQ ID NO: 380013 - RNA, 22 nt, Human
ucccaggagcaccuuuugagcc

SEQ ID NO: 380014 - RNA, 22 nt, Human
aggccugacuugaauuuagggc

SEQ ID NO: 380015 - RNA, 22 nt, Human
gcccagcaggggauggcagcuc

SEQ ID NO: 380016 - RNA, 22 nt, Human
gagcaggaugggagcuggggcc

SEQ ID NO: 380017 - RNA, 22 nt, Human
gaugcaggauagcuucacccag

SEQ ID NO: 380018 - RNA, 22 nt, Human
acuauacaguauguacgugcac

SEQ ID NO: 380019 - RNA, 22 nt, Human
gaggucagucagaccaggguuu

SEQ ID NO: 380020 - RNA, 22 nt, Human
aaagauaauguuuccuuauucu

SEQ ID NO: 380021 - RNA, 22 nt, Human
aaugaacaggugaaugucagau

SEQ ID NO: 380022 - RNA, 21 nt, Human
ugcauaaagaaauacaaauac

SEQ ID NO: 380023 - RNA, 22 nt, Human
gagccagggcugugagcugagc

SEQ ID NO: 380024 - RNA, 22 nt, Human
uggcuuuacaucaaauugagua

SEQ ID NO: 380025 - RNA, 17 nt, Human
ucagagggaugagcagg

SEQ ID NO: 380026 - RNA, 22 nt, Human
auguauccuuauacacauuuau

SEQ ID NO: 380027 - RNA, 22 nt, Human
uggggcagaguaggauuuuggc

SEQ ID NO: 380028 - RNA, 22 nt, Human
uuucacaaacugaggagacaau

SEQ ID NO: 380029 - RNA, 22 nt, Human
gguggccuuucaguggaucagg

SEQ ID NO: 380030 - RNA, 22 nt, Human
cucuuuccaggguaccccaggu

SEQ ID NO: 380031 - RNA, 22 nt, Human
uuuaccaaauagauuaugucag

SEQ ID NO: 380032 - RNA, 22 nt, Human
gccucugcaauuacauugugcc

SEQ ID NO: 380033 - RNA, 22 nt, Human
uccaggagagguagaggguucc

SEQ ID NO: 380034 - RNA, 22 nt, Human
agaccaagaaaggaugaggauc

SEQ ID NO: 380035 - RNA, 22 nt, Human
auuauuauuguugauguuaggg

SEQ ID NO: 380036 - RNA, 21 nt, Human
gggcuggacaugguggcucau

SEQ ID NO: 380037 - RNA, 22 nt, Human
acuuaguauuuuucagcuuuga

SEQ ID NO: 380038 - RNA, 22 nt, Human
agucuucccugugccagagugu

SEQ ID NO: 380039 - RNA, 22 nt, Human
uuccuuaguugacugucuuagu

SEQ ID NO: 380040 - RNA, 22 nt, Human
ccaaaguccauaguuuacauua

SEQ ID NO: 380041 - RNA, 18 nt, Human
gggcauggaugcagcauc

SEQ ID NO: 380042 - RNA, 22 nt, Human
gggggcaguaaggauauggaaa

SEQ ID NO: 380043 - RNA, 22 nt, Human
cauguugaauggccuugauuuu

SEQ ID NO: 380044 - RNA, 22 nt, Human
gccagguggcugagcagcugca

SEQ ID NO: 380045 - RNA, 22 nt, Human
accugcaggcacaggugugcgc

SEQ ID NO: 380046 - RNA, 22 nt, Human
aggcucaguuugguuuccauug

SEQ ID NO: 380047 - RNA, 22 nt, Human
cugaggaguuuggguuguucaa

SEQ ID NO: 380048 - RNA, 22 nt, Human
cacugccuggaaggagagacau

SEQ ID NO: 380049 - RNA, 22 nt, Human
aguacauuuauuaaugguaaaa

SEQ ID NO: 380050 - RNA, 20 nt, Human
gagccuuccccucaccacug

SEQ ID NO: 380051 - RNA, 22 nt, Human
ggugaagggccuuaggagacag

SEQ ID NO: 380052 - RNA, 22 nt, Human
auucuucauacagacaaguccu

SEQ ID NO: 380053 - RNA, 22 nt, Human
uauuccaaaaucccaaacugcc

SEQ ID NO: 380054 - RNA, 23 nt, Human
uguaaaaugggguaguguuacca

SEQ ID NO: 380055 - RNA, 22 nt, Human
aagccagccagugccagucuua

SEQ ID NO: 380056 - RNA, 20 nt, Human
ugcagcuucaccugugucau

SEQ ID NO: 380057 - RNA, 22 nt, Human
agcagcaacuuauuuuucuuau

SEQ ID NO: 380058 - RNA, 22 nt, Human
uugaaaguuaucuagauucuga

SEQ ID NO: 380059 - RNA, 22 nt, Human
ccauggcauuuuaugugucuua

SEQ ID NO: 380060 - RNA, 22 nt, Human
ugacauuuuaucaauaucacag

SEQ ID NO: 380061 - RNA, 22 nt, Human
cauggauugaauauaaauuaga

SEQ ID NO: 380062 - RNA, 22 nt, Human
aagugagugguaaggagcaugg

SEQ ID NO: 380063 - RNA, 22 nt, Human
uaugucaaaguuaagaaauagg

SEQ ID NO: 380064 - RNA, 22 nt, Human
uucaggaugacaccauguccag

SEQ ID NO: 380065 - RNA, 22 nt, Human
agccacagcauguguguaugua

SEQ ID NO: 380066 - RNA, 22 nt, Human
uccuuuccaugcuucuagaggc

SEQ ID NO: 380067 - RNA, 23 nt, Human
ucaguuuuggcuguucaguguug

SEQ ID NO: 380068 - RNA, 23 nt, Human
uauggcuuacagugcuuuaggua

SEQ ID NO: 380069 - RNA, 22 nt, Human
ugcagaccucccauggcugccu

SEQ ID NO: 380070 - RNA, 22 nt, Human
cuggggggagcugcguccagca

SEQ ID NO: 380071 - RNA, 22 nt, Human
uucuuuugggaauuacguaugc

SEQ ID NO: 380072 - RNA, 22 nt, Human
ugucacauaggcaaaauguuuu

SEQ ID NO: 380073 - RNA, 21 nt, Human
gcagacugcccugcugucccc

SEQ ID NO: 380074 - RNA, 21 nt, Human
gaaaagcaagggaguagaaca

SEQ ID NO: 380075 - RNA, 22 nt, Human
aggugagguuugggagguguca

SEQ ID NO: 380076 - RNA, 22 nt, Human
uuucaguggguuuauuucaugu

SEQ ID NO: 380077 - RNA, 22 nt, Human
uugcucugauuagguggaaaca

SEQ ID NO: 380078 - RNA, 23 nt, Human
gugcugugagccccuuggccucc

SEQ ID NO: 380079 - RNA, 22 nt, Human
uuauccaaacuggugaaucauu

SEQ ID NO: 380080 - RNA, 18 nt, Human
gagucuuuguuacugcug

SEQ ID NO: 380081 - RNA, 22 nt, Human
cggcagagacggcgcuuugaac

SEQ ID NO: 380082 - RNA, 22 nt, Human
uacuuuuagccuauuugauucu

SEQ ID NO: 380083 - RNA, 22 nt, Human
auucauuugcuauuguguaugg

SEQ ID NO: 380084 - RNA, 22 nt, Human
ucagagaguuggaaagaauuaa

SEQ ID NO: 380085 - RNA, 22 nt, Human
acauuucuuugcuagacagcag

SEQ ID NO: 380086 - RNA, 22 nt, Human
agcuggaggauaacucacuucu

SEQ ID NO: 380087 - RNA, 22 nt, Human
caggccagugugcuucccaggc

SEQ ID NO: 380088 - RNA, 22 nt, Human
uugcaggauuuuagagaugaca

SEQ ID NO: 380089 - RNA, 22 nt, Human
acaagaauuuacauguagugga

SEQ ID NO: 380090 - RNA, 22 nt, Human
aaauuuaagaagugugugcgug

SEQ ID NO: 380091 - RNA, 22 nt, Human
cagacacagauaugcauauggc

SEQ ID NO: 380092 - RNA, 22 nt, Human
ccaugagcuucaacugacacag

SEQ ID NO: 380093 - RNA, 22 nt, Human
ccuccagggcagacggggagca

SEQ ID NO: 380094 - RNA, 22 nt, Human
cagaaguggccucagagggagu

SEQ ID NO: 380095 - RNA, 22 nt, Human
uauaaaauucucaguuuggggu

SEQ ID NO: 380096 - RNA, 22 nt, Human
gcaaaauuaaacuuagcaucau

SEQ ID NO: 380097 - RNA, 22 nt, Human
aaauaugaaugauaagaguuau

SEQ ID NO: 380098 - RNA, 22 nt, Human
gggucccaggaaggagcagugu

SEQ ID NO: 380099 - RNA, 22 nt, Human
ucaccuuagcuagaggaagaga

SEQ ID NO: 380100 - RNA, 20 nt, Human
uggcaucucucaauuguagg

SEQ ID NO: 380101 - RNA, 22 nt, Human
ucccagauucuucugugugggc

SEQ ID NO: 380102 - RNA, 22 nt, Human
ugccaggcgauugcuaucagca

SEQ ID NO: 380103 - RNA, 22 nt, Human
acccacgaagaugagcggcaug

SEQ ID NO: 380104 - RNA, 18 nt, Human
gccugcaggcacgggggu

SEQ ID NO: 380105 - RNA, 22 nt, Human
caaugaaagcaacugccuauaa

SEQ ID NO: 380106 - RNA, 22 nt, Human
agcacagauucugaagaguccu

SEQ ID NO: 380107 - RNA, 22 nt, Human
guacauguugguuguuuccagu

SEQ ID NO: 380108 - RNA, 22 nt, Human
cugcagccuaggugcagcuggg

SEQ ID NO: 380109 - RNA, 22 nt, Human
uggaaggcaugggaacuguucu

SEQ ID NO: 380110 - RNA, 22 nt, Human
cuccucccucuuugccacacau

SEQ ID NO: 380111 - RNA, 22 nt, Human
aguggcaggaaaguggaagaga

SEQ ID NO: 380112 - RNA, 17 nt, Human
ucaggcugugccuggua

SEQ ID NO: 380113 - RNA, 22 nt, Human
ggugauuuucgaguuucauguu

SEQ ID NO: 380114 - RNA, 22 nt, Human
uggcagcuggaucccaaggcag

SEQ ID NO: 380115 - RNA, 22 nt, Human
uaaagccaacacuuuacugcuc

SEQ ID NO: 380116 - RNA, 22 nt, Human
cuggcuccaucacugggugaug

SEQ ID NO: 380117 - RNA, 22 nt, Human
gcccaggacucagggugucgcg

SEQ ID NO: 380118 - RNA, 22 nt, Human
ugaagcugugggcaguggagcc

SEQ ID NO: 380119 - RNA, 22 nt, Human
aauuuguuaaaagugagugaca

SEQ ID NO: 380120 - RNA, 22 nt, Human
gaggcugcccaacuggagugga

SEQ ID NO: 380121 - RNA, 22 nt, Human
aguacaauuauauuuagauggu

SEQ ID NO: 380122 - RNA, 22 nt, Human
gcaggagccaggccgagcuggu

SEQ ID NO: 380123 - RNA, 22 nt, Human
ggugggcacccgagacuggauc

SEQ ID NO: 380124 - RNA, 22 nt, Human
ugccaggcacgugagaguggcc

SEQ ID NO: 380125 - RNA, 22 nt, Human
ccuuucucauuuuaagcauuag

SEQ ID NO: 380126 - RNA, 22 nt, Human
gaaaaaugagcugaugucaggg

SEQ ID NO: 380127 - RNA, 22 nt, Human
aaggcacucauucaaggagaua

SEQ ID NO: 380128 - RNA, 22 nt, Human
gcugucacaaauauuucucagc

SEQ ID NO: 380129 - RNA, 22 nt, Human
aagaauguuaguuucugauaca

SEQ ID NO: 380130 - RNA, 22 nt, Human
ucaagagaaggggaaauagacu

SEQ ID NO: 380131 - RNA, 22 nt, Human
uugucuguccaggcaccccaag

SEQ ID NO: 380132 - RNA, 22 nt, Human
aagauacugaugauguaggcua

SEQ ID NO: 380133 - RNA, 17 nt, Human
uggcagcugaaagcucu

SEQ ID NO: 380134 - RNA, 22 nt, Human
auuucaguguuuuaagaguuca

SEQ ID NO: 380135 - RNA, 18 nt, Human
gcaggugccacugcuguu

SEQ ID NO: 380136 - RNA, 22 nt, Human
ggcagucuuaucagcauuggac

SEQ ID NO: 380137 - RNA, 22 nt, Human
cagcuuuauuucacguguuugu

SEQ ID NO: 380138 - RNA, 22 nt, Human
agauuucccucuuguauuugca

SEQ ID NO: 380139 - RNA, 22 nt, Human
ggcuucucgugccgaagcaaga

SEQ ID NO: 380140 - RNA, 22 nt, Human
uuuauucuugagagugagaaga

SEQ ID NO: 380141 - RNA, 22 nt, Human
cuguggaaggccuguccugaaa

SEQ ID NO: 380142 - RNA, 22 nt, Human
aggaaaugcugaugcuccugga

SEQ ID NO: 380143 - RNA, 22 nt, Human
aggccuguuccuuccugggcac

SEQ ID NO: 380144 - RNA, 17 nt, Human
uggagcugcguguguuc

SEQ ID NO: 380145 - RNA, 22 nt, Human
auuauaggcuugagccaccgug

SEQ ID NO: 380146 - RNA, 22 nt, Human
agggcacaagacucugagcccc

SEQ ID NO: 380147 - RNA, 22 nt, Human
gccuggagugguccugcugccc

SEQ ID NO: 380148 - RNA, 22 nt, Human
agauacauuaguaguuacuugu

SEQ ID NO: 380149 - RNA, 21 nt, Human
cuggacugaggagacagucgc

SEQ ID NO: 380150 - RNA, 21 nt, Human
agacagagugcagucuacaua

SEQ ID NO: 380151 - RNA, 22 nt, Human
ucaguaaaugaaugaauauaug

SEQ ID NO: 380152 - RNA, 22 nt, Human
cuggagcaggcuugucccagcu

SEQ ID NO: 380153 - RNA, 23 nt, Human
uuccacaaugaaaauaaagcagg

SEQ ID NO: 380154 - RNA, 23 nt, Human
cagagcuggcucagagcugccug

SEQ ID NO: 380155 - RNA, 22 nt, Human
aggccugcagcaggagcaaacc

SEQ ID NO: 380156 - RNA, 22 nt, Human
aagggcucugcugucucucccc

SEQ ID NO: 380157 - RNA, 22 nt, Human
gagucugagucuaauggcccca

SEQ ID NO: 380158 - RNA, 18 nt, Human
ucuuccaacacugacacc

SEQ ID NO: 380159 - RNA, 22 nt, Human
caaggccagagccagcgauaag

SEQ ID NO: 380160 - RNA, 22 nt, Human
caguggccugagccaggcuucc

SEQ ID NO: 380161 - RNA, 22 nt, Human
cucacugacgaggaagcugaga

SEQ ID NO: 380162 - RNA, 19 nt, Human
ucaggaguuaguugugcuc

SEQ ID NO: 380163 - RNA, 22 nt, Human
ugccugggccucugaggaaggc

SEQ ID NO: 380164 - RNA, 22 nt, Human
ccaggagagcaaaggucacucu

SEQ ID NO: 380165 - RNA, 22 nt, Human
gcugcccagacauugaaucagg

SEQ ID NO: 380166 - RNA, 22 nt, Human
cuggagcucuguguguuccuga

SEQ ID NO: 380167 - RNA, 22 nt, Human
acuaaggaauaugacaaacuca

SEQ ID NO: 380168 - RNA, 22 nt, Human
cuccagggaggucugcaggacu

SEQ ID NO: 380169 - RNA, 21 nt, Human
cacugcagccuugaccugggc

SEQ ID NO: 380170 - RNA, 22 nt, Human
cacaggagaacccacagauucu

SEQ ID NO: 380171 - RNA, 22 nt, Human
agggagcuguggucagcucagu

SEQ ID NO: 380172 - RNA, 19 nt, Human
cugaggugcaguaagaggc

SEQ ID NO: 380173 - RNA, 22 nt, Human
guucuucagaggggaaagaacc

SEQ ID NO: 380174 - RNA, 22 nt, Human
accuuucaaaguggcuaucacu

SEQ ID NO: 380175 - RNA, 22 nt, Human
cagcaguggccaucuguguggu

SEQ ID NO: 380176 - RNA, 22 nt, Human
uuuccauauucugcgucugcca

SEQ ID NO: 380177 - RNA, 22 nt, Human
uguguccuuuggaggaucagcg

SEQ ID NO: 380178 - RNA, 22 nt, Human
uggcaggaaaaagggccagagg

SEQ ID NO: 380179 - RNA, 22 nt, Human
gggcagcugcagggauggugac

SEQ ID NO: 380180 - RNA, 23 nt, Human
uccuucagagccucccuccaagc

SEQ ID NO: 380181 - RNA, 22 nt, Human
gaauuucacaaggugaggauaa

SEQ ID NO: 380182 - RNA, 22 nt, Human
aaaguauucuugacuguuuuuc

SEQ ID NO: 380183 - RNA, 22 nt, Human
ugaguuuugucuugcuagaagu

SEQ ID NO: 380184 - RNA, 18 nt, Human
agaugaaagcaaaugaca

SEQ ID NO: 380185 - RNA, 22 nt, Human
ggcugcugguggaaugguaggc

SEQ ID NO: 380186 - RNA, 22 nt, Human
aggcuggcccuacuggcugccu

SEQ ID NO: 380187 - RNA, 22 nt, Human
uuagaaaucaccucugaagauc

SEQ ID NO: 380188 - RNA, 22 nt, Human
uaaagacaaacccacuaggguu

SEQ ID NO: 380189 - RNA, 22 nt, Human
aaauccuaaugacaaguuuagu

SEQ ID NO: 380190 - RNA, 22 nt, Human
aggagagucuugagucacuggu

SEQ ID NO: 380191 - RNA, 22 nt, Human
agggaggaucugcuccuugucu

SEQ ID NO: 380192 - RNA, 21 nt, Human
ugggggagaauugguugcuuu

SEQ ID NO: 380193 - RNA, 19 nt, Human
accaggcuuauggucagug

SEQ ID NO: 380194 - RNA, 20 nt, Human
aggcugccaggucucacauc

SEQ ID NO: 380195 - RNA, 22 nt, Human
auuuaguguguauugcuauuau

SEQ ID NO: 380196 - RNA, 22 nt, Human
gaggaagggcugccugccgggc

SEQ ID NO: 380197 - RNA, 22 nt, Human
aaagucauggaaaaucuuggaa

SEQ ID NO: 380198 - RNA, 22 nt, Human
ccacagggauaggaauggggcu

SEQ ID NO: 380199 - RNA, 22 nt, Human
gaggaggcuuccgggaggcacg

SEQ ID NO: 380200 - RNA, 22 nt, Human
agcagcugguaggaguggccac

SEQ ID NO: 380201 - RNA, 20 nt, Human
uucauucauuccacaacuuc

SEQ ID NO: 380202 - RNA, 22 nt, Human
cugccacuagcuuucacaucuu

SEQ ID NO: 380203 - RNA, 22 nt, Human
gcaggagcuggaaagugauguu

SEQ ID NO: 380204 - RNA, 22 nt, Human
gugcuugggggaaguaacagac

SEQ ID NO: 380205 - RNA, 22 nt, Human
ggccagagagccgcuguuagga

SEQ ID NO: 380206 - RNA, 22 nt, Human
agcaucuggucaugagugagaa

SEQ ID NO: 380207 - RNA, 22 nt, Human
caggcagcaggagcccugcucg

SEQ ID NO: 380208 - RNA, 22 nt, Human
gggcauggugaugugcaccugu

SEQ ID NO: 380209 - RNA, 22 nt, Human
ccugucugaggaggugcucuuu

SEQ ID NO: 380210 - RNA, 22 nt, Human
ccuuucucuuggauaccgauug

SEQ ID NO: 380211 - RNA, 22 nt, Human
gucccuggggaaucagcuggag

SEQ ID NO: 380212 - RNA, 21 nt, Human
ccuuuacaauuuugcauuccu

SEQ ID NO: 380213 - RNA, 22 nt, Human
aagauuuccauuucuagcucau

SEQ ID NO: 380214 - RNA, 19 nt, Human
agccagugagccucugggu

SEQ ID NO: 380215 - RNA, 22 nt, Human
ucccagagcagaugugcuaaag

SEQ ID NO: 380216 - RNA, 22 nt, Human
auacagauguugaauguuauau

SEQ ID NO: 380217 - RNA, 20 nt, Human
cuggguggcaagcaaggggg

SEQ ID NO: 380218 - RNA, 22 nt, Human
uucaggauuauacucucuuccc

SEQ ID NO: 380219 - RNA, 22 nt, Human
ugcuuuauucgacaucugguag

SEQ ID NO: 380220 - RNA, 22 nt, Human
gccacccccaaguagguggucu

SEQ ID NO: 380221 - RNA, 22 nt, Human
agcaggaacucagggaguucuc

SEQ ID NO: 380222 - RNA, 22 nt, Human
gaaaugugcagaauguguuaga

SEQ ID NO: 380223 - RNA, 22 nt, Human
ggcccacacugacagcugagcu

SEQ ID NO: 380224 - RNA, 21 nt, Human
agcuuguguguaucacagugu

SEQ ID NO: 380225 - RNA, 22 nt, Human
acuuugcagggcuugauaucca

SEQ ID NO: 380226 - RNA, 22 nt, Human
gcugggcaccggagagacccca

SEQ ID NO: 380227 - RNA, 22 nt, Human
acaggcuuuuuuagaaugacau

SEQ ID NO: 380228 - RNA, 22 nt, Human
uggcagugggaagcuggaaguc

SEQ ID NO: 380229 - RNA, 22 nt, Human
gcaaaauuuacacuccuucuuc

SEQ ID NO: 380230 - RNA, 22 nt, Human
gaaggaaaacagaucugccuga

SEQ ID NO: 380231 - RNA, 22 nt, Human
cagcaucaccgccauuucugau

SEQ ID NO: 380232 - RNA, 22 nt, Human
uacagaaguaaauaccaaaagc

SEQ ID NO: 380233 - RNA, 22 nt, Human
accucugcaaugcaaugucaug

SEQ ID NO: 380234 - RNA, 22 nt, Human
aagcugccuuccaugugaggaa

SEQ ID NO: 380235 - RNA, 19 nt, Human
ggcuggcaagugacagugu

SEQ ID NO: 380236 - RNA, 22 nt, Human
uguuucauguggacauaguugu

SEQ ID NO: 380237 - RNA, 22 nt, Human
uuccuccacgugacaggagcca

SEQ ID NO: 380238 - RNA, 22 nt, Human
guaaaguucuacuagaaucaac

SEQ ID NO: 380239 - RNA, 22 nt, Human
accaaaggcagagcugaacacu

SEQ ID NO: 380240 - RNA, 22 nt, Human
aggccuggguguucaccagaag

SEQ ID NO: 380241 - RNA, 22 nt, Human
uccagggauguccuguagcacu

SEQ ID NO: 380242 - RNA, 22 nt, Human
gccuucugauugcuggacugac

SEQ ID NO: 380243 - RNA, 22 nt, Human
agggucagcuggcugucagggg

SEQ ID NO: 380244 - RNA, 22 nt, Human
cagaagcagugagagaugugca

SEQ ID NO: 380245 - RNA, 22 nt, Human
gagggcuccacacgggcccagc

SEQ ID NO: 380246 - RNA, 22 nt, Human
ugcauaaagugccauaguauua

SEQ ID NO: 380247 - RNA, 22 nt, Human
agaaggcagaugggacggagca

SEQ ID NO: 380248 - RNA, 22 nt, Human
uuucacauguggaaugccaggu

SEQ ID NO: 380249 - RNA, 21 nt, Human
agucccauccgguaagcaagc

SEQ ID NO: 380250 - RNA, 22 nt, Human
uggcucagaaggcugccuucac

SEQ ID NO: 380251 - RNA, 22 nt, Human
gcacugaaauuauaugcauuug

SEQ ID NO: 380252 - RNA, 22 nt, Human
ugggcucugcaucagugcccau

SEQ ID NO: 380253 - RNA, 22 nt, Human
guuauguacuuuuuaaaucuug

SEQ ID NO: 380254 - RNA, 22 nt, Human
ccuguucagagcuaagcaucau

SEQ ID NO: 380255 - RNA, 22 nt, Human
uauagccauuuccaguggcauc

SEQ ID NO: 380256 - RNA, 22 nt, Human
gagccaggguuugaaacuagac

SEQ ID NO: 380257 - RNA, 22 nt, Human
gagcucuggcagggcaggucug

SEQ ID NO: 380258 - RNA, 22 nt, Human
gauuuuauauggcauacugugg

SEQ ID NO: 380259 - RNA, 22 nt, Human
aauucuagcauugugaaaauau

SEQ ID NO: 380260 - RNA, 22 nt, Human
aaaaagguugauccagauuagg

SEQ ID NO: 380261 - RNA, 22 nt, Human
ggagugggaacaaugacauggu

SEQ ID NO: 380262 - RNA, 20 nt, Human
cgcccaggagggcccaugug

SEQ ID NO: 380263 - RNA, 22 nt, Human
aaucaguuaaauauugaguaca

SEQ ID NO: 380264 - RNA, 22 nt, Human
auuuacagaugaugcuauuuga

SEQ ID NO: 380265 - RNA, 19 nt, Human
gggaccugacuaauuggca

SEQ ID NO: 380266 - RNA, 22 nt, Human
agagccacugggagacagagca

SEQ ID NO: 380267 - RNA, 23 nt, Human
aggauccugguacaggagcagag

SEQ ID NO: 380268 - RNA, 19 nt, Human
uggcauuuggaggcaaccu

SEQ ID NO: 380269 - RNA, 22 nt, Human
uccuucuuugacaaguggcaga

SEQ ID NO: 380270 - RNA, 22 nt, Human
ugagccuggccugcagagacca

SEQ ID NO: 380271 - RNA, 17 nt, Human
uucucuuccuggauagu

SEQ ID NO: 380272 - RNA, 22 nt, Human
cugcugagcccuggcacaggug

SEQ ID NO: 380273 - RNA, 20 nt, Human
aggccaggaaauguaguucu

SEQ ID NO: 380274 - RNA, 23 nt, Human
uggggagaguuacccuggaagcg

SEQ ID NO: 380275 - RNA, 22 nt, Human
cuggcucauuuuagcaucaggu

SEQ ID NO: 380276 - RNA, 22 nt, Human
gagucaccuugggucagcgaua

SEQ ID NO: 380277 - RNA, 20 nt, Human
aggagaugauccagagucag

SEQ ID NO: 380278 - RNA, 21 nt, Human
aaaaagcuggggcaugcaugc

SEQ ID NO: 380279 - RNA, 22 nt, Human
auuuuuaugacaaaccauccuc

SEQ ID NO: 380280 - RNA, 22 nt, Human
uucagcaagaccaccauguacc

SEQ ID NO: 380281 - RNA, 22 nt, Human
uauaaaacagaaagcacuaccu

SEQ ID NO: 380282 - RNA, 22 nt, Human
aucuaucccaguuuaacucauu

SEQ ID NO: 380283 - RNA, 22 nt, Human
uggccuuccuggugacucauga

SEQ ID NO: 380284 - RNA, 22 nt, Human
cagucacauugcccugcauuua

SEQ ID NO: 380285 - RNA, 22 nt, Human
caggaggcagagguugcaguga

SEQ ID NO: 380286 - RNA, 22 nt, Human
uuuucuuacugucugugauccu

SEQ ID NO: 380287 - RNA, 22 nt, Human
cucuggagcauuucaccuacau

SEQ ID NO: 380288 - RNA, 22 nt, Human
uggugccuugggccuacagcgc

SEQ ID NO: 380289 - RNA, 22 nt, Human
caguuucugggcguucacaggu

SEQ ID NO: 380290 - RNA, 22 nt, Human
cacucacuuauuucuaacagaa

SEQ ID NO: 380291 - RNA, 22 nt, Human
cacugaagcuuucauucucuug

SEQ ID NO: 380292 - RNA, 22 nt, Human
gcagggcugcagagggcacugu

SEQ ID NO: 380293 - RNA, 22 nt, Human
caggagugagaugcgaucacuu

SEQ ID NO: 380294 - RNA, 22 nt, Human
cagaggccaccuguggccacug

SEQ ID NO: 380295 - RNA, 22 nt, Human
auguaucagauaaagcaugugg

SEQ ID NO: 380296 - RNA, 22 nt, Human
ccugggagguggagguugcagu

SEQ ID NO: 380297 - RNA, 22 nt, Human
uaucugagaaagaagcaccaga

SEQ ID NO: 380298 - RNA, 22 nt, Human
uagccaggucacacuguguguu

SEQ ID NO: 380299 - RNA, 21 nt, Human
cagcuucuucugugaccuggu

SEQ ID NO: 380300 - RNA, 22 nt, Human
cugcuuugaggggcucuguaua

SEQ ID NO: 380301 - RNA, 22 nt, Human
ucucugucugagccuggcagac

SEQ ID NO: 380302 - RNA, 22 nt, Human
uacagauacagaucuagauaca

SEQ ID NO: 380303 - RNA, 22 nt, Human
cuguguggccucaagccagccu

SEQ ID NO: 380304 - RNA, 22 nt, Human
ccagcucuagccccauguggcu

SEQ ID NO: 380305 - RNA, 22 nt, Human
uagaugcuguagaaauacuuau

SEQ ID NO: 380306 - RNA, 22 nt, Human
caugccaguuuugagaugcacc

SEQ ID NO: 380307 - RNA, 22 nt, Human
aacauugcagcuuaauugcagg

SEQ ID NO: 380308 - RNA, 22 nt, Human
gacccaggaagcuacuucuggu

SEQ ID NO: 380309 - RNA, 22 nt, Human
uuuccucauuuaucugcuggga

SEQ ID NO: 380310 - RNA, 22 nt, Human
cagaguccuggacacagagaca

SEQ ID NO: 380311 - RNA, 22 nt, Human
agccacagagcaggagaccuuu

SEQ ID NO: 380312 - RNA, 22 nt, Human
uuuuagcacuaagugauaugcu

SEQ ID NO: 380313 - RNA, 22 nt, Human
caggauccuggcugcauggacg

SEQ ID NO: 380314 - RNA, 20 nt, Human
ucauuacagugcuaagaugu

SEQ ID NO: 380315 - RNA, 22 nt, Human
cugggaggacaacuuggagcuc

SEQ ID NO: 380316 - RNA, 22 nt, Human
uacaagaaugucuuaaaagcuc

SEQ ID NO: 380317 - RNA, 22 nt, Human
augguguagcaugugauaugac

SEQ ID NO: 380318 - RNA, 22 nt, Human
caaacauucaaguacaagucuu

SEQ ID NO: 380319 - RNA, 19 nt, Human
ugucucagugucccuuccu

SEQ ID NO: 380320 - RNA, 22 nt, Human
caggcagaugcugacaagaguu

SEQ ID NO: 380321 - RNA, 22 nt, Human
gggcugagggguaucucauggg

SEQ ID NO: 380322 - RNA, 22 nt, Human
agcagccacccagcugcucauu

SEQ ID NO: 380323 - RNA, 22 nt, Human
gaggcauggccugaggcuagga

SEQ ID NO: 380324 - RNA, 22 nt, Human
ugcacagcgggugucugucagg

SEQ ID NO: 380325 - RNA, 22 nt, Human
caagagcugaggcuggagaggu

SEQ ID NO: 380326 - RNA, 22 nt, Human
ggcagcuaguuuaagaaagagg

SEQ ID NO: 380327 - RNA, 22 nt, Human
uagacacauccguggaagcuuc

SEQ ID NO: 380328 - RNA, 22 nt, Human
cugggcagugcagcuauagaac

SEQ ID NO: 380329 - RNA, 19 nt, Human
agcagccaucgaccaugga

SEQ ID NO: 380330 - RNA, 22 nt, Human
acagaaggcggggacaaggcgg

SEQ ID NO: 380331 - RNA, 22 nt, Human
ugcacacacgcggcacaucugu

SEQ ID NO: 380332 - RNA, 22 nt, Human
cauacuuucuuuuucacgcaua

SEQ ID NO: 380333 - RNA, 22 nt, Human
gucaggggccaugggccaagga

SEQ ID NO: 380334 - RNA, 22 nt, Human
ggaggccaaggcagguggauca

SEQ ID NO: 380335 - RNA, 22 nt, Human
auuucccagcuuugaucaguuu

SEQ ID NO: 380336 - RNA, 22 nt, Human
aggugcuagguguguaguggag

SEQ ID NO: 380337 - RNA, 22 nt, Human
cucagagaaccuaagcggagga

SEQ ID NO: 380338 - RNA, 20 nt, Human
cucuccucacccgugucagg

SEQ ID NO: 380339 - RNA, 22 nt, Human
ugaacucgggaggaggcugcag

SEQ ID NO: 380340 - RNA, 22 nt, Human
aggagcugagucagcccgacag

SEQ ID NO: 380341 - RNA, 22 nt, Human
agagugauggguugugcugacc

SEQ ID NO: 380342 - RNA, 22 nt, Human
aggccagguuccucaaucuuga

SEQ ID NO: 380343 - RNA, 18 nt, Human
uuugcaaaggaaguaugg

SEQ ID NO: 380344 - RNA, 22 nt, Human
ucaggaucaggggccuuuccuu

SEQ ID NO: 380345 - RNA, 23 nt, Human
uugauuucaaaugcagagaacac

SEQ ID NO: 380346 - RNA, 22 nt, Human
cggggacacacuggcagcuccu

SEQ ID NO: 380347 - RNA, 22 nt, Human
cuucccacuaguaucacagagc

SEQ ID NO: 380348 - RNA, 22 nt, Human
ucacagugaugacgugggagca

SEQ ID NO: 380349 - RNA, 22 nt, Human
agcuuuaucccuugcccaucga

SEQ ID NO: 380350 - RNA, 22 nt, Human
agcaggcuaagggaccuguuua

SEQ ID NO: 380351 - RNA, 22 nt, Human
ggaggggauuuaguagaugcua

SEQ ID NO: 380352 - RNA, 22 nt, Human
caguuucuuaucuucaaaauug

SEQ ID NO: 380353 - RNA, 22 nt, Human
caggaaagaaaugagaacacca

SEQ ID NO: 380354 - RNA, 22 nt, Human
uacaacauguaaagugguuuaa

SEQ ID NO: 380355 - RNA, 22 nt, Human
ucccagaggcuccagucucuau

SEQ ID NO: 380356 - RNA, 22 nt, Human
uucaggauggcggauguugggg

SEQ ID NO: 380357 - RNA, 22 nt, Human
aggguggcaguuacuggagcaa

SEQ ID NO: 380358 - RNA, 20 nt, Human
gcagggcaagggauaugaaa

SEQ ID NO: 380359 - RNA, 22 nt, Human
aaggaaagacauauaaaugacu

SEQ ID NO: 380360 - RNA, 22 nt, Human
uaauauguguuacugacuuuuu

SEQ ID NO: 380361 - RNA, 22 nt, Human
cagcugccccauaaaucacagu

SEQ ID NO: 380362 - RNA, 22 nt, Human
cuuaaaaucuggcaguuagcua

SEQ ID NO: 380363 - RNA, 22 nt, Human
guauacauagaugaugaacaag

SEQ ID NO: 380364 - RNA, 22 nt, Human
agcagccagugggagugauaca

SEQ ID NO: 380365 - RNA, 22 nt, Human
auuagggcuggaugcaaggaaa

SEQ ID NO: 380366 - RNA, 22 nt, Human
uugauuuauagaauguucaagc

SEQ ID NO: 380367 - RNA, 22 nt, Human
uuucuucagccacuccaaacug

SEQ ID NO: 380368 - RNA, 22 nt, Human
agcaaucaccaccucuauauuu

SEQ ID NO: 380369 - RNA, 22 nt, Human
uggcagagcuggcugcggauga

SEQ ID NO: 380370 - RNA, 22 nt, Human
guggccagcaagugcugccucu

SEQ ID NO: 380371 - RNA, 22 nt, Human
acagggcagagaggcaggcuug

SEQ ID NO: 380372 - RNA, 17 nt, Human
ucaggauguagcaguag

SEQ ID NO: 380373 - RNA, 17 nt, Human
ggagagugggaauggcc

SEQ ID NO: 380374 - RNA, 22 nt, Human
cagggcagaaggcacucuacuc

SEQ ID NO: 380375 - RNA, 22 nt, Human
ggugcccaccugucuuccugga

SEQ ID NO: 380376 - RNA, 22 nt, Human
ugcucuggguccugggccuccu

SEQ ID NO: 380377 - RNA, 22 nt, Human
ggcuuccuggggccuccugcaa

SEQ ID NO: 380378 - RNA, 22 nt, Human
gucaccaggucugaugcagcca

SEQ ID NO: 380379 - RNA, 23 nt, Human
uggcuucugccccauucucucca

SEQ ID NO: 380380 - RNA, 22 nt, Human
cccuggaggaaaaucugaggcu

SEQ ID NO: 380381 - RNA, 22 nt, Human
uagugaaacaguuaucaaucug

SEQ ID NO: 380382 - RNA, 22 nt, Human
gcaggggcuacucugagcuucc

SEQ ID NO: 380383 - RNA, 19 nt, Human
ggcauccagaacuaccagu

SEQ ID NO: 380384 - RNA, 22 nt, Human
caaaggcuuccacugcauccuu

SEQ ID NO: 380385 - RNA, 21 nt, Human
uccuccuucaaguccuggccu

SEQ ID NO: 380386 - RNA, 22 nt, Human
aaucagaaaauucaguggaauu

SEQ ID NO: 380387 - RNA, 22 nt, Human
uggacagguuugggugccuguu

SEQ ID NO: 380388 - RNA, 22 nt, Human
uuuaaauggcauuuucccagau

SEQ ID NO: 380389 - RNA, 22 nt, Human
auuucuguugcuuauaaauuac

SEQ ID NO: 380390 - RNA, 17 nt, Human
uagagcugguucaggag

SEQ ID NO: 380391 - RNA, 22 nt, Human
cuccacagccccuccaguggca

SEQ ID NO: 380392 - RNA, 22 nt, Human
gacacauagaucuaucucacuc

SEQ ID NO: 380393 - RNA, 22 nt, Human
ccccagccagcaggaccucuga

SEQ ID NO: 380394 - RNA, 22 nt, Human
ugcaggaacugggagggauagu

SEQ ID NO: 380395 - RNA, 22 nt, Human
agaagagccuggggaccauggc

SEQ ID NO: 380396 - RNA, 22 nt, Human
uuucuucagccuucacaaccug

SEQ ID NO: 380397 - RNA, 22 nt, Human
agguauagaauugaaaggguuu

SEQ ID NO: 380398 - RNA, 22 nt, Human
caguaugagaguugaaucaagg

SEQ ID NO: 380399 - RNA, 22 nt, Human
agcaggcuuucaagagucuucu

SEQ ID NO: 380400 - RNA, 22 nt, Human
ggcagcacugcagcuuguuggg

SEQ ID NO: 380401 - RNA, 22 nt, Human
cugaaggaagcagaagcgaggu

SEQ ID NO: 380402 - RNA, 22 nt, Human
ccagagagaaaauggagggcca

SEQ ID NO: 380403 - RNA, 22 nt, Human
cagcacaguacaaggcacggau

SEQ ID NO: 380404 - RNA, 22 nt, Human
agggcugcuauguugauucaga

SEQ ID NO: 380405 - RNA, 22 nt, Human
cuucaagauauuucuagaauca

SEQ ID NO: 380406 - RNA, 22 nt, Human
uuucuguaauuaaaagggcagg

SEQ ID NO: 380407 - RNA, 22 nt, Human
ucugagggcuugaggggaagua

SEQ ID NO: 380408 - RNA, 22 nt, Human
ugaacgcagguccacauggcuc

SEQ ID NO: 380409 - RNA, 22 nt, Human
aaaauguguuuaugcauuucgu

SEQ ID NO: 380410 - RNA, 22 nt, Human
uauaucaccaaaaacaguucug

SEQ ID NO: 380411 - RNA, 22 nt, Human
acauguauugacauuauauucu

SEQ ID NO: 380412 - RNA, 22 nt, Human
cugagccauccauaccagcuua

SEQ ID NO: 380413 - RNA, 22 nt, Human
ugagggaguuggguguauagga

SEQ ID NO: 380414 - RNA, 18 nt, Human
cugaaggauccaggugua

SEQ ID NO: 380415 - RNA, 22 nt, Human
gcugcaggggggucuggacuug

SEQ ID NO: 380416 - RNA, 22 nt, Human
cacauuuaaagguugaagcuga

SEQ ID NO: 380417 - RNA, 22 nt, Human
ugggagcaagcuggugcuggag

SEQ ID NO: 380418 - RNA, 22 nt, Human
ggccucugcccucacuccuguc

SEQ ID NO: 380419 - RNA, 22 nt, Human
auguauaaugcuaauuagcuag

SEQ ID NO: 380420 - RNA, 22 nt, Human
uacaaaugaccauagccacuua

SEQ ID NO: 380421 - RNA, 22 nt, Human
auuucaguguugguuagcaagc

SEQ ID NO: 380422 - RNA, 22 nt, Human
gaguccaggcucagaaacccgu

SEQ ID NO: 380423 - RNA, 22 nt, Human
ugcaggaaugagguucucaguu

SEQ ID NO: 380424 - RNA, 22 nt, Human
gaaaucugaacucuguauccuu

SEQ ID NO: 380425 - RNA, 22 nt, Human
uuauuagguuauucucuguacu

SEQ ID NO: 380426 - RNA, 22 nt, Human
uaauccaaaacugaaucugugg

SEQ ID NO: 380427 - RNA, 22 nt, Human
cagaaaauaaaguuucuacgca

SEQ ID NO: 380428 - RNA, 22 nt, Human
ucuguucaguugauguaguuuu

SEQ ID NO: 380429 - RNA, 22 nt, Human
cagaggaggcgguauacacugc

SEQ ID NO: 380430 - RNA, 22 nt, Human
uguccuuuuggcugucuauggu

SEQ ID NO: 380431 - RNA, 22 nt, Human
augguuuuucaaguauucagaa

SEQ ID NO: 380432 - RNA, 23 nt, Human
aagaaugcuucugaagagcugcc

SEQ ID NO: 380433 - RNA, 22 nt, Human
augcaguguuuggaagcuuaag

SEQ ID NO: 380434 - RNA, 22 nt, Human
cugcagagaauuguggggcuuc

SEQ ID NO: 380435 - RNA, 22 nt, Human
cugccuggcuaaacucaagucg

SEQ ID NO: 380436 - RNA, 21 nt, Human
uuuaaagaauaggaagggagg

SEQ ID NO: 380437 - RNA, 22 nt, Human
auagcuuuacagaagaguuuag

SEQ ID NO: 380438 - RNA, 22 nt, Human
cagcucuguaaauuccuucauc

SEQ ID NO: 380439 - RNA, 22 nt, Human
uaaggccaauuacauauguuca

SEQ ID NO: 380440 - RNA, 22 nt, Human
agcagugaugcaugacagccua

SEQ ID NO: 380441 - RNA, 22 nt, Human
agucuccuuggccucaaugccu

SEQ ID NO: 380442 - RNA, 18 nt, Human
uggaggcagaguucuggc

SEQ ID NO: 380443 - RNA, 22 nt, Human
uaaaguuuguagcaauugauau

SEQ ID NO: 380444 - RNA, 22 nt, Human
guuauaaaaugcacaguuguuu

SEQ ID NO: 380445 - RNA, 22 nt, Human
cauggccugccuccuccuggug

SEQ ID NO: 380446 - RNA, 22 nt, Human
agggagcucuaaguagagggac

SEQ ID NO: 380447 - RNA, 22 nt, Human
guggcugcagagggcacagcau

SEQ ID NO: 380448 - RNA, 22 nt, Human
uccuugaauauaauaacaguag

SEQ ID NO: 380449 - RNA, 22 nt, Human
cugagcugggacucaguagcaa

SEQ ID NO: 380450 - RNA, 22 nt, Human
caggcagaagaaguggaaggac

SEQ ID NO: 380451 - RNA, 22 nt, Human
aaaggccauuacuugcuuuuag

SEQ ID NO: 380452 - RNA, 22 nt, Human
aggaaggguucuuugugaaaga

SEQ ID NO: 380453 - RNA, 22 nt, Human
uauuaucauuaacuguugaauu

SEQ ID NO: 380454 - RNA, 21 nt, Human
agcaacucugacuagaugagg

SEQ ID NO: 380455 - RNA, 19 nt, Human
cccagcuugaccaccugcu

SEQ ID NO: 380456 - RNA, 22 nt, Human
gugaauaaucacccuucuggau

SEQ ID NO: 380457 - RNA, 22 nt, Human
aaucaguuguccaaaguucaca

SEQ ID NO: 380458 - RNA, 22 nt, Human
aauuucuccaagaaugcuuaga

SEQ ID NO: 380459 - RNA, 22 nt, Human
uacaguaaagcugcuaugaauu

SEQ ID NO: 380460 - RNA, 22 nt, Human
uaggaaaacgugauuuucucac

SEQ ID NO: 380461 - RNA, 22 nt, Human
aagcuggacucugccauuuacu

SEQ ID NO: 380462 - RNA, 22 nt, Human
gaggagaggggcucccaagagc

SEQ ID NO: 380463 - RNA, 22 nt, Human
ucuggcucauaggaaggccauu

SEQ ID NO: 380464 - RNA, 22 nt, Human
uagggcucacugagaugaauau

SEQ ID NO: 380465 - RNA, 22 nt, Human
ucucugagcgcauuccuccggc

SEQ ID NO: 380466 - RNA, 22 nt, Human
cagccccucccucaggcaggug

SEQ ID NO: 380467 - RNA, 22 nt, Human
agucucugugagcucccaaugg

SEQ ID NO: 380468 - RNA, 22 nt, Human
augaagucuagcaagcauugaa

SEQ ID NO: 380469 - RNA, 22 nt, Human
caguggcugugaccagggaccu

SEQ ID NO: 380470 - RNA, 22 nt, Human
gccaccagccccaugcgcugug

SEQ ID NO: 380471 - RNA, 22 nt, Human
aagaaauuaaggaaugcaacga

SEQ ID NO: 380472 - RNA, 23 nt, Human
ugcugggguaguuuguggcacag

SEQ ID NO: 380473 - RNA, 22 nt, Human
uuggaucaaauuucaugcuguc

SEQ ID NO: 380474 - RNA, 22 nt, Human
aggcucagugcaaaucauucug

SEQ ID NO: 380475 - RNA, 22 nt, Human
gacuuuuagaauggugaggaau

SEQ ID NO: 380476 - RNA, 22 nt, Human
cccaggaggccaagguugcagu

SEQ ID NO: 380477 - RNA, 22 nt, Human
ugugcaguuucuauguugucca

SEQ ID NO: 380478 - RNA, 22 nt, Human
uggcagggugggcuucagcccc

SEQ ID NO: 380479 - RNA, 22 nt, Human
gaggcugcaggcaaugcugccc

SEQ ID NO: 380480 - RNA, 22 nt, Human
ugggcagaggcagcagaaaccu

SEQ ID NO: 380481 - RNA, 22 nt, Human
auucuucaucacuaccuuguga

SEQ ID NO: 380482 - RNA, 22 nt, Human
ugaacucucucaagugacagaa

SEQ ID NO: 380483 - RNA, 22 nt, Human
gaaauagacacuuucuaugaau

SEQ ID NO: 380484 - RNA, 22 nt, Human
ucacaugcuugaggaaagaaaa

SEQ ID NO: 380485 - RNA, 17 nt, Human
ucucuuucccuuucugc

SEQ ID NO: 380486 - RNA, 22 nt, Human
aggcaggcucaggcccaugcuu

SEQ ID NO: 380487 - RNA, 22 nt, Human
cccuucucuuucacucacuauu

SEQ ID NO: 380488 - RNA, 22 nt, Human
cagaggaaguuccuugaugaga

SEQ ID NO: 380489 - RNA, 22 nt, Human
caacuuuucugugaauuuaagu

SEQ ID NO: 380490 - RNA, 22 nt, Human
uuuuaacuuaaaauacauagau

SEQ ID NO: 380491 - RNA, 22 nt, Human
cacauuugaaggaauuagcauu

SEQ ID NO: 380492 - RNA, 22 nt, Human
aaggcugauuagacugauagcu

SEQ ID NO: 380493 - RNA, 22 nt, Human
aggccuggccccaguugcuagg

SEQ ID NO: 380494 - RNA, 22 nt, Human
cuggccaacuugcuuguuggca

SEQ ID NO: 380495 - RNA, 22 nt, Human
ccaggagaaugggauuacccua

SEQ ID NO: 380496 - RNA, 22 nt, Human
cagcuucugucugauuagcaag

SEQ ID NO: 380497 - RNA, 22 nt, Human
gacagcuguggagaggcaugug

SEQ ID NO: 380498 - RNA, 21 nt, Human
uagcuuuaauauucccacauu

SEQ ID NO: 380499 - RNA, 22 nt, Human
gucuggagccacccuaagcauu

SEQ ID NO: 380500 - RNA, 21 nt, Human
agcugagcccagaagacuggu

SEQ ID NO: 380501 - RNA, 22 nt, Human
caggcacuggccagucagcaca

SEQ ID NO: 380502 - RNA, 22 nt, Human
uaugcacauugguuuccucauu

SEQ ID NO: 380503 - RNA, 22 nt, Human
ugcuugugagaguuuuuucaga

SEQ ID NO: 380504 - RNA, 22 nt, Human
ucagcagggaggcucugugccc

SEQ ID NO: 380505 - RNA, 20 nt, Human
aggagccauugacugcagca

SEQ ID NO: 380506 - RNA, 22 nt, Human
aggccugggucucgugccuacc

SEQ ID NO: 380507 - RNA, 22 nt, Human
cagggccaaguuggugccuuuu

SEQ ID NO: 380508 - RNA, 22 nt, Human
ugucucaguacacuccgauguu

SEQ ID NO: 380509 - RNA, 22 nt, Human
cuuuacauccuguuucccguuu

SEQ ID NO: 380510 - RNA, 20 nt, Human
uaggcagcuugacccuuggu

SEQ ID NO: 380511 - RNA, 22 nt, Human
cagugggcugugauggauucac

SEQ ID NO: 380512 - RNA, 22 nt, Human
cccaggucuaugccagcucuga

SEQ ID NO: 380513 - RNA, 22 nt, Human
agcagggcagguaaggaucaga

SEQ ID NO: 380514 - RNA, 22 nt, Human
acacaguauuacaauaggugcu

SEQ ID NO: 380515 - RNA, 22 nt, Human
caguggaggccuugggaccuuu

SEQ ID NO: 380516 - RNA, 22 nt, Human
gcucucuguuauuaagaucuuu

SEQ ID NO: 380517 - RNA, 21 nt, Human
ugggagagggcucagcuaccc

SEQ ID NO: 380518 - RNA, 22 nt, Human
ucugcagaaguggcugggccac

SEQ ID NO: 380519 - RNA, 22 nt, Human
aacaggcaacaguugacucuga

SEQ ID NO: 380520 - RNA, 21 nt, Human
guuauuuuaagugagcuuugc

SEQ ID NO: 380521 - RNA, 22 nt, Human
agggccagggaaacgaucagca

SEQ ID NO: 380522 - RNA, 22 nt, Human
agcugauuccacuuuuucccca

SEQ ID NO: 380523 - RNA, 22 nt, Human
gggcugagaauucagcuuuccu

SEQ ID NO: 380524 - RNA, 22 nt, Human
acagauuuguucuuuugggcua

SEQ ID NO: 380525 - RNA, 22 nt, Human
ggcaggcaagucugcucuguga

SEQ ID NO: 380526 - RNA, 22 nt, Human
ucacaaauauuuuaacaguagg

SEQ ID NO: 380527 - RNA, 22 nt, Human
ucccaggcuggcaggcagcagu

SEQ ID NO: 380528 - RNA, 22 nt, Human
gugggcagacagugcuuugcag

SEQ ID NO: 380529 - RNA, 22 nt, Human
cugggcugcaguuccugguccu

SEQ ID NO: 380530 - RNA, 22 nt, Human
ccagagacgucggucagggcgc

SEQ ID NO: 380531 - RNA, 22 nt, Human
caggcuugggagcagagccacu

SEQ ID NO: 380532 - RNA, 20 nt, Human
aggcagagcgcacuuuuaga

SEQ ID NO: 380533 - RNA, 22 nt, Human
guagggacaauauguuauuaga

SEQ ID NO: 380534 - RNA, 22 nt, Human
gaggcuggaggucaaagaugaa

SEQ ID NO: 380535 - RNA, 22 nt, Human
cuggaugcuuccucucugcuag

SEQ ID NO: 380536 - RNA, 22 nt, Human
uagcucuucaaucacugucucc

SEQ ID NO: 380537 - RNA, 22 nt, Human
caggcagagucagauuagacuu

SEQ ID NO: 380538 - RNA, 22 nt, Human
augugcauuaaaugucaauguu

SEQ ID NO: 380539 - RNA, 22 nt, Human
aauauguuccacuuaaagcugg

SEQ ID NO: 380540 - RNA, 22 nt, Human
aacauacagugagcaguggacu

SEQ ID NO: 380541 - RNA, 22 nt, Human
ucucaggacuuugggaagcuca

SEQ ID NO: 380542 - RNA, 22 nt, Human
ucagagccccuccgcuguccca

SEQ ID NO: 380543 - RNA, 22 nt, Human
cugaaauuccauuucagccaca

SEQ ID NO: 380544 - RNA, 22 nt, Human
gcagggugaaggucacauagaa

SEQ ID NO: 380545 - RNA, 22 nt, Human
cuguccuuacugcuucuggcuu

SEQ ID NO: 380546 - RNA, 22 nt, Human
aucuacaggauuuuacagaguu

SEQ ID NO: 380547 - RNA, 22 nt, Human
aggcccuggguuagggcccacu

SEQ ID NO: 380548 - RNA, 22 nt, Human
cauucauuuacuuucaacagcu

SEQ ID NO: 380549 - RNA, 22 nt, Human
gcugccugcucggcuccuggga

SEQ ID NO: 380550 - RNA, 22 nt, Human
ucuagggaacaugggucaagcu

SEQ ID NO: 380551 - RNA, 22 nt, Human
uauuucaugugcaccauaauuc

SEQ ID NO: 380552 - RNA, 22 nt, Human
gaggcugcuguuagcccugggc

SEQ ID NO: 380553 - RNA, 18 nt, Human
aaaugcuaggcuacauga

SEQ ID NO: 380554 - RNA, 22 nt, Human
ugguaauuuacgcauuucugua

SEQ ID NO: 380555 - RNA, 22 nt, Human
gcagaggccaggccaccagcaa

SEQ ID NO: 380556 - RNA, 22 nt, Human
cuguugucccugggagcucagc

SEQ ID NO: 380557 - RNA, 22 nt, Human
aucagagacaaaaccagcacuu

SEQ ID NO: 380558 - RNA, 22 nt, Human
ccaggacaaguguggccauggc

SEQ ID NO: 380559 - RNA, 22 nt, Human
aagccucaccuuuuagaagcua

SEQ ID NO: 380560 - RNA, 17 nt, Human
uaaagccagucaaguca

SEQ ID NO: 380561 - RNA, 22 nt, Human
uuugaaguggaaaaggauuuaa

SEQ ID NO: 380562 - RNA, 22 nt, Human
gaggacagcuuagggcuuccug

SEQ ID NO: 380563 - RNA, 22 nt, Human
ucauucuugaucacuaguuagu

SEQ ID NO: 380564 - RNA, 22 nt, Human
aaaugucugagacuucugaacu

SEQ ID NO: 380565 - RNA, 20 nt, Human
cacaagagaauacacacugg

SEQ ID NO: 380566 - RNA, 19 nt, Human
guuuuucccagacgaggca

SEQ ID NO: 380567 - RNA, 22 nt, Human
cuccugggaauuuaguugugag

SEQ ID NO: 380568 - RNA, 22 nt, Human
uuuuucaugagacuagaaguca

SEQ ID NO: 380569 - RNA, 22 nt, Human
gaagaacacuucaugauucauu

SEQ ID NO: 380570 - RNA, 22 nt, Human
gccacguugccacccgggugac

SEQ ID NO: 380571 - RNA, 22 nt, Human
agcagcugaucaaagcacuuau

SEQ ID NO: 380572 - RNA, 22 nt, Human
uccugggguccugacugcuucc

SEQ ID NO: 380573 - RNA, 20 nt, Human
gcccacucuaauccacuguc

SEQ ID NO: 380574 - RNA, 22 nt, Human
cugucaguucuuccagauagag

SEQ ID NO: 380575 - RNA, 22 nt, Human
guguugaugacauuuuagaaac

SEQ ID NO: 380576 - RNA, 22 nt, Human
caccagguuccgggcagagcug

SEQ ID NO: 380577 - RNA, 22 nt, Human
ugucugagugugccugggcauu

SEQ ID NO: 380578 - RNA, 22 nt, Human
ggcauggcucggagucagaaca

SEQ ID NO: 380579 - RNA, 22 nt, Human
gaccauuugcuaguaaauugca

SEQ ID NO: 380580 - RNA, 22 nt, Human
acauuucucaucuaguagagua

SEQ ID NO: 380581 - RNA, 22 nt, Human
caacauuugaguaaagaaaugg

SEQ ID NO: 380582 - RNA, 22 nt, Human
ccaggcugcuguugguguccgc

SEQ ID NO: 380583 - RNA, 22 nt, Human
uguacaguguagucaugagguu

SEQ ID NO: 380584 - RNA, 22 nt, Human
gugauuucagguuuuucauacu

SEQ ID NO: 380585 - RNA, 22 nt, Human
aggccuccugcagggaugagug

SEQ ID NO: 380586 - RNA, 22 nt, Human
gaggaggaaacccuguuccucu

SEQ ID NO: 380587 - RNA, 22 nt, Human
cagccagcuucagauccaagcc

SEQ ID NO: 380588 - RNA, 22 nt, Human
uauuagguaaaggacuugcagg

SEQ ID NO: 380589 - RNA, 22 nt, Human
cugcagccuccugggguacaug

SEQ ID NO: 380590 - RNA, 22 nt, Human
ucucuuccaguaagagucuuua

SEQ ID NO: 380591 - RNA, 22 nt, Human
aaaggugacacucugccagcug

SEQ ID NO: 380592 - RNA, 22 nt, Human
aggacagugguguucuggagug

SEQ ID NO: 380593 - RNA, 22 nt, Human
ggcagcuuucaauaggguuaug

SEQ ID NO: 380594 - RNA, 18 nt, Human
agggaucaucacugcagc

SEQ ID NO: 380595 - RNA, 22 nt, Human
auauauuuugcggucacguggc

SEQ ID NO: 380596 - RNA, 22 nt, Human
cuugccuuugucuucaaaggcu

SEQ ID NO: 380597 - RNA, 22 nt, Human
gaaaagagaacaucugaggauc

SEQ ID NO: 380598 - RNA, 22 nt, Human
agggccagggaagcuguauuuu

SEQ ID NO: 380599 - RNA, 22 nt, Human
caggagccagcugucccaacca

SEQ ID NO: 380600 - RNA, 22 nt, Human
cuugcuggugguguuuucuaug

SEQ ID NO: 380601 - RNA, 22 nt, Human
aguguugucaaacggcucagca

SEQ ID NO: 380602 - RNA, 22 nt, Human
ugguuucccauuaucugcagga

SEQ ID NO: 380603 - RNA, 22 nt, Human
uaaaucucacuggguauauugg

SEQ ID NO: 380604 - RNA, 22 nt, Human
gguuuauuaaugugaacuguau

SEQ ID NO: 380605 - RNA, 23 nt, Human
ugucacauuuaguuggcauuguu

SEQ ID NO: 380606 - RNA, 21 nt, Human
agagagaaggccauauggucc

SEQ ID NO: 380607 - RNA, 22 nt, Human
agcuggagaucaugcugauacu

SEQ ID NO: 380608 - RNA, 22 nt, Human
cagagcugcgcuuuuuccuggu

SEQ ID NO: 380609 - RNA, 22 nt, Human
accaggagacaugaccaaugag

SEQ ID NO: 380610 - RNA, 22 nt, Human
acuucuugggacccuggcaccg

SEQ ID NO: 380611 - RNA, 22 nt, Human
ucugggugcccuuugcucuguu

SEQ ID NO: 380612 - RNA, 22 nt, Human
auacaaagcuaaauaugguuuc

SEQ ID NO: 380613 - RNA, 22 nt, Human
ccacagggcacagacaggaagc

SEQ ID NO: 380614 - RNA, 22 nt, Human
uauaguacauggaaucuucaua

SEQ ID NO: 380615 - RNA, 22 nt, Human
ccaucagcaugggagcaugggc

SEQ ID NO: 380616 - RNA, 22 nt, Human
ugcagagguuuccaggcaaguu

SEQ ID NO: 380617 - RNA, 22 nt, Human
uggggcuguggauucucacgaa

SEQ ID NO: 380618 - RNA, 22 nt, Human
acaagcaugggcuuugacauca

SEQ ID NO: 380619 - RNA, 22 nt, Human
uccuggcccggccgggccugcu

SEQ ID NO: 380620 - RNA, 22 nt, Human
uuacaaagagaaguuguagaau

SEQ ID NO: 380621 - RNA, 22 nt, Human
uugauacaggccuucuagauga

SEQ ID NO: 380622 - RNA, 22 nt, Human
cagggcuguggaaaacuggugc

SEQ ID NO: 380623 - RNA, 19 nt, Human
ucucagagcccuagaggcc

SEQ ID NO: 380624 - RNA, 22 nt, Human
cccaggcagcggggucuccuug

SEQ ID NO: 380625 - RNA, 22 nt, Human
auguuuauguugggcuauauuu

SEQ ID NO: 380626 - RNA, 20 nt, Human
agugacagagacuguguggc

SEQ ID NO: 380627 - RNA, 22 nt, Human
agagccugaggccaggaaaaug

SEQ ID NO: 380628 - RNA, 22 nt, Human
uaguggagaggauguggagaaa

SEQ ID NO: 380629 - RNA, 17 nt, Human
gggcugacaguggccuc

SEQ ID NO: 380630 - RNA, 22 nt, Human
gcccucucuucugcagccucca

SEQ ID NO: 380631 - RNA, 22 nt, Human
aagggcucccugccugaggugg

SEQ ID NO: 380632 - RNA, 22 nt, Human
accaggcagagcugggccuuaa

SEQ ID NO: 380633 - RNA, 22 nt, Human
gccugggagagggauagugcag

SEQ ID NO: 380634 - RNA, 22 nt, Human
cagcuuuggcccagucgggagg

SEQ ID NO: 380635 - RNA, 22 nt, Human
uauaaaauggcaucagcuccaa

SEQ ID NO: 380636 - RNA, 22 nt, Human
uguuuaauaauucuaugauagu

SEQ ID NO: 380637 - RNA, 22 nt, Human
uuucauaaggguuucuagacuu

SEQ ID NO: 380638 - RNA, 21 nt, Human
acagaacuguauagugauaaa

SEQ ID NO: 380639 - RNA, 22 nt, Human
ccagaggugccacagaaagagc

SEQ ID NO: 380640 - RNA, 22 nt, Human
ccuugcauauauuauaucuuug

SEQ ID NO: 380641 - RNA, 22 nt, Human
aguacuucagaggcugcccagg

SEQ ID NO: 380642 - RNA, 22 nt, Human
gugugcagggaugagugcaggu

SEQ ID NO: 380643 - RNA, 22 nt, Human
aggcaggccccugagaauagac

SEQ ID NO: 380644 - RNA, 22 nt, Human
aggacagaccuaggacuggagc

SEQ ID NO: 380645 - RNA, 22 nt, Human
cuucuggggauggagcccagaa

SEQ ID NO: 380646 - RNA, 22 nt, Human
guuagaauaaaaggucagagag

SEQ ID NO: 380647 - RNA, 22 nt, Human
ugcaggugaaaauuaugaggau

SEQ ID NO: 380648 - RNA, 22 nt, Human
cacccaggacaggccagaugug

SEQ ID NO: 380649 - RNA, 22 nt, Human
ucuguucauuugccucggcucu

SEQ ID NO: 380650 - RNA, 22 nt, Human
gcaggugauucacccugggccu

SEQ ID NO: 380651 - RNA, 17 nt, Human
gcuggcugacccaugcc

SEQ ID NO: 380652 - RNA, 22 nt, Human
acagagcugggugcccccugga

SEQ ID NO: 380653 - RNA, 22 nt, Human
ugcacacaaguuggagaaugaa

SEQ ID NO: 380654 - RNA, 22 nt, Human
uagcuuuaauaagcugcugaau

SEQ ID NO: 380655 - RNA, 22 nt, Human
cagaagcaaaugccuugcugag

SEQ ID NO: 380656 - RNA, 22 nt, Human
uuugcauugcauuaaguauucu

SEQ ID NO: 380657 - RNA, 22 nt, Human
cacaaugcguacauauaucaaa

SEQ ID NO: 380658 - RNA, 22 nt, Human
acagucuugagcaucagccaga

SEQ ID NO: 380659 - RNA, 19 nt, Human
ugagacagggauucaggug

SEQ ID NO: 380660 - RNA, 21 nt, Human
ccugccaggaaacugaguguc

SEQ ID NO: 380661 - RNA, 22 nt, Human
uagagcuggaaaacugcaggua

SEQ ID NO: 380662 - RNA, 22 nt, Human
gcagucaguaaggcagccagaa

SEQ ID NO: 380663 - RNA, 22 nt, Human
guauuaggaaauaugaagaaag

SEQ ID NO: 380664 - RNA, 22 nt, Human
guccaguguguuuaucuuggau

SEQ ID NO: 380665 - RNA, 22 nt, Human
gagucaguaauggauaugucau

SEQ ID NO: 380666 - RNA, 22 nt, Human
gaggcaggcacuguuaucagca

SEQ ID NO: 380667 - RNA, 22 nt, Human
caucccugcccucaugccuaua

SEQ ID NO: 380668 - RNA, 22 nt, Human
gcagcugagcgugaggaagagu

SEQ ID NO: 380669 - RNA, 22 nt, Human
uauuaaagagagaaucaucauc

SEQ ID NO: 380670 - RNA, 22 nt, Human
cuggcagcuggaggcuagaggc

SEQ ID NO: 380671 - RNA, 22 nt, Human
agcugcuguggggcucggccug

SEQ ID NO: 380672 - RNA, 22 nt, Human
aggugaaguugaggaggcagaa

SEQ ID NO: 380673 - RNA, 22 nt, Human
uccugggcuugcuccuccagcu

SEQ ID NO: 380674 - RNA, 22 nt, Human
agaagugcuccagugaguuggg

SEQ ID NO: 380675 - RNA, 22 nt, Human
acugaaggaaacuuuuguguuu

SEQ ID NO: 380676 - RNA, 22 nt, Human
uagaaaagaauuuuauuugaua

SEQ ID NO: 380677 - RNA, 22 nt, Human
cuggaagguucuuugugugccu

SEQ ID NO: 380678 - RNA, 20 nt, Human
ugcuggggacauacagggug

SEQ ID NO: 380679 - RNA, 22 nt, Human
cugccugugccaccgccucauu

SEQ ID NO: 380680 - RNA, 22 nt, Human
uuuccuaggagauugaucacau

SEQ ID NO: 380681 - RNA, 22 nt, Human
ucaggggagguugaaucgucuc

SEQ ID NO: 380682 - RNA, 22 nt, Human
uaagaacagauaaaguuucccc

SEQ ID NO: 380683 - RNA, 22 nt, Human
ucaggcagagcuguggagcucu

SEQ ID NO: 380684 - RNA, 22 nt, Human
ggcucugcaugugagugggugg

SEQ ID NO: 380685 - RNA, 22 nt, Human
ccagcagcccacaggcgucccu

SEQ ID NO: 380686 - RNA, 23 nt, Human
aagcuuccuucacgucuccuggg

SEQ ID NO: 380687 - RNA, 22 nt, Human
cacagaggaaaggcaguuggua

SEQ ID NO: 380688 - RNA, 22 nt, Human
gcugcuguugauuuaguccaau

SEQ ID NO: 380689 - RNA, 21 nt, Human
ggccuuggcgggggccgaauu

SEQ ID NO: 380690 - RNA, 22 nt, Human
cccaggagacauauagaaggac

SEQ ID NO: 380691 - RNA, 21 nt, Human
aucaccagcagaagcugcaga

SEQ ID NO: 380692 - RNA, 22 nt, Human
gauaucauaucagacaaccucu

SEQ ID NO: 380693 - RNA, 22 nt, Human
aucacauugccagugauuaccc

SEQ ID NO: 380694 - RNA, 23 nt, Human
uuugaaguugacugccuuccaga

SEQ ID NO: 380695 - RNA, 22 nt, Human
accacugcccauggugaaaacu

SEQ ID NO: 380696 - RNA, 22 nt, Human
guggcccugucccaggccuccu

SEQ ID NO: 380697 - RNA, 22 nt, Human
ucaggauggcuucugcaucaaa

SEQ ID NO: 380698 - RNA, 22 nt, Human
guggaggagaggcgccuugcgg

SEQ ID NO: 380699 - RNA, 22 nt, Human
gaggauggaggugugagcuaug

SEQ ID NO: 380700 - RNA, 22 nt, Human
ugaaaucaauugcaauguuuau

SEQ ID NO: 380701 - RNA, 22 nt, Human
cugucaccuguucacugcagca

SEQ ID NO: 380702 - RNA, 22 nt, Human
gcaucuaaauaaacgugggagu

SEQ ID NO: 380703 - RNA, 22 nt, Human
caagagcucccagaccugggca

SEQ ID NO: 380704 - RNA, 22 nt, Human
aaagccaugaauguuauagagg

SEQ ID NO: 380705 - RNA, 22 nt, Human
agcucccagcagagcuggccac

SEQ ID NO: 380706 - RNA, 22 nt, Human
acagggucauuuuaugaucugu

SEQ ID NO: 380707 - RNA, 22 nt, Human
acaggcaggcuucggccagagc

SEQ ID NO: 380708 - RNA, 22 nt, Human
caguacuuguccucagguguua

SEQ ID NO: 380709 - RNA, 22 nt, Human
uagaaauccccagucucauagu

SEQ ID NO: 380710 - RNA, 18 nt, Human
gucaccuggaucagauua

SEQ ID NO: 380711 - RNA, 22 nt, Human
gucaggauuauuuuauuaaaag

SEQ ID NO: 380712 - RNA, 22 nt, Human
cuggguggaaagugcugagaau

SEQ ID NO: 380713 - RNA, 22 nt, Human
ccagauuugagcgucuuaaacc

SEQ ID NO: 380714 - RNA, 22 nt, Human
uuuuauuggagugauaccaagc

SEQ ID NO: 380715 - RNA, 22 nt, Human
cucuggccgcagcucagcucug

SEQ ID NO: 380716 - RNA, 22 nt, Human
aggugccagcucucaggcagga

SEQ ID NO: 380717 - RNA, 22 nt, Human
gggcaguagcuucguaggcauc

SEQ ID NO: 380718 - RNA, 21 nt, Human
agagcugggacuugccugaga

SEQ ID NO: 380719 - RNA, 22 nt, Human
ggggaccuuuccauuucugaga

SEQ ID NO: 380720 - RNA, 22 nt, Human
ugcagaagaccuuccagggcug

SEQ ID NO: 380721 - RNA, 22 nt, Human
acccugggucauauacagugug

SEQ ID NO: 380722 - RNA, 22 nt, Human
ggagccagcagggugacacuga

SEQ ID NO: 380723 - RNA, 22 nt, Human
uagcuuuagugaaaaauaucag

SEQ ID NO: 380724 - RNA, 23 nt, Human
aggugcagcccuggaccugcccc

SEQ ID NO: 380725 - RNA, 22 nt, Human
aguuuuucugggaggcacugcu

SEQ ID NO: 380726 - RNA, 22 nt, Human
ucugcagcgugcaggcuggugc

SEQ ID NO: 380727 - RNA, 22 nt, Human
uguuugaauuuugcuaacgugu

SEQ ID NO: 380728 - RNA, 22 nt, Human
ucagaacauuuaaaaagugguu

SEQ ID NO: 380729 - RNA, 22 nt, Human
agcccccaaaagugcuuaugau

SEQ ID NO: 380730 - RNA, 19 nt, Human
augucuguugaauuucaua

SEQ ID NO: 380731 - RNA, 22 nt, Human
cucuggaauguuuacaugcccu

SEQ ID NO: 380732 - RNA, 22 nt, Human
uguucaauccccagguccugaa

SEQ ID NO: 380733 - RNA, 22 nt, Human
cccugggacccgcugcagaggc

SEQ ID NO: 380734 - RNA, 22 nt, Human
uucucuagguuuuagaugaaga

SEQ ID NO: 380735 - RNA, 22 nt, Human
cugcugugccuuaaaaugcaag

SEQ ID NO: 380736 - RNA, 22 nt, Human
gagcagcuguccccaaagcuuc

SEQ ID NO: 380737 - RNA, 22 nt, Human
ggagcagagcugggcuuggcug

SEQ ID NO: 380738 - RNA, 22 nt, Human
uggcagcacuagguacugagcu

SEQ ID NO: 380739 - RNA, 22 nt, Human
aagacaauuugauacuaguugc

SEQ ID NO: 380740 - RNA, 22 nt, Human
ugagcuggucacuccuucugaa

SEQ ID NO: 380741 - RNA, 22 nt, Human
uggccuggggaagaccaugggc

SEQ ID NO: 380742 - RNA, 21 nt, Human
uuugaaagugggugauucuuu

SEQ ID NO: 380743 - RNA, 22 nt, Human
agcugucucugguauuauguga

SEQ ID NO: 380744 - RNA, 22 nt, Human
uguguccuucugggagucccag

SEQ ID NO: 380745 - RNA, 22 nt, Human
auuucagauucagaaauguagg

SEQ ID NO: 380746 - RNA, 17 nt, Human
ugauaguucauuuuaag

SEQ ID NO: 380747 - RNA, 19 nt, Human
gccugagccagccaugcaa

SEQ ID NO: 380748 - RNA, 22 nt, Human
uaugcauauagaugcacacaca

SEQ ID NO: 380749 - RNA, 22 nt, Human
cugcucugacccuuucaccuuc

SEQ ID NO: 380750 - RNA, 22 nt, Human
cagcuggcccuuugguagccuu

SEQ ID NO: 380751 - RNA, 22 nt, Human
uccuucagaggacggcagccag

SEQ ID NO: 380752 - RNA, 22 nt, Human
uucuucuccgaggagggcuggu

SEQ ID NO: 380753 - RNA, 20 nt, Human
caggaggcaaggucaagguc

SEQ ID NO: 380754 - RNA, 22 nt, Human
guggccuggaugagcuucgaca

SEQ ID NO: 380755 - RNA, 22 nt, Human
ucaguucuuuauuucacaguga

SEQ ID NO: 380756 - RNA, 22 nt, Human
ccauggcucuuaccuuguuaua

SEQ ID NO: 380757 - RNA, 19 nt, Human
aaggcagaaguuggauaug

SEQ ID NO: 380758 - RNA, 17 nt, Human
aggccucccuccaggcc

SEQ ID NO: 380759 - RNA, 20 nt, Human
uguaacaaucuggauguugc

SEQ ID NO: 380760 - RNA, 23 nt, Human
aguacauucgaaaaauucuguga

SEQ ID NO: 380761 - RNA, 22 nt, Human
ugggccugauucuugaauccug

SEQ ID NO: 380762 - RNA, 22 nt, Human
gcagcuggagccagccagacac

SEQ ID NO: 380763 - RNA, 22 nt, Human
aggcuuuaaguggccuacagcu

SEQ ID NO: 380764 - RNA, 22 nt, Human
gauaauaagcacagcaggaugu

SEQ ID NO: 380765 - RNA, 22 nt, Human
gaaacaugucugacaauuuacc

SEQ ID NO: 380766 - RNA, 22 nt, Human
uuugaguugcuuauuuaauagg

SEQ ID NO: 380767 - RNA, 22 nt, Human
agggccagcuagagcccucgcc

SEQ ID NO: 380768 - RNA, 22 nt, Human
uccagggcuggguuggcucagc

SEQ ID NO: 380769 - RNA, 22 nt, Human
ugcuggcuggccuggccuggac

SEQ ID NO: 380770 - RNA, 22 nt, Human
cucucugggcccaguuggcacc

SEQ ID NO: 380771 - RNA, 22 nt, Human
agugcuguaacaacuuauuugg

SEQ ID NO: 380772 - RNA, 15 nt, Human
ugggcagaucacuug

SEQ ID NO: 380773 - RNA, 19 nt, Human
ugagcaugcgagcugagaa

SEQ ID NO: 380774 - RNA, 22 nt, Human
ggacaggaugcugaagaugaag

SEQ ID NO: 380775 - RNA, 22 nt, Human
ggcaggagggcggacaaugacc

SEQ ID NO: 380776 - RNA, 22 nt, Human
accagugcuuccugcuggagcu

SEQ ID NO: 380777 - RNA, 22 nt, Human
uguguacacagauaguaauggc

SEQ ID NO: 380778 - RNA, 22 nt, Human
ggcuucuccagguacugagcau

SEQ ID NO: 380779 - RNA, 22 nt, Human
gcuccucugucaaaugagagug

SEQ ID NO: 380780 - RNA, 22 nt, Human
agccuggcuguaaccucauggu

SEQ ID NO: 380781 - RNA, 22 nt, Human
ugcaccauacccauuccccucu

SEQ ID NO: 380782 - RNA, 22 nt, Human
gggugggccacugagcagcgug

SEQ ID NO: 380783 - RNA, 20 nt, Human
uccuggccucccuggggcuc

SEQ ID NO: 380784 - RNA, 22 nt, Human
agaauuguugggguaauaaaag

SEQ ID NO: 380785 - RNA, 21 nt, Human
aggagggcacaaggccaggaa

SEQ ID NO: 380786 - RNA, 22 nt, Human
agccuggauccauguggcuacc

SEQ ID NO: 380787 - RNA, 22 nt, Human
auguacaguuucuagacucaaa

SEQ ID NO: 380788 - RNA, 22 nt, Human
gcugccuguggcccuucugggu

SEQ ID NO: 380789 - RNA, 22 nt, Human
ucuggaaguuagaggaggaaag

SEQ ID NO: 380790 - RNA, 22 nt, Human
agccuggauucgugcauccaca

SEQ ID NO: 380791 - RNA, 22 nt, Human
cucugugauuuugugagccaga

SEQ ID NO: 380792 - RNA, 22 nt, Human
ucaaacuguuuacagugagaua

SEQ ID NO: 380793 - RNA, 22 nt, Human
ggugaggcagguggcugcugag

SEQ ID NO: 380794 - RNA, 22 nt, Human
gcugccugcacagagcugcuuu

SEQ ID NO: 380795 - RNA, 22 nt, Human
acauuucuuccuaauuaucccu

SEQ ID NO: 380796 - RNA, 22 nt, Human
gaugguuugguaaaaguauguu

SEQ ID NO: 380797 - RNA, 22 nt, Human
aacuuucuuggaugucucaaca

SEQ ID NO: 380798 - RNA, 22 nt, Human
guuuuauaauugcuucauaaga

SEQ ID NO: 380799 - RNA, 22 nt, Human
uugguacagaugagguauucuc

SEQ ID NO: 380800 - RNA, 22 nt, Human
agggcagagauuaauuaagaca

SEQ ID NO: 380801 - RNA, 22 nt, Human
gcccggcagucacacacccagg

SEQ ID NO: 380802 - RNA, 22 nt, Human
auaugcauguacgugugcacaa

SEQ ID NO: 380803 - RNA, 22 nt, Human
uuucuaggucuuccauacugcc

SEQ ID NO: 380804 - RNA, 22 nt, Human
uuucagacagauucuucucagu

SEQ ID NO: 380805 - RNA, 19 nt, Human
agauggcaaaaugcaaaga

SEQ ID NO: 380806 - RNA, 22 nt, Human
gcccagcagaucucagugucuc

SEQ ID NO: 380807 - RNA, 19 nt, Human
gugaggauacugcucagag

SEQ ID NO: 380808 - RNA, 22 nt, Human
acaugcauucucuaaaagcaaa

SEQ ID NO: 380809 - RNA, 22 nt, Human
ccacagaguuacaaaacaguca

SEQ ID NO: 380810 - RNA, 22 nt, Human
auucuagaugcuguaaguagca

SEQ ID NO: 380811 - RNA, 22 nt, Human
uuugcauaaaggagcauuucuc

SEQ ID NO: 380812 - RNA, 22 nt, Human
aagccagauuucacucuuaauu

SEQ ID NO: 380813 - RNA, 22 nt, Human
aacauguaaauaucauuguacu

SEQ ID NO: 380814 - RNA, 22 nt, Human
caaauucucacccuguuugauu

SEQ ID NO: 380815 - RNA, 19 nt, Human
acagaagcauagaaaagga

SEQ ID NO: 380816 - RNA, 22 nt, Human
uguaaauaguuagcuugccucu

SEQ ID NO: 380817 - RNA, 22 nt, Human
ggccucugccccagccacaccu

SEQ ID NO: 380818 - RNA, 22 nt, Human
ucucaggcuaccuugcacaagg

SEQ ID NO: 380819 - RNA, 22 nt, Human
ccuggauucaagucuuucuuuc

SEQ ID NO: 380820 - RNA, 22 nt, Human
guacccaggcacgccuugcuga

SEQ ID NO: 380821 - RNA, 22 nt, Human
ugcauugauagaaaaacaugga

SEQ ID NO: 380822 - RNA, 22 nt, Human
cucucccccacagcagccuucu

SEQ ID NO: 380823 - RNA, 22 nt, Human
cagcuuauucaguaagcacaua

SEQ ID NO: 380824 - RNA, 22 nt, Human
agcagggcuucugugccugugc

SEQ ID NO: 380825 - RNA, 22 nt, Human
aggugaguuacaggaggagguc

SEQ ID NO: 380826 - RNA, 22 nt, Human
guaggaagcucugaggcuaguu

SEQ ID NO: 380827 - RNA, 23 nt, Human
uguaacaauucccagccuuugcc

SEQ ID NO: 380828 - RNA, 22 nt, Human
aaauuugauaagccauuguuac

SEQ ID NO: 380829 - RNA, 22 nt, Human
aggcaggucacaugcuuggcga

SEQ ID NO: 380830 - RNA, 22 nt, Human
ccagaucuaguguuguaaagcu

SEQ ID NO: 380831 - RNA, 22 nt, Human
ggguaccaagcugcuugggggc

SEQ ID NO: 380832 - RNA, 22 nt, Human
gaaguggaauuacugggucaua

SEQ ID NO: 380833 - RNA, 22 nt, Human
gccuguuggugacuuucuguug

SEQ ID NO: 380834 - RNA, 21 nt, Human
ugucagagcuuguaggacauu

SEQ ID NO: 380835 - RNA, 22 nt, Human
gauuucaaggauguuagaggug

SEQ ID NO: 380836 - RNA, 22 nt, Human
cuggcucucugagauauugagu

SEQ ID NO: 380837 - RNA, 22 nt, Human
ccacccuuggguucggaggccg

SEQ ID NO: 380838 - RNA, 22 nt, Human
caggauggagggagggcuguua

SEQ ID NO: 380839 - RNA, 22 nt, Human
cuggccagacuacacaugugug

SEQ ID NO: 380840 - RNA, 22 nt, Human
gggcuguggagccgcgagggcu

SEQ ID NO: 380841 - RNA, 22 nt, Human
cuggccugcugggugagguccu

SEQ ID NO: 380842 - RNA, 20 nt, Human
uuuacauuuugaaacaguga

SEQ ID NO: 380843 - RNA, 22 nt, Human
agccagacauggcuccugcucc

SEQ ID NO: 380844 - RNA, 22 nt, Human
ccuguucauuuguauuugucuu

SEQ ID NO: 380845 - RNA, 20 nt, Human
auacuuguuuucaggcuuuu

SEQ ID NO: 380846 - RNA, 20 nt, Human
ccuccuggucaggugugcag

SEQ ID NO: 380847 - RNA, 22 nt, Human
ugccaggcaacugcccagccau

SEQ ID NO: 380848 - RNA, 22 nt, Human
uuuuaccugaaccacacaguau

SEQ ID NO: 380849 - RNA, 20 nt, Human
gcugaagauucccaugcaag

SEQ ID NO: 380850 - RNA, 23 nt, Human
gccuucagcucgggaaggcuccc

SEQ ID NO: 380851 - RNA, 22 nt, Human
uuuaggaaugugguuuuugagc

SEQ ID NO: 380852 - RNA, 22 nt, Human
aaguccaguuuuuccagguggu

SEQ ID NO: 380853 - RNA, 22 nt, Human
uuccagagaaaagguuuauuuc

SEQ ID NO: 380854 - RNA, 22 nt, Human
cuguggcaggaagggacuagca

SEQ ID NO: 380855 - RNA, 22 nt, Human
gagaggagucccuaucacaguu

SEQ ID NO: 380856 - RNA, 22 nt, Human
gccucugcaggugcgguuaucc

SEQ ID NO: 380857 - RNA, 22 nt, Human
gcuguguuggugaagcuguagc

SEQ ID NO: 380858 - RNA, 22 nt, Human
agaggcugagaaacccucuucu

SEQ ID NO: 380859 - RNA, 21 nt, Human
uucauaaaccauucucaugca

SEQ ID NO: 380860 - RNA, 22 nt, Human
aaacggauauaacagcaaacgc

SEQ ID NO: 380861 - RNA, 22 nt, Human
uugaauaguuuuggauagcaua

SEQ ID NO: 380862 - RNA, 22 nt, Human
gugugcagucugcuaggcaggg

SEQ ID NO: 380863 - RNA, 22 nt, Human
aggggcugacuggaaagugcca

SEQ ID NO: 380864 - RNA, 19 nt, Human
aguagcagaaagugcagug

SEQ ID NO: 380865 - RNA, 23 nt, Human
gccuggccaccccagggcugcuu

SEQ ID NO: 380866 - RNA, 22 nt, Human
gaggccagcuaguccaggaagu

SEQ ID NO: 380867 - RNA, 22 nt, Human
uuacagaauguucuuccaacag

SEQ ID NO: 380868 - RNA, 22 nt, Human
agcuaccuggcuuaucacuguc

SEQ ID NO: 380869 - RNA, 22 nt, Human
ccucgaccuccccaggcucagg

SEQ ID NO: 380870 - RNA, 22 nt, Human
aaugauuuggcaaaggaaucca

SEQ ID NO: 380871 - RNA, 22 nt, Human
ucuggagcuggcagggcccugg

SEQ ID NO: 380872 - RNA, 22 nt, Human
cuuuauuccuacaagauuuucu

SEQ ID NO: 380873 - RNA, 22 nt, Human
cuuuauguccaccagacugcaa

SEQ ID NO: 380874 - RNA, 22 nt, Human
ugcagaagcagagccgguggcc

SEQ ID NO: 380875 - RNA, 22 nt, Human
guggagacgggacagaagcuaa

SEQ ID NO: 380876 - RNA, 22 nt, Human
aggccugaggaccagauaaaug

SEQ ID NO: 380877 - RNA, 23 nt, Human
gcugagguacauuuacaggaaga

SEQ ID NO: 380878 - RNA, 22 nt, Human
gggcugagccauuugaaccuug

SEQ ID NO: 380879 - RNA, 22 nt, Human
acucaggaaaugaagacugguu

SEQ ID NO: 380880 - RNA, 22 nt, Human
auaucagacagaaagcauugac

SEQ ID NO: 380881 - RNA, 23 nt, Human
uccuccuuuugcuugugcuuccc

SEQ ID NO: 380882 - RNA, 22 nt, Human
aguaaaaauugaggugcaaaau

SEQ ID NO: 380883 - RNA, 22 nt, Human
agcugcucuugggugacuucaa

SEQ ID NO: 380884 - RNA, 22 nt, Human
gugugcagugagcaaaagaucu

SEQ ID NO: 380885 - RNA, 20 nt, Human
cuuagaaauuuuuacccugg

SEQ ID NO: 380886 - RNA, 22 nt, Human
gccaccagugggggccugggca

SEQ ID NO: 380887 - RNA, 22 nt, Human
gcuggcucccauugguccuucc

SEQ ID NO: 380888 - RNA, 22 nt, Human
gacaauuucucaauauagaaac

SEQ ID NO: 380889 - RNA, 22 nt, Human
ccaggccucaccugcccaccua

SEQ ID NO: 380890 - RNA, 22 nt, Human
aaggcacuuaacgugggaggau

SEQ ID NO: 380891 - RNA, 22 nt, Human
caguacuugggggguucuaagu

SEQ ID NO: 380892 - RNA, 22 nt, Human
agguacagcaauauaagagguc

SEQ ID NO: 380893 - RNA, 22 nt, Human
gcagagcuucuguccuucagga

SEQ ID NO: 380894 - RNA, 21 nt, Human
gccugccugcgugacccucuu

SEQ ID NO: 380895 - RNA, 22 nt, Human
ucacuccucauugcugcccauu

SEQ ID NO: 380896 - RNA, 20 nt, Human
ccacaggaguccagucgacc

SEQ ID NO: 380897 - RNA, 22 nt, Human
ucaggagacaaagggugcggag

SEQ ID NO: 380898 - RNA, 22 nt, Human
uccugcagccauuagaggucaa

SEQ ID NO: 380899 - RNA, 22 nt, Human
caggcagcugaggacuuugcua

SEQ ID NO: 380900 - RNA, 22 nt, Human
ugagaguauuuuggcauuauca

SEQ ID NO: 380901 - RNA, 18 nt, Human
aggaagcaggaggaaggc

SEQ ID NO: 380902 - RNA, 22 nt, Human
ugaggcucacaaaucugcauuu

SEQ ID NO: 380903 - RNA, 22 nt, Human
agcucucaagauaagaaagaac

SEQ ID NO: 380904 - RNA, 22 nt, Human
uccugcagugugucuccugcac

SEQ ID NO: 380905 - RNA, 22 nt, Human
aggcacaggaaugucauccagu

SEQ ID NO: 380906 - RNA, 22 nt, Human
agagggcuuugauucucaguuc

SEQ ID NO: 380907 - RNA, 22 nt, Human
auugcagcuggucaggguaauu

SEQ ID NO: 380908 - RNA, 22 nt, Human
uucauguauuuaucauguaaau

SEQ ID NO: 380909 - RNA, 22 nt, Human
uuuucauuuuuguagaugcaag

SEQ ID NO: 380910 - RNA, 17 nt, Human
ggcuggagcagcucccc

SEQ ID NO: 380911 - RNA, 22 nt, Human
cccuggagucagguuggccugg

SEQ ID NO: 380912 - RNA, 21 nt, Human
gcagggacaaagcuucaggag

SEQ ID NO: 380913 - RNA, 22 nt, Human
uuugcagucuggccugcuuugg

SEQ ID NO: 380914 - RNA, 22 nt, Human
agagcagagggcucugggacaa

SEQ ID NO: 380915 - RNA, 23 nt, Human
uaaagucacauauuagagugagc

SEQ ID NO: 380916 - RNA, 22 nt, Human
ugcauuguugaauauuucauag

SEQ ID NO: 380917 - RNA, 21 nt, Human
agcagaggcugccuggugacu

SEQ ID NO: 380918 - RNA, 22 nt, Human
uuaaacaguguuucaugugggg

SEQ ID NO: 380919 - RNA, 22 nt, Human
agccuggcuaaauucucccaug

SEQ ID NO: 380920 - RNA, 22 nt, Human
aaaauuuugcccuauccuucau

SEQ ID NO: 380921 - RNA, 22 nt, Human
ccagcagcuguggcuuugccuc

SEQ ID NO: 380922 - RNA, 22 nt, Human
cagcccaaagccccaggcuaga

SEQ ID NO: 380923 - RNA, 22 nt, Human
agacagcaugauacaugaugcu

SEQ ID NO: 380924 - RNA, 22 nt, Human
uagcuuuaggaugguucucuug

SEQ ID NO: 380925 - RNA, 22 nt, Human
agacucaagcagauaggaauua

SEQ ID NO: 380926 - RNA, 22 nt, Human
cacagcuggugacagagcccag

SEQ ID NO: 380927 - RNA, 22 nt, Human
ggagggcucaauugacuccuga

SEQ ID NO: 380928 - RNA, 22 nt, Human
cccaggaaguggagguugcagu

SEQ ID NO: 380929 - RNA, 22 nt, Human
ggcaagcucaggccucaggugu

SEQ ID NO: 380930 - RNA, 22 nt, Human
ccugggcaauauagugaggccc

SEQ ID NO: 380931 - RNA, 17 nt, Human
uucaagauauugaaaug

SEQ ID NO: 380932 - RNA, 22 nt, Human
uaggcagcagugcuaugauucu

SEQ ID NO: 380933 - RNA, 22 nt, Human
agcuggagaauguggaugaucc

SEQ ID NO: 380934 - RNA, 22 nt, Human
caguggaagcuggcugugaaga

SEQ ID NO: 380935 - RNA, 19 nt, Human
ucaaagcaagcauguucug

SEQ ID NO: 380936 - RNA, 22 nt, Human
aggccugaggaccuucuggagg

SEQ ID NO: 380937 - RNA, 22 nt, Human
caaaauguucuggcaccuuuaa

SEQ ID NO: 380938 - RNA, 22 nt, Human
auugaaaguccuaucuaaggga

SEQ ID NO: 380939 - RNA, 22 nt, Human
ucuguuuaggcaaaauagcuac

SEQ ID NO: 380940 - RNA, 22 nt, Human
cacauaaucaccaaguccuuuc

SEQ ID NO: 380941 - RNA, 22 nt, Human
ugugccaugaggcucugauaug

SEQ ID NO: 380942 - RNA, 22 nt, Human
ggcuucauggaggaggugaguc

SEQ ID NO: 380943 - RNA, 22 nt, Human
ccugccugcggcccgcggggag

SEQ ID NO: 380944 - RNA, 22 nt, Human
ucucuucacaugcuugcuccaa

SEQ ID NO: 380945 - RNA, 22 nt, Human
guucauuuaugauguaacaugu

SEQ ID NO: 380946 - RNA, 22 nt, Human
cugggagagaagcgaagcuggg

SEQ ID NO: 380947 - RNA, 22 nt, Human
acugccaaugguaguuugaugg

SEQ ID NO: 380948 - RNA, 22 nt, Human
ugaaagcagcaccaauaccauu

SEQ ID NO: 380949 - RNA, 19 nt, Human
aggauuuauuaugugcuca

SEQ ID NO: 380950 - RNA, 22 nt, Human
gggacugggagauccuccuggc

SEQ ID NO: 380951 - RNA, 22 nt, Human
auggaguucuuuaaauucacag

SEQ ID NO: 380952 - RNA, 22 nt, Human
ggcagaggaagcuggaaguggg

SEQ ID NO: 380953 - RNA, 21 nt, Human
ggcagccugacccccagagag

SEQ ID NO: 380954 - RNA, 22 nt, Human
aauaugcauuaacuguguacau

SEQ ID NO: 380955 - RNA, 22 nt, Human
ggucaggguuccagguaucuuc

SEQ ID NO: 380956 - RNA, 22 nt, Human
ugucuuuagccagcagucuucu

SEQ ID NO: 380957 - RNA, 22 nt, Human
agggcacagccuaaagccuaug

SEQ ID NO: 380958 - RNA, 22 nt, Human
agggcugaaacauaauccuucu

SEQ ID NO: 380959 - RNA, 22 nt, Human
gcuggcugggucccugagaggc

SEQ ID NO: 380960 - RNA, 22 nt, Human
aguuaacaaguuggcaaucaac

SEQ ID NO: 380961 - RNA, 22 nt, Human
uuagauaauguagagauaugag

SEQ ID NO: 380962 - RNA, 22 nt, Human
cauuuauucucagauccuuguc

SEQ ID NO: 380963 - RNA, 22 nt, Human
gcacagaagagcuuuggaauga

SEQ ID NO: 380964 - RNA, 23 nt, Human
uuacuuuugcaccaaccuaauau

SEQ ID NO: 380965 - RNA, 22 nt, Human
auguccuuugcuucucuggucc

SEQ ID NO: 380966 - RNA, 22 nt, Human
cuggggugucucgucugccauu

SEQ ID NO: 380967 - RNA, 22 nt, Human
uuacagaagugaaggccuuuaa

SEQ ID NO: 380968 - RNA, 22 nt, Human
ugaagcaguuacuggguguuaa

SEQ ID NO: 380969 - RNA, 22 nt, Human
ggcuucugagugcucugcuguu

SEQ ID NO: 380970 - RNA, 22 nt, Human
guuguauucuucaauaucagag

SEQ ID NO: 380971 - RNA, 22 nt, Human
agcuggcaguaugacuggugac

SEQ ID NO: 380972 - RNA, 22 nt, Human
cccaaggccucuccuuggcuug

SEQ ID NO: 380973 - RNA, 22 nt, Human
ucuuugcaggagcccuuugaac

SEQ ID NO: 380974 - RNA, 22 nt, Human
augggcuguccuaguccagccc

SEQ ID NO: 380975 - RNA, 22 nt, Human
gggcugcuuccuggggaaugcu

SEQ ID NO: 380976 - RNA, 22 nt, Human
cccaggaaccuaccagcucgag

SEQ ID NO: 380977 - RNA, 22 nt, Human
guccucuguguaggcugcagac

SEQ ID NO: 380978 - RNA, 22 nt, Human
ucacuuuugaucccuaugcagu

SEQ ID NO: 380979 - RNA, 22 nt, Human
cuuugaagauggcaaauuuaga

SEQ ID NO: 380980 - RNA, 22 nt, Human
cucuuaguaaugccaugaagca

SEQ ID NO: 380981 - RNA, 22 nt, Human
gccuccuggccuuugcuccuca

SEQ ID NO: 380982 - RNA, 22 nt, Human
uuauuuacaacucuucucuucc

SEQ ID NO: 380983 - RNA, 21 nt, Human
uaucuacuggugucuuucaga

SEQ ID NO: 380984 - RNA, 19 nt, Human
ucccaggaaccuuuuauuu

SEQ ID NO: 380985 - RNA, 22 nt, Human
acuggaucagaaucugauuuuu

SEQ ID NO: 380986 - RNA, 22 nt, Human
guggccuggaguuugauguagg

SEQ ID NO: 380987 - RNA, 22 nt, Human
agggggugcccagaugaaggau

SEQ ID NO: 380988 - RNA, 22 nt, Human
ggccuuggugcucuguguugca

SEQ ID NO: 380989 - RNA, 22 nt, Human
cagcagguauguuuguucagca

SEQ ID NO: 380990 - RNA, 22 nt, Human
cugcuguguggauucaauggcu

SEQ ID NO: 380991 - RNA, 22 nt, Human
uccugggaagagaccugagcau

SEQ ID NO: 380992 - RNA, 22 nt, Human
caggcagagaggagcauuuaau

SEQ ID NO: 380993 - RNA, 22 nt, Human
gucacuguauccagguuccagc

SEQ ID NO: 380994 - RNA, 22 nt, Human
cauagcaacagcaucaagucaa

SEQ ID NO: 380995 - RNA, 22 nt, Human
uacuuaaugccacugaauugua

SEQ ID NO: 380996 - RNA, 22 nt, Human
gccaccaggagcccaguccaaa

SEQ ID NO: 380997 - RNA, 22 nt, Human
gaggaacccagcugggguugcc

SEQ ID NO: 380998 - RNA, 22 nt, Human
agcagaagaaagccacaugacu

SEQ ID NO: 380999 - RNA, 22 nt, Human
accaggaggcuacacuguccca

SEQ ID NO: 381000 - RNA, 22 nt, Human
ucagccagguaauguggagaug

SEQ ID NO: 381001 - RNA, 22 nt, Human
caucacuguccucagcauucca

SEQ ID NO: 381002 - RNA, 22 nt, Human
gcugucagcgcccaaggagcuc

SEQ ID NO: 381003 - RNA, 22 nt, Human
gaguccuuuugugccacaggga

SEQ ID NO: 381004 - RNA, 22 nt, Human
caggucagaggcgcagccccca

SEQ ID NO: 381005 - RNA, 22 nt, Human
agggugcagaaggagccuagga

SEQ ID NO: 381006 - RNA, 22 nt, Human
agcagccacacgccuccuucuc

SEQ ID NO: 381007 - RNA, 22 nt, Human
agagcuggauggucaagauggc

SEQ ID NO: 381008 - RNA, 22 nt, Human
guuuacauauuuuaauugguga

SEQ ID NO: 381009 - RNA, 22 nt, Human
augaggcaaggcuggccguguu

SEQ ID NO: 381010 - RNA, 22 nt, Human
uguggcaguauaagagcuagaa

SEQ ID NO: 381011 - RNA, 20 nt, Human
auucuacaagaauaagcaug

SEQ ID NO: 381012 - RNA, 22 nt, Human
ugcagggccuugggaugugucc

SEQ ID NO: 381013 - RNA, 22 nt, Human
ggaggagacggagugauuagug

SEQ ID NO: 381014 - RNA, 22 nt, Human
acuuucuauucccacagagaua

SEQ ID NO: 381015 - RNA, 22 nt, Human
cugggccuggcguuccaggcug

SEQ ID NO: 381016 - RNA, 22 nt, Human
uggcuggcccugggagugcaga

SEQ ID NO: 381017 - RNA, 22 nt, Human
aggcugcugaggccaccacgcu

SEQ ID NO: 381018 - RNA, 19 nt, Human
ggcaggcuggauagagagg

SEQ ID NO: 381019 - RNA, 20 nt, Human
ugaggcaggagaauggcaug

SEQ ID NO: 381020 - RNA, 22 nt, Human
agauguguuucuaguuccugca

SEQ ID NO: 381021 - RNA, 22 nt, Human
uaaugcacaugacugaacuauu

SEQ ID NO: 381022 - RNA, 22 nt, Human
caucagaaccaguggggacauu

SEQ ID NO: 381023 - RNA, 22 nt, Human
gggcccuggacguggcggcaga

SEQ ID NO: 381024 - RNA, 22 nt, Human
accugagccuagggagguugag

SEQ ID NO: 381025 - RNA, 22 nt, Human
auccugggaagcugacauugaa

SEQ ID NO: 381026 - RNA, 22 nt, Human
aaugguauuugucaagcauagu

SEQ ID NO: 381027 - RNA, 22 nt, Human
gcaaagcugggugugaaugcac

SEQ ID NO: 381028 - RNA, 22 nt, Human
cuggcucacuagcccugcccug

SEQ ID NO: 381029 - RNA, 22 nt, Human
uacauagcaaggaaaugacaga

SEQ ID NO: 381030 - RNA, 22 nt, Human
ucaaaguuuguggcaauuuauu

SEQ ID NO: 381031 - RNA, 22 nt, Human
ucccagagaaagucaaggucuu

SEQ ID NO: 381032 - RNA, 22 nt, Human
uuacagaaaauguguuuuaacu

SEQ ID NO: 381033 - RNA, 22 nt, Human
ugugccuucucaguccugcuca

SEQ ID NO: 381034 - RNA, 20 nt, Human
gcagagcuguucugugggga

SEQ ID NO: 381035 - RNA, 22 nt, Human
aguuauuucaguaacauaauag

SEQ ID NO: 381036 - RNA, 22 nt, Human
agaucugaccuaaccccaccac

SEQ ID NO: 381037 - RNA, 22 nt, Human
cugaggcagagggcagaccaga

SEQ ID NO: 381038 - RNA, 22 nt, Human
cugcccagaagcuuagagcuua

SEQ ID NO: 381039 - RNA, 22 nt, Human
augugucaauuuucaaaugcuu

SEQ ID NO: 381040 - RNA, 22 nt, Human
auuucauugaaguuaauucuuc

SEQ ID NO: 381041 - RNA, 22 nt, Human
caauaauauccugugcuguuug

SEQ ID NO: 381042 - RNA, 22 nt, Human
ccuagaugggauggcggccggg

SEQ ID NO: 381043 - RNA, 22 nt, Human
aggcagcagccacaaggccuga

SEQ ID NO: 381044 - RNA, 22 nt, Human
uuuagaaguucacacauuuaaa

SEQ ID NO: 381045 - RNA, 22 nt, Human
ggcaggcagaggcugagacagg

SEQ ID NO: 381046 - RNA, 22 nt, Human
agcaccuucacaggcucucagg

SEQ ID NO: 381047 - RNA, 22 nt, Human
ggcaaaaaccacaauuacuuuu

SEQ ID NO: 381048 - RNA, 22 nt, Human
ggcuguggccagcggggcugag

SEQ ID NO: 381049 - RNA, 22 nt, Human
ucaaaucagcaagcagcuuccc

SEQ ID NO: 381050 - RNA, 22 nt, Human
aggguaggguaaaugaugcauc

SEQ ID NO: 381051 - RNA, 22 nt, Human
ugauuucccucaucauaacaga

SEQ ID NO: 381052 - RNA, 22 nt, Human
gcuuagucaauuauaaauaggc

SEQ ID NO: 381053 - RNA, 22 nt, Human
aaaugugcuugugaucagcugu

SEQ ID NO: 381054 - RNA, 22 nt, Human
augaaaauucuaugcaggccag

SEQ ID NO: 381055 - RNA, 22 nt, Human
agagcuggaaucagaccucagg

SEQ ID NO: 381056 - RNA, 21 nt, Human
gggaaauuaggauugcucauc

SEQ ID NO: 381057 - RNA, 22 nt, Human
auuauuaggacuacugggguug

SEQ ID NO: 381058 - RNA, 22 nt, Human
ucacauuuuccuugguaucugu

SEQ ID NO: 381059 - RNA, 20 nt, Human
uucuggaggcuacaagucug

SEQ ID NO: 381060 - RNA, 22 nt, Human
ccaguuugagguuucaagaugu

SEQ ID NO: 381061 - RNA, 22 nt, Human
ugucauaacuuagugacaaauc

SEQ ID NO: 381062 - RNA, 22 nt, Human
cauuuacuguugaaucccuagc

SEQ ID NO: 381063 - RNA, 22 nt, Human
uguauuuucuucuggaagcuua

SEQ ID NO: 381064 - RNA, 22 nt, Human
ucauuucaaguucugacagcua

SEQ ID NO: 381065 - RNA, 22 nt, Human
acagguuuuuguggauauaugu

SEQ ID NO: 381066 - RNA, 22 nt, Human
ggagaggcuuggcccagccugg

SEQ ID NO: 381067 - RNA, 22 nt, Human
ccaccuccaccuauugccagcc

SEQ ID NO: 381068 - RNA, 22 nt, Human
uccuuagagacaagaccaguuu

SEQ ID NO: 381069 - RNA, 22 nt, Human
uccaagaucuacagcaguuuag

SEQ ID NO: 381070 - RNA, 22 nt, Human
agaacuuaggaacaacagcuua

SEQ ID NO: 381071 - RNA, 22 nt, Human
aaagauuugaguucugcuuaua

SEQ ID NO: 381072 - RNA, 22 nt, Human
uccuugaagcaacgugcagaca

SEQ ID NO: 381073 - RNA, 22 nt, Human
cagcuagcuaagaaggccagag

SEQ ID NO: 381074 - RNA, 22 nt, Human
agagaaaagaguucaggcuuug

SEQ ID NO: 381075 - RNA, 22 nt, Human
ggcugcagcggauuggggauug

SEQ ID NO: 381076 - RNA, 23 nt, Human
uuuauccaacucuguaaucucuc

SEQ ID NO: 381077 - RNA, 22 nt, Human
agucucuuuugcgaagaguguu

SEQ ID NO: 381078 - RNA, 22 nt, Human
acagaacuuccugcuggagugg

SEQ ID NO: 381079 - RNA, 22 nt, Human
aggaagcuaaccagggagugag

SEQ ID NO: 381080 - RNA, 22 nt, Human
gggcaagcucuucagaagcucu

SEQ ID NO: 381081 - RNA, 22 nt, Human
cauuuggccauuccagucacau

SEQ ID NO: 381082 - RNA, 22 nt, Human
ucauaaaaugcuccugauauug

SEQ ID NO: 381083 - RNA, 22 nt, Human
gugcugcagagucucgugccgc

SEQ ID NO: 381084 - RNA, 22 nt, Human
ugucauaaaacacaagcuguug

SEQ ID NO: 381085 - RNA, 22 nt, Human
cuguuuaucccuuuggucagca

SEQ ID NO: 381086 - RNA, 22 nt, Human
aaaucugguucaguaaguccuc

SEQ ID NO: 381087 - RNA, 22 nt, Human
gauacauuuuaucuccuaacag

SEQ ID NO: 381088 - RNA, 22 nt, Human
gcaugcugcaccagagccucuc

SEQ ID NO: 381089 - RNA, 22 nt, Human
uggcugccuagugucugagcag

SEQ ID NO: 381090 - RNA, 22 nt, Human
augcaguaaauguuaagaaaaa

SEQ ID NO: 381091 - RNA, 22 nt, Human
gagggagggccaggucccaacc

SEQ ID NO: 381092 - RNA, 22 nt, Human
uggcagagcaaaaagauagaau

SEQ ID NO: 381093 - RNA, 22 nt, Human
aauguguauacuggcaauuaag

SEQ ID NO: 381094 - RNA, 22 nt, Human
cauuuguaauacugacuugcag

SEQ ID NO: 381095 - RNA, 20 nt, Human
ucagugauuuugaagaggaa

SEQ ID NO: 381096 - RNA, 22 nt, Human
uccuucagggcugaccacaggc

SEQ ID NO: 381097 - RNA, 22 nt, Human
ccagggucuuggagaggagugc

SEQ ID NO: 381098 - RNA, 22 nt, Human
uaaucauggccucaaauuuuau

SEQ ID NO: 381099 - RNA, 22 nt, Human
auuaggcauucaugcagcuccu

SEQ ID NO: 381100 - RNA, 22 nt, Human
aaacagcuaauggccaggaaua

SEQ ID NO: 381101 - RNA, 22 nt, Human
gggaccuggucuagcacugagc

SEQ ID NO: 381102 - RNA, 17 nt, Human
aggaagggcaaguuucu

SEQ ID NO: 381103 - RNA, 22 nt, Human
gggcugggaauggcuaaguaug

SEQ ID NO: 381104 - RNA, 22 nt, Human
aagagcuggaugaagaaaucaa

SEQ ID NO: 381105 - RNA, 22 nt, Human
cugcugcucagugucaucaugu

SEQ ID NO: 381106 - RNA, 22 nt, Human
uguguuauugccacugaagacc

SEQ ID NO: 381107 - RNA, 21 nt, Human
aggcccagcuuuccucuugcu

SEQ ID NO: 381108 - RNA, 22 nt, Human
aguaggaggcgggagcaugaag

SEQ ID NO: 381109 - RNA, 22 nt, Human
ugaggaggucagagucuggcug

SEQ ID NO: 381110 - RNA, 22 nt, Human
cccacacauuuuucacuuaccg

SEQ ID NO: 381111 - RNA, 22 nt, Human
aacagaauugcugcugccaaug

SEQ ID NO: 381112 - RNA, 22 nt, Human
ugaggcuuagagaagaugggau

SEQ ID NO: 381113 - RNA, 22 nt, Human
cagcaauaacucaaagccauuu

SEQ ID NO: 381114 - RNA, 22 nt, Human
gccugcagauauauaggauggu

SEQ ID NO: 381115 - RNA, 22 nt, Human
acaaaauuaccuaguuauuuuc

SEQ ID NO: 381116 - RNA, 22 nt, Human
gggcagugguccaggcuacagc

SEQ ID NO: 381117 - RNA, 22 nt, Human
uuucccaauugagagguucugu

SEQ ID NO: 381118 - RNA, 22 nt, Human
ugaggccagucucaucacaggc

SEQ ID NO: 381119 - RNA, 22 nt, Human
acagagcaauaacagggagagg

SEQ ID NO: 381120 - RNA, 22 nt, Human
uggaaggaagccaaggaagguu

SEQ ID NO: 381121 - RNA, 22 nt, Human
aggugagggugccagugcaugg

SEQ ID NO: 381122 - RNA, 23 nt, Human
gagcugggauacaggcuuacugc

SEQ ID NO: 381123 - RNA, 22 nt, Human
aucaguuuugggggacauacug

SEQ ID NO: 381124 - RNA, 22 nt, Human
aggguggcuggaggaaucagaa

SEQ ID NO: 381125 - RNA, 22 nt, Human
aaaucugggagcagcucggcca

SEQ ID NO: 381126 - RNA, 22 nt, Human
caguacuuauuucuauuuaggg

SEQ ID NO: 381127 - RNA, 22 nt, Human
uucagagaugacaccugguguu

SEQ ID NO: 381128 - RNA, 22 nt, Human
auauuaggaguuaaauguauua

SEQ ID NO: 381129 - RNA, 22 nt, Human
ggaggccaaagugugggcggcu

SEQ ID NO: 381130 - RNA, 22 nt, Human
acauucaugucccacuucuagc

SEQ ID NO: 381131 - RNA, 22 nt, Human
ugucucugguauuaggugaaaa

SEQ ID NO: 381132 - RNA, 22 nt, Human
uacaaaugaguuguaugaacca

SEQ ID NO: 381133 - RNA, 22 nt, Human
auaaggcaagcugucaguuugu

SEQ ID NO: 381134 - RNA, 22 nt, Human
aggggcuggcuuaucugagagu

SEQ ID NO: 381135 - RNA, 22 nt, Human
aggugcuggagucugggcagga

SEQ ID NO: 381136 - RNA, 22 nt, Human
gagaaacuaacaucugaaggug

SEQ ID NO: 381137 - RNA, 22 nt, Human
uucucagugaaguuuagaacau

SEQ ID NO: 381138 - RNA, 22 nt, Human
acagggcagagugaaaugcuau

SEQ ID NO: 381139 - RNA, 22 nt, Human
aggaaagggguagguguggacg

SEQ ID NO: 381140 - RNA, 22 nt, Human
uuggccuuguuaaggaggcccu

SEQ ID NO: 381141 - RNA, 22 nt, Human
gcaaagucucaagacccaagug

SEQ ID NO: 381142 - RNA, 22 nt, Human
augguuuauugcuuuaaugaaa

SEQ ID NO: 381143 - RNA, 22 nt, Human
uggagcaggaagucuauggcug

SEQ ID NO: 381144 - RNA, 22 nt, Human
ucccaggaaggauucggcauuu

SEQ ID NO: 381145 - RNA, 19 nt, Human
guuucauuaagauaggaaa

SEQ ID NO: 381146 - RNA, 22 nt, Human
agaagccaaucagcucucugcu

SEQ ID NO: 381147 - RNA, 22 nt, Human
uuuccucuccaccaggaggucu

SEQ ID NO: 381148 - RNA, 22 nt, Human
ugccucugugggccuuccuggc

SEQ ID NO: 381149 - RNA, 22 nt, Human
gccuggcaggccuguuggggcu

SEQ ID NO: 381150 - RNA, 22 nt, Human
gccaccagcagaaaaggggcca

SEQ ID NO: 381151 - RNA, 22 nt, Human
ccagcuccucuucccaguguca

SEQ ID NO: 381152 - RNA, 22 nt, Human
agggaggucuggcugcccugag

SEQ ID NO: 381153 - RNA, 22 nt, Human
cuggcagcagcuucuggaucga

SEQ ID NO: 381154 - RNA, 22 nt, Human
ccagcugcugugaggaccacag

SEQ ID NO: 381155 - RNA, 22 nt, Human
uaaguaaauuuauaaugugauu

SEQ ID NO: 381156 - RNA, 22 nt, Human
gaccauuuguugaaaagauuau

SEQ ID NO: 381157 - RNA, 22 nt, Human
augaaaauacugugguugauag

SEQ ID NO: 381158 - RNA, 22 nt, Human
cuguucauggaaaaauaguugg

SEQ ID NO: 381159 - RNA, 22 nt, Human
gccaggcaggugucggagcccu

SEQ ID NO: 381160 - RNA, 19 nt, Human
cagaccuguccagccugug

SEQ ID NO: 381161 - RNA, 22 nt, Human
cuucugggcauucagcugcaca

SEQ ID NO: 381162 - RNA, 22 nt, Human
ggaggagacccugugucaguuu

SEQ ID NO: 381163 - RNA, 20 nt, Human
aguagcagugugacauugac

SEQ ID NO: 381164 - RNA, 22 nt, Human
uucucagaauugacugggagca

SEQ ID NO: 381165 - RNA, 22 nt, Human
ggagcagagcauuucacagccu

SEQ ID NO: 381166 - RNA, 22 nt, Human
cuacagaaaaucagccacaggc

SEQ ID NO: 381167 - RNA, 22 nt, Human
guucuuaagaccacaauaaaaa

SEQ ID NO: 381168 - RNA, 23 nt, Human
ucaugcccaggcuccagauguca

SEQ ID NO: 381169 - RNA, 22 nt, Human
ucauugaacgaagagcuccauu

SEQ ID NO: 381170 - RNA, 22 nt, Human
auuucugauaaacguaagcugc

SEQ ID NO: 381171 - RNA, 21 nt, Human
acagcagggcuggcaugacag

SEQ ID NO: 381172 - RNA, 22 nt, Human
gaggcucugugaugugccaggc

SEQ ID NO: 381173 - RNA, 22 nt, Human
agggggcaucagguccuggcuc

SEQ ID NO: 381174 - RNA, 20 nt, Human
uccaggcagcucagaguguc

SEQ ID NO: 381175 - RNA, 22 nt, Human
ucagccaguuuguuuauuccgg

SEQ ID NO: 381176 - RNA, 22 nt, Human
agguauuauuagcaucucuauu

SEQ ID NO: 381177 - RNA, 20 nt, Human
cugggcagguguuugaucuc

SEQ ID NO: 381178 - RNA, 22 nt, Human
aggcagauuuaggagaaaagaa

SEQ ID NO: 381179 - RNA, 22 nt, Human
aucuacagcugucugcacagua

SEQ ID NO: 381180 - RNA, 21 nt, Human
uccuucaguucugcacuuucu

SEQ ID NO: 381181 - RNA, 22 nt, Human
uuacagaaaguuucccaugccg

SEQ ID NO: 381182 - RNA, 22 nt, Human
ccugucucuguuaccacauuug

SEQ ID NO: 381183 - RNA, 22 nt, Human
ggauguugauugaauggccauu

SEQ ID NO: 381184 - RNA, 22 nt, Human
ggcagugaacagaaaugcagaa

SEQ ID NO: 381185 - RNA, 23 nt, Human
ggagaggggugugggcaucuuua

SEQ ID NO: 381186 - RNA, 22 nt, Human
acugaaagauaaaucaguuagc

SEQ ID NO: 381187 - RNA, 22 nt, Human
cccaggagguguagcugcgugg

SEQ ID NO: 381188 - RNA, 22 nt, Human
gaauauauuggugaaaauaguu

SEQ ID NO: 381189 - RNA, 22 nt, Human
cagguacacucccuugugcuga

SEQ ID NO: 381190 - RNA, 20 nt, Human
aauguauauuuuaugccagg

SEQ ID NO: 381191 - RNA, 22 nt, Human
ggagaggacauggcucccacag

SEQ ID NO: 381192 - RNA, 22 nt, Human
ucuucacagaugcauauacuuc

SEQ ID NO: 381193 - RNA, 22 nt, Human
agagccuguuuugugggagaug

SEQ ID NO: 381194 - RNA, 22 nt, Human
agggggaggcugugcugcgucu

SEQ ID NO: 381195 - RNA, 21 nt, Human
ucacacacguuuccaagggca

SEQ ID NO: 381196 - RNA, 22 nt, Human
aucagcaaucucguguauuagg

SEQ ID NO: 381197 - RNA, 18 nt, Human
uauaaacacacuuagguu

SEQ ID NO: 381198 - RNA, 21 nt, Human
gcaaauguucaggaaaaaaga

SEQ ID NO: 381199 - RNA, 22 nt, Human
uaaaugauuuauguaugugaaa

SEQ ID NO: 381200 - RNA, 20 nt, Human
cagcuuggaugagaggcuga

SEQ ID NO: 381201 - RNA, 22 nt, Human
aguguuucucagaagggccuau

SEQ ID NO: 381202 - RNA, 22 nt, Human
aaugaaugaaccacauauaaca

SEQ ID NO: 381203 - RNA, 22 nt, Human
auacauauaugguacuuccugg

SEQ ID NO: 381204 - RNA, 22 nt, Human
ucacaggacccugaggguggcg

SEQ ID NO: 381205 - RNA, 22 nt, Human
ucucugaguauccugaacugcc

SEQ ID NO: 381206 - RNA, 22 nt, Human
uggcugagagaagacggggaag

SEQ ID NO: 381207 - RNA, 22 nt, Human
caaguccaucagauaagcaaga

SEQ ID NO: 381208 - RNA, 22 nt, Human
ccaggagauaagcugaguuuau

SEQ ID NO: 381209 - RNA, 22 nt, Human
agagugaaguucaucgugcagc

SEQ ID NO: 381210 - RNA, 22 nt, Human
gaggcagcaggcugaggaggau

SEQ ID NO: 381211 - RNA, 22 nt, Human
agaggcggagguugcagugagc

SEQ ID NO: 381212 - RNA, 22 nt, Human
aucauuacuccuguaaaauugu

SEQ ID NO: 381213 - RNA, 22 nt, Human
ucaaaauuucagcacuagcccu

SEQ ID NO: 381214 - RNA, 22 nt, Human
cucaggauggaagccuacagga

SEQ ID NO: 381215 - RNA, 22 nt, Human
gaggccugguuugcaugagaau

SEQ ID NO: 381216 - RNA, 22 nt, Human
uaugcccagcuuaaaguacaca

SEQ ID NO: 381217 - RNA, 22 nt, Human
cucaggauagcugcgcagccug

SEQ ID NO: 381218 - RNA, 22 nt, Human
ccaggcagagggauccccaucc

SEQ ID NO: 381219 - RNA, 22 nt, Human
cugggcagcuaccaccacugcu

SEQ ID NO: 381220 - RNA, 22 nt, Human
caguguuuaaucauugugaauu

SEQ ID NO: 381221 - RNA, 22 nt, Human
uaagauaaguggguugagaugg

SEQ ID NO: 381222 - RNA, 22 nt, Human
uuugcauuaguuuagauuucaa

SEQ ID NO: 381223 - RNA, 22 nt, Human
gcaacuuuagaaaaaucuauaa

SEQ ID NO: 381224 - RNA, 22 nt, Human
gggagaaggagcuaguucuuga

SEQ ID NO: 381225 - RNA, 22 nt, Human
cagcugccaagaaucuuuucua

SEQ ID NO: 381226 - RNA, 22 nt, Human
aagccaguccucuacugggcac

SEQ ID NO: 381227 - RNA, 22 nt, Human
uagaaacacagaucugguguca

SEQ ID NO: 381228 - RNA, 22 nt, Human
ggcagcacgacaggaguggaag

SEQ ID NO: 381229 - RNA, 22 nt, Human
ucugggcucugucagcaccucu

SEQ ID NO: 381230 - RNA, 22 nt, Human
ugucccuggaacuauggcucca

SEQ ID NO: 381231 - RNA, 22 nt, Human
cucagagcccaggguacacccg

SEQ ID NO: 381232 - RNA, 22 nt, Human
uagggacccucccugcucuaac

SEQ ID NO: 381233 - RNA, 22 nt, Human
acaguguuuuagaaaagcuuga

SEQ ID NO: 381234 - RNA, 22 nt, Human
gguuugcacgauauuuccaugg

SEQ ID NO: 381235 - RNA, 22 nt, Human
ucagcuggagaugagaaccgaa

SEQ ID NO: 381236 - RNA, 22 nt, Human
cugcugugcacccaggaaggcu

SEQ ID NO: 381237 - RNA, 22 nt, Human
cagcugaauucuucagacucca

SEQ ID NO: 381238 - RNA, 22 nt, Human
ugagagugaaaugucacauguc

SEQ ID NO: 381239 - RNA, 22 nt, Human
uuagaaaugucacagaucugau

SEQ ID NO: 381240 - RNA, 22 nt, Human
auguguacaaccaagcacuaaa

SEQ ID NO: 381241 - RNA, 22 nt, Human
cuggagcugucuucacaggccu

SEQ ID NO: 381242 - RNA, 22 nt, Human
ccuuccuggagcccaugcagau

SEQ ID NO: 381243 - RNA, 22 nt, Human
acaaggaggucuggggggcccu

SEQ ID NO: 381244 - RNA, 22 nt, Human
aaaguuucaauagaggaagugg

SEQ ID NO: 381245 - RNA, 21 nt, Human
uagaaaucagcuggugccucu

SEQ ID NO: 381246 - RNA, 22 nt, Human
ccccaggagauuugggagcaca

SEQ ID NO: 381247 - RNA, 22 nt, Human
uaucagaaugcagccaugugca

SEQ ID NO: 381248 - RNA, 22 nt, Human
ugauuuccucuacuagcaauua

SEQ ID NO: 381249 - RNA, 22 nt, Human
uuucacaacguuguggugagag

SEQ ID NO: 381250 - RNA, 22 nt, Human
augggaguuuucucugaugcuc

SEQ ID NO: 381251 - RNA, 22 nt, Human
gucuuuauuugagauugucauu

SEQ ID NO: 381252 - RNA, 22 nt, Human
aucuacaggcugaggugggagg

SEQ ID NO: 381253 - RNA, 22 nt, Human
cacuggaauucaagauacugag

SEQ ID NO: 381254 - RNA, 20 nt, Human
cccugcagccaugggagugg

SEQ ID NO: 381255 - RNA, 21 nt, Human
agcagagugcuuugacuuugu

SEQ ID NO: 381256 - RNA, 22 nt, Human
gcuggccauauauuuugcuguu

SEQ ID NO: 381257 - RNA, 22 nt, Human
gccaggcuggugucacaacucu

SEQ ID NO: 381258 - RNA, 22 nt, Human
caagggccuccaccuugcucgu

SEQ ID NO: 381259 - RNA, 22 nt, Human
uuuguaaagucuguucugaguu

SEQ ID NO: 381260 - RNA, 22 nt, Human
uauccaaaggaacaaucacagc

SEQ ID NO: 381261 - RNA, 23 nt, Human
uacauuguggauggaguccuggg

SEQ ID NO: 381262 - RNA, 22 nt, Human
caggcagcagccacucugguau

SEQ ID NO: 381263 - RNA, 22 nt, Human
guucuucagauuccauuucagu

SEQ ID NO: 381264 - RNA, 22 nt, Human
ccuguucauuuuuugacucugc

SEQ ID NO: 381265 - RNA, 22 nt, Human
caguaucugucaguaaucaggu

SEQ ID NO: 381266 - RNA, 20 nt, Human
uugagcuuuuaguacagaca

SEQ ID NO: 381267 - RNA, 22 nt, Human
ggccugagucacaucaggagag

SEQ ID NO: 381268 - RNA, 22 nt, Human
agggcagcacaaggcauggacu

SEQ ID NO: 381269 - RNA, 21 nt, Human
uucuucaugaugauuaauggc

SEQ ID NO: 381270 - RNA, 18 nt, Human
uugagggaggggcagagu

SEQ ID NO: 381271 - RNA, 22 nt, Human
gggcuggaggagauccagaggc

SEQ ID NO: 381272 - RNA, 22 nt, Human
agugaaaugauucugagcaaga

SEQ ID NO: 381273 - RNA, 22 nt, Human
auuuccagacuuuuuccaggaa

SEQ ID NO: 381274 - RNA, 22 nt, Human
agggaggugguuccccagugga

SEQ ID NO: 381275 - RNA, 22 nt, Human
uugcagggaccugcagaaagcu

SEQ ID NO: 381276 - RNA, 22 nt, Human
cagacaugauguaagcagaggc

SEQ ID NO: 381277 - RNA, 21 nt, Human
ucugucucuccacugcccugc

SEQ ID NO: 381278 - RNA, 22 nt, Human
agucaccaucuguggcagccug

SEQ ID NO: 381279 - RNA, 22 nt, Human
agucaccaggguuugcuggguu

SEQ ID NO: 381280 - RNA, 22 nt, Human
aguuacaaccaugacacaagca

SEQ ID NO: 381281 - RNA, 22 nt, Human
ccuccuagaggaaccccagggc

SEQ ID NO: 381282 - RNA, 22 nt, Human
agcccuagagcuggaggucagu

SEQ ID NO: 381283 - RNA, 22 nt, Human
auauuucaugggguuccauacu

SEQ ID NO: 381284 - RNA, 22 nt, Human
ccaggagcuggagggugcagug

SEQ ID NO: 381285 - RNA, 17 nt, Human
ugaaacaccaagacugu

SEQ ID NO: 381286 - RNA, 20 nt, Human
uuacagaaaugauguuauuu

SEQ ID NO: 381287 - RNA, 22 nt, Human
ucagaauucuacaauagaucag

SEQ ID NO: 381288 - RNA, 22 nt, Human
ccuccagguguuacauaugacu

SEQ ID NO: 381289 - RNA, 22 nt, Human
aagggccauaacuugcaguguu

SEQ ID NO: 381290 - RNA, 22 nt, Human
gagcuuuacuucugacuggugc

SEQ ID NO: 381291 - RNA, 22 nt, Human
aaaacaguuuaggcaucacagu

SEQ ID NO: 381292 - RNA, 22 nt, Human
ggccugccucacagucagcacc

SEQ ID NO: 381293 - RNA, 19 nt, Human
uggcauugguccagauaaa

SEQ ID NO: 381294 - RNA, 22 nt, Human
caauuuuuguacuuauaguacu

SEQ ID NO: 381295 - RNA, 20 nt, Human
ugcuuccuggccacugcggg

SEQ ID NO: 381296 - RNA, 22 nt, Human
ccaggacucaguggggaaaggg

SEQ ID NO: 381297 - RNA, 21 nt, Human
aggcucagcagguguauaaag

SEQ ID NO: 381298 - RNA, 22 nt, Human
auuuccacauaagggaaauaag

SEQ ID NO: 381299 - RNA, 19 nt, Human
cuggaaugagaacaugccc

SEQ ID NO: 381300 - RNA, 22 nt, Human
gccuucaguaguauccucauga

SEQ ID NO: 381301 - RNA, 22 nt, Human
aggucauuccagccauuccccu

SEQ ID NO: 381302 - RNA, 22 nt, Human
aaauuauucucauguguuucuu

SEQ ID NO: 381303 - RNA, 22 nt, Human
agcaggugggcaugaaagcuga

SEQ ID NO: 381304 - RNA, 22 nt, Human
uucuuuccacagaggggaugau

SEQ ID NO: 381305 - RNA, 22 nt, Human
uaagcauaacuaaaaaugauuu

SEQ ID NO: 381306 - RNA, 22 nt, Human
ucucagaguuccucuggagucc

SEQ ID NO: 381307 - RNA, 22 nt, Human
aggccuggugugccggaugcag

SEQ ID NO: 381308 - RNA, 22 nt, Human
agaacuguccuuggaggagagu

SEQ ID NO: 381309 - RNA, 22 nt, Human
uggaggcaacugaagauguagu

SEQ ID NO: 381310 - RNA, 22 nt, Human
agcagcaucuucuaaguaaggc

SEQ ID NO: 381311 - RNA, 20 nt, Human
uaacagaaguagaagugggu

SEQ ID NO: 381312 - RNA, 22 nt, Human
agacuucuuugugagcauuuuc

SEQ ID NO: 381313 - RNA, 19 nt, Human
uuucuuaggccuuuggccu

SEQ ID NO: 381314 - RNA, 22 nt, Human
uauugaggaucuccugcuaauu

SEQ ID NO: 381315 - RNA, 19 nt, Human
aggugaugugacucuagaa

SEQ ID NO: 381316 - RNA, 22 nt, Human
uccucaugccgggucucacgcu

SEQ ID NO: 381317 - RNA, 22 nt, Human
gcauccagagguagccacugug

SEQ ID NO: 381318 - RNA, 22 nt, Human
aaacaucaauugcaucucccaa

SEQ ID NO: 381319 - RNA, 22 nt, Human
ccagggcucaggcucccagugg

SEQ ID NO: 381320 - RNA, 22 nt, Human
gauuuucaugauaaacuuguga

SEQ ID NO: 381321 - RNA, 22 nt, Human
aucuggcuuggguguggguagc

SEQ ID NO: 381322 - RNA, 22 nt, Human
gcuucacaggcaaguuaagccu

SEQ ID NO: 381323 - RNA, 22 nt, Human
agccaagcugaucuccugcuga

SEQ ID NO: 381324 - RNA, 22 nt, Human
agcuggagcuucaagcagguaa

SEQ ID NO: 381325 - RNA, 22 nt, Human
ucacaugaguauuauuuuccaa

SEQ ID NO: 381326 - RNA, 22 nt, Human
aagagagaacucccuucgccag

SEQ ID NO: 381327 - RNA, 22 nt, Human
agggccuggugaccuggguccu

SEQ ID NO: 381328 - RNA, 22 nt, Human
ccuggaucuccucuauucauau

SEQ ID NO: 381329 - RNA, 19 nt, Human
ccugugugggguagagauc

SEQ ID NO: 381330 - RNA, 22 nt, Human
gguguccaucaggcugugcuuc

SEQ ID NO: 381331 - RNA, 22 nt, Human
ugcagggaacuuggacagcuag

SEQ ID NO: 381332 - RNA, 22 nt, Human
uauuuagaaugcguguacgugu

SEQ ID NO: 381333 - RNA, 22 nt, Human
ucugaaggugcuagagaaagcu

SEQ ID NO: 381334 - RNA, 22 nt, Human
aagacacagcgaaauguuccug

SEQ ID NO: 381335 - RNA, 22 nt, Human
uggaggcaguaacugagcaaca

SEQ ID NO: 381336 - RNA, 20 nt, Human
gcccaggaauuugcauuucu

SEQ ID NO: 381337 - RNA, 20 nt, Human
ugugugcacacaugacauuc

SEQ ID NO: 381338 - RNA, 22 nt, Human
uuuuguuguaauauaccuaucc

SEQ ID NO: 381339 - RNA, 18 nt, Human
uguuuauuuuucucuuac

SEQ ID NO: 381340 - RNA, 22 nt, Human
aaaagccaagguccucuucaga

SEQ ID NO: 381341 - RNA, 22 nt, Human
acacugugagcugaagggcugc

SEQ ID NO: 381342 - RNA, 22 nt, Human
ugauuuccaauaaggagaaugu

SEQ ID NO: 381343 - RNA, 22 nt, Human
agacaggcagaggcugcagagg

SEQ ID NO: 381344 - RNA, 22 nt, Human
agcuguccuggcucaggcugug

SEQ ID NO: 381345 - RNA, 22 nt, Human
agucaguguagaaagcccaggc

SEQ ID NO: 381346 - RNA, 19 nt, Human
caugagcugcucacuuccc

SEQ ID NO: 381347 - RNA, 22 nt, Human
auuucuguuugcuacuauaagu

SEQ ID NO: 381348 - RNA, 20 nt, Human
uggagcugugguaaggagca

SEQ ID NO: 381349 - RNA, 19 nt, Human
ucaaaggcaaggaggaacu

SEQ ID NO: 381350 - RNA, 22 nt, Human
agucacaguuccuacccaguaa

SEQ ID NO: 381351 - RNA, 22 nt, Human
ugggcacuauggcucugugcac

SEQ ID NO: 381352 - RNA, 22 nt, Human
caggguggggcuggcuaucaaa

SEQ ID NO: 381353 - RNA, 22 nt, Human
ucucauucauacccuacaugcu

SEQ ID NO: 381354 - RNA, 22 nt, Human
ggcuccuguccuccuggagcuc

SEQ ID NO: 381355 - RNA, 19 nt, Human
ucuggagcugaugcaggug

SEQ ID NO: 381356 - RNA, 22 nt, Human
uauuucagucacuucuucucug

SEQ ID NO: 381357 - RNA, 22 nt, Human
cuugaaguugcaaaacauuaau

SEQ ID NO: 381358 - RNA, 22 nt, Human
ccuucccuaaagcgucgcuuag

SEQ ID NO: 381359 - RNA, 22 nt, Human
gccccagcguggcuguguuagg

SEQ ID NO: 381360 - RNA, 21 nt, Human
acagaugggaugagcacacug

SEQ ID NO: 381361 - RNA, 22 nt, Human
caguggagugggacuggucuga

SEQ ID NO: 381362 - RNA, 22 nt, Human
uuggcugagagaggaaaagggc

SEQ ID NO: 381363 - RNA, 22 nt, Human
ggcucccaggagggccuggagg

SEQ ID NO: 381364 - RNA, 22 nt, Human
auguaacuguuauauuuuguug

SEQ ID NO: 381365 - RNA, 22 nt, Human
aaggcugaggagggccugcagg

SEQ ID NO: 381366 - RNA, 22 nt, Human
gagagcuguaauagucaugucu

SEQ ID NO: 381367 - RNA, 22 nt, Human
uggcucagcugucacagccugg

SEQ ID NO: 381368 - RNA, 22 nt, Human
ugucuuuucuacuguaagcaua

SEQ ID NO: 381369 - RNA, 22 nt, Human
gcagggaccugccacugcuguc

SEQ ID NO: 381370 - RNA, 22 nt, Human
ugcuccauucucuagccagugc

SEQ ID NO: 381371 - RNA, 22 nt, Human
caguguggugugcacagcuuag

SEQ ID NO: 381372 - RNA, 22 nt, Human
ugcugccuucuaggcgugcccu

SEQ ID NO: 381373 - RNA, 22 nt, Human
aaguuauuuccucgugacugaa

SEQ ID NO: 381374 - RNA, 22 nt, Human
ucagggcacugucaccugauau

SEQ ID NO: 381375 - RNA, 22 nt, Human
ggcucugcccagguggacagca

SEQ ID NO: 381376 - RNA, 22 nt, Human
aagccaggggcugcuuaggaga

SEQ ID NO: 381377 - RNA, 22 nt, Human
acaaguaccaaaugcucaagua

SEQ ID NO: 381378 - RNA, 23 nt, Human
ccuggcagcaaacgaggagguua

SEQ ID NO: 381379 - RNA, 22 nt, Human
ugcuuuaucugacuuggcgcug

SEQ ID NO: 381380 - RNA, 22 nt, Human
ugcauuauacuuuuagaaauuu

SEQ ID NO: 381381 - RNA, 22 nt, Human
uacauuccacuagugacuggcg

SEQ ID NO: 381382 - RNA, 22 nt, Human
ccagagccugcugagccccauu

SEQ ID NO: 381383 - RNA, 22 nt, Human
acagagguaggacaugagauau

SEQ ID NO: 381384 - RNA, 22 nt, Human
gccuccugguugcuucuccaac

SEQ ID NO: 381385 - RNA, 22 nt, Human
acagagcuuaggaugacuccca

SEQ ID NO: 381386 - RNA, 22 nt, Human
gggcugaaaggccgccucagau

SEQ ID NO: 381387 - RNA, 22 nt, Human
uucaagaucuggguuuucagcu

SEQ ID NO: 381388 - RNA, 22 nt, Human
ucuggcucucaacaaauauuua

SEQ ID NO: 381389 - RNA, 22 nt, Human
aggcugaugcuggcugaggcug

SEQ ID NO: 381390 - RNA, 22 nt, Human
cuacagaaguuucccuugcuua

SEQ ID NO: 381391 - RNA, 22 nt, Human
uggcuauugagugaucucuaga

SEQ ID NO: 381392 - RNA, 22 nt, Human
uccaggcagggcagccaucaag

SEQ ID NO: 381393 - RNA, 22 nt, Human
uguuuuucaaauauugcucugu

SEQ ID NO: 381394 - RNA, 22 nt, Human
agagagagggaaacugcuaaac

SEQ ID NO: 381395 - RNA, 22 nt, Human
auuuugaaaccaaguuauuucc

SEQ ID NO: 381396 - RNA, 22 nt, Human
aauuaggggaggacguaucaua

SEQ ID NO: 381397 - RNA, 22 nt, Human
aagggcagaauagagaagaugg

SEQ ID NO: 381398 - RNA, 22 nt, Human
ucauaaaacacaccagguaguu

SEQ ID NO: 381399 - RNA, 23 nt, Human
agagcaucaugaugcuaagucug

SEQ ID NO: 381400 - RNA, 22 nt, Human
uuaagucauuucugauuauaga

SEQ ID NO: 381401 - RNA, 22 nt, Human
uaaaucccuacaucuguguuuu

SEQ ID NO: 381402 - RNA, 22 nt, Human
auuuccaauuucauccaugucc

SEQ ID NO: 381403 - RNA, 22 nt, Human
uuaacaugucuugacuucaucu

SEQ ID NO: 381404 - RNA, 22 nt, Human
ucuuggagacucuuguauauuu

SEQ ID NO: 381405 - RNA, 22 nt, Human
ugccuggcaacuguggugggcu

SEQ ID NO: 381406 - RNA, 22 nt, Human
ugugcucuggaguugccuucac

SEQ ID NO: 381407 - RNA, 22 nt, Human
auugcuaggaacagguugcacc

SEQ ID NO: 381408 - RNA, 22 nt, Human
uuacaaagcguugagacaagua

SEQ ID NO: 381409 - RNA, 17 nt, Human
gucauucucagaaaaug

SEQ ID NO: 381410 - RNA, 22 nt, Human
aggcagcagggccacuggcuga

SEQ ID NO: 381411 - RNA, 22 nt, Human
guacagaaaugugaugacgcaa

SEQ ID NO: 381412 - RNA, 22 nt, Human
gcagauggcucagacacugggg

SEQ ID NO: 381413 - RNA, 22 nt, Human
uucacaauagcuggcaucaucu

SEQ ID NO: 381414 - RNA, 22 nt, Human
ccugucugcggaggaguggaag

SEQ ID NO: 381415 - RNA, 22 nt, Human
gggugggguguaucggauccua

SEQ ID NO: 381416 - RNA, 22 nt, Human
uguccuuagggauauaaaauau

SEQ ID NO: 381417 - RNA, 22 nt, Human
augcuucagugcuaccuucaaa

SEQ ID NO: 381418 - RNA, 22 nt, Human
cuggcuuucucugugguguuca

SEQ ID NO: 381419 - RNA, 22 nt, Human
uacaagaaauuucugcauauau

SEQ ID NO: 381420 - RNA, 22 nt, Human
gcagagaacccagcagauuggc

SEQ ID NO: 381421 - RNA, 22 nt, Human
uagucucuggagacucuagggg

SEQ ID NO: 381422 - RNA, 22 nt, Human
gccagccccuuagggcucuccc

SEQ ID NO: 381423 - RNA, 22 nt, Human
ccagaggaguugaggcuuuggg

SEQ ID NO: 381424 - RNA, 22 nt, Human
gaguccuuuucauagcaguggg

SEQ ID NO: 381425 - RNA, 22 nt, Human
aggcugaggcuggcagcuccag

SEQ ID NO: 381426 - RNA, 22 nt, Human
aggcugcaggucugggucaugu

SEQ ID NO: 381427 - RNA, 22 nt, Human
ggccuugggcuggcugcaguau

SEQ ID NO: 381428 - RNA, 22 nt, Human
uuucacauuuuauacuuaagcc

SEQ ID NO: 381429 - RNA, 22 nt, Human
cuggugccauucuguggccuag

SEQ ID NO: 381430 - RNA, 22 nt, Human
gcaggguccauggaggcagccc

SEQ ID NO: 381431 - RNA, 22 nt, Human
agccuggaauuaaggaaaugca

SEQ ID NO: 381432 - RNA, 18 nt, Human
cggcagagugcuucuagc

SEQ ID NO: 381433 - RNA, 22 nt, Human
uucuccgcuaaguucucugcag

SEQ ID NO: 381434 - RNA, 22 nt, Human
uaagaaucuauuaggaauaugu

SEQ ID NO: 381435 - RNA, 22 nt, Human
ggucagggcucuuccaguggcu

SEQ ID NO: 381436 - RNA, 22 nt, Human
auccagucaaaauuaguaaggu

SEQ ID NO: 381437 - RNA, 22 nt, Human
uagcagaaccagcagucaauuu

SEQ ID NO: 381438 - RNA, 22 nt, Human
ccucucccacguggcagaggcu

SEQ ID NO: 381439 - RNA, 22 nt, Human
guuaggcagcccaagaugucag

SEQ ID NO: 381440 - RNA, 22 nt, Human
cuggacagaaaccaguccuggg

SEQ ID NO: 381441 - RNA, 22 nt, Human
ccagcuccgggaguugcugcug

SEQ ID NO: 381442 - RNA, 19 nt, Human
cucuggccucuggaugcug

SEQ ID NO: 381443 - RNA, 21 nt, Human
ugcagccauucagcccuaugc

SEQ ID NO: 381444 - RNA, 22 nt, Human
uucacagaauggcaaguuaugg

SEQ ID NO: 381445 - RNA, 22 nt, Human
agcagggcagugaucagaaagg

SEQ ID NO: 381446 - RNA, 22 nt, Human
aggccagagaggggaccagccu

SEQ ID NO: 381447 - RNA, 22 nt, Human
acuauacauaaaacauuugggu

SEQ ID NO: 381448 - RNA, 22 nt, Human
cacagggcuuugauggcugagu

SEQ ID NO: 381449 - RNA, 22 nt, Human
gagcuucccucugcagucccug

SEQ ID NO: 381450 - RNA, 20 nt, Human
gcugggggugugcugaguga

SEQ ID NO: 381451 - RNA, 22 nt, Human
gccucugcaccaguacugugcc

SEQ ID NO: 381452 - RNA, 22 nt, Human
gcagaagaccaugguggaaaga

SEQ ID NO: 381453 - RNA, 19 nt, Human
ucuuucauuucuagcucug

SEQ ID NO: 381454 - RNA, 22 nt, Human
cagggcucgcucuugcccuucg

SEQ ID NO: 381455 - RNA, 22 nt, Human
ugccacacuccccugcugcagu

SEQ ID NO: 381456 - RNA, 22 nt, Human
uggccugggucacaccaggguc

SEQ ID NO: 381457 - RNA, 22 nt, Human
ugcagggcccucauuccugucc

SEQ ID NO: 381458 - RNA, 22 nt, Human
agagccagccuucucagcuuac

SEQ ID NO: 381459 - RNA, 22 nt, Human
ucaaacagaggaacaauuguuu

SEQ ID NO: 381460 - RNA, 22 nt, Human
gggcagcucuuugguauccuuc

SEQ ID NO: 381461 - RNA, 22 nt, Human
uguccaggucagcagcagggac

SEQ ID NO: 381462 - RNA, 22 nt, Human
aaacaugaauagauauuaaaca

SEQ ID NO: 381463 - RNA, 22 nt, Human
cuuugaauugccguuucaucug

SEQ ID NO: 381464 - RNA, 22 nt, Human
ccugccuggcuuccagaagaga

SEQ ID NO: 381465 - RNA, 22 nt, Human
acuuuuaucaaggaagugaucu

SEQ ID NO: 381466 - RNA, 22 nt, Human
cuccaggggccagaagccuggc

SEQ ID NO: 381467 - RNA, 22 nt, Human
ugccaggggaccuagggauguc

SEQ ID NO: 381468 - RNA, 22 nt, Human
ugccuggauucgguuguuguca

SEQ ID NO: 381469 - RNA, 22 nt, Human
ggcagauguuauaugaucugag

SEQ ID NO: 381470 - RNA, 22 nt, Human
auucucaaacaagugguuugau

SEQ ID NO: 381471 - RNA, 22 nt, Human
ucaggcugaaggaggccuaucu

SEQ ID NO: 381472 - RNA, 23 nt, Human
ccacuagcaccuguucaacuucu

SEQ ID NO: 381473 - RNA, 22 nt, Human
uaauuauuugaagacauuagag

SEQ ID NO: 381474 - RNA, 22 nt, Human
aggcagugcaugcaaaggucgg

SEQ ID NO: 381475 - RNA, 22 nt, Human
agauggagaaugacaauuaagg

SEQ ID NO: 381476 - RNA, 22 nt, Human
gaacccaggcuuuugaggcugu

SEQ ID NO: 381477 - RNA, 22 nt, Human
cagugcccuuccaggacugcag

SEQ ID NO: 381478 - RNA, 22 nt, Human
gcagagacuccacugucuugug

SEQ ID NO: 381479 - RNA, 22 nt, Human
ugccuaggaaaccucaugcuuc

SEQ ID NO: 381480 - RNA, 22 nt, Human
auuucucagugaaaugacaggc

SEQ ID NO: 381481 - RNA, 22 nt, Human
uugcauuguaggauguuagaag

SEQ ID NO: 381482 - RNA, 22 nt, Human
auugacaagcaguaugucuuag

SEQ ID NO: 381483 - RNA, 22 nt, Human
ccagcugcugugcagggaggcu

SEQ ID NO: 381484 - RNA, 22 nt, Human
agauuccagaucccaaaaauga

SEQ ID NO: 381485 - RNA, 22 nt, Human
auugacaaauggauguugacau

SEQ ID NO: 381486 - RNA, 22 nt, Human
gcccaggaguuugcauuuuaac

SEQ ID NO: 381487 - RNA, 22 nt, Human
uuauuccaauuucuccuacaaa

SEQ ID NO: 381488 - RNA, 22 nt, Human
aggcagagagcaguggccgucu

SEQ ID NO: 381489 - RNA, 22 nt, Human
auucucaauggcuacuuucaua

SEQ ID NO: 381490 - RNA, 22 nt, Human
ggcagcuccuccuagucugccc

SEQ ID NO: 381491 - RNA, 22 nt, Human
ggcacugagaacaggcugacuu

SEQ ID NO: 381492 - RNA, 22 nt, Human
auggcuuugcucaaguuuagcc

SEQ ID NO: 381493 - RNA, 22 nt, Human
uccuggagggaggcggugcuac

SEQ ID NO: 381494 - RNA, 21 nt, Human
ccuguucacagaucuguaacu

SEQ ID NO: 381495 - RNA, 22 nt, Human
acuuguucauugaguacauaug

SEQ ID NO: 381496 - RNA, 22 nt, Human
uauaagaaacaaggcaaauuuu

SEQ ID NO: 381497 - RNA, 22 nt, Human
agauuuacuggagucuuuggug

SEQ ID NO: 381498 - RNA, 22 nt, Human
ugcaguggugguaaagaugcuc

SEQ ID NO: 381499 - RNA, 22 nt, Human
uggggacacagagguucguugg

SEQ ID NO: 381500 - RNA, 18 nt, Human
ggcugccuguuccugaag

SEQ ID NO: 381501 - RNA, 22 nt, Human
uauugacaauaggcaacugagg

SEQ ID NO: 381502 - RNA, 20 nt, Human
uuccuguauacaaagaguuc

SEQ ID NO: 381503 - RNA, 22 nt, Human
aucuuucuauuucuaaaaacua

SEQ ID NO: 381504 - RNA, 22 nt, Human
aggcugaguuucucauucucgc

SEQ ID NO: 381505 - RNA, 21 nt, Human
uccucugcucucauaccacaa

SEQ ID NO: 381506 - RNA, 22 nt, Human
uggcugagugaacauguccauu

SEQ ID NO: 381507 - RNA, 22 nt, Human
guggugcaggccagcaggggcg

SEQ ID NO: 381508 - RNA, 22 nt, Human
uuuaaauuuagaagaaacacug

SEQ ID NO: 381509 - RNA, 22 nt, Human
ugggacagugugccuugcuccu

SEQ ID NO: 381510 - RNA, 17 nt, Human
guccuacccauggucua

SEQ ID NO: 381511 - RNA, 22 nt, Human
agauacaucuugaacuucuaga

SEQ ID NO: 381512 - RNA, 22 nt, Human
ggcugcuucucacucauuugca

SEQ ID NO: 381513 - RNA, 17 nt, Human
cuggagccuccaacucc

SEQ ID NO: 381514 - RNA, 22 nt, Human
caggggccggcuguccgugccc

SEQ ID NO: 381515 - RNA, 22 nt, Human
cccaggagagaggggauaaagc

SEQ ID NO: 381516 - RNA, 22 nt, Human
cugagucucccggcaguggagg

SEQ ID NO: 381517 - RNA, 22 nt, Human
ugugcccaucccucuggagugu

SEQ ID NO: 381518 - RNA, 22 nt, Human
ucaauaauggcaggauaaauuu

SEQ ID NO: 381519 - RNA, 22 nt, Human
uccaguggcaccuuggcccuca

SEQ ID NO: 381520 - RNA, 22 nt, Human
ggaagaggaggagccaggcuuu

SEQ ID NO: 381521 - RNA, 20 nt, Human
ucauaaagaggaaauaaaua

SEQ ID NO: 381522 - RNA, 22 nt, Human
gcuguccucuuggacucagggc

SEQ ID NO: 381523 - RNA, 21 nt, Human
uuuuuucuugcgugaggccug

SEQ ID NO: 381524 - RNA, 22 nt, Human
agucagugaaaacuagaauguu

SEQ ID NO: 381525 - RNA, 20 nt, Human
auuucaguguuugcaauuuc

SEQ ID NO: 381526 - RNA, 22 nt, Human
ugccaggcuaaguggaggacuu

SEQ ID NO: 381527 - RNA, 22 nt, Human
ugaggaaguuguuucucuucua

SEQ ID NO: 381528 - RNA, 22 nt, Human
gcucugucuucagcacacagua

SEQ ID NO: 381529 - RNA, 22 nt, Human
cccagggauuauaaaggugaaa

SEQ ID NO: 381530 - RNA, 22 nt, Human
ccagguguaggacaccaaggga

SEQ ID NO: 381531 - RNA, 22 nt, Human
gggcagcuggccagguauucug

SEQ ID NO: 381532 - RNA, 22 nt, Human
ucagagagguuaaauaucuugu

SEQ ID NO: 381533 - RNA, 22 nt, Human
acauuucucuuagaguuggacu

SEQ ID NO: 381534 - RNA, 22 nt, Human
cuucuucacacuggucugaagc

SEQ ID NO: 381535 - RNA, 17 nt, Human
uuccaguuuaguauugu

SEQ ID NO: 381536 - RNA, 22 nt, Human
gcaggguaggugacagguaguc

SEQ ID NO: 381537 - RNA, 22 nt, Human
aucaggaagccagucuaaugga

SEQ ID NO: 381538 - RNA, 22 nt, Human
uaguaaaaguuuaguugaaagu

SEQ ID NO: 381539 - RNA, 22 nt, Human
ccaggagacaaagaugacugcu

SEQ ID NO: 381540 - RNA, 22 nt, Human
agggacccugaugacugaggag

SEQ ID NO: 381541 - RNA, 22 nt, Human
uugcagcuuagugauguuaucu

SEQ ID NO: 381542 - RNA, 22 nt, Human
caguucagcuagaagaaacaaa

SEQ ID NO: 381543 - RNA, 22 nt, Human
gcacccagaggucagcagugcu

SEQ ID NO: 381544 - RNA, 22 nt, Human
gaguuauuggguggaaagguag

SEQ ID NO: 381545 - RNA, 21 nt, Human
gccagccuguuuaccuguggu

SEQ ID NO: 381546 - RNA, 22 nt, Human
ccugagacaugaaccaggcucc

SEQ ID NO: 381547 - RNA, 18 nt, Human
gcagcugcaguuguagcu

SEQ ID NO: 381548 - RNA, 22 nt, Human
ucaggaaagaagaugcucagug

SEQ ID NO: 381549 - RNA, 22 nt, Human
auguggaaugaacaaaggaggc

SEQ ID NO: 381550 - RNA, 22 nt, Human
uggcagcaguagccaccccagc

SEQ ID NO: 381551 - RNA, 22 nt, Human
ggcaguggcuccucucuacucc

SEQ ID NO: 381552 - RNA, 22 nt, Human
aggccagcucuacccuuggacu

SEQ ID NO: 381553 - RNA, 22 nt, Human
ucugcagauuuaucagcagcug

SEQ ID NO: 381554 - RNA, 22 nt, Human
aauuaguauugcgauucauuag

SEQ ID NO: 381555 - RNA, 22 nt, Human
uggcagcugucagaaugcaaau

SEQ ID NO: 381556 - RNA, 22 nt, Human
aauacuaguuauuaaagcuuuu

SEQ ID NO: 381557 - RNA, 21 nt, Human
ggagaaggacaauguugagua

SEQ ID NO: 381558 - RNA, 22 nt, Human
gaauaaucaugaaauucaguga

SEQ ID NO: 381559 - RNA, 22 nt, Human
caaaugcaggucauaaccugag

SEQ ID NO: 381560 - RNA, 22 nt, Human
ggcagcuuucucacccaugacc

SEQ ID NO: 381561 - RNA, 22 nt, Human
gcaguguuguuaaaagauuaga

SEQ ID NO: 381562 - RNA, 22 nt, Human
uggaagccaggcccgcuccuaa

SEQ ID NO: 381563 - RNA, 22 nt, Human
acauucacgcucucaaagcuga

SEQ ID NO: 381564 - RNA, 22 nt, Human
aaaucaguuaagaugaggccau

SEQ ID NO: 381565 - RNA, 22 nt, Human
uuuuaucaaucauuaagacauu

SEQ ID NO: 381566 - RNA, 22 nt, Human
uaaugcuuaacagcuggcuuuu

SEQ ID NO: 381567 - RNA, 22 nt, Human
uguucauuuggcccuuuuguau

SEQ ID NO: 381568 - RNA, 22 nt, Human
ugccugucuuaauaucuggaaa

SEQ ID NO: 381569 - RNA, 22 nt, Human
gggcugucaugugucagugacc

SEQ ID NO: 381570 - RNA, 22 nt, Human
gggccagugaacaaugagggaa

SEQ ID NO: 381571 - RNA, 22 nt, Human
gaaaugcagauucugauucugu

SEQ ID NO: 381572 - RNA, 22 nt, Human
uagaaaucauuuagaaguauug

SEQ ID NO: 381573 - RNA, 22 nt, Human
agcagccagaaauccagaggug

SEQ ID NO: 381574 - RNA, 22 nt, Human
agcugguguccuccuggagcug

SEQ ID NO: 381575 - RNA, 22 nt, Human
ucacauuuucuacuacuguacg

SEQ ID NO: 381576 - RNA, 22 nt, Human
acagagcauuugggacagagag

SEQ ID NO: 381577 - RNA, 22 nt, Human
agggucugacuccucuggcaag

SEQ ID NO: 381578 - RNA, 22 nt, Human
gccucugcaucuucgccgcacu

SEQ ID NO: 381579 - RNA, 22 nt, Human
cacagggcuucucauggggugc

SEQ ID NO: 381580 - RNA, 22 nt, Human
guauuuucaugauuucagacca

SEQ ID NO: 381581 - RNA, 18 nt, Human
gucuggaggucaggagcu

SEQ ID NO: 381582 - RNA, 18 nt, Human
uggcagcaggaagccauu

SEQ ID NO: 381583 - RNA, 22 nt, Human
auguuucagauacagaucaaau

SEQ ID NO: 381584 - RNA, 22 nt, Human
gccuggagggucccucucugga

SEQ ID NO: 381585 - RNA, 22 nt, Human
ccaguuuaagacuuaucucaau

SEQ ID NO: 381586 - RNA, 18 nt, Human
aaaaagugcucaggccua

SEQ ID NO: 381587 - RNA, 22 nt, Human
gcucaggaaaacagucuaguaa

SEQ ID NO: 381588 - RNA, 22 nt, Human
uuucacauucagauauagacuu

SEQ ID NO: 381589 - RNA, 22 nt, Human
uuaugcaaaggggccucuuccu

SEQ ID NO: 381590 - RNA, 22 nt, Human
aacaaagucguugccuagaaga

SEQ ID NO: 381591 - RNA, 22 nt, Human
auuuucauggcuucugcucagu

SEQ ID NO: 381592 - RNA, 22 nt, Human
cuuaggcagggcuggaagaucu

SEQ ID NO: 381593 - RNA, 22 nt, Human
aaaaauugcugagaacggaauu

SEQ ID NO: 381594 - RNA, 22 nt, Human
uuccuaaaagaauacacuggau

SEQ ID NO: 381595 - RNA, 22 nt, Human
aggcacuguucccaguuauccu

SEQ ID NO: 381596 - RNA, 22 nt, Human
uaaggcaccauaauauauuuaa

SEQ ID NO: 381597 - RNA, 22 nt, Human
uuccagaagccuccauauuacu

SEQ ID NO: 381598 - RNA, 22 nt, Human
uugauuaaucccaugugaguag

SEQ ID NO: 381599 - RNA, 23 nt, Human
uggggcugauggagacggaccag

SEQ ID NO: 381600 - RNA, 22 nt, Human
cuucccuuggugaacagagcau

SEQ ID NO: 381601 - RNA, 22 nt, Human
uggcugaaucugcagcaggaag

SEQ ID NO: 381602 - RNA, 22 nt, Human
acugugugacuguuauuacugu

SEQ ID NO: 381603 - RNA, 22 nt, Human
gcagacagacugcagugauuuu

SEQ ID NO: 381604 - RNA, 21 nt, Human
aggagcuguguuagcuggucg

SEQ ID NO: 381605 - RNA, 22 nt, Human
uauucugugugauauguaaaug

SEQ ID NO: 381606 - RNA, 22 nt, Human
cagucucagaggugggaguggg

SEQ ID NO: 381607 - RNA, 22 nt, Human
cuggccagcugacagcagggcu

SEQ ID NO: 381608 - RNA, 22 nt, Human
cccaggcagcccuucugacgca

SEQ ID NO: 381609 - RNA, 22 nt, Human
cccucaggagaugucagcugga

SEQ ID NO: 381610 - RNA, 22 nt, Human
aaugaaaauuggacccuagaac

SEQ ID NO: 381611 - RNA, 22 nt, Human
aaguguauauaugacuuauaaa

SEQ ID NO: 381612 - RNA, 22 nt, Human
cagggcagggagcuuagaauga

SEQ ID NO: 381613 - RNA, 22 nt, Human
gaguguggugaacaggagcacc

SEQ ID NO: 381614 - RNA, 22 nt, Human
auuuucauuuugcagggugaga

SEQ ID NO: 381615 - RNA, 22 nt, Human
cagggacaauggcagagccuga

SEQ ID NO: 381616 - RNA, 22 nt, Human
uucagaaaucgaguuucauguc

SEQ ID NO: 381617 - RNA, 22 nt, Human
gccugccuuuuggaggcacauu

SEQ ID NO: 381618 - RNA, 17 nt, Human
acaggccugcuugcacu

SEQ ID NO: 381619 - RNA, 22 nt, Human
auauguguacgugcaguauaua

SEQ ID NO: 381620 - RNA, 22 nt, Human
uugcauugaugucuauacgcug

SEQ ID NO: 381621 - RNA, 22 nt, Human
cagggugccucccgcucgccgg

SEQ ID NO: 381622 - RNA, 22 nt, Human
cucagaguucuccugggaggug

SEQ ID NO: 381623 - RNA, 22 nt, Human
uggccuccccuaacagccucuu

SEQ ID NO: 381624 - RNA, 22 nt, Human
ucuuuacaguccucugucaauc

SEQ ID NO: 381625 - RNA, 22 nt, Human
cauaagaauauuccauccuuug

SEQ ID NO: 381626 - RNA, 22 nt, Human
cuacauaaauuuaucacagacu

SEQ ID NO: 381627 - RNA, 22 nt, Human
acaggccugagauuuugcauuu

SEQ ID NO: 381628 - RNA, 22 nt, Human
agguaagggucacaguucauau

SEQ ID NO: 381629 - RNA, 22 nt, Human
agcaguggagcgagauguuuaa

SEQ ID NO: 381630 - RNA, 22 nt, Human
aaaguguacuaugucaugaaca

SEQ ID NO: 381631 - RNA, 22 nt, Human
agauaacuuuuggguauucaug

SEQ ID NO: 381632 - RNA, 22 nt, Human
uugcuuccaguccaagucuguu

SEQ ID NO: 381633 - RNA, 21 nt, Human
ccugugugucugacugggcua

SEQ ID NO: 381634 - RNA, 23 nt, Human
aaaugcagggucgcagguuacag

SEQ ID NO: 381635 - RNA, 22 nt, Human
augaaaacggaccagagcuauu

SEQ ID NO: 381636 - RNA, 22 nt, Human
gccuaauaacuagcuguguaac

SEQ ID NO: 381637 - RNA, 22 nt, Human
uuuuggucagguuggucucgaa

SEQ ID NO: 381638 - RNA, 22 nt, Human
gucuucaacaauaacuaccacu

SEQ ID NO: 381639 - RNA, 22 nt, Human
cccaggcuggagugcaauggug

SEQ ID NO: 381640 - RNA, 22 nt, Human
gaggccuggugugucucccgcu

SEQ ID NO: 381641 - RNA, 22 nt, Human
cagcagggggcagcgcagauca

SEQ ID NO: 381642 - RNA, 22 nt, Human
aucaaaaugcuccagugauggu

SEQ ID NO: 381643 - RNA, 20 nt, Human
acccagcucugugcccuggg

SEQ ID NO: 381644 - RNA, 22 nt, Human
gagcacugauuuauuuuugucu

SEQ ID NO: 381645 - RNA, 22 nt, Human
agaggcagaaguguucaaaccc

SEQ ID NO: 381646 - RNA, 21 nt, Human
cccugcaggccagggcugagc

SEQ ID NO: 381647 - RNA, 21 nt, Human
ccauaccuaccucaccugguu

SEQ ID NO: 381648 - RNA, 22 nt, Human
cagcaucuuucucuucuggagu

SEQ ID NO: 381649 - RNA, 22 nt, Human
guugggaagcagauggaugagc

SEQ ID NO: 381650 - RNA, 22 nt, Human
agauaaugaaugccaugacauu

SEQ ID NO: 381651 - RNA, 23 nt, Human
auggagcugguacuagcuaccuc

SEQ ID NO: 381652 - RNA, 23 nt, Human
ucacaggggccagcgcucugugg

SEQ ID NO: 381653 - RNA, 22 nt, Human
agacagcauggagcugauaaca

SEQ ID NO: 381654 - RNA, 22 nt, Human
uuuccuuccagguuccuaaggc

SEQ ID NO: 381655 - RNA, 22 nt, Human
aggcugucugaccccagagccc

SEQ ID NO: 381656 - RNA, 22 nt, Human
uguucaaaugaucuucuuaaau

SEQ ID NO: 381657 - RNA, 22 nt, Human
uaagcuauuccugaagaagguu

SEQ ID NO: 381658 - RNA, 22 nt, Human
uuuacaaccucauauucugaug

SEQ ID NO: 381659 - RNA, 23 nt, Human
uggaccugaaccagugccucugu

SEQ ID NO: 381660 - RNA, 22 nt, Human
uuaauuuucucaucugugaaau

SEQ ID NO: 381661 - RNA, 22 nt, Human
cacagggcagguacucucagag

SEQ ID NO: 381662 - RNA, 22 nt, Human
uagagcuggccgggacagcugg

SEQ ID NO: 381663 - RNA, 22 nt, Human
cuagagggauguuaggauagca

SEQ ID NO: 381664 - RNA, 22 nt, Human
uugacaauguccuuugaauuuc

SEQ ID NO: 381665 - RNA, 23 nt, Human
ggcuggcccggggcugcuccuga

SEQ ID NO: 381666 - RNA, 22 nt, Human
ccucagccuuggccccaggcag

SEQ ID NO: 381667 - RNA, 22 nt, Human
uggcaggagguuuucuccagga

SEQ ID NO: 381668 - RNA, 22 nt, Human
gaggcagcaugguaccuuggag

SEQ ID NO: 381669 - RNA, 17 nt, Human
gcaagggaugggagauu

SEQ ID NO: 381670 - RNA, 22 nt, Human
cacagcuucugagugaggauuu

SEQ ID NO: 381671 - RNA, 22 nt, Human
gcugagugagguccagagcuug

SEQ ID NO: 381672 - RNA, 20 nt, Human
uccaggcagacagcuauggg

SEQ ID NO: 381673 - RNA, 22 nt, Human
aaacauuugcaacucgguuugg

SEQ ID NO: 381674 - RNA, 22 nt, Human
acuguguccucauguggcagaa

SEQ ID NO: 381675 - RNA, 17 nt, Human
agaaagaggauccacag

SEQ ID NO: 381676 - RNA, 22 nt, Human
agcuggcccucgagagccaauu

SEQ ID NO: 381677 - RNA, 19 nt, Human
ucaucucacagggccuggc

SEQ ID NO: 381678 - RNA, 22 nt, Human
aggcagcugcccucuccuuccu

SEQ ID NO: 381679 - RNA, 22 nt, Human
gccugcagcaugcuaggucuug

SEQ ID NO: 381680 - RNA, 22 nt, Human
cuagggcacuaggacucaugug

SEQ ID NO: 381681 - RNA, 22 nt, Human
uaguccuuacuuacuagaauaa

SEQ ID NO: 381682 - RNA, 22 nt, Human
cuugucagccaauuguggauuu

SEQ ID NO: 381683 - RNA, 22 nt, Human
cucaggagaugacagaagguau

SEQ ID NO: 381684 - RNA, 22 nt, Human
gcagggcuaauggggcaaguag

SEQ ID NO: 381685 - RNA, 22 nt, Human
agugcugacucugggcacagug

SEQ ID NO: 381686 - RNA, 22 nt, Human
gccagggaggcuguaggguccu

SEQ ID NO: 381687 - RNA, 22 nt, Human
agcagcagaggucagaaaggua

SEQ ID NO: 381688 - RNA, 22 nt, Human
uaaauguauaggcacuaaaccu

SEQ ID NO: 381689 - RNA, 22 nt, Human
caaugaaaauuuaaguugcagc

SEQ ID NO: 381690 - RNA, 22 nt, Human
augucuaaaagauaaaguuuaa

SEQ ID NO: 381691 - RNA, 22 nt, Human
uuguacaaguauuaugugaaca

SEQ ID NO: 381692 - RNA, 22 nt, Human
auccaguuuaugucauauucuu

SEQ ID NO: 381693 - RNA, 22 nt, Human
gaaggcacugaacuccuucugg

SEQ ID NO: 381694 - RNA, 22 nt, Human
aggaccuggaucacagagaucu

SEQ ID NO: 381695 - RNA, 22 nt, Human
caugaaaaugucaaguucugcu

SEQ ID NO: 381696 - RNA, 22 nt, Human
guugaguggguuaggaugcuga

SEQ ID NO: 381697 - RNA, 22 nt, Human
uccaggagguagugcuuaauuu

SEQ ID NO: 381698 - RNA, 22 nt, Human
aagucacagcuaaauagcuaag

SEQ ID NO: 381699 - RNA, 22 nt, Human
augguuuacugaucuuuuuggu

SEQ ID NO: 381700 - RNA, 22 nt, Human
aggcucugaucagguggcugug

SEQ ID NO: 381701 - RNA, 22 nt, Human
ggaggaccccagcagcucccca

SEQ ID NO: 381702 - RNA, 22 nt, Human
caagggaccugagauggucucu

SEQ ID NO: 381703 - RNA, 22 nt, Human
uggaaagucucuuuugacugua

SEQ ID NO: 381704 - RNA, 20 nt, Human
cagaggcauuuucagacucu

SEQ ID NO: 381705 - RNA, 22 nt, Human
gcugcugcgcuugucuacuguu

SEQ ID NO: 381706 - RNA, 22 nt, Human
ggguccagacacuccagaggaa

SEQ ID NO: 381707 - RNA, 22 nt, Human
augcugaagagugcacaggcua

SEQ ID NO: 381708 - RNA, 22 nt, Human
agcaccugucacaagcagaagg

SEQ ID NO: 381709 - RNA, 23 nt, Human
ugggccuggccucccaguccagc

SEQ ID NO: 381710 - RNA, 22 nt, Human
ugggcuccguugccuggggcag

SEQ ID NO: 381711 - RNA, 22 nt, Human
ggcuuccuuucacuacccucag

SEQ ID NO: 381712 - RNA, 22 nt, Human
gacccaggguuucugcacaggg

SEQ ID NO: 381713 - RNA, 20 nt, Human
aggcagacaaggagucuguu

SEQ ID NO: 381714 - RNA, 22 nt, Human
cccaggauggggcugcaguuau

SEQ ID NO: 381715 - RNA, 22 nt, Human
uccagaccuagggcaccccagu

SEQ ID NO: 381716 - RNA, 22 nt, Human
acaguggauauauuaaaugaga

SEQ ID NO: 381717 - RNA, 22 nt, Human
ccagcaggggaauauuuuuagg

SEQ ID NO: 381718 - RNA, 22 nt, Human
ugaagccagcuuuggaagacac

SEQ ID NO: 381719 - RNA, 22 nt, Human
uccuuugguucucuaagaugcu

SEQ ID NO: 381720 - RNA, 22 nt, Human
ccaaggagcaaguuuacaccug

SEQ ID NO: 381721 - RNA, 18 nt, Human
guccugagcucugcugua

SEQ ID NO: 381722 - RNA, 22 nt, Human
ggucucagcaguugcuuugacu

SEQ ID NO: 381723 - RNA, 22 nt, Human
aauuaggaauaaaugaguacuu

SEQ ID NO: 381724 - RNA, 22 nt, Human
caagaacaguuugccaaauugg

SEQ ID NO: 381725 - RNA, 22 nt, Human
caggcugaggcaguaggguuug

SEQ ID NO: 381726 - RNA, 22 nt, Human
ugcuagaaaucugaaacuagca

SEQ ID NO: 381727 - RNA, 22 nt, Human
uggggcuccuccuggcaggagg

SEQ ID NO: 381728 - RNA, 22 nt, Human
uuauuaggaaaaggucagaugu

SEQ ID NO: 381729 - RNA, 22 nt, Human
augcagagacagauguggcaug

SEQ ID NO: 381730 - RNA, 22 nt, Human
ugagacaaaauugacagacaaa

SEQ ID NO: 381731 - RNA, 22 nt, Human
cugcccugugaggguccuuggg

SEQ ID NO: 381732 - RNA, 22 nt, Human
cuugaaagcacuuaguaaauua

SEQ ID NO: 381733 - RNA, 22 nt, Human
cucugggcaaguuucuucauga

SEQ ID NO: 381734 - RNA, 22 nt, Human
uuauguacaauguuaauguaaa

SEQ ID NO: 381735 - RNA, 22 nt, Human
gcaccuggacagugacccuagc

SEQ ID NO: 381736 - RNA, 22 nt, Human
guaacauaguuugugcuucauc

SEQ ID NO: 381737 - RNA, 22 nt, Human
guuccacaaaauguacccaguu

SEQ ID NO: 381738 - RNA, 22 nt, Human
aggcagaauguuggaaaggaag

SEQ ID NO: 381739 - RNA, 22 nt, Human
uggcucagcuuacuuuugaggg

SEQ ID NO: 381740 - RNA, 22 nt, Human
auugacaauguauuuguaucug

SEQ ID NO: 381741 - RNA, 22 nt, Human
ccagcccugucaccaacuggag

SEQ ID NO: 381742 - RNA, 22 nt, Human
cuggcagcguguuuaugaacau

SEQ ID NO: 381743 - RNA, 22 nt, Human
gcaggccucuguugagggccuu

SEQ ID NO: 381744 - RNA, 22 nt, Human
guccucuggugaaagcauuccc

SEQ ID NO: 381745 - RNA, 23 nt, Human
ugauuuccagugagucaguggga

SEQ ID NO: 381746 - RNA, 22 nt, Human
ucagagagccucaggcacugcc

SEQ ID NO: 381747 - RNA, 22 nt, Human
uucacagucacccuucuccaug

SEQ ID NO: 381748 - RNA, 21 nt, Human
uauacaugugugcauacgugu

SEQ ID NO: 381749 - RNA, 22 nt, Human
uuaguaauguguuaauaugaau

SEQ ID NO: 381750 - RNA, 22 nt, Human
uggcucuguuuguuaacuagac

SEQ ID NO: 381751 - RNA, 22 nt, Human
gauuuccaggucauuaauaaag

SEQ ID NO: 381752 - RNA, 22 nt, Human
ccaggcuggagugcaauggugc

SEQ ID NO: 381753 - RNA, 22 nt, Human
cugcuggagguuggagcaugca

SEQ ID NO: 381754 - RNA, 22 nt, Human
gcaaggagacuguagggccaag

SEQ ID NO: 381755 - RNA, 22 nt, Human
aggcacuguacuagguacaggg

SEQ ID NO: 381756 - RNA, 22 nt, Human
ucuggauggucagcucuuccug

SEQ ID NO: 381757 - RNA, 22 nt, Human
ugggcagaucuuugguggcuag

SEQ ID NO: 381758 - RNA, 22 nt, Human
auuucuuacauaacaaauuguu

SEQ ID NO: 381759 - RNA, 22 nt, Human
cccagccuggugcacugugggg

SEQ ID NO: 381760 - RNA, 22 nt, Human
uuugaaagcaggugugggaggg

SEQ ID NO: 381761 - RNA, 22 nt, Human
aaguucaaggaagccuccaguu

SEQ ID NO: 381762 - RNA, 21 nt, Human
agggaaagaaaaugagcuaau

SEQ ID NO: 381763 - RNA, 22 nt, Human
aucaggaugacuauaaggcugc

SEQ ID NO: 381764 - RNA, 22 nt, Human
guuuuacacaccuaugaaagac

SEQ ID NO: 381765 - RNA, 22 nt, Human
uggcuggcgccgggcuagccac

SEQ ID NO: 381766 - RNA, 22 nt, Human
gagcucuguguagccugagggu

SEQ ID NO: 381767 - RNA, 22 nt, Human
caauagcagcuucugaaugcaa

SEQ ID NO: 381768 - RNA, 22 nt, Human
uugaaagacuucuccugugaaa

SEQ ID NO: 381769 - RNA, 22 nt, Human
ccagcaugagacgaugaugaag

SEQ ID NO: 381770 - RNA, 22 nt, Human
ugcuuuauaaccauuucugugg

SEQ ID NO: 381771 - RNA, 22 nt, Human
aauguuguuuuucugcaugucu

SEQ ID NO: 381772 - RNA, 22 nt, Human
gcacacagauuaggaaacagaa

SEQ ID NO: 381773 - RNA, 22 nt, Human
agccuggcccugcugaacucug

SEQ ID NO: 381774 - RNA, 21 nt, Human
agcagcaucagccucaccuga

SEQ ID NO: 381775 - RNA, 22 nt, Human
ucaggagacauucuuaaaguag

SEQ ID NO: 381776 - RNA, 22 nt, Human
agcagcauccccggccuccacc

SEQ ID NO: 381777 - RNA, 22 nt, Human
gaggaagaagcaaaccagcuaa

SEQ ID NO: 381778 - RNA, 17 nt, Human
cauguguaugugggagu

SEQ ID NO: 381779 - RNA, 22 nt, Human
ucuuuguaaaugccuagcauaa

SEQ ID NO: 381780 - RNA, 22 nt, Human
gaugcacagugacccugccagu

SEQ ID NO: 381781 - RNA, 22 nt, Human
augcacccagugucuggacuau

SEQ ID NO: 381782 - RNA, 22 nt, Human
gcccagugguaaaagcaggccu

SEQ ID NO: 381783 - RNA, 19 nt, Human
uagcugccuguuaccucca

SEQ ID NO: 381784 - RNA, 22 nt, Human
auuuauuauugugguuacuucu

SEQ ID NO: 381785 - RNA, 22 nt, Human
gaggcuccccaugaggccccag

SEQ ID NO: 381786 - RNA, 22 nt, Human
aggcugucucaccucaggaggg

SEQ ID NO: 381787 - RNA, 22 nt, Human
ggcagcuucuuaauauggagac

SEQ ID NO: 381788 - RNA, 22 nt, Human
aggcugggcaccguuuugaucc

SEQ ID NO: 381789 - RNA, 22 nt, Human
augcuguggaugccuugcccca

SEQ ID NO: 381790 - RNA, 22 nt, Human
aaugucugccugaacuuuauau

SEQ ID NO: 381791 - RNA, 22 nt, Human
gccugguggacacugggcauca

SEQ ID NO: 381792 - RNA, 22 nt, Human
aggagggaccuaggaauauugc

SEQ ID NO: 381793 - RNA, 18 nt, Human
ccuggcuuccaucuuggu

SEQ ID NO: 381794 - RNA, 22 nt, Human
ucauuacaguguuuauaugucu

SEQ ID NO: 381795 - RNA, 22 nt, Human
gccugagcuacuagggagucug

SEQ ID NO: 381796 - RNA, 22 nt, Human
augcuuuaaaugucuuuugcuu

SEQ ID NO: 381797 - RNA, 22 nt, Human
cugauuccaaagccaaagcuau

SEQ ID NO: 381798 - RNA, 19 nt, Human
agugucaucagcuacucag

SEQ ID NO: 381799 - RNA, 23 nt, Human
uucauuugucuacuucacuuguu

SEQ ID NO: 381800 - RNA, 22 nt, Human
aggagucauaaaugugaacaaa

SEQ ID NO: 381801 - RNA, 21 nt, Human
guccagagagccggcuccuga

SEQ ID NO: 381802 - RNA, 22 nt, Human
agagacagaggcaauauagcuu

SEQ ID NO: 381803 - RNA, 22 nt, Human
caguguuucugaguuccagcuc

SEQ ID NO: 381804 - RNA, 22 nt, Human
uuuugucuaagaacuuugcaaa

SEQ ID NO: 381805 - RNA, 22 nt, Human
cugcccugccuggccagugugg

SEQ ID NO: 381806 - RNA, 22 nt, Human
gcucugagcacugugcggcugg

SEQ ID NO: 381807 - RNA, 22 nt, Human
gcccucucggcauagcaggggc

SEQ ID NO: 381808 - RNA, 22 nt, Human
guuaggcaguuuucuucauucu

SEQ ID NO: 381809 - RNA, 22 nt, Human
cagcuuguuaccgagggagggu

SEQ ID NO: 381810 - RNA, 22 nt, Human
cagggugccuguccucagcaaa

SEQ ID NO: 381811 - RNA, 22 nt, Human
agcugcaggcccaugcucaguc

SEQ ID NO: 381812 - RNA, 22 nt, Human
gcuguggcugaagaugcaggga

SEQ ID NO: 381813 - RNA, 22 nt, Human
gucuuucuaugaugaacuguug

SEQ ID NO: 381814 - RNA, 22 nt, Human
aacaucuacuaagugccaggca

SEQ ID NO: 381815 - RNA, 22 nt, Human
uacaugcuccacuuucuccugu

SEQ ID NO: 381816 - RNA, 22 nt, Human
uggcagagaaccugggcuuugu

SEQ ID NO: 381817 - RNA, 22 nt, Human
gcugucacacaugggaucucag

SEQ ID NO: 381818 - RNA, 22 nt, Human
aggacagggauucaaacuccca

SEQ ID NO: 381819 - RNA, 22 nt, Human
cuuuauguuggggugucuuagu

SEQ ID NO: 381820 - RNA, 22 nt, Human
cuggccuuggaagggagcccgu

SEQ ID NO: 381821 - RNA, 22 nt, Human
gaagugaagguuacucuagauu

SEQ ID NO: 381822 - RNA, 22 nt, Human
uuacauuuuaguuaaccuguga

SEQ ID NO: 381823 - RNA, 20 nt, Human
auauguguacguguauacau

SEQ ID NO: 381824 - RNA, 22 nt, Human
uggaggcauuuuagguugucac

SEQ ID NO: 381825 - RNA, 22 nt, Human
acauaauaccuaggacaguuug

SEQ ID NO: 381826 - RNA, 22 nt, Human
cauggcaggugcagauucugug

SEQ ID NO: 381827 - RNA, 21 nt, Human
caaguccuuugccaaagugcu

SEQ ID NO: 381828 - RNA, 22 nt, Human
cagcucugcugggaggaugcag

SEQ ID NO: 381829 - RNA, 22 nt, Human
ucgugucagaucagagguuccu

SEQ ID NO: 381830 - RNA, 22 nt, Human
agcuggccuucggugucacugg

SEQ ID NO: 381831 - RNA, 22 nt, Human
ggugaccucaccuggucccacc

SEQ ID NO: 381832 - RNA, 22 nt, Human
ggacagaggguugacagaguau

SEQ ID NO: 381833 - RNA, 22 nt, Human
cugggagcugucaggagcgugu

SEQ ID NO: 381834 - RNA, 22 nt, Human
cuuucucugugugguaaagggc

SEQ ID NO: 381835 - RNA, 22 nt, Human
gaggaggcacuugagcagaugu

SEQ ID NO: 381836 - RNA, 22 nt, Human
agccuccaucccaugcacaaag

SEQ ID NO: 381837 - RNA, 22 nt, Human
ucaaagucuaucuguaauuacu

SEQ ID NO: 381838 - RNA, 22 nt, Human
ugaagcaaacgcuucuguuccu

SEQ ID NO: 381839 - RNA, 22 nt, Human
aaagaagggacagacugccucu

SEQ ID NO: 381840 - RNA, 22 nt, Human
ugaagcaggguggccagauugu

SEQ ID NO: 381841 - RNA, 22 nt, Human
uuccaaagaaauugaccaagac

SEQ ID NO: 381842 - RNA, 22 nt, Human
cugaaggauuagagagcacuua

SEQ ID NO: 381843 - RNA, 22 nt, Human
gggguggauuccuacaggucca

SEQ ID NO: 381844 - RNA, 22 nt, Human
agucuugcucuugcaucugcuu

SEQ ID NO: 381845 - RNA, 18 nt, Human
ucagaggagauaccuaaa

SEQ ID NO: 381846 - RNA, 22 nt, Human
agggacuggcucucugagcagg

SEQ ID NO: 381847 - RNA, 23 nt, Human
ccucagcauggcaggagcccagc

SEQ ID NO: 381848 - RNA, 22 nt, Human
gagcuuuaagggcacuggucuu

SEQ ID NO: 381849 - RNA, 22 nt, Human
caagggaguuacugagggcggg

SEQ ID NO: 381850 - RNA, 22 nt, Human
gagcuuccauggacgccaucug

SEQ ID NO: 381851 - RNA, 22 nt, Human
uucuuguauauaaaaaucauuu

SEQ ID NO: 381852 - RNA, 22 nt, Human
guccagggaaauagcgacaggg

SEQ ID NO: 381853 - RNA, 22 nt, Human
guuugcauggaagacagugagu

SEQ ID NO: 381854 - RNA, 22 nt, Human
ucccagaguucaaugggaaggu

SEQ ID NO: 381855 - RNA, 22 nt, Human
acuccuggggcugccaucacag

SEQ ID NO: 381856 - RNA, 22 nt, Human
cacucuccagcacaccccauuu

SEQ ID NO: 381857 - RNA, 22 nt, Human
cugcauuagucaugcuuugcag

SEQ ID NO: 381858 - RNA, 22 nt, Human
cauggcagaaaccugagcugcu

SEQ ID NO: 381859 - RNA, 22 nt, Human
guuugcauuuauuagucuucug

SEQ ID NO: 381860 - RNA, 22 nt, Human
uuuggaaaguguacaaauuuga

SEQ ID NO: 381861 - RNA, 22 nt, Human
cauuugaauuguucugugggaa

SEQ ID NO: 381862 - RNA, 17 nt, Human
ucuuuccugccaugcuc

SEQ ID NO: 381863 - RNA, 21 nt, Human
agaggcaggcauuaaguacac

SEQ ID NO: 381864 - RNA, 22 nt, Human
gaaggccauuagagccugugcc

SEQ ID NO: 381865 - RNA, 20 nt, Human
gaggcucugggcauggcgcc

SEQ ID NO: 381866 - RNA, 22 nt, Human
aaauuucuaagcagccacuucc

SEQ ID NO: 381867 - RNA, 22 nt, Human
aguguauugauuggaacagccu

SEQ ID NO: 381868 - RNA, 22 nt, Human
guugaaagagcauggacuugaa

SEQ ID NO: 381869 - RNA, 22 nt, Human
uaaauguguuguggaugaaguu

SEQ ID NO: 381870 - RNA, 22 nt, Human
uucacaaaacacuauuuucugg

SEQ ID NO: 381871 - RNA, 22 nt, Human
uugcugaaaacaguggguauug

SEQ ID NO: 381872 - RNA, 22 nt, Human
gcccucugcuggccucaccucg

SEQ ID NO: 381873 - RNA, 22 nt, Human
uggaaagacauucagccgcugg

SEQ ID NO: 381874 - RNA, 22 nt, Human
agagaacacgugcaucugcaau

SEQ ID NO: 381875 - RNA, 22 nt, Human
aggcugagucaaguuaggguga

SEQ ID NO: 381876 - RNA, 22 nt, Human
agggaccugcucacugccuggc

SEQ ID NO: 381877 - RNA, 19 nt, Human
acuguaaggcauuuuuuuc

SEQ ID NO: 381878 - RNA, 20 nt, Human
agcaagaguaaggacagcga

SEQ ID NO: 381879 - RNA, 22 nt, Human
uauuugcaacauaaaacucuga

SEQ ID NO: 381880 - RNA, 22 nt, Human
gcagugugaccgagcuugcuuc

SEQ ID NO: 381881 - RNA, 22 nt, Human
aggguggcaccuggaagggaug

SEQ ID NO: 381882 - RNA, 22 nt, Human
aggagaguaccauugggccgca

SEQ ID NO: 381883 - RNA, 22 nt, Human
ugagccaggaguuugaggcugu

SEQ ID NO: 381884 - RNA, 21 nt, Human
cagaaguaaggguaacuucuc

SEQ ID NO: 381885 - RNA, 22 nt, Human
aagggcugggucugguuaaccc

SEQ ID NO: 381886 - RNA, 22 nt, Human
agagugucugguagcugcucug

SEQ ID NO: 381887 - RNA, 22 nt, Human
gugcucuccuggcugcccugac

SEQ ID NO: 381888 - RNA, 22 nt, Human
ggcacugaucugauuucccucc

SEQ ID NO: 381889 - RNA, 20 nt, Human
agcugaggcaccugagguua

SEQ ID NO: 381890 - RNA, 22 nt, Human
uucauacaguggcugcacucca

SEQ ID NO: 381891 - RNA, 18 nt, Human
aaacuggcuuggccugug

SEQ ID NO: 381892 - RNA, 22 nt, Human
gagguagcgaguggacagugca

SEQ ID NO: 381893 - RNA, 22 nt, Human
gcagggcauagaggcacggagg

SEQ ID NO: 381894 - RNA, 22 nt, Human
auuauuaggugcucucugacaa

SEQ ID NO: 381895 - RNA, 22 nt, Human
agcagagcccuuccauggccuu

SEQ ID NO: 381896 - RNA, 23 nt, Human
ucagagaacucgggcagaugacc

SEQ ID NO: 381897 - RNA, 22 nt, Human
ugcagaaggaggaggaaaucca

SEQ ID NO: 381898 - RNA, 22 nt, Human
ugaggaagaacaagaauuuaga

SEQ ID NO: 381899 - RNA, 22 nt, Human
cauccaggcaccacaaccagcu

SEQ ID NO: 381900 - RNA, 22 nt, Human
cucagaagaacaaaggcucuac

SEQ ID NO: 381901 - RNA, 22 nt, Human
gcucugcuggaaguucucugga

SEQ ID NO: 381902 - RNA, 22 nt, Human
ugggcuguggagcaccuuugca

SEQ ID NO: 381903 - RNA, 22 nt, Human
aacccgggaggcagagguugug

SEQ ID NO: 381904 - RNA, 22 nt, Human
agagagcccgggccagggcaca

SEQ ID NO: 381905 - RNA, 22 nt, Human
ucugggaacagccuggcugugu

SEQ ID NO: 381906 - RNA, 22 nt, Human
caagggcauugcuugggaccuu

SEQ ID NO: 381907 - RNA, 22 nt, Human
gccagaaacauacacaucacuu

SEQ ID NO: 381908 - RNA, 22 nt, Human
gccaggcagauaugugagcuua

SEQ ID NO: 381909 - RNA, 22 nt, Human
gaguucuaaaggcagaacauaa

SEQ ID NO: 381910 - RNA, 21 nt, Human
acagagcauaaugguguggca

SEQ ID NO: 381911 - RNA, 22 nt, Human
cagggcccaagacacaaugagg

SEQ ID NO: 381912 - RNA, 22 nt, Human
cacaggguuguucugaggauuc

SEQ ID NO: 381913 - RNA, 22 nt, Human
gcagugggagcuuaggcagugc

SEQ ID NO: 381914 - RNA, 22 nt, Human
gcuauacagcaggagaauggaa

SEQ ID NO: 381915 - RNA, 22 nt, Human
gcagcaaucuucacagugucau

SEQ ID NO: 381916 - RNA, 21 nt, Human
aaggagccuaggaggcucagg

SEQ ID NO: 381917 - RNA, 22 nt, Human
uuaaguccuugguaauuuucuu

SEQ ID NO: 381918 - RNA, 22 nt, Human
ucaauaaauagcuuggcucagc

SEQ ID NO: 381919 - RNA, 22 nt, Human
caggagagauaugaguccccac

SEQ ID NO: 381920 - RNA, 22 nt, Human
aagauucucagagugaaagaau

SEQ ID NO: 381921 - RNA, 22 nt, Human
uauagagguggaaacugagguu

SEQ ID NO: 381922 - RNA, 22 nt, Human
cagacagacagccguggccacc

SEQ ID NO: 381923 - RNA, 22 nt, Human
aaagcauuucaugucuagaaag

SEQ ID NO: 381924 - RNA, 22 nt, Human
ccaggccuguguuguguggagg

SEQ ID NO: 381925 - RNA, 22 nt, Human
uuauuuucagcuaggaaagcca

SEQ ID NO: 381926 - RNA, 22 nt, Human
ccugucagcugauggcuaugua

SEQ ID NO: 381927 - RNA, 22 nt, Human
ugaagccaucaggaagccagca

SEQ ID NO: 381928 - RNA, 21 nt, Human
ucaggcagugcaaauacaugg

SEQ ID NO: 381929 - RNA, 21 nt, Human
ugcugccaucaugcagagaug

SEQ ID NO: 381930 - RNA, 22 nt, Human
ccucagagguuuucauucugua

SEQ ID NO: 381931 - RNA, 22 nt, Human
guucuucaucauuaacacucug

SEQ ID NO: 381932 - RNA, 22 nt, Human
gagggccaauggauuucaacug

SEQ ID NO: 381933 - RNA, 22 nt, Human
uuugaagucaaagauugauucc

SEQ ID NO: 381934 - RNA, 22 nt, Human
ugcuggguagaaguauuagucu

SEQ ID NO: 381935 - RNA, 22 nt, Human
uugugguuaaccgcacauuuuu

SEQ ID NO: 381936 - RNA, 22 nt, Human
ucugaacuccagcccugcucuc

SEQ ID NO: 381937 - RNA, 22 nt, Human
auaacagauacucucugugagg

SEQ ID NO: 381938 - RNA, 22 nt, Human
ggccugcacagagguggcucua

SEQ ID NO: 381939 - RNA, 22 nt, Human
uaaggcauucucaugcugugaa

SEQ ID NO: 381940 - RNA, 22 nt, Human
ucucacuuuccagacuuuucaa

SEQ ID NO: 381941 - RNA, 22 nt, Human
gaauucuuuucuuucugaaagu

SEQ ID NO: 381942 - RNA, 23 nt, Human
gggcuccagucucugcucaguug

SEQ ID NO: 381943 - RNA, 22 nt, Human
guggcgcagaggguggcagaga

SEQ ID NO: 381944 - RNA, 22 nt, Human
guuauuuuaucucugagagguu

SEQ ID NO: 381945 - RNA, 22 nt, Human
cccugagagugagugccaccuu

SEQ ID NO: 381946 - RNA, 22 nt, Human
uauuucugaauccaaaagguca

SEQ ID NO: 381947 - RNA, 22 nt, Human
auggcauuauagcaaugguuug

SEQ ID NO: 381948 - RNA, 22 nt, Human
aguuuaugaaacacagauuuga

SEQ ID NO: 381949 - RNA, 22 nt, Human
cccaggaguucgaggcuguagu

SEQ ID NO: 381950 - RNA, 21 nt, Human
auggauuuaaacaggccacaa

SEQ ID NO: 381951 - RNA, 22 nt, Human
cagagccugccaccuuucuccc

SEQ ID NO: 381952 - RNA, 22 nt, Human
uggagagguugaauaacuuguc

SEQ ID NO: 381953 - RNA, 22 nt, Human
aagcaguguucccagcuggccc

SEQ ID NO: 381954 - RNA, 22 nt, Human
uucuucaugcuguugcugcuug

SEQ ID NO: 381955 - RNA, 22 nt, Human
caggaaacauaugugcuugagg

SEQ ID NO: 381956 - RNA, 22 nt, Human
uccuugaauggacauuacacug

SEQ ID NO: 381957 - RNA, 22 nt, Human
caaauaguuuuucauguauuau

SEQ ID NO: 381958 - RNA, 22 nt, Human
ggacaggguaaguacuagugug

SEQ ID NO: 381959 - RNA, 22 nt, Human
acauuucuuagccuaguuccag

SEQ ID NO: 381960 - RNA, 22 nt, Human
guuauguauugggaaauccaag

SEQ ID NO: 381961 - RNA, 22 nt, Human
gcagagugauggaaugugggug

SEQ ID NO: 381962 - RNA, 22 nt, Human
ucauuacagagauauaaucuac

SEQ ID NO: 381963 - RNA, 22 nt, Human
ucuggcuccuggcuccacugcc

SEQ ID NO: 381964 - RNA, 21 nt, Human
gaacauuuggguuguuucuac

SEQ ID NO: 381965 - RNA, 22 nt, Human
aucugccugcaguggagguggg

SEQ ID NO: 381966 - RNA, 22 nt, Human
uccaggcauuccagccauucca

SEQ ID NO: 381967 - RNA, 22 nt, Human
ggggcagagcauagcuccaauu

SEQ ID NO: 381968 - RNA, 22 nt, Human
agccugugugcuuuggacaggg

SEQ ID NO: 381969 - RNA, 22 nt, Human
cuucuugcaauuuucaucuuau

SEQ ID NO: 381970 - RNA, 22 nt, Human
uacauucuggaaaggcacagac

SEQ ID NO: 381971 - RNA, 22 nt, Human
agaugagggguagaaaggacuu

SEQ ID NO: 381972 - RNA, 22 nt, Human
ugugccauuucuauucugcagc

SEQ ID NO: 381973 - RNA, 22 nt, Human
uuauuuaaaagugguaagauuc

SEQ ID NO: 381974 - RNA, 22 nt, Human
ugagaggcagaauggugccugc

SEQ ID NO: 381975 - RNA, 19 nt, Human
uggauuuauauucuuuauc

SEQ ID NO: 381976 - RNA, 22 nt, Human
aaauguuucuacuugugagcau

SEQ ID NO: 381977 - RNA, 22 nt, Human
acacuuuguuguggcauauacg

SEQ ID NO: 381978 - RNA, 22 nt, Human
cagcagagguuggaacaguucu

SEQ ID NO: 381979 - RNA, 22 nt, Human
uaaaauagcaugugcagugaaa

SEQ ID NO: 381980 - RNA, 22 nt, Human
ucuugccucuuccccuuuccau

SEQ ID NO: 381981 - RNA, 22 nt, Human
cuaguucuagaucccugaggaa

SEQ ID NO: 381982 - RNA, 22 nt, Human
uuaagacauucagauauuucua

SEQ ID NO: 381983 - RNA, 21 nt, Human
cccuguguuccacagcagaca

SEQ ID NO: 381984 - RNA, 22 nt, Human
ggaaccaggaguuacacgaguu

SEQ ID NO: 381985 - RNA, 19 nt, Human
gaaguccucuaguaaauuu

SEQ ID NO: 381986 - RNA, 22 nt, Human
gagggcaggggucuugcacggu

SEQ ID NO: 381987 - RNA, 22 nt, Human
gggcagcucucacagcagccaa

SEQ ID NO: 381988 - RNA, 22 nt, Human
auauauuugagaauauucauga

SEQ ID NO: 381989 - RNA, 22 nt, Human
ugagaaccaugaaaagcuguca

SEQ ID NO: 381990 - RNA, 22 nt, Human
gggagggaggugcugguucacg

SEQ ID NO: 381991 - RNA, 22 nt, Human
ugaaacacugcgauaaaauccu

SEQ ID NO: 381992 - RNA, 22 nt, Human
aguugacauccauaacaggaag

SEQ ID NO: 381993 - RNA, 22 nt, Human
uucucuuagcuguaaagucaau

SEQ ID NO: 381994 - RNA, 22 nt, Human
agggcuccgggcaggcgaugga

SEQ ID NO: 381995 - RNA, 22 nt, Human
cugugcuugcggguguggagcc

SEQ ID NO: 381996 - RNA, 22 nt, Human
ugcugggcuaggguggagcucu

SEQ ID NO: 381997 - RNA, 22 nt, Human
acucaggaauggggcugggacu

SEQ ID NO: 381998 - RNA, 19 nt, Human
cccagagcauccugaacuu

SEQ ID NO: 381999 - RNA, 22 nt, Human
gccuccccugcaauuguccuug

SEQ ID NO: 382000 - RNA, 22 nt, Human
uuccugaugcacacagucauuu

SEQ ID NO: 382001 - RNA, 21 nt, Human
guggcccugccgcagugucca

SEQ ID NO: 382002 - RNA, 22 nt, Human
ugugucaauuuucauuccuacu

SEQ ID NO: 382003 - RNA, 22 nt, Human
gacacagggggauguguggacg

SEQ ID NO: 382004 - RNA, 22 nt, Human
ucugaagaacugaguaaacaug

SEQ ID NO: 382005 - RNA, 22 nt, Human
ccucagggacuccaugcugcag

SEQ ID NO: 382006 - RNA, 22 nt, Human
gccaggcaguucaaguacacca

SEQ ID NO: 382007 - RNA, 22 nt, Human
cuggcugcuuguagacucgacu

SEQ ID NO: 382008 - RNA, 22 nt, Human
gagcuuugcuggaagccugggg

SEQ ID NO: 382009 - RNA, 22 nt, Human
gcagggacugugaucucacaga

SEQ ID NO: 382010 - RNA, 22 nt, Human
uccaugagcuagcuuuccaaag

SEQ ID NO: 382011 - RNA, 22 nt, Human
agucagcagccuggccaggaga

SEQ ID NO: 382012 - RNA, 20 nt, Human
gggcuagaccagggcagagg

SEQ ID NO: 382013 - RNA, 22 nt, Human
aggcacugcuucuaaguaggaa

SEQ ID NO: 382014 - RNA, 22 nt, Human
uuuucagugggcaaugauguga

SEQ ID NO: 382015 - RNA, 19 nt, Human
ugcaggaggacugagcaga

SEQ ID NO: 382016 - RNA, 22 nt, Human
aagcugccugccacgcuagaua

SEQ ID NO: 382017 - RNA, 20 nt, Human
gugcuucagaagccauugcu

SEQ ID NO: 382018 - RNA, 22 nt, Human
ucauuguuauguuuugcugucu

SEQ ID NO: 382019 - RNA, 22 nt, Human
gggggcuggaauauccaucaac

SEQ ID NO: 382020 - RNA, 22 nt, Human
ccuggccucagccuagggcuga

SEQ ID NO: 382021 - RNA, 22 nt, Human
aguucuagaagacuuuuccauu

SEQ ID NO: 382022 - RNA, 22 nt, Human
guaacaaaguuucuaggugcug

SEQ ID NO: 382023 - RNA, 22 nt, Human
aaagaggauggaguagucagcu

SEQ ID NO: 382024 - RNA, 22 nt, Human
agggagcugagcugugagcagc

SEQ ID NO: 382025 - RNA, 22 nt, Human
aaggcagcaugaaucccuguac

SEQ ID NO: 382026 - RNA, 20 nt, Human
uuucagugguuugugccuag

SEQ ID NO: 382027 - RNA, 22 nt, Human
ugcauuaugcuacccagaagcu

SEQ ID NO: 382028 - RNA, 22 nt, Human
uggcugaauaauauucuguugu

SEQ ID NO: 382029 - RNA, 22 nt, Human
cuuaacagcaagaucuguguca

SEQ ID NO: 382030 - RNA, 22 nt, Human
aauguucagaggacaauauaaa

SEQ ID NO: 382031 - RNA, 22 nt, Human
gcuccucucccagagcugcagg

SEQ ID NO: 382032 - RNA, 22 nt, Human
uaaaugugcacagguuagaagg

SEQ ID NO: 382033 - RNA, 22 nt, Human
gcugcucuccauggccgugagu

SEQ ID NO: 382034 - RNA, 22 nt, Human
aauauaauuuuauuccuagagu

SEQ ID NO: 382035 - RNA, 22 nt, Human
aaguccaucucugccccacaca

SEQ ID NO: 382036 - RNA, 22 nt, Human
agagucagcuuaugacacaguc

SEQ ID NO: 382037 - RNA, 22 nt, Human
caggugggccaugaaaaaugac

SEQ ID NO: 382038 - RNA, 22 nt, Human
uguccauggauagagcugcucg

SEQ ID NO: 382039 - RNA, 22 nt, Human
uacccagcaaucccuagagguu

SEQ ID NO: 382040 - RNA, 22 nt, Human
ggcuccucucuggccgcucccg

SEQ ID NO: 382041 - RNA, 22 nt, Human
gcagggucuugagaggcagcca

SEQ ID NO: 382042 - RNA, 19 nt, Human
agcuggggcgguguguguu

SEQ ID NO: 382043 - RNA, 22 nt, Human
uguggccuccccacuucugggg

SEQ ID NO: 382044 - RNA, 21 nt, Human
ucuccaguauccuucucugag

SEQ ID NO: 382045 - RNA, 22 nt, Human
ggggccugcgagguucaacuuc

SEQ ID NO: 382046 - RNA, 22 nt, Human
gauuuacagcuauacccaaugg

SEQ ID NO: 382047 - RNA, 22 nt, Human
agagcuggguggacuuguaguu

SEQ ID NO: 382048 - RNA, 18 nt, Human
gccaggcaggguggggaa

SEQ ID NO: 382049 - RNA, 22 nt, Human
ccaggcugccgaggaaagaaag

SEQ ID NO: 382050 - RNA, 19 nt, Human
acagagcucucugcuucug

SEQ ID NO: 382051 - RNA, 22 nt, Human
agcagcauggagaaaccguuca

SEQ ID NO: 382052 - RNA, 22 nt, Human
cagagacuggagugcaguggcg

SEQ ID NO: 382053 - RNA, 22 nt, Human
uggcagucuggguuggcaguua

SEQ ID NO: 382054 - RNA, 22 nt, Human
cccuggcagaaugucucugggc

SEQ ID NO: 382055 - RNA, 22 nt, Human
ucagaacauugacauucuuauu

SEQ ID NO: 382056 - RNA, 22 nt, Human
ccacugggcguuucuguccaau

SEQ ID NO: 382057 - RNA, 22 nt, Human
cuguggcuaugguguacauacu

SEQ ID NO: 382058 - RNA, 22 nt, Human
gccucuggucccucaugcugug

SEQ ID NO: 382059 - RNA, 22 nt, Human
acugcccuguaacugccaggua

SEQ ID NO: 382060 - RNA, 22 nt, Human
auuguaucuugucauuaugcau

SEQ ID NO: 382061 - RNA, 22 nt, Human
ugcuuuaucugugagaaccuga

SEQ ID NO: 382062 - RNA, 22 nt, Human
gcauuuauuucuuuacugcauc

SEQ ID NO: 382063 - RNA, 22 nt, Human
ucaggggacagccagcuggagg

SEQ ID NO: 382064 - RNA, 22 nt, Human
ucucugauguauaucagagaac

SEQ ID NO: 382065 - RNA, 22 nt, Human
caauuucaucuugugcuucaau

SEQ ID NO: 382066 - RNA, 22 nt, Human
ucacaccuguaaucccaggccu

SEQ ID NO: 382067 - RNA, 22 nt, Human
gcacagccagcaucugagggau

SEQ ID NO: 382068 - RNA, 22 nt, Human
gggcacugaaugccaagcuagg

SEQ ID NO: 382069 - RNA, 22 nt, Human
gccuucugauaucucuuggcau

SEQ ID NO: 382070 - RNA, 22 nt, Human
uccucugcuccaggcuggacuu

SEQ ID NO: 382071 - RNA, 22 nt, Human
cccagcagggucucugugucua

SEQ ID NO: 382072 - RNA, 22 nt, Human
uauucacaguugauuuacaguu

SEQ ID NO: 382073 - RNA, 22 nt, Human
acagaauauugguuacuguugc

SEQ ID NO: 382074 - RNA, 22 nt, Human
aggcugaggagggauguugcuu

SEQ ID NO: 382075 - RNA, 22 nt, Human
uaaaugcagcaguuucuguucu

SEQ ID NO: 382076 - RNA, 22 nt, Human
aaauacagaguugcuuaaaagc

SEQ ID NO: 382077 - RNA, 22 nt, Human
uggggaggacgggcgccuuccu

SEQ ID NO: 382078 - RNA, 22 nt, Human
ccugaagagcacucuagaguug

SEQ ID NO: 382079 - RNA, 23 nt, Human
ggccuccuggucuaggcuagacu

SEQ ID NO: 382080 - RNA, 22 nt, Human
ugcugccaugcagagcaacaga

SEQ ID NO: 382081 - RNA, 22 nt, Human
augcugugucaggaauuugaua

SEQ ID NO: 382082 - RNA, 22 nt, Human
cucuggagcgcugcuucccgcg

SEQ ID NO: 382083 - RNA, 22 nt, Human
aacuuucaggcaaugaauauuu

SEQ ID NO: 382084 - RNA, 22 nt, Human
ggagcugcauuuagggagccuu

SEQ ID NO: 382085 - RNA, 22 nt, Human
ggcugggcugcugggucagagc

SEQ ID NO: 382086 - RNA, 22 nt, Human
gggagcugagggaccucugugg

SEQ ID NO: 382087 - RNA, 22 nt, Human
ccuggcuuccuggagcucacaa

SEQ ID NO: 382088 - RNA, 22 nt, Human
augaggcaaggaucagguaagg

SEQ ID NO: 382089 - RNA, 22 nt, Human
acacugaaugcuguuuagaaau

SEQ ID NO: 382090 - RNA, 22 nt, Human
gcaggagacaacuguaaggaga

SEQ ID NO: 382091 - RNA, 22 nt, Human
cacagaauaaauugguaucaga

SEQ ID NO: 382092 - RNA, 22 nt, Human
ccagcugauucgguggugguug

SEQ ID NO: 382093 - RNA, 22 nt, Human
gccucugcggggcccgagcccg

SEQ ID NO: 382094 - RNA, 22 nt, Human
ucuggcucuguguccccaccca

SEQ ID NO: 382095 - RNA, 23 nt, Human
gugagucuugccuuugcugugga

SEQ ID NO: 382096 - RNA, 22 nt, Human
gaaauauacauugcaggaagag

SEQ ID NO: 382097 - RNA, 22 nt, Human
cccugcagggaggauucugaag

SEQ ID NO: 382098 - RNA, 22 nt, Human
ggagccagagggaugcaguuga

SEQ ID NO: 382099 - RNA, 22 nt, Human
aaucaggaugacugucauuuca

SEQ ID NO: 382100 - RNA, 21 nt, Human
aggaaguggccagauugggaa

SEQ ID NO: 382101 - RNA, 22 nt, Human
ugcaggugugguuccucagcca

SEQ ID NO: 382102 - RNA, 22 nt, Human
aaaguuuccugcuaagugcuau

SEQ ID NO: 382103 - RNA, 22 nt, Human
uaaggcacccuucugaguagag

SEQ ID NO: 382104 - RNA, 22 nt, Human
uuucaucuuccuuggcauaggu

SEQ ID NO: 382105 - RNA, 21 nt, Human
ucuuguccuugcucucccacu

SEQ ID NO: 382106 - RNA, 22 nt, Human
caagaaucuugcagcuuagacu

SEQ ID NO: 382107 - RNA, 22 nt, Human
auuaaagaaacccagcauguga

SEQ ID NO: 382108 - RNA, 22 nt, Human
ugugccugucacccucagagag

SEQ ID NO: 382109 - RNA, 22 nt, Human
aucuaagaguuaacaucaagaa

SEQ ID NO: 382110 - RNA, 22 nt, Human
gucccuggaucugggacagcug

SEQ ID NO: 382111 - RNA, 22 nt, Human
gggaguggagagcaauggauga

SEQ ID NO: 382112 - RNA, 22 nt, Human
uaggcugggaagaaagauucuc

SEQ ID NO: 382113 - RNA, 22 nt, Human
auccagggauaaaaguaagguu

SEQ ID NO: 382114 - RNA, 22 nt, Human
ucagcagauggguuguguuggc

SEQ ID NO: 382115 - RNA, 22 nt, Human
uauuugaagauucuucugaugu

SEQ ID NO: 382116 - RNA, 22 nt, Human
aucaggaucaugcuggguggga

SEQ ID NO: 382117 - RNA, 21 nt, Human
ggcacugagccagauggacuc

SEQ ID NO: 382118 - RNA, 22 nt, Human
caggagcugggucuggaagcag

SEQ ID NO: 382119 - RNA, 22 nt, Human
ucuccucaccaccagcagcaga

SEQ ID NO: 382120 - RNA, 18 nt, Human
ugugguggagcugccuuc

SEQ ID NO: 382121 - RNA, 22 nt, Human
gaaaucugucuuuguuugaaua

SEQ ID NO: 382122 - RNA, 22 nt, Human
aggaggccgcugaugggcuccc

SEQ ID NO: 382123 - RNA, 22 nt, Human
ggcacugggagaggugagacgg

SEQ ID NO: 382124 - RNA, 22 nt, Human
ugugccaggcacuugcccaggc

SEQ ID NO: 382125 - RNA, 22 nt, Human
cuugaaagucagcagaguggau

SEQ ID NO: 382126 - RNA, 22 nt, Human
cuuccugguuugaagcucgccg

SEQ ID NO: 382127 - RNA, 22 nt, Human
uuugcauugcauacaaggaacu

SEQ ID NO: 382128 - RNA, 22 nt, Human
cucagaaucugccaaguucagg

SEQ ID NO: 382129 - RNA, 22 nt, Human
gugagcaggauuucauggugua

SEQ ID NO: 382130 - RNA, 23 nt, Human
uugcacauuggagcuggucuucu

SEQ ID NO: 382131 - RNA, 22 nt, Human
aaagauuucagaagccugugcc

SEQ ID NO: 382132 - RNA, 22 nt, Human
agccuggauccuaggcucagcu

SEQ ID NO: 382133 - RNA, 22 nt, Human
uacauacaagauguguuuaaaa

SEQ ID NO: 382134 - RNA, 22 nt, Human
aaggagcucccggcagaccagg

SEQ ID NO: 382135 - RNA, 22 nt, Human
ugugccuuaugaauucuuucug

SEQ ID NO: 382136 - RNA, 22 nt, Human
agcuuuauauguuguuucucca

SEQ ID NO: 382137 - RNA, 22 nt, Human
cuggccaggcuugggacagaca

SEQ ID NO: 382138 - RNA, 22 nt, Human
aagcauuuugccacuugaaguu

SEQ ID NO: 382139 - RNA, 22 nt, Human
uacacauguauuuauguguaca

SEQ ID NO: 382140 - RNA, 22 nt, Human
cagaagcauugacuccuugcuc

SEQ ID NO: 382141 - RNA, 22 nt, Human
augucuuucucacagccaguuc

SEQ ID NO: 382142 - RNA, 22 nt, Human
uccugcagcugcagaccugggg

SEQ ID NO: 382143 - RNA, 17 nt, Human
ugcauuguuggaaauuu

SEQ ID NO: 382144 - RNA, 22 nt, Human
gcaggaggaucacuugagccca

SEQ ID NO: 382145 - RNA, 22 nt, Human
ccaggagcaaagaucacuggga

SEQ ID NO: 382146 - RNA, 22 nt, Human
cuagagaggcagauguccugug

SEQ ID NO: 382147 - RNA, 22 nt, Human
accgaaggaaacuggaaccguu

SEQ ID NO: 382148 - RNA, 22 nt, Human
cugcaagauuggaagaugcaau

SEQ ID NO: 382149 - RNA, 16 nt, Human
gccuggaguggcaggg

SEQ ID NO: 382150 - RNA, 22 nt, Human
agacaaaugguaauuaugucua

SEQ ID NO: 382151 - RNA, 22 nt, Human
gccaggcacugcucuaagcccu

SEQ ID NO: 382152 - RNA, 22 nt, Human
guggcuucacauggcauuuggc

SEQ ID NO: 382153 - RNA, 22 nt, Human
aaacaaacauagguuugaaagu

SEQ ID NO: 382154 - RNA, 22 nt, Human
agggccagagucuguguagaua

SEQ ID NO: 382155 - RNA, 20 nt, Human
ggggcaguggcucaugccug

SEQ ID NO: 382156 - RNA, 22 nt, Human
gcuccugucuuggggcacuggc

SEQ ID NO: 382157 - RNA, 22 nt, Human
ggcagcuucucccaggcuguuu

SEQ ID NO: 382158 - RNA, 22 nt, Human
accaggcacucuuguggcagug

SEQ ID NO: 382159 - RNA, 23 nt, Human
agaccugcaucugauaggcccug

SEQ ID NO: 382160 - RNA, 22 nt, Human
gcagugaaacaauaggaucaaa

SEQ ID NO: 382161 - RNA, 22 nt, Human
aaucuucacagagaaaauuagg

SEQ ID NO: 382162 - RNA, 22 nt, Human
uuacaugguuguuggaaaugcu

SEQ ID NO: 382163 - RNA, 22 nt, Human
uccacauccauugcuugacuuu

SEQ ID NO: 382164 - RNA, 19 nt, Human
uucauucuuucuacuuacc

SEQ ID NO: 382165 - RNA, 22 nt, Human
ggcagcaacucggagagaagag

SEQ ID NO: 382166 - RNA, 22 nt, Human
cccauuuaucccaagguuacuc

SEQ ID NO: 382167 - RNA, 22 nt, Human
agggcagcaaugcagcugcugc

SEQ ID NO: 382168 - RNA, 22 nt, Human
agcagccagagucugaacauua

SEQ ID NO: 382169 - RNA, 21 nt, Human
uaagaacauuaucuucuuccu

SEQ ID NO: 382170 - RNA, 22 nt, Human
ucuuagaaaugaaguucuuucu

SEQ ID NO: 382171 - RNA, 22 nt, Human
auuuccaccggcucaggaaguu

SEQ ID NO: 382172 - RNA, 22 nt, Human
ugggcccaagagagucuccaac

SEQ ID NO: 382173 - RNA, 22 nt, Human
ccaaggcaggggaucaaaguuu

SEQ ID NO: 382174 - RNA, 22 nt, Human
gccucugggcucugccccuggc

SEQ ID NO: 382175 - RNA, 22 nt, Human
caggcugcagcagcaguggccc

SEQ ID NO: 382176 - RNA, 22 nt, Human
gcucaggaucagccaccucuuu

SEQ ID NO: 382177 - RNA, 22 nt, Human
gcucagagauguucaguagcuu

SEQ ID NO: 382178 - RNA, 22 nt, Human
caguuauuaugaggucauuagg

SEQ ID NO: 382179 - RNA, 22 nt, Human
agggaagcccuggcugagaccc

SEQ ID NO: 382180 - RNA, 22 nt, Human
auugaaaggcaaaguaggaagc

SEQ ID NO: 382181 - RNA, 22 nt, Human
ugaauaguccuuggaauaacug

SEQ ID NO: 382182 - RNA, 22 nt, Human
aaaaugaugcuguaauuuggca

SEQ ID NO: 382183 - RNA, 22 nt, Human
ccucuggggguccucagagucu

SEQ ID NO: 382184 - RNA, 22 nt, Human
agggcagcagcccauggcucug

SEQ ID NO: 382185 - RNA, 22 nt, Human
ggucccaggagaauaggugcaa

SEQ ID NO: 382186 - RNA, 22 nt, Human
agacaaauggaguaugagcaac

SEQ ID NO: 382187 - RNA, 22 nt, Human
aguggcaguuugggagcuacag

SEQ ID NO: 382188 - RNA, 22 nt, Human
gguggggucacgacagagggaa

SEQ ID NO: 382189 - RNA, 22 nt, Human
aaggugugaagagaugggaaga

SEQ ID NO: 382190 - RNA, 22 nt, Human
ucagaggaucaugucccuacuc

SEQ ID NO: 382191 - RNA, 22 nt, Human
auucagcaaugagcuuggauuu

SEQ ID NO: 382192 - RNA, 22 nt, Human
agggcaguucagccacaggcuc

SEQ ID NO: 382193 - RNA, 20 nt, Human
cccuccagcaaccaggacuu

SEQ ID NO: 382194 - RNA, 22 nt, Human
cuauugaauuaacuauuaaagu

SEQ ID NO: 382195 - RNA, 22 nt, Human
augaagcugaccuugucuugcu

SEQ ID NO: 382196 - RNA, 22 nt, Human
uguauuagaucugagaacuucu

SEQ ID NO: 382197 - RNA, 19 nt, Human
uagaggagaagggaagugg

SEQ ID NO: 382198 - RNA, 22 nt, Human
auucacaaaaugauauagauac

SEQ ID NO: 382199 - RNA, 22 nt, Human
auguuuuugagauacaaacaga

SEQ ID NO: 382200 - RNA, 22 nt, Human
cccagcaguuguuggugcacau

SEQ ID NO: 382201 - RNA, 19 nt, Human
augucccaccgccccugag

SEQ ID NO: 382202 - RNA, 22 nt, Human
aauacauauggaauuccauguu

SEQ ID NO: 382203 - RNA, 22 nt, Human
gccagggagucugggccacaga

SEQ ID NO: 382204 - RNA, 22 nt, Human
ugucccaggccucauguugcca

SEQ ID NO: 382205 - RNA, 22 nt, Human
uggcagagucaucacaucugga

SEQ ID NO: 382206 - RNA, 22 nt, Human
cuugaaagcuuugcgucuucua

SEQ ID NO: 382207 - RNA, 22 nt, Human
gcagcauugugagguccugccc

SEQ ID NO: 382208 - RNA, 22 nt, Human
uccugccuucauacugcuguau

SEQ ID NO: 382209 - RNA, 22 nt, Human
uuacagaaugugccauuugguc

SEQ ID NO: 382210 - RNA, 22 nt, Human
acagacagauuuugucugaugu

SEQ ID NO: 382211 - RNA, 22 nt, Human
uguugagacugagggagucagc

SEQ ID NO: 382212 - RNA, 19 nt, Human
gcauaaaaugucaaugugu

SEQ ID NO: 382213 - RNA, 22 nt, Human
cuuagaugaagucacagaaccc

SEQ ID NO: 382214 - RNA, 22 nt, Human
caggcugggcagccuccccggc

SEQ ID NO: 382215 - RNA, 20 nt, Human
agguauaagaaaugugauuu

SEQ ID NO: 382216 - RNA, 22 nt, Human
ucccagccggugccuggguccc

SEQ ID NO: 382217 - RNA, 22 nt, Human
ggcuccugaaagacuaugggaa

SEQ ID NO: 382218 - RNA, 22 nt, Human
gcagcugccgugagcucacgcc

SEQ ID NO: 382219 - RNA, 22 nt, Human
ucagccacuacccaccuuaaca

SEQ ID NO: 382220 - RNA, 22 nt, Human
gugcccaggcccaaggcaccac

SEQ ID NO: 382221 - RNA, 22 nt, Human
ugcaggugcguuuucaagccuc

SEQ ID NO: 382222 - RNA, 17 nt, Human
uucucugagcuguauug

SEQ ID NO: 382223 - RNA, 22 nt, Human
cugaagcaaaggaucgagcuaa

SEQ ID NO: 382224 - RNA, 22 nt, Human
caucagaaaccuugaggaaacu

SEQ ID NO: 382225 - RNA, 22 nt, Human
ggaucugagagcaagcaggacc

SEQ ID NO: 382226 - RNA, 22 nt, Human
uugcacuccagcccgagcaaca

SEQ ID NO: 382227 - RNA, 22 nt, Human
agaagaaacugucggggauauu

SEQ ID NO: 382228 - RNA, 22 nt, Human
uuuaacuuaaucugcuugauga

SEQ ID NO: 382229 - RNA, 22 nt, Human
uuccuuaguguuagauucugug

SEQ ID NO: 382230 - RNA, 22 nt, Human
uauugaugcuuggauugggcca

SEQ ID NO: 382231 - RNA, 22 nt, Human
uuuccucugggcccugccaccc

SEQ ID NO: 382232 - RNA, 22 nt, Human
ugucuucaucucagacacaguu

SEQ ID NO: 382233 - RNA, 22 nt, Human
caguuuauagcucuagcagcuu

SEQ ID NO: 382234 - RNA, 22 nt, Human
cauggaaggcaaaagacacaga

SEQ ID NO: 382235 - RNA, 22 nt, Human
cuggcucaauuuguacugcugu

SEQ ID NO: 382236 - RNA, 22 nt, Human
uccaagaagucaucuaaacugu

SEQ ID NO: 382237 - RNA, 22 nt, Human
uagaaagugaagguuaauuaau

SEQ ID NO: 382238 - RNA, 22 nt, Human
agggccugggauguccuccuag

SEQ ID NO: 382239 - RNA, 22 nt, Human
aggucauuuuugccuucuauuu

SEQ ID NO: 382240 - RNA, 22 nt, Human
guauuaggaggaacacaggccu

SEQ ID NO: 382241 - RNA, 22 nt, Human
cuauuauuuccucaucuauaaa

SEQ ID NO: 382242 - RNA, 22 nt, Human
agagauucauguuuacuguagg

SEQ ID NO: 382243 - RNA, 22 nt, Human
uugaccuauguuucuucaucug

SEQ ID NO: 382244 - RNA, 22 nt, Human
uuuugaaagaguccugcuacag

SEQ ID NO: 382245 - RNA, 22 nt, Human
ccagggcagggaccacgugucu

SEQ ID NO: 382246 - RNA, 22 nt, Human
auucuuauuauaguaaaacagu

SEQ ID NO: 382247 - RNA, 22 nt, Human
ucucuucuauuugagacuauuu

SEQ ID NO: 382248 - RNA, 22 nt, Human
auccuugagccuuaucuuuugu

SEQ ID NO: 382249 - RNA, 23 nt, Human
aacaccaaggcucagagagauaa

SEQ ID NO: 382250 - RNA, 22 nt, Human
cagaaauucccauuucagauuc

SEQ ID NO: 382251 - RNA, 22 nt, Human
caauauucaguggaaaagccau

SEQ ID NO: 382252 - RNA, 19 nt, Human
ucaguuuuagucaucaguu

SEQ ID NO: 382253 - RNA, 17 nt, Human
agggacagcaguuuagg

SEQ ID NO: 382254 - RNA, 22 nt, Human
uccagcagguuggucaggugca

SEQ ID NO: 382255 - RNA, 22 nt, Human
uguaucaaaccaaauuaauucu

SEQ ID NO: 382256 - RNA, 22 nt, Human
cacccacauggaaauucacagu

SEQ ID NO: 382257 - RNA, 22 nt, Human
caaggcugcugcgggucgcacc

SEQ ID NO: 382258 - RNA, 22 nt, Human
ggagcagagcucuucaucugca

SEQ ID NO: 382259 - RNA, 17 nt, Human
gcauccaguaacaugcc

SEQ ID NO: 382260 - RNA, 22 nt, Human
ccagcagcuuuauuggcucucc

SEQ ID NO: 382261 - RNA, 22 nt, Human
aacacagcuaauuucugucaau

SEQ ID NO: 382262 - RNA, 22 nt, Human
ugcagaagcagagaguugccaa

SEQ ID NO: 382263 - RNA, 21 nt, Human
uucuucuuggacuguuuuggc

SEQ ID NO: 382264 - RNA, 20 nt, Human
aggcugggguguuuugccca

SEQ ID NO: 382265 - RNA, 17 nt, Human
gcugagugcagggaguc

SEQ ID NO: 382266 - RNA, 22 nt, Human
agugcuuucuugcuccaucagu

SEQ ID NO: 382267 - RNA, 22 nt, Human
aguggggagguccaggccaccc

SEQ ID NO: 382268 - RNA, 22 nt, Human
uguccuuagaagaagugaaaga

SEQ ID NO: 382269 - RNA, 22 nt, Human
gggcagcuagcccucuagccca

SEQ ID NO: 382270 - RNA, 21 nt, Human
ccagaggccucucuuggccac

SEQ ID NO: 382271 - RNA, 22 nt, Human
aaauggauggaaagcaauuuuu

SEQ ID NO: 382272 - RNA, 22 nt, Human
cagcaggcccagaguuucaugg

SEQ ID NO: 382273 - RNA, 22 nt, Human
uuuguaaaggccugaauuucag

SEQ ID NO: 382274 - RNA, 22 nt, Human
uuguuuuuaugaacauccagga

SEQ ID NO: 382275 - RNA, 22 nt, Human
uuuaggcacaacuacucagcua

SEQ ID NO: 382276 - RNA, 22 nt, Human
agcagcauggaugggccucagc

SEQ ID NO: 382277 - RNA, 22 nt, Human
gccagggcucgcggucccucgu

SEQ ID NO: 382278 - RNA, 22 nt, Human
cuccuuccugccccagugauaa

SEQ ID NO: 382279 - RNA, 22 nt, Human
uguaaauaaugcauguaaauca

SEQ ID NO: 382280 - RNA, 22 nt, Human
gcugggagucgcgucuguggcc

SEQ ID NO: 382281 - RNA, 22 nt, Human
gucaccagcaccaaugccacau

SEQ ID NO: 382282 - RNA, 22 nt, Human
ucaguuuucucaucugugaaau

SEQ ID NO: 382283 - RNA, 22 nt, Human
cugcagggaugugaggcccguu

SEQ ID NO: 382284 - RNA, 23 nt, Human
agggccacugggaaggauuacug

SEQ ID NO: 382285 - RNA, 23 nt, Human
acagugugguggacaaggagcag

SEQ ID NO: 382286 - RNA, 22 nt, Human
ugaaaucuucacuaagucucuu

SEQ ID NO: 382287 - RNA, 22 nt, Human
aguuuucacacucaccaaaagg

SEQ ID NO: 382288 - RNA, 22 nt, Human
gcugucacacauggccccagcu

SEQ ID NO: 382289 - RNA, 22 nt, Human
agaaaagguugaaaguaggauu

SEQ ID NO: 382290 - RNA, 22 nt, Human
ggucauugaaaucagaaggguu

SEQ ID NO: 382291 - RNA, 20 nt, Human
agccaggccucaaguuaagu

SEQ ID NO: 382292 - RNA, 19 nt, Human
ucccaggaagcaaauguca

SEQ ID NO: 382293 - RNA, 19 nt, Human
auacagauguauccaugau

SEQ ID NO: 382294 - RNA, 22 nt, Human
gggcaggaggcuaauucugcau

SEQ ID NO: 382295 - RNA, 22 nt, Human
ugauuuccaguugcugggugcu

SEQ ID NO: 382296 - RNA, 22 nt, Human
caggccuggguucaaaucccuu

SEQ ID NO: 382297 - RNA, 18 nt, Human
ucucuuuuccccucauug

SEQ ID NO: 382298 - RNA, 22 nt, Human
ugugucagagguagagauggca

SEQ ID NO: 382299 - RNA, 22 nt, Human
cuggcucuucagugcuugguuc

SEQ ID NO: 382300 - RNA, 22 nt, Human
agacaaguucugugggucaccu

SEQ ID NO: 382301 - RNA, 22 nt, Human
ucuucaucucagauuaacagga

SEQ ID NO: 382302 - RNA, 22 nt, Human
uuucuauugaucuaauaaacau

SEQ ID NO: 382303 - RNA, 22 nt, Human
ccugagugccaugagagcaccc

SEQ ID NO: 382304 - RNA, 22 nt, Human
ugccugcuaggcccugcugggu

SEQ ID NO: 382305 - RNA, 22 nt, Human
aggauuuauuacaagccauggu

SEQ ID NO: 382306 - RNA, 22 nt, Human
ugagcauggugggugcagagca

SEQ ID NO: 382307 - RNA, 22 nt, Human
gccaggcaugggcuucugggcg

SEQ ID NO: 382308 - RNA, 22 nt, Human
uagggaugagccaguggguagu

SEQ ID NO: 382309 - RNA, 22 nt, Human
caugcuccaaaaacaagagaau

SEQ ID NO: 382310 - RNA, 22 nt, Human
gccuggccugaacuaggaggug

SEQ ID NO: 382311 - RNA, 22 nt, Human
uuugucagucaugucugcuuuu

SEQ ID NO: 382312 - RNA, 22 nt, Human
ccaggccucuggcugcuuaguc

SEQ ID NO: 382313 - RNA, 22 nt, Human
ucaugaaucguggaaugauuua

SEQ ID NO: 382314 - RNA, 21 nt, Human
ggauggauagggaagagauuu

SEQ ID NO: 382315 - RNA, 22 nt, Human
ucagcaggcgguuccuuguggg

SEQ ID NO: 382316 - RNA, 22 nt, Human
ggcuguggggccggguacagug

SEQ ID NO: 382317 - RNA, 22 nt, Human
ccagccacugggccacugccag

SEQ ID NO: 382318 - RNA, 22 nt, Human
auucuucacauggauaggaucu

SEQ ID NO: 382319 - RNA, 22 nt, Human
agcaggaggguuuuguagaguc

SEQ ID NO: 382320 - RNA, 22 nt, Human
ucagcuuucucaaagaagcugg

SEQ ID NO: 382321 - RNA, 22 nt, Human
agccacagugcaagagagaaaa

SEQ ID NO: 382322 - RNA, 22 nt, Human
auagcuguuagauuggggucga

SEQ ID NO: 382323 - RNA, 22 nt, Human
gcaaacaagcugccugaagauu

SEQ ID NO: 382324 - RNA, 22 nt, Human
caccaggcuggagugcagaggu

SEQ ID NO: 382325 - RNA, 21 nt, Human
uccucugcagugagguggccu

SEQ ID NO: 382326 - RNA, 22 nt, Human
ccuggcagaauauuaaagugca

SEQ ID NO: 382327 - RNA, 22 nt, Human
ucucccacugcaagcccaggcu

SEQ ID NO: 382328 - RNA, 22 nt, Human
gcacagaaguaaaauacaaguc

SEQ ID NO: 382329 - RNA, 22 nt, Human
ugggacagagugagcuuuggcc

SEQ ID NO: 382330 - RNA, 22 nt, Human
gggcugagagcuggaaucugag

SEQ ID NO: 382331 - RNA, 22 nt, Human
acuaaauaguuuugacagaaca

SEQ ID NO: 382332 - RNA, 22 nt, Human
cagaaaaccugacucuagaacu

SEQ ID NO: 382333 - RNA, 22 nt, Human
gcagugguccaguucacaccca

SEQ ID NO: 382334 - RNA, 22 nt, Human
auaguggugagcugcauuuaug

SEQ ID NO: 382335 - RNA, 18 nt, Human
ugaccugcgcuucacggu

SEQ ID NO: 382336 - RNA, 18 nt, Human
cugucaccgccaccacac

SEQ ID NO: 382337 - RNA, 22 nt, Human
aaagcagaacugagagagcugg

SEQ ID NO: 382338 - RNA, 22 nt, Human
acacaggggaaaguggagcuga

SEQ ID NO: 382339 - RNA, 22 nt, Human
cagcaugguggagcugcucuuu

SEQ ID NO: 382340 - RNA, 22 nt, Human
guggcccucugauagggucagg

SEQ ID NO: 382341 - RNA, 22 nt, Human
cauugcacuuuggguccaggac

SEQ ID NO: 382342 - RNA, 22 nt, Human
uccaggacuagcauuucugaua

SEQ ID NO: 382343 - RNA, 19 nt, Human
ucccgcccacugagcgugc

SEQ ID NO: 382344 - RNA, 21 nt, Human
aaauacagaugcaaaucuguu

SEQ ID NO: 382345 - RNA, 20 nt, Human
agaagccaagugacauguuu

SEQ ID NO: 382346 - RNA, 22 nt, Human
uuguacaaaggauuuggaagag

SEQ ID NO: 382347 - RNA, 22 nt, Human
ucugagagccucuagccuaagu

SEQ ID NO: 382348 - RNA, 22 nt, Human
aagguucuaagggaagccaugc

SEQ ID NO: 382349 - RNA, 19 nt, Human
gggcuccuugggccucucu

SEQ ID NO: 382350 - RNA, 22 nt, Human
gugagaguguuuggaaauagaa

SEQ ID NO: 382351 - RNA, 22 nt, Human
cacugaaauauuaauaucuuau

SEQ ID NO: 382352 - RNA, 22 nt, Human
uauccaauucaccauugauggg

SEQ ID NO: 382353 - RNA, 22 nt, Human
cuugugcauuucauuccucagg

SEQ ID NO: 382354 - RNA, 22 nt, Human
caguugcuacaguucaagugug

SEQ ID NO: 382355 - RNA, 18 nt, Human
uccauuguucuacuguga

SEQ ID NO: 382356 - RNA, 19 nt, Human
gcagccaggugcucuaccu

SEQ ID NO: 382357 - RNA, 22 nt, Human
uggcccugacagguccugggca

SEQ ID NO: 382358 - RNA, 22 nt, Human
auccaaaccuggacaugagugg

SEQ ID NO: 382359 - RNA, 22 nt, Human
ccagcgcuucccaucagggagg

SEQ ID NO: 382360 - RNA, 19 nt, Human
agucuuucccacucgucuu

SEQ ID NO: 382361 - RNA, 22 nt, Human
uaauacuuuugccuuguauuca

SEQ ID NO: 382362 - RNA, 22 nt, Human
aaauguaguauguugcauguau

SEQ ID NO: 382363 - RNA, 22 nt, Human
gagaagcagguuuagcagacaa

SEQ ID NO: 382364 - RNA, 22 nt, Human
ucucuucauagugacacccauc

SEQ ID NO: 382365 - RNA, 22 nt, Human
cccaggugcugcgugaagccuc

SEQ ID NO: 382366 - RNA, 22 nt, Human
caugagauaauuuuucuccagu

SEQ ID NO: 382367 - RNA, 21 nt, Human
uaaaugugagcagggcugggc

SEQ ID NO: 382368 - RNA, 22 nt, Human
aaaagguaguugccaaauaagg

SEQ ID NO: 382369 - RNA, 18 nt, Human
uccagagcuacuguggug

SEQ ID NO: 382370 - RNA, 22 nt, Human
aagcauuugguucugaagacuc

SEQ ID NO: 382371 - RNA, 22 nt, Human
gcccaggaggcagagguugugg

SEQ ID NO: 382372 - RNA, 22 nt, Human
gaagaauccuguccucuuuagg

SEQ ID NO: 382373 - RNA, 22 nt, Human
gcugagguggcugccuuaguaa

SEQ ID NO: 382374 - RNA, 22 nt, Human
agaauuguaagcaauuugauua

SEQ ID NO: 382375 - RNA, 22 nt, Human
aaugcacauauauguguauaca

SEQ ID NO: 382376 - RNA, 22 nt, Human
gggcagcucagccaccaugcag

SEQ ID NO: 382377 - RNA, 22 nt, Human
gcaggggaguggaugauggauu

SEQ ID NO: 382378 - RNA, 21 nt, Human
acauuuucuguuuuaggaagu

SEQ ID NO: 382379 - RNA, 22 nt, Human
cugaaugucgaucagcuugggu

SEQ ID NO: 382380 - RNA, 22 nt, Human
cugcucuguucccccaucaucu

SEQ ID NO: 382381 - RNA, 22 nt, Human
augaauaaacaggugccucuuc

SEQ ID NO: 382382 - RNA, 22 nt, Human
agagcagcuggggcagagacca

SEQ ID NO: 382383 - RNA, 22 nt, Human
guugaaagaucauguggcugcc

SEQ ID NO: 382384 - RNA, 22 nt, Human
uuuauugacccaaagcgagagu

SEQ ID NO: 382385 - RNA, 22 nt, Human
aggaagccaugguggacgucua

SEQ ID NO: 382386 - RNA, 22 nt, Human
gagaaguuucugguuugcauag

SEQ ID NO: 382387 - RNA, 22 nt, Human
ggccucgcggcuucugguggcu

SEQ ID NO: 382388 - RNA, 20 nt, Human
aacacagauaccaaagguug

SEQ ID NO: 382389 - RNA, 18 nt, Human
uccagcgugcuccagggc

SEQ ID NO: 382390 - RNA, 22 nt, Human
agcugcuguccuaggcacugua

SEQ ID NO: 382391 - RNA, 22 nt, Human
aucagagaccggucaagucaug

SEQ ID NO: 382392 - RNA, 22 nt, Human
ugucaccacuggcugaaacacc

SEQ ID NO: 382393 - RNA, 22 nt, Human
agugaguggacccugcaaggaa

SEQ ID NO: 382394 - RNA, 22 nt, Human
aagccaagaguuaacuauuugu

SEQ ID NO: 382395 - RNA, 22 nt, Human
cugaggcugaagagggccuacg

SEQ ID NO: 382396 - RNA, 22 nt, Human
auuucuucaggucagaaauaga

SEQ ID NO: 382397 - RNA, 22 nt, Human
cuuaauuuaagccuagaaugca

SEQ ID NO: 382398 - RNA, 22 nt, Human
caggacaguauaggcuuuagga

SEQ ID NO: 382399 - RNA, 22 nt, Human
uggcagcuuccugcucauagga

SEQ ID NO: 382400 - RNA, 22 nt, Human
aguccaguguguucuggcagca

SEQ ID NO: 382401 - RNA, 22 nt, Human
uagugcacacgcauguagcagu

SEQ ID NO: 382402 - RNA, 22 nt, Human
gggauggggucaacauguaccu

SEQ ID NO: 382403 - RNA, 22 nt, Human
uuccaggaggagguacuagagg

SEQ ID NO: 382404 - RNA, 22 nt, Human
gugucccaaagauuagaaauca

SEQ ID NO: 382405 - RNA, 22 nt, Human
augaugguggguaauguguaaa

SEQ ID NO: 382406 - RNA, 22 nt, Human
ccagcagcgauagggugagugc

SEQ ID NO: 382407 - RNA, 22 nt, Human
cucaggauuuacuaauuucaag

SEQ ID NO: 382408 - RNA, 22 nt, Human
acaaaguuaacaguuggauagu

SEQ ID NO: 382409 - RNA, 22 nt, Human
ucucagaguaauucuuuaaggu

SEQ ID NO: 382410 - RNA, 22 nt, Human
ccacagagacagagcccagggu

SEQ ID NO: 382411 - RNA, 22 nt, Human
ucccaggauguuuauggcuggu

SEQ ID NO: 382412 - RNA, 23 nt, Human
gcucugagggcuuaucccuccca

SEQ ID NO: 382413 - RNA, 22 nt, Human
gagguggccucaagcagucuuc

SEQ ID NO: 382414 - RNA, 22 nt, Human
ggagcuguugcgcaugcgcucg

SEQ ID NO: 382415 - RNA, 19 nt, Human
cagagcugcuggccucguc

SEQ ID NO: 382416 - RNA, 21 nt, Human
agagacugucacugcaguacc

SEQ ID NO: 382417 - RNA, 22 nt, Human
aucauaaaauugcaccauuucu

SEQ ID NO: 382418 - RNA, 22 nt, Human
gggcugaccaaugccuugcuuu

SEQ ID NO: 382419 - RNA, 22 nt, Human
aauaauuuugagagccuggaaa

SEQ ID NO: 382420 - RNA, 22 nt, Human
gucagagagggcacgugcacac

SEQ ID NO: 382421 - RNA, 22 nt, Human
acccaggacaaaauaaccaggu

SEQ ID NO: 382422 - RNA, 22 nt, Human
agcagcaucaacccucccgugu

SEQ ID NO: 382423 - RNA, 22 nt, Human
ugcaaucucggcacuuugggag

SEQ ID NO: 382424 - RNA, 22 nt, Human
uccacagaauguaagauccaca

SEQ ID NO: 382425 - RNA, 22 nt, Human
ugacaauacagagagagcaaaa

SEQ ID NO: 382426 - RNA, 22 nt, Human
cagggcagagccaggauuucaa

SEQ ID NO: 382427 - RNA, 22 nt, Human
gaggucaggggagaggcugaug

SEQ ID NO: 382428 - RNA, 22 nt, Human
gagaaagauguaggcugggagg

SEQ ID NO: 382429 - RNA, 22 nt, Human
ccugccuguacuagagacccag

SEQ ID NO: 382430 - RNA, 22 nt, Human
ucagugugaggucuuccacccg

SEQ ID NO: 382431 - RNA, 22 nt, Human
aggccuggccugggcggcauug

SEQ ID NO: 382432 - RNA, 21 nt, Human
uucugggaaaugagcuggggc

SEQ ID NO: 382433 - RNA, 22 nt, Human
cccgggaggaggaaguugcagu

SEQ ID NO: 382434 - RNA, 22 nt, Human
aucucagacauguuguccauga

SEQ ID NO: 382435 - RNA, 22 nt, Human
gaacuguaguuaauacuacaca

SEQ ID NO: 382436 - RNA, 20 nt, Human
gaggccucagccucagcucc

SEQ ID NO: 382437 - RNA, 17 nt, Human
gguguauggggagggaa

SEQ ID NO: 382438 - RNA, 22 nt, Human
ggcacugagaggcucuuccuaa

SEQ ID NO: 382439 - RNA, 22 nt, Human
cuagaaauguagauucuuagug

SEQ ID NO: 382440 - RNA, 22 nt, Human
ucagguggcuuggagggggacg

SEQ ID NO: 382441 - RNA, 22 nt, Human
ccugaggcuuaaucugucccaa

SEQ ID NO: 382442 - RNA, 22 nt, Human
gcagccagccccucugaccucu

SEQ ID NO: 382443 - RNA, 23 nt, Human
uuuauuuauuuaggcugagggau

SEQ ID NO: 382444 - RNA, 22 nt, Human
ugaaggugucuuugugaacauc

SEQ ID NO: 382445 - RNA, 22 nt, Human
cuuguucaguccugacuuccug

SEQ ID NO: 382446 - RNA, 22 nt, Human
ugccaaggagcuggaucagggc

SEQ ID NO: 382447 - RNA, 22 nt, Human
agaauucauaggaaguuuccua

SEQ ID NO: 382448 - RNA, 22 nt, Human
gcaggggcugcugggaacucgg

SEQ ID NO: 382449 - RNA, 20 nt, Human
uuugucuguuaaguguuucu

SEQ ID NO: 382450 - RNA, 22 nt, Human
gggcugcacguauucugcucac

SEQ ID NO: 382451 - RNA, 18 nt, Human
gagcugccauauuuaguu

SEQ ID NO: 382452 - RNA, 22 nt, Human
agucccagcuucccccaugcag

SEQ ID NO: 382453 - RNA, 20 nt, Human
auguccagugacuggaccau

SEQ ID NO: 382454 - RNA, 22 nt, Human
gaggcagcaauaaaaagaauuu

SEQ ID NO: 382455 - RNA, 21 nt, Human
uggcacugcuuagcagguucc

SEQ ID NO: 382456 - RNA, 22 nt, Human
cccagcagccuggauguucuuu

SEQ ID NO: 382457 - RNA, 21 nt, Human
agcagaggggacauguuugau

SEQ ID NO: 382458 - RNA, 22 nt, Human
cacagcuugggcucugacaaua

SEQ ID NO: 382459 - RNA, 22 nt, Human
ggcagaggugacagugucuuuu

SEQ ID NO: 382460 - RNA, 22 nt, Human
ccaggguggaggcuggauggag

SEQ ID NO: 382461 - RNA, 17 nt, Human
agugaaauuuacauugc

SEQ ID NO: 382462 - RNA, 22 nt, Human
agggcaaguugagugugcgugg

SEQ ID NO: 382463 - RNA, 22 nt, Human
agccagggauggcagugcccag

SEQ ID NO: 382464 - RNA, 22 nt, Human
aggcagcagacuguuaaucaga

SEQ ID NO: 382465 - RNA, 22 nt, Human
cccugcagcuuuugcauaguca

SEQ ID NO: 382466 - RNA, 19 nt, Human
agucccaggcccgaaagag

SEQ ID NO: 382467 - RNA, 22 nt, Human
cucccugggcagauguggcucu

SEQ ID NO: 382468 - RNA, 21 nt, Human
gggagcuggaaacugggugac

SEQ ID NO: 382469 - RNA, 22 nt, Human
uugcuguguaacuccuggccug

SEQ ID NO: 382470 - RNA, 22 nt, Human
caguggugaagagcaggggcuc

SEQ ID NO: 382471 - RNA, 22 nt, Human
guucuaauuuggggcuccuuag

SEQ ID NO: 382472 - RNA, 22 nt, Human
uuugcuauaaaagggucacacg

SEQ ID NO: 382473 - RNA, 20 nt, Human
ugcugucguguuuucugcuu

SEQ ID NO: 382474 - RNA, 22 nt, Human
uagggcucugagaguucagccu

SEQ ID NO: 382475 - RNA, 22 nt, Human
ucagggcauucaagaggccugg

SEQ ID NO: 382476 - RNA, 22 nt, Human
cagcuuuaguaacccacugcuc

SEQ ID NO: 382477 - RNA, 23 nt, Human
gaagcagaugucugaguaggcag

SEQ ID NO: 382478 - RNA, 22 nt, Human
ggacccugggcuugcuccuggg

SEQ ID NO: 382479 - RNA, 23 nt, Human
gugcucugcggucugcuagucug

SEQ ID NO: 382480 - RNA, 22 nt, Human
gaauguaauagucaguagaaca

SEQ ID NO: 382481 - RNA, 22 nt, Human
uuucaugaggggcaaaaucuca

SEQ ID NO: 382482 - RNA, 22 nt, Human
ccugcuggccaguggagggcug

SEQ ID NO: 382483 - RNA, 23 nt, Human
ugcagcugccucuggcgggccgg

SEQ ID NO: 382484 - RNA, 22 nt, Human
gcuggggcugggcugaggaaga

SEQ ID NO: 382485 - RNA, 22 nt, Human
aauguguacuuuuucaugcuca

SEQ ID NO: 382486 - RNA, 22 nt, Human
acuguccauucacucauauuca

SEQ ID NO: 382487 - RNA, 22 nt, Human
aaaucuggccccuugccuauuu

SEQ ID NO: 382488 - RNA, 22 nt, Human
ugauaauauuuugaaucauaag

SEQ ID NO: 382489 - RNA, 22 nt, Human
uugauuaaacaggcauauucaa

SEQ ID NO: 382490 - RNA, 22 nt, Human
augaaacaguguguauagcaaa

SEQ ID NO: 382491 - RNA, 22 nt, Human
uuauucuucuucucuugccagg

SEQ ID NO: 382492 - RNA, 22 nt, Human
gggaagguauuuagcugcugaa

SEQ ID NO: 382493 - RNA, 21 nt, Human
cccuugccugcacuccucggc

SEQ ID NO: 382494 - RNA, 17 nt, Human
cugagcauccgugcucu

SEQ ID NO: 382495 - RNA, 22 nt, Human
aagcugccagauucagucugcu

SEQ ID NO: 382496 - RNA, 22 nt, Human
cagcuucucagaaagcugaggu

SEQ ID NO: 382497 - RNA, 22 nt, Human
aaucauaauucaaauaagcuua

SEQ ID NO: 382498 - RNA, 23 nt, Human
aguuuuucugcaugguucuguau

SEQ ID NO: 382499 - RNA, 23 nt, Human
aagcugccuucgcaguuggucug

SEQ ID NO: 382500 - RNA, 22 nt, Human
uaagacaauucuucagucacaa

SEQ ID NO: 382501 - RNA, 22 nt, Human
cccuguacagucucuguggcac

SEQ ID NO: 382502 - RNA, 22 nt, Human
ggagaggagcuauugggggcuc

SEQ ID NO: 382503 - RNA, 22 nt, Human
uucaggaucaaguugccaguag

SEQ ID NO: 382504 - RNA, 22 nt, Human
auuucauacuaaggcucaaaaa

SEQ ID NO: 382505 - RNA, 22 nt, Human
ucucugggugauggcagggcac

SEQ ID NO: 382506 - RNA, 23 nt, Human
uuugcaaauuggacacaaccaca

SEQ ID NO: 382507 - RNA, 22 nt, Human
agcagcauucucugguaugggg

SEQ ID NO: 382508 - RNA, 22 nt, Human
aagucuguuugagugucacacu

SEQ ID NO: 382509 - RNA, 22 nt, Human
ugaguccaccuuaguauauggg

SEQ ID NO: 382510 - RNA, 22 nt, Human
agggccuggaacuggagaccac

SEQ ID NO: 382511 - RNA, 22 nt, Human
uggaggcaguuuaagucugaga

SEQ ID NO: 382512 - RNA, 22 nt, Human
ugccaggcauuugacagacacu

SEQ ID NO: 382513 - RNA, 22 nt, Human
cacccuagcugucauuucaguu

SEQ ID NO: 382514 - RNA, 22 nt, Human
agaggggcucauauccugucau

SEQ ID NO: 382515 - RNA, 22 nt, Human
uguggcccagaugagugugcua

SEQ ID NO: 382516 - RNA, 22 nt, Human
agcaguggugugaggagggcuc

SEQ ID NO: 382517 - RNA, 22 nt, Human
cccagcaguaaccaguggaaau

SEQ ID NO: 382518 - RNA, 22 nt, Human
ucacauuuucauauucucugag

SEQ ID NO: 382519 - RNA, 22 nt, Human
ccaagaugaucuuuacaguguu

SEQ ID NO: 382520 - RNA, 22 nt, Human
aagucacccuagggccuggacu

SEQ ID NO: 382521 - RNA, 22 nt, Human
uugcauuugagaaaguucuccu

SEQ ID NO: 382522 - RNA, 22 nt, Human
ucaucuugcugccauugcuuua

SEQ ID NO: 382523 - RNA, 20 nt, Human
aggcacuguugucuguaucc

SEQ ID NO: 382524 - RNA, 22 nt, Human
augggcagcagcugccauucau

SEQ ID NO: 382525 - RNA, 22 nt, Human
auugcacaaacacagucagacu

SEQ ID NO: 382526 - RNA, 22 nt, Human
cucugagcccgcugcagcccca

SEQ ID NO: 382527 - RNA, 22 nt, Human
aaaagagucuuaggcagucaua

SEQ ID NO: 382528 - RNA, 21 nt, Human
gagcucucaggcaagaagcag

SEQ ID NO: 382529 - RNA, 22 nt, Human
auggcagauggcuggagcaggu

SEQ ID NO: 382530 - RNA, 22 nt, Human
gaaaugcaaauucucucucgcu

SEQ ID NO: 382531 - RNA, 22 nt, Human
cugcagggugacguugcccacc

SEQ ID NO: 382532 - RNA, 22 nt, Human
ggcugccagugagugcagaccg

SEQ ID NO: 382533 - RNA, 22 nt, Human
auagaauuauggaaagcaucuu

SEQ ID NO: 382534 - RNA, 17 nt, Human
agagggaaaaugcgguu

SEQ ID NO: 382535 - RNA, 22 nt, Human
auuguuaauguugcacuaaggu

SEQ ID NO: 382536 - RNA, 22 nt, Human
auuuagccucauuuuugacaua

SEQ ID NO: 382537 - RNA, 22 nt, Human
auucuuggagcagucaaagaag

SEQ ID NO: 382538 - RNA, 22 nt, Human
aaaaugugcaguuuuuaagcug

SEQ ID NO: 382539 - RNA, 22 nt, Human
ccucugccaccucccacgaggc

SEQ ID NO: 382540 - RNA, 22 nt, Human
augggaggaucacuugaggcca

SEQ ID NO: 382541 - RNA, 22 nt, Human
uggcccuguguccugcugccag

SEQ ID NO: 382542 - RNA, 22 nt, Human
cagcaugacagucugcagcaga

SEQ ID NO: 382543 - RNA, 21 nt, Human
aaauacagaaacuuguuuuca

SEQ ID NO: 382544 - RNA, 22 nt, Human
caacagaagguguacuacugaa

SEQ ID NO: 382545 - RNA, 22 nt, Human
acuggaugaggggaaagagaca

SEQ ID NO: 382546 - RNA, 18 nt, Human
agaagccacgaggagucc

SEQ ID NO: 382547 - RNA, 17 nt, Human
uugaacugcugagucag

SEQ ID NO: 382548 - RNA, 22 nt, Human
agcagcauagaugcuauccgag

SEQ ID NO: 382549 - RNA, 22 nt, Human
caggugucaaaauacuaagugg

SEQ ID NO: 382550 - RNA, 22 nt, Human
caugcacagugauaucugaaga

SEQ ID NO: 382551 - RNA, 22 nt, Human
guggggcaugcacgcugcuccu

SEQ ID NO: 382552 - RNA, 22 nt, Human
uuacaggggacauuggggacau

SEQ ID NO: 382553 - RNA, 22 nt, Human
uaaacauguugacaucuuaccu

SEQ ID NO: 382554 - RNA, 22 nt, Human
ggccaggcugcccugggagcag

SEQ ID NO: 382555 - RNA, 22 nt, Human
gagggauggugugagaggcuca

SEQ ID NO: 382556 - RNA, 22 nt, Human
ucagggcaggacaguguaggcc

SEQ ID NO: 382557 - RNA, 22 nt, Human
acagugucugacacauuguagc

SEQ ID NO: 382558 - RNA, 22 nt, Human
ugaaggaaugagggaguggguc

SEQ ID NO: 382559 - RNA, 22 nt, Human
gccugcagugagugcagaaggu

SEQ ID NO: 382560 - RNA, 22 nt, Human
auacauguuguaccauauguuu

SEQ ID NO: 382561 - RNA, 22 nt, Human
agagggaucacccuguuucugg

SEQ ID NO: 382562 - RNA, 22 nt, Human
aaguuacaggagaaagagauca

SEQ ID NO: 382563 - RNA, 22 nt, Human
ugugcaggugcaggaagggggc

SEQ ID NO: 382564 - RNA, 22 nt, Human
uuuuuaagcuccuuugauguca

SEQ ID NO: 382565 - RNA, 22 nt, Human
cccuggccagcucaugucugag

SEQ ID NO: 382566 - RNA, 22 nt, Human
caccagcagaagacugagggug

SEQ ID NO: 382567 - RNA, 22 nt, Human
cuguggagcuuguggcaguggg

SEQ ID NO: 382568 - RNA, 22 nt, Human
ccagaucuucuuuucagugucu

SEQ ID NO: 382569 - RNA, 22 nt, Human
gcaguguuuacauauuagaaac

SEQ ID NO: 382570 - RNA, 22 nt, Human
ucucacagugcaggucugucuc

SEQ ID NO: 382571 - RNA, 22 nt, Human
gggcucugguacuuccuggcuc

SEQ ID NO: 382572 - RNA, 22 nt, Human
gcagccacuaguuuuccuguuu

SEQ ID NO: 382573 - RNA, 22 nt, Human
gggcagccucggugccugcugc

SEQ ID NO: 382574 - RNA, 22 nt, Human
gucccagaggacagggucacau

SEQ ID NO: 382575 - RNA, 23 nt, Human
gcugucugucaucucugcgggag

SEQ ID NO: 382576 - RNA, 22 nt, Human
ccagagccuggcaucugcauaa

SEQ ID NO: 382577 - RNA, 22 nt, Human
agugugucugaucacuugugag

SEQ ID NO: 382578 - RNA, 22 nt, Human
ugcagcucauugcuggggucug

SEQ ID NO: 382579 - RNA, 22 nt, Human
cuguguuugaugagaagccacc

SEQ ID NO: 382580 - RNA, 22 nt, Human
aauguguagauguugcauuccu

SEQ ID NO: 382581 - RNA, 22 nt, Human
cugaagcaaaugaaacagcucu

SEQ ID NO: 382582 - RNA, 22 nt, Human
uuuaggcaugcaguucuauuua

SEQ ID NO: 382583 - RNA, 22 nt, Human
agcauuuaggagaauuugagaa

SEQ ID NO: 382584 - RNA, 22 nt, Human
aggugccaauuuucagugaaca

SEQ ID NO: 382585 - RNA, 22 nt, Human
cagcugugaauugucuuaucua

SEQ ID NO: 382586 - RNA, 21 nt, Human
ccugcagcaccagaaggagau

SEQ ID NO: 382587 - RNA, 22 nt, Human
auguuucaugacugagcaaaau

SEQ ID NO: 382588 - RNA, 19 nt, Human
aggcugcaagguggugggc

SEQ ID NO: 382589 - RNA, 22 nt, Human
ucaaaauuagugaccaaaggca

SEQ ID NO: 382590 - RNA, 22 nt, Human
agaaaucuaagaugcucaagga

SEQ ID NO: 382591 - RNA, 22 nt, Human
cagcugacgccagaguggaauu

SEQ ID NO: 382592 - RNA, 22 nt, Human
aaugaaacuguauauagacugu

SEQ ID NO: 382593 - RNA, 22 nt, Human
gaauagcuuccuuuuuuccaaa

SEQ ID NO: 382594 - RNA, 22 nt, Human
cuccagggaugagacagaguag

SEQ ID NO: 382595 - RNA, 22 nt, Human
accuuucacgguaucagacauc

SEQ ID NO: 382596 - RNA, 22 nt, Human
ccagggcagaaaaagagggaau

SEQ ID NO: 382597 - RNA, 22 nt, Human
aggagagagaacacuugggucc

SEQ ID NO: 382598 - RNA, 22 nt, Human
gucauugcaguggcaaaucaca

SEQ ID NO: 382599 - RNA, 22 nt, Human
uugguuuacuaggauucaaauu

SEQ ID NO: 382600 - RNA, 22 nt, Human
ugucuccucauacugucauauu

SEQ ID NO: 382601 - RNA, 22 nt, Human
auuaauuuccaggcacugugcu

SEQ ID NO: 382602 - RNA, 22 nt, Human
ccaggaaaauaccaagcuuuaa

SEQ ID NO: 382603 - RNA, 22 nt, Human
gagccaccuucaacucaggaau

SEQ ID NO: 382604 - RNA, 22 nt, Human
gccuaggaguacagaaugguuu

SEQ ID NO: 382605 - RNA, 22 nt, Human
aagaaugagcucaaagaucuua

SEQ ID NO: 382606 - RNA, 22 nt, Human
ggagacaguauggcuuguagcu

SEQ ID NO: 382607 - RNA, 20 nt, Human
cuuuggcaaugagaacaggg

SEQ ID NO: 382608 - RNA, 20 nt, Human
ggaagcagagaacuguuuuc

SEQ ID NO: 382609 - RNA, 22 nt, Human
gagcugagccuggguggaccgc

SEQ ID NO: 382610 - RNA, 22 nt, Human
aagccaggcugcacuugcuggg

SEQ ID NO: 382611 - RNA, 22 nt, Human
acauuguuugagaauacagaug

SEQ ID NO: 382612 - RNA, 23 nt, Human
cauuucaacgaauuuuccuucug

SEQ ID NO: 382613 - RNA, 22 nt, Human
gagagggccagggugagaacua

SEQ ID NO: 382614 - RNA, 22 nt, Human
ugaaggccagcucuuuaucagc

SEQ ID NO: 382615 - RNA, 22 nt, Human
uguuucuuuguagauauucuuu

SEQ ID NO: 382616 - RNA, 22 nt, Human
aaagucauugcuguuaucaaug

SEQ ID NO: 382617 - RNA, 22 nt, Human
cauuuguaggaugcuucuuguu

SEQ ID NO: 382618 - RNA, 22 nt, Human
acauguaaaaggaacaugcaug

SEQ ID NO: 382619 - RNA, 22 nt, Human
cacucccuucaggagccuagga

SEQ ID NO: 382620 - RNA, 22 nt, Human
ucuuuguaacugucuauugaga

SEQ ID NO: 382621 - RNA, 22 nt, Human
aggcuuccgaguagcugggacu

SEQ ID NO: 382622 - RNA, 20 nt, Human
auuuggcaugaaguauugau

SEQ ID NO: 382623 - RNA, 22 nt, Human
gcuucccagcagaggaaagacu

SEQ ID NO: 382624 - RNA, 22 nt, Human
aggcugagagcaacgugucaga

SEQ ID NO: 382625 - RNA, 22 nt, Human
cuugcuuuguccagaaauucag

SEQ ID NO: 382626 - RNA, 22 nt, Human
guucccauacaguaucagugcu

SEQ ID NO: 382627 - RNA, 22 nt, Human
ucauugaauuucacagcuuuau

SEQ ID NO: 382628 - RNA, 22 nt, Human
aggcugcagaacagucaggugc

SEQ ID NO: 382629 - RNA, 23 nt, Human
agccacuucuaucuugcuccugg

SEQ ID NO: 382630 - RNA, 22 nt, Human
agaugcugugaggaagcuagga

SEQ ID NO: 382631 - RNA, 22 nt, Human
ucaguggauuggaugagaucug

SEQ ID NO: 382632 - RNA, 22 nt, Human
gcagcugaaagggaucucuaca

SEQ ID NO: 382633 - RNA, 22 nt, Human
uggcucuggcgugaagcccaga

SEQ ID NO: 382634 - RNA, 22 nt, Human
ugugaugguucacugggcauga

SEQ ID NO: 382635 - RNA, 22 nt, Human
cugaggcucccucgggucugcu

SEQ ID NO: 382636 - RNA, 17 nt, Human
gccucugcuugugucau

SEQ ID NO: 382637 - RNA, 20 nt, Human
cugggaggucuuccaaauca

SEQ ID NO: 382638 - RNA, 22 nt, Human
gggcagagagcuggaacuccuu

SEQ ID NO: 382639 - RNA, 22 nt, Human
acaagagacaagagguucuucu

SEQ ID NO: 382640 - RNA, 22 nt, Human
guggcaggagacuggaagaugg

SEQ ID NO: 382641 - RNA, 22 nt, Human
ccuguggcacaugcagggauuc

SEQ ID NO: 382642 - RNA, 22 nt, Human
acaguggaugacauccuuuugc

SEQ ID NO: 382643 - RNA, 22 nt, Human
agagcagaggcauggccguggg

SEQ ID NO: 382644 - RNA, 22 nt, Human
agcagcauuuaaguuucuucua

SEQ ID NO: 382645 - RNA, 22 nt, Human
ccugccagauccccugagcuga

SEQ ID NO: 382646 - RNA, 22 nt, Human
gguuauauaauucagugcuuuc

SEQ ID NO: 382647 - RNA, 22 nt, Human
ggacacaguggaagacagcuug

SEQ ID NO: 382648 - RNA, 22 nt, Human
ggcagccaugucccagggcuuc

SEQ ID NO: 382649 - RNA, 22 nt, Human
cuacagaaucuaccucaagcca

SEQ ID NO: 382650 - RNA, 22 nt, Human
gggucuggacggcugcaggaag

SEQ ID NO: 382651 - RNA, 22 nt, Human
gcuuuggaugugugccugaggu

SEQ ID NO: 382652 - RNA, 22 nt, Human
ucccagcagggccgaccagccu

SEQ ID NO: 382653 - RNA, 22 nt, Human
agcccagguugaggcugcagug

SEQ ID NO: 382654 - RNA, 22 nt, Human
ugcagcucugaacagucaugaa

SEQ ID NO: 382655 - RNA, 22 nt, Human
acaggcagcacuaaucucuggu

SEQ ID NO: 382656 - RNA, 22 nt, Human
auucauucugaccucaagagaa

SEQ ID NO: 382657 - RNA, 22 nt, Human
auagaaauggcagcuggugcua

SEQ ID NO: 382658 - RNA, 22 nt, Human
ugaaaaaacaaguuggcccauu

SEQ ID NO: 382659 - RNA, 22 nt, Human
aucaguuuuguucacuacuaua

SEQ ID NO: 382660 - RNA, 22 nt, Human
gucuaacaagcauuaggaaccc

SEQ ID NO: 382661 - RNA, 22 nt, Human
cucuggagguggagguugcagu

SEQ ID NO: 382662 - RNA, 22 nt, Human
caguugccuacuacauggcagg

SEQ ID NO: 382663 - RNA, 22 nt, Human
gcuguggcuugcagcuggggcu

SEQ ID NO: 382664 - RNA, 22 nt, Human
uggcugagaccuucccaaauuc

SEQ ID NO: 382665 - RNA, 22 nt, Human
uugguacaaaaguaacuguggu

SEQ ID NO: 382666 - RNA, 22 nt, Human
aauuagagaucaguucuuugac

SEQ ID NO: 382667 - RNA, 22 nt, Human
gugacaguggucacuuguaguu

SEQ ID NO: 382668 - RNA, 22 nt, Human
gagaggauccacaaaccaggaa

SEQ ID NO: 382669 - RNA, 18 nt, Human
gcccugguggagcuggug

SEQ ID NO: 382670 - RNA, 22 nt, Human
aaggggaaaaaguguuaggagu

SEQ ID NO: 382671 - RNA, 22 nt, Human
gaguccaguuagugaggcuggg

SEQ ID NO: 382672 - RNA, 22 nt, Human
acagcaagccagcuugucacug

SEQ ID NO: 382673 - RNA, 22 nt, Human
gcaccugggguacacagcuaca

SEQ ID NO: 382674 - RNA, 22 nt, Human
aggaaaggccuuugcauuuggu

SEQ ID NO: 382675 - RNA, 18 nt, Human
ucagagagcagcuuuauu

SEQ ID NO: 382676 - RNA, 22 nt, Human
uucacagaauugucuugacugg

SEQ ID NO: 382677 - RNA, 22 nt, Human
acagccugcugccugcuucuug

SEQ ID NO: 382678 - RNA, 22 nt, Human
agaaaugaagcaggaguuauua

SEQ ID NO: 382679 - RNA, 22 nt, Human
uggcccugucccuggagccugg

SEQ ID NO: 382680 - RNA, 22 nt, Human
ugggcugcccaagguggccaug

SEQ ID NO: 382681 - RNA, 22 nt, Human
uaaguucaguuggucgaaguag

SEQ ID NO: 382682 - RNA, 18 nt, Human
gagguccugcucuagccc

SEQ ID NO: 382683 - RNA, 22 nt, Human
uagcacaucuucuuggccugca

SEQ ID NO: 382684 - RNA, 19 nt, Human
agggucaggacaaggacuu

SEQ ID NO: 382685 - RNA, 22 nt, Human
uugagggucuggaucugcugcu

SEQ ID NO: 382686 - RNA, 22 nt, Human
caaaugauaccuauuacuaggc

SEQ ID NO: 382687 - RNA, 22 nt, Human
uaauuucaaguuuagggcucua

SEQ ID NO: 382688 - RNA, 22 nt, Human
uccuccuucgggacugcuugac

SEQ ID NO: 382689 - RNA, 23 nt, Human
cuugcaggaagcagauggcacac

SEQ ID NO: 382690 - RNA, 22 nt, Human
caggguagacaguaggugucug

SEQ ID NO: 382691 - RNA, 22 nt, Human
auuauauaggacuugcccuucc

SEQ ID NO: 382692 - RNA, 22 nt, Human
aagcugccuagaguugaauguc

SEQ ID NO: 382693 - RNA, 22 nt, Human
uagcacauaacuuagaauaguu

SEQ ID NO: 382694 - RNA, 22 nt, Human
gaggcucagagacuuuaaguuu

SEQ ID NO: 382695 - RNA, 22 nt, Human
agaccaagugcaggugccacua

SEQ ID NO: 382696 - RNA, 21 nt, Human
guggccugauuaugaaugggu

SEQ ID NO: 382697 - RNA, 22 nt, Human
cagaaauguacugacaugcagu

SEQ ID NO: 382698 - RNA, 22 nt, Human
gugcauuugacgaauacucacu

SEQ ID NO: 382699 - RNA, 22 nt, Human
ggcuuugccuggaauuuccuug

SEQ ID NO: 382700 - RNA, 22 nt, Human
ucuggcucacuucaggcuucac

SEQ ID NO: 382701 - RNA, 22 nt, Human
aguaacaagugccaacguuaga

SEQ ID NO: 382702 - RNA, 22 nt, Human
ucagagucucccccaguuuggg

SEQ ID NO: 382703 - RNA, 22 nt, Human
gcuguucagggcacucaugggc

SEQ ID NO: 382704 - RNA, 22 nt, Human
gcucaagagagaugcaguucuu

SEQ ID NO: 382705 - RNA, 22 nt, Human
agaggggagagcuaagcaauuc

SEQ ID NO: 382706 - RNA, 22 nt, Human
ggagacagugacuuagagacug

SEQ ID NO: 382707 - RNA, 22 nt, Human
gagcacagccaaaguaagaagg

SEQ ID NO: 382708 - RNA, 21 nt, Human
gcagccacagccaccaagcua

SEQ ID NO: 382709 - RNA, 22 nt, Human
uuggaauucaaguuguagcuua

SEQ ID NO: 382710 - RNA, 18 nt, Human
uggagcaggaagccuggc

SEQ ID NO: 382711 - RNA, 22 nt, Human
ccagggcaauaggaacacuuuu

SEQ ID NO: 382712 - RNA, 20 nt, Human
gauuacaaaaugaaaugcau

SEQ ID NO: 382713 - RNA, 22 nt, Human
ucaggaugguguggaggaaaua

SEQ ID NO: 382714 - RNA, 19 nt, Human
ccaguagagacagcugcag

SEQ ID NO: 382715 - RNA, 22 nt, Human
aguuuccaaauauuguuuuagc

SEQ ID NO: 382716 - RNA, 22 nt, Human
ugaaaugaaacagaacauauca

SEQ ID NO: 382717 - RNA, 22 nt, Human
ggcagcuuccuaggagagggca

SEQ ID NO: 382718 - RNA, 22 nt, Human
aacaguaacgagauguccuaac

SEQ ID NO: 382719 - RNA, 22 nt, Human
ucaggcagcuccaggaauggua

SEQ ID NO: 382720 - RNA, 22 nt, Human
gaauuucaacaguccucaaaug

SEQ ID NO: 382721 - RNA, 22 nt, Human
cucaggauagauuguccucuca

SEQ ID NO: 382722 - RNA, 22 nt, Human
aauaagauccugaagauauguu

SEQ ID NO: 382723 - RNA, 22 nt, Human
agcuucuugggcuuuacacaaa

SEQ ID NO: 382724 - RNA, 22 nt, Human
uuucucaaguucagauauuuga

SEQ ID NO: 382725 - RNA, 22 nt, Human
aggcucugugacaaucaagcug

SEQ ID NO: 382726 - RNA, 22 nt, Human
ucaugcacaugugucaccauca

SEQ ID NO: 382727 - RNA, 22 nt, Human
agguggguaucaugagagauua

SEQ ID NO: 382728 - RNA, 22 nt, Human
auaugccauuagcuagaaauaa

SEQ ID NO: 382729 - RNA, 22 nt, Human
uauuccagguauucuucaagag

SEQ ID NO: 382730 - RNA, 22 nt, Human
agggccucuaccauccaagguu

SEQ ID NO: 382731 - RNA, 22 nt, Human
aaaggccacuugaaggauuuuu

SEQ ID NO: 382732 - RNA, 22 nt, Human
agccuggagaggcgccauacac

SEQ ID NO: 382733 - RNA, 22 nt, Human
uccaugagcuagggauucauca

SEQ ID NO: 382734 - RNA, 22 nt, Human
uacauguaauuuucauaguaag

SEQ ID NO: 382735 - RNA, 22 nt, Human
cguguacagucuaucuuuuuuc

SEQ ID NO: 382736 - RNA, 22 nt, Human
aagcagccaccucaucuccacu

SEQ ID NO: 382737 - RNA, 22 nt, Human
agggagcucacaguccaguaga

SEQ ID NO: 382738 - RNA, 22 nt, Human
uggcagcugccauguccacgug

SEQ ID NO: 382739 - RNA, 22 nt, Human
ucaucugucccaggcuuuuuuc

SEQ ID NO: 382740 - RNA, 22 nt, Human
aggaaagcucccaguagggcuc

SEQ ID NO: 382741 - RNA, 22 nt, Human
uuagauaaauuaagacuuuaca

SEQ ID NO: 382742 - RNA, 19 nt, Human
ugccugucaguagaucuca

SEQ ID NO: 382743 - RNA, 17 nt, Human
aguguuuccuuaucauu

SEQ ID NO: 382744 - RNA, 22 nt, Human
cuugccuucuuuuccuauagaa

SEQ ID NO: 382745 - RNA, 22 nt, Human
cauuuucaugaguuucuguuca

SEQ ID NO: 382746 - RNA, 21 nt, Human
uuagaaagcucacuacaguua

SEQ ID NO: 382747 - RNA, 22 nt, Human
aggagcagaauuuaaugugcag

SEQ ID NO: 382748 - RNA, 23 nt, Human
uggcucucucagugcugcagagg

SEQ ID NO: 382749 - RNA, 22 nt, Human
cugcacagagcagggcagacac

SEQ ID NO: 382750 - RNA, 22 nt, Human
acaucucaugaaugauaaauca

SEQ ID NO: 382751 - RNA, 22 nt, Human
gugaaaucugaggcccaugaug

SEQ ID NO: 382752 - RNA, 22 nt, Human
agggcagcuaaggugcugacug

SEQ ID NO: 382753 - RNA, 22 nt, Human
ucugagggugggagaaggagcu

SEQ ID NO: 382754 - RNA, 22 nt, Human
aaccugcauguuucuaaaagca

SEQ ID NO: 382755 - RNA, 22 nt, Human
accauguuggccaagcuggucu

SEQ ID NO: 382756 - RNA, 22 nt, Human
gugcugcucacaucuggaggua

SEQ ID NO: 382757 - RNA, 22 nt, Human
uacauacacaaauauacuguuu

SEQ ID NO: 382758 - RNA, 22 nt, Human
cauuuagaaacuguuuuuaaca

SEQ ID NO: 382759 - RNA, 22 nt, Human
gcuggccauucucuuugagaug

SEQ ID NO: 382760 - RNA, 22 nt, Human
cauugcacgggcgucugucugu

SEQ ID NO: 382761 - RNA, 22 nt, Human
cuugaauccaaaugggagauga

SEQ ID NO: 382762 - RNA, 22 nt, Human
ccaucccuccuccaccagcuag

SEQ ID NO: 382763 - RNA, 22 nt, Human
caggccugacccugagcuucac

SEQ ID NO: 382764 - RNA, 22 nt, Human
gugugggcugcagaggcacagc

SEQ ID NO: 382765 - RNA, 22 nt, Human
gagagugagauaauuucacaua

SEQ ID NO: 382766 - RNA, 22 nt, Human
augaaggcuguguggagccccc

SEQ ID NO: 382767 - RNA, 22 nt, Human
cuguccuguggaccugaggacg

SEQ ID NO: 382768 - RNA, 22 nt, Human
gcuaugcaggagccuaaugaca

SEQ ID NO: 382769 - RNA, 22 nt, Human
cuccugguucagagagcugaga

SEQ ID NO: 382770 - RNA, 20 nt, Human
gugcauuucaccuguacugu

SEQ ID NO: 382771 - RNA, 22 nt, Human
ucuccuggucaccucagaaguc

SEQ ID NO: 382772 - RNA, 20 nt, Human
uauuucugggcaaccauuua

SEQ ID NO: 382773 - RNA, 19 nt, Human
ggccuggauuuagggcucc

SEQ ID NO: 382774 - RNA, 22 nt, Human
cugcuguguaucauuuuagaug

SEQ ID NO: 382775 - RNA, 22 nt, Human
cagccaggcccccgagucguug

SEQ ID NO: 382776 - RNA, 23 nt, Human
cccauuuucauguuaacuccugg

SEQ ID NO: 382777 - RNA, 22 nt, Human
uauaauuuuagaagagauggaa

SEQ ID NO: 382778 - RNA, 22 nt, Human
acauuucugcauguaggguaau

SEQ ID NO: 382779 - RNA, 22 nt, Human
cagcagccuacaaugcacagaa

SEQ ID NO: 382780 - RNA, 22 nt, Human
gcuacugauugaccuuggagag

SEQ ID NO: 382781 - RNA, 22 nt, Human
agaaggaguguacaggucaugc

SEQ ID NO: 382782 - RNA, 22 nt, Human
aggcacuggucuaccccuuagu

SEQ ID NO: 382783 - RNA, 22 nt, Human
gaguucaguguuucuaguagug

SEQ ID NO: 382784 - RNA, 22 nt, Human
uggcucagcugacucggcuucu

SEQ ID NO: 382785 - RNA, 22 nt, Human
ugcaggaacuugguuuuacuca

SEQ ID NO: 382786 - RNA, 23 nt, Human
ggcagagagcauggcuggggccc

SEQ ID NO: 382787 - RNA, 22 nt, Human
ucucuggaauuuugagagugac

SEQ ID NO: 382788 - RNA, 22 nt, Human
gccuucugcgcucgugucuccg

SEQ ID NO: 382789 - RNA, 22 nt, Human
gcccaggagccuggagaugugu

SEQ ID NO: 382790 - RNA, 22 nt, Human
augaggcaguacacacaaagcc

SEQ ID NO: 382791 - RNA, 22 nt, Human
acagcuguggggacucuugccc

SEQ ID NO: 382792 - RNA, 22 nt, Human
cugcuuuguguggucccuccag

SEQ ID NO: 382793 - RNA, 22 nt, Human
gagagugaggcaucaggggcag

SEQ ID NO: 382794 - RNA, 22 nt, Human
ggugcagaggagccagcugggg

SEQ ID NO: 382795 - RNA, 22 nt, Human
aggugucuucagggugagacag

SEQ ID NO: 382796 - RNA, 22 nt, Human
cuggcucaggguggucuggguc

SEQ ID NO: 382797 - RNA, 22 nt, Human
uuugugaaaugaagucacaacu

SEQ ID NO: 382798 - RNA, 22 nt, Human
guagggacccacagucuauauu

SEQ ID NO: 382799 - RNA, 22 nt, Human
aucuggcuuuuaccccacggcc

SEQ ID NO: 382800 - RNA, 22 nt, Human
gcugccugauguccagcaggac

SEQ ID NO: 382801 - RNA, 22 nt, Human
gcacccagggacuuggcuggcc

SEQ ID NO: 382802 - RNA, 19 nt, Human
cgcaggagccgaggugacc

SEQ ID NO: 382803 - RNA, 22 nt, Human
agcagagguguuuauuauggga

SEQ ID NO: 382804 - RNA, 22 nt, Human
aacaguaucuuuuaucagaaau

SEQ ID NO: 382805 - RNA, 22 nt, Human
aaugaugguuaaacacuggagg

SEQ ID NO: 382806 - RNA, 22 nt, Human
gagcugccggcccacaguacua

SEQ ID NO: 382807 - RNA, 22 nt, Human
guaacacagaaaugaaauucca

SEQ ID NO: 382808 - RNA, 22 nt, Human
uccuggcccgaucccugugaag

SEQ ID NO: 382809 - RNA, 22 nt, Human
cuggggacuugcagacacaauu

SEQ ID NO: 382810 - RNA, 22 nt, Human
agugccuugugugugggcagcc

SEQ ID NO: 382811 - RNA, 22 nt, Human
gcagagaguugggcugcgccag

SEQ ID NO: 382812 - RNA, 22 nt, Human
agaggaugguugaggaagaccu

SEQ ID NO: 382813 - RNA, 22 nt, Human
ugguccagaugccuuggcuuua

SEQ ID NO: 382814 - RNA, 22 nt, Human
uccuuccugcaggccaaguccu

SEQ ID NO: 382815 - RNA, 22 nt, Human
cugcugggucuaugcaagugga

SEQ ID NO: 382816 - RNA, 22 nt, Human
cacaagagagugcgcguugcaa

SEQ ID NO: 382817 - RNA, 22 nt, Human
aaaaguucccugguuagaaaag

SEQ ID NO: 382818 - RNA, 22 nt, Human
auuuccaagaaagcuuuaggau

SEQ ID NO: 382819 - RNA, 22 nt, Human
ccagggcaauuauuuggagggu

SEQ ID NO: 382820 - RNA, 22 nt, Human
ccugcccuagagaugacacaau

SEQ ID NO: 382821 - RNA, 22 nt, Human
ucauuguuucugcuuuucauga

SEQ ID NO: 382822 - RNA, 22 nt, Human
uuagccaugugggaaaaacagc

SEQ ID NO: 382823 - RNA, 22 nt, Human
uaggugugggcucaggaaugug

SEQ ID NO: 382824 - RNA, 22 nt, Human
acuuccuguuaugugugccucu

SEQ ID NO: 382825 - RNA, 22 nt, Human
cuggcaguguccagcucgugau

SEQ ID NO: 382826 - RNA, 19 nt, Human
cucagcuguagcucaugug

SEQ ID NO: 382827 - RNA, 22 nt, Human
ucugagaggcagaccuuccuaa

SEQ ID NO: 382828 - RNA, 19 nt, Human
uagaaugcccacuuaaaaa

SEQ ID NO: 382829 - RNA, 22 nt, Human
accugcagccacuucucuccuu

SEQ ID NO: 382830 - RNA, 20 nt, Human
uacugggcaagcccacagac

SEQ ID NO: 382831 - RNA, 21 nt, Human
aggucccagguuugggcagca

SEQ ID NO: 382832 - RNA, 22 nt, Human
ccagaggucuccugcacgggau

SEQ ID NO: 382833 - RNA, 22 nt, Human
ccuggaucuuucugacugacaa

SEQ ID NO: 382834 - RNA, 22 nt, Human
acacauaagccuaaucaucucc

SEQ ID NO: 382835 - RNA, 22 nt, Human
uggaaugacagagagucugaau

SEQ ID NO: 382836 - RNA, 22 nt, Human
acuugcauuauauuuaucacaa

SEQ ID NO: 382837 - RNA, 22 nt, Human
ggcucugcccagaugaagagga

SEQ ID NO: 382838 - RNA, 18 nt, Human
guuaauuuugaaguucau

SEQ ID NO: 382839 - RNA, 22 nt, Human
ugcacacacaugaaguagcaug

SEQ ID NO: 382840 - RNA, 22 nt, Human
gccaggaguucagaugcauguu

SEQ ID NO: 382841 - RNA, 20 nt, Human
auaaaauaacugccacaaga

SEQ ID NO: 382842 - RNA, 23 nt, Human
ggccauggagacuuagaaugggc

SEQ ID NO: 382843 - RNA, 22 nt, Human
uguuugcucugacuaucuugcg

SEQ ID NO: 382844 - RNA, 19 nt, Human
agaggccucagcagcuggc

SEQ ID NO: 382845 - RNA, 22 nt, Human
cuggggccacaacggcgcacgc

SEQ ID NO: 382846 - RNA, 22 nt, Human
agcagguguagggcucuuugua

SEQ ID NO: 382847 - RNA, 19 nt, Human
aggcagcaggccagggaug

SEQ ID NO: 382848 - RNA, 22 nt, Human
auagucacugccuuccauuugu

SEQ ID NO: 382849 - RNA, 22 nt, Human
gagcucauucauucauugccug

SEQ ID NO: 382850 - RNA, 18 nt, Human
caagaaucucuaaagaag

SEQ ID NO: 382851 - RNA, 22 nt, Human
ugggggagauugugcaucucua

SEQ ID NO: 382852 - RNA, 22 nt, Human
uccaggagguaugaguggcccc

SEQ ID NO: 382853 - RNA, 22 nt, Human
aggaaaaauaaggcagcagggc

SEQ ID NO: 382854 - RNA, 22 nt, Human
agaaauuccuaagguacacaag

SEQ ID NO: 382855 - RNA, 22 nt, Human
cugccagccaggccagguaggc

SEQ ID NO: 382856 - RNA, 22 nt, Human
ugccacagaggugaagcccacu

SEQ ID NO: 382857 - RNA, 23 nt, Human
uccuuccuuugagaggcuccauc

SEQ ID NO: 382858 - RNA, 22 nt, Human
aagcagcagaccugauuuugaa

SEQ ID NO: 382859 - RNA, 21 nt, Human
cugcucuggggaccggcugug

SEQ ID NO: 382860 - RNA, 22 nt, Human
uuguccuuggaugaagcuggga

SEQ ID NO: 382861 - RNA, 22 nt, Human
aaagcagacugauuugcaucac

SEQ ID NO: 382862 - RNA, 22 nt, Human
uucaaaacagcuagauauugga

SEQ ID NO: 382863 - RNA, 22 nt, Human
ggauucuaacugaacagaauau

SEQ ID NO: 382864 - RNA, 22 nt, Human
caggauccccaggucgccgucc

SEQ ID NO: 382865 - RNA, 22 nt, Human
uccagggagauacuggcugcca

SEQ ID NO: 382866 - RNA, 22 nt, Human
agacagagauacuauguuguca

SEQ ID NO: 382867 - RNA, 20 nt, Human
gugugaagcccucaggagga

SEQ ID NO: 382868 - RNA, 22 nt, Human
ucuuugcaggccaaauuguuaa

SEQ ID NO: 382869 - RNA, 22 nt, Human
augggugugaaaauggucaucu

SEQ ID NO: 382870 - RNA, 22 nt, Human
ugcuuaauacguauuugcugga

SEQ ID NO: 382871 - RNA, 22 nt, Human
uuuggaauauuaaaaugucuca

SEQ ID NO: 382872 - RNA, 22 nt, Human
ccaguggaaauguggucaggau

SEQ ID NO: 382873 - RNA, 22 nt, Human
aaagccagggacagugugcaug

SEQ ID NO: 382874 - RNA, 20 nt, Human
ucacauccucucccaacaug

SEQ ID NO: 382875 - RNA, 22 nt, Human
gccugaaguuucaugccucuau

SEQ ID NO: 382876 - RNA, 22 nt, Human
cuaggaggcgggggcugcagua

SEQ ID NO: 382877 - RNA, 22 nt, Human
aggacuccauguguccuggaga

SEQ ID NO: 382878 - RNA, 22 nt, Human
auccuugaaugacucugcccuc

SEQ ID NO: 382879 - RNA, 22 nt, Human
uacuuuuugucucuuugaaugu

SEQ ID NO: 382880 - RNA, 22 nt, Human
gucuugaucuccugaccuugug

SEQ ID NO: 382881 - RNA, 22 nt, Human
uagauaaauuagaaaguuuacu

SEQ ID NO: 382882 - RNA, 22 nt, Human
cucuuccucucaugcggucaua

SEQ ID NO: 382883 - RNA, 22 nt, Human
aaacagacugcacugccaguca

SEQ ID NO: 382884 - RNA, 22 nt, Human
agccauucauugugcucucaga

SEQ ID NO: 382885 - RNA, 22 nt, Human
gagcagaugugugccaggaugc

SEQ ID NO: 382886 - RNA, 22 nt, Human
cacucugacuggcccugcagga

SEQ ID NO: 382887 - RNA, 16 nt, Human
gcacacacaucaauga

SEQ ID NO: 382888 - RNA, 22 nt, Human
uucuggaggccccuuccuucuc

SEQ ID NO: 382889 - RNA, 22 nt, Human
ggcaggugcucugugggccugg

SEQ ID NO: 382890 - RNA, 22 nt, Human
uuauuauaaugagggauaaaaa

SEQ ID NO: 382891 - RNA, 22 nt, Human
gcuggcagacugggggcagaac

SEQ ID NO: 382892 - RNA, 22 nt, Human
uguaaaaccaaaucaaucuagu

SEQ ID NO: 382893 - RNA, 22 nt, Human
cuggcugccacuucagggucuu

SEQ ID NO: 382894 - RNA, 22 nt, Human
uggagcugggaguccugggcug

SEQ ID NO: 382895 - RNA, 22 nt, Human
gggacagcuguagugcuuggcu

SEQ ID NO: 382896 - RNA, 22 nt, Human
auguacaguggaaacuaacaaa

SEQ ID NO: 382897 - RNA, 22 nt, Human
cucagcagcagggaagagguca

SEQ ID NO: 382898 - RNA, 22 nt, Human
ugaccaaaggugguuuauuugg

SEQ ID NO: 382899 - RNA, 22 nt, Human
gcaagcaguuguggcuucugag

SEQ ID NO: 382900 - RNA, 22 nt, Human
ugaagguggcauaggagagaug

SEQ ID NO: 382901 - RNA, 22 nt, Human
aauggccagcugggagaguuga

SEQ ID NO: 382902 - RNA, 22 nt, Human
gcacacagccagcugagggcua

SEQ ID NO: 382903 - RNA, 22 nt, Human
uuugagaaaugggcucugugcu

SEQ ID NO: 382904 - RNA, 22 nt, Human
gugcuuaauacaugucaauaac

SEQ ID NO: 382905 - RNA, 22 nt, Human
gcuuugcauuguuuaaucagga

SEQ ID NO: 382906 - RNA, 22 nt, Human
uaaggccaauuaacaaccaggg

SEQ ID NO: 382907 - RNA, 17 nt, Human
cccugccaccaggaagc

SEQ ID NO: 382908 - RNA, 22 nt, Human
uaauuuauuucaacugccaagg

SEQ ID NO: 382909 - RNA, 22 nt, Human
aaggaagacacagaugaaguga

SEQ ID NO: 382910 - RNA, 22 nt, Human
ggcugcugcccaccccugcaug

SEQ ID NO: 382911 - RNA, 22 nt, Human
uucaaucauuuuuacauagucc

SEQ ID NO: 382912 - RNA, 22 nt, Human
ucagggcaccaaaaaagaugcc

SEQ ID NO: 382913 - RNA, 22 nt, Human
uccuucaguuaaagaucucaca

SEQ ID NO: 382914 - RNA, 22 nt, Human
agcagccaaaugaagauuuuac

SEQ ID NO: 382915 - RNA, 22 nt, Human
cacauaaguggguuccauugca

SEQ ID NO: 382916 - RNA, 22 nt, Human
aggaggaauacaauccagcagc

SEQ ID NO: 382917 - RNA, 22 nt, Human
aaggcagcaacuaauggaucuc

SEQ ID NO: 382918 - RNA, 22 nt, Human
cucuccagaauaugccgccgug

SEQ ID NO: 382919 - RNA, 22 nt, Human
agcuuuaugaggagaccuuagu

SEQ ID NO: 382920 - RNA, 22 nt, Human
ggcaccugcucaucuggacuca

SEQ ID NO: 382921 - RNA, 22 nt, Human
agaugcagaaaaacuaagugau

SEQ ID NO: 382922 - RNA, 22 nt, Human
gugcagugagcagugcagcacc

SEQ ID NO: 382923 - RNA, 19 nt, Human
acaagggcaggcaagguga

SEQ ID NO: 382924 - RNA, 22 nt, Human
agggucaguucugugagguguu

SEQ ID NO: 382925 - RNA, 22 nt, Human
cccaggucccgccccagcucua

SEQ ID NO: 382926 - RNA, 20 nt, Human
uucacagaggacucagguca

SEQ ID NO: 382927 - RNA, 22 nt, Human
uuucaguguaucuuccaaaagc

SEQ ID NO: 382928 - RNA, 22 nt, Human
ucuccuggauggaccuucucuu

SEQ ID NO: 382929 - RNA, 22 nt, Human
cccaggagcuucucucugccuc

SEQ ID NO: 382930 - RNA, 22 nt, Human
cagggcuagugacaccccaguc

SEQ ID NO: 382931 - RNA, 22 nt, Human
cagggccagcgucucgggcuau

SEQ ID NO: 382932 - RNA, 22 nt, Human
cagacagaccugcaagggcaca

SEQ ID NO: 382933 - RNA, 22 nt, Human
aggcagugcagaguccucuucu

SEQ ID NO: 382934 - RNA, 22 nt, Human
aaggcagcacagcaacugcuca

SEQ ID NO: 382935 - RNA, 22 nt, Human
uagaaguuaaaggaauacagaa

SEQ ID NO: 382936 - RNA, 21 nt, Human
agggccugugcucuccagguc

SEQ ID NO: 382937 - RNA, 22 nt, Human
cccaucaggaacccaggagccc

SEQ ID NO: 382938 - RNA, 22 nt, Human
uagaaaucagcaggcauaugua

SEQ ID NO: 382939 - RNA, 22 nt, Human
gacagggcgcccagccuguuuc

SEQ ID NO: 382940 - RNA, 22 nt, Human
aaagaauuuguacacccuacua

SEQ ID NO: 382941 - RNA, 22 nt, Human
uugcacagaugagggugaugcu

SEQ ID NO: 382942 - RNA, 22 nt, Human
cuggagccagccagggcccucu

SEQ ID NO: 382943 - RNA, 19 nt, Human
ugcuuccucaccaucuccc

SEQ ID NO: 382944 - RNA, 22 nt, Human
cagcugggagcuccauuagaua

SEQ ID NO: 382945 - RNA, 22 nt, Human
caggugcugcguggcggagcug

SEQ ID NO: 382946 - RNA, 21 nt, Human
acagagccgggcacaaagcug

SEQ ID NO: 382947 - RNA, 22 nt, Human
ugaagcaggcauugacugauga

SEQ ID NO: 382948 - RNA, 22 nt, Human
gauuuagagcaggaaugcaugg

SEQ ID NO: 382949 - RNA, 22 nt, Human
ggucucagacuggcaggcagug

SEQ ID NO: 382950 - RNA, 22 nt, Human
cucagggcuugaguguccagga

SEQ ID NO: 382951 - RNA, 22 nt, Human
uggcagcuccuggggccagcac

SEQ ID NO: 382952 - RNA, 22 nt, Human
gcauuguccugcuucugagugu

SEQ ID NO: 382953 - RNA, 22 nt, Human
cccagcuugcccaggacugagg

SEQ ID NO: 382954 - RNA, 22 nt, Human
uggccugguaccacauagauuu

SEQ ID NO: 382955 - RNA, 22 nt, Human
agggacagaugaaugacugagu

SEQ ID NO: 382956 - RNA, 22 nt, Human
ggcugaggcucaugccaucuug

SEQ ID NO: 382957 - RNA, 22 nt, Human
caauuucauggauaaaagaugu

SEQ ID NO: 382958 - RNA, 22 nt, Human
ggcauuuagagggcuuuucuga

SEQ ID NO: 382959 - RNA, 22 nt, Human
aaggagagagcuuugcuggaac

SEQ ID NO: 382960 - RNA, 22 nt, Human
aggggcuguggaaaccaacucu

SEQ ID NO: 382961 - RNA, 22 nt, Human
aaggccugcucagcugucugug

SEQ ID NO: 382962 - RNA, 22 nt, Human
caagagcuggguggcaagcuag

SEQ ID NO: 382963 - RNA, 22 nt, Human
guuccaaacaagucauaaagua

SEQ ID NO: 382964 - RNA, 22 nt, Human
ccagugggugcugggcucugcc

SEQ ID NO: 382965 - RNA, 22 nt, Human
uuagagucaaaauggcauguua

SEQ ID NO: 382966 - RNA, 22 nt, Human
gcauggcauuaacaagauggaa

SEQ ID NO: 382967 - RNA, 22 nt, Human
aggcaggagcaagcccuacaag

SEQ ID NO: 382968 - RNA, 21 nt, Human
uucucagagucuauuacaguu

SEQ ID NO: 382969 - RNA, 22 nt, Human
ugcuggguuaccuaagccuaaa

SEQ ID NO: 382970 - RNA, 22 nt, Human
gcccaggaggucaaguagcuau

SEQ ID NO: 382971 - RNA, 22 nt, Human
cagggcucccaaauaucucuuc

SEQ ID NO: 382972 - RNA, 22 nt, Human
auccaaaggugacacagaauac

SEQ ID NO: 382973 - RNA, 22 nt, Human
aaagacuagcauuuauauguac

SEQ ID NO: 382974 - RNA, 22 nt, Human
gggcaugguggcaggcaccugu

SEQ ID NO: 382975 - RNA, 22 nt, Human
agggcaugcuggaggagagaca

SEQ ID NO: 382976 - RNA, 22 nt, Human
uucaggauccccaccgcguuua

SEQ ID NO: 382977 - RNA, 22 nt, Human
ccggggacuuaaagugaaggaa

SEQ ID NO: 382978 - RNA, 22 nt, Human
ugucuuuagagucacaaaacca

SEQ ID NO: 382979 - RNA, 22 nt, Human
uggcagagagagugcagucgac

SEQ ID NO: 382980 - RNA, 18 nt, Human
acauacauucugucugca

SEQ ID NO: 382981 - RNA, 22 nt, Human
cagggccaccguguuugcugcu

SEQ ID NO: 382982 - RNA, 22 nt, Human
cacccaggcagguggcugagaa

SEQ ID NO: 382983 - RNA, 22 nt, Human
gggacagaaggaagugagcaca

SEQ ID NO: 382984 - RNA, 19 nt, Human
uggcugggcgugccuccgu

SEQ ID NO: 382985 - RNA, 22 nt, Human
ucccuguccugggcaaucccag

SEQ ID NO: 382986 - RNA, 22 nt, Human
agugggaggcggcugacgggcg

SEQ ID NO: 382987 - RNA, 22 nt, Human
aggagccaagcagaacuaagga

SEQ ID NO: 382988 - RNA, 22 nt, Human
gagggcugcaaugagacagaga

SEQ ID NO: 382989 - RNA, 23 nt, Human
ccuggaguacuaaggggauggaa

SEQ ID NO: 382990 - RNA, 22 nt, Human
ggaggaggggugacugaaugcu

SEQ ID NO: 382991 - RNA, 22 nt, Human
uaaaacugaauacauacugagg

SEQ ID NO: 382992 - RNA, 22 nt, Human
ccuggcagcuguuuggcuuggc

SEQ ID NO: 382993 - RNA, 22 nt, Human
agccucugcuuaugcaaaggua

SEQ ID NO: 382994 - RNA, 22 nt, Human
uggcugaguuacgaacagagca

SEQ ID NO: 382995 - RNA, 22 nt, Human
caguagcagggauuauuuuagg

SEQ ID NO: 382996 - RNA, 22 nt, Human
gcagaauuuucuguuuucuaga

SEQ ID NO: 382997 - RNA, 22 nt, Human
aacauuuaugguagucauugca

SEQ ID NO: 382998 - RNA, 22 nt, Human
ggaccagagaagugagcaccug

SEQ ID NO: 382999 - RNA, 22 nt, Human
acugaaggcuuucccaagguca

SEQ ID NO: 383000 - RNA, 23 nt, Human
uuccagaggaagaagucaugacu

SEQ ID NO: 383001 - RNA, 22 nt, Human
ucucagagaucuuucugcaugu

SEQ ID NO: 383002 - RNA, 22 nt, Human
gucauuccuuauguugauucag

SEQ ID NO: 383003 - RNA, 22 nt, Human
uucagugugugauaccugcugu

SEQ ID NO: 383004 - RNA, 22 nt, Human
uccucaggugacuagguaucuu

SEQ ID NO: 383005 - RNA, 22 nt, Human
aggcucaggugccucauucaca

SEQ ID NO: 383006 - RNA, 22 nt, Human
cauuucaaggaccacccuggga

SEQ ID NO: 383007 - RNA, 22 nt, Human
cagcacugcuucgcagccaggg

SEQ ID NO: 383008 - RNA, 22 nt, Human
cacaggagugcugcuauuguug

SEQ ID NO: 383009 - RNA, 22 nt, Human
ucucagggaccaugaugaugac

SEQ ID NO: 383010 - RNA, 22 nt, Human
agggcagagcacugaauuggga

SEQ ID NO: 383011 - RNA, 18 nt, Human
uucacaggaaaugucuuu

SEQ ID NO: 383012 - RNA, 22 nt, Human
auugaaagauaggcuacugugg

SEQ ID NO: 383013 - RNA, 22 nt, Human
aaagucaucagaaccuuccaga

SEQ ID NO: 383014 - RNA, 22 nt, Human
gcaaggcuuugugaauuuuaaa

SEQ ID NO: 383015 - RNA, 22 nt, Human
aggcuucuacguggucccaggg

SEQ ID NO: 383016 - RNA, 22 nt, Human
ugcaagggcuuagggggcugug

SEQ ID NO: 383017 - RNA, 22 nt, Human
ugaggcagccugcauuaaagag

SEQ ID NO: 383018 - RNA, 22 nt, Human
agggagccagaguugggagcuc

SEQ ID NO: 383019 - RNA, 22 nt, Human
ucuggccaacaaaaacuaaguc

SEQ ID NO: 383020 - RNA, 22 nt, Human
ggcucccugccuguccucaguc

SEQ ID NO: 383021 - RNA, 22 nt, Human
gcaggagacuggcugugguagu

SEQ ID NO: 383022 - RNA, 22 nt, Human
gcccaggaguugaaugcagcag

SEQ ID NO: 383023 - RNA, 22 nt, Human
aucaggauagugguuaccuggg

SEQ ID NO: 383024 - RNA, 22 nt, Human
cuuccucacggugcaacaggaa

SEQ ID NO: 383025 - RNA, 22 nt, Human
aggugcaguggcucaugccugu

SEQ ID NO: 383026 - RNA, 22 nt, Human
ccugggcucaagugauccuccu

SEQ ID NO: 383027 - RNA, 22 nt, Human
ucacagaagaugcuggauguug

SEQ ID NO: 383028 - RNA, 22 nt, Human
ugggcuccuugggagcaaguga

SEQ ID NO: 383029 - RNA, 22 nt, Human
cagggcucgcucgcucgcucgc

SEQ ID NO: 383030 - RNA, 22 nt, Human
cagcuuugcaggcuggucagug

SEQ ID NO: 383031 - RNA, 22 nt, Human
cugggcuguucugccccugggu

SEQ ID NO: 383032 - RNA, 22 nt, Human
guuuccauggcucuguuaaugg

SEQ ID NO: 383033 - RNA, 22 nt, Human
auugaaagcacaaagaacaagu

SEQ ID NO: 383034 - RNA, 22 nt, Human
ugccucagucuaaagucucuca

SEQ ID NO: 383035 - RNA, 22 nt, Human
agggcugacacaccuuauccuc

SEQ ID NO: 383036 - RNA, 21 nt, Human
uucaaagagugggcauuguca

SEQ ID NO: 383037 - RNA, 22 nt, Human
accauccugaaaccuucaugcu

SEQ ID NO: 383038 - RNA, 22 nt, Human
gcaggaagaugagcucagguaa

SEQ ID NO: 383039 - RNA, 22 nt, Human
guuuggggucugcagagcggcg

SEQ ID NO: 383040 - RNA, 22 nt, Human
uggggguguccuggugcacaca

SEQ ID NO: 383041 - RNA, 22 nt, Human
uacccagggcuuuucugaugca

SEQ ID NO: 383042 - RNA, 18 nt, Human
uggagccauugccaccau

SEQ ID NO: 383043 - RNA, 20 nt, Human
uacagacaugacaauaaugg

SEQ ID NO: 383044 - RNA, 22 nt, Human
ccuggccacucagguguggggc

SEQ ID NO: 383045 - RNA, 22 nt, Human
agugugaccuuauuuggaaaca

SEQ ID NO: 383046 - RNA, 22 nt, Human
uggccugcagaggcuguggggc

SEQ ID NO: 383047 - RNA, 22 nt, Human
uaaagacaugguguaggugaac

SEQ ID NO: 383048 - RNA, 22 nt, Human
ucagcuuuuuacaugugaaaua

SEQ ID NO: 383049 - RNA, 19 nt, Human
uggagaggaaaugcugcuc

SEQ ID NO: 383050 - RNA, 22 nt, Human
ccugccaggcuuugggcuucug

SEQ ID NO: 383051 - RNA, 22 nt, Human
gccagcaguauguccuggcagu

SEQ ID NO: 383052 - RNA, 22 nt, Human
ucucccacagucucccauggcu

SEQ ID NO: 383053 - RNA, 22 nt, Human
gggcccuggauuuaagcaugga

SEQ ID NO: 383054 - RNA, 22 nt, Human
gcugucccgcugacuuccagcu

SEQ ID NO: 383055 - RNA, 22 nt, Human
gcucaggagcucuugguggcgc

SEQ ID NO: 383056 - RNA, 22 nt, Human
cagcaaaauuugaggauugccu

SEQ ID NO: 383057 - RNA, 22 nt, Human
aauacaguaauuuugaugaguu

SEQ ID NO: 383058 - RNA, 22 nt, Human
cagaguacugggagaacagaag

SEQ ID NO: 383059 - RNA, 21 nt, Human
ccucugcucgggcaugcguuu

SEQ ID NO: 383060 - RNA, 22 nt, Human
augcuguguuugagaaccuagg

SEQ ID NO: 383061 - RNA, 22 nt, Human
ugcaggcuuuagccccauggcu

SEQ ID NO: 383062 - RNA, 23 nt, Human
cagcccuuccugcauguuuuugu

SEQ ID NO: 383063 - RNA, 22 nt, Human
cggagaggaccugcaacucgcu

SEQ ID NO: 383064 - RNA, 17 nt, Human
ccugggaggaguuauga

SEQ ID NO: 383065 - RNA, 22 nt, Human
agaugguuuugucuuuaugauu

SEQ ID NO: 383066 - RNA, 22 nt, Human
cagaggaaaugggaaggagaua

SEQ ID NO: 383067 - RNA, 22 nt, Human
aggcaucugaguuugcaagcuu

SEQ ID NO: 383068 - RNA, 22 nt, Human
uggcagcugcguuguguuucug

SEQ ID NO: 383069 - RNA, 22 nt, Human
ccagcuauugcuguguaacagu

SEQ ID NO: 383070 - RNA, 22 nt, Human
gcuuccuaaaugcacagggcag

SEQ ID NO: 383071 - RNA, 22 nt, Human
aggggugugcauccuggaggau

SEQ ID NO: 383072 - RNA, 22 nt, Human
agugaaaugauaguguaaauac

SEQ ID NO: 383073 - RNA, 21 nt, Human
ugcagagauaucugaagcaga

SEQ ID NO: 383074 - RNA, 22 nt, Human
gucuucuguaagaugagguccc

SEQ ID NO: 383075 - RNA, 22 nt, Human
ccagagagcuacaaggcauaaa

SEQ ID NO: 383076 - RNA, 22 nt, Human
aaaucaguucucccuuucuuca

SEQ ID NO: 383077 - RNA, 22 nt, Human
uccuuuggagcuugacugguag

SEQ ID NO: 383078 - RNA, 22 nt, Human
uagagcuggaauuugcagcaag

SEQ ID NO: 383079 - RNA, 22 nt, Human
uauggcuuuucauuccuaugug

SEQ ID NO: 383080 - RNA, 22 nt, Human
ugcacauucacuuagguauugu

SEQ ID NO: 383081 - RNA, 20 nt, Human
ucagauuuuucuaacuuuga

SEQ ID NO: 383082 - RNA, 22 nt, Human
aaacaggcaucacucagcaaag

SEQ ID NO: 383083 - RNA, 19 nt, Human
ggucagcugggcuagaggc

SEQ ID NO: 383084 - RNA, 21 nt, Human
cugcuguggcccccgacaugc

SEQ ID NO: 383085 - RNA, 23 nt, Human
gagauuuagcagacaaagcucuu

SEQ ID NO: 383086 - RNA, 22 nt, Human
ucugcugucacucauuugcuuc

SEQ ID NO: 383087 - RNA, 22 nt, Human
ugugaaagcaagucuaguucuc

SEQ ID NO: 383088 - RNA, 22 nt, Human
uggaaggaaagguagcagagaa

SEQ ID NO: 383089 - RNA, 22 nt, Human
gggagggaaggaggcgccgugu

SEQ ID NO: 383090 - RNA, 23 nt, Human
gaguguucauagcaggcucuugc

SEQ ID NO: 383091 - RNA, 22 nt, Human
ucaauacuuaagcuuaauucua

SEQ ID NO: 383092 - RNA, 22 nt, Human
caauauauaggaacaacuuagg

SEQ ID NO: 383093 - RNA, 22 nt, Human
cacaccuguaauaccagcuacu

SEQ ID NO: 383094 - RNA, 22 nt, Human
agcagcuguggaaaaguaacua

SEQ ID NO: 383095 - RNA, 22 nt, Human
aggguggagggagucccugagc

SEQ ID NO: 383096 - RNA, 22 nt, Human
ggcuuuauauuguuugagcaga

SEQ ID NO: 383097 - RNA, 22 nt, Human
ugucaugcccaggagcaaggua

SEQ ID NO: 383098 - RNA, 22 nt, Human
gugcuuuuaaaggcaauuagua

SEQ ID NO: 383099 - RNA, 22 nt, Human
ucugcuguauuagguugaacug

SEQ ID NO: 383100 - RNA, 22 nt, Human
uguuuguucccucucuuuccug

SEQ ID NO: 383101 - RNA, 22 nt, Human
gaagcacauggcuauagcuauu

SEQ ID NO: 383102 - RNA, 22 nt, Human
augcugaauugaugcgagggag

SEQ ID NO: 383103 - RNA, 19 nt, Human
acccagagcccuuugcagg

SEQ ID NO: 383104 - RNA, 22 nt, Human
aggcugcuucaauggauaagau

SEQ ID NO: 383105 - RNA, 22 nt, Human
aaucauaauuguauacauucau

SEQ ID NO: 383106 - RNA, 22 nt, Human
aagggcagccugacucacgguc

SEQ ID NO: 383107 - RNA, 22 nt, Human
acuucuucuucagcugggggau

SEQ ID NO: 383108 - RNA, 22 nt, Human
uccaggcacgaggcccugugca

SEQ ID NO: 383109 - RNA, 22 nt, Human
gcucccagggcagcgcagaaga

SEQ ID NO: 383110 - RNA, 22 nt, Human
acagauuuauugaagcugcugc

SEQ ID NO: 383111 - RNA, 22 nt, Human
ccuggcagacagcacugaagcu

SEQ ID NO: 383112 - RNA, 22 nt, Human
acccagaggcggagguugcagu

SEQ ID NO: 383113 - RNA, 23 nt, Human
agcaggaaaccgagggugauguu

SEQ ID NO: 383114 - RNA, 22 nt, Human
aaaguguagagacuuuggaacc

SEQ ID NO: 383115 - RNA, 22 nt, Human
gaggagaaauuuggggaccuga

SEQ ID NO: 383116 - RNA, 22 nt, Human
ugaaaaggguagaucccuaagu

SEQ ID NO: 383117 - RNA, 18 nt, Human
cucucugggugaggacaa

SEQ ID NO: 383118 - RNA, 22 nt, Human
gggagaaggaggacugugcugu

SEQ ID NO: 383119 - RNA, 22 nt, Human
uuuaaauucugucugccgcuua

SEQ ID NO: 383120 - RNA, 23 nt, Human
aggcccugccugucccucuuuuu

SEQ ID NO: 383121 - RNA, 22 nt, Human
aucuggcuuacgaagcacuggu

SEQ ID NO: 383122 - RNA, 22 nt, Human
ucagagugcagggaguagcagc

SEQ ID NO: 383123 - RNA, 22 nt, Human
accaaggaagagauucucaguu

SEQ ID NO: 383124 - RNA, 22 nt, Human
agcugagagguggcaagcugua

SEQ ID NO: 383125 - RNA, 22 nt, Human
ccaggcagggcucaaggaaccu

SEQ ID NO: 383126 - RNA, 22 nt, Human
caccaggcugaaccagagggga

SEQ ID NO: 383127 - RNA, 22 nt, Human
uggaccugcguaggugcugggc

SEQ ID NO: 383128 - RNA, 22 nt, Human
cccuuccuugugacuggugggg

SEQ ID NO: 383129 - RNA, 22 nt, Human
ucauugcaguugaguuguguua

SEQ ID NO: 383130 - RNA, 22 nt, Human
cauugacaguucuuuaaguugc

SEQ ID NO: 383131 - RNA, 22 nt, Human
cauauuucagucuaagaugugu

SEQ ID NO: 383132 - RNA, 22 nt, Human
uuauuauuggugaguuaaggaa

SEQ ID NO: 383133 - RNA, 22 nt, Human
agaggcuguuacacucccagau

SEQ ID NO: 383134 - RNA, 22 nt, Human
guuuuccacuggauuguuugga

SEQ ID NO: 383135 - RNA, 22 nt, Human
agcccuucaaccugccuacucc

SEQ ID NO: 383136 - RNA, 22 nt, Human
ugugcugguacaugugaggaug

SEQ ID NO: 383137 - RNA, 22 nt, Human
cuuuggcaaugucauuuucaau

SEQ ID NO: 383138 - RNA, 22 nt, Human
ucaguuuuuaaaugauauaauu

SEQ ID NO: 383139 - RNA, 22 nt, Human
guuuucaugucuauugggcaua

SEQ ID NO: 383140 - RNA, 22 nt, Human
cacauacaaugguguuauuugg

SEQ ID NO: 383141 - RNA, 22 nt, Human
ugaaaugacagucuuaagcucu

SEQ ID NO: 383142 - RNA, 22 nt, Human
aagagcauggaauggagaucca

SEQ ID NO: 383143 - RNA, 22 nt, Human
uggcaagagggaugcaagguuu

SEQ ID NO: 383144 - RNA, 21 nt, Human
cagacccucuagaggccaccu

SEQ ID NO: 383145 - RNA, 22 nt, Human
aucacuguguauguauaugcag

SEQ ID NO: 383146 - RNA, 22 nt, Human
aggaaccagagguugagcaacu

SEQ ID NO: 383147 - RNA, 21 nt, Human
aaggaaaagcuuggucucuga

SEQ ID NO: 383148 - RNA, 22 nt, Human
uuugcauuccugccugcauuca

SEQ ID NO: 383149 - RNA, 19 nt, Human
ugagaaggcaguggggagc

SEQ ID NO: 383150 - RNA, 22 nt, Human
guccucuguuagaaaugugcuu

SEQ ID NO: 383151 - RNA, 22 nt, Human
ucccagagucagagguggggcc

SEQ ID NO: 383152 - RNA, 22 nt, Human
aucauguuccagaaacagugau

SEQ ID NO: 383153 - RNA, 22 nt, Human
ggagaagccacacauugggugu

SEQ ID NO: 383154 - RNA, 22 nt, Human
uggcugagaaaaugguuuuagg

SEQ ID NO: 383155 - RNA, 22 nt, Human
ugaggcagggaguuuaauuguc

SEQ ID NO: 383156 - RNA, 22 nt, Human
agauuucagguuggggcagaag

SEQ ID NO: 383157 - RNA, 22 nt, Human
gcagacuguaucaaugucagua

SEQ ID NO: 383158 - RNA, 22 nt, Human
uuucagauuaucucaacuuugg

SEQ ID NO: 383159 - RNA, 22 nt, Human
ucauaaaguucuaagaauugua

SEQ ID NO: 383160 - RNA, 22 nt, Human
gccacagggcagaugcgcagag

SEQ ID NO: 383161 - RNA, 22 nt, Human
cagaagaggacuggguagcuca

SEQ ID NO: 383162 - RNA, 22 nt, Human
aauugcuaaagauuauguuuuc

SEQ ID NO: 383163 - RNA, 22 nt, Human
ggacacagauaaucacacagau

SEQ ID NO: 383164 - RNA, 22 nt, Human
cugggugguucuaacuguugau

SEQ ID NO: 383165 - RNA, 22 nt, Human
uggcagagugcggcauccccug

SEQ ID NO: 383166 - RNA, 22 nt, Human
ugaugaauaaacuugagaguca

SEQ ID NO: 383167 - RNA, 17 nt, Human
aggcaggcagagcggga

SEQ ID NO: 383168 - RNA, 23 nt, Human
cugucuccugggcuagguggaau

SEQ ID NO: 383169 - RNA, 22 nt, Human
uaugaagaaaccuauccucuag

SEQ ID NO: 383170 - RNA, 22 nt, Human
acagaggucauggagaguucuc

SEQ ID NO: 383171 - RNA, 22 nt, Human
gcuggcuguuggagguaccugc

SEQ ID NO: 383172 - RNA, 23 nt, Human
auagaagauuauugcaacagucc

SEQ ID NO: 383173 - RNA, 22 nt, Human
guaugcaucgacucaagucuga

SEQ ID NO: 383174 - RNA, 22 nt, Human
ccugccagucacuaugucaccu

SEQ ID NO: 383175 - RNA, 22 nt, Human
acugcccucccaucuauugcaa

SEQ ID NO: 383176 - RNA, 22 nt, Human
gccugcagggcccuuguggguc

SEQ ID NO: 383177 - RNA, 22 nt, Human
ggacucagcagccaggaguggc

SEQ ID NO: 383178 - RNA, 22 nt, Human
gcuguguccucacacagccuuu

SEQ ID NO: 383179 - RNA, 20 nt, Human
cagcaguggaugagaguuuu

SEQ ID NO: 383180 - RNA, 20 nt, Human
uuggcucugaucaguggagc

SEQ ID NO: 383181 - RNA, 22 nt, Human
agaugauggccauguccucucc

SEQ ID NO: 383182 - RNA, 22 nt, Human
cagcuuccgaccgggggcugca

SEQ ID NO: 383183 - RNA, 20 nt, Human
auaauuuacccugcaccacu

SEQ ID NO: 383184 - RNA, 22 nt, Human
cuucuucaaccugaaaguuuca

SEQ ID NO: 383185 - RNA, 22 nt, Human
aaucagaacuccuaccacagag

SEQ ID NO: 383186 - RNA, 22 nt, Human
uucaaacaaaacuguucccaua

SEQ ID NO: 383187 - RNA, 22 nt, Human
aaguuucaugauguaauuauug

SEQ ID NO: 383188 - RNA, 22 nt, Human
cuucuuaaaguugucacagcug

SEQ ID NO: 383189 - RNA, 22 nt, Human
gucaugccuggcuucuuagaca

SEQ ID NO: 383190 - RNA, 22 nt, Human
cucuccuggggagcacacacac

SEQ ID NO: 383191 - RNA, 21 nt, Human
gugguucuagagaaacagaau

SEQ ID NO: 383192 - RNA, 22 nt, Human
cccugagaugccucacccuagu

SEQ ID NO: 383193 - RNA, 22 nt, Human
ugcauuauuugcaugugccugu

SEQ ID NO: 383194 - RNA, 22 nt, Human
acuuuggaucugauguaaucag

SEQ ID NO: 383195 - RNA, 22 nt, Human
gggcagagguucaacuucaaca

SEQ ID NO: 383196 - RNA, 22 nt, Human
ccuggugccacuagagaauguc

SEQ ID NO: 383197 - RNA, 22 nt, Human
gggcuggcaucgguugcugaga

SEQ ID NO: 383198 - RNA, 22 nt, Human
aguccuuagaacagugccuggg

SEQ ID NO: 383199 - RNA, 22 nt, Human
caggcugagcucuggccugggc

SEQ ID NO: 383200 - RNA, 20 nt, Human
agcccaggccugugugaguc

SEQ ID NO: 383201 - RNA, 22 nt, Human
ugggccacgugacccuuacccu

SEQ ID NO: 383202 - RNA, 22 nt, Human
aggcccagggcugcucucugaa

SEQ ID NO: 383203 - RNA, 22 nt, Human
aggagcugacuuguaaagcauu

SEQ ID NO: 383204 - RNA, 22 nt, Human
ugcagugguguccagguguacu

SEQ ID NO: 383205 - RNA, 22 nt, Human
uugcuucaguagcucuuuaaag

SEQ ID NO: 383206 - RNA, 22 nt, Human
cugggccagucucggccgcucu

SEQ ID NO: 383207 - RNA, 22 nt, Human
guaaaucccauccuuucucugg

SEQ ID NO: 383208 - RNA, 22 nt, Human
caagcagagacuagauagcugu

SEQ ID NO: 383209 - RNA, 22 nt, Human
uccuuugguuguagacaggaau

SEQ ID NO: 383210 - RNA, 22 nt, Human
agagcuguucagcagccagguu

SEQ ID NO: 383211 - RNA, 22 nt, Human
uccaugaguuugaggaaaagag

SEQ ID NO: 383212 - RNA, 20 nt, Human
cuccagggaacagacuggag

SEQ ID NO: 383213 - RNA, 22 nt, Human
auucuuaaauuuaggucuguga

SEQ ID NO: 383214 - RNA, 22 nt, Human
agcucccaauugacuugaacua

SEQ ID NO: 383215 - RNA, 23 nt, Human
uucaagauacgguuuccaggcug

SEQ ID NO: 383216 - RNA, 22 nt, Human
ugucucugaacagcuuacuaaa

SEQ ID NO: 383217 - RNA, 22 nt, Human
gcagaggacagggauuuagauu

SEQ ID NO: 383218 - RNA, 22 nt, Human
auucuuggcaaggagauuuaaa

SEQ ID NO: 383219 - RNA, 22 nt, Human
uaguggagaaguggagucugug

SEQ ID NO: 383220 - RNA, 21 nt, Human
uccaggagcacgggacuagga

SEQ ID NO: 383221 - RNA, 18 nt, Human
ggccugaggauuucagca

SEQ ID NO: 383222 - RNA, 22 nt, Human
gugcauuuaggucacaugaugu

SEQ ID NO: 383223 - RNA, 22 nt, Human
ucuggaucucccucauccuggg

SEQ ID NO: 383224 - RNA, 18 nt, Human
caguuuuuauaucuggca

SEQ ID NO: 383225 - RNA, 22 nt, Human
aagcuggagaguuaggugaaua

SEQ ID NO: 383226 - RNA, 22 nt, Human
auuuccuauagauauggugagu

SEQ ID NO: 383227 - RNA, 22 nt, Human
aaggcagccagauccuuugggu

SEQ ID NO: 383228 - RNA, 22 nt, Human
acuuggagagcauugcugggga

SEQ ID NO: 383229 - RNA, 22 nt, Human
accaugggucagccaccucagc

SEQ ID NO: 383230 - RNA, 19 nt, Human
acaggcagaauugggugug

SEQ ID NO: 383231 - RNA, 22 nt, Human
guauuauuggguaguaugguaa

SEQ ID NO: 383232 - RNA, 22 nt, Human
gcuggcugaggucuagcucuuu

SEQ ID NO: 383233 - RNA, 22 nt, Human
aaaggccagguuggcugguauu

SEQ ID NO: 383234 - RNA, 22 nt, Human
cccaggaggucgaagcugcagu

SEQ ID NO: 383235 - RNA, 22 nt, Human
cccagaaggucgaggcugcagu

SEQ ID NO: 383236 - RNA, 22 nt, Human
ugcuuuauucaggguuuacccc

SEQ ID NO: 383237 - RNA, 22 nt, Human
agugaggcuaauaggcaauggu

SEQ ID NO: 383238 - RNA, 22 nt, Human
gagaaagacguaggcugggagg

SEQ ID NO: 383239 - RNA, 19 nt, Human
guucaaacacugauucagc

SEQ ID NO: 383240 - RNA, 21 nt, Human
cugaggcagcacagcuaguca

SEQ ID NO: 383241 - RNA, 22 nt, Human
ugaaagcacaaguucuaacagg

SEQ ID NO: 383242 - RNA, 22 nt, Human
ccacagggaacaugacagccuu

SEQ ID NO: 383243 - RNA, 22 nt, Human
ucauugcaagcucauuuaucug

SEQ ID NO: 383244 - RNA, 22 nt, Human
agaaaguucacugguauauuuu

SEQ ID NO: 383245 - RNA, 22 nt, Human
cuagaaauacaggcacgugcca

SEQ ID NO: 383246 - RNA, 22 nt, Human
ucugggcccuaaaccagcucua

SEQ ID NO: 383247 - RNA, 22 nt, Human
uguacaauggcuauaauacccu

SEQ ID NO: 383248 - RNA, 22 nt, Human
cagaggcucaccagccuuucac

SEQ ID NO: 383249 - RNA, 18 nt, Human
acauuucuaugcuucugg

SEQ ID NO: 383250 - RNA, 22 nt, Human
uuaugggagcaauuggggaggu

SEQ ID NO: 383251 - RNA, 22 nt, Human
cagcugcccaagccccagaugu

SEQ ID NO: 383252 - RNA, 22 nt, Human
agccagugggauuagagccucu

SEQ ID NO: 383253 - RNA, 22 nt, Human
ccuggagaccagaggauacuuc

SEQ ID NO: 383254 - RNA, 22 nt, Human
aggagugggggcgagaaguuaa

SEQ ID NO: 383255 - RNA, 22 nt, Human
uggcagaguaggauggcccugu

SEQ ID NO: 383256 - RNA, 22 nt, Human
uaagaaucgauguuuauuuaga

SEQ ID NO: 383257 - RNA, 22 nt, Human
gcugcagugagccaagaucgug

SEQ ID NO: 383258 - RNA, 22 nt, Human
cugggagcccgcguccuggugg

SEQ ID NO: 383259 - RNA, 22 nt, Human
aucaggauuauuaaaucuggau

SEQ ID NO: 383260 - RNA, 22 nt, Human
aggcaccuugagagcaggagcu

SEQ ID NO: 383261 - RNA, 21 nt, Human
uggcucuggguaggagagugc

SEQ ID NO: 383262 - RNA, 22 nt, Human
cccagcccagcguucgaggggu

SEQ ID NO: 383263 - RNA, 22 nt, Human
auuguggugucaguuauaggca

SEQ ID NO: 383264 - RNA, 22 nt, Human
ggcuucuuccugugaacauguu

SEQ ID NO: 383265 - RNA, 22 nt, Human
uaaguccuucaccuaauccuca

SEQ ID NO: 383266 - RNA, 22 nt, Human
aaaugcaggaaauuaugcuuuu

SEQ ID NO: 383267 - RNA, 22 nt, Human
ucccaggaugugcgugccgccg

SEQ ID NO: 383268 - RNA, 22 nt, Human
uuuuccuauaugcaaagaaugc

SEQ ID NO: 383269 - RNA, 19 nt, Human
auagucuuuccaauuauac

SEQ ID NO: 383270 - RNA, 22 nt, Human
aagagcugauuaagucaugagg

SEQ ID NO: 383271 - RNA, 20 nt, Human
cauuugaaucuccauucugc

SEQ ID NO: 383272 - RNA, 22 nt, Human
cuggcagcgguuugcagccugg

SEQ ID NO: 383273 - RNA, 22 nt, Human
gccaggcugacucccccggccu

SEQ ID NO: 383274 - RNA, 22 nt, Human
gaagccacuauagauauucuaa

SEQ ID NO: 383275 - RNA, 22 nt, Human
agacaaagaaaccguagaagca

SEQ ID NO: 383276 - RNA, 22 nt, Human
gcuuccugagaaacaaucugau

SEQ ID NO: 383277 - RNA, 22 nt, Human
agggcagccucucagccuaggu

SEQ ID NO: 383278 - RNA, 22 nt, Human
gggacuggaacuacuggugcag

SEQ ID NO: 383279 - RNA, 22 nt, Human
gaggugagaagggggucagaug

SEQ ID NO: 383280 - RNA, 22 nt, Human
agcugcaggccucuccugggga

SEQ ID NO: 383281 - RNA, 22 nt, Human
aaaugcacagguuuuaaauccu

SEQ ID NO: 383282 - RNA, 22 nt, Human
caauguguguguuuuucucaac

SEQ ID NO: 383283 - RNA, 22 nt, Human
ucucccuggagcccugaagcau

SEQ ID NO: 383284 - RNA, 22 nt, Human
uguggcagaaccagaauucaaa

SEQ ID NO: 383285 - RNA, 22 nt, Human
gccaggcagccacccucugcga

SEQ ID NO: 383286 - RNA, 22 nt, Human
acuccugguuuguguccuggcu

SEQ ID NO: 383287 - RNA, 22 nt, Human
agcuuguuaaggaugcauauua

SEQ ID NO: 383288 - RNA, 21 nt, Human
agaggccuuacaggauagacc

SEQ ID NO: 383289 - RNA, 22 nt, Human
ucccagagcucugacaccagcu

SEQ ID NO: 383290 - RNA, 22 nt, Human
caagaaucaacauuauuuagug

SEQ ID NO: 383291 - RNA, 17 nt, Human
gauuuccugaaguucuu

SEQ ID NO: 383292 - RNA, 22 nt, Human
ugcauccuuaaccagcaucacu

SEQ ID NO: 383293 - RNA, 22 nt, Human
ucuuccugaaacccuguuccag

SEQ ID NO: 383294 - RNA, 22 nt, Human
ggacuccucuagaaguugaggc

SEQ ID NO: 383295 - RNA, 22 nt, Human
auguauguuaguguauuaucua

SEQ ID NO: 383296 - RNA, 21 nt, Human
uucaaugaaaacaaagugagg

SEQ ID NO: 383297 - RNA, 22 nt, Human
agaggagguggugaugcuuuaa

SEQ ID NO: 383298 - RNA, 22 nt, Human
ccucaugguacuuacuguagcu

SEQ ID NO: 383299 - RNA, 22 nt, Human
uucuuaaagaggcaaaacacag

SEQ ID NO: 383300 - RNA, 22 nt, Human
acaaaggcauagugaauguuuu

SEQ ID NO: 383301 - RNA, 22 nt, Human
ccugugugucugucacugcaca

SEQ ID NO: 383302 - RNA, 22 nt, Human
acauuucuauagugcaucuguu

SEQ ID NO: 383303 - RNA, 22 nt, Human
aauguucauugauuaaaugaau

SEQ ID NO: 383304 - RNA, 22 nt, Human
gacaguccuugcccaguaucua

SEQ ID NO: 383305 - RNA, 22 nt, Human
ucuggcaggcaaucggcucugg

SEQ ID NO: 383306 - RNA, 22 nt, Human
gggcuggcgggaaaggcaauuc

SEQ ID NO: 383307 - RNA, 22 nt, Human
cuggcuugcagcucaucauaaa

SEQ ID NO: 383308 - RNA, 22 nt, Human
aggcacugggaauaugcugagg

SEQ ID NO: 383309 - RNA, 21 nt, Human
ggagauggguaucgccugggc

SEQ ID NO: 383310 - RNA, 22 nt, Human
cucugggcuuguugaccugcac

SEQ ID NO: 383311 - RNA, 22 nt, Human
ucucccagugucuggcagucag

SEQ ID NO: 383312 - RNA, 22 nt, Human
acuauacauugaauguuaaggu

SEQ ID NO: 383313 - RNA, 22 nt, Human
augaaaacuuuagccucauuag

SEQ ID NO: 383314 - RNA, 22 nt, Human
cgugagcaaaauggacacuccc

SEQ ID NO: 383315 - RNA, 18 nt, Human
agcuggcccuggcugccg

SEQ ID NO: 383316 - RNA, 17 nt, Human
aggcuggcucacaggga

SEQ ID NO: 383317 - RNA, 22 nt, Human
aauuagggaaaacauuugcuuu

SEQ ID NO: 383318 - RNA, 22 nt, Human
cugugcaguaggucagggcugg

SEQ ID NO: 383319 - RNA, 22 nt, Human
uggaggaaguggcuggccagaa

SEQ ID NO: 383320 - RNA, 22 nt, Human
uaggccagcccuuaguccuguc

SEQ ID NO: 383321 - RNA, 22 nt, Human
cagaggcagaauggagauuugg

SEQ ID NO: 383322 - RNA, 22 nt, Human
ccccuuccaggaagcagaaucg

SEQ ID NO: 383323 - RNA, 22 nt, Human
auucugauaucuuauucuagcu

SEQ ID NO: 383324 - RNA, 22 nt, Human
aaaauguaaagcuugaguguag

SEQ ID NO: 383325 - RNA, 20 nt, Human
uuggucagugguucaguuug

SEQ ID NO: 383326 - RNA, 22 nt, Human
cucacugugaccucagcagaca

SEQ ID NO: 383327 - RNA, 22 nt, Human
cacaauacuauuuuuaggucuu

SEQ ID NO: 383328 - RNA, 22 nt, Human
agguaaaauagauaguauuucu

SEQ ID NO: 383329 - RNA, 22 nt, Human
auaaauaucacuguugucccuc

SEQ ID NO: 383330 - RNA, 22 nt, Human
aaaugcauguagaauaauagag

SEQ ID NO: 383331 - RNA, 22 nt, Human
uagaggcacccuggaggagacu

SEQ ID NO: 383332 - RNA, 22 nt, Human
uuucccaaguguaaacauggca

SEQ ID NO: 383333 - RNA, 18 nt, Human
gacccagcagaugggcuu

SEQ ID NO: 383334 - RNA, 22 nt, Human
uucacagggcagcagcugagcc

SEQ ID NO: 383335 - RNA, 22 nt, Human
agcuuccuuggcgcugaggccu

SEQ ID NO: 383336 - RNA, 22 nt, Human
aaauaaguaguuuaguguugug

SEQ ID NO: 383337 - RNA, 22 nt, Human
cacagggcuaaaugaaggguug

SEQ ID NO: 383338 - RNA, 22 nt, Human
aauauaugugguauugaccagc

SEQ ID NO: 383339 - RNA, 22 nt, Human
guugaaaguggagaaccugguu

SEQ ID NO: 383340 - RNA, 22 nt, Human
cagaguguuagcgcugguuggg

SEQ ID NO: 383341 - RNA, 20 nt, Human
aggagggaccuggauuggcg

SEQ ID NO: 383342 - RNA, 22 nt, Human
uccuuggcagcagggagcauga

SEQ ID NO: 383343 - RNA, 22 nt, Human
uaaaaguggauaagcuguagga

SEQ ID NO: 383344 - RNA, 22 nt, Human
agcaggcuuguuaugucugaga

SEQ ID NO: 383345 - RNA, 21 nt, Human
aaguggagaagaaaagcugga

SEQ ID NO: 383346 - RNA, 22 nt, Human
augauggugggagaugacccag

SEQ ID NO: 383347 - RNA, 22 nt, Human
aggcaugugacccuggacucag

SEQ ID NO: 383348 - RNA, 22 nt, Human
uuaacacuaucugucauaauua

SEQ ID NO: 383349 - RNA, 22 nt, Human
uaagcugugggagauuggcaua

SEQ ID NO: 383350 - RNA, 17 nt, Human
ugaaaucagcacccagg

SEQ ID NO: 383351 - RNA, 22 nt, Human
uucaacacaggaacaugauaua

SEQ ID NO: 383352 - RNA, 22 nt, Human
cagugagggcccccuuccaggu

SEQ ID NO: 383353 - RNA, 22 nt, Human
agcaugcacaugacuggcuuaa

SEQ ID NO: 383354 - RNA, 22 nt, Human
ggccaggccaagaggguuggaa

SEQ ID NO: 383355 - RNA, 22 nt, Human
uugaaucucuugaaucucuguu

SEQ ID NO: 383356 - RNA, 22 nt, Human
uguuaaucaaucaacaguauua

SEQ ID NO: 383357 - RNA, 22 nt, Human
cuuccaaauguaaauaaguuuc

SEQ ID NO: 383358 - RNA, 22 nt, Human
ggcagcugcaaaucugcucugu

SEQ ID NO: 383359 - RNA, 20 nt, Human
ccagagcugauggcugcccg

SEQ ID NO: 383360 - RNA, 23 nt, Human
ucacacagcuggucagguacaga

SEQ ID NO: 383361 - RNA, 22 nt, Human
ugguccugccccgugcacagag

SEQ ID NO: 383362 - RNA, 22 nt, Human
caagggugguauugggagcaua

SEQ ID NO: 383363 - RNA, 22 nt, Human
agcaggaaguagucuguaagca

SEQ ID NO: 383364 - RNA, 22 nt, Human
uucaaaggcaggauagcagcug

SEQ ID NO: 383365 - RNA, 22 nt, Human
aaauaucauuuauaacuuuuaa

SEQ ID NO: 383366 - RNA, 22 nt, Human
ccucacuggccagccaggggug

SEQ ID NO: 383367 - RNA, 22 nt, Human
gcccauggacacccaagugcca

SEQ ID NO: 383368 - RNA, 17 nt, Human
ucccaggaacagggaau

SEQ ID NO: 383369 - RNA, 22 nt, Human
auaaacagcuccauuuagugcc

SEQ ID NO: 383370 - RNA, 22 nt, Human
gggcagcuggauaguuuuaaau

SEQ ID NO: 383371 - RNA, 22 nt, Human
aaucaguuaggguguuaaugag

SEQ ID NO: 383372 - RNA, 18 nt, Human
ucaagacaucaugaaaua

SEQ ID NO: 383373 - RNA, 22 nt, Human
aucaccaggcaaaaugucagag

SEQ ID NO: 383374 - RNA, 22 nt, Human
auggcucauuuaucuugcagcc

SEQ ID NO: 383375 - RNA, 22 nt, Human
ugaaaugaucaguuugguuacu

SEQ ID NO: 383376 - RNA, 22 nt, Human
augaccccuaaaauuuacuguc

SEQ ID NO: 383377 - RNA, 22 nt, Human
acacaguaugaaaagucuaguu

SEQ ID NO: 383378 - RNA, 22 nt, Human
aggcaagggggcgccaccuucc

SEQ ID NO: 383379 - RNA, 19 nt, Human
gggcagaauggcaucucag

SEQ ID NO: 383380 - RNA, 22 nt, Human
ggauggcauguugggcucuguu

SEQ ID NO: 383381 - RNA, 22 nt, Human
ugaaguccuagaacuccuggua

SEQ ID NO: 383382 - RNA, 17 nt, Human
ggcagcugccacuuuuu

SEQ ID NO: 383383 - RNA, 22 nt, Human
uuguugucauuguagaggauuu

SEQ ID NO: 383384 - RNA, 22 nt, Human
acauagcuuaaaugagaagaua

SEQ ID NO: 383385 - RNA, 21 nt, Human
ggucagggggugccuccaggu

SEQ ID NO: 383386 - RNA, 22 nt, Human
cuuaagauuugagauaccuaau

SEQ ID NO: 383387 - RNA, 22 nt, Human
acaguggaagaagcacugaacu

SEQ ID NO: 383388 - RNA, 22 nt, Human
gggucaggcucagcagggcagc

SEQ ID NO: 383389 - RNA, 22 nt, Human
ucucagagccuaacuaaccuaa

SEQ ID NO: 383390 - RNA, 22 nt, Human
cacagcuggugcacuagcucug

SEQ ID NO: 383391 - RNA, 22 nt, Human
ccagggaggguccuguggcuuc

SEQ ID NO: 383392 - RNA, 22 nt, Human
gcaaauacauguugagcaccua

SEQ ID NO: 383393 - RNA, 18 nt, Human
aagaggaggaaacccagg

SEQ ID NO: 383394 - RNA, 22 nt, Human
ugcagcagcagggaggaggcuc

SEQ ID NO: 383395 - RNA, 17 nt, Human
aggcugcugggccaggg

SEQ ID NO: 383396 - RNA, 22 nt, Human
aggcacugugcuucuuauaugu

SEQ ID NO: 383397 - RNA, 22 nt, Human
aggaaaaaccuguuaaugguag

SEQ ID NO: 383398 - RNA, 19 nt, Human
cacagggcaggucucaugu

SEQ ID NO: 383399 - RNA, 23 nt, Human
caugggagugagaaugccagcuc

SEQ ID NO: 383400 - RNA, 22 nt, Human
agcaggcagccauuuggaaggc

SEQ ID NO: 383401 - RNA, 22 nt, Human
ccucugggagacugcuacugag

SEQ ID NO: 383402 - RNA, 22 nt, Human
ucaggcuggagugcaguggcgc

SEQ ID NO: 383403 - RNA, 22 nt, Human
agggcagccaugagccuucagg

SEQ ID NO: 383404 - RNA, 22 nt, Human
aauuccagaggaggacaguccu

SEQ ID NO: 383405 - RNA, 22 nt, Human
agggagaacaguugcagcagac

SEQ ID NO: 383406 - RNA, 22 nt, Human
aaaugugucaguuucauucucu

SEQ ID NO: 383407 - RNA, 22 nt, Human
uccaggcacagaguuggucagu

SEQ ID NO: 383408 - RNA, 22 nt, Human
ggcagccagagggcagcuggau

SEQ ID NO: 383409 - RNA, 22 nt, Human
ucagcaauaugauaggcuuugu

SEQ ID NO: 383410 - RNA, 22 nt, Human
agccccugggaguagcugcugc

SEQ ID NO: 383411 - RNA, 22 nt, Human
ugaaugaaugaauuaauagagu

SEQ ID NO: 383412 - RNA, 22 nt, Human
uuauuuuguagcucugaucuuu

SEQ ID NO: 383413 - RNA, 22 nt, Human
gguggguuuggaagagcaggcu

SEQ ID NO: 383414 - RNA, 21 nt, Human
ccagagagagggaaguggguu

SEQ ID NO: 383415 - RNA, 21 nt, Human
auggagggaccagggaagcag

SEQ ID NO: 383416 - RNA, 22 nt, Human
uagcagcucugauucugggccc

SEQ ID NO: 383417 - RNA, 22 nt, Human
uccagaguacggaagagucauc

SEQ ID NO: 383418 - RNA, 22 nt, Human
aagggcucgguagcaguccuga

SEQ ID NO: 383419 - RNA, 22 nt, Human
agcagggcugcagugugucuuu

SEQ ID NO: 383420 - RNA, 22 nt, Human
uucuucucggcugucagauagu

SEQ ID NO: 383421 - RNA, 22 nt, Human
gaggguggguuucuugcacguc

SEQ ID NO: 383422 - RNA, 22 nt, Human
uucacauugugcagauuauggu

SEQ ID NO: 383423 - RNA, 22 nt, Human
auccuuaguuaagaacaggagu

SEQ ID NO: 383424 - RNA, 18 nt, Human
ucauagaagugaaucaga

SEQ ID NO: 383425 - RNA, 22 nt, Human
gcugcccuaauaucacauguua

SEQ ID NO: 383426 - RNA, 22 nt, Human
aucagaauaauuagauuucaga

SEQ ID NO: 383427 - RNA, 22 nt, Human
uugcauaaaugcuuaaaauuug

SEQ ID NO: 383428 - RNA, 22 nt, Human
gaggcucauugcauugugcauu

SEQ ID NO: 383429 - RNA, 20 nt, Human
cucaguguggccugaguguu

SEQ ID NO: 383430 - RNA, 22 nt, Human
cugaagcacagcauauaaauaa

SEQ ID NO: 383431 - RNA, 22 nt, Human
agucccagaugacccagcuacu

SEQ ID NO: 383432 - RNA, 22 nt, Human
ucauggagacuuugagccuguu

SEQ ID NO: 383433 - RNA, 22 nt, Human
ccaggcucaggugcgagagaca

SEQ ID NO: 383434 - RNA, 22 nt, Human
gcccaggaguugguggcugcag

SEQ ID NO: 383435 - RNA, 22 nt, Human
accucugccacuuucuaacucu

SEQ ID NO: 383436 - RNA, 22 nt, Human
ugcaggccggcccuaggccuca

SEQ ID NO: 383437 - RNA, 22 nt, Human
ugugaaagucaaauuaauugaa

SEQ ID NO: 383438 - RNA, 22 nt, Human
aggccagcagcaugacggcauc

SEQ ID NO: 383439 - RNA, 22 nt, Human
ccagagaggccuuggcaagaca

SEQ ID NO: 383440 - RNA, 22 nt, Human
gcugggagcccuggucugcucc

SEQ ID NO: 383441 - RNA, 22 nt, Human
ccugggcagugcuggaguugaa

SEQ ID NO: 383442 - RNA, 22 nt, Human
cugaggcuuggaggggucuggu

SEQ ID NO: 383443 - RNA, 22 nt, Human
aaugaacaaaauaugcuuugca

SEQ ID NO: 383444 - RNA, 22 nt, Human
ugaggcaggaggauugcaggau

SEQ ID NO: 383445 - RNA, 22 nt, Human
agagcauccaucggccaggacc

SEQ ID NO: 383446 - RNA, 22 nt, Human
uuuuaucugcuucauuaguuga

SEQ ID NO: 383447 - RNA, 22 nt, Human
ucuaaacacuaagucuugaugc

SEQ ID NO: 383448 - RNA, 22 nt, Human
ucagagagaaauaguuuuugac

SEQ ID NO: 383449 - RNA, 22 nt, Human
uagcacaucuggcgcuuauagg

SEQ ID NO: 383450 - RNA, 22 nt, Human
ccagguguagcacugcucacag

SEQ ID NO: 383451 - RNA, 22 nt, Human
auaguuguguggggauucuggu

SEQ ID NO: 383452 - RNA, 22 nt, Human
acagacauuuucuguauugccu

SEQ ID NO: 383453 - RNA, 22 nt, Human
cccaggagauaacguucccaag

SEQ ID NO: 383454 - RNA, 22 nt, Human
ucccaggauuuuaggcucucag

SEQ ID NO: 383455 - RNA, 22 nt, Human
caggaccuggaaugcuugugaa

SEQ ID NO: 383456 - RNA, 22 nt, Human
guuucuuagguaaauucuuuga

SEQ ID NO: 383457 - RNA, 22 nt, Human
ugagaagcugcugacuuagccu

SEQ ID NO: 383458 - RNA, 22 nt, Human
aaaagcucuuucugcuguagau

SEQ ID NO: 383459 - RNA, 22 nt, Human
gaagccucaacaucucugcguc

SEQ ID NO: 383460 - RNA, 22 nt, Human
ucuuugcacugugcaagcagaa

SEQ ID NO: 383461 - RNA, 22 nt, Human
ucugaggcuaagagacagaggc

SEQ ID NO: 383462 - RNA, 22 nt, Human
agugcuuugguauagaacuauu

SEQ ID NO: 383463 - RNA, 22 nt, Human
cccaggacucuucacugcagcc

SEQ ID NO: 383464 - RNA, 22 nt, Human
ucauuucuguugugcaucacug

SEQ ID NO: 383465 - RNA, 22 nt, Human
gaggcagcaucuauggugggaa

SEQ ID NO: 383466 - RNA, 22 nt, Human
ggcugcugguagggguaggaag

SEQ ID NO: 383467 - RNA, 22 nt, Human
ugugaagguaaggaggggcaag

SEQ ID NO: 383468 - RNA, 22 nt, Human
ggaggccacgguuuagcaccga

SEQ ID NO: 383469 - RNA, 22 nt, Human
caggaggaggugagguagaacu

SEQ ID NO: 383470 - RNA, 22 nt, Human
cauuguuaccaucuuuuaccua

SEQ ID NO: 383471 - RNA, 22 nt, Human
gcagcuucaguaggugaagaca

SEQ ID NO: 383472 - RNA, 22 nt, Human
gccuggcccagggcuccgcagg

SEQ ID NO: 383473 - RNA, 22 nt, Human
agcagugagugggaggaccaug

SEQ ID NO: 383474 - RNA, 22 nt, Human
cugggcagcuguaucagggagu

SEQ ID NO: 383475 - RNA, 22 nt, Human
ucucucugccaacucacagcca

SEQ ID NO: 383476 - RNA, 22 nt, Human
aguacaaugucugacacaguag

SEQ ID NO: 383477 - RNA, 22 nt, Human
aaggcccuggcaggaagcagga

SEQ ID NO: 383478 - RNA, 22 nt, Human
uggccagcccuucagccaugcc

SEQ ID NO: 383479 - RNA, 22 nt, Human
acuuugaaggggaacauuuuaa

SEQ ID NO: 383480 - RNA, 22 nt, Human
agguguguauaaacauacauau

SEQ ID NO: 383481 - RNA, 21 nt, Human
aaauuucugcaagccucaacu

SEQ ID NO: 383482 - RNA, 22 nt, Human
ugucccagucaaggcugucauc

SEQ ID NO: 383483 - RNA, 22 nt, Human
agagugguacuucuuuuucuuc

SEQ ID NO: 383484 - RNA, 22 nt, Human
uaaagccacuucauucuagucu

SEQ ID NO: 383485 - RNA, 22 nt, Human
acaagagauuaucuacagauga

SEQ ID NO: 383486 - RNA, 22 nt, Human
ugaugaaauguugaggcaguga

SEQ ID NO: 383487 - RNA, 22 nt, Human
cuacagaauucaacaaaugguu

SEQ ID NO: 383488 - RNA, 23 nt, Human
auacauacagucuuacugacuuu

SEQ ID NO: 383489 - RNA, 22 nt, Human
agcugccagcaaguuucaaaca

SEQ ID NO: 383490 - RNA, 22 nt, Human
caggcaccccaggugagcacug

SEQ ID NO: 383491 - RNA, 21 nt, Human
acagcauguuuguguguuugc

SEQ ID NO: 383492 - RNA, 22 nt, Human
aaagucauuuguauauacccuu

SEQ ID NO: 383493 - RNA, 22 nt, Human
ggccucucuggcauggcugccc

SEQ ID NO: 383494 - RNA, 22 nt, Human
acugucugcuggccccugguua

SEQ ID NO: 383495 - RNA, 22 nt, Human
gugccuggcacacagaaggcaa

SEQ ID NO: 383496 - RNA, 22 nt, Human
ggcugccugaacuuuggggaaa

SEQ ID NO: 383497 - RNA, 21 nt, Human
cuguggaagggaacuagaggg

SEQ ID NO: 383498 - RNA, 22 nt, Human
aaagccuugagauccuauaguu

SEQ ID NO: 383499 - RNA, 22 nt, Human
ggcugccaggagaagcucagug

SEQ ID NO: 383500 - RNA, 22 nt, Human
gagagugaugaaugguuaaaca

SEQ ID NO: 383501 - RNA, 22 nt, Human
caugguuuauuagagcuuauuu

SEQ ID NO: 383502 - RNA, 22 nt, Human
ugccuguguugauuacuuuguc

SEQ ID NO: 383503 - RNA, 22 nt, Human
aggauuuaucaggaacucucuu

SEQ ID NO: 383504 - RNA, 22 nt, Human
cugcagagcauaaaucugaaua

SEQ ID NO: 383505 - RNA, 22 nt, Human
ggcauuuaauccaucugauuga

SEQ ID NO: 383506 - RNA, 23 nt, Human
gccaggaguggguagacuaaugc

SEQ ID NO: 383507 - RNA, 22 nt, Human
uccaggcaguuuuccagguugu

SEQ ID NO: 383508 - RNA, 22 nt, Human
uuaggaguccagaugucuuggg

SEQ ID NO: 383509 - RNA, 22 nt, Human
agagaugaacauaaaacaagga

SEQ ID NO: 383510 - RNA, 22 nt, Human
agagcugugaaaaugagguuug

SEQ ID NO: 383511 - RNA, 22 nt, Human
cccagacauaacagcagagagg

SEQ ID NO: 383512 - RNA, 22 nt, Human
aagaggucauaccagauaaggg

SEQ ID NO: 383513 - RNA, 22 nt, Human
gucacuguuuccuauuauauuu

SEQ ID NO: 383514 - RNA, 22 nt, Human
uuggcuucuucgcacagcagua

SEQ ID NO: 383515 - RNA, 22 nt, Human
auuguggcuagacagucacaau

SEQ ID NO: 383516 - RNA, 22 nt, Human
agugcuuuccuucuugugacau

SEQ ID NO: 383517 - RNA, 22 nt, Human
cauguacauucuguagauggag

SEQ ID NO: 383518 - RNA, 19 nt, Human
uugaaagauuagcuuucua

SEQ ID NO: 383519 - RNA, 22 nt, Human
cuuuacagaauaagaauacugg

SEQ ID NO: 383520 - RNA, 22 nt, Human
agucucagcuacuugggaggcu

SEQ ID NO: 383521 - RNA, 22 nt, Human
gaaggcuggcuuucugagagca

SEQ ID NO: 383522 - RNA, 22 nt, Human
cccuggguucuggcugggcugc

SEQ ID NO: 383523 - RNA, 22 nt, Human
aagcacaaugaacaucuuagau

SEQ ID NO: 383524 - RNA, 22 nt, Human
cugggcaguuuuacaucauugc

SEQ ID NO: 383525 - RNA, 22 nt, Human
cccaggagaccugugaaaggac

SEQ ID NO: 383526 - RNA, 20 nt, Human
gcauccagacacccagcugc

SEQ ID NO: 383527 - RNA, 22 nt, Human
uugaauaauauguucaggagga

SEQ ID NO: 383528 - RNA, 22 nt, Human
guggcaggagagacacagccau

SEQ ID NO: 383529 - RNA, 22 nt, Human
gcagcauuuguggaaugggccc

SEQ ID NO: 383530 - RNA, 22 nt, Human
gagagucacugucugcauuucc

SEQ ID NO: 383531 - RNA, 22 nt, Human
caucacagggggcuagaagucu

SEQ ID NO: 383532 - RNA, 22 nt, Human
caaugauucugcaacugugugc

SEQ ID NO: 383533 - RNA, 21 nt, Human
uucaaagacuugaugcugacc

SEQ ID NO: 383534 - RNA, 22 nt, Human
agccugagugcuuaggacuguu

SEQ ID NO: 383535 - RNA, 22 nt, Human
cuggagccacuuuuuauccuuu

SEQ ID NO: 383536 - RNA, 22 nt, Human
aaugaucuggcucaggauauca

SEQ ID NO: 383537 - RNA, 22 nt, Human
agguggggugagcugcagacua

SEQ ID NO: 383538 - RNA, 22 nt, Human
uuccucugaaauggcuuggaaa

SEQ ID NO: 383539 - RNA, 22 nt, Human
ugaagccauaggacagaggaua

SEQ ID NO: 383540 - RNA, 22 nt, Human
ugagcuucaaaauaugugaauc

SEQ ID NO: 383541 - RNA, 22 nt, Human
auacaacagaaaaugauuauuc

SEQ ID NO: 383542 - RNA, 22 nt, Human
ugcucuccggcuuccguggccu

SEQ ID NO: 383543 - RNA, 22 nt, Human
ccugccugucccucaguccaca

SEQ ID NO: 383544 - RNA, 22 nt, Human
ccacagggcucuaggcgcuucc

SEQ ID NO: 383545 - RNA, 17 nt, Human
uaaguccuaguuauuuu

SEQ ID NO: 383546 - RNA, 22 nt, Human
gcaguggcuaggagucuggcgu

SEQ ID NO: 383547 - RNA, 22 nt, Human
ggcacagagcccagcuuccuag

SEQ ID NO: 383548 - RNA, 22 nt, Human
augcugagacuggagcagcugg

SEQ ID NO: 383549 - RNA, 23 nt, Human
ugcauuauccucucugaagacca

SEQ ID NO: 383550 - RNA, 22 nt, Human
gcagaggggaagcugaggaauu

SEQ ID NO: 383551 - RNA, 22 nt, Human
ucccagaggacuguuggugcua

SEQ ID NO: 383552 - RNA, 22 nt, Human
ccagggccucguguucugagug

SEQ ID NO: 383553 - RNA, 22 nt, Human
aguauguauuuuauacuuacag

SEQ ID NO: 383554 - RNA, 22 nt, Human
aucacaaaggguuuucucugag

SEQ ID NO: 383555 - RNA, 22 nt, Human
gcuguauuuaacaacuggcuca

SEQ ID NO: 383556 - RNA, 22 nt, Human
ccugagcuggaagagcuugugc

SEQ ID NO: 383557 - RNA, 22 nt, Human
agggcagaccacgugcaaggau

SEQ ID NO: 383558 - RNA, 22 nt, Human
uccaggcaaaaggaacugcuug

SEQ ID NO: 383559 - RNA, 22 nt, Human
cacaauuuccaagucauguuau

SEQ ID NO: 383560 - RNA, 22 nt, Human
uaaguccuauuccaggucucuc

SEQ ID NO: 383561 - RNA, 22 nt, Human
uucagcaaauggacuguucagg

SEQ ID NO: 383562 - RNA, 22 nt, Human
acuugguuggucucacccuguu

SEQ ID NO: 383563 - RNA, 22 nt, Human
gagccugagugcugccuccccu

SEQ ID NO: 383564 - RNA, 22 nt, Human
aaagaaggggucuacauccaau

SEQ ID NO: 383565 - RNA, 22 nt, Human
uaaaacuuaacuauccagauua

SEQ ID NO: 383566 - RNA, 22 nt, Human
acagccagguaaaggcauggca

SEQ ID NO: 383567 - RNA, 22 nt, Human
gaaaguuuauagguuauauaau

SEQ ID NO: 383568 - RNA, 22 nt, Human
uuuauuguuguuagucauaagu

SEQ ID NO: 383569 - RNA, 22 nt, Human
ucaggauaaaauguaauggcaa

SEQ ID NO: 383570 - RNA, 18 nt, Human
cauuguacaaugcuuuau

SEQ ID NO: 383571 - RNA, 22 nt, Human
ucaggggaaaucucucagcgaa

SEQ ID NO: 383572 - RNA, 22 nt, Human
cuagccugggauuugaacuuau

SEQ ID NO: 383573 - RNA, 22 nt, Human
agacaaaggauuaaugaugaug

SEQ ID NO: 383574 - RNA, 22 nt, Human
ugcagccaauucauucauucuu

SEQ ID NO: 383575 - RNA, 22 nt, Human
gcagccucagggcacucagaug

SEQ ID NO: 383576 - RNA, 22 nt, Human
auuaaauuaaguggcuaauuua

SEQ ID NO: 383577 - RNA, 22 nt, Human
ccuugcugcgugcuagcacaga

SEQ ID NO: 383578 - RNA, 22 nt, Human
ugaaugaauccuaacaaagaca

SEQ ID NO: 383579 - RNA, 22 nt, Human
ugggccugaaggagcugcgccc

SEQ ID NO: 383580 - RNA, 22 nt, Human
agugccaggagcaaggagcucc

SEQ ID NO: 383581 - RNA, 22 nt, Human
ggcugccugcucaggugcggcg

SEQ ID NO: 383582 - RNA, 22 nt, Human
gggagcugagcuggaagagaau

SEQ ID NO: 383583 - RNA, 23 nt, Human
agaauuguaaauagaauauaccu

SEQ ID NO: 383584 - RNA, 22 nt, Human
ccagccagccuugaucugagua

SEQ ID NO: 383585 - RNA, 22 nt, Human
aaagaaaccuaucagccacaug

SEQ ID NO: 383586 - RNA, 22 nt, Human
cagagccuaaaacgacuccacu

SEQ ID NO: 383587 - RNA, 19 nt, Human
aagcagcccuggcaagagc

SEQ ID NO: 383588 - RNA, 22 nt, Human
ugcugccacaaauucagcugcc

SEQ ID NO: 383589 - RNA, 22 nt, Human
gcagagcucaagguguucagcu

SEQ ID NO: 383590 - RNA, 22 nt, Human
auaaacaguaaaugugagcagu

SEQ ID NO: 383591 - RNA, 22 nt, Human
uggcuuccaaaggaaugggccu

SEQ ID NO: 383592 - RNA, 22 nt, Human
ggugaggggagagugaaagaaa

SEQ ID NO: 383593 - RNA, 22 nt, Human
ugggaggcagguaggugaugau

SEQ ID NO: 383594 - RNA, 22 nt, Human
acauuuuuuagagucccacauu

SEQ ID NO: 383595 - RNA, 23 nt, Human
cagaccuggcagucauccucaac

SEQ ID NO: 383596 - RNA, 23 nt, Human
gggagccauggguggucauggag

SEQ ID NO: 383597 - RNA, 22 nt, Human
auguuucaaugcacuuuagccu

SEQ ID NO: 383598 - RNA, 22 nt, Human
ccacaaguuucagcacccagag

SEQ ID NO: 383599 - RNA, 22 nt, Human
uaucagaaaugccuuaaauugg

SEQ ID NO: 383600 - RNA, 22 nt, Human
uacugugacagaguacuuaaac

SEQ ID NO: 383601 - RNA, 22 nt, Human
cuuccaaagcacuuuauggacc

SEQ ID NO: 383602 - RNA, 18 nt, Human
cugccuguugcugagagg

SEQ ID NO: 383603 - RNA, 22 nt, Human
augguuuacaauguuuucaguu

SEQ ID NO: 383604 - RNA, 22 nt, Human
aggcagcugaggucuggcgccc

SEQ ID NO: 383605 - RNA, 22 nt, Human
uuccuuagggucagccagaucu

SEQ ID NO: 383606 - RNA, 22 nt, Human
cccccagccagcagugcucagc

SEQ ID NO: 383607 - RNA, 22 nt, Human
gccaggcugaggcucuggaaga

SEQ ID NO: 383608 - RNA, 22 nt, Human
uggcucagcuuuccccaucugg

SEQ ID NO: 383609 - RNA, 19 nt, Human
aucugccuguuaucacaua

SEQ ID NO: 383610 - RNA, 23 nt, Human
ugggaccuguuugcccacagaug

SEQ ID NO: 383611 - RNA, 22 nt, Human
acacaaacagucuauagcacca

SEQ ID NO: 383612 - RNA, 22 nt, Human
acaaaauuaugaagaggccuug

SEQ ID NO: 383613 - RNA, 22 nt, Human
aucuaacacuguaaacugucuu

SEQ ID NO: 383614 - RNA, 22 nt, Human
cuuagaaaucgaacucagguua

SEQ ID NO: 383615 - RNA, 22 nt, Human
gagcccagguucugcuuccagc

SEQ ID NO: 383616 - RNA, 22 nt, Human
caggaaugaggucguaaguguc

SEQ ID NO: 383617 - RNA, 22 nt, Human
gaggaaaauaacaacuaagggc

SEQ ID NO: 383618 - RNA, 22 nt, Human
aaugcuuuuugcgaaaugugca

SEQ ID NO: 383619 - RNA, 19 nt, Human
cacaucagcagggcugugg

SEQ ID NO: 383620 - RNA, 22 nt, Human
aagggaaaucauauggugcagu

SEQ ID NO: 383621 - RNA, 22 nt, Human
gaagcagcuagcccacuaguca

SEQ ID NO: 383622 - RNA, 22 nt, Human
ugcugguggagaaaguggaggu

SEQ ID NO: 383623 - RNA, 22 nt, Human
aaauaguucagcuuguaaaccc

SEQ ID NO: 383624 - RNA, 22 nt, Human
gaggugaguggaucacgagguc

SEQ ID NO: 383625 - RNA, 23 nt, Human
acuuuagauaaauuaugugcaca

SEQ ID NO: 383626 - RNA, 22 nt, Human
cauucauucuguaaguaacuau

SEQ ID NO: 383627 - RNA, 22 nt, Human
aagaguuuucuauaaucuuggc

SEQ ID NO: 383628 - RNA, 22 nt, Human
uaaguucauaagcuuauucuua

SEQ ID NO: 383629 - RNA, 22 nt, Human
gaggagguuccggguggagaag

SEQ ID NO: 383630 - RNA, 22 nt, Human
gcaggauggugcccuuucugcc

SEQ ID NO: 383631 - RNA, 20 nt, Human
gggcagcuccccucauucug

SEQ ID NO: 383632 - RNA, 22 nt, Human
gcucugugccacaugcaguguu

SEQ ID NO: 383633 - RNA, 20 nt, Human
uccugguggauacugcuuaa

SEQ ID NO: 383634 - RNA, 22 nt, Human
agcugucuccagauacaggauu

SEQ ID NO: 383635 - RNA, 22 nt, Human
uuucaaugacacaaaagagaaa

SEQ ID NO: 383636 - RNA, 22 nt, Human
auaaagucauuaugaagaucua

SEQ ID NO: 383637 - RNA, 22 nt, Human
aggccucagugaucaucaucag

SEQ ID NO: 383638 - RNA, 22 nt, Human
cagggaggaugggcuguuuugc

SEQ ID NO: 383639 - RNA, 22 nt, Human
uggcugccuuucaccucaucuc

SEQ ID NO: 383640 - RNA, 18 nt, Human
ucucagaggccauccuag

SEQ ID NO: 383641 - RNA, 22 nt, Human
caacaguguugcaaucugaaaa

SEQ ID NO: 383642 - RNA, 22 nt, Human
caguuucuucaucaguuaagca

SEQ ID NO: 383643 - RNA, 22 nt, Human
ucuggccugaaaguccaugcuu

SEQ ID NO: 383644 - RNA, 22 nt, Human
auggcccaggccuccuguggcu

SEQ ID NO: 383645 - RNA, 22 nt, Human
caugggaggucugcaaggugcu

SEQ ID NO: 383646 - RNA, 22 nt, Human
ggcuuuauuugcagccauuguu

SEQ ID NO: 383647 - RNA, 21 nt, Human
ggagucauuagucauuuccuu

SEQ ID NO: 383648 - RNA, 22 nt, Human
gucccuaguggaaagacaugau

SEQ ID NO: 383649 - RNA, 15 nt, Human
uggcagcuuguuaag

SEQ ID NO: 383650 - RNA, 22 nt, Human
aguggggaagagcaugggcccu

SEQ ID NO: 383651 - RNA, 22 nt, Human
aucaggaucugcaucauaagaa

SEQ ID NO: 383652 - RNA, 22 nt, Human
aggcugcugccuuggagagugu

SEQ ID NO: 383653 - RNA, 22 nt, Human
ccacuggcauccagcugccauc

SEQ ID NO: 383654 - RNA, 22 nt, Human
cugcccaggcugaaggaacauc

SEQ ID NO: 383655 - RNA, 22 nt, Human
cugccuggccugaucuccacgc

SEQ ID NO: 383656 - RNA, 22 nt, Human
ggcuccuggggaggugagcuug

SEQ ID NO: 383657 - RNA, 22 nt, Human
uuuauccagaaucaggauuuuu

SEQ ID NO: 383658 - RNA, 22 nt, Human
gcagauggacuguaugaccuga

SEQ ID NO: 383659 - RNA, 21 nt, Human
uccaggaguggcugggcaggg

SEQ ID NO: 383660 - RNA, 22 nt, Human
cuuggcagagggcugggcucag

SEQ ID NO: 383661 - RNA, 19 nt, Human
uuugaaaggauuguuauuu

SEQ ID NO: 383662 - RNA, 22 nt, Human
uuaaauuccagccucauaauag

SEQ ID NO: 383663 - RNA, 22 nt, Human
aggcccagcccguccucgugcu

SEQ ID NO: 383664 - RNA, 22 nt, Human
uccauaagcagguucuuccuga

SEQ ID NO: 383665 - RNA, 22 nt, Human
ccugaagggacuccagagagca

SEQ ID NO: 383666 - RNA, 22 nt, Human
agcagcucuguuuaccuggagg

SEQ ID NO: 383667 - RNA, 21 nt, Human
gcagccagacgggauucaguu

SEQ ID NO: 383668 - RNA, 22 nt, Human
gcaggguauaauacuuagguga

SEQ ID NO: 383669 - RNA, 22 nt, Human
gcagcugaagcugcaguuccag

SEQ ID NO: 383670 - RNA, 22 nt, Human
aauuugcaugaugagaacaaua

SEQ ID NO: 383671 - RNA, 22 nt, Human
uauuuaauuagugauuguagag

SEQ ID NO: 383672 - RNA, 22 nt, Human
ugcugccaaaugcgagcucugu

SEQ ID NO: 383673 - RNA, 22 nt, Human
auguuauuaaaguacagauucu

SEQ ID NO: 383674 - RNA, 22 nt, Human
cuggugggagcagcaggcagcu

SEQ ID NO: 383675 - RNA, 22 nt, Human
cuugaacucaaugugaggaaga

SEQ ID NO: 383676 - RNA, 22 nt, Human
uauggaaagggaguuuaauuug

SEQ ID NO: 383677 - RNA, 22 nt, Human
accuuuuuucagaacucuaaag

SEQ ID NO: 383678 - RNA, 22 nt, Human
uacaucauaauaauacuuagaa

SEQ ID NO: 383679 - RNA, 22 nt, Human
ucuuuccaaggacucuguagca

SEQ ID NO: 383680 - RNA, 22 nt, Human
ggucauugucagagccuguacu

SEQ ID NO: 383681 - RNA, 22 nt, Human
uccuucagugucccgcucaggu

SEQ ID NO: 383682 - RNA, 22 nt, Human
aagugacaaaaggguauccaaa

SEQ ID NO: 383683 - RNA, 22 nt, Human
gaaaucugaaucuucuguuggu

SEQ ID NO: 383684 - RNA, 22 nt, Human
auacuagacuguucuguuauca

SEQ ID NO: 383685 - RNA, 22 nt, Human
ucucccaguccucugugcuuac

SEQ ID NO: 383686 - RNA, 22 nt, Human
gaguucaguaguuauagucuag

SEQ ID NO: 383687 - RNA, 22 nt, Human
agcugagcugcagaugacugua

SEQ ID NO: 383688 - RNA, 22 nt, Human
acugcagccuuugggcucauaa

SEQ ID NO: 383689 - RNA, 22 nt, Human
aacuuucagcaaguaauucugg

SEQ ID NO: 383690 - RNA, 22 nt, Human
aggagaggguggcauuaaguuu

SEQ ID NO: 383691 - RNA, 22 nt, Human
ccuucagaccuagacaggaauc

SEQ ID NO: 383692 - RNA, 22 nt, Human
gaguggagcaaaagagguagau

SEQ ID NO: 383693 - RNA, 22 nt, Human
cagaggcuaagaugagugggug

SEQ ID NO: 383694 - RNA, 22 nt, Human
guguuuuaagaaagaagcucag

SEQ ID NO: 383695 - RNA, 22 nt, Human
cccaggaggcgcagguugcggu

SEQ ID NO: 383696 - RNA, 22 nt, Human
ccccggaggcggagguugcagu

SEQ ID NO: 383697 - RNA, 22 nt, Human
aaaacaguuuuugcuaacugcu

SEQ ID NO: 383698 - RNA, 22 nt, Human
uggcacugaccccaggccugug

SEQ ID NO: 383699 - RNA, 22 nt, Human
caacagucugguuuauauaaua

SEQ ID NO: 383700 - RNA, 19 nt, Human
agcaccugugagagccugg

SEQ ID NO: 383701 - RNA, 22 nt, Human
uagaauucaagauucaacaggc

SEQ ID NO: 383702 - RNA, 22 nt, Human
cugaaggagguagagugacaua

SEQ ID NO: 383703 - RNA, 23 nt, Human
uggcucugugucacauacaggau

SEQ ID NO: 383704 - RNA, 22 nt, Human
gcuccuggcuccaggcagccaa

SEQ ID NO: 383705 - RNA, 22 nt, Human
acaauguguuuuuauacauuug

SEQ ID NO: 383706 - RNA, 22 nt, Human
cggcugagacggccauagacac

SEQ ID NO: 383707 - RNA, 22 nt, Human
uagugauuaaaggcagaauguu

SEQ ID NO: 383708 - RNA, 22 nt, Human
acugcuuuuagaaaucuauaga

SEQ ID NO: 383709 - RNA, 22 nt, Human
ccguagcacaugcuccuggggc

SEQ ID NO: 383710 - RNA, 22 nt, Human
cagggcuccaugcagggacucc

SEQ ID NO: 383711 - RNA, 22 nt, Human
uugaaagucacaauggcauuaa

SEQ ID NO: 383712 - RNA, 22 nt, Human
gaugccuccaaaugagggcaga

SEQ ID NO: 383713 - RNA, 23 nt, Human
gacagagugagaccuugucuuac

SEQ ID NO: 383714 - RNA, 21 nt, Human
uggcucugagccucauggcug

SEQ ID NO: 383715 - RNA, 21 nt, Human
ucacuuauaauguauuugcug

SEQ ID NO: 383716 - RNA, 21 nt, Human
gucagcagauccagcacuugu

SEQ ID NO: 383717 - RNA, 19 nt, Human
ucccuuccugucgggcucc

SEQ ID NO: 383718 - RNA, 22 nt, Human
uauuuagaugcauuuggauugc

SEQ ID NO: 383719 - RNA, 22 nt, Human
uacugcauaacuggcauguggg

SEQ ID NO: 383720 - RNA, 22 nt, Human
cagaguguaucuguguaagcau

SEQ ID NO: 383721 - RNA, 22 nt, Human
cagcugccaugacauguccugc

SEQ ID NO: 383722 - RNA, 22 nt, Human
agacgagggccuggcacacagu

SEQ ID NO: 383723 - RNA, 22 nt, Human
uguggccucaaggcugcccuca

SEQ ID NO: 383724 - RNA, 22 nt, Human
cccugccuacaggguuuucuuu

SEQ ID NO: 383725 - RNA, 22 nt, Human
aggaagugaaagggaaggaguu

SEQ ID NO: 383726 - RNA, 22 nt, Human
augugaggcagcacggagauua

SEQ ID NO: 383727 - RNA, 22 nt, Human
aggggccauuguucugcccgcu

SEQ ID NO: 383728 - RNA, 22 nt, Human
aguggagaauaugcagaaagcc

SEQ ID NO: 383729 - RNA, 22 nt, Human
cugggugaguugaugaaggaga

SEQ ID NO: 383730 - RNA, 22 nt, Human
aggugucugugaugggagcgau

SEQ ID NO: 383731 - RNA, 22 nt, Human
cuacauggagaagaaaauucuu

SEQ ID NO: 383732 - RNA, 22 nt, Human
cugucaggggcggguggagcgg

SEQ ID NO: 383733 - RNA, 22 nt, Human
uugaaauacugcauuguucagu

SEQ ID NO: 383734 - RNA, 22 nt, Human
gcuguucacagacucugcucug

SEQ ID NO: 383735 - RNA, 22 nt, Human
uguggccuugcagccuggaggu

SEQ ID NO: 383736 - RNA, 22 nt, Human
cauuuguagcuauuuacuguau

SEQ ID NO: 383737 - RNA, 22 nt, Human
ccuggggcucaagauggcgccg

SEQ ID NO: 383738 - RNA, 23 nt, Human
gugauuucagggaacagaaucag

SEQ ID NO: 383739 - RNA, 22 nt, Human
ugucccaguucccaggguugcu

SEQ ID NO: 383740 - RNA, 22 nt, Human
uugauuucuauucagauguaga

SEQ ID NO: 383741 - RNA, 22 nt, Human
cagcugagucugagguucuuug

SEQ ID NO: 383742 - RNA, 19 nt, Human
uccugcagguggcuugcag

SEQ ID NO: 383743 - RNA, 23 nt, Human
ugagcccaggaggucaaggcugc

SEQ ID NO: 383744 - RNA, 22 nt, Human
acaggcugccuaccaaguauca

SEQ ID NO: 383745 - RNA, 22 nt, Human
cuuaagaauauugaaguugugg

SEQ ID NO: 383746 - RNA, 22 nt, Human
ggcaggucagguccaugaccaa

SEQ ID NO: 383747 - RNA, 22 nt, Human
uuuacagaugaggauacugagg

SEQ ID NO: 383748 - RNA, 22 nt, Human
ugcuuaaacauacuauuuauau

SEQ ID NO: 383749 - RNA, 22 nt, Human
caucagaagauggcucuggaaa

SEQ ID NO: 383750 - RNA, 22 nt, Human
aacuuuaaggcuauaaauuaug

SEQ ID NO: 383751 - RNA, 22 nt, Human
caggggaguuuuaugcaacaga

SEQ ID NO: 383752 - RNA, 22 nt, Human
aggaccugccaggugcaaagca

SEQ ID NO: 383753 - RNA, 18 nt, Human
ugaggcagucagugaugg

SEQ ID NO: 383754 - RNA, 22 nt, Human
ccaggcugggcggggaaccugg

SEQ ID NO: 383755 - RNA, 22 nt, Human
gacagcagggacauguaggaag

SEQ ID NO: 383756 - RNA, 22 nt, Human
cugggccuagaggaagcugaca

SEQ ID NO: 383757 - RNA, 22 nt, Human
caaguccuccaugugacuaggu

SEQ ID NO: 383758 - RNA, 22 nt, Human
gagagcuggguucaaguagcug

SEQ ID NO: 383759 - RNA, 22 nt, Human
acacuaaugagaaaggaauuaa

SEQ ID NO: 383760 - RNA, 22 nt, Human
ugaagcagauggucuggucauu

SEQ ID NO: 383761 - RNA, 20 nt, Human
agcaggaaugaugcuuucau

SEQ ID NO: 383762 - RNA, 22 nt, Human
auuuauuaugggauuuggcuca

SEQ ID NO: 383763 - RNA, 22 nt, Human
acaguaaaaagccuuagaauuu

SEQ ID NO: 383764 - RNA, 22 nt, Human
agauuuagacugccuuaaucau

SEQ ID NO: 383765 - RNA, 22 nt, Human
gauuuccucacuaacauccauc

SEQ ID NO: 383766 - RNA, 22 nt, Human
cuguggugagcaacugacugaa

SEQ ID NO: 383767 - RNA, 22 nt, Human
gccugucucuuggaacuuggua

SEQ ID NO: 383768 - RNA, 22 nt, Human
aauguuaaaaccuucagugcuu

SEQ ID NO: 383769 - RNA, 22 nt, Human
aguauuuccuggcuuaucugcu

SEQ ID NO: 383770 - RNA, 22 nt, Human
gagcugaaauaugaagccaauu

SEQ ID NO: 383771 - RNA, 22 nt, Human
caugaauauuuaguauuuacuu

SEQ ID NO: 383772 - RNA, 22 nt, Human
ucucagagauuuuguuucccuu

SEQ ID NO: 383773 - RNA, 22 nt, Human
ggauuuccucuugacucuaaag

SEQ ID NO: 383774 - RNA, 22 nt, Human
cugucaguaggcucccaucauu

SEQ ID NO: 383775 - RNA, 20 nt, Human
ucauugcacauaauggaagc

SEQ ID NO: 383776 - RNA, 22 nt, Human
uguagaaagcucuucugaaauc

SEQ ID NO: 383777 - RNA, 17 nt, Human
gacaggcucagugacga

SEQ ID NO: 383778 - RNA, 22 nt, Human
acagaguacauucagagacuau

SEQ ID NO: 383779 - RNA, 22 nt, Human
gaggagcugggucagggagaca

SEQ ID NO: 383780 - RNA, 22 nt, Human
caggaggaagaacucugcaaca

SEQ ID NO: 383781 - RNA, 20 nt, Human
aguuuauuccaggagaacug

SEQ ID NO: 383782 - RNA, 22 nt, Human
ugaagcuuuccuguggucagga

SEQ ID NO: 383783 - RNA, 22 nt, Human
cuggaagggucuacuuagcaga

SEQ ID NO: 383784 - RNA, 22 nt, Human
acaaaggcagccaaucaucugc

SEQ ID NO: 383785 - RNA, 22 nt, Human
ggggagaguccuuuccaguucc

SEQ ID NO: 383786 - RNA, 22 nt, Human
gagaggaguaggcugauggugc

SEQ ID NO: 383787 - RNA, 22 nt, Human
gugcagauccugauugcaguuc

SEQ ID NO: 383788 - RNA, 22 nt, Human
cuacagaagaaacuaucacuau

SEQ ID NO: 383789 - RNA, 22 nt, Human
ggugaaggucuacugugugcca

SEQ ID NO: 383790 - RNA, 22 nt, Human
acacauaugguugcugcaguga

SEQ ID NO: 383791 - RNA, 22 nt, Human
uucagagccacuucaagucuaa

SEQ ID NO: 383792 - RNA, 22 nt, Human
ugcaggcugggaagagggacaa

SEQ ID NO: 383793 - RNA, 22 nt, Human
aaagccauuacaaaauuucaua

SEQ ID NO: 383794 - RNA, 22 nt, Human
agagugaaaagcuagagcagua

SEQ ID NO: 383795 - RNA, 22 nt, Human
uacaguagacaauguuaguaug

SEQ ID NO: 383796 - RNA, 22 nt, Human
gccuggcaggggccugggagug

SEQ ID NO: 383797 - RNA, 22 nt, Human
ugccagcccaccuuggggccuc

SEQ ID NO: 383798 - RNA, 22 nt, Human
cucuguagaaacagggcagaag

SEQ ID NO: 383799 - RNA, 22 nt, Human
agucaauucuuuucaacucaag

SEQ ID NO: 383800 - RNA, 22 nt, Human
uuuugagauggagucuugcucu

SEQ ID NO: 383801 - RNA, 19 nt, Human
ugcugcuguccuugcaggg

SEQ ID NO: 383802 - RNA, 22 nt, Human
uccagacccaugacccugggga

SEQ ID NO: 383803 - RNA, 22 nt, Human
agaagccauagucugggaggca

SEQ ID NO: 383804 - RNA, 22 nt, Human
gaauccaggguuguuugagcua

SEQ ID NO: 383805 - RNA, 22 nt, Human
gggcugcacagaucuucaaggg

SEQ ID NO: 383806 - RNA, 22 nt, Human
agaaauaugcugauuagaugaa

SEQ ID NO: 383807 - RNA, 22 nt, Human
agagccagcauuugggcccugc

SEQ ID NO: 383808 - RNA, 22 nt, Human
agaaaugacaagacugaucagg

SEQ ID NO: 383809 - RNA, 22 nt, Human
cuguccagaaagggggcaacaa

SEQ ID NO: 383810 - RNA, 22 nt, Human
ugaggcaggaguuaaugugcuc

SEQ ID NO: 383811 - RNA, 21 nt, Human
aggggacagaguagcuccagg

SEQ ID NO: 383812 - RNA, 23 nt, Human
cauaaaauauuaguaugguagca

SEQ ID NO: 383813 - RNA, 22 nt, Human
caucagaagaaagacaaaugau

SEQ ID NO: 383814 - RNA, 22 nt, Human
uuccaggagacuuccagaaaua

SEQ ID NO: 383815 - RNA, 22 nt, Human
aggguccaucaaggacugcaca

SEQ ID NO: 383816 - RNA, 22 nt, Human
aguccuuacucgggggcccaga

SEQ ID NO: 383817 - RNA, 22 nt, Human
ggaccugcucucccaguucucu

SEQ ID NO: 383818 - RNA, 22 nt, Human
gagcugccugaacaagcagcag

SEQ ID NO: 383819 - RNA, 22 nt, Human
ucagcuuucuauguugcuaaac

SEQ ID NO: 383820 - RNA, 22 nt, Human
agggcucugagcuggaccaccu

SEQ ID NO: 383821 - RNA, 22 nt, Human
caggccugucugcacaugaggc

SEQ ID NO: 383822 - RNA, 20 nt, Human
agcauuugaaauaugacuau

SEQ ID NO: 383823 - RNA, 23 nt, Human
uccaugagaugugggcuucuagu

SEQ ID NO: 383824 - RNA, 22 nt, Human
uggaagggagugacagucagag

SEQ ID NO: 383825 - RNA, 22 nt, Human
uguguacucaauugagccauuu

SEQ ID NO: 383826 - RNA, 22 nt, Human
uggacaggaucugagacugaga

SEQ ID NO: 383827 - RNA, 22 nt, Human
aucaguuucacuugcuugcaaa

SEQ ID NO: 383828 - RNA, 22 nt, Human
agaagugagugugacucagcag

SEQ ID NO: 383829 - RNA, 22 nt, Human
agguacaaaagaguauaugaga

SEQ ID NO: 383830 - RNA, 22 nt, Human
cccagcuucugagggggccuug

SEQ ID NO: 383831 - RNA, 22 nt, Human
ggauuucuuccuuccucagaag

SEQ ID NO: 383832 - RNA, 22 nt, Human
ucuucccuaaucaccaucuuca

SEQ ID NO: 383833 - RNA, 22 nt, Human
agacaguguguguauauauggu

SEQ ID NO: 383834 - RNA, 22 nt, Human
uccugggcccaggcugccaggg

SEQ ID NO: 383835 - RNA, 22 nt, Human
uuaaauuauuucuagugaggug

SEQ ID NO: 383836 - RNA, 18 nt, Human
ugcuuuaugcuuauauaa

SEQ ID NO: 383837 - RNA, 22 nt, Human
uuagaaagaacuuuagauauca

SEQ ID NO: 383838 - RNA, 22 nt, Human
gcucagagggaacaaggggcug

SEQ ID NO: 383839 - RNA, 23 nt, Human
uguagcaucucuuauuucucagc

SEQ ID NO: 383840 - RNA, 22 nt, Human
ccaggagucuggaugagguguc

SEQ ID NO: 383841 - RNA, 22 nt, Human
acagagcuucccagccugagca

SEQ ID NO: 383842 - RNA, 22 nt, Human
aauuuuaaucaguggugcugag

SEQ ID NO: 383843 - RNA, 21 nt, Human
cauugucgacauuuuccccuc

SEQ ID NO: 383844 - RNA, 22 nt, Human
ggagccuugggcgcucucccau

SEQ ID NO: 383845 - RNA, 22 nt, Human
ugcaaacaggagaguaaguaua

SEQ ID NO: 383846 - RNA, 22 nt, Human
auuuggaaaugcaucucuugag

SEQ ID NO: 383847 - RNA, 22 nt, Human
ugggaggagcccucugggaagg

SEQ ID NO: 383848 - RNA, 22 nt, Human
aaaguggucaccuucucauuuc

SEQ ID NO: 383849 - RNA, 22 nt, Human
cucuuaaauaacaucauugcuu

SEQ ID NO: 383850 - RNA, 22 nt, Human
uggcagcagggaggccaguguu

SEQ ID NO: 383851 - RNA, 22 nt, Human
uauuucagcacaugggauaggu

SEQ ID NO: 383852 - RNA, 22 nt, Human
ugcuugggaauguggagucaga

SEQ ID NO: 383853 - RNA, 22 nt, Human
cagguggggcgcccucaggcag

SEQ ID NO: 383854 - RNA, 22 nt, Human
caggacccaaccucccugcucu

SEQ ID NO: 383855 - RNA, 22 nt, Human
acagucucuccacacugcaggg

SEQ ID NO: 383856 - RNA, 22 nt, Human
cugcagaggucuugcugauggu

SEQ ID NO: 383857 - RNA, 19 nt, Human
aggcagucauuggaauaua

SEQ ID NO: 383858 - RNA, 22 nt, Human
uuacagauggaucuagcaaaau

SEQ ID NO: 383859 - RNA, 22 nt, Human
aguccuuugggaaaaaugacua

SEQ ID NO: 383860 - RNA, 22 nt, Human
uuucagauggagguuuaggaca

SEQ ID NO: 383861 - RNA, 22 nt, Human
ggcuuggaccagucacaguggu

SEQ ID NO: 383862 - RNA, 22 nt, Human
agugcuuuauguuguugugcaa

SEQ ID NO: 383863 - RNA, 22 nt, Human
cuggagcccaggccuggugucu

SEQ ID NO: 383864 - RNA, 22 nt, Human
ugggcagauguggcucuccuug

SEQ ID NO: 383865 - RNA, 22 nt, Human
agccagcuggagaccacuguuu

SEQ ID NO: 383866 - RNA, 22 nt, Human
agggcacccucucugcaguacc

SEQ ID NO: 383867 - RNA, 22 nt, Human
ccuuccaggugcaggcaagccu

SEQ ID NO: 383868 - RNA, 22 nt, Human
ugaauccagagcuauuucgucc

SEQ ID NO: 383869 - RNA, 22 nt, Human
accaggagccacaggaggagcc

SEQ ID NO: 383870 - RNA, 21 nt, Human
ccagagccugcugagcccccu

SEQ ID NO: 383871 - RNA, 22 nt, Human
cugucucucuaggacacugggg

SEQ ID NO: 383872 - RNA, 22 nt, Human
gcuucuaucccuccacugcacu

SEQ ID NO: 383873 - RNA, 22 nt, Human
uauaauuuuaagugguaaauua

SEQ ID NO: 383874 - RNA, 22 nt, Human
cagugccucuuaagugucaccc

SEQ ID NO: 383875 - RNA, 22 nt, Human
ggggcacacuuuugguagauau

SEQ ID NO: 383876 - RNA, 22 nt, Human
gaggggcugcccuggugucagg

SEQ ID NO: 383877 - RNA, 22 nt, Human
cuggcucacaggugagaugcau

SEQ ID NO: 383878 - RNA, 22 nt, Human
gcucccagacugaccagaggug

SEQ ID NO: 383879 - RNA, 22 nt, Human
auucuaggcuugaaacaugaag

SEQ ID NO: 383880 - RNA, 22 nt, Human
ucuuccagcaaugugaaaucac

SEQ ID NO: 383881 - RNA, 22 nt, Human
acugcagccuugaacucugggc

SEQ ID NO: 383882 - RNA, 22 nt, Human
ucucagaggcccgacguucucc

SEQ ID NO: 383883 - RNA, 22 nt, Human
uauaacaguuuaggugguguca

SEQ ID NO: 383884 - RNA, 18 nt, Human
ccucaggggaccuggcag

SEQ ID NO: 383885 - RNA, 22 nt, Human
cuggagccugcaguuuucacuu

SEQ ID NO: 383886 - RNA, 22 nt, Human
auuuccuuugcaaagacugugc

SEQ ID NO: 383887 - RNA, 22 nt, Human
ucccagagacaucauuucuccg

SEQ ID NO: 383888 - RNA, 22 nt, Human
uucuuuucuuuaggcauugugu

SEQ ID NO: 383889 - RNA, 23 nt, Human
auguuauuauuagcagucuugcc

SEQ ID NO: 383890 - RNA, 22 nt, Human
uccaggaggcagggcugugccc

SEQ ID NO: 383891 - RNA, 22 nt, Human
gaagcagcuaggaucuucauuu

SEQ ID NO: 383892 - RNA, 22 nt, Human
uaacagaaauaguaggugaggg

SEQ ID NO: 383893 - RNA, 22 nt, Human
uagauuucaggcuggcuugcgg

SEQ ID NO: 383894 - RNA, 22 nt, Human
uagauuucucauucauagauug

SEQ ID NO: 383895 - RNA, 22 nt, Human
cucccaagauaaauaaggcagu

SEQ ID NO: 383896 - RNA, 22 nt, Human
gugccugcagcaauccauggca

SEQ ID NO: 383897 - RNA, 22 nt, Human
uguuugaacugaauaacauagu

SEQ ID NO: 383898 - RNA, 22 nt, Human
gcuggccaggugcuuugguucu

SEQ ID NO: 383899 - RNA, 22 nt, Human
aguuauccgaaggcacugagau

SEQ ID NO: 383900 - RNA, 22 nt, Human
acaugauuuuuaaagagauaau

SEQ ID NO: 383901 - RNA, 20 nt, Human
gggugggagagucugagggu

SEQ ID NO: 383902 - RNA, 22 nt, Human
agcacccucagccuuauccaga

SEQ ID NO: 383903 - RNA, 22 nt, Human
acauugaugaaaagguaucauu

SEQ ID NO: 383904 - RNA, 22 nt, Human
gcaaggcagcgcggaguagcua

SEQ ID NO: 383905 - RNA, 22 nt, Human
agccaucauuucugucacuggc

SEQ ID NO: 383906 - RNA, 22 nt, Human
ugaaugauacagaauuauguag

SEQ ID NO: 383907 - RNA, 22 nt, Human
uccaggcaucccccaggacaga

SEQ ID NO: 383908 - RNA, 22 nt, Human
uuugcauaggauggacauuuua

SEQ ID NO: 383909 - RNA, 22 nt, Human
aguuugaaauguuggcaauauu

SEQ ID NO: 383910 - RNA, 22 nt, Human
cagagcagcagagcuuccaugg

SEQ ID NO: 383911 - RNA, 22 nt, Human
uuggccuucccuaccugggcca

SEQ ID NO: 383912 - RNA, 22 nt, Human
augcacgccccacacuggugug

SEQ ID NO: 383913 - RNA, 22 nt, Human
aaucuucuuucuuaacaguaca

SEQ ID NO: 383914 - RNA, 22 nt, Human
guguuuccucacuucucugacu

SEQ ID NO: 383915 - RNA, 22 nt, Human
ugaaagcucugucaucauuccu

SEQ ID NO: 383916 - RNA, 22 nt, Human
ucuuccaagguugcacacuauc

SEQ ID NO: 383917 - RNA, 22 nt, Human
gcaccugcaggaugagccaggg

SEQ ID NO: 383918 - RNA, 22 nt, Human
cuguucucuggcgguggcuguu

SEQ ID NO: 383919 - RNA, 22 nt, Human
cuucagaauccagaaucagaau

SEQ ID NO: 383920 - RNA, 21 nt, Human
uuucacaaaaguaugugacaa

SEQ ID NO: 383921 - RNA, 22 nt, Human
gcccagcacauugcugaggacc

SEQ ID NO: 383922 - RNA, 22 nt, Human
gugauuuaguguuaaguauguu

SEQ ID NO: 383923 - RNA, 22 nt, Human
ucuguucagaaauggaagugcc

SEQ ID NO: 383924 - RNA, 23 nt, Human
ggccuguguuuugucugaaguac

SEQ ID NO: 383925 - RNA, 22 nt, Human
agagacaccgcgcaucauggcu

SEQ ID NO: 383926 - RNA, 22 nt, Human
uaaaugcaguuaguacuugcca

SEQ ID NO: 383927 - RNA, 19 nt, Human
ggacacagaaagcugcauu

SEQ ID NO: 383928 - RNA, 22 nt, Human
cauugcuguuaauugucucuag

SEQ ID NO: 383929 - RNA, 21 nt, Human
aacugcuggucuuuucugucu

SEQ ID NO: 383930 - RNA, 22 nt, Human
gaaucacgguauucugcacggg

SEQ ID NO: 383931 - RNA, 22 nt, Human
aguggcagagccaaguagagcc

SEQ ID NO: 383932 - RNA, 22 nt, Human
caaagugcugagauuacaggua

SEQ ID NO: 383933 - RNA, 22 nt, Human
aagcccagcaucccugcaccag

SEQ ID NO: 383934 - RNA, 22 nt, Human
ugcucugucaagaaaagaugcc

SEQ ID NO: 383935 - RNA, 20 nt, Human
cccaggagcugugccccauc

SEQ ID NO: 383936 - RNA, 22 nt, Human
caguggagagacuuuuacucuu

SEQ ID NO: 383937 - RNA, 22 nt, Human
uggcucugucacugugagcuau

SEQ ID NO: 383938 - RNA, 22 nt, Human
aauacaguagguaauaguucau

SEQ ID NO: 383939 - RNA, 22 nt, Human
cagugauggauauggagaaguc

SEQ ID NO: 383940 - RNA, 22 nt, Human
uugcaagacacuuggaagcaca

SEQ ID NO: 383941 - RNA, 22 nt, Human
acagaguuaauggauaggcagg

SEQ ID NO: 383942 - RNA, 22 nt, Human
gaggaggaggaaguggaaccca

SEQ ID NO: 383943 - RNA, 22 nt, Human
uuuucauuguaaaucaggaaac

SEQ ID NO: 383944 - RNA, 22 nt, Human
cacuguuuuauuccaacauagg

SEQ ID NO: 383945 - RNA, 22 nt, Human
cuccucacuuuccagacugggc

SEQ ID NO: 383946 - RNA, 22 nt, Human
cuggagugaggucugggagccu

SEQ ID NO: 383947 - RNA, 22 nt, Human
gcucugugcaguucagggacac

SEQ ID NO: 383948 - RNA, 22 nt, Human
gagcugccagacaugggaauga

SEQ ID NO: 383949 - RNA, 22 nt, Human
ucucagaguuuagagcugagcc

SEQ ID NO: 383950 - RNA, 22 nt, Human
agcaggugacagggcuguggug

SEQ ID NO: 383951 - RNA, 18 nt, Human
agcagcugugccacacug

SEQ ID NO: 383952 - RNA, 20 nt, Human
uugauucccucuaaacucgc

SEQ ID NO: 383953 - RNA, 22 nt, Human
aaacauuguaauuuuagcaugg

SEQ ID NO: 383954 - RNA, 22 nt, Human
caggguggaaaagcuaguugga

SEQ ID NO: 383955 - RNA, 22 nt, Human
gcuauacaaguguagaauagag

SEQ ID NO: 383956 - RNA, 22 nt, Human
aaguguuuggggaucauuuuaa

SEQ ID NO: 383957 - RNA, 22 nt, Human
gguacaauucugggguaugcuc

SEQ ID NO: 383958 - RNA, 20 nt, Human
cugagcgucuaagaggugag

SEQ ID NO: 383959 - RNA, 22 nt, Human
uuccuuaggggacagggggaua

SEQ ID NO: 383960 - RNA, 22 nt, Human
aaugcaaagcaagcagagauuu

SEQ ID NO: 383961 - RNA, 22 nt, Human
ucaggagacuuaugucacagug

SEQ ID NO: 383962 - RNA, 22 nt, Human
uuugaaaggaauuaggaugaca

SEQ ID NO: 383963 - RNA, 22 nt, Human
ugucucugcuuuccuugcaggg

SEQ ID NO: 383964 - RNA, 22 nt, Human
ggggacaguuaaagaccaagac

SEQ ID NO: 383965 - RNA, 22 nt, Human
cuguccuaugaguacucacuag

SEQ ID NO: 383966 - RNA, 22 nt, Human
ggagauuuauagcacacuucag

SEQ ID NO: 383967 - RNA, 22 nt, Human
cuacauuuguucuauagcuuuu

SEQ ID NO: 383968 - RNA, 22 nt, Human
agugggaccggugcuauuccag

SEQ ID NO: 383969 - RNA, 22 nt, Human
gggggcuggacuuucccacaca

SEQ ID NO: 383970 - RNA, 22 nt, Human
cccuggagcugcuugcauguug

SEQ ID NO: 383971 - RNA, 22 nt, Human
aaguggaggccgaguucacgca

SEQ ID NO: 383972 - RNA, 22 nt, Human
uuaaacauuuauggaggcagca

SEQ ID NO: 383973 - RNA, 23 nt, Human
gcugggcuuacucuuucagugag

SEQ ID NO: 383974 - RNA, 19 nt, Human
gcugugccucucuccugcu

SEQ ID NO: 383975 - RNA, 22 nt, Human
guggaaugaauagauuugcauu

SEQ ID NO: 383976 - RNA, 22 nt, Human
ugucacaguuuguacuuuauag

SEQ ID NO: 383977 - RNA, 22 nt, Human
auagaauuugcacuaaaucugc

SEQ ID NO: 383978 - RNA, 22 nt, Human
uggguggaauaaaucaguucug

SEQ ID NO: 383979 - RNA, 22 nt, Human
uggagcaggugcucaggguaau

SEQ ID NO: 383980 - RNA, 22 nt, Human
gcaggagcaaacugcagugugg

SEQ ID NO: 383981 - RNA, 22 nt, Human
gcugagcuagaaaaggaccaca

SEQ ID NO: 383982 - RNA, 22 nt, Human
cuggcagcugugugaagaacug

SEQ ID NO: 383983 - RNA, 22 nt, Human
gagaagcaauuuccaacugugc

SEQ ID NO: 383984 - RNA, 22 nt, Human
agggcucugggguggcagagau

SEQ ID NO: 383985 - RNA, 22 nt, Human
gggacgggcaguccaagggguc

SEQ ID NO: 383986 - RNA, 22 nt, Human
auauaggcuaacaacuauugag

SEQ ID NO: 383987 - RNA, 22 nt, Human
cccagcaggaggagguugcagu

SEQ ID NO: 383988 - RNA, 22 nt, Human
ucauacauaacuuguacaguga

SEQ ID NO: 383989 - RNA, 22 nt, Human
uuugcauuguuucaaaagugaa

SEQ ID NO: 383990 - RNA, 19 nt, Human
ugaagcagcaaacucucag

SEQ ID NO: 383991 - RNA, 22 nt, Human
agcccaggaaguugaggcuugc

SEQ ID NO: 383992 - RNA, 18 nt, Human
ggcaugugagugcugagg

SEQ ID NO: 383993 - RNA, 22 nt, Human
gggcugcuguagagaacauguu

SEQ ID NO: 383994 - RNA, 22 nt, Human
agaagccacaggccucgucugg

SEQ ID NO: 383995 - RNA, 20 nt, Human
aagggcagagggaacagacu

SEQ ID NO: 383996 - RNA, 22 nt, Human
gcaggaugggagcuucacucug

SEQ ID NO: 383997 - RNA, 22 nt, Human
gccuugcuuugcuucuggacag

SEQ ID NO: 383998 - RNA, 22 nt, Human
gaggcgagaagcuggagauggu

SEQ ID NO: 383999 - RNA, 22 nt, Human
uagcccagcaugagcagagcug

SEQ ID NO: 384000 - RNA, 19 nt, Human
gcgaggaagucacuguggu

SEQ ID NO: 384001 - RNA, 22 nt, Human
auauaaaguguuuagaaagcug

SEQ ID NO: 384002 - RNA, 22 nt, Human
ggaagccagagugcugggcagg

SEQ ID NO: 384003 - RNA, 22 nt, Human
cagucccacuagugccaauacc

SEQ ID NO: 384004 - RNA, 22 nt, Human
acauuuaaauaugccuuauauu

SEQ ID NO: 384005 - RNA, 20 nt, Human
cuucuucagccuaugcuuca

SEQ ID NO: 384006 - RNA, 22 nt, Human
cagaccugagguugaguaccag

SEQ ID NO: 384007 - RNA, 22 nt, Human
cagccagguucaaguccuuaua

SEQ ID NO: 384008 - RNA, 22 nt, Human
guguccagagaaacucacagcu

SEQ ID NO: 384009 - RNA, 22 nt, Human
gacauucacagguaaacauucc

SEQ ID NO: 384010 - RNA, 22 nt, Human
aaaugauugucaaaguucuguu

SEQ ID NO: 384011 - RNA, 22 nt, Human
gugcagcugugguggagccagg

SEQ ID NO: 384012 - RNA, 22 nt, Human
gugugcagggcugccugugccg

SEQ ID NO: 384013 - RNA, 22 nt, Human
gagcagcuccagccgcaugacu

SEQ ID NO: 384014 - RNA, 22 nt, Human
uaaauguguguagccaucugug

SEQ ID NO: 384015 - RNA, 19 nt, Human
ucaggcaguuauucacaaa

SEQ ID NO: 384016 - RNA, 22 nt, Human
agccucugacugucagcaaggu

SEQ ID NO: 384017 - RNA, 19 nt, Human
gaggaggcuucagcuuucu

SEQ ID NO: 384018 - RNA, 22 nt, Human
ugugaaggagaugaagggagug

SEQ ID NO: 384019 - RNA, 22 nt, Human
uacaaaguuugagaaugcuuuc

SEQ ID NO: 384020 - RNA, 22 nt, Human
gaaauguguuguucauuucuaa

SEQ ID NO: 384021 - RNA, 22 nt, Human
ccucccagugccuccagagcag

SEQ ID NO: 384022 - RNA, 22 nt, Human
gaaaauagcagauagaccaaug

SEQ ID NO: 384023 - RNA, 18 nt, Human
aagcugcccucaggcagg

SEQ ID NO: 384024 - RNA, 22 nt, Human
gcugagggcauguguggcgacu

SEQ ID NO: 384025 - RNA, 19 nt, Human
gcugugggacagcagggug

SEQ ID NO: 384026 - RNA, 20 nt, Human
aaucagaaagugugagcucu

SEQ ID NO: 384027 - RNA, 22 nt, Human
acacagggaggaggugcugugc

SEQ ID NO: 384028 - RNA, 22 nt, Human
uuuaugaacuacagauauaacu

SEQ ID NO: 384029 - RNA, 22 nt, Human
aagagcugcaucuaagccauga

SEQ ID NO: 384030 - RNA, 22 nt, Human
augaaacaugcuuuguggauga

SEQ ID NO: 384031 - RNA, 22 nt, Human
ccaggcuggauuuugcaguuca

SEQ ID NO: 384032 - RNA, 22 nt, Human
gggaagcaggugcagcucgccu

SEQ ID NO: 384033 - RNA, 22 nt, Human
aagcagcacgcuuugccaacaa

SEQ ID NO: 384034 - RNA, 22 nt, Human
gaggccuggaauuccagccugg

SEQ ID NO: 384035 - RNA, 22 nt, Human
gugggcagugguuugcgcgguc

SEQ ID NO: 384036 - RNA, 22 nt, Human
gcuugggauaugcugauguaaa

SEQ ID NO: 384037 - RNA, 22 nt, Human
uauuucuucgggauucaagcua

SEQ ID NO: 384038 - RNA, 22 nt, Human
uuucaacguguaaucuuauuua

SEQ ID NO: 384039 - RNA, 22 nt, Human
aauuucagaccauuugcaauua

SEQ ID NO: 384040 - RNA, 22 nt, Human
aacaucuuuuuguuugcugaaa

SEQ ID NO: 384041 - RNA, 22 nt, Human
auaacagaguugggaagugaaa

SEQ ID NO: 384042 - RNA, 22 nt, Human
cagggagcuuucccaggacccu

SEQ ID NO: 384043 - RNA, 22 nt, Human
uauuuauaccaggugaucggag

SEQ ID NO: 384044 - RNA, 22 nt, Human
ucaggggcuugaggugcauguc

SEQ ID NO: 384045 - RNA, 22 nt, Human
caggagcucuuaaggaugugau

SEQ ID NO: 384046 - RNA, 22 nt, Human
ccagcuccaaguuugggcauca

SEQ ID NO: 384047 - RNA, 22 nt, Human
caggauggugugagugugagga

SEQ ID NO: 384048 - RNA, 22 nt, Human
uuuaauuuuccugguaggccug

SEQ ID NO: 384049 - RNA, 22 nt, Human
gcaaacaaggacauacauccug

SEQ ID NO: 384050 - RNA, 22 nt, Human
uguauacaggcauaagagauac

SEQ ID NO: 384051 - RNA, 22 nt, Human
auauaaagaaguggaaaaugag

SEQ ID NO: 384052 - RNA, 22 nt, Human
aauaacagauuuucaagcugug

SEQ ID NO: 384053 - RNA, 21 nt, Human
ugccagcauguaggcuaguug

SEQ ID NO: 384054 - RNA, 22 nt, Human
aggucagcaggccaggggcgaa

SEQ ID NO: 384055 - RNA, 22 nt, Human
ccaggugguucaggucaccaua

SEQ ID NO: 384056 - RNA, 22 nt, Human
auucuucacuguuucagaauga

SEQ ID NO: 384057 - RNA, 22 nt, Human
ccagagcagauguggccuuggu

SEQ ID NO: 384058 - RNA, 22 nt, Human
gagugagggcagcaggggcugc

SEQ ID NO: 384059 - RNA, 22 nt, Human
ucaggccacuucacaggugauu

SEQ ID NO: 384060 - RNA, 20 nt, Human
gaggcugcggacugcuggac

SEQ ID NO: 384061 - RNA, 22 nt, Human
uccagcucuaacaugcugggcc

SEQ ID NO: 384062 - RNA, 22 nt, Human
caaaugcuaacuucuuuccaaa

SEQ ID NO: 384063 - RNA, 23 nt, Human
agcagccauagggaagcaauaca

SEQ ID NO: 384064 - RNA, 22 nt, Human
agcugcucccuauccuuuccuu

SEQ ID NO: 384065 - RNA, 22 nt, Human
gaguggggcguggauccagcgu

SEQ ID NO: 384066 - RNA, 20 nt, Human
uuucugugcccaggucuguu

SEQ ID NO: 384067 - RNA, 22 nt, Human
uugaacauuaacuucagucuau

SEQ ID NO: 384068 - RNA, 22 nt, Human
agccaacuaauuaaacaacuuu

SEQ ID NO: 384069 - RNA, 22 nt, Human
uucaauucugcucugaucuuag

SEQ ID NO: 384070 - RNA, 22 nt, Human
gggccuggcaugcagccccguu

SEQ ID NO: 384071 - RNA, 22 nt, Human
aggcugggaaauguagucuucc

SEQ ID NO: 384072 - RNA, 22 nt, Human
aaaacuguaucuucuugggacu

SEQ ID NO: 384073 - RNA, 22 nt, Human
aggcugggaaauguauuccagc

SEQ ID NO: 384074 - RNA, 22 nt, Human
ugccugugguuccaguuuuuuc

SEQ ID NO: 384075 - RNA, 22 nt, Human
gagugcaguaucuucugugucc

SEQ ID NO: 384076 - RNA, 21 nt, Human
agccugggaggcggagguugc

SEQ ID NO: 384077 - RNA, 22 nt, Human
cagcuggcgggcagagccgcca

SEQ ID NO: 384078 - RNA, 22 nt, Human
ucaggcagagggagaagccaag

SEQ ID NO: 384079 - RNA, 22 nt, Human
auuugcuuaucuccacaguugu

SEQ ID NO: 384080 - RNA, 22 nt, Human
gcacaggcacagagggccacug

SEQ ID NO: 384081 - RNA, 22 nt, Human
uacccagcuucaagucaggacu

SEQ ID NO: 384082 - RNA, 22 nt, Human
ucagacaguuugcagugugccu

SEQ ID NO: 384083 - RNA, 15 nt, Human
ugauuuccuacuaac

SEQ ID NO: 384084 - RNA, 22 nt, Human
uggcugaacuaaugugcuguuu

SEQ ID NO: 384085 - RNA, 22 nt, Human
gcagacagccagacugcacugg

SEQ ID NO: 384086 - RNA, 22 nt, Human
gccaggcuggaaagaacagaca

SEQ ID NO: 384087 - RNA, 19 nt, Human
uaaaaugucuguggucagu

SEQ ID NO: 384088 - RNA, 22 nt, Human
aggcggcuccgggagugugggc

SEQ ID NO: 384089 - RNA, 22 nt, Human
augaggcucucaggggagcugu

SEQ ID NO: 384090 - RNA, 22 nt, Human
cucuucuugaaagaggaauuca

SEQ ID NO: 384091 - RNA, 22 nt, Human
augcugugucuagcaggaacac

SEQ ID NO: 384092 - RNA, 22 nt, Human
acaaaaauuagcugggcauggu

SEQ ID NO: 384093 - RNA, 22 nt, Human
caggcagcccugcaccaagugu

SEQ ID NO: 384094 - RNA, 22 nt, Human
ucagaggucccuagcaggagug

SEQ ID NO: 384095 - RNA, 22 nt, Human
auuaggcagggcaugguggcuc

SEQ ID NO: 384096 - RNA, 22 nt, Human
uguagcauguaaauugguuauu

SEQ ID NO: 384097 - RNA, 18 nt, Human
acagcagguuucauucuu

SEQ ID NO: 384098 - RNA, 22 nt, Human
uucaagauccagcacaacagug

SEQ ID NO: 384099 - RNA, 22 nt, Human
cuguggcauugccgaggcuggc

SEQ ID NO: 384100 - RNA, 22 nt, Human
accaaggaguuugguauuuuag

SEQ ID NO: 384101 - RNA, 22 nt, Human
aaguccuucuuuauaugagagu

SEQ ID NO: 384102 - RNA, 22 nt, Human
cauuuacacuucuaaccacaag

SEQ ID NO: 384103 - RNA, 22 nt, Human
ugcugccucagcuuccugggcu

SEQ ID NO: 384104 - RNA, 22 nt, Human
gacggcagaaacucaugagguc

SEQ ID NO: 384105 - RNA, 22 nt, Human
acaugggaucaaugaggcaggc

SEQ ID NO: 384106 - RNA, 22 nt, Human
acccagccacagcauugaggga

SEQ ID NO: 384107 - RNA, 21 nt, Human
agggagcuggccacacagccu

SEQ ID NO: 384108 - RNA, 19 nt, Human
agcauuuggaauucuacac

SEQ ID NO: 384109 - RNA, 22 nt, Human
ggugggcagcucuuggcaggca

SEQ ID NO: 384110 - RNA, 22 nt, Human
uuguuacacauaauaacauuuu

SEQ ID NO: 384111 - RNA, 22 nt, Human
uucuuaauaccuauuuucuacc

SEQ ID NO: 384112 - RNA, 22 nt, Human
ucccagggacaccaagcuguuu

SEQ ID NO: 384113 - RNA, 22 nt, Human
uccagcuuugagauuuuaugga

SEQ ID NO: 384114 - RNA, 22 nt, Human
ggagaggauguuuuaguaacuu

SEQ ID NO: 384115 - RNA, 22 nt, Human
gaggcagcgggucaggaccgug

SEQ ID NO: 384116 - RNA, 18 nt, Human
ugaacagaugaguugaag

SEQ ID NO: 384117 - RNA, 22 nt, Human
ggaaagaggauaguggguaggu

SEQ ID NO: 384118 - RNA, 21 nt, Human
ucccagggccaggugccauca

SEQ ID NO: 384119 - RNA, 22 nt, Human
cagaagaauggugucugagcuc

SEQ ID NO: 384120 - RNA, 17 nt, Human
gccugcaggcccgcaga

SEQ ID NO: 384121 - RNA, 22 nt, Human
gggcugcugccaaucacagccu

SEQ ID NO: 384122 - RNA, 22 nt, Human
acguguucaauuuccaucugac

SEQ ID NO: 384123 - RNA, 22 nt, Human
agguggccggugccagccgggc

SEQ ID NO: 384124 - RNA, 22 nt, Human
guauuuucaagagcaguaguau

SEQ ID NO: 384125 - RNA, 22 nt, Human
caggaugagguagaggcagaua

SEQ ID NO: 384126 - RNA, 22 nt, Human
ucagggcauggcugcacuuggc

SEQ ID NO: 384127 - RNA, 22 nt, Human
agcccagguucuaaagccaaac

SEQ ID NO: 384128 - RNA, 22 nt, Human
cuccauugaacauccucucaga

SEQ ID NO: 384129 - RNA, 22 nt, Human
agauuucacaugcugcucuauu

SEQ ID NO: 384130 - RNA, 22 nt, Human
uggggcuggggaucuugagccu

SEQ ID NO: 384131 - RNA, 22 nt, Human
gaauuugaaaagugaugggaau

SEQ ID NO: 384132 - RNA, 22 nt, Human
aucagaaaggugggcaagcaga

SEQ ID NO: 384133 - RNA, 19 nt, Human
ggcagcuugggaagguagc

SEQ ID NO: 384134 - RNA, 22 nt, Human
cccagcucaucaggagccgccc

SEQ ID NO: 384135 - RNA, 22 nt, Human
uggccugcagcucucagggaag

SEQ ID NO: 384136 - RNA, 22 nt, Human
cacuacuugaaagaauuacaga

SEQ ID NO: 384137 - RNA, 22 nt, Human
ggucccagaauugguuagcaca

SEQ ID NO: 384138 - RNA, 22 nt, Human
uuggaaggcccugccuagcagg

SEQ ID NO: 384139 - RNA, 22 nt, Human
cuccaggccauggcugcggagg

SEQ ID NO: 384140 - RNA, 20 nt, Human
ucucuucuggggagauaaaa

SEQ ID NO: 384141 - RNA, 22 nt, Human
aagcuuuaagugucagucagcc

SEQ ID NO: 384142 - RNA, 22 nt, Human
ccugcacuaccuggggcugcug

SEQ ID NO: 384143 - RNA, 22 nt, Human
guguaauuauauaaagaucuac

SEQ ID NO: 384144 - RNA, 22 nt, Human
cuggauuuuagaaggcuuccua

SEQ ID NO: 384145 - RNA, 20 nt, Human
aauuuacucacagaaugaau

SEQ ID NO: 384146 - RNA, 22 nt, Human
ugagcagggacuuugaguguag

SEQ ID NO: 384147 - RNA, 21 nt, Human
ggcagcacuaccugaagcaua

SEQ ID NO: 384148 - RNA, 22 nt, Human
gcugaaugaauguauuuuaaaa

SEQ ID NO: 384149 - RNA, 21 nt, Human
uugaaggaucacuucuguacc

SEQ ID NO: 384150 - RNA, 21 nt, Human
auuuucauuuccaggggagga

SEQ ID NO: 384151 - RNA, 22 nt, Human
ugacaccacaacuagccauuga

SEQ ID NO: 384152 - RNA, 22 nt, Human
uggagcccagacacuggcauug

SEQ ID NO: 384153 - RNA, 22 nt, Human
gaggcugggaaguccaagauca

SEQ ID NO: 384154 - RNA, 22 nt, Human
agauaaaaugguucaaaggcua

SEQ ID NO: 384155 - RNA, 22 nt, Human
uuucaugagauuccuccacauc

SEQ ID NO: 384156 - RNA, 22 nt, Human
ccagagccuaagaucugauccu

SEQ ID NO: 384157 - RNA, 22 nt, Human
agaagccagcuucagcugcccg

SEQ ID NO: 384158 - RNA, 22 nt, Human
ggguguccugugccaagcuggg

SEQ ID NO: 384159 - RNA, 22 nt, Human
acagguggaggcuuuaggaggu

SEQ ID NO: 384160 - RNA, 20 nt, Human
cccagugaagcauggaagag

SEQ ID NO: 384161 - RNA, 22 nt, Human
agaaagaacguugguuaucuua

SEQ ID NO: 384162 - RNA, 20 nt, Human
caccaggcgcucugagaaca

SEQ ID NO: 384163 - RNA, 22 nt, Human
agggcugguauguccaugaaag

SEQ ID NO: 384164 - RNA, 22 nt, Human
auggaaagcuaagccauuuacc

SEQ ID NO: 384165 - RNA, 22 nt, Human
gaggaaggcuaaggggcuuaga

SEQ ID NO: 384166 - RNA, 22 nt, Human
uuaagcaacacacauuaauuau

SEQ ID NO: 384167 - RNA, 22 nt, Human
uaacaucuuuagcagcucgaac

SEQ ID NO: 384168 - RNA, 22 nt, Human
gcaaaugaguuguaacauaaaa

SEQ ID NO: 384169 - RNA, 22 nt, Human
ggcugagccaugggcacugcag

SEQ ID NO: 384170 - RNA, 22 nt, Human
gcagggacaaggcagguguucu

SEQ ID NO: 384171 - RNA, 18 nt, Human
uuucacagauucaugacu

SEQ ID NO: 384172 - RNA, 22 nt, Human
uaugaguacaaggacucugucu

SEQ ID NO: 384173 - RNA, 20 nt, Human
ucugcucagcccucaguggc

SEQ ID NO: 384174 - RNA, 22 nt, Human
gauuuuaauuauaggagguccu

SEQ ID NO: 384175 - RNA, 22 nt, Human
gccagcagguugucaaggagcu

SEQ ID NO: 384176 - RNA, 22 nt, Human
uuaaaacagcgugaaucuggca

SEQ ID NO: 384177 - RNA, 22 nt, Human
cggcuggggcuguccccaugac

SEQ ID NO: 384178 - RNA, 22 nt, Human
cccagcaucuccaggcauggcc

SEQ ID NO: 384179 - RNA, 22 nt, Human
uauuucuuucagguauguguug

SEQ ID NO: 384180 - RNA, 22 nt, Human
ugucacauaauuuaucuguagg

SEQ ID NO: 384181 - RNA, 22 nt, Human
acuggagcccguggaggcgcag

SEQ ID NO: 384182 - RNA, 22 nt, Human
auuucacaaagaacagaugcag

SEQ ID NO: 384183 - RNA, 22 nt, Human
gcagggaccagggccagaucca

SEQ ID NO: 384184 - RNA, 22 nt, Human
guggccaggacauugccaggca

SEQ ID NO: 384185 - RNA, 22 nt, Human
agccaggaaugcaugcucugcu

SEQ ID NO: 384186 - RNA, 22 nt, Human
ggcuucuguccucuggaucugu

SEQ ID NO: 384187 - RNA, 22 nt, Human
cugaaugaggaaaagagugagg

SEQ ID NO: 384188 - RNA, 22 nt, Human
aaugggauaggucuucaggaau

SEQ ID NO: 384189 - RNA, 22 nt, Human
caagugucuauaucagugcuug

SEQ ID NO: 384190 - RNA, 22 nt, Human
cagccaggacagggaaacuagu

SEQ ID NO: 384191 - RNA, 22 nt, Human
ggcuggcaagugucugcucaug

SEQ ID NO: 384192 - RNA, 22 nt, Human
aagggcucuguugccauuucag

SEQ ID NO: 384193 - RNA, 22 nt, Human
gaggaggccaguggaaggaagc

SEQ ID NO: 384194 - RNA, 22 nt, Human
ggggaugguagaccggugacgu

SEQ ID NO: 384195 - RNA, 22 nt, Human
cauguuauuuauccauuaaaca

SEQ ID NO: 384196 - RNA, 22 nt, Human
guacagaaaguacccauagaag

SEQ ID NO: 384197 - RNA, 22 nt, Human
aggaaaaucgagucuggaggca

SEQ ID NO: 384198 - RNA, 22 nt, Human
gcugugcagguccccacugccu

SEQ ID NO: 384199 - RNA, 22 nt, Human
ccaggagccacucaggcccaca

SEQ ID NO: 384200 - RNA, 22 nt, Human
ccaaaugugccuguuucaacaa

SEQ ID NO: 384201 - RNA, 22 nt, Human
agcuucccaagguuggaagguu

SEQ ID NO: 384202 - RNA, 22 nt, Human
ucugccuugagguccucagcuc

SEQ ID NO: 384203 - RNA, 22 nt, Human
gcugggaagugcaagaucaagg

SEQ ID NO: 384204 - RNA, 22 nt, Human
agaaauguuguggguuuuguua

SEQ ID NO: 384205 - RNA, 23 nt, Human
cccagggacacgaugacaccucc

SEQ ID NO: 384206 - RNA, 22 nt, Human
uucuccagaccuugugacuaug

SEQ ID NO: 384207 - RNA, 20 nt, Human
uccaagggcagcagaaucag

SEQ ID NO: 384208 - RNA, 22 nt, Human
guaaucucagcuacuugggagg

SEQ ID NO: 384209 - RNA, 22 nt, Human
uucaggauucucucccauuuac

SEQ ID NO: 384210 - RNA, 22 nt, Human
aaguccagcucuaaauaucuga

SEQ ID NO: 384211 - RNA, 22 nt, Human
uguggcuguguccaccugcugc

SEQ ID NO: 384212 - RNA, 22 nt, Human
acuuuuaaaugaguuucaguug

SEQ ID NO: 384213 - RNA, 22 nt, Human
uaaagguagugugacauauugu

SEQ ID NO: 384214 - RNA, 22 nt, Human
cgcugggcgccgaccugcuggc

SEQ ID NO: 384215 - RNA, 22 nt, Human
cugcagggcagggccuccuggc

SEQ ID NO: 384216 - RNA, 22 nt, Human
uugaggagcacuagucagguau

SEQ ID NO: 384217 - RNA, 22 nt, Human
aggcaggcccucuggaaaggua

SEQ ID NO: 384218 - RNA, 22 nt, Human
agcagggccucuggcacugguc

SEQ ID NO: 384219 - RNA, 22 nt, Human
agugcuguuagguuaauauagu

SEQ ID NO: 384220 - RNA, 23 nt, Human
aggcccaacucugugagggcugc

SEQ ID NO: 384221 - RNA, 22 nt, Human
uaguuaggaaaguccagggagc

SEQ ID NO: 384222 - RNA, 22 nt, Human
gacagggcaagacucugucuaa

SEQ ID NO: 384223 - RNA, 22 nt, Human
cauguuuucuaggcuuucacaa

SEQ ID NO: 384224 - RNA, 22 nt, Human
gccagggaaacugcagaccagc

SEQ ID NO: 384225 - RNA, 22 nt, Human
uacagacaguuuuucagauauu

SEQ ID NO: 384226 - RNA, 22 nt, Human
gcucugcugcuuacuagauggu

SEQ ID NO: 384227 - RNA, 22 nt, Human
uccagcagguccgagacaaguu

SEQ ID NO: 384228 - RNA, 22 nt, Human
aaggcugagagucacaguccua

SEQ ID NO: 384229 - RNA, 22 nt, Human
acaagauaaggugucagugugu

SEQ ID NO: 384230 - RNA, 22 nt, Human
agcagagccugggcuaggggug

SEQ ID NO: 384231 - RNA, 22 nt, Human
uccauuuucuugcucuagguaa

SEQ ID NO: 384232 - RNA, 22 nt, Human
aggucauuaaaguuaaaugagg

SEQ ID NO: 384233 - RNA, 18 nt, Human
ggcagcuugacuagcaac

SEQ ID NO: 384234 - RNA, 23 nt, Human
ugucauugugacuacagaaccag

SEQ ID NO: 384235 - RNA, 22 nt, Human
ggcugccugaggcagugagaga

SEQ ID NO: 384236 - RNA, 22 nt, Human
agagcccugaagcagagcuaaa

SEQ ID NO: 384237 - RNA, 19 nt, Human
ucgagucaagacacuaggc

SEQ ID NO: 384238 - RNA, 22 nt, Human
ucagcccugggacccagggaug

SEQ ID NO: 384239 - RNA, 21 nt, Human
ucaggagagcccaucuacaaa

SEQ ID NO: 384240 - RNA, 22 nt, Human
aaggaguuuggguagucauaca

SEQ ID NO: 384241 - RNA, 22 nt, Human
ggcuggagauaugucuggaaca

SEQ ID NO: 384242 - RNA, 22 nt, Human
uuuuaagaugcuaguauuucag

SEQ ID NO: 384243 - RNA, 22 nt, Human
ccuccugggccuugcucuguga

SEQ ID NO: 384244 - RNA, 22 nt, Human
aaggugucggguuagcucagcc

SEQ ID NO: 384245 - RNA, 22 nt, Human
cacauugaaaugacccaauaau

SEQ ID NO: 384246 - RNA, 22 nt, Human
augaggcaaucaugguccaguu

SEQ ID NO: 384247 - RNA, 22 nt, Human
caaagcaccacaaaccagguga

SEQ ID NO: 384248 - RNA, 22 nt, Human
augagcugugggauuccagagg

SEQ ID NO: 384249 - RNA, 22 nt, Human
acaggcaggcgggacagcccga

SEQ ID NO: 384250 - RNA, 22 nt, Human
acaucugaccauuacaagacau

SEQ ID NO: 384251 - RNA, 22 nt, Human
uugaagaaagucauauauaaug

SEQ ID NO: 384252 - RNA, 22 nt, Human
ggcagucagugugguucauaaa

SEQ ID NO: 384253 - RNA, 22 nt, Human
cuggugugauugagcccaggug

SEQ ID NO: 384254 - RNA, 20 nt, Human
aggcugaguucuaugcacuu

SEQ ID NO: 384255 - RNA, 22 nt, Human
agcagggcugcggccccaccac

SEQ ID NO: 384256 - RNA, 22 nt, Human
cugggcagaauuuuaggauggc

SEQ ID NO: 384257 - RNA, 22 nt, Human
cagggcaguuugugccuaugag

SEQ ID NO: 384258 - RNA, 22 nt, Human
gacuuuggcaucuagacauugu

SEQ ID NO: 384259 - RNA, 22 nt, Human
ucagcugcucuguugagcugaa

SEQ ID NO: 384260 - RNA, 22 nt, Human
cagcucuggcgucagggagcga

SEQ ID NO: 384261 - RNA, 22 nt, Human
cagagcagacguugagauuaag

SEQ ID NO: 384262 - RNA, 22 nt, Human
uuacaucuaaacugugaacaau

SEQ ID NO: 384263 - RNA, 22 nt, Human
aaucagaaauugagggucuggu

SEQ ID NO: 384264 - RNA, 22 nt, Human
gcagcauugcacuuuuguucuu

SEQ ID NO: 384265 - RNA, 22 nt, Human
ucucacugggucacagcagagg

SEQ ID NO: 384266 - RNA, 22 nt, Human
auuaggcacuagaaugucaauu

SEQ ID NO: 384267 - RNA, 22 nt, Human
auguuuccgugagcauccuuga

SEQ ID NO: 384268 - RNA, 22 nt, Human
ggcugcugugaccucaggugau

SEQ ID NO: 384269 - RNA, 22 nt, Human
ccaggaugacccccacuuuccu

SEQ ID NO: 384270 - RNA, 22 nt, Human
uugacagcaaagauugugccua

SEQ ID NO: 384271 - RNA, 22 nt, Human
ugcucccaaacgaccuacugug

SEQ ID NO: 384272 - RNA, 22 nt, Human
uucacauuggugauauguuucu

SEQ ID NO: 384273 - RNA, 22 nt, Human
agaauccugaugaaaaggagag

SEQ ID NO: 384274 - RNA, 22 nt, Human
agauggggcucaguguggaggc

SEQ ID NO: 384275 - RNA, 23 nt, Human
aaguucaagucacagccugucuu

SEQ ID NO: 384276 - RNA, 22 nt, Human
aagucaccccacacucuuggga

SEQ ID NO: 384277 - RNA, 22 nt, Human
ucuccccaaaggacucacucuc

SEQ ID NO: 384278 - RNA, 18 nt, Human
ugggauggagaguaacug

SEQ ID NO: 384279 - RNA, 22 nt, Human
agagcugaaaaagcugacccgg

SEQ ID NO: 384280 - RNA, 22 nt, Human
uucuuacagcccuauuacuaaa

SEQ ID NO: 384281 - RNA, 22 nt, Human
aggauuuacuagcaaggauucu

SEQ ID NO: 384282 - RNA, 22 nt, Human
agcagugaaacagcugcauaug

SEQ ID NO: 384283 - RNA, 20 nt, Human
uccuugaaagugggguauau

SEQ ID NO: 384284 - RNA, 22 nt, Human
gggaguggguuuggccuaggcc

SEQ ID NO: 384285 - RNA, 19 nt, Human
ucagggcaguccggucccc

SEQ ID NO: 384286 - RNA, 22 nt, Human
cugacucagcagcugaugaucc

SEQ ID NO: 384287 - RNA, 20 nt, Human
aggaggggauagaaucaaag

SEQ ID NO: 384288 - RNA, 22 nt, Human
cauaauuuuuuuaagucagaac

SEQ ID NO: 384289 - RNA, 22 nt, Human
ucagaggaauaaugcugcauuu

SEQ ID NO: 384290 - RNA, 22 nt, Human
ugcagggacaggcucuggggau

SEQ ID NO: 384291 - RNA, 22 nt, Human
agauucuacucuagauccaugg

SEQ ID NO: 384292 - RNA, 22 nt, Human
gcuggccuugugucugaggaag

SEQ ID NO: 384293 - RNA, 22 nt, Human
caccaggugcuggaggacauca

SEQ ID NO: 384294 - RNA, 22 nt, Human
ccaaggaggccccaggucagcu

SEQ ID NO: 384295 - RNA, 22 nt, Human
uagaaaugcaguguacuguguc

SEQ ID NO: 384296 - RNA, 22 nt, Human
auuucucagcacuuccuaucuc

SEQ ID NO: 384297 - RNA, 17 nt, Human
gcagugaaaagagauca

SEQ ID NO: 384298 - RNA, 22 nt, Human
uccuugaaaaucuugguuuaga

SEQ ID NO: 384299 - RNA, 22 nt, Human
aaugagcugcugcuguuccacc

SEQ ID NO: 384300 - RNA, 22 nt, Human
gugccugguuuggggaguguuc

SEQ ID NO: 384301 - RNA, 22 nt, Human
agggugccugcugcagguucag

SEQ ID NO: 384302 - RNA, 20 nt, Human
uguuaaaggacacuugcuuu

SEQ ID NO: 384303 - RNA, 22 nt, Human
auguaucaauuaucugucugca

SEQ ID NO: 384304 - RNA, 20 nt, Human
aaggcacuaugucugcuagc

SEQ ID NO: 384305 - RNA, 22 nt, Human
ucuuucucucuaaucaagcaca

SEQ ID NO: 384306 - RNA, 22 nt, Human
cugggcugcgggcgccccucca

SEQ ID NO: 384307 - RNA, 22 nt, Human
ggcaggcaggucuucauggccc

SEQ ID NO: 384308 - RNA, 22 nt, Human
acccaggagagagcuauaaaau

SEQ ID NO: 384309 - RNA, 22 nt, Human
agaagcuugaaggagcagugac

SEQ ID NO: 384310 - RNA, 22 nt, Human
gaccauuucuaggaaucagacu

SEQ ID NO: 384311 - RNA, 22 nt, Human
ccagagcaauucucacagaacu

SEQ ID NO: 384312 - RNA, 22 nt, Human
aauguacaaggguuccaguuuu

SEQ ID NO: 384313 - RNA, 22 nt, Human
ugcagggaaucuguggcuggac

SEQ ID NO: 384314 - RNA, 22 nt, Human
agauacauauagaaaacaucaa

SEQ ID NO: 384315 - RNA, 22 nt, Human
aaguuaugaaauuuggacagcu

SEQ ID NO: 384316 - RNA, 22 nt, Human
aaugucugccagaacugaucau

SEQ ID NO: 384317 - RNA, 22 nt, Human
caugucuggguauaugcauaug

SEQ ID NO: 384318 - RNA, 22 nt, Human
gaagcccuauccucuccuggga

SEQ ID NO: 384319 - RNA, 22 nt, Human
uucuucucagggucccacaugg

SEQ ID NO: 384320 - RNA, 22 nt, Human
ccugccugguguaagucuaagg

SEQ ID NO: 384321 - RNA, 22 nt, Human
aucauucuaguccuuauggucu

SEQ ID NO: 384322 - RNA, 22 nt, Human
uuuacagaucuguugauuuguu

SEQ ID NO: 384323 - RNA, 22 nt, Human
gagccuccuccuggugugccga

SEQ ID NO: 384324 - RNA, 22 nt, Human
agcaggguuccaggaguugcag

SEQ ID NO: 384325 - RNA, 22 nt, Human
acugaaggcuuaacucuuucau

SEQ ID NO: 384326 - RNA, 22 nt, Human
cagagaaagggugaauuccuuc

SEQ ID NO: 384327 - RNA, 22 nt, Human
uuccacaauguaugaauaagau

SEQ ID NO: 384328 - RNA, 22 nt, Human
cccugcagacgucuugaugccu

SEQ ID NO: 384329 - RNA, 21 nt, Human
uggcucaguugcugggcacag

SEQ ID NO: 384330 - RNA, 20 nt, Human
ccuggaagagcuccccaggc

SEQ ID NO: 384331 - RNA, 22 nt, Human
ggaaaguggugguggaaagagg

SEQ ID NO: 384332 - RNA, 19 nt, Human
acucaagucuaaugaaauc

SEQ ID NO: 384333 - RNA, 22 nt, Human
cagggcucccugcagccucugu

SEQ ID NO: 384334 - RNA, 22 nt, Human
agcaucuggcagaaagucagaa

SEQ ID NO: 384335 - RNA, 22 nt, Human
ugcagaagauggucugagcacc

SEQ ID NO: 384336 - RNA, 22 nt, Human
aucugcagaggacaggcgagga

SEQ ID NO: 384337 - RNA, 22 nt, Human
uggcagcugaauggcuggaugg

SEQ ID NO: 384338 - RNA, 22 nt, Human
augcaguaaauguucuaguuug

SEQ ID NO: 384339 - RNA, 22 nt, Human
caggacugauguuccuccagcc

SEQ ID NO: 384340 - RNA, 22 nt, Human
ccugucuguccucucaugagcc

SEQ ID NO: 384341 - RNA, 20 nt, Human
uccuuuggccuuagagcugu

SEQ ID NO: 384342 - RNA, 20 nt, Human
accuuucaaaugauucagca

SEQ ID NO: 384343 - RNA, 22 nt, Human
uaaaugcaguacaaauuguucu

SEQ ID NO: 384344 - RNA, 22 nt, Human
acucccagguugccuggcaggc

SEQ ID NO: 384345 - RNA, 22 nt, Human
gcaagauguuaacauagggaga

SEQ ID NO: 384346 - RNA, 21 nt, Human
uaaagaagaugaaugugauca

SEQ ID NO: 384347 - RNA, 22 nt, Human
aagaugcuuauugcuccugcag

SEQ ID NO: 384348 - RNA, 22 nt, Human
uugaauucauuucucauugagu

SEQ ID NO: 384349 - RNA, 22 nt, Human
aauaucaguauauuguaucagu

SEQ ID NO: 384350 - RNA, 22 nt, Human
aaugccaguguguugauuccag

SEQ ID NO: 384351 - RNA, 22 nt, Human
gggcucugggaugcucuuagag

SEQ ID NO: 384352 - RNA, 22 nt, Human
uguauuuuuagaccuuuagacc

SEQ ID NO: 384353 - RNA, 22 nt, Human
accagggcugacaaucugaugg

SEQ ID NO: 384354 - RNA, 22 nt, Human
ucucaccaaagccuugaccaua

SEQ ID NO: 384355 - RNA, 22 nt, Human
ugaguucuaguggcugcagauu

SEQ ID NO: 384356 - RNA, 22 nt, Human
auaaggaaugauguaucaguuu

SEQ ID NO: 384357 - RNA, 22 nt, Human
aaauguguguauguacauauau

SEQ ID NO: 384358 - RNA, 22 nt, Human
gaggagagccugcacuuugacc

SEQ ID NO: 384359 - RNA, 22 nt, Human
agcuagccuaggcagagugcau

SEQ ID NO: 384360 - RNA, 22 nt, Human
cgggcuggcugcagcugcugga

SEQ ID NO: 384361 - RNA, 22 nt, Human
gggcugaggaacauauuuuguu

SEQ ID NO: 384362 - RNA, 22 nt, Human
augccuguaaucccagugcuuu

SEQ ID NO: 384363 - RNA, 22 nt, Human
aauguauaaaguguuaauaacu

SEQ ID NO: 384364 - RNA, 22 nt, Human
cccagaggugcuucagaggugc

SEQ ID NO: 384365 - RNA, 22 nt, Human
auccaugauuaguaggauaaag

SEQ ID NO: 384366 - RNA, 22 nt, Human
gacaggcuuccuaagugccaga

SEQ ID NO: 384367 - RNA, 22 nt, Human
cagacagaaggcuccuugaggu

SEQ ID NO: 384368 - RNA, 22 nt, Human
uggcuggggccacaguuuuccu

SEQ ID NO: 384369 - RNA, 22 nt, Human
acuuuauuuccuauugcaucca

SEQ ID NO: 384370 - RNA, 22 nt, Human
uuuaggcagucauugaacaagu

SEQ ID NO: 384371 - RNA, 22 nt, Human
gucaaauauacuaagagguaaa

SEQ ID NO: 384372 - RNA, 22 nt, Human
agaagugccauacuguggucca

SEQ ID NO: 384373 - RNA, 22 nt, Human
ggucuuccgagaggccugugcu

SEQ ID NO: 384374 - RNA, 20 nt, Human
gugggcagcaggcauacugg

SEQ ID NO: 384375 - RNA, 22 nt, Human
ugcuuuggccacuagaauucag

SEQ ID NO: 384376 - RNA, 23 nt, Human
aggcuuccuaucuuagagcuggg

SEQ ID NO: 384377 - RNA, 22 nt, Human
ugagccagaguggagugugccu

SEQ ID NO: 384378 - RNA, 22 nt, Human
aggggcucaaagugugcaggga

SEQ ID NO: 384379 - RNA, 22 nt, Human
ggcagcaugagccuggugaauu

SEQ ID NO: 384380 - RNA, 23 nt, Human
cuuugccacccagagccugacag

SEQ ID NO: 384381 - RNA, 22 nt, Human
uugcucagcacuggagccagcu

SEQ ID NO: 384382 - RNA, 22 nt, Human
gaauacaaauaauaccaaggug

SEQ ID NO: 384383 - RNA, 23 nt, Human
uggcucagcuaguuuuccauuuc

SEQ ID NO: 384384 - RNA, 22 nt, Human
cagggcccauggcucagguagg

SEQ ID NO: 384385 - RNA, 22 nt, Human
gcucucagguacaaagcugugu

SEQ ID NO: 384386 - RNA, 22 nt, Human
acauacuuuuuaaaagauugcu

SEQ ID NO: 384387 - RNA, 22 nt, Human
ugcaauaacccaguaucuguga

SEQ ID NO: 384388 - RNA, 22 nt, Human
gaggggcuggguagggcaaccc

SEQ ID NO: 384389 - RNA, 22 nt, Human
uuguuuuggaagaacuuacucu

SEQ ID NO: 384390 - RNA, 22 nt, Human
agggacacugaugagaaauucu

SEQ ID NO: 384391 - RNA, 22 nt, Human
gguucacauauugagaguauuc

SEQ ID NO: 384392 - RNA, 22 nt, Human
aggccagcuuccagaggggcag

SEQ ID NO: 384393 - RNA, 22 nt, Human
ccuuuccuuuuuagugugggag

SEQ ID NO: 384394 - RNA, 22 nt, Human
aggaagcuuagugaaaggacca

SEQ ID NO: 384395 - RNA, 22 nt, Human
ccucuucugagugagacucccu

SEQ ID NO: 384396 - RNA, 22 nt, Human
guacauuucauuuaaaugaugu

SEQ ID NO: 384397 - RNA, 22 nt, Human
uccuucagccaugggcucucca

SEQ ID NO: 384398 - RNA, 22 nt, Human
cugaggcauguuacaggacaua

SEQ ID NO: 384399 - RNA, 22 nt, Human
aaaucuguaagcaauugcucag

SEQ ID NO: 384400 - RNA, 22 nt, Human
aaggcaguuugggccaccaucu

SEQ ID NO: 384401 - RNA, 22 nt, Human
cuacauuuggagaguauaggaa

SEQ ID NO: 384402 - RNA, 22 nt, Human
agggccagccaggcccuacaaa

SEQ ID NO: 384403 - RNA, 22 nt, Human
cucagagaggcaguggaaguca

SEQ ID NO: 384404 - RNA, 22 nt, Human
ccaaggaguagagcaggaagcu

SEQ ID NO: 384405 - RNA, 22 nt, Human
aggcaguuguugcugagcagcu

SEQ ID NO: 384406 - RNA, 22 nt, Human
gguggccuccagggcauaggug

SEQ ID NO: 384407 - RNA, 22 nt, Human
ggcagcugucucugaguuagca

SEQ ID NO: 384408 - RNA, 22 nt, Human
ugauuuccacagucaggggugc

SEQ ID NO: 384409 - RNA, 22 nt, Human
uguaugcuuuccaaaaaugcug

SEQ ID NO: 384410 - RNA, 21 nt, Human
uuucagaccuaucuuugaagg

SEQ ID NO: 384411 - RNA, 23 nt, Human
ucuccagugucucuucauugagu

SEQ ID NO: 384412 - RNA, 19 nt, Human
guuaggcaggguggggagu

SEQ ID NO: 384413 - RNA, 22 nt, Human
ugacccugcuucuuggugcagg

SEQ ID NO: 384414 - RNA, 22 nt, Human
uccagccaugcaugacaaucac

SEQ ID NO: 384415 - RNA, 22 nt, Human
auucaguuaaaaacuguacuuc

SEQ ID NO: 384416 - RNA, 22 nt, Human
gugcagcugugugagagcucca

SEQ ID NO: 384417 - RNA, 22 nt, Human
ucaggcugcuggccagcaggcu

SEQ ID NO: 384418 - RNA, 22 nt, Human
caggccaggcugcauuugcccc

SEQ ID NO: 384419 - RNA, 22 nt, Human
ugcugucccccgugucugggcu

SEQ ID NO: 384420 - RNA, 22 nt, Human
auguguagaacuguaaugccca

SEQ ID NO: 384421 - RNA, 22 nt, Human
ucuggaucccaccgccacacac

SEQ ID NO: 384422 - RNA, 18 nt, Human
agcagggcauuuugccau

SEQ ID NO: 384423 - RNA, 19 nt, Human
ugagaggcuuaaggcagcu

SEQ ID NO: 384424 - RNA, 22 nt, Human
ggagccuguuaguugagugcuc

SEQ ID NO: 384425 - RNA, 22 nt, Human
ucaguuuucaauuucaucagag

SEQ ID NO: 384426 - RNA, 22 nt, Human
guaaugaaugaaagaaacuggg

SEQ ID NO: 384427 - RNA, 22 nt, Human
auccuuagguggugcaucaggg

SEQ ID NO: 384428 - RNA, 22 nt, Human
cgcagagggcaggcagugcugg

SEQ ID NO: 384429 - RNA, 22 nt, Human
agucucaggcagaggaaggcua

SEQ ID NO: 384430 - RNA, 22 nt, Human
uacaaaguuuucuuggauugag

SEQ ID NO: 384431 - RNA, 21 nt, Human
ggacaccagucacacuggauu

SEQ ID NO: 384432 - RNA, 22 nt, Human
uuugggcaauucagugggaccu

SEQ ID NO: 384433 - RNA, 22 nt, Human
cugagccuguguuucucuggca

SEQ ID NO: 384434 - RNA, 22 nt, Human
gacccaggguggucaccugaaa

SEQ ID NO: 384435 - RNA, 22 nt, Human
gaacuuuaccauuuagguaacu

SEQ ID NO: 384436 - RNA, 22 nt, Human
acaggagacccugcugguucug

SEQ ID NO: 384437 - RNA, 22 nt, Human
cauucauuagaauagauaugua

SEQ ID NO: 384438 - RNA, 22 nt, Human
ucucuuaauaaguaaauacuga

SEQ ID NO: 384439 - RNA, 22 nt, Human
gggcaguugauggaggucugga

SEQ ID NO: 384440 - RNA, 22 nt, Human
cagcacugcugcuguacacaca

SEQ ID NO: 384441 - RNA, 22 nt, Human
aaucagaaagaggucauguugc

SEQ ID NO: 384442 - RNA, 22 nt, Human
ugagauuuguuuuauaaaauag

SEQ ID NO: 384443 - RNA, 22 nt, Human
ugggcagaguugugaugaacug

SEQ ID NO: 384444 - RNA, 22 nt, Human
uuugaaaauuagacacaggcua

SEQ ID NO: 384445 - RNA, 20 nt, Human
aggcucagcugagcucuugg

SEQ ID NO: 384446 - RNA, 22 nt, Human
cugcccagaagccagaugggca

SEQ ID NO: 384447 - RNA, 23 nt, Human
gccucagagaaacagcugcacac

SEQ ID NO: 384448 - RNA, 22 nt, Human
ucaggcacugcuuucugauaug

SEQ ID NO: 384449 - RNA, 22 nt, Human
cuucagaagccugcagccuuug

SEQ ID NO: 384450 - RNA, 22 nt, Human
uggagcagagaugggagcccaa

SEQ ID NO: 384451 - RNA, 22 nt, Human
aaaugcacucugcuucugugac

SEQ ID NO: 384452 - RNA, 22 nt, Human
ccugggugacccgugagcgucc

SEQ ID NO: 384453 - RNA, 22 nt, Human
gaggggcucuugggcaugaagg

SEQ ID NO: 384454 - RNA, 22 nt, Human
acagucauuagauacaaugucu

SEQ ID NO: 384455 - RNA, 22 nt, Human
agcgugaaggcgggcagucggc

SEQ ID NO: 384456 - RNA, 22 nt, Human
aguccccucuaacccaacuuua

SEQ ID NO: 384457 - RNA, 18 nt, Human
caauuucauccuuaagcc

SEQ ID NO: 384458 - RNA, 22 nt, Human
auuauuauauagggaaaguccc

SEQ ID NO: 384459 - RNA, 22 nt, Human
aucagaaaucuaggauucagaa

SEQ ID NO: 384460 - RNA, 22 nt, Human
uuccugggacuggagcagccca

SEQ ID NO: 384461 - RNA, 18 nt, Human
gcagcugacacuggaguu

SEQ ID NO: 384462 - RNA, 22 nt, Human
ccagccugaaaugccucauccu

SEQ ID NO: 384463 - RNA, 22 nt, Human
uuuacagaauguugaauuuggg

SEQ ID NO: 384464 - RNA, 22 nt, Human
acaggagaaaucuggucaaaag

SEQ ID NO: 384465 - RNA, 22 nt, Human
ggcggggguccaggagccugca

SEQ ID NO: 384466 - RNA, 23 nt, Human
ugggccuggaaagccuuagagag

SEQ ID NO: 384467 - RNA, 22 nt, Human
aaaaucugguaauuugaaugug

SEQ ID NO: 384468 - RNA, 22 nt, Human
gcugccacucugagcuugcuuc

SEQ ID NO: 384469 - RNA, 22 nt, Human
uacaaaaaauugauacugacga

SEQ ID NO: 384470 - RNA, 22 nt, Human
ucuucagacuccaaauguuuua

SEQ ID NO: 384471 - RNA, 22 nt, Human
cugugaauuaaguauuguuauc

SEQ ID NO: 384472 - RNA, 22 nt, Human
uacauggugguggcacuugacu

SEQ ID NO: 384473 - RNA, 22 nt, Human
gcugggagcaaguacucaucuu

SEQ ID NO: 384474 - RNA, 22 nt, Human
agcaggagcccuuaucaccagg

SEQ ID NO: 384475 - RNA, 22 nt, Human
ggacacagcugcagccacaccc

SEQ ID NO: 384476 - RNA, 22 nt, Human
gggccugacugagagcuccuca

SEQ ID NO: 384477 - RNA, 22 nt, Human
ggcccacuugaaauggagcuca

SEQ ID NO: 384478 - RNA, 22 nt, Human
ucaggaugguccuuuaugagaa

SEQ ID NO: 384479 - RNA, 22 nt, Human
agccucugcuggcccuggcacu

SEQ ID NO: 384480 - RNA, 22 nt, Human
agaggggacagccaccugcccg

SEQ ID NO: 384481 - RNA, 22 nt, Human
guggccucaugucuauaaagag

SEQ ID NO: 384482 - RNA, 23 nt, Human
ggggaaguggcagugagugaggc

SEQ ID NO: 384483 - RNA, 22 nt, Human
uaauaucuacuucauagaguuu

SEQ ID NO: 384484 - RNA, 22 nt, Human
uuucagaaagcaucaucaaagu

SEQ ID NO: 384485 - RNA, 22 nt, Human
ugccugggggacuaaggccaaa

SEQ ID NO: 384486 - RNA, 23 nt, Human
uuacagaaaguaugcuuuuguuu

SEQ ID NO: 384487 - RNA, 22 nt, Human
uaugacaagguggaguaugagu

SEQ ID NO: 384488 - RNA, 22 nt, Human
cucagugugaaugcucaguaaa

SEQ ID NO: 384489 - RNA, 22 nt, Human
agcagcugucccuuaacaucag

SEQ ID NO: 384490 - RNA, 20 nt, Human
caggagggacauuucagcau

SEQ ID NO: 384491 - RNA, 22 nt, Human
aauaauuuuagcucagaguugu

SEQ ID NO: 384492 - RNA, 22 nt, Human
uaacaauaguguuugcuaguca

SEQ ID NO: 384493 - RNA, 22 nt, Human
ggcugccugaggcugaggcccg

SEQ ID NO: 384494 - RNA, 22 nt, Human
gauggcaggcaggugaguagag

SEQ ID NO: 384495 - RNA, 22 nt, Human
uuucacaugguacugccuguuu

SEQ ID NO: 384496 - RNA, 22 nt, Human
acagguggggaggcugagguuc

SEQ ID NO: 384497 - RNA, 22 nt, Human
uccucagggggccaacccagcc

SEQ ID NO: 384498 - RNA, 22 nt, Human
ccaggaguuugaggcugcagug

SEQ ID NO: 384499 - RNA, 22 nt, Human
cuugaaagauuuggccucugug

SEQ ID NO: 384500 - RNA, 19 nt, Human
ccagagacauuggcaucuu

SEQ ID NO: 384501 - RNA, 22 nt, Human
gccuggaguagcauggcaagcc

SEQ ID NO: 384502 - RNA, 22 nt, Human
uuccagauuucuacacaagacc

SEQ ID NO: 384503 - RNA, 22 nt, Human
cauagcuuagggguuaaacuca

SEQ ID NO: 384504 - RNA, 22 nt, Human
agaaauguggaucguuuuaaaa

SEQ ID NO: 384505 - RNA, 22 nt, Human
gcucccagcuggagccucaaca

SEQ ID NO: 384506 - RNA, 22 nt, Human
ugcuggaggggccugaccagga

SEQ ID NO: 384507 - RNA, 22 nt, Human
ccagacuguggaguuccuggug

SEQ ID NO: 384508 - RNA, 22 nt, Human
auuccaguuggguucuaauaca

SEQ ID NO: 384509 - RNA, 21 nt, Human
uaaauaauaaguugcugagau

SEQ ID NO: 384510 - RNA, 22 nt, Human
gccacacugcuucuuugagccu

SEQ ID NO: 384511 - RNA, 22 nt, Human
cacucaggguacaauggagggc

SEQ ID NO: 384512 - RNA, 22 nt, Human
ccaggcagagggaauagcaagu

SEQ ID NO: 384513 - RNA, 22 nt, Human
ugaaggcacuugccuaggggca

SEQ ID NO: 384514 - RNA, 22 nt, Human
ucucagaguuugaaucuggagu

SEQ ID NO: 384515 - RNA, 22 nt, Human
ucuuuacaucacaauuguaugg

SEQ ID NO: 384516 - RNA, 22 nt, Human
cauuuauucauuugcuagggcu

SEQ ID NO: 384517 - RNA, 20 nt, Human
agcccuguuuccuggagaga

SEQ ID NO: 384518 - RNA, 22 nt, Human
gcugggcuugguuucccugcuu

SEQ ID NO: 384519 - RNA, 22 nt, Human
cugagccaaaaagcagagcuug

SEQ ID NO: 384520 - RNA, 18 nt, Human
cucagggcaucagucugg

SEQ ID NO: 384521 - RNA, 22 nt, Human
auucagcauaaucaguagcuug

SEQ ID NO: 384522 - RNA, 18 nt, Human
acacacacaccuguguau

SEQ ID NO: 384523 - RNA, 22 nt, Human
uuuauuauucucuggagaaugu

SEQ ID NO: 384524 - RNA, 22 nt, Human
auucuaacacaugcucuaagaa

SEQ ID NO: 384525 - RNA, 22 nt, Human
cagggacagccuugggguggcg

SEQ ID NO: 384526 - RNA, 23 nt, Human
acugucugauauguuuuccauca

SEQ ID NO: 384527 - RNA, 19 nt, Human
uacauacuuauucuaaaag

SEQ ID NO: 384528 - RNA, 22 nt, Human
ugaggggagcccgcccuggacg

SEQ ID NO: 384529 - RNA, 22 nt, Human
ccugucucccuggcauggcuca

SEQ ID NO: 384530 - RNA, 22 nt, Human
guacauuucucuuguucuuauu

SEQ ID NO: 384531 - RNA, 22 nt, Human
ucaaagucacaacucucuaauu

SEQ ID NO: 384532 - RNA, 22 nt, Human
ccuccagcugccucagucucuu

SEQ ID NO: 384533 - RNA, 22 nt, Human
agugucugccagcugccaggug

SEQ ID NO: 384534 - RNA, 22 nt, Human
gaggccugucgcuaggccucug

SEQ ID NO: 384535 - RNA, 22 nt, Human
agcagcauauugugucuucaua

SEQ ID NO: 384536 - RNA, 22 nt, Human
uccucuucugcccaucagaggc

SEQ ID NO: 384537 - RNA, 22 nt, Human
uggagcuggaauuucugggccu

SEQ ID NO: 384538 - RNA, 22 nt, Human
uccuuaauauggaagaguucuc

SEQ ID NO: 384539 - RNA, 18 nt, Human
uggagcugagugcugugc

SEQ ID NO: 384540 - RNA, 20 nt, Human
gggguuggcuggcacaggga

SEQ ID NO: 384541 - RNA, 22 nt, Human
uaagauguuuugguuugauaag

SEQ ID NO: 384542 - RNA, 22 nt, Human
ccaggagccugggccaggcugg

SEQ ID NO: 384543 - RNA, 22 nt, Human
guuaauaaagguauagaaucag

SEQ ID NO: 384544 - RNA, 20 nt, Human
cugcuguguuauuguagaac

SEQ ID NO: 384545 - RNA, 22 nt, Human
ucagggcaagucucagaagguu

SEQ ID NO: 384546 - RNA, 22 nt, Human
ccaucccuucaccacagcagua

SEQ ID NO: 384547 - RNA, 22 nt, Human
ggcaugcugcguacagaugaac

SEQ ID NO: 384548 - RNA, 22 nt, Human
aaaugcacagagccuuagagau

SEQ ID NO: 384549 - RNA, 22 nt, Human
cugcccugucugcagccuggcu

SEQ ID NO: 384550 - RNA, 22 nt, Human
uauauguaagcuauguaagagu

SEQ ID NO: 384551 - RNA, 22 nt, Human
uuuccuuugcccaauacauguc

SEQ ID NO: 384552 - RNA, 22 nt, Human
caucagaauagcucuguggaua

SEQ ID NO: 384553 - RNA, 22 nt, Human
ucccagagcugauaagccuuua

SEQ ID NO: 384554 - RNA, 22 nt, Human
aggcugccucgugagcucgcug

SEQ ID NO: 384555 - RNA, 22 nt, Human
ggcagcugugaagugccucaca

SEQ ID NO: 384556 - RNA, 22 nt, Human
gcucaggacccaggugugaccu

SEQ ID NO: 384557 - RNA, 22 nt, Human
gccaggcuggucuugaacuccu

SEQ ID NO: 384558 - RNA, 22 nt, Human
cugucuguuuuaccuucuccag

SEQ ID NO: 384559 - RNA, 22 nt, Human
uuccuguccgcaauggccuggg

SEQ ID NO: 384560 - RNA, 18 nt, Human
acugugguuuauguguag

SEQ ID NO: 384561 - RNA, 22 nt, Human
ugacagaaugugacucucagau

SEQ ID NO: 384562 - RNA, 22 nt, Human
ccaucuccaguuuauucuuccu

SEQ ID NO: 384563 - RNA, 22 nt, Human
agaguucugcucuucucaguga

SEQ ID NO: 384564 - RNA, 22 nt, Human
cucucaggcuugggucguggca

SEQ ID NO: 384565 - RNA, 22 nt, Human
cuaaaugacuuccagugguuau

SEQ ID NO: 384566 - RNA, 22 nt, Human
ugaggcagaguaagauacauga

SEQ ID NO: 384567 - RNA, 18 nt, Human
aagaggaggagcagguug

SEQ ID NO: 384568 - RNA, 22 nt, Human
cuggagcugcuguccuugggug

SEQ ID NO: 384569 - RNA, 22 nt, Human
gcccaggaguuggaggcugcag

SEQ ID NO: 384570 - RNA, 22 nt, Human
ccuccaguacuccaguccagcg

SEQ ID NO: 384571 - RNA, 22 nt, Human
cuguuuaucuaggaguugcagg

SEQ ID NO: 384572 - RNA, 21 nt, Human
cucaaagaccaaaaguguaga

SEQ ID NO: 384573 - RNA, 22 nt, Human
cagugcccaagaugugccaugc

SEQ ID NO: 384574 - RNA, 22 nt, Human
cagccugcccuggaagcccagc

SEQ ID NO: 384575 - RNA, 22 nt, Human
uggugcaagucucugaggaggg

SEQ ID NO: 384576 - RNA, 21 nt, Human
aucagcaaaugccugucuccc

SEQ ID NO: 384577 - RNA, 21 nt, Human
auacacauacacauaaaugug

SEQ ID NO: 384578 - RNA, 22 nt, Human
agguuuaugccuuggagcuggg

SEQ ID NO: 384579 - RNA, 22 nt, Human
auuagggaaacugacuugucuc

SEQ ID NO: 384580 - RNA, 22 nt, Human
aaaagggacuacucucagcucc

SEQ ID NO: 384581 - RNA, 22 nt, Human
caauuucagucucagagaguuc

SEQ ID NO: 384582 - RNA, 22 nt, Human
gcagggagguuugcugaccugg

SEQ ID NO: 384583 - RNA, 22 nt, Human
agaaugcuccagagcugaaaga

SEQ ID NO: 384584 - RNA, 22 nt, Human
aaguguguugacugaauugggg

SEQ ID NO: 384585 - RNA, 22 nt, Human
ucugucugcaccuaagcacagu

SEQ ID NO: 384586 - RNA, 22 nt, Human
agggaccucuucuugcagcuga

SEQ ID NO: 384587 - RNA, 22 nt, Human
uacuaaauaguuuaauuccuca

SEQ ID NO: 384588 - RNA, 22 nt, Human
cacugcuuauaaauucuaggca

SEQ ID NO: 384589 - RNA, 22 nt, Human
augcugugccuucucugugcca

SEQ ID NO: 384590 - RNA, 22 nt, Human
ucagaggaaagggaacauaguc

SEQ ID NO: 384591 - RNA, 20 nt, Human
caggccucugggggcccugg

SEQ ID NO: 384592 - RNA, 22 nt, Human
gcccaggcuggagugcaguagc

SEQ ID NO: 384593 - RNA, 22 nt, Human
acauuuacagugcuagacaauc

SEQ ID NO: 384594 - RNA, 22 nt, Human
caugggcucuucuggacugcac

SEQ ID NO: 384595 - RNA, 22 nt, Human
cugcccugcuugaugacagcga

SEQ ID NO: 384596 - RNA, 22 nt, Human
aagcagggugucuugacccaug

SEQ ID NO: 384597 - RNA, 22 nt, Human
uuucuuucaauucuccuaaugc

SEQ ID NO: 384598 - RNA, 22 nt, Human
auguacauuuuccuaauguuuu

SEQ ID NO: 384599 - RNA, 22 nt, Human
aacagcagggggaccugcuggu

SEQ ID NO: 384600 - RNA, 22 nt, Human
uuacaaaguguuaugauaaaca

SEQ ID NO: 384601 - RNA, 22 nt, Human
uaugcacauuaucuaauccauu

SEQ ID NO: 384602 - RNA, 22 nt, Human
caucucaugggcaugccaagcu

SEQ ID NO: 384603 - RNA, 22 nt, Human
cagcucccaguggcagcuccuu

SEQ ID NO: 384604 - RNA, 22 nt, Human
ccagccuggguguuagaagaca

SEQ ID NO: 384605 - RNA, 22 nt, Human
cagcuggcuccaccucugggcu

SEQ ID NO: 384606 - RNA, 22 nt, Human
auuaggcauucugaaugagguc

SEQ ID NO: 384607 - RNA, 22 nt, Human
uaaaguucagugcaugaaugug

SEQ ID NO: 384608 - RNA, 22 nt, Human
auucuggauuaucaguccacca

SEQ ID NO: 384609 - RNA, 22 nt, Human
acuggcaggcugcuggccggcg

SEQ ID NO: 384610 - RNA, 22 nt, Human
cucaagacugaucgcaguggaa

SEQ ID NO: 384611 - RNA, 22 nt, Human
ggcucugcgcgguaaagugacu

SEQ ID NO: 384612 - RNA, 22 nt, Human
aaggccaugaccacuugcugug

SEQ ID NO: 384613 - RNA, 22 nt, Human
guagcccaccuggggagggcga

SEQ ID NO: 384614 - RNA, 22 nt, Human
ccaggcaggcagcguucucagg

SEQ ID NO: 384615 - RNA, 21 nt, Human
ugcagaggcacaaacaagccc

SEQ ID NO: 384616 - RNA, 22 nt, Human
aucuguucuucaaaauauuaca

SEQ ID NO: 384617 - RNA, 15 nt, Human
uccaggcauucauuc

SEQ ID NO: 384618 - RNA, 23 nt, Human
gguggcaggaguggaugcugagc

SEQ ID NO: 384619 - RNA, 22 nt, Human
uugcugaauugaauccuuuggu

SEQ ID NO: 384620 - RNA, 22 nt, Human
ucagaggagccaaaguucugag

SEQ ID NO: 384621 - RNA, 22 nt, Human
agucucagcaagcauggcuagu

SEQ ID NO: 384622 - RNA, 22 nt, Human
gagucugagaacugggcucagu

SEQ ID NO: 384623 - RNA, 22 nt, Human
gaggagagaugguagauugggu

SEQ ID NO: 384624 - RNA, 22 nt, Human
uaacagaaaggcucaggugcuc

SEQ ID NO: 384625 - RNA, 22 nt, Human
cuccuuccccuacucagcaucc

SEQ ID NO: 384626 - RNA, 22 nt, Human
ccugccugggcucacuugccag

SEQ ID NO: 384627 - RNA, 22 nt, Human
ggccugagucccaccuggcugu

SEQ ID NO: 384628 - RNA, 22 nt, Human
uggccacccagcugacgccuuc

SEQ ID NO: 384629 - RNA, 22 nt, Human
ugccaggagucaggccaggcag

SEQ ID NO: 384630 - RNA, 22 nt, Human
uauuucagguauggugugaaau

SEQ ID NO: 384631 - RNA, 22 nt, Human
ggcaggugcaccugagccaucu

SEQ ID NO: 384632 - RNA, 22 nt, Human
ucagccugcgucauggugacac

SEQ ID NO: 384633 - RNA, 22 nt, Human
cagugcugggcagaggagagcg

SEQ ID NO: 384634 - RNA, 22 nt, Human
ccacaggaccagaggagaucac

SEQ ID NO: 384635 - RNA, 22 nt, Human
ggcagggaaacagcugauccca

SEQ ID NO: 384636 - RNA, 22 nt, Human
ggauuugaauuguugaaaugau

SEQ ID NO: 384637 - RNA, 22 nt, Human
ccagugccugugggcauggugc

SEQ ID NO: 384638 - RNA, 20 nt, Human
ucugcccaccccggcuccca

SEQ ID NO: 384639 - RNA, 22 nt, Human
cccaugccuucugacucacagg

SEQ ID NO: 384640 - RNA, 22 nt, Human
caaguaaacaauaugugauuca

SEQ ID NO: 384641 - RNA, 22 nt, Human
gccugccucaaaaucccaguuc

SEQ ID NO: 384642 - RNA, 22 nt, Human
cacccugggcugggccuguuaa

SEQ ID NO: 384643 - RNA, 22 nt, Human
ccagggcugguggcugcagagg

SEQ ID NO: 384644 - RNA, 22 nt, Human
cagcucucuaaggucuugcuuu

SEQ ID NO: 384645 - RNA, 22 nt, Human
aggcagcauuugaauccagguc

SEQ ID NO: 384646 - RNA, 22 nt, Human
uggcagucggacuucuaucuca

SEQ ID NO: 384647 - RNA, 22 nt, Human
agccagugaugaagacucugga

SEQ ID NO: 384648 - RNA, 19 nt, Human
cugggagguguucagagaa

SEQ ID NO: 384649 - RNA, 22 nt, Human
ugcugccuccaacuccugggcu

SEQ ID NO: 384650 - RNA, 22 nt, Human
aggcucaguucuguggugagcc

SEQ ID NO: 384651 - RNA, 22 nt, Human
ucuuccaguguagacaucugcc

SEQ ID NO: 384652 - RNA, 22 nt, Human
aggcugcuggcaggcguggacg

SEQ ID NO: 384653 - RNA, 22 nt, Human
agcagcauagaagcugggagga

SEQ ID NO: 384654 - RNA, 22 nt, Human
caggcagccuucucgucucaca

SEQ ID NO: 384655 - RNA, 22 nt, Human
uggagagcaagucgcagacaug

SEQ ID NO: 384656 - RNA, 22 nt, Human
aagccauuuguuguccuucagg

SEQ ID NO: 384657 - RNA, 22 nt, Human
aguucaggcauaaggcaugaac

SEQ ID NO: 384658 - RNA, 17 nt, Human
agcuccugcccauggcu

SEQ ID NO: 384659 - RNA, 22 nt, Human
ggagcugcacgcucugaagccu

SEQ ID NO: 384660 - RNA, 22 nt, Human
uacagagauacucuagaucaaa

SEQ ID NO: 384661 - RNA, 22 nt, Human
acagaguaggugcugucgacug

SEQ ID NO: 384662 - RNA, 22 nt, Human
acacaccaugauuuauuuaccc

SEQ ID NO: 384663 - RNA, 22 nt, Human
cuccuggacauggagcggagga

SEQ ID NO: 384664 - RNA, 22 nt, Human
uucucauggugucuuuauacau

SEQ ID NO: 384665 - RNA, 22 nt, Human
cccaggcagagagcuggugagc

SEQ ID NO: 384666 - RNA, 22 nt, Human
acaguguguuggaggagacugu

SEQ ID NO: 384667 - RNA, 22 nt, Human
cacuggugacuucugagcugga

SEQ ID NO: 384668 - RNA, 22 nt, Human
uugaauaauuaauuacacucag

SEQ ID NO: 384669 - RNA, 22 nt, Human
uuccucucucuugccagaaugu

SEQ ID NO: 384670 - RNA, 22 nt, Human
cuuuccuagauggccaucuuuc

SEQ ID NO: 384671 - RNA, 22 nt, Human
ggcagggcaggaaagucaggaa

SEQ ID NO: 384672 - RNA, 22 nt, Human
gagaagguggaccugaaggagc

SEQ ID NO: 384673 - RNA, 22 nt, Human
uugaacaguuuugucagguuca

SEQ ID NO: 384674 - RNA, 22 nt, Human
aguaccaugcuuccugacuggu

SEQ ID NO: 384675 - RNA, 22 nt, Human
gaaggcuaaaggggcagagguu

SEQ ID NO: 384676 - RNA, 22 nt, Human
acugcuuuucuaagauucugug

SEQ ID NO: 384677 - RNA, 22 nt, Human
uucugcaggagcccuaguguau

SEQ ID NO: 384678 - RNA, 22 nt, Human
uucacagaguuauuuuuaugcu

SEQ ID NO: 384679 - RNA, 22 nt, Human
cccaggcugaguuagagguguc

SEQ ID NO: 384680 - RNA, 22 nt, Human
auacaacuuuaucuguaaugag

SEQ ID NO: 384681 - RNA, 22 nt, Human
uagggaugacgaaaggacagag

SEQ ID NO: 384682 - RNA, 22 nt, Human
cuugcugucuugcauuuagagc

SEQ ID NO: 384683 - RNA, 22 nt, Human
gggcugacucugcacugagcca

SEQ ID NO: 384684 - RNA, 22 nt, Human
uccaggcaaagggacuagcagg

SEQ ID NO: 384685 - RNA, 22 nt, Human
uucuaucauacuugaauacauu

SEQ ID NO: 384686 - RNA, 22 nt, Human
gggacccugggaggcuggcgca

SEQ ID NO: 384687 - RNA, 22 nt, Human
ucacaaaagcuuuugaauuugg

SEQ ID NO: 384688 - RNA, 22 nt, Human
cccaggccagaacuugguugcu

SEQ ID NO: 384689 - RNA, 22 nt, Human
ucccagcagagccagcaagccg

SEQ ID NO: 384690 - RNA, 22 nt, Human
aggagcuggguuccuuuggugg

SEQ ID NO: 384691 - RNA, 22 nt, Human
acacauauucauauguacuuac

SEQ ID NO: 384692 - RNA, 22 nt, Human
ucagaggugguaaaggacagca

SEQ ID NO: 384693 - RNA, 22 nt, Human
caguccaggccuggaggagcca

SEQ ID NO: 384694 - RNA, 22 nt, Human
uaaagccauacugaaagccacu

SEQ ID NO: 384695 - RNA, 22 nt, Human
acucaggaaaaauguagugaua

SEQ ID NO: 384696 - RNA, 22 nt, Human
ccaggccuggaccaugccaggg

SEQ ID NO: 384697 - RNA, 22 nt, Human
gccuggaguggacuuggccccu

SEQ ID NO: 384698 - RNA, 22 nt, Human
ccucacugcuauguguuugcuc

SEQ ID NO: 384699 - RNA, 19 nt, Human
agauuuaccucauauaguu

SEQ ID NO: 384700 - RNA, 22 nt, Human
ugacaguuaagguauacauuca

SEQ ID NO: 384701 - RNA, 22 nt, Human
cacagaaguuucauagucucga

SEQ ID NO: 384702 - RNA, 22 nt, Human
agauacauugaguuuccuccug

SEQ ID NO: 384703 - RNA, 22 nt, Human
ccugggcagggcuggacucuca

SEQ ID NO: 384704 - RNA, 19 nt, Human
accaggaguaucagagcug

SEQ ID NO: 384705 - RNA, 22 nt, Human
ugggcagaaaucaguaucagau

SEQ ID NO: 384706 - RNA, 22 nt, Human
agcaagcuaccuagauagucua

SEQ ID NO: 384707 - RNA, 22 nt, Human
ucuggccaggauggcaagacca

SEQ ID NO: 384708 - RNA, 22 nt, Human
uguucuucuagauugccuuuua

SEQ ID NO: 384709 - RNA, 22 nt, Human
aaucaagaaaaugaggauucuu

SEQ ID NO: 384710 - RNA, 22 nt, Human
uugcaccaaaugaguuaaaauu

SEQ ID NO: 384711 - RNA, 22 nt, Human
agccucucuguuagucacuggg

SEQ ID NO: 384712 - RNA, 22 nt, Human
gucuucuuuucagucugcuugu

SEQ ID NO: 384713 - RNA, 22 nt, Human
acagcagcaauagcagugacau

SEQ ID NO: 384714 - RNA, 22 nt, Human
ccugagguggcugcagcacugc

SEQ ID NO: 384715 - RNA, 22 nt, Human
gaggcucacugggcaaagacuc

SEQ ID NO: 384716 - RNA, 21 nt, Human
uuucugucucugccacuaguu

SEQ ID NO: 384717 - RNA, 22 nt, Human
gcucccacugcagcccugagcc

SEQ ID NO: 384718 - RNA, 20 nt, Human
cucucccagcacagcuuccu

SEQ ID NO: 384719 - RNA, 22 nt, Human
gauuucaaaaguagauccauca

SEQ ID NO: 384720 - RNA, 22 nt, Human
uggcaggaggaugaggcggcua

SEQ ID NO: 384721 - RNA, 22 nt, Human
cuggccucauagccaagcugug

SEQ ID NO: 384722 - RNA, 22 nt, Human
cuguaaaacacuguaguaucug

SEQ ID NO: 384723 - RNA, 22 nt, Human
aacuggauuuaggaacagagaa

SEQ ID NO: 384724 - RNA, 22 nt, Human
ccuggcugaaccaaugaagugg

SEQ ID NO: 384725 - RNA, 22 nt, Human
cuuaauuuuuguaguagaugga

SEQ ID NO: 384726 - RNA, 22 nt, Human
ucugggaaaugcuguuccuugu

SEQ ID NO: 384727 - RNA, 22 nt, Human
gcaccugguuuauauaaucaua

SEQ ID NO: 384728 - RNA, 18 nt, Human
aggcuucuuggcucaguc

SEQ ID NO: 384729 - RNA, 22 nt, Human
agcagccagagaaugaugcagu

SEQ ID NO: 384730 - RNA, 21 nt, Human
aggcucagagaucaaacagua

SEQ ID NO: 384731 - RNA, 22 nt, Human
auacacauguguaugugcaugc

SEQ ID NO: 384732 - RNA, 22 nt, Human
cucacaggcaucucaucaggcu

SEQ ID NO: 384733 - RNA, 19 nt, Human
cuggcucuuggguggagga

SEQ ID NO: 384734 - RNA, 22 nt, Human
ucuauaaagggccagauaguag

SEQ ID NO: 384735 - RNA, 22 nt, Human
gggcugagucugcugccuguca

SEQ ID NO: 384736 - RNA, 22 nt, Human
gccagccuucuguggccugcaa

SEQ ID NO: 384737 - RNA, 22 nt, Human
ugggaauggaugcuaagugcua

SEQ ID NO: 384738 - RNA, 22 nt, Human
guccaugacugugacucacaug

SEQ ID NO: 384739 - RNA, 22 nt, Human
uccauucuaugcuuacauuuau

SEQ ID NO: 384740 - RNA, 23 nt, Human
uccaggcaugagcucuggaugga

SEQ ID NO: 384741 - RNA, 22 nt, Human
auguacacaugcaugcaugugc

SEQ ID NO: 384742 - RNA, 22 nt, Human
agcauuuaauuacaguuuaauu

SEQ ID NO: 384743 - RNA, 22 nt, Human
ugaaaaaccucaguccgcuuua

SEQ ID NO: 384744 - RNA, 22 nt, Human
cucagaauuuagggcucugagg

SEQ ID NO: 384745 - RNA, 22 nt, Human
agaauucuuggugguuagaaua

SEQ ID NO: 384746 - RNA, 22 nt, Human
agaugggcgcccuggacugagg

SEQ ID NO: 384747 - RNA, 22 nt, Human
ccuguucaauauucuuccuugu

SEQ ID NO: 384748 - RNA, 22 nt, Human
acuggcagcagcagcccuuggg

SEQ ID NO: 384749 - RNA, 22 nt, Human
cccagggcccuggacagcuaca

SEQ ID NO: 384750 - RNA, 22 nt, Human
ggccucugggguccugagccca

SEQ ID NO: 384751 - RNA, 22 nt, Human
uggcagagagacucuccuugau

SEQ ID NO: 384752 - RNA, 22 nt, Human
aaguuacacauuuucauuguaa

SEQ ID NO: 384753 - RNA, 22 nt, Human
ucucugagcccagugucccccu

SEQ ID NO: 384754 - RNA, 17 nt, Human
gcuuuggaaggguagac

SEQ ID NO: 384755 - RNA, 22 nt, Human
gcucacuggccugaagaggacg

SEQ ID NO: 384756 - RNA, 22 nt, Human
ugcuuuauuuuaaauaugccau

SEQ ID NO: 384757 - RNA, 22 nt, Human
uagcagggaaggugugcugagc

SEQ ID NO: 384758 - RNA, 22 nt, Human
ccccagcucagugcagggacau

SEQ ID NO: 384759 - RNA, 22 nt, Human
uacaaagucaccagcuucuugc

SEQ ID NO: 384760 - RNA, 22 nt, Human
cagcagaggugguucacauugu

SEQ ID NO: 384761 - RNA, 22 nt, Human
acagcuuuguuuucccugcuga

SEQ ID NO: 384762 - RNA, 22 nt, Human
gucaaacaaauuaacauaucca

SEQ ID NO: 384763 - RNA, 22 nt, Human
gguggcagcgucuaucugacau

SEQ ID NO: 384764 - RNA, 22 nt, Human
gaaaucugcggugaggccugag

SEQ ID NO: 384765 - RNA, 22 nt, Human
cacaucagguagaccuacagag

SEQ ID NO: 384766 - RNA, 22 nt, Human
gucaugccagcggagcucggga

SEQ ID NO: 384767 - RNA, 23 nt, Human
caauuucauaugauucuaccuaa

SEQ ID NO: 384768 - RNA, 22 nt, Human
acugucuccucaucaugccugg

SEQ ID NO: 384769 - RNA, 22 nt, Human
uuuaagauucaguaaggcaaac

SEQ ID NO: 384770 - RNA, 22 nt, Human
gcuggcuguguuucaucucuga

SEQ ID NO: 384771 - RNA, 22 nt, Human
caaagauuuuagaauuugcaau

SEQ ID NO: 384772 - RNA, 22 nt, Human
acugccuugaaagauuguugag

SEQ ID NO: 384773 - RNA, 22 nt, Human
agagccuugaagaucuggaaaa

SEQ ID NO: 384774 - RNA, 22 nt, Human
ugagccaguggaagauggcagu

SEQ ID NO: 384775 - RNA, 22 nt, Human
cccuggaggcaaagguugcagu

SEQ ID NO: 384776 - RNA, 22 nt, Human
ccugccugacagagaagguuca

SEQ ID NO: 384777 - RNA, 22 nt, Human
uucccaauauucugcuuuuaug

SEQ ID NO: 384778 - RNA, 22 nt, Human
aaaauuauggaguaucccaaag

SEQ ID NO: 384779 - RNA, 22 nt, Human
gcuggcaggguucucacugaaa

SEQ ID NO: 384780 - RNA, 22 nt, Human
ugggcugcuuccucagcugaga

SEQ ID NO: 384781 - RNA, 21 nt, Human
uuacuuuugcaccaaccuaau

SEQ ID NO: 384782 - RNA, 22 nt, Human
ggcucaggacacagugguuuag

SEQ ID NO: 384783 - RNA, 22 nt, Human
caggugggcguggcgagaaggc

SEQ ID NO: 384784 - RNA, 22 nt, Human
gcuucuauuauuuggagcugag

SEQ ID NO: 384785 - RNA, 22 nt, Human
aggaagcuggugugaggaugaa

SEQ ID NO: 384786 - RNA, 21 nt, Human
ugaaaguuggagucaaaugua

SEQ ID NO: 384787 - RNA, 22 nt, Human
cuuaauuacuguccaauaugca

SEQ ID NO: 384788 - RNA, 22 nt, Human
uacaugaacaaaauagcagaaa

SEQ ID NO: 384789 - RNA, 22 nt, Human
accuggccauccagcuggcauc

SEQ ID NO: 384790 - RNA, 22 nt, Human
gcugccuuuuaaagccucgcuu

SEQ ID NO: 384791 - RNA, 22 nt, Human
agagguagagguugcagugagc

SEQ ID NO: 384792 - RNA, 22 nt, Human
aggaagcuagagccaccggacu

SEQ ID NO: 384793 - RNA, 22 nt, Human
ccacacagggggaugaguuauu

SEQ ID NO: 384794 - RNA, 22 nt, Human
auacuguuucucuucuacauga

SEQ ID NO: 384795 - RNA, 22 nt, Human
gacaugcaugaaugcaggucuc

SEQ ID NO: 384796 - RNA, 22 nt, Human
gcagagaggaaugaagccaucc

SEQ ID NO: 384797 - RNA, 22 nt, Human
agcugggucuugggccaggaga

SEQ ID NO: 384798 - RNA, 22 nt, Human
cugcugagguccuugcucagac

SEQ ID NO: 384799 - RNA, 22 nt, Human
cccugccuuguuggagccuaug

SEQ ID NO: 384800 - RNA, 22 nt, Human
gcagccacccucaaggcugaau

SEQ ID NO: 384801 - RNA, 22 nt, Human
aaguucuacuguggguaaaaug

SEQ ID NO: 384802 - RNA, 22 nt, Human
aagaagagaacuggcauccuaa

SEQ ID NO: 384803 - RNA, 22 nt, Human
cauauuugguauaacuuaagca

SEQ ID NO: 384804 - RNA, 22 nt, Human
augugaaagagguguucagugg

SEQ ID NO: 384805 - RNA, 22 nt, Human
ugcugcucuguaaagugaugag

SEQ ID NO: 384806 - RNA, 22 nt, Human
cccucugcaggcuggaccugcc

SEQ ID NO: 384807 - RNA, 22 nt, Human
cacugcauggaugauggcugua

SEQ ID NO: 384808 - RNA, 19 nt, Human
ucucacaucagcuccuagc

SEQ ID NO: 384809 - RNA, 22 nt, Human
gcuugaaaauucauagguauuu

SEQ ID NO: 384810 - RNA, 18 nt, Human
uacaugcauaaaugaagc

SEQ ID NO: 384811 - RNA, 22 nt, Human
uucucagauauuuacugagcau

SEQ ID NO: 384812 - RNA, 22 nt, Human
cagaggaagcuggguguggagu

SEQ ID NO: 384813 - RNA, 22 nt, Human
uguuuauaccuugguauaacca

SEQ ID NO: 384814 - RNA, 22 nt, Human
augccagucaaagaagaugaca

SEQ ID NO: 384815 - RNA, 22 nt, Human
cugacccauauaagaguggagg

SEQ ID NO: 384816 - RNA, 20 nt, Human
gccuggcacccggggcuggc

SEQ ID NO: 384817 - RNA, 22 nt, Human
acccagcaaagauaaacuuaug

SEQ ID NO: 384818 - RNA, 22 nt, Human
ggagggaaugucuagcauucuu

SEQ ID NO: 384819 - RNA, 20 nt, Human
ccagaagagaugaucaucca

SEQ ID NO: 384820 - RNA, 21 nt, Human
cccagggaagccgcagucacc

SEQ ID NO: 384821 - RNA, 22 nt, Human
uucaggauccccuugaugggcu

SEQ ID NO: 384822 - RNA, 22 nt, Human
uucagaaagugaaucuuguuau

SEQ ID NO: 384823 - RNA, 22 nt, Human
aggcagccaaucagaggcugac

SEQ ID NO: 384824 - RNA, 22 nt, Human
ucaggcagaccaccgugggcag

SEQ ID NO: 384825 - RNA, 22 nt, Human
cugucccuucauuauucacuac

SEQ ID NO: 384826 - RNA, 22 nt, Human
uggauaaacucacuguaaguug

SEQ ID NO: 384827 - RNA, 22 nt, Human
gccaggcagagccccgugcagc

SEQ ID NO: 384828 - RNA, 22 nt, Human
aaugcuagugugauauguaagg

SEQ ID NO: 384829 - RNA, 22 nt, Human
cugcuuuggacaacuauucuug

SEQ ID NO: 384830 - RNA, 22 nt, Human
aggaggccgauuucagaggucg

SEQ ID NO: 384831 - RNA, 22 nt, Human
acacagggcaaugcuuugaccu

SEQ ID NO: 384832 - RNA, 22 nt, Human
aaguucaaguaguguuacaugg

SEQ ID NO: 384833 - RNA, 22 nt, Human
cacagcugugagaagggagccu

SEQ ID NO: 384834 - RNA, 22 nt, Human
ugaaucaguauaaauucucaaa

SEQ ID NO: 384835 - RNA, 22 nt, Human
guggccucuguuggcuccuagg

SEQ ID NO: 384836 - RNA, 22 nt, Human
gacaggguacgggcuaggcaca

SEQ ID NO: 384837 - RNA, 22 nt, Human
cucagaaguucagccuagagua

SEQ ID NO: 384838 - RNA, 22 nt, Human
ggccugagaaccauggggccaa

SEQ ID NO: 384839 - RNA, 19 nt, Human
agggcuaggcacauagggc

SEQ ID NO: 384840 - RNA, 22 nt, Human
ugggcugcccugaugguccuca

SEQ ID NO: 384841 - RNA, 22 nt, Human
cagaggugcauacaggucauua

SEQ ID NO: 384842 - RNA, 22 nt, Human
auuuucagagacaucuggacuu

SEQ ID NO: 384843 - RNA, 22 nt, Human
agaucauaugaaaaauuucaag

SEQ ID NO: 384844 - RNA, 22 nt, Human
gcagagccgugaauggauuuca

SEQ ID NO: 384845 - RNA, 22 nt, Human
ucucccagaaguccucaguaca

SEQ ID NO: 384846 - RNA, 22 nt, Human
uacauaauugucuuuguccuca

SEQ ID NO: 384847 - RNA, 22 nt, Human
cugcagcugucucuacugggca

SEQ ID NO: 384848 - RNA, 22 nt, Human
gcugccuggcuuuaguccacuu

SEQ ID NO: 384849 - RNA, 22 nt, Human
uggggccuggucagagcugcac

SEQ ID NO: 384850 - RNA, 22 nt, Human
auaaagcaucuagucugucacu

SEQ ID NO: 384851 - RNA, 22 nt, Human
aauuccaggaugcaggaggugc

SEQ ID NO: 384852 - RNA, 22 nt, Human
auacuuaacuguggagucauug

SEQ ID NO: 384853 - RNA, 22 nt, Human
ucaagagagugcugcuuggggu

SEQ ID NO: 384854 - RNA, 22 nt, Human
aguccaugguucugacucaucu

SEQ ID NO: 384855 - RNA, 22 nt, Human
uuugaaauuaagauauugucca

SEQ ID NO: 384856 - RNA, 22 nt, Human
auauaguuggguuucauucuac

SEQ ID NO: 384857 - RNA, 22 nt, Human
acuguucacagauuagucgaug

SEQ ID NO: 384858 - RNA, 22 nt, Human
uuagaaaggaaucuucauuuca

SEQ ID NO: 384859 - RNA, 22 nt, Human
ggcaaaaaccauaauuacuuuu

SEQ ID NO: 384860 - RNA, 22 nt, Human
uauucacaaaaugagguccuca

SEQ ID NO: 384861 - RNA, 19 nt, Human
cagcaauaaugccagaugg

SEQ ID NO: 384862 - RNA, 22 nt, Human
ugcuuuauggauuuguguccug

SEQ ID NO: 384863 - RNA, 22 nt, Human
ccagcacugcucucagacugag

SEQ ID NO: 384864 - RNA, 22 nt, Human
guuguuuuuguucucuauagcu

SEQ ID NO: 384865 - RNA, 20 nt, Human
gucugaggagcagugggaaa

SEQ ID NO: 384866 - RNA, 22 nt, Human
uuauuacacugaaagaauugcg

SEQ ID NO: 384867 - RNA, 22 nt, Human
aaguuauaucaucucauugacg

SEQ ID NO: 384868 - RNA, 22 nt, Human
ucccagccauuccuuuaggugu

SEQ ID NO: 384869 - RNA, 22 nt, Human
cuugggaaugcuaacagaugac

SEQ ID NO: 384870 - RNA, 18 nt, Human
uggcagagugucuguucu

SEQ ID NO: 384871 - RNA, 22 nt, Human
gcaggcaguuugcuuuucccuc

SEQ ID NO: 384872 - RNA, 22 nt, Human
caggcugggcuccggagauaaa

SEQ ID NO: 384873 - RNA, 22 nt, Human
cagccaucaguaaagacagcuu

SEQ ID NO: 384874 - RNA, 22 nt, Human
gagagaagaaagccaugguccu

SEQ ID NO: 384875 - RNA, 22 nt, Human
acaguggaaagaacauggauuu

SEQ ID NO: 384876 - RNA, 22 nt, Human
uugauggcugugauuuacucag

SEQ ID NO: 384877 - RNA, 22 nt, Human
gaaagccauagcccagcuuuac

SEQ ID NO: 384878 - RNA, 22 nt, Human
ugaaggcagcaugcacacuagu

SEQ ID NO: 384879 - RNA, 22 nt, Human
cccaggagagaggccaguuggc

SEQ ID NO: 384880 - RNA, 22 nt, Human
uggcuggcuagugggcaggauu

SEQ ID NO: 384881 - RNA, 22 nt, Human
cuguccuccggccaccuacagu

SEQ ID NO: 384882 - RNA, 22 nt, Human
cagucacauggaugauggauag

SEQ ID NO: 384883 - RNA, 22 nt, Human
uuccaguugguagaauguaagg

SEQ ID NO: 384884 - RNA, 22 nt, Human
uccaggaguggggcagaggucu

SEQ ID NO: 384885 - RNA, 22 nt, Human
ggcgcacaaugugcagguuugu

SEQ ID NO: 384886 - RNA, 22 nt, Human
caugcuuucuguccaaauguua

SEQ ID NO: 384887 - RNA, 22 nt, Human
uaauuucagugggcucugggcu

SEQ ID NO: 384888 - RNA, 22 nt, Human
uuccaaacugccaauucagaag

SEQ ID NO: 384889 - RNA, 22 nt, Human
aggcagcagagguugaggaaag

SEQ ID NO: 384890 - RNA, 22 nt, Human
ucccagagugagccaggggcag

SEQ ID NO: 384891 - RNA, 22 nt, Human
ucauacaucuuguauaucuauc

SEQ ID NO: 384892 - RNA, 22 nt, Human
ccauggccgccgcugcucagga

SEQ ID NO: 384893 - RNA, 22 nt, Human
ugaguccauugauggauaguga

SEQ ID NO: 384894 - RNA, 22 nt, Human
gaaaauguuuccuguuauuugc

SEQ ID NO: 384895 - RNA, 22 nt, Human
gcugucaguuuuacccacagac

SEQ ID NO: 384896 - RNA, 22 nt, Human
aggcaagcauugggaacagggc

SEQ ID NO: 384897 - RNA, 22 nt, Human
uuuaggcagaacauggacuuug

SEQ ID NO: 384898 - RNA, 22 nt, Human
cucccacuccuggcucaccaca

SEQ ID NO: 384899 - RNA, 22 nt, Human
agcagacaacccagaugaccca

SEQ ID NO: 384900 - RNA, 22 nt, Human
agcuaggacagguagagauggg

SEQ ID NO: 384901 - RNA, 22 nt, Human
agugagaguauuaaugugaacu

SEQ ID NO: 384902 - RNA, 22 nt, Human
ugggcagagaguagaggcaacg

SEQ ID NO: 384903 - RNA, 22 nt, Human
aucaggauggguuuggcuuagg

SEQ ID NO: 384904 - RNA, 22 nt, Human
cagggcucccuugcaaggaggg

SEQ ID NO: 384905 - RNA, 22 nt, Human
agggaguuagaaauccaggaua

SEQ ID NO: 384906 - RNA, 22 nt, Human
aaaggucaaaaucgugacauug

SEQ ID NO: 384907 - RNA, 22 nt, Human
caugcuuuuuucuaguauaaau

SEQ ID NO: 384908 - RNA, 22 nt, Human
ucucauguauugcccuggugug

SEQ ID NO: 384909 - RNA, 22 nt, Human
gcagugcuaaguagcuggccca

SEQ ID NO: 384910 - RNA, 17 nt, Human
gcugagaggcagcacag

SEQ ID NO: 384911 - RNA, 22 nt, Human
uccuucagaaaaccucagucuu

SEQ ID NO: 384912 - RNA, 17 nt, Human
gaggacagggaaguagg

SEQ ID NO: 384913 - RNA, 22 nt, Human
guuucauacagauuauucaugg

SEQ ID NO: 384914 - RNA, 22 nt, Human
ucacaguuauagucuguagaau

SEQ ID NO: 384915 - RNA, 22 nt, Human
aucauaaaccacuuuguaaucu

SEQ ID NO: 384916 - RNA, 22 nt, Human
ucaagagauugaauaauaacug

SEQ ID NO: 384917 - RNA, 22 nt, Human
auuucacaucuaucucagauuu

SEQ ID NO: 384918 - RNA, 22 nt, Human
ugaaaucugcaugcaaaguccu

SEQ ID NO: 384919 - RNA, 22 nt, Human
ugaaggccucugguacaugcca

SEQ ID NO: 384920 - RNA, 22 nt, Human
gagggcugauguugccaccuca

SEQ ID NO: 384921 - RNA, 22 nt, Human
uauuauguagaguaaggguuaa

SEQ ID NO: 384922 - RNA, 22 nt, Human
aaggccagaguacuagaggcug

SEQ ID NO: 384923 - RNA, 22 nt, Human
ugugcauguauugauuuguacc

SEQ ID NO: 384924 - RNA, 22 nt, Human
auuuagaagcuaauuuuucaga

SEQ ID NO: 384925 - RNA, 22 nt, Human
gggcuggagccagcuguggcug

SEQ ID NO: 384926 - RNA, 22 nt, Human
uccugcaguuacaucccagcca

SEQ ID NO: 384927 - RNA, 22 nt, Human
ccuggcugugcauugccggccc

SEQ ID NO: 384928 - RNA, 21 nt, Human
uuugagaauuggucagagugc

SEQ ID NO: 384929 - RNA, 22 nt, Human
ugaaacaagauccacagacuug

SEQ ID NO: 384930 - RNA, 22 nt, Human
uccauuuuucaugacuccucaa

SEQ ID NO: 384931 - RNA, 22 nt, Human
ugcagggcagcuagggagcuuu

SEQ ID NO: 384932 - RNA, 22 nt, Human
cuuauguacacacauauauugu

SEQ ID NO: 384933 - RNA, 22 nt, Human
cugccuguuuucugauagauuu

SEQ ID NO: 384934 - RNA, 20 nt, Human
aggaggcauagucuggaaag

SEQ ID NO: 384935 - RNA, 22 nt, Human
uaaccauauuuuccauuaaguu

SEQ ID NO: 384936 - RNA, 22 nt, Human
aauucuaaauguaauuuagaau

SEQ ID NO: 384937 - RNA, 22 nt, Human
agcauuuagucuuuauugcagc

SEQ ID NO: 384938 - RNA, 22 nt, Human
uggcuuccuccagagcaggagg

SEQ ID NO: 384939 - RNA, 22 nt, Human
agagccaggcaggcaauguuga

SEQ ID NO: 384940 - RNA, 22 nt, Human
uccaucaccauuucugcgagcu

SEQ ID NO: 384941 - RNA, 22 nt, Human
caaagcaaggcucaguuugaac

SEQ ID NO: 384942 - RNA, 22 nt, Human
gcacugaacuuuaaucauuucu

SEQ ID NO: 384943 - RNA, 22 nt, Human
gcagggcucaacaggacacccc

SEQ ID NO: 384944 - RNA, 22 nt, Human
ugggacaguuguccuccacucu

SEQ ID NO: 384945 - RNA, 22 nt, Human
aauguuaauguguuugcuuaug

SEQ ID NO: 384946 - RNA, 22 nt, Human
aguuuuucuccccuggcuucau

SEQ ID NO: 384947 - RNA, 22 nt, Human
caguuucucucaauaagcaucg

SEQ ID NO: 384948 - RNA, 22 nt, Human
aacuggauuaacuggcucaaau

SEQ ID NO: 384949 - RNA, 22 nt, Human
uucucagaggagucgggagcug

SEQ ID NO: 384950 - RNA, 22 nt, Human
gaucagaauucuuguguguuuc

SEQ ID NO: 384951 - RNA, 22 nt, Human
uagaaacaucagcuaaccaaaa

SEQ ID NO: 384952 - RNA, 22 nt, Human
gcuggcucuucaguggagauag

SEQ ID NO: 384953 - RNA, 22 nt, Human
acuuucucaggaauucacagac

SEQ ID NO: 384954 - RNA, 22 nt, Human
uggcagggccugcucaucaucc

SEQ ID NO: 384955 - RNA, 22 nt, Human
gcagcugcuggaaguuccugcc

SEQ ID NO: 384956 - RNA, 22 nt, Human
ccugcagguugcagaggcggaa

SEQ ID NO: 384957 - RNA, 22 nt, Human
aucuggcugagcgaggcccaca

SEQ ID NO: 384958 - RNA, 22 nt, Human
uuagcuaaacuguaacuagaau

SEQ ID NO: 384959 - RNA, 22 nt, Human
caguccuuagauuuuacugcca

SEQ ID NO: 384960 - RNA, 22 nt, Human
cuggcaggaagaggaaagguca

SEQ ID NO: 384961 - RNA, 22 nt, Human
caguacuuuucuggcuuucuac

SEQ ID NO: 384962 - RNA, 22 nt, Human
uguccuuuaugaaaugguguuu

SEQ ID NO: 384963 - RNA, 22 nt, Human
uagcugugagcacccaggcugu

SEQ ID NO: 384964 - RNA, 22 nt, Human
ucucugagcccaauguagcaau

SEQ ID NO: 384965 - RNA, 22 nt, Human
caguuuuugccauuaagaguaa

SEQ ID NO: 384966 - RNA, 22 nt, Human
auauccaagaaacaauuaauuc

SEQ ID NO: 384967 - RNA, 23 nt, Human
ucuauacauacugcagccucugg

SEQ ID NO: 384968 - RNA, 22 nt, Human
uccugcagcauccgucgucugu

SEQ ID NO: 384969 - RNA, 22 nt, Human
gcuuggaaguaggauugggaga

SEQ ID NO: 384970 - RNA, 22 nt, Human
aaguucuaauuuugcauucagg

SEQ ID NO: 384971 - RNA, 22 nt, Human
ucaaggcuaaacuuucagagua

SEQ ID NO: 384972 - RNA, 21 nt, Human
ucacuagugccuucugucauu

SEQ ID NO: 384973 - RNA, 22 nt, Human
uguggcaggcaagauguacaga

SEQ ID NO: 384974 - RNA, 20 nt, Human
aagcaauauagugcaaaugu

SEQ ID NO: 384975 - RNA, 22 nt, Human
gccagagccacuuuugggugau

SEQ ID NO: 384976 - RNA, 22 nt, Human
ucacaauuuggauacagcuaug

SEQ ID NO: 384977 - RNA, 22 nt, Human
uaauuucacaguucaacgcaca

SEQ ID NO: 384978 - RNA, 22 nt, Human
uuuagggacaagggucuggggu

SEQ ID NO: 384979 - RNA, 22 nt, Human
cugaggccagcugcagagcucu

SEQ ID NO: 384980 - RNA, 22 nt, Human
uucauucugcaguucucagcuc

SEQ ID NO: 384981 - RNA, 22 nt, Human
cuguguccugcgucaagccaau

SEQ ID NO: 384982 - RNA, 22 nt, Human
uucaggagcuggcugcgaagga

SEQ ID NO: 384983 - RNA, 22 nt, Human
agaggaggccaggcccacaccu

SEQ ID NO: 384984 - RNA, 22 nt, Human
gaggcaguguugaaaaggagag

SEQ ID NO: 384985 - RNA, 22 nt, Human
gggcugggauggcuugaagauu

SEQ ID NO: 384986 - RNA, 22 nt, Human
auucauaacggcaaaugucacc

SEQ ID NO: 384987 - RNA, 22 nt, Human
cagcaauaaugucuacaaaucu

SEQ ID NO: 384988 - RNA, 22 nt, Human
ugcuuuaaauaugaauuagcau

SEQ ID NO: 384989 - RNA, 22 nt, Human
uacauucuacuuuuucacuccc

SEQ ID NO: 384990 - RNA, 22 nt, Human
ugagaaaagguugagaugauaa

SEQ ID NO: 384991 - RNA, 22 nt, Human
ggcugccauaacagaguaccac

SEQ ID NO: 384992 - RNA, 22 nt, Human
cuggacagaaaaggccacugga

SEQ ID NO: 384993 - RNA, 22 nt, Human
ggggauggauuccgggucccug

SEQ ID NO: 384994 - RNA, 22 nt, Human
cggggcugcucguccuccugug

SEQ ID NO: 384995 - RNA, 22 nt, Human
gagcugggacauggguccucuc

SEQ ID NO: 384996 - RNA, 22 nt, Human
uccagcuuauagguagauuuaa

SEQ ID NO: 384997 - RNA, 22 nt, Human
ucagugugaguaccaugcucag

SEQ ID NO: 384998 - RNA, 22 nt, Human
agagcagguggcaacucuggga

SEQ ID NO: 384999 - RNA, 22 nt, Human
gcgagggcacgcgguugaaggc

SEQ ID NO: 385000 - RNA, 22 nt, Human
cugccaggcacgugcagcauca

SEQ ID NO: 385001 - RNA, 22 nt, Human
ccagagaggcaaaacuccuucc

SEQ ID NO: 385002 - RNA, 18 nt, Human
ugucucaggcugaaacag

SEQ ID NO: 385003 - RNA, 22 nt, Human
gccagccugugggggcucugug

SEQ ID NO: 385004 - RNA, 21 nt, Human
ggcuccugcuuugugaggggc

SEQ ID NO: 385005 - RNA, 22 nt, Human
caggcccagcccagcccuucga

SEQ ID NO: 385006 - RNA, 22 nt, Human
agggugucagccacggaauggg

SEQ ID NO: 385007 - RNA, 22 nt, Human
cccauuuagauaacaguucaaa

SEQ ID NO: 385008 - RNA, 22 nt, Human
guccucuggccuuucccaggac

SEQ ID NO: 385009 - RNA, 22 nt, Human
ucuggcuccacucugugcaugc

SEQ ID NO: 385010 - RNA, 22 nt, Human
gugagggguggcugagcaguuu

SEQ ID NO: 385011 - RNA, 22 nt, Human
uggcugagggcacuaugaagcc

SEQ ID NO: 385012 - RNA, 22 nt, Human
uaagaaguacaaaaauuuucug

SEQ ID NO: 385013 - RNA, 19 nt, Human
gaggcgaggcgugcaggag

SEQ ID NO: 385014 - RNA, 22 nt, Human
ccacugucagaggggcugugcc

SEQ ID NO: 385015 - RNA, 22 nt, Human
gcagaggagcaagcuggacacc

SEQ ID NO: 385016 - RNA, 22 nt, Human
ucaagaaagggcuucaccagga

SEQ ID NO: 385017 - RNA, 22 nt, Human
caguggcagagaacagagaccu

SEQ ID NO: 385018 - RNA, 22 nt, Human
uauuacaauuuacauugcacuu

SEQ ID NO: 385019 - RNA, 22 nt, Human
gccucugcucucagguagccuc

SEQ ID NO: 385020 - RNA, 22 nt, Human
ggcagcuuuuaucccugacaga

SEQ ID NO: 385021 - RNA, 22 nt, Human
ccucucaucauuaucgcuuugu

SEQ ID NO: 385022 - RNA, 22 nt, Human
uuccuguauuuugcgaauuuuc

SEQ ID NO: 385023 - RNA, 22 nt, Human
uacucagagucauugcccuucu

SEQ ID NO: 385024 - RNA, 22 nt, Human
ugauugacuuuagaauagcacu

SEQ ID NO: 385025 - RNA, 19 nt, Human
aggucauugauagugcagg

SEQ ID NO: 385026 - RNA, 22 nt, Human
caguguggcugagacagaggcu

SEQ ID NO: 385027 - RNA, 22 nt, Human
uugcauugaucccagcuugggc

SEQ ID NO: 385028 - RNA, 22 nt, Human
uccaggcauguggccaguacuc

SEQ ID NO: 385029 - RNA, 22 nt, Human
ccagcugucugguuccagagcc

SEQ ID NO: 385030 - RNA, 19 nt, Human
ugucucugaaagaugagcu

SEQ ID NO: 385031 - RNA, 22 nt, Human
ccugggaggcggagguugcagg

SEQ ID NO: 385032 - RNA, 22 nt, Human
caaauacuaaacauaagauuuu

SEQ ID NO: 385033 - RNA, 22 nt, Human
auggcagggaccaagcugucau

SEQ ID NO: 385034 - RNA, 22 nt, Human
uccugaggcucacuuugaaugu

SEQ ID NO: 385035 - RNA, 22 nt, Human
caaaagcaguucuaucugaguu

SEQ ID NO: 385036 - RNA, 20 nt, Human
ccugucuggagacaaagaga

SEQ ID NO: 385037 - RNA, 22 nt, Human
uucauacuguguuuccaaguuu

SEQ ID NO: 385038 - RNA, 22 nt, Human
ucccuuaaaacucauguguugu

SEQ ID NO: 385039 - RNA, 22 nt, Human
cagagcugcacauucuaugaug

SEQ ID NO: 385040 - RNA, 22 nt, Human
aaucuguuuaguucugcguaug

SEQ ID NO: 385041 - RNA, 23 nt, Human
aggcgagcucuucuccagcacgu

SEQ ID NO: 385042 - RNA, 22 nt, Human
ugcccagggauaagccuagaga

SEQ ID NO: 385043 - RNA, 22 nt, Human
acauuaccuggcauuugaucuu

SEQ ID NO: 385044 - RNA, 22 nt, Human
cugucucagcaggaagucauca

SEQ ID NO: 385045 - RNA, 22 nt, Human
ugaaauagacacagugcuauac

SEQ ID NO: 385046 - RNA, 23 nt, Human
auauuagggagauuagcccucua

SEQ ID NO: 385047 - RNA, 22 nt, Human
agugcuccuauggaucaguugu

SEQ ID NO: 385048 - RNA, 22 nt, Human
agcugggagcagagccacagcc

SEQ ID NO: 385049 - RNA, 22 nt, Human
uuugaagauuaugccagaguga

SEQ ID NO: 385050 - RNA, 20 nt, Human
gccugagcuauugccaggau

SEQ ID NO: 385051 - RNA, 22 nt, Human
acucagaguuugcguuccauac

SEQ ID NO: 385052 - RNA, 22 nt, Human
auuugaagucuucaugauuucu

SEQ ID NO: 385053 - RNA, 19 nt, Human
uggcugagcuggacugagg

SEQ ID NO: 385054 - RNA, 22 nt, Human
cuggggcugcagcgaucuucau

SEQ ID NO: 385055 - RNA, 21 nt, Human
acaggcucuggggaugcuggg

SEQ ID NO: 385056 - RNA, 22 nt, Human
acaauuccacauggcaugcagg

SEQ ID NO: 385057 - RNA, 22 nt, Human
aagccaggcaugcuuggacagu

SEQ ID NO: 385058 - RNA, 19 nt, Human
gacagugcaguuguaguac

SEQ ID NO: 385059 - RNA, 22 nt, Human
acccaggauagagugcugcagu

SEQ ID NO: 385060 - RNA, 22 nt, Human
uacugcaugguggaguggagcu

SEQ ID NO: 385061 - RNA, 22 nt, Human
uacauguauugauuucucuucu

SEQ ID NO: 385062 - RNA, 22 nt, Human
cagucacacaaguggacuuggg

SEQ ID NO: 385063 - RNA, 22 nt, Human
aucauuucccuuuagaucacaa

SEQ ID NO: 385064 - RNA, 22 nt, Human
aagagcuggauugugcugcaga

SEQ ID NO: 385065 - RNA, 19 nt, Human
agccuggcuuugcucugcu

SEQ ID NO: 385066 - RNA, 22 nt, Human
ucagcaauccucccacaggugg

SEQ ID NO: 385067 - RNA, 21 nt, Human
gcagaggaaugguauacauaa

SEQ ID NO: 385068 - RNA, 22 nt, Human
aagccaguguuuuugagaguug

SEQ ID NO: 385069 - RNA, 22 nt, Human
agggauguaaauucuucuucuu

SEQ ID NO: 385070 - RNA, 22 nt, Human
cagggcagaacauauagauagu

SEQ ID NO: 385071 - RNA, 22 nt, Human
uccagccuaggggaacagcugc

SEQ ID NO: 385072 - RNA, 22 nt, Human
cugggcuacguguugacagcau

SEQ ID NO: 385073 - RNA, 23 nt, Human
cucccuggaguuucuggaagaug

SEQ ID NO: 385074 - RNA, 22 nt, Human
ggcgcaggccuuggauccuggu

SEQ ID NO: 385075 - RNA, 22 nt, Human
gcuggggaggcagcagagaaca

SEQ ID NO: 385076 - RNA, 22 nt, Human
cacauaauugaacgugaugagu

SEQ ID NO: 385077 - RNA, 22 nt, Human
ccugcagaaaggguccccagga

SEQ ID NO: 385078 - RNA, 22 nt, Human
cugcagugaaaucaggaagcaa

SEQ ID NO: 385079 - RNA, 22 nt, Human
aagccuuccugagugcaaggcc

SEQ ID NO: 385080 - RNA, 22 nt, Human
agccagccgggggaccacagug

SEQ ID NO: 385081 - RNA, 20 nt, Human
aagagcugacucacaguggu

SEQ ID NO: 385082 - RNA, 22 nt, Human
aagagcaucuauuucacagugg

SEQ ID NO: 385083 - RNA, 22 nt, Human
aaagcaguauauugguaguugu

SEQ ID NO: 385084 - RNA, 22 nt, Human
uuugcaaagugacuauuauaug

SEQ ID NO: 385085 - RNA, 22 nt, Human
ucaaaggcgguccaggaauaaa

SEQ ID NO: 385086 - RNA, 22 nt, Human
agauacauagcugugagcacac

SEQ ID NO: 385087 - RNA, 22 nt, Human
acuggcaguggcagcagaaaga

SEQ ID NO: 385088 - RNA, 22 nt, Human
ugccaggcuuuggucaaaggcu

SEQ ID NO: 385089 - RNA, 22 nt, Human
cagcacacagugacucgcaccu

SEQ ID NO: 385090 - RNA, 22 nt, Human
aagaacaacugcuuuaaaagca

SEQ ID NO: 385091 - RNA, 22 nt, Human
gauaaugaugacaaugacaacc

SEQ ID NO: 385092 - RNA, 22 nt, Human
ccccaggagaaaucuuaaacua

SEQ ID NO: 385093 - RNA, 22 nt, Human
caggcuugauuauucagacaau

SEQ ID NO: 385094 - RNA, 22 nt, Human
agucccagaucuccauucgguc

SEQ ID NO: 385095 - RNA, 23 nt, Human
cugcugugaaacaugguuuuggu

SEQ ID NO: 385096 - RNA, 22 nt, Human
cucaggcuugggaggaggccca

SEQ ID NO: 385097 - RNA, 22 nt, Human
uagcuguguagacacucagagc

SEQ ID NO: 385098 - RNA, 22 nt, Human
gacuguguccaugugcuggauu

SEQ ID NO: 385099 - RNA, 22 nt, Human
gaggccugguuuccagcauccu

SEQ ID NO: 385100 - RNA, 22 nt, Human
ugcaguggaaagacucagacuu

SEQ ID NO: 385101 - RNA, 18 nt, Human
ucugucuguacaaguauc

SEQ ID NO: 385102 - RNA, 22 nt, Human
ucagggcauccauugccuguug

SEQ ID NO: 385103 - RNA, 22 nt, Human
auaguaacuggcauguuuauga

SEQ ID NO: 385104 - RNA, 22 nt, Human
caaggccaugagcagcgagugu

SEQ ID NO: 385105 - RNA, 17 nt, Human
ccucacagggaccagac

SEQ ID NO: 385106 - RNA, 20 nt, Human
aggauuuacuacuaccugcu

SEQ ID NO: 385107 - RNA, 22 nt, Human
uuucauaugggcauuggcaaua

SEQ ID NO: 385108 - RNA, 22 nt, Human
ggcugagcucaggggcagcagg

SEQ ID NO: 385109 - RNA, 22 nt, Human
ucucccaggucauacacagaga

SEQ ID NO: 385110 - RNA, 22 nt, Human
aggccagacagcuagaaacagg

SEQ ID NO: 385111 - RNA, 21 nt, Human
uuugcauuuuacaugugggga

SEQ ID NO: 385112 - RNA, 22 nt, Human
cccuggagguggagguugcagg

SEQ ID NO: 385113 - RNA, 22 nt, Human
ggcugccuccugcugggcugga

SEQ ID NO: 385114 - RNA, 22 nt, Human
aggccuccuggcuccaggccuu

SEQ ID NO: 385115 - RNA, 22 nt, Human
uccagggacacagaguccuucu

SEQ ID NO: 385116 - RNA, 22 nt, Human
ucauacacaagagcauguaaca

SEQ ID NO: 385117 - RNA, 22 nt, Human
guaggcagugguuggaagagaa

SEQ ID NO: 385118 - RNA, 22 nt, Human
gcuuccuggagggagagagcug

SEQ ID NO: 385119 - RNA, 22 nt, Human
ggaaaaggccacagggacacau

SEQ ID NO: 385120 - RNA, 22 nt, Human
caaaguccuagaacagugcuug

SEQ ID NO: 385121 - RNA, 22 nt, Human
uggacucaaguccaaguucacg

SEQ ID NO: 385122 - RNA, 22 nt, Human
gcuggucacucugggagcugcu

SEQ ID NO: 385123 - RNA, 22 nt, Human
uauucacauguacauaugcuca

SEQ ID NO: 385124 - RNA, 22 nt, Human
uggcugaggcuggagugcagug

SEQ ID NO: 385125 - RNA, 22 nt, Human
ucccagggucaguggugaggcc

SEQ ID NO: 385126 - RNA, 22 nt, Human
gucucuuuuauggugaguugau

SEQ ID NO: 385127 - RNA, 22 nt, Human
gccaccucggcuuucucugcuc

SEQ ID NO: 385128 - RNA, 22 nt, Human
uuccuuagcugucccuggaaau

SEQ ID NO: 385129 - RNA, 22 nt, Human
accugaggccuccccagcagac

SEQ ID NO: 385130 - RNA, 22 nt, Human
gggcugcuuuuuucuuagcaga

SEQ ID NO: 385131 - RNA, 22 nt, Human
agaaaugugagccccuuaucaa

SEQ ID NO: 385132 - RNA, 19 nt, Human
uggggcuguguuuugaccc

SEQ ID NO: 385133 - RNA, 22 nt, Human
acaugcauaggagaagucuuua

SEQ ID NO: 385134 - RNA, 22 nt, Human
cagcuccagcccaggcagcucc

SEQ ID NO: 385135 - RNA, 17 nt, Human
aagacagaagccaugag

SEQ ID NO: 385136 - RNA, 22 nt, Human
guuauguaucuugauugggugg

SEQ ID NO: 385137 - RNA, 22 nt, Human
gagguggguguaucacagguca

SEQ ID NO: 385138 - RNA, 22 nt, Human
uuucauaauagugcaguuuguu

SEQ ID NO: 385139 - RNA, 22 nt, Human
gccaggcucagcagucaaccug

SEQ ID NO: 385140 - RNA, 22 nt, Human
gcccucugcacagcucugagca

SEQ ID NO: 385141 - RNA, 18 nt, Human
cagagcagagguggagcg

SEQ ID NO: 385142 - RNA, 22 nt, Human
agcuggugcucaggggcaugga

SEQ ID NO: 385143 - RNA, 22 nt, Human
agcugcagcguucauuuuucca

SEQ ID NO: 385144 - RNA, 22 nt, Human
ccagugcuucuuugcuagcugg

SEQ ID NO: 385145 - RNA, 22 nt, Human
auucacaaagaagggaaguaca

SEQ ID NO: 385146 - RNA, 22 nt, Human
gccagguggcugagugacugag

SEQ ID NO: 385147 - RNA, 22 nt, Human
uuugcauaagucauguccagug

SEQ ID NO: 385148 - RNA, 22 nt, Human
gcugccaauccagcugugggag

SEQ ID NO: 385149 - RNA, 22 nt, Human
uucugaaaauugggucauacuu

SEQ ID NO: 385150 - RNA, 19 nt, Human
cuguggcugaccucuggcc

SEQ ID NO: 385151 - RNA, 22 nt, Human
accuggcacuacaggcaccugu

SEQ ID NO: 385152 - RNA, 23 nt, Human
ggcacugaagcuacaauggugag

SEQ ID NO: 385153 - RNA, 22 nt, Human
gagccaggcaccuucuguguug

SEQ ID NO: 385154 - RNA, 22 nt, Human
acagguggcuuauuggcugauu

SEQ ID NO: 385155 - RNA, 22 nt, Human
acaaagucacaauaauuaaccu

SEQ ID NO: 385156 - RNA, 22 nt, Human
cagccagugugaccgaggagga

SEQ ID NO: 385157 - RNA, 22 nt, Human
cucugggcacauuuuccaggac

SEQ ID NO: 385158 - RNA, 22 nt, Human
uguguuccugccuggcucuggu

SEQ ID NO: 385159 - RNA, 22 nt, Human
augccaggccccacgcugggca

SEQ ID NO: 385160 - RNA, 22 nt, Human
gugccugugcggacucagggaa

SEQ ID NO: 385161 - RNA, 22 nt, Human
ugaggcucagaaauguaaguuu

SEQ ID NO: 385162 - RNA, 22 nt, Human
agcagcaggagccgugggguga

SEQ ID NO: 385163 - RNA, 22 nt, Human
guccucaggaaagcagauaaca

SEQ ID NO: 385164 - RNA, 22 nt, Human
aggccagcuguuacuagagcca

SEQ ID NO: 385165 - RNA, 22 nt, Human
aagacuuucaaaccuauguuug

SEQ ID NO: 385166 - RNA, 18 nt, Human
ugucucugaauuccagug

SEQ ID NO: 385167 - RNA, 19 nt, Human
cuugguuaugguaugaugc

SEQ ID NO: 385168 - RNA, 22 nt, Human
cucaaggacuuauucaugccug

SEQ ID NO: 385169 - RNA, 22 nt, Human
caguuucuauggcugggcucug

SEQ ID NO: 385170 - RNA, 22 nt, Human
aucaggaucacagaaacuuuua

SEQ ID NO: 385171 - RNA, 15 nt, Human
aaucuggcggcaagu

SEQ ID NO: 385172 - RNA, 22 nt, Human
cucagggcuggaaagccaggaa

SEQ ID NO: 385173 - RNA, 21 nt, Human
auucagaguaauucaucuuua

SEQ ID NO: 385174 - RNA, 22 nt, Human
uuagaaaucugcugccaugcaa

SEQ ID NO: 385175 - RNA, 22 nt, Human
uuucuauaugaggagcuaaagu

SEQ ID NO: 385176 - RNA, 22 nt, Human
auugaaagguuuugagcagaua

SEQ ID NO: 385177 - RNA, 22 nt, Human
uucccaguauuaccuucaggaa

SEQ ID NO: 385178 - RNA, 22 nt, Human
ggcuguggacacugagcucaga

SEQ ID NO: 385179 - RNA, 22 nt, Human
agugugaguaauucagggaggg

SEQ ID NO: 385180 - RNA, 22 nt, Human
cuguccuugcuggccagguaug

SEQ ID NO: 385181 - RNA, 22 nt, Human
cugcagaguggagccucggcug

SEQ ID NO: 385182 - RNA, 16 nt, Human
ggcaccagugaacaca

SEQ ID NO: 385183 - RNA, 22 nt, Human
cuuucucaaugccggaaggcac

SEQ ID NO: 385184 - RNA, 17 nt, Human
cuggagccaagagggcc

SEQ ID NO: 385185 - RNA, 22 nt, Human
aucaggauucaccccagagcug

SEQ ID NO: 385186 - RNA, 22 nt, Human
gcguaaggccucuggucucgga

SEQ ID NO: 385187 - RNA, 20 nt, Human
cccaggaguuugcucuuacu

SEQ ID NO: 385188 - RNA, 22 nt, Human
cagugucuccagaugcuccaau

SEQ ID NO: 385189 - RNA, 22 nt, Human
cuggcuggcaaguagaacacaa

SEQ ID NO: 385190 - RNA, 22 nt, Human
gcccugcugucuucagaguaua

SEQ ID NO: 385191 - RNA, 22 nt, Human
uucaauacaaagaaaggaauuu

SEQ ID NO: 385192 - RNA, 22 nt, Human
cugccaggcagcagagggagaa

SEQ ID NO: 385193 - RNA, 22 nt, Human
gcaggcuccaggccggccccuu

SEQ ID NO: 385194 - RNA, 22 nt, Human
gcccaggagguggaggugcagu

SEQ ID NO: 385195 - RNA, 22 nt, Human
gggcucugggauucagagcaag

SEQ ID NO: 385196 - RNA, 22 nt, Human
cagagcauuaaaaccagcucug

SEQ ID NO: 385197 - RNA, 22 nt, Human
agcuguggggcaggcagcgagg

SEQ ID NO: 385198 - RNA, 22 nt, Human
ccagucugugugccagccugcg

SEQ ID NO: 385199 - RNA, 22 nt, Human
ugcauuguuuagaacucuuugg

SEQ ID NO: 385200 - RNA, 22 nt, Human
agcagggcacuggaaggcacug

SEQ ID NO: 385201 - RNA, 22 nt, Human
uggagcaggccggaaguggcuu

SEQ ID NO: 385202 - RNA, 22 nt, Human
agccucucuuucugguggcuaa

SEQ ID NO: 385203 - RNA, 22 nt, Human
auuugauuagcuguguaauuuu

SEQ ID NO: 385204 - RNA, 22 nt, Human
ucucugaguucuccuccagccc

SEQ ID NO: 385205 - RNA, 22 nt, Human
uucagagauggaaggcagaaug

SEQ ID NO: 385206 - RNA, 22 nt, Human
uaaaaugcacagcaguugaaag

SEQ ID NO: 385207 - RNA, 22 nt, Human
guggagccaggggcuguaggua

SEQ ID NO: 385208 - RNA, 22 nt, Human
ugcaguggaagagguggagauc

SEQ ID NO: 385209 - RNA, 22 nt, Human
cugaaggauguguggugggagu

SEQ ID NO: 385210 - RNA, 22 nt, Human
ugcauuugucuugucucaugaa

SEQ ID NO: 385211 - RNA, 22 nt, Human
gcuuuguguagaaggaggaugg

SEQ ID NO: 385212 - RNA, 22 nt, Human
acaacuuuguagcaauuccacg

SEQ ID NO: 385213 - RNA, 22 nt, Human
acagaguauuggaaaggcagug

SEQ ID NO: 385214 - RNA, 22 nt, Human
ucacauuuuaucuauuuuaagu

SEQ ID NO: 385215 - RNA, 22 nt, Human
uccugucagugaggcagaugaa

SEQ ID NO: 385216 - RNA, 22 nt, Human
acagccaggaauucuggagaag

SEQ ID NO: 385217 - RNA, 22 nt, Human
agcugcccugguaagauugaug

SEQ ID NO: 385218 - RNA, 22 nt, Human
acucugagcaucccaagucuua

SEQ ID NO: 385219 - RNA, 22 nt, Human
uuagaaagcuuuccauagucaa

SEQ ID NO: 385220 - RNA, 22 nt, Human
aaggguugaagauaaauaaggu

SEQ ID NO: 385221 - RNA, 19 nt, Human
uccauaaugaagauagagg

SEQ ID NO: 385222 - RNA, 22 nt, Human
cacacaggaugaagcagcagaa

SEQ ID NO: 385223 - RNA, 22 nt, Human
acaugaaaaauguuugcaguuu

SEQ ID NO: 385224 - RNA, 22 nt, Human
aguggcaggcagaagcuucuca

SEQ ID NO: 385225 - RNA, 22 nt, Human
aagguacaguuuuaagaauaag

SEQ ID NO: 385226 - RNA, 22 nt, Human
ucugucaccgagggcauccaaa

SEQ ID NO: 385227 - RNA, 18 nt, Human
gcagagugcgucucugug

SEQ ID NO: 385228 - RNA, 22 nt, Human
caguuuuucaaaauuacaugau

SEQ ID NO: 385229 - RNA, 22 nt, Human
aacucaguucuuuccacaaugc

SEQ ID NO: 385230 - RNA, 22 nt, Human
cuuaggcaguuuaggaaagaga

SEQ ID NO: 385231 - RNA, 22 nt, Human
aggcagccugguuugaauggaa

SEQ ID NO: 385232 - RNA, 22 nt, Human
uuuccucuaaacgcauuugcuu

SEQ ID NO: 385233 - RNA, 21 nt, Human
uucuucaguuuaauauaaaau

SEQ ID NO: 385234 - RNA, 22 nt, Human
cugagccagcgggcucacuuuu

SEQ ID NO: 385235 - RNA, 22 nt, Human
cuuguucaguugccucuccugc

SEQ ID NO: 385236 - RNA, 22 nt, Human
ucagagccaaucauggugcauu

SEQ ID NO: 385237 - RNA, 22 nt, Human
ccaggagagcucucguucagug

SEQ ID NO: 385238 - RNA, 22 nt, Human
auuauguaacugugguucagca

SEQ ID NO: 385239 - RNA, 22 nt, Human
agggacuauuuacccaucucac

SEQ ID NO: 385240 - RNA, 22 nt, Human
aaaggccacugcaagggaaggu

SEQ ID NO: 385241 - RNA, 20 nt, Human
aggcucaggguguuuaggaa

SEQ ID NO: 385242 - RNA, 22 nt, Human
aaggcccuggccccagcuucuu

SEQ ID NO: 385243 - RNA, 22 nt, Human
ucucuuauuuugccuuugacaa

SEQ ID NO: 385244 - RNA, 22 nt, Human
uagagcugauaaugaggccaag

SEQ ID NO: 385245 - RNA, 22 nt, Human
cugcagugcaagcccagaugga

SEQ ID NO: 385246 - RNA, 22 nt, Human
agccacagggggugagggacaa

SEQ ID NO: 385247 - RNA, 22 nt, Human
gauggcagguaguggucucauc

SEQ ID NO: 385248 - RNA, 20 nt, Human
ccagcauguacacaugugga

SEQ ID NO: 385249 - RNA, 22 nt, Human
ggugguggagccagcugggagu

SEQ ID NO: 385250 - RNA, 22 nt, Human
aaacuguaagagaauaaacuac

SEQ ID NO: 385251 - RNA, 22 nt, Human
gccuggcugagguggggaggca

SEQ ID NO: 385252 - RNA, 22 nt, Human
aggcaguggaaggagaaagcaa

SEQ ID NO: 385253 - RNA, 22 nt, Human
uggucuuuaagguagcugucau

SEQ ID NO: 385254 - RNA, 22 nt, Human
agggaagaaaauccaucgcugc

SEQ ID NO: 385255 - RNA, 23 nt, Human
ugaagugaaauuucacaagggac

SEQ ID NO: 385256 - RNA, 22 nt, Human
aaacuguaaacacagcaguaca

SEQ ID NO: 385257 - RNA, 22 nt, Human
aaagcucacaguaauacaaggc

SEQ ID NO: 385258 - RNA, 22 nt, Human
cccuggggcugagggauggccg

SEQ ID NO: 385259 - RNA, 22 nt, Human
agagggagugaaauggaauaga

SEQ ID NO: 385260 - RNA, 22 nt, Human
accaugaugggaagcucagggc

SEQ ID NO: 385261 - RNA, 22 nt, Human
aaggcagccucugccagccggg

SEQ ID NO: 385262 - RNA, 22 nt, Human
ccacugucugcaggccucagca

SEQ ID NO: 385263 - RNA, 22 nt, Human
uugguuuaggaacuggcuugga

SEQ ID NO: 385264 - RNA, 22 nt, Human
aggcagcuagagagugaaacug

SEQ ID NO: 385265 - RNA, 22 nt, Human
auuauguauuugguauaguuug

SEQ ID NO: 385266 - RNA, 22 nt, Human
uucuucaguguagcaacuguau

SEQ ID NO: 385267 - RNA, 22 nt, Human
auuaaacugagcaaauuaacau

SEQ ID NO: 385268 - RNA, 22 nt, Human
aagggcucccaacucaucuuuu

SEQ ID NO: 385269 - RNA, 22 nt, Human
cuucuccucugaguccugggag

SEQ ID NO: 385270 - RNA, 19 nt, Human
cagcugcaccgugaccauc

SEQ ID NO: 385271 - RNA, 22 nt, Human
gcugaagagagaugcguccagc

SEQ ID NO: 385272 - RNA, 22 nt, Human
auaaggcagaaaugauucuagu

SEQ ID NO: 385273 - RNA, 22 nt, Human
gcuggccucaucacugacuucu

SEQ ID NO: 385274 - RNA, 22 nt, Human
ucacaggguuuggaagccuccu

SEQ ID NO: 385275 - RNA, 22 nt, Human
ccuggccaggcauggagucaca

SEQ ID NO: 385276 - RNA, 22 nt, Human
gcaugggcaagaggacuggggg

SEQ ID NO: 385277 - RNA, 22 nt, Human
cauuuacagugagaguuuuuac

SEQ ID NO: 385278 - RNA, 22 nt, Human
aaagacugguguguuacauaua

SEQ ID NO: 385279 - RNA, 20 nt, Human
uacagaaacaggacuuuugg

SEQ ID NO: 385280 - RNA, 21 nt, Human
cagcaaaucauugggcagacu

SEQ ID NO: 385281 - RNA, 22 nt, Human
agagugggccucugagucccag

SEQ ID NO: 385282 - RNA, 22 nt, Human
uggagacucugcaucugugaca

SEQ ID NO: 385283 - RNA, 22 nt, Human
gaaagcaguaaaugggucccau

SEQ ID NO: 385284 - RNA, 23 nt, Human
ucagggacaugaugugucauauc

SEQ ID NO: 385285 - RNA, 22 nt, Human
ccagaagucaggaaugagucuu

SEQ ID NO: 385286 - RNA, 22 nt, Human
agaggaggaagagcuuuaaaau

SEQ ID NO: 385287 - RNA, 22 nt, Human
cucuggaguucuucaagcuacu

SEQ ID NO: 385288 - RNA, 22 nt, Human
agggcagagagaugaaugggau

SEQ ID NO: 385289 - RNA, 22 nt, Human
caaaugaagaaccuucucaccu

SEQ ID NO: 385290 - RNA, 22 nt, Human
cagagcuguccaaacccugaca

SEQ ID NO: 385291 - RNA, 22 nt, Human
gcugcucuggcucugcaguguc

SEQ ID NO: 385292 - RNA, 22 nt, Human
ucuuugaauucaaacuguucaa

SEQ ID NO: 385293 - RNA, 22 nt, Human
aaagcagaggugauaugacuua

SEQ ID NO: 385294 - RNA, 20 nt, Human
uccugcaguuccuaggaggg

SEQ ID NO: 385295 - RNA, 22 nt, Human
caggggcucuaaugcaugauca

SEQ ID NO: 385296 - RNA, 22 nt, Human
uggcucagaacuacuucuaguu

SEQ ID NO: 385297 - RNA, 22 nt, Human
gcccagccuccaagcuccaagg

SEQ ID NO: 385298 - RNA, 22 nt, Human
gauucugagcugguguuuuacg

SEQ ID NO: 385299 - RNA, 22 nt, Human
aagucacacuagacaacugagg

SEQ ID NO: 385300 - RNA, 22 nt, Human
uagcaggguccaaugugaggca

SEQ ID NO: 385301 - RNA, 22 nt, Human
auuucucaucaagugccaacuc

SEQ ID NO: 385302 - RNA, 22 nt, Human
agcagagccaggucucucugua

SEQ ID NO: 385303 - RNA, 22 nt, Human
augccaaagcccaaguucauca

SEQ ID NO: 385304 - RNA, 22 nt, Human
gcagagcccuggggguauggug

SEQ ID NO: 385305 - RNA, 22 nt, Human
guguggcugauugacaugguca

SEQ ID NO: 385306 - RNA, 22 nt, Human
uugcauuguugcaaugaaguau

SEQ ID NO: 385307 - RNA, 22 nt, Human
uggcucaggaucuaagcagaau

SEQ ID NO: 385308 - RNA, 22 nt, Human
cagacagcugcuuucuugcugu

SEQ ID NO: 385309 - RNA, 22 nt, Human
ccugggagugucagacuugcuu

SEQ ID NO: 385310 - RNA, 22 nt, Human
ugugaaaggggucacagggaaa

SEQ ID NO: 385311 - RNA, 22 nt, Human
agaggcuccaccuucucugucc

SEQ ID NO: 385312 - RNA, 22 nt, Human
gcucucugguuccagucaggaa

SEQ ID NO: 385313 - RNA, 22 nt, Human
gcugccuguguggccacucacu

SEQ ID NO: 385314 - RNA, 22 nt, Human
gccucaggacuggcauacucau

SEQ ID NO: 385315 - RNA, 20 nt, Human
aggcacuggggauagguaag

SEQ ID NO: 385316 - RNA, 22 nt, Human
ucagaauucagagggagugggg

SEQ ID NO: 385317 - RNA, 22 nt, Human
acacaguaccccaaggcugggc

SEQ ID NO: 385318 - RNA, 22 nt, Human
ucccuggcagcuaagggugguc

SEQ ID NO: 385319 - RNA, 21 nt, Human
gcugcugccccuagugaggcc

SEQ ID NO: 385320 - RNA, 22 nt, Human
ggcagcugagcauggcuaccuu

SEQ ID NO: 385321 - RNA, 18 nt, Human
cagaaguccuucaaggcc

SEQ ID NO: 385322 - RNA, 22 nt, Human
ccugccuguaagauggguacaa

SEQ ID NO: 385323 - RNA, 22 nt, Human
ucauaaagcauuucagcuuuug

SEQ ID NO: 385324 - RNA, 22 nt, Human
uugaagcaaggcgaaucuugug

SEQ ID NO: 385325 - RNA, 22 nt, Human
augcugcacaagccacauguag

SEQ ID NO: 385326 - RNA, 23 nt, Human
acaugggagggacauggaggcug

SEQ ID NO: 385327 - RNA, 22 nt, Human
ucagaagcauguggggagccug

SEQ ID NO: 385328 - RNA, 19 nt, Human
cuugcugggugguuucugc

SEQ ID NO: 385329 - RNA, 22 nt, Human
gaagcccauuuguacagcacau

SEQ ID NO: 385330 - RNA, 22 nt, Human
uucagcagugcagacacccagu

SEQ ID NO: 385331 - RNA, 22 nt, Human
ucaguguauggagugcuggauu

SEQ ID NO: 385332 - RNA, 22 nt, Human
ucagccagcaucagcuaagugc

SEQ ID NO: 385333 - RNA, 20 nt, Human
cucucuggaaggugggagcc

SEQ ID NO: 385334 - RNA, 22 nt, Human
gaggcccaguccugcaagcacg

SEQ ID NO: 385335 - RNA, 22 nt, Human
ucuguucaucaucuggacacau

SEQ ID NO: 385336 - RNA, 23 nt, Human
ccucccaccuauuucacuuucuu

SEQ ID NO: 385337 - RNA, 22 nt, Human
ccagggucucugcugccugaga

SEQ ID NO: 385338 - RNA, 23 nt, Human
cuucucagaagucugugccagga

SEQ ID NO: 385339 - RNA, 22 nt, Human
uuucaguuuaugucuugaauua

SEQ ID NO: 385340 - RNA, 22 nt, Human
caggaaauaucuccuggcagag

SEQ ID NO: 385341 - RNA, 22 nt, Human
cuuauguaaacuacagauaaua

SEQ ID NO: 385342 - RNA, 22 nt, Human
ugaaaggugacauuucuuggau

SEQ ID NO: 385343 - RNA, 22 nt, Human
ugucaccaugccagcuucugcc

SEQ ID NO: 385344 - RNA, 22 nt, Human
agaggccagggacacugcucaa

SEQ ID NO: 385345 - RNA, 22 nt, Human
gauuucuugauaaguaguguga

SEQ ID NO: 385346 - RNA, 22 nt, Human
gcucugagaggugcagcaguaa

SEQ ID NO: 385347 - RNA, 22 nt, Human
aguucacagaauggccagaacu

SEQ ID NO: 385348 - RNA, 22 nt, Human
uggaggagaauuuauggucgaa

SEQ ID NO: 385349 - RNA, 22 nt, Human
cccaggaggcagagguugcagu

SEQ ID NO: 385350 - RNA, 17 nt, Human
caauuucauagguuuug

SEQ ID NO: 385351 - RNA, 22 nt, Human
ugucacuucaggaaugcaggga

SEQ ID NO: 385352 - RNA, 18 nt, Human
uccagagguguuggagcc

SEQ ID NO: 385353 - RNA, 22 nt, Human
ugggcaggcaagugaauaccuu

SEQ ID NO: 385354 - RNA, 22 nt, Human
ucaguuucuccaucgcuccagu

SEQ ID NO: 385355 - RNA, 22 nt, Human
gaggcugcugagagcccuguuu

SEQ ID NO: 385356 - RNA, 19 nt, Human
agacagagacugaaauaga

SEQ ID NO: 385357 - RNA, 22 nt, Human
uuagauauguuuuugcuaaugc

SEQ ID NO: 385358 - RNA, 21 nt, Human
acaguucaugauaacuccauc

SEQ ID NO: 385359 - RNA, 22 nt, Human
augcuguagaucuuagccucua

SEQ ID NO: 385360 - RNA, 22 nt, Human
gcagcugccuucagcuggaugg

SEQ ID NO: 385361 - RNA, 22 nt, Human
cuagcaucagaugagaagcugu

SEQ ID NO: 385362 - RNA, 22 nt, Human
acagguggccccgagggagugg

SEQ ID NO: 385363 - RNA, 22 nt, Human
acuuccuggcugggugaccugg

SEQ ID NO: 385364 - RNA, 20 nt, Human
aggcagcuggccaggcaggu

SEQ ID NO: 385365 - RNA, 19 nt, Human
uguuggugcggauguggag

SEQ ID NO: 385366 - RNA, 22 nt, Human
cccaggaggguggccucugccc

SEQ ID NO: 385367 - RNA, 20 nt, Human
ucugucucugagcuagacuu

SEQ ID NO: 385368 - RNA, 22 nt, Human
ucacagcuaagcuuggucacug

SEQ ID NO: 385369 - RNA, 22 nt, Human
gaaguccugguccucucauuca

SEQ ID NO: 385370 - RNA, 22 nt, Human
ucuucacaccgggcagcaggaa

SEQ ID NO: 385371 - RNA, 22 nt, Human
uguguacaggccuugcuagacu

SEQ ID NO: 385372 - RNA, 22 nt, Human
cuggacagaaagggcugcugug

SEQ ID NO: 385373 - RNA, 22 nt, Human
agggucugacaaugugacuuag

SEQ ID NO: 385374 - RNA, 21 nt, Human
aggugcagagccagggaccag

SEQ ID NO: 385375 - RNA, 22 nt, Human
auacagaaaaguggauagccag

SEQ ID NO: 385376 - RNA, 22 nt, Human
aucagaaauagucauguuacuu

SEQ ID NO: 385377 - RNA, 22 nt, Human
uaauuauaacaguuacaucuua

SEQ ID NO: 385378 - RNA, 22 nt, Human
aagucacccacaggcagcagaa

SEQ ID NO: 385379 - RNA, 22 nt, Human
ccaaaguccauaguuuacuuua

SEQ ID NO: 385380 - RNA, 22 nt, Human
gcaaaaaaugcuuguugcuuag

SEQ ID NO: 385381 - RNA, 22 nt, Human
ccuuccuggcuguccgccugau

SEQ ID NO: 385382 - RNA, 22 nt, Human
guuuuuccuugcugaggacccg

SEQ ID NO: 385383 - RNA, 22 nt, Human
ucccagaagugaaauuucuaga

SEQ ID NO: 385384 - RNA, 22 nt, Human
cacagggccuggggcagcugcu

SEQ ID NO: 385385 - RNA, 22 nt, Human
agucccagccuguaggauuggg

SEQ ID NO: 385386 - RNA, 22 nt, Human
uguccugggaaugggaugcagu

SEQ ID NO: 385387 - RNA, 23 nt, Human
accaggagaaaagcuuugcggga

SEQ ID NO: 385388 - RNA, 20 nt, Human
gcucccugguagaaauguuu

SEQ ID NO: 385389 - RNA, 22 nt, Human
gaaggccaguuuugagauaggu

SEQ ID NO: 385390 - RNA, 23 nt, Human
aaaugacauaugguuucugaagg

SEQ ID NO: 385391 - RNA, 22 nt, Human
ucugguuagccaauaaugccaa

SEQ ID NO: 385392 - RNA, 22 nt, Human
ucaguguagcagacuuguagcc

SEQ ID NO: 385393 - RNA, 18 nt, Human
cuguccaguagacucugc

SEQ ID NO: 385394 - RNA, 22 nt, Human
guggccugucagaagccguggg

SEQ ID NO: 385395 - RNA, 22 nt, Human
ccucucuguaagggucccuccc

SEQ ID NO: 385396 - RNA, 22 nt, Human
gcaagcaagcagguagagcuga

SEQ ID NO: 385397 - RNA, 22 nt, Human
ggagaugcuauguaguuugguu

SEQ ID NO: 385398 - RNA, 19 nt, Human
ggagaagcccaggaauccu

SEQ ID NO: 385399 - RNA, 22 nt, Human
ugcacaaacuugugucccaggg

SEQ ID NO: 385400 - RNA, 22 nt, Human
aguggcagcugucaugcccuag

SEQ ID NO: 385401 - RNA, 22 nt, Human
cugaggucuagacaccccaggg

SEQ ID NO: 385402 - RNA, 22 nt, Human
ugaaagcacucacuucugcucu

SEQ ID NO: 385403 - RNA, 23 nt, Human
cugcuguguuggucucgauggga

SEQ ID NO: 385404 - RNA, 22 nt, Human
aggcacugacagauucuguguc

SEQ ID NO: 385405 - RNA, 22 nt, Human
gcacccaggccggcgacugcag

SEQ ID NO: 385406 - RNA, 22 nt, Human
auugacaagugagcugggcugc

SEQ ID NO: 385407 - RNA, 22 nt, Human
agaauuagguaaguucaucuga

SEQ ID NO: 385408 - RNA, 22 nt, Human
cugccagucuaugcugcucggc

SEQ ID NO: 385409 - RNA, 22 nt, Human
ggccaugguuggggaagacaug

SEQ ID NO: 385410 - RNA, 22 nt, Human
uauuuccagcaguaagaagaca

SEQ ID NO: 385411 - RNA, 22 nt, Human
ugucaugcuuauguuacauacu

SEQ ID NO: 385412 - RNA, 22 nt, Human
cuguauuuucaugccuacguac

SEQ ID NO: 385413 - RNA, 22 nt, Human
guggugaagccccaucucugcu

SEQ ID NO: 385414 - RNA, 22 nt, Human
acagaggaagcauauagcacaa

SEQ ID NO: 385415 - RNA, 22 nt, Human
auacagaauuugcccuuuucau

SEQ ID NO: 385416 - RNA, 22 nt, Human
uccugggcuguggccccgggca

SEQ ID NO: 385417 - RNA, 22 nt, Human
ucagagaugcagugccaccuac

SEQ ID NO: 385418 - RNA, 22 nt, Human
gcugugcacuaccuauacaucc

SEQ ID NO: 385419 - RNA, 22 nt, Human
cacaggaggaggccagagcgua

SEQ ID NO: 385420 - RNA, 22 nt, Human
cuagaaauucugauucaguagg

SEQ ID NO: 385421 - RNA, 22 nt, Human
guacaguuuucaguguucacug

SEQ ID NO: 385422 - RNA, 22 nt, Human
ucugggagcacacgcagugauc

SEQ ID NO: 385423 - RNA, 22 nt, Human
gccaccagggggugcaaggucc

SEQ ID NO: 385424 - RNA, 22 nt, Human
ccuggagccccucuggccagcc

SEQ ID NO: 385425 - RNA, 22 nt, Human
gaauacaagccugccaccugga

SEQ ID NO: 385426 - RNA, 17 nt, Human
aaggccauuuccaccca

SEQ ID NO: 385427 - RNA, 22 nt, Human
ucagccaguuugauucuauuug

SEQ ID NO: 385428 - RNA, 22 nt, Human
ugaauaaucuuggguauuaaua

SEQ ID NO: 385429 - RNA, 22 nt, Human
acuguacacgugucauuuacag

SEQ ID NO: 385430 - RNA, 22 nt, Human
uacaaagucagaauaacaggug

SEQ ID NO: 385431 - RNA, 22 nt, Human
gccacaugcaauugcagcacgu

SEQ ID NO: 385432 - RNA, 22 nt, Human
auuuaugauuagccuauuguug

SEQ ID NO: 385433 - RNA, 22 nt, Human
ccugucugaaggcagggggaug

SEQ ID NO: 385434 - RNA, 22 nt, Human
auuugcuuucagguauaaaagg

SEQ ID NO: 385435 - RNA, 22 nt, Human
gaagcagcaaguauaggacagg

SEQ ID NO: 385436 - RNA, 22 nt, Human
gaacagcugcuagagaucugug

SEQ ID NO: 385437 - RNA, 22 nt, Human
gcugagcuagcuaucucagucu

SEQ ID NO: 385438 - RNA, 22 nt, Human
ggagaggggcaaguuuaucuag

SEQ ID NO: 385439 - RNA, 22 nt, Human
agguaggguuaauggagauaua

SEQ ID NO: 385440 - RNA, 22 nt, Human
gauuuccuaauguggaucucug

SEQ ID NO: 385441 - RNA, 21 nt, Human
ugcaggagucugugagucagg

SEQ ID NO: 385442 - RNA, 22 nt, Human
cagauuuagaguggggcuugga

SEQ ID NO: 385443 - RNA, 22 nt, Human
ucuucacaugaccuucaugucu

SEQ ID NO: 385444 - RNA, 22 nt, Human
gcaaggacucccugggucauuc

SEQ ID NO: 385445 - RNA, 19 nt, Human
acacugaauguagaauugg

SEQ ID NO: 385446 - RNA, 22 nt, Human
acuguggcucaucaggcuggug

SEQ ID NO: 385447 - RNA, 22 nt, Human
ucuauacaugugcacacacauc

SEQ ID NO: 385448 - RNA, 20 nt, Human
agaagucagcucagaaguga

SEQ ID NO: 385449 - RNA, 22 nt, Human
caggcaggugcagauuccucuu

SEQ ID NO: 385450 - RNA, 22 nt, Human
aucuaagauguauugagcacuu

SEQ ID NO: 385451 - RNA, 22 nt, Human
agagcucaagacgcucacagua

SEQ ID NO: 385452 - RNA, 22 nt, Human
aagggcucacccaacucacuuc

SEQ ID NO: 385453 - RNA, 22 nt, Human
uagaaaucuacuuagacuuucu

SEQ ID NO: 385454 - RNA, 22 nt, Human
ggagcaggagucucuugaauuu

SEQ ID NO: 385455 - RNA, 22 nt, Human
aggaaaaagaguugcugccuuc

SEQ ID NO: 385456 - RNA, 22 nt, Human
ucccagggcagcuguccagaag

SEQ ID NO: 385457 - RNA, 22 nt, Human
cugccagcagaggccagcgcug

SEQ ID NO: 385458 - RNA, 22 nt, Human
cugucaucacaguugagcagcc

SEQ ID NO: 385459 - RNA, 22 nt, Human
gaggcucaacccacagggguug

SEQ ID NO: 385460 - RNA, 22 nt, Human
guuucacagaugguguucauau

SEQ ID NO: 385461 - RNA, 22 nt, Human
caaauucaaauuucaucagugu

SEQ ID NO: 385462 - RNA, 22 nt, Human
ugggcugcugcggugcucuugg

SEQ ID NO: 385463 - RNA, 22 nt, Human
ugucaccaguuccaggaaauaa

SEQ ID NO: 385464 - RNA, 22 nt, Human
auaaaaucagaguuggauugga

SEQ ID NO: 385465 - RNA, 22 nt, Human
uggcucucaggccugcugcguu

SEQ ID NO: 385466 - RNA, 22 nt, Human
ucaaagucauggcaggcucaga

SEQ ID NO: 385467 - RNA, 22 nt, Human
aaaugcacaaaguaaguguaau

SEQ ID NO: 385468 - RNA, 22 nt, Human
aaaguccuugcaguuuccucuu

SEQ ID NO: 385469 - RNA, 22 nt, Human
auuguauaacagcauguauuuu

SEQ ID NO: 385470 - RNA, 23 nt, Human
aaauucaguccuucaacucugag

SEQ ID NO: 385471 - RNA, 23 nt, Human
auaauaacgucugucuugucucu

SEQ ID NO: 385472 - RNA, 22 nt, Human
aaggccagacaggaccacaucu

SEQ ID NO: 385473 - RNA, 22 nt, Human
ucagucuuugcuuaugacaaua

SEQ ID NO: 385474 - RNA, 20 nt, Human
aggaagcugagauguagagg

SEQ ID NO: 385475 - RNA, 22 nt, Human
cuuugaaagcucccaggacuua

SEQ ID NO: 385476 - RNA, 22 nt, Human
uggcagaggagaauuaagauua

SEQ ID NO: 385477 - RNA, 22 nt, Human
aaaccgcaauuacuuuugcguc

SEQ ID NO: 385478 - RNA, 18 nt, Human
gcagcuuuugauucaccc

SEQ ID NO: 385479 - RNA, 22 nt, Human
guuuuauaugucucugcugaca

SEQ ID NO: 385480 - RNA, 19 nt, Human
uccuuugaauaucaguuga

SEQ ID NO: 385481 - RNA, 22 nt, Human
gauaaaauaacuauggaauacu

SEQ ID NO: 385482 - RNA, 22 nt, Human
ucccagcgcggggggaggaucc

SEQ ID NO: 385483 - RNA, 22 nt, Human
acagacagggcaccugccuccu

SEQ ID NO: 385484 - RNA, 22 nt, Human
ugcaguggcgccaucucagcuc

SEQ ID NO: 385485 - RNA, 22 nt, Human
acugcaucugaaacauggguca

SEQ ID NO: 385486 - RNA, 20 nt, Human
gcagagccucacugcaaggg

SEQ ID NO: 385487 - RNA, 22 nt, Human
ugcccacauucaaaaggugaug

SEQ ID NO: 385488 - RNA, 22 nt, Human
ccuccacaggagcugcagugcu

SEQ ID NO: 385489 - RNA, 22 nt, Human
cacugcaguuccccagugcgca

SEQ ID NO: 385490 - RNA, 22 nt, Human
uuucaucuucccagagaccuug

SEQ ID NO: 385491 - RNA, 22 nt, Human
gcagaggacacaggagggcaag

SEQ ID NO: 385492 - RNA, 22 nt, Human
acaaaugcagcauaaagugaac

SEQ ID NO: 385493 - RNA, 22 nt, Human
auuaggcaauucugggcaucuc

SEQ ID NO: 385494 - RNA, 21 nt, Human
aggaggaacccguggcugggc

SEQ ID NO: 385495 - RNA, 22 nt, Human
cccagcccugaccuauuggaaa

SEQ ID NO: 385496 - RNA, 22 nt, Human
gacagcauggugucuguucagg

SEQ ID NO: 385497 - RNA, 22 nt, Human
gcccucagaguuccccacagug

SEQ ID NO: 385498 - RNA, 19 nt, Human
ggcauccacgaaugcagag

SEQ ID NO: 385499 - RNA, 22 nt, Human
acagagagcugugauugaguua

SEQ ID NO: 385500 - RNA, 22 nt, Human
uuuuccucuguauuugaaaugc

SEQ ID NO: 385501 - RNA, 16 nt, Human
agcagccagcacugga

SEQ ID NO: 385502 - RNA, 22 nt, Human
uccaauauggauaaaaggggcc

SEQ ID NO: 385503 - RNA, 22 nt, Human
uuuauacuccacucugcaagcg

SEQ ID NO: 385504 - RNA, 22 nt, Human
ugaugggacugccagcugcuga

SEQ ID NO: 385505 - RNA, 20 nt, Human
ugcugcaguuucaugggacu

SEQ ID NO: 385506 - RNA, 22 nt, Human
gugggaugguagguagguaaua

SEQ ID NO: 385507 - RNA, 22 nt, Human
ugggcucugcugcguaccaguu

SEQ ID NO: 385508 - RNA, 22 nt, Human
cagucacuggaauagcugagga

SEQ ID NO: 385509 - RNA, 22 nt, Human
aaggaccuauauugucagagga

SEQ ID NO: 385510 - RNA, 22 nt, Human
acuguagcugccacuggaugca

SEQ ID NO: 385511 - RNA, 23 nt, Human
uaucagugugaugaggcugcugc

SEQ ID NO: 385512 - RNA, 22 nt, Human
uggguagagacacagucugggg

SEQ ID NO: 385513 - RNA, 22 nt, Human
ccaggcccugcuccucacacca

SEQ ID NO: 385514 - RNA, 23 nt, Human
uuuauauuccuaaugucuugagc

SEQ ID NO: 385515 - RNA, 22 nt, Human
ccuggagauuucuucaagcuuu

SEQ ID NO: 385516 - RNA, 22 nt, Human
agggcagacuaggauggaagug

SEQ ID NO: 385517 - RNA, 22 nt, Human
gggcaggugcccagggccagag

SEQ ID NO: 385518 - RNA, 22 nt, Human
ggacagagcccugguggccuaa

SEQ ID NO: 385519 - RNA, 22 nt, Human
uucauacuaaaguguaagaugu

SEQ ID NO: 385520 - RNA, 19 nt, Human
uuuacucuccaaggugagu

SEQ ID NO: 385521 - RNA, 22 nt, Human
cacacuuugugcuaaucuauuu

SEQ ID NO: 385522 - RNA, 22 nt, Human
ccucagaguaggucucagcugu

SEQ ID NO: 385523 - RNA, 22 nt, Human
aaaaucugcuuccuuuuacaga

SEQ ID NO: 385524 - RNA, 22 nt, Human
guuuaaucagaggaauuauaga

SEQ ID NO: 385525 - RNA, 22 nt, Human
gaaagagaaccugggccuagau

SEQ ID NO: 385526 - RNA, 22 nt, Human
gaggacagagccgccuggcaag

SEQ ID NO: 385527 - RNA, 22 nt, Human
ucuuuacacaagacaagaauaa

SEQ ID NO: 385528 - RNA, 20 nt, Human
cccagguaggugccaugagu

SEQ ID NO: 385529 - RNA, 22 nt, Human
gugcugugucuaucaggaauaa

SEQ ID NO: 385530 - RNA, 22 nt, Human
ucacauuuauuucaaaguuacu

SEQ ID NO: 385531 - RNA, 22 nt, Human
uaaguucagaguucucauuugu

SEQ ID NO: 385532 - RNA, 20 nt, Human
cagcucugggaaagaggcca

SEQ ID NO: 385533 - RNA, 22 nt, Human
ugggaccuguuacauugaguua

SEQ ID NO: 385534 - RNA, 22 nt, Human
agggucugacugaauggaaaag

SEQ ID NO: 385535 - RNA, 22 nt, Human
cuggcagcugcccgagaugccc

SEQ ID NO: 385536 - RNA, 22 nt, Human
guuuucauuacugcugugauuu

SEQ ID NO: 385537 - RNA, 22 nt, Human
aggaaaacacaguauugaugga

SEQ ID NO: 385538 - RNA, 22 nt, Human
cugggaggugcagcaaaaauca

SEQ ID NO: 385539 - RNA, 22 nt, Human
agaauaaaucaaauguccugag

SEQ ID NO: 385540 - RNA, 22 nt, Human
aggcagcugugaggacuggauu

SEQ ID NO: 385541 - RNA, 22 nt, Human
ucuguucagcugccucagggua

SEQ ID NO: 385542 - RNA, 22 nt, Human
guaaacauuuucaucugugccc

SEQ ID NO: 385543 - RNA, 22 nt, Human
cugcugugcaggugccuaugau

SEQ ID NO: 385544 - RNA, 22 nt, Human
ccaggguguagggauuccagau

SEQ ID NO: 385545 - RNA, 22 nt, Human
ccaggccugcaucugcugcgca

SEQ ID NO: 385546 - RNA, 19 nt, Human
cagcucaguuugauucucu

SEQ ID NO: 385547 - RNA, 22 nt, Human
gucugaggaagaugcaggggga

SEQ ID NO: 385548 - RNA, 22 nt, Human
gcagcaggcacggucucgacau

SEQ ID NO: 385549 - RNA, 22 nt, Human
cugggaggcacuauucaggagg

SEQ ID NO: 385550 - RNA, 22 nt, Human
gagugggcaccgugggcacacu

SEQ ID NO: 385551 - RNA, 22 nt, Human
gggcagcagagcccugccgagu

SEQ ID NO: 385552 - RNA, 22 nt, Human
uugcugugaaaccaugggaagu

SEQ ID NO: 385553 - RNA, 22 nt, Human
ucauacaucuguccuggagcuc

SEQ ID NO: 385554 - RNA, 22 nt, Human
aaguuauugcagcaauccaagu

SEQ ID NO: 385555 - RNA, 22 nt, Human
aggguauguuuuuaucuacugu

SEQ ID NO: 385556 - RNA, 22 nt, Human
cucagaagccuucagucuuggc

SEQ ID NO: 385557 - RNA, 22 nt, Human
uucacuuaacaucauaucauga

SEQ ID NO: 385558 - RNA, 22 nt, Human
agucuuaacuaugcaaguacua

SEQ ID NO: 385559 - RNA, 22 nt, Human
cagccuccugggacacucaccg

SEQ ID NO: 385560 - RNA, 22 nt, Human
cugagccaaggggacagugaca

SEQ ID NO: 385561 - RNA, 22 nt, Human
aaggagugcaugacucagagua

SEQ ID NO: 385562 - RNA, 22 nt, Human
uaacagaagaugaaacuucuuu

SEQ ID NO: 385563 - RNA, 22 nt, Human
cugagaauuacucugaugagua

SEQ ID NO: 385564 - RNA, 22 nt, Human
aaaugcuguguuuuaacauaga

SEQ ID NO: 385565 - RNA, 22 nt, Human
ugccagcuccgaggagcugcag

SEQ ID NO: 385566 - RNA, 22 nt, Human
agcuuuaucuucaccugggaau

SEQ ID NO: 385567 - RNA, 22 nt, Human
ggaggcacuucccgucucagcc

SEQ ID NO: 385568 - RNA, 22 nt, Human
gcuggccauggccugcgccauc

SEQ ID NO: 385569 - RNA, 22 nt, Human
aaagucauacauggugcuuacu

SEQ ID NO: 385570 - RNA, 22 nt, Human
ccuuucucuuugcugaucaugu

SEQ ID NO: 385571 - RNA, 22 nt, Human
ugacacagauuagagacauacc

SEQ ID NO: 385572 - RNA, 22 nt, Human
aaggcacuuuucuaaagaccuu

SEQ ID NO: 385573 - RNA, 22 nt, Human
cucccaggcacagggaggagcc

SEQ ID NO: 385574 - RNA, 22 nt, Human
ucuguucauguugggcuuuucc

SEQ ID NO: 385575 - RNA, 22 nt, Human
cuggcuucugggccagggcaga

SEQ ID NO: 385576 - RNA, 20 nt, Human
uccagggcuagggagcucau

SEQ ID NO: 385577 - RNA, 22 nt, Human
acagauuuuaaaugacacuccc

SEQ ID NO: 385578 - RNA, 22 nt, Human
ucuggcuccacuuucuucauuu

SEQ ID NO: 385579 - RNA, 22 nt, Human
cauugcacuccagcuugggcaa

SEQ ID NO: 385580 - RNA, 22 nt, Human
ccagcaggacuuuggaaauaug

SEQ ID NO: 385581 - RNA, 22 nt, Human
ugccuggguccaggccaagccu

SEQ ID NO: 385582 - RNA, 21 nt, Human
agccuggcccagggggaggcu

SEQ ID NO: 385583 - RNA, 22 nt, Human
uggaggcauaggccugggcccu

SEQ ID NO: 385584 - RNA, 22 nt, Human
ggccuugggaggagggucagaa

SEQ ID NO: 385585 - RNA, 22 nt, Human
ugggccagcaauugcugcucag

SEQ ID NO: 385586 - RNA, 22 nt, Human
gcacagagggcagugagccucu

SEQ ID NO: 385587 - RNA, 22 nt, Human
uuuaacacuaguuucuuuaacu

SEQ ID NO: 385588 - RNA, 22 nt, Human
ucaauacauacaauguauagug

SEQ ID NO: 385589 - RNA, 22 nt, Human
cagggcucuucaucacacagua

SEQ ID NO: 385590 - RNA, 23 nt, Human
ggagccuggcauaugagacgcau

SEQ ID NO: 385591 - RNA, 22 nt, Human
aguuacuugagacguuuaugaa

SEQ ID NO: 385592 - RNA, 22 nt, Human
aguauguagugcaaucagucag

SEQ ID NO: 385593 - RNA, 22 nt, Human
ucuuuaauguacuuucuuucac

SEQ ID NO: 385594 - RNA, 22 nt, Human
ggcagcagggucuagauugaug

SEQ ID NO: 385595 - RNA, 22 nt, Human
uuucuacagcuggugcaacuuu

SEQ ID NO: 385596 - RNA, 22 nt, Human
gaguccuuccagcaggcauuua

SEQ ID NO: 385597 - RNA, 22 nt, Human
auagaauucguguuuguaauuc

SEQ ID NO: 385598 - RNA, 22 nt, Human
agagaagagcaaugauaaauuu

SEQ ID NO: 385599 - RNA, 22 nt, Human
gagcaggccagcaauggaaggg

SEQ ID NO: 385600 - RNA, 19 nt, Human
gccugccuggguuucugag

SEQ ID NO: 385601 - RNA, 18 nt, Human
uccugccugcgggcuccc

SEQ ID NO: 385602 - RNA, 22 nt, Human
gagguacaugaggauacacagg

SEQ ID NO: 385603 - RNA, 22 nt, Human
uuccuguaguugugcaauguac

SEQ ID NO: 385604 - RNA, 17 nt, Human
agccaggcauaugaagu

SEQ ID NO: 385605 - RNA, 22 nt, Human
gcagagcagcaaauggaaagga

SEQ ID NO: 385606 - RNA, 22 nt, Human
auugaaaaaugacuauugcuua

SEQ ID NO: 385607 - RNA, 22 nt, Human
cacaguggcagguguggguugu

SEQ ID NO: 385608 - RNA, 22 nt, Human
aggcugagauagguggaucauu

SEQ ID NO: 385609 - RNA, 22 nt, Human
uucacauuaucaggauuguuuc

SEQ ID NO: 385610 - RNA, 22 nt, Human
uugcuuuguuacugcaguuucc

SEQ ID NO: 385611 - RNA, 22 nt, Human
gcucagagcuugaaguuccacu

SEQ ID NO: 385612 - RNA, 22 nt, Human
auucagcaguuccugcuucagu

SEQ ID NO: 385613 - RNA, 22 nt, Human
ugaucugagagcagaucaccau

SEQ ID NO: 385614 - RNA, 22 nt, Human
aggauccuccuuagaaaagacc

SEQ ID NO: 385615 - RNA, 22 nt, Human
aggcugcuuccuuacguggcug

SEQ ID NO: 385616 - RNA, 22 nt, Human
gugcgccagcucaaggggaggc

SEQ ID NO: 385617 - RNA, 22 nt, Human
ucaggagaguguucaguggagg

SEQ ID NO: 385618 - RNA, 22 nt, Human
uacaguauguucuugaauuugg

SEQ ID NO: 385619 - RNA, 22 nt, Human
caugcuuuaccaaagcagugau

SEQ ID NO: 385620 - RNA, 22 nt, Human
uucccaguuagucauuuuuaca

SEQ ID NO: 385621 - RNA, 22 nt, Human
caggcauggugagaacucagcc

SEQ ID NO: 385622 - RNA, 22 nt, Human
ucugccugagggagcugaggaa

SEQ ID NO: 385623 - RNA, 22 nt, Human
ucugagagucucugaggcagau

SEQ ID NO: 385624 - RNA, 22 nt, Human
ggcucaggccuguaauccuagc

SEQ ID NO: 385625 - RNA, 22 nt, Human
uuuagaaauugcagagugggug

SEQ ID NO: 385626 - RNA, 22 nt, Human
ccucuggcuguaccacuggcac

SEQ ID NO: 385627 - RNA, 22 nt, Human
ugaaugauuugggugcauucag

SEQ ID NO: 385628 - RNA, 21 nt, Human
augacagaugcugcagaucgu

SEQ ID NO: 385629 - RNA, 22 nt, Human
cccugagcccauaguugacauu

SEQ ID NO: 385630 - RNA, 22 nt, Human
augcacaagaggcuagaaaaga

SEQ ID NO: 385631 - RNA, 22 nt, Human
cauuuguauguuccuccuuagg

SEQ ID NO: 385632 - RNA, 19 nt, Human
cuggcagccugucuguguc

SEQ ID NO: 385633 - RNA, 22 nt, Human
accaggcagcugggggugaugu

SEQ ID NO: 385634 - RNA, 22 nt, Human
uuugcagugucagcuucugugu

SEQ ID NO: 385635 - RNA, 22 nt, Human
ugaggugaccgcagaugggaag

SEQ ID NO: 385636 - RNA, 22 nt, Human
ggagcagggcagugaauucugg

SEQ ID NO: 385637 - RNA, 22 nt, Human
gcagcucccagcuugaaagguc

SEQ ID NO: 385638 - RNA, 22 nt, Human
aagauucagccaaauuguucau

SEQ ID NO: 385639 - RNA, 22 nt, Human
guggcagagggugagcuggacu

SEQ ID NO: 385640 - RNA, 22 nt, Human
uugcauuccaguccccacugug

SEQ ID NO: 385641 - RNA, 22 nt, Human
aaaagacaucuauuucaggcag

SEQ ID NO: 385642 - RNA, 22 nt, Human
uagccucucuccuccacaaccu

SEQ ID NO: 385643 - RNA, 22 nt, Human
acacaggggcucggcugggugc

SEQ ID NO: 385644 - RNA, 17 nt, Human
ggccuugggcugcucuu

SEQ ID NO: 385645 - RNA, 20 nt, Human
cugcagggugagugggcgau

SEQ ID NO: 385646 - RNA, 22 nt, Human
aggcacugaccugcuuccuuga

SEQ ID NO: 385647 - RNA, 22 nt, Human
cagggguguuuuuggccaggag

SEQ ID NO: 385648 - RNA, 22 nt, Human
uagggcuguuuaaaagugaggu

SEQ ID NO: 385649 - RNA, 22 nt, Human
ucugggaacugagcuccccuag

SEQ ID NO: 385650 - RNA, 22 nt, Human
ucugccuggguguggagcagag

SEQ ID NO: 385651 - RNA, 20 nt, Human
acaaaugcauucugugacau

SEQ ID NO: 385652 - RNA, 22 nt, Human
cccuucccuucugggagaucca

SEQ ID NO: 385653 - RNA, 19 nt, Human
ggucacagggguuacaagg

SEQ ID NO: 385654 - RNA, 20 nt, Human
agcugccccugggcacugcc

SEQ ID NO: 385655 - RNA, 22 nt, Human
uuccucagagggcgcuggggaa

SEQ ID NO: 385656 - RNA, 22 nt, Human
ccauggcuuucuuucauuguaa

SEQ ID NO: 385657 - RNA, 22 nt, Human
gccugggaacucugaucuccug

SEQ ID NO: 385658 - RNA, 22 nt, Human
agccagaguugaaugugagucu

SEQ ID NO: 385659 - RNA, 22 nt, Human
uccagggaugccagccauguug

SEQ ID NO: 385660 - RNA, 22 nt, Human
cgggcagcggcguggccauggu

SEQ ID NO: 385661 - RNA, 22 nt, Human
uaacagaauagcagaaacagaa

SEQ ID NO: 385662 - RNA, 22 nt, Human
augggaggcaggcucagaaccg

SEQ ID NO: 385663 - RNA, 22 nt, Human
uuccuuagauccuucaaucacg

SEQ ID NO: 385664 - RNA, 22 nt, Human
gcugugcagauguagggagugg

SEQ ID NO: 385665 - RNA, 22 nt, Human
gcccucagaggacagcugacuu

SEQ ID NO: 385666 - RNA, 23 nt, Human
acuuuauugaccccaggucaguu

SEQ ID NO: 385667 - RNA, 22 nt, Human
ggacuggacucucaggcucaca

SEQ ID NO: 385668 - RNA, 22 nt, Human
agaugaagauaucugcaggggc

SEQ ID NO: 385669 - RNA, 22 nt, Human
ggccccacgggggaguccuagu

SEQ ID NO: 385670 - RNA, 22 nt, Human
ugauuuccacgugcacccaggu

SEQ ID NO: 385671 - RNA, 22 nt, Human
gaguuguucaacgugugugaaa

SEQ ID NO: 385672 - RNA, 22 nt, Human
uggcucagagccuugagagcug

SEQ ID NO: 385673 - RNA, 22 nt, Human
aggauuuagcaugaaaugugaa

SEQ ID NO: 385674 - RNA, 22 nt, Human
ugcagagaagaggacaguucua

SEQ ID NO: 385675 - RNA, 22 nt, Human
accuggcaugaagcaugccuua

SEQ ID NO: 385676 - RNA, 22 nt, Human
cugccuugaggagguuguggga

SEQ ID NO: 385677 - RNA, 22 nt, Human
aacaaacaaacauuuugucauc

SEQ ID NO: 385678 - RNA, 22 nt, Human
uuugcauuuguuuagaaccuga

SEQ ID NO: 385679 - RNA, 22 nt, Human
gccacccugagcugggccaggg

SEQ ID NO: 385680 - RNA, 22 nt, Human
ucugccuggauuccauucucca

SEQ ID NO: 385681 - RNA, 22 nt, Human
auuguacuuuuauuacauguag

SEQ ID NO: 385682 - RNA, 21 nt, Human
agccagcuaucacacagcauu

SEQ ID NO: 385683 - RNA, 22 nt, Human
ugggcugcugucugcacaugcu

SEQ ID NO: 385684 - RNA, 22 nt, Human
cuagccaugggcauuaaaggua

SEQ ID NO: 385685 - RNA, 22 nt, Human
ggcacugacugugcagcgcacc

SEQ ID NO: 385686 - RNA, 22 nt, Human
aagaggagacuucagcaacuug

SEQ ID NO: 385687 - RNA, 22 nt, Human
ucuuuccauggccacacagucu

SEQ ID NO: 385688 - RNA, 22 nt, Human
ccaggccugugcaaggagggag

SEQ ID NO: 385689 - RNA, 22 nt, Human
ucugccugagcagagggaggcc

SEQ ID NO: 385690 - RNA, 22 nt, Human
gggccccuuguaucucuggcuc

SEQ ID NO: 385691 - RNA, 22 nt, Human
ugggcuggcugaacuucaaccu

SEQ ID NO: 385692 - RNA, 22 nt, Human
aggauuuauuauaugcccucau

SEQ ID NO: 385693 - RNA, 22 nt, Human
acccaggccugagagacaggag

SEQ ID NO: 385694 - RNA, 22 nt, Human
ucugucugcucauuuaccucag

SEQ ID NO: 385695 - RNA, 22 nt, Human
cacagaggacuguagcggggag

SEQ ID NO: 385696 - RNA, 22 nt, Human
ggcucagggaaugaggaagaau

SEQ ID NO: 385697 - RNA, 22 nt, Human
cagcuggcagcccuggcccugc

SEQ ID NO: 385698 - RNA, 22 nt, Human
cccaggcaucccauuaaggagc

SEQ ID NO: 385699 - RNA, 22 nt, Human
ugcugugggcaguacauaagcu

SEQ ID NO: 385700 - RNA, 19 nt, Human
gagcugagaguagcacugg

SEQ ID NO: 385701 - RNA, 22 nt, Human
cucugagaaagcugugagcuaa

SEQ ID NO: 385702 - RNA, 23 nt, Human
cagaaaacccagagcucaguccc

SEQ ID NO: 385703 - RNA, 22 nt, Human
uggcagcuauggucuaagggcc

SEQ ID NO: 385704 - RNA, 22 nt, Human
ggcacugaaccaggacacaagc

SEQ ID NO: 385705 - RNA, 22 nt, Human
agagagcauggcacagaggggu

SEQ ID NO: 385706 - RNA, 22 nt, Human
ggcauuuagauugaauuucugu

SEQ ID NO: 385707 - RNA, 22 nt, Human
cagcaucuaaucuucaugccgg

SEQ ID NO: 385708 - RNA, 18 nt, Human
cugaggcuuagagagguu

SEQ ID NO: 385709 - RNA, 22 nt, Human
gagagggcugccuggugugagg

SEQ ID NO: 385710 - RNA, 19 nt, Human
ggugaccaccuggucagug

SEQ ID NO: 385711 - RNA, 22 nt, Human
aauugagugcagccagcccagu

SEQ ID NO: 385712 - RNA, 22 nt, Human
ucaggugguccuaagugccauc

SEQ ID NO: 385713 - RNA, 22 nt, Human
ugcaggagcagagauggcugga

SEQ ID NO: 385714 - RNA, 22 nt, Human
ccugcugugaaacuggcauaug

SEQ ID NO: 385715 - RNA, 22 nt, Human
ccuggaucuaaggaagcuggga

SEQ ID NO: 385716 - RNA, 17 nt, Human
uguuuucauucauugcu

SEQ ID NO: 385717 - RNA, 22 nt, Human
gggcaggagagaacagucaugg

SEQ ID NO: 385718 - RNA, 22 nt, Human
aaaaaugaauucuucaguggca

SEQ ID NO: 385719 - RNA, 19 nt, Human
ugagagugaggaaggcuuc

SEQ ID NO: 385720 - RNA, 22 nt, Human
cuuuacauaaggauaaaccugg

SEQ ID NO: 385721 - RNA, 22 nt, Human
gucucuggguuaagcagugcau

SEQ ID NO: 385722 - RNA, 22 nt, Human
ugccugucuuuccucccucgua

SEQ ID NO: 385723 - RNA, 22 nt, Human
gccacaugucaugugcucagua

SEQ ID NO: 385724 - RNA, 22 nt, Human
agucccuguacuuuccacugcc

SEQ ID NO: 385725 - RNA, 22 nt, Human
gaggcaguggucugaugcaagg

SEQ ID NO: 385726 - RNA, 21 nt, Human
agaauucuuaaguauucuaau

SEQ ID NO: 385727 - RNA, 22 nt, Human
ucugggagggagccucagaauc

SEQ ID NO: 385728 - RNA, 22 nt, Human
aggcagugugggccaagcuucc

SEQ ID NO: 385729 - RNA, 22 nt, Human
ucacugucugaaagaaauggcc

SEQ ID NO: 385730 - RNA, 22 nt, Human
aagugauuucugccugcauguu

SEQ ID NO: 385731 - RNA, 22 nt, Human
agcagggcaguuaaaggguccu

SEQ ID NO: 385732 - RNA, 22 nt, Human
uacaggcacugaaaugcuuauu

SEQ ID NO: 385733 - RNA, 22 nt, Human
cagucuggaggucagcuggcuu

SEQ ID NO: 385734 - RNA, 22 nt, Human
aagaagguguggaaagaugcuc

SEQ ID NO: 385735 - RNA, 22 nt, Human
auuccaaagacagaagcagcug

SEQ ID NO: 385736 - RNA, 22 nt, Human
uuacucagucucccauacauug

SEQ ID NO: 385737 - RNA, 20 nt, Human
uacaauacacaugcauauga

SEQ ID NO: 385738 - RNA, 22 nt, Human
cugcugcucgaccagucccagg

SEQ ID NO: 385739 - RNA, 23 nt, Human
ugagaagccauuagagcaggugg

SEQ ID NO: 385740 - RNA, 22 nt, Human
uuacuuuggguccugcuuauaa

SEQ ID NO: 385741 - RNA, 22 nt, Human
ucuggcucucauacucgccagu

SEQ ID NO: 385742 - RNA, 20 nt, Human
uucuauacauaucacugaaa

SEQ ID NO: 385743 - RNA, 18 nt, Human
aacaguuuccagauucuc

SEQ ID NO: 385744 - RNA, 22 nt, Human
caggugcuguccugcacauguc

SEQ ID NO: 385745 - RNA, 22 nt, Human
auuccaaacagugcugcagacu

SEQ ID NO: 385746 - RNA, 22 nt, Human
uauguacaguccuuaacuuaaa

SEQ ID NO: 385747 - RNA, 22 nt, Human
ggugccagccuagugcaguggu

SEQ ID NO: 385748 - RNA, 18 nt, Human
agacccucuaagggcagu

SEQ ID NO: 385749 - RNA, 22 nt, Human
uaaugucagcauaguuuauuuu

SEQ ID NO: 385750 - RNA, 22 nt, Human
gcucuuccauuucucuugaacu

SEQ ID NO: 385751 - RNA, 22 nt, Human
guaucacuuuugagagugagaa

SEQ ID NO: 385752 - RNA, 22 nt, Human
agcagcagauccaaaaaaugug

SEQ ID NO: 385753 - RNA, 22 nt, Human
guggagccaggaucuccgcaca

SEQ ID NO: 385754 - RNA, 22 nt, Human
ggcucuggagacauguggagag

SEQ ID NO: 385755 - RNA, 22 nt, Human
gugauuucuaaucaucugaaug

SEQ ID NO: 385756 - RNA, 22 nt, Human
accaugccaguggcagccagac

SEQ ID NO: 385757 - RNA, 21 nt, Human
agcaggaggcagucacagcuc

SEQ ID NO: 385758 - RNA, 22 nt, Human
cugcuucuaagaaccugcagcu

SEQ ID NO: 385759 - RNA, 22 nt, Human
uuucuacauucaaaaacuacca

SEQ ID NO: 385760 - RNA, 22 nt, Human
cucaaggaaagucuggagaaga

SEQ ID NO: 385761 - RNA, 22 nt, Human
gugaauaaccuacuccaggccu

SEQ ID NO: 385762 - RNA, 22 nt, Human
uuuauccauaucauuaaaaucu

SEQ ID NO: 385763 - RNA, 22 nt, Human
aguuaucagguguuuucaugga

SEQ ID NO: 385764 - RNA, 20 nt, Human
ugaaggccauuuguuccaga

SEQ ID NO: 385765 - RNA, 22 nt, Human
agauuuccaucuuuuucaugug

SEQ ID NO: 385766 - RNA, 22 nt, Human
acuuuagaccaucuuccacagu

SEQ ID NO: 385767 - RNA, 18 nt, Human
ggcugugcguggaggcug

SEQ ID NO: 385768 - RNA, 22 nt, Human
caaaguuaucaacugcaacauu

SEQ ID NO: 385769 - RNA, 22 nt, Human
ccugcucugguuuagucagucu

SEQ ID NO: 385770 - RNA, 22 nt, Human
cugaugcuauaagccacagugg

SEQ ID NO: 385771 - RNA, 22 nt, Human
acuggcagccacaacuggcagg

SEQ ID NO: 385772 - RNA, 22 nt, Human
uuucaaaguugggaauuguaau

SEQ ID NO: 385773 - RNA, 22 nt, Human
agucuuuccugcuugacuguuc

SEQ ID NO: 385774 - RNA, 19 nt, Human
aggagaaguagcagaaauu

SEQ ID NO: 385775 - RNA, 22 nt, Human
aauggacaggagagcauaguca

SEQ ID NO: 385776 - RNA, 22 nt, Human
cugcuuuguggaaucacacugg

SEQ ID NO: 385777 - RNA, 22 nt, Human
uucuggagcuaaaguccacucu

SEQ ID NO: 385778 - RNA, 22 nt, Human
ugucccauggauaccaggcuau

SEQ ID NO: 385779 - RNA, 22 nt, Human
augaggcuaugaauggggagau

SEQ ID NO: 385780 - RNA, 22 nt, Human
gagagggauacugaguuuuggu

SEQ ID NO: 385781 - RNA, 22 nt, Human
gcagcuuuagaaacaagggcug

SEQ ID NO: 385782 - RNA, 22 nt, Human
ggucucagaucuuuauuaaggc

SEQ ID NO: 385783 - RNA, 22 nt, Human
guauuaggugguggaauuguag

SEQ ID NO: 385784 - RNA, 22 nt, Human
guucuucaggccauccucccag

SEQ ID NO: 385785 - RNA, 22 nt, Human
caggagagcccggguccgggcu

SEQ ID NO: 385786 - RNA, 22 nt, Human
gcaggggaguccacucuaugca

SEQ ID NO: 385787 - RNA, 22 nt, Human
aggagcagaccguaguccugca

SEQ ID NO: 385788 - RNA, 22 nt, Human
agauggggcagaauggagccau

SEQ ID NO: 385789 - RNA, 22 nt, Human
ucauucuuuaccaaguugucac

SEQ ID NO: 385790 - RNA, 22 nt, Human
ugaaaucugucccacuuuagcu

SEQ ID NO: 385791 - RNA, 22 nt, Human
cggggcuguagcacagcugagc

SEQ ID NO: 385792 - RNA, 22 nt, Human
guuauaaaugacugcaaaaguu

SEQ ID NO: 385793 - RNA, 22 nt, Human
ucagaacagaagaaggaacacg

SEQ ID NO: 385794 - RNA, 22 nt, Human
agcuucuggaaggcaaggcuug

SEQ ID NO: 385795 - RNA, 22 nt, Human
gccagagguucaacaacugucu

SEQ ID NO: 385796 - RNA, 18 nt, Human
gcucugcccaggcugccc

SEQ ID NO: 385797 - RNA, 22 nt, Human
cagcugcuguuacugcuuauua

SEQ ID NO: 385798 - RNA, 22 nt, Human
cagggacugagauccagacugu

SEQ ID NO: 385799 - RNA, 22 nt, Human
agagccagguguagucucggag

SEQ ID NO: 385800 - RNA, 22 nt, Human
gggcuugcugauuugggcagga

SEQ ID NO: 385801 - RNA, 22 nt, Human
ccagguggaggugugagguccu

SEQ ID NO: 385802 - RNA, 19 nt, Human
agggagaauuccaagagga

SEQ ID NO: 385803 - RNA, 22 nt, Human
caguauuuguucccuaucaaug

SEQ ID NO: 385804 - RNA, 22 nt, Human
acuuccugggcaugcagagucc

SEQ ID NO: 385805 - RNA, 22 nt, Human
gaggggagacagggaaaucagu

SEQ ID NO: 385806 - RNA, 22 nt, Human
acaggcagguugagaaacauuu

SEQ ID NO: 385807 - RNA, 22 nt, Human
cuauaauuaugcucaaaaugua

SEQ ID NO: 385808 - RNA, 19 nt, Human
aggcagcauucuggggcuu

SEQ ID NO: 385809 - RNA, 22 nt, Human
ccugggagcuguggaaaggcug

SEQ ID NO: 385810 - RNA, 20 nt, Human
caucagugccugacaggucc

SEQ ID NO: 385811 - RNA, 22 nt, Human
ggagaaggugcuggucacugug

SEQ ID NO: 385812 - RNA, 22 nt, Human
uuucauaaccucaagcuacagu

SEQ ID NO: 385813 - RNA, 22 nt, Human
agugaaauuuguuuagauaggu

SEQ ID NO: 385814 - RNA, 22 nt, Human
gcuguauuuauuuucuaggguu

SEQ ID NO: 385815 - RNA, 22 nt, Human
aacagaacccgagugugaaucu

SEQ ID NO: 385816 - RNA, 22 nt, Human
cauccagggcagccauggccug

SEQ ID NO: 385817 - RNA, 22 nt, Human
caguccuuauuccuauauuccu

SEQ ID NO: 385818 - RNA, 22 nt, Human
cucugagagcggucuguggcuu

SEQ ID NO: 385819 - RNA, 22 nt, Human
ugaagcaggaaacuucuuguuu

SEQ ID NO: 385820 - RNA, 22 nt, Human
uucucagagugaccaagucuuu

SEQ ID NO: 385821 - RNA, 22 nt, Human
uuuucaagggcagggaaaucau

SEQ ID NO: 385822 - RNA, 22 nt, Human
agcuggcagagcauuuguggcc

SEQ ID NO: 385823 - RNA, 22 nt, Human
aucuggcuuuuacugaauugcu

SEQ ID NO: 385824 - RNA, 22 nt, Human
uauuuguugaguuguuaugucu

SEQ ID NO: 385825 - RNA, 22 nt, Human
cucuggagcaccgggcuaucca

SEQ ID NO: 385826 - RNA, 22 nt, Human
cagagcugcagauugaaggcau

SEQ ID NO: 385827 - RNA, 22 nt, Human
accaaggagacaaagguguauu

SEQ ID NO: 385828 - RNA, 22 nt, Human
gcagcuguggguuccaagucua

SEQ ID NO: 385829 - RNA, 20 nt, Human
ucucaggccccaguuuucuu

SEQ ID NO: 385830 - RNA, 22 nt, Human
cacugcccagcgucuuaggcac

SEQ ID NO: 385831 - RNA, 21 nt, Human
aaaguucaugcuuuaauauuc

SEQ ID NO: 385832 - RNA, 22 nt, Human
uuagggacaaauuugcagaacc

SEQ ID NO: 385833 - RNA, 22 nt, Human
acaugaaacuguugcauuagaa

SEQ ID NO: 385834 - RNA, 22 nt, Human
aauauuaucaaaagcuuuuuca

SEQ ID NO: 385835 - RNA, 22 nt, Human
uacauaaugagcuaguuaaguu

SEQ ID NO: 385836 - RNA, 20 nt, Human
gcugucuggauuagaagccu

SEQ ID NO: 385837 - RNA, 23 nt, Human
ugcugguguuuuugggaccaggg

SEQ ID NO: 385838 - RNA, 22 nt, Human
cugucucugucuuaacucccag

SEQ ID NO: 385839 - RNA, 22 nt, Human
acauugcugcauucuccuuccc

SEQ ID NO: 385840 - RNA, 22 nt, Human
auacuguaauaccuaaaugaac

SEQ ID NO: 385841 - RNA, 22 nt, Human
auaaggcagucacuggaauguu

SEQ ID NO: 385842 - RNA, 20 nt, Human
agcuggccuguccuaggccu

SEQ ID NO: 385843 - RNA, 22 nt, Human
agccugagccccauccagcuga

SEQ ID NO: 385844 - RNA, 21 nt, Human
uccauuguuuucccaggguuu

SEQ ID NO: 385845 - RNA, 22 nt, Human
uuccucuccucccaccagguga

SEQ ID NO: 385846 - RNA, 22 nt, Human
auucuucauaccuacugagguu

SEQ ID NO: 385847 - RNA, 22 nt, Human
ucagccugcuccaagugcugcc

SEQ ID NO: 385848 - RNA, 22 nt, Human
caccagcuuugcccacugccca

SEQ ID NO: 385849 - RNA, 22 nt, Human
gcagggacaucuuugucuagua

SEQ ID NO: 385850 - RNA, 22 nt, Human
agccaggccuuagggagaggca

SEQ ID NO: 385851 - RNA, 22 nt, Human
ccagcuggaagagugcagaacu

SEQ ID NO: 385852 - RNA, 21 nt, Human
aguugcauaggccagccaucc

SEQ ID NO: 385853 - RNA, 22 nt, Human
agaggccggccgagcccauggg

SEQ ID NO: 385854 - RNA, 18 nt, Human
ccgggcuuuggugacaca

SEQ ID NO: 385855 - RNA, 19 nt, Human
gagcacagcggcauuuggu

SEQ ID NO: 385856 - RNA, 22 nt, Human
agcagaaccacagcacuguuga

SEQ ID NO: 385857 - RNA, 22 nt, Human
caggcuugcugcuagagcacuu

SEQ ID NO: 385858 - RNA, 22 nt, Human
ucuggcuccaccuccuuuacua

SEQ ID NO: 385859 - RNA, 22 nt, Human
gcagggcagccacaggcccccu

SEQ ID NO: 385860 - RNA, 22 nt, Human
ggccucucuccuuggcuugcag

SEQ ID NO: 385861 - RNA, 22 nt, Human
ggucccaguugcccaggucagg

SEQ ID NO: 385862 - RNA, 20 nt, Human
acaggggcagcacaauaaug

SEQ ID NO: 385863 - RNA, 22 nt, Human
ugccagucucacccuggguccu

SEQ ID NO: 385864 - RNA, 23 nt, Human
cauggcagcaagagcucauggcc

SEQ ID NO: 385865 - RNA, 22 nt, Human
uuuucauuguuccucgagcauu

SEQ ID NO: 385866 - RNA, 22 nt, Human
acacagccgugaaucugcuucu

SEQ ID NO: 385867 - RNA, 22 nt, Human
aggccagcaagaaagagagucu

SEQ ID NO: 385868 - RNA, 22 nt, Human
agaccacagucaggcuccuggu

SEQ ID NO: 385869 - RNA, 22 nt, Human
ggagccaggcaaucuguacuuu

SEQ ID NO: 385870 - RNA, 22 nt, Human
uuuggaauuggcauucuauucu

SEQ ID NO: 385871 - RNA, 22 nt, Human
auggagacgcaagggaccuagg

SEQ ID NO: 385872 - RNA, 22 nt, Human
ucaagagacaggacguguuuca

SEQ ID NO: 385873 - RNA, 22 nt, Human
aggcagcagucaugaggaaaga

SEQ ID NO: 385874 - RNA, 22 nt, Human
ucaguuuuucuauacuuuguag

SEQ ID NO: 385875 - RNA, 23 nt, Human
acaaaugcccauacaucuaguuc

SEQ ID NO: 385876 - RNA, 22 nt, Human
uggcaucucaaacaggcagauu

SEQ ID NO: 385877 - RNA, 22 nt, Human
ccagagaguaaacauuuuccgg

SEQ ID NO: 385878 - RNA, 22 nt, Human
uugauuccuugaaauauccuug

SEQ ID NO: 385879 - RNA, 22 nt, Human
ggggcugggauuugaacccagg

SEQ ID NO: 385880 - RNA, 22 nt, Human
uggcauuucuguuagacucuca

SEQ ID NO: 385881 - RNA, 22 nt, Human
uaugaaauuuaaacacagauca

SEQ ID NO: 385882 - RNA, 18 nt, Human
gugagcagagagcaucac

SEQ ID NO: 385883 - RNA, 22 nt, Human
ugaggcaggagaauggcgggaa

SEQ ID NO: 385884 - RNA, 22 nt, Human
caguggaggcucaagugugcuu

SEQ ID NO: 385885 - RNA, 19 nt, Human
ggcugccuuuccuuaccag

SEQ ID NO: 385886 - RNA, 22 nt, Human
cagagaaaaaauccugcucuca

SEQ ID NO: 385887 - RNA, 22 nt, Human
ccuguucaccauggucacgugc

SEQ ID NO: 385888 - RNA, 22 nt, Human
cagcccagagauguuaucuagu

SEQ ID NO: 385889 - RNA, 22 nt, Human
uauguacaccggggaagguggg

SEQ ID NO: 385890 - RNA, 22 nt, Human
ggccaggagauggacaccacau

SEQ ID NO: 385891 - RNA, 22 nt, Human
gcagagccagaauggccaggac

SEQ ID NO: 385892 - RNA, 22 nt, Human
ccaggcucugagccucacucuu

SEQ ID NO: 385893 - RNA, 22 nt, Human
aucagcaaguccuguuaauucu

SEQ ID NO: 385894 - RNA, 20 nt, Human
aaguuacauuguauuguacc

SEQ ID NO: 385895 - RNA, 22 nt, Human
cugagccagggccacacaugga

SEQ ID NO: 385896 - RNA, 22 nt, Human
uggcucaguuccaucaucugga

SEQ ID NO: 385897 - RNA, 22 nt, Human
cauuauguucaguagcuuaaaa

SEQ ID NO: 385898 - RNA, 22 nt, Human
ugaaauuccaggagaguuaaaa

SEQ ID NO: 385899 - RNA, 19 nt, Human
aacuggauaauggccacau

SEQ ID NO: 385900 - RNA, 21 nt, Human
cucagagaaaugucugggagc

SEQ ID NO: 385901 - RNA, 22 nt, Human
cuggccugaucucaugcugucc

SEQ ID NO: 385902 - RNA, 22 nt, Human
auugaaagauuuugggcucaug

SEQ ID NO: 385903 - RNA, 22 nt, Human
agcugagccagcagcaacagga

SEQ ID NO: 385904 - RNA, 22 nt, Human
caggcacuguguuaggcacugu

SEQ ID NO: 385905 - RNA, 22 nt, Human
ggaaaaggccauuguuucucug

SEQ ID NO: 385906 - RNA, 22 nt, Human
uaguccuugguaaaauucuaug

SEQ ID NO: 385907 - RNA, 21 nt, Human
gcucagaguauugcacuguuu

SEQ ID NO: 385908 - RNA, 22 nt, Human
ggcaggagcucuccaguuugcc

SEQ ID NO: 385909 - RNA, 22 nt, Human
ccuggagcaggagcugcagagg

SEQ ID NO: 385910 - RNA, 22 nt, Human
guguguccucaguaguggcaug

SEQ ID NO: 385911 - RNA, 22 nt, Human
ccagggcaggagaaagacucac

SEQ ID NO: 385912 - RNA, 22 nt, Human
uuuccaaacccagcgagcuaca

SEQ ID NO: 385913 - RNA, 22 nt, Human
uaagaacagugucugucucaca

SEQ ID NO: 385914 - RNA, 22 nt, Human
augcaaaauaaggcagaaacau

SEQ ID NO: 385915 - RNA, 22 nt, Human
ugaggcaggacugagcgggaug

SEQ ID NO: 385916 - RNA, 22 nt, Human
acuuuuuacaggguguauacca

SEQ ID NO: 385917 - RNA, 20 nt, Human
uagaaaucuuauaaaagacu

SEQ ID NO: 385918 - RNA, 22 nt, Human
cagaggcagccgggggagaacg

SEQ ID NO: 385919 - RNA, 22 nt, Human
uggagcaggugccaggugugug

SEQ ID NO: 385920 - RNA, 22 nt, Human
gcaguggauggccagcaggggc

SEQ ID NO: 385921 - RNA, 22 nt, Human
uuccuguaugucagugaagagc

SEQ ID NO: 385922 - RNA, 22 nt, Human
ccagccaggcuggcuguggagg

SEQ ID NO: 385923 - RNA, 22 nt, Human
aaacugcugguugcuggccagc

SEQ ID NO: 385924 - RNA, 22 nt, Human
ucaguggauauuucuguggcug

SEQ ID NO: 385925 - RNA, 22 nt, Human
uaguuacagcaggcaggauaua

SEQ ID NO: 385926 - RNA, 22 nt, Human
aucaguuugauaauaaggcuug

SEQ ID NO: 385927 - RNA, 19 nt, Human
agggccugcagcucaagcu

SEQ ID NO: 385928 - RNA, 22 nt, Human
uguaugcagggcuuguaugcag

SEQ ID NO: 385929 - RNA, 21 nt, Human
aggcagaaagagcccaggcug

SEQ ID NO: 385930 - RNA, 22 nt, Human
ucuucagagugaaagucuguga

SEQ ID NO: 385931 - RNA, 22 nt, Human
agcugcucucacuggacgccug

SEQ ID NO: 385932 - RNA, 22 nt, Human
acuuuuaugauaaucaauguuc

SEQ ID NO: 385933 - RNA, 22 nt, Human
cuuauuauaaaauccuguuuga

SEQ ID NO: 385934 - RNA, 22 nt, Human
aggaagccugcaggugacugcu

SEQ ID NO: 385935 - RNA, 21 nt, Human
gcaggcuggucaaaccucagu

SEQ ID NO: 385936 - RNA, 22 nt, Human
uccucaggagagcuccuaugcc

SEQ ID NO: 385937 - RNA, 20 nt, Human
gccagcacagggagcaguuc

SEQ ID NO: 385938 - RNA, 19 nt, Human
uggaagaggaagggaaaua

SEQ ID NO: 385939 - RNA, 22 nt, Human
aaauagcacagcagcugaggcu

SEQ ID NO: 385940 - RNA, 21 nt, Human
ggcagcccgcccucuccuggc

SEQ ID NO: 385941 - RNA, 22 nt, Human
uuaacacuugaacucuacaugu

SEQ ID NO: 385942 - RNA, 22 nt, Human
cagggcucaggaaaucagacgu

SEQ ID NO: 385943 - RNA, 22 nt, Human
ugcuggggagugauugaccauc

SEQ ID NO: 385944 - RNA, 22 nt, Human
uauguuauuuucauacaacaga

SEQ ID NO: 385945 - RNA, 22 nt, Human
uggcuguguuaccacuucaugu

SEQ ID NO: 385946 - RNA, 22 nt, Human
aggcagucuaguccccaggcaa

SEQ ID NO: 385947 - RNA, 22 nt, Human
cugcugugucagaguccagggg

SEQ ID NO: 385948 - RNA, 22 nt, Human
aggcagacaaggucccuggucu

SEQ ID NO: 385949 - RNA, 22 nt, Human
uauauaacuacuauuuugcuca

SEQ ID NO: 385950 - RNA, 22 nt, Human
uucucagauccaucagaagucc

SEQ ID NO: 385951 - RNA, 22 nt, Human
gugggugauguacuggaggcca

SEQ ID NO: 385952 - RNA, 22 nt, Human
uggaagagggagcuggguggcc

SEQ ID NO: 385953 - RNA, 22 nt, Human
gagcugggcacacgccacuuga

SEQ ID NO: 385954 - RNA, 22 nt, Human
ucaggcugaaucauccuagcuu

SEQ ID NO: 385955 - RNA, 20 nt, Human
cugugcuuuggaaccuggaa

SEQ ID NO: 385956 - RNA, 22 nt, Human
gcuguauuccugcacuguauag

SEQ ID NO: 385957 - RNA, 22 nt, Human
uggcauuuucuccuuugaguuu

SEQ ID NO: 385958 - RNA, 22 nt, Human
aggagagagcugagcuuugcug

SEQ ID NO: 385959 - RNA, 22 nt, Human
acagaggccccgugggagagcc

SEQ ID NO: 385960 - RNA, 22 nt, Human
cauuuguaucauauguaucuua

SEQ ID NO: 385961 - RNA, 22 nt, Human
agauaugacuagaagcucauuu

SEQ ID NO: 385962 - RNA, 22 nt, Human
uuacagaaaagggguuguccuu

SEQ ID NO: 385963 - RNA, 22 nt, Human
caguggagaggcaugcuuggca

SEQ ID NO: 385964 - RNA, 22 nt, Human
aaagauucgagcgauguauaaa

SEQ ID NO: 385965 - RNA, 22 nt, Human
uccuucaggguugaggccgacu

SEQ ID NO: 385966 - RNA, 22 nt, Human
uauccaaaguuucucagaaacu

SEQ ID NO: 385967 - RNA, 22 nt, Human
uuucaguuuuugcucgauguau

SEQ ID NO: 385968 - RNA, 21 nt, Human
uucuccccagcgaauccucgg

SEQ ID NO: 385969 - RNA, 22 nt, Human
gagggcugugaaggagcggguu

SEQ ID NO: 385970 - RNA, 22 nt, Human
uucaguuucagucuugcaaaaa

SEQ ID NO: 385971 - RNA, 22 nt, Human
uuuacucuugcuacacaacugu

SEQ ID NO: 385972 - RNA, 22 nt, Human
cugggcuccuaaccauccaggu

SEQ ID NO: 385973 - RNA, 22 nt, Human
aggauuuauuccagaaaugcaa

SEQ ID NO: 385974 - RNA, 22 nt, Human
cugugcaguggcagcguguggg

SEQ ID NO: 385975 - RNA, 22 nt, Human
ggagcugugcugggugaucagg

SEQ ID NO: 385976 - RNA, 22 nt, Human
cagacaggcuagccagacucac

SEQ ID NO: 385977 - RNA, 22 nt, Human
auuucacucauucauguuacuu

SEQ ID NO: 385978 - RNA, 22 nt, Human
agcugagcucaggcugauguaa

SEQ ID NO: 385979 - RNA, 22 nt, Human
ugaggcagguggauuacaaggu

SEQ ID NO: 385980 - RNA, 22 nt, Human
uucaucaauguguuuaauaaug

SEQ ID NO: 385981 - RNA, 22 nt, Human
uguccucaaggagcuucagucu

SEQ ID NO: 385982 - RNA, 22 nt, Human
auacaaugauaauaguacuuua

SEQ ID NO: 385983 - RNA, 22 nt, Human
aggagugaguguccucagcaga

SEQ ID NO: 385984 - RNA, 22 nt, Human
uucucuucuguucagugcccaa

SEQ ID NO: 385985 - RNA, 22 nt, Human
uugcuagcugguguaugcauug

SEQ ID NO: 385986 - RNA, 22 nt, Human
cauaccuuucucaagcacaugu

SEQ ID NO: 385987 - RNA, 22 nt, Human
cuaugaaaggauuuggaguugu

SEQ ID NO: 385988 - RNA, 22 nt, Human
ccaggcuuucccagccucucca

SEQ ID NO: 385989 - RNA, 22 nt, Human
gugggccucuugaggguggcua

SEQ ID NO: 385990 - RNA, 22 nt, Human
auugaaucugcacuaguauuuu

SEQ ID NO: 385991 - RNA, 22 nt, Human
gcugagagcaaagcaugucuag

SEQ ID NO: 385992 - RNA, 20 nt, Human
cagcccuccaguggaggcag

SEQ ID NO: 385993 - RNA, 22 nt, Human
uguggucucguuauguugccca

SEQ ID NO: 385994 - RNA, 22 nt, Human
gaggcucaguuauuuuagccug

SEQ ID NO: 385995 - RNA, 22 nt, Human
gcugucacucaccaggccugca

SEQ ID NO: 385996 - RNA, 22 nt, Human
ucuugcacuucaugaauauguu

SEQ ID NO: 385997 - RNA, 22 nt, Human
cauggcuuuguucauauaauuu

SEQ ID NO: 385998 - RNA, 22 nt, Human
uuaacagagaacauagaaguag

SEQ ID NO: 385999 - RNA, 22 nt, Human
uugaaggaggcuccuuuuuaaa

SEQ ID NO: 386000 - RNA, 22 nt, Human
gaaaucugaacaacagcuguca

SEQ ID NO: 386001 - RNA, 22 nt, Human
aagcagagccaccagcuuugga

SEQ ID NO: 386002 - RNA, 22 nt, Human
cuggugagacgguugacaggag

SEQ ID NO: 386003 - RNA, 22 nt, Human
ucuucauuuuacaggcagaccu

SEQ ID NO: 386004 - RNA, 22 nt, Human
uuucaaauagaaucuuuccaaa

SEQ ID NO: 386005 - RNA, 22 nt, Human
auuuccaaaaccacuuauugcc

SEQ ID NO: 386006 - RNA, 22 nt, Human
uccaugugccaaggggcagagg

SEQ ID NO: 386007 - RNA, 22 nt, Human
agugcagccgagaucaggugcu

SEQ ID NO: 386008 - RNA, 22 nt, Human
ucacgagaggcacagaauagag

SEQ ID NO: 386009 - RNA, 22 nt, Human
cacagcuuaugccacugauugg

SEQ ID NO: 386010 - RNA, 22 nt, Human
uggggcugaggagccucacucu

SEQ ID NO: 386011 - RNA, 22 nt, Human
uacacuuuuuacuacagauucu

SEQ ID NO: 386012 - RNA, 21 nt, Human
aucagaaguuuuggucaguag

SEQ ID NO: 386013 - RNA, 22 nt, Human
cuggauuuaggacuaguccaag

SEQ ID NO: 386014 - RNA, 22 nt, Human
gugguuuugccauuacaaguaa

SEQ ID NO: 386015 - RNA, 22 nt, Human
uugacacaguuuucucauuaag

SEQ ID NO: 386016 - RNA, 19 nt, Human
ccauggagagagaugcauu

SEQ ID NO: 386017 - RNA, 22 nt, Human
augggaggaugcucgggugcuc

SEQ ID NO: 386018 - RNA, 22 nt, Human
uccagccuuucuacucacugag

SEQ ID NO: 386019 - RNA, 22 nt, Human
gcagaggagaugaagauacuuu

SEQ ID NO: 386020 - RNA, 22 nt, Human
gcuggcuugauaguuucugcuu

SEQ ID NO: 386021 - RNA, 22 nt, Human
auauuuaaacaggguaccaaua

SEQ ID NO: 386022 - RNA, 22 nt, Human
uuuuaaguuaauauaauugagg

SEQ ID NO: 386023 - RNA, 22 nt, Human
accagagcuggcagaguaucaa

SEQ ID NO: 386024 - RNA, 22 nt, Human
agcagccacagcagaucugagu

SEQ ID NO: 386025 - RNA, 22 nt, Human
ccuuucucuggcagcaggacag

SEQ ID NO: 386026 - RNA, 22 nt, Human
aggaguggugcaggaccugcca

SEQ ID NO: 386027 - RNA, 22 nt, Human
cugugcuuccaggauggcagcu

SEQ ID NO: 386028 - RNA, 22 nt, Human
cuggccugugggcugucuccgg

SEQ ID NO: 386029 - RNA, 22 nt, Human
cuuggccucuucucaggguggg

SEQ ID NO: 386030 - RNA, 22 nt, Human
uaaauucagugaguaauuucug

SEQ ID NO: 386031 - RNA, 22 nt, Human
aaagcaauggaugagaaucugu

SEQ ID NO: 386032 - RNA, 22 nt, Human
ugcagggcacggugcgcguggg

SEQ ID NO: 386033 - RNA, 22 nt, Human
ucgggcucgcucuccuagcgga

SEQ ID NO: 386034 - RNA, 22 nt, Human
uuuaacagaugcuaugucuacc

SEQ ID NO: 386035 - RNA, 19 nt, Human
acaaagcugugagcagcuu

SEQ ID NO: 386036 - RNA, 22 nt, Human
uuaacauuguccuuagcagauu

SEQ ID NO: 386037 - RNA, 22 nt, Human
ccagaagggcuauugcagugac

SEQ ID NO: 386038 - RNA, 17 nt, Human
aaaauucuguaaagagg

SEQ ID NO: 386039 - RNA, 18 nt, Human
acauuucucucugcguga

SEQ ID NO: 386040 - RNA, 22 nt, Human
aggcugagcugguagugaguac

SEQ ID NO: 386041 - RNA, 22 nt, Human
ugucucaggcccaagccaguaa

SEQ ID NO: 386042 - RNA, 22 nt, Human
aggcagugcucaagacagcagc

SEQ ID NO: 386043 - RNA, 20 nt, Human
ugugcaggagagugaggcug

SEQ ID NO: 386044 - RNA, 22 nt, Human
cagcacuggggggauucggagc

SEQ ID NO: 386045 - RNA, 22 nt, Human
ugcaggcucacccuggagcuga

SEQ ID NO: 386046 - RNA, 22 nt, Human
gcacaauaacagccaagguuau

SEQ ID NO: 386047 - RNA, 22 nt, Human
agccucugcacgggcacgggug

SEQ ID NO: 386048 - RNA, 21 nt, Human
ccacauucucauucugacugc

SEQ ID NO: 386049 - RNA, 22 nt, Human
augcuauacauaugacaucaca

SEQ ID NO: 386050 - RNA, 18 nt, Human
gguggccuugacuucucu

SEQ ID NO: 386051 - RNA, 21 nt, Human
aggugcaggccucaagcccca

SEQ ID NO: 386052 - RNA, 22 nt, Human
auacaacuuuacaugcaauucc

SEQ ID NO: 386053 - RNA, 22 nt, Human
cagugaaaucacaacuuuaguu

SEQ ID NO: 386054 - RNA, 22 nt, Human
uugaaauggaagugaaaauucu

SEQ ID NO: 386055 - RNA, 22 nt, Human
uucugaaagccaauucauugaa

SEQ ID NO: 386056 - RNA, 22 nt, Human
cacugcuucuggaggaauuugg

SEQ ID NO: 386057 - RNA, 22 nt, Human
cugcugugagcacuccagccug

SEQ ID NO: 386058 - RNA, 17 nt, Human
aggcagcucagaacauc

SEQ ID NO: 386059 - RNA, 22 nt, Human
gggugacauuucccaaugagcc

SEQ ID NO: 386060 - RNA, 22 nt, Human
gcaugggcuuucucagaguucu

SEQ ID NO: 386061 - RNA, 22 nt, Human
cagggcuggcuguggcaaucuc

SEQ ID NO: 386062 - RNA, 22 nt, Human
auuauguagguuaggugguugu

SEQ ID NO: 386063 - RNA, 22 nt, Human
ugacucuguaccugucugccuu

SEQ ID NO: 386064 - RNA, 22 nt, Human
gaaauaagaguccaugccaggu

SEQ ID NO: 386065 - RNA, 22 nt, Human
ugcuugaaagggguuucccagu

SEQ ID NO: 386066 - RNA, 22 nt, Human
uucuucaaaauccagcaugauu

SEQ ID NO: 386067 - RNA, 19 nt, Human
uuagggacaugaauucuag

SEQ ID NO: 386068 - RNA, 22 nt, Human
ugugaaaggagccauagacagu

SEQ ID NO: 386069 - RNA, 22 nt, Human
aguuucauauuaccaugucacc

SEQ ID NO: 386070 - RNA, 20 nt, Human
uggagccacagucagguucc

SEQ ID NO: 386071 - RNA, 22 nt, Human
auagacauuuugcauucaagca

SEQ ID NO: 386072 - RNA, 22 nt, Human
auggcagagggauugaacagcu

SEQ ID NO: 386073 - RNA, 22 nt, Human
aggaccugagaguuggaaaucc

SEQ ID NO: 386074 - RNA, 22 nt, Human
acauuucuugaugccucuguga

SEQ ID NO: 386075 - RNA, 22 nt, Human
cagagcuguugcggggcuuggc

SEQ ID NO: 386076 - RNA, 22 nt, Human
agaggcaacauggggaacagau

SEQ ID NO: 386077 - RNA, 22 nt, Human
acuuugcagagccagaagagaa

SEQ ID NO: 386078 - RNA, 22 nt, Human
guacagaaggauuucuaguagu

SEQ ID NO: 386079 - RNA, 22 nt, Human
aaauugugagcuauagaucuag

SEQ ID NO: 386080 - RNA, 22 nt, Human
ugcuuauugcuuucaagacugu

SEQ ID NO: 386081 - RNA, 22 nt, Human
gauuucuuugcaagcuguguuc

SEQ ID NO: 386082 - RNA, 22 nt, Human
gguccuggaaauugacggaaag

SEQ ID NO: 386083 - RNA, 22 nt, Human
caugggcuuuggaggcuggagg

SEQ ID NO: 386084 - RNA, 22 nt, Human
caagggcuucaaguggccaaga

SEQ ID NO: 386085 - RNA, 22 nt, Human
cagaagccugccucagaugcac

SEQ ID NO: 386086 - RNA, 22 nt, Human
ugguuugcccacucgagugauu

SEQ ID NO: 386087 - RNA, 22 nt, Human
uggcagagacaaggccgggccu

SEQ ID NO: 386088 - RNA, 22 nt, Human
gaagggagaagguugggugacg

SEQ ID NO: 386089 - RNA, 22 nt, Human
agacugaauaacaagcaaauaa

SEQ ID NO: 386090 - RNA, 22 nt, Human
ggccucacccaucggugccuuu

SEQ ID NO: 386091 - RNA, 22 nt, Human
uucuucaaacaaaaguggcaug

SEQ ID NO: 386092 - RNA, 22 nt, Human
gcagagcucaugccugcaccuc

SEQ ID NO: 386093 - RNA, 22 nt, Human
ugggcaggaugcguugauucuu

SEQ ID NO: 386094 - RNA, 22 nt, Human
uugaacaguccuaagagacccu

SEQ ID NO: 386095 - RNA, 22 nt, Human
ugggccugccccaggcuucagc

SEQ ID NO: 386096 - RNA, 22 nt, Human
uggcugcugcuuggucuucuuc

SEQ ID NO: 386097 - RNA, 22 nt, Human
ucagcuuucucucgccaucagg

SEQ ID NO: 386098 - RNA, 23 nt, Human
ucugggcaccuuguugacaugau

SEQ ID NO: 386099 - RNA, 22 nt, Human
acuuugcacuaaguuacucauu

SEQ ID NO: 386100 - RNA, 22 nt, Human
uuugcagcaaggagagagcauu

SEQ ID NO: 386101 - RNA, 20 nt, Human
cagcaggaaaagugccucag

SEQ ID NO: 386102 - RNA, 22 nt, Human
ucccagcagucagagcuaugug

SEQ ID NO: 386103 - RNA, 22 nt, Human
gcacggcuaauuuuuguauuuu

SEQ ID NO: 386104 - RNA, 22 nt, Human
agcagcucugagaggccagcac

SEQ ID NO: 386105 - RNA, 22 nt, Human
cuggagcuccagggucuccucu

SEQ ID NO: 386106 - RNA, 22 nt, Human
ucaggcuggaaugcaguggggc

SEQ ID NO: 386107 - RNA, 22 nt, Human
aaugauuggcacuagauacaca

SEQ ID NO: 386108 - RNA, 22 nt, Human
caaaaugugagucccaccucaa

SEQ ID NO: 386109 - RNA, 23 nt, Human
gggggcugguugacucucugcag

SEQ ID NO: 386110 - RNA, 22 nt, Human
uccugagaaggcacagcuugca

SEQ ID NO: 386111 - RNA, 22 nt, Human
aucuggcuccuacacuugaaga

SEQ ID NO: 386112 - RNA, 22 nt, Human
gcagcuuucuaagcuuuauugc

SEQ ID NO: 386113 - RNA, 22 nt, Human
caaguccuaggucugauugaac

SEQ ID NO: 386114 - RNA, 22 nt, Human
ucacugcagagaccucuaguca

SEQ ID NO: 386115 - RNA, 22 nt, Human
guuaauuuaguagaguccagau

SEQ ID NO: 386116 - RNA, 22 nt, Human
ucauuuaauugguuuugcucgu

SEQ ID NO: 386117 - RNA, 22 nt, Human
uggcucagauaauucaaggggc

SEQ ID NO: 386118 - RNA, 23 nt, Human
gagugcagaauagacaugcagug

SEQ ID NO: 386119 - RNA, 23 nt, Human
gaggcagcuccugcagugcccug

SEQ ID NO: 386120 - RNA, 22 nt, Human
ggcuucugguaaagaccacacc

SEQ ID NO: 386121 - RNA, 22 nt, Human
gaaaauguuuguccggagcuga

SEQ ID NO: 386122 - RNA, 22 nt, Human
cuccucuggaaauuccucugcc

SEQ ID NO: 386123 - RNA, 22 nt, Human
uaggcagaaaggaaggcaaguu

SEQ ID NO: 386124 - RNA, 22 nt, Human
uuucaaagucaauaucauuacc

SEQ ID NO: 386125 - RNA, 22 nt, Human
auacauguucguguacauguuc

SEQ ID NO: 386126 - RNA, 22 nt, Human
gagauuuagagagacuuaaaca

SEQ ID NO: 386127 - RNA, 22 nt, Human
agcagagccagaauuggaccag

SEQ ID NO: 386128 - RNA, 22 nt, Human
gcagagcugucuaagucacuuc

SEQ ID NO: 386129 - RNA, 22 nt, Human
cuggcucaugugaugagggcaa

SEQ ID NO: 386130 - RNA, 22 nt, Human
ccuccaggcugaauaucuagaa

SEQ ID NO: 386131 - RNA, 22 nt, Human
auccaaagcccuaaguuaacug

SEQ ID NO: 386132 - RNA, 22 nt, Human
agggucagugaugagggagccc

SEQ ID NO: 386133 - RNA, 22 nt, Human
cacaagucuguggucuccaaca

SEQ ID NO: 386134 - RNA, 22 nt, Human
gggugaggagcugccagucaug

SEQ ID NO: 386135 - RNA, 22 nt, Human
uggccagguguggguucucaga

SEQ ID NO: 386136 - RNA, 22 nt, Human
agcagcuggugagcaagcucag

SEQ ID NO: 386137 - RNA, 22 nt, Human
uaauucagggccagaaucccca

SEQ ID NO: 386138 - RNA, 22 nt, Human
ugcccaaguguuuggcugaguc

SEQ ID NO: 386139 - RNA, 22 nt, Human
gugucaugcacacucaguguug

SEQ ID NO: 386140 - RNA, 17 nt, Human
cacaggugugguuugag

SEQ ID NO: 386141 - RNA, 22 nt, Human
uauuucagggagaauaaauuug

SEQ ID NO: 386142 - RNA, 22 nt, Human
uugaagaaauuauuuuauauag

SEQ ID NO: 386143 - RNA, 22 nt, Human
aagggcugaaagaccuugggca

SEQ ID NO: 386144 - RNA, 22 nt, Human
cauuuguaguuaaaaaugucuc

SEQ ID NO: 386145 - RNA, 22 nt, Human
gcuuggcauugaccauuaucau

SEQ ID NO: 386146 - RNA, 22 nt, Human
cugugcaagcccaagauaaaac

SEQ ID NO: 386147 - RNA, 22 nt, Human
cugacagucucauugauuugcu

SEQ ID NO: 386148 - RNA, 22 nt, Human
ccuguguggaaaccgcaugacg

SEQ ID NO: 386149 - RNA, 22 nt, Human
agugcccuggcccagcuggacc

SEQ ID NO: 386150 - RNA, 19 nt, Human
ugagcuggcugagccucuc

SEQ ID NO: 386151 - RNA, 22 nt, Human
uuuccuuccaaaugcccgggag

SEQ ID NO: 386152 - RNA, 20 nt, Human
ggcucugcuugugagcagcc

SEQ ID NO: 386153 - RNA, 18 nt, Human
acagaacucaggggcacc

SEQ ID NO: 386154 - RNA, 22 nt, Human
gaucugaagagcaaugaaauau

SEQ ID NO: 386155 - RNA, 22 nt, Human
auuucacucucccugccacuua

SEQ ID NO: 386156 - RNA, 18 nt, Human
uaaaugcauguuaauaac

SEQ ID NO: 386157 - RNA, 22 nt, Human
gcugucuccauagcuguguguc

SEQ ID NO: 386158 - RNA, 22 nt, Human
gcugguuagaaaacagagcuca

SEQ ID NO: 386159 - RNA, 22 nt, Human
uuauuuaaaauguagguuggga

SEQ ID NO: 386160 - RNA, 22 nt, Human
cuguuuucaaagagagagaaug

SEQ ID NO: 386161 - RNA, 22 nt, Human
aaugcacauaaauauggucuua

SEQ ID NO: 386162 - RNA, 22 nt, Human
aagaaauauugggccuuauaaa

SEQ ID NO: 386163 - RNA, 22 nt, Human
gcugcagcccggcgcgccugag

SEQ ID NO: 386164 - RNA, 22 nt, Human
aaacuguauauuuauggcaugu

SEQ ID NO: 386165 - RNA, 22 nt, Human
ucccaggacaggccacauggaa

SEQ ID NO: 386166 - RNA, 22 nt, Human
uuauuccauuauuucacuuagg

SEQ ID NO: 386167 - RNA, 22 nt, Human
uuguuuucacagcuuugcccgg

SEQ ID NO: 386168 - RNA, 22 nt, Human
agagcugagaauguggcuuccu

SEQ ID NO: 386169 - RNA, 22 nt, Human
auugaaagauauacuguucuca

SEQ ID NO: 386170 - RNA, 22 nt, Human
cagcauggugccagugagucca

SEQ ID NO: 386171 - RNA, 22 nt, Human
aaugaacaucaaaugccuacca

SEQ ID NO: 386172 - RNA, 22 nt, Human
uggcagccacaucucguggauu

SEQ ID NO: 386173 - RNA, 17 nt, Human
acacagggagagggagc

SEQ ID NO: 386174 - RNA, 22 nt, Human
aucuagaacuuaaagucaguca

SEQ ID NO: 386175 - RNA, 22 nt, Human
ucaaaggcugcuugucuucugg

SEQ ID NO: 386176 - RNA, 22 nt, Human
cucugaagggagggccaagccc

SEQ ID NO: 386177 - RNA, 22 nt, Human
uggcagcuacagacagagguga

SEQ ID NO: 386178 - RNA, 22 nt, Human
ggcugccauaacugauaccaua

SEQ ID NO: 386179 - RNA, 22 nt, Human
ugaggggaacugaugcccauug

SEQ ID NO: 386180 - RNA, 22 nt, Human
gugcagugacccuggagagcug

SEQ ID NO: 386181 - RNA, 22 nt, Human
gggggacuaacuggauccugga

SEQ ID NO: 386182 - RNA, 22 nt, Human
uucacauuauaaucaguucugc

SEQ ID NO: 386183 - RNA, 20 nt, Human
aggcucagauacccagggaa

SEQ ID NO: 386184 - RNA, 19 nt, Human
gcucugagaggggcauggg

SEQ ID NO: 386185 - RNA, 22 nt, Human
ggcaggguggcagaggcucaga

SEQ ID NO: 386186 - RNA, 21 nt, Human
agccuguugguuuacugcuca

SEQ ID NO: 386187 - RNA, 22 nt, Human
uauuuuaucugccagaguggag

SEQ ID NO: 386188 - RNA, 22 nt, Human
aauaacuggcacauaucacaua

SEQ ID NO: 386189 - RNA, 22 nt, Human
ucuuuugugauucuucaguuac

SEQ ID NO: 386190 - RNA, 22 nt, Human
ugcuuauucuuuccacaauuca

SEQ ID NO: 386191 - RNA, 22 nt, Human
ucucuucuaacacuagaaauuc

SEQ ID NO: 386192 - RNA, 22 nt, Human
gggcuucucccuaaggacucug

SEQ ID NO: 386193 - RNA, 22 nt, Human
gccuugccucagccauggaaac

SEQ ID NO: 386194 - RNA, 20 nt, Human
uccaggagaacugggagccg

SEQ ID NO: 386195 - RNA, 22 nt, Human
ucagagugugagacauauugga

SEQ ID NO: 386196 - RNA, 22 nt, Human
uaggcuggaggaagcagugccu

SEQ ID NO: 386197 - RNA, 22 nt, Human
aggcagcccacaggacacagga

SEQ ID NO: 386198 - RNA, 22 nt, Human
ucaguguaaguuauguagaugu

SEQ ID NO: 386199 - RNA, 22 nt, Human
uccaggagguuuggaggaagca

SEQ ID NO: 386200 - RNA, 22 nt, Human
uugauagguuuuauguauaguu

SEQ ID NO: 386201 - RNA, 19 nt, Human
gccugggaugggcagaacu

SEQ ID NO: 386202 - RNA, 22 nt, Human
gccaggagcccugggcaaguuc

SEQ ID NO: 386203 - RNA, 22 nt, Human
cagggcugaagaaauucaaaag

SEQ ID NO: 386204 - RNA, 22 nt, Human
aucuggcucaccuggguaaaua

SEQ ID NO: 386205 - RNA, 22 nt, Human
gcucaggacuggaggagcgggg

SEQ ID NO: 386206 - RNA, 22 nt, Human
aaggcacuguacuaguuaguua

SEQ ID NO: 386207 - RNA, 22 nt, Human
cuucagagugcagaagauuggg

SEQ ID NO: 386208 - RNA, 22 nt, Human
ucugcugcacaaauucaucucu

SEQ ID NO: 386209 - RNA, 22 nt, Human
auauucuugugauuauaaagua

SEQ ID NO: 386210 - RNA, 22 nt, Human
ggccucugaggacagccuuggc

SEQ ID NO: 386211 - RNA, 22 nt, Human
gucucagggacugcuucugggg

SEQ ID NO: 386212 - RNA, 22 nt, Human
acaccaccgucccagccuccug

SEQ ID NO: 386213 - RNA, 22 nt, Human
uuucccagagguaugaauaagu

SEQ ID NO: 386214 - RNA, 22 nt, Human
acaaaugugucuaauugugccu

SEQ ID NO: 386215 - RNA, 22 nt, Human
acaauucucucauaucuuauua

SEQ ID NO: 386216 - RNA, 22 nt, Human
aagggaggccagagguuuugca

SEQ ID NO: 386217 - RNA, 23 nt, Human
gaggcacucaggaaaugugagug

SEQ ID NO: 386218 - RNA, 22 nt, Human
cugucccucaucaccucugggu

SEQ ID NO: 386219 - RNA, 22 nt, Human
uccauuuacuauucucauaucg

SEQ ID NO: 386220 - RNA, 22 nt, Human
agaccgagaaguucuccaggcc

SEQ ID NO: 386221 - RNA, 22 nt, Human
uuccauaaaggugauaguauac

SEQ ID NO: 386222 - RNA, 22 nt, Human
uuucaaaccuacuuguauguuu

SEQ ID NO: 386223 - RNA, 22 nt, Human
agaaaugaaaccaaagccuaga

SEQ ID NO: 386224 - RNA, 19 nt, Human
ccuggcccugcugcgcggg

SEQ ID NO: 386225 - RNA, 22 nt, Human
caaugugucaggaaaagggcca

SEQ ID NO: 386226 - RNA, 22 nt, Human
uuucagaugcaauuaauuuuca

SEQ ID NO: 386227 - RNA, 22 nt, Human
ggcugggcaggucugcacaggg

SEQ ID NO: 386228 - RNA, 20 nt, Human
gagggcucguggauggauaa

SEQ ID NO: 386229 - RNA, 22 nt, Human
gcucuugucaaaaauuaguuga

SEQ ID NO: 386230 - RNA, 22 nt, Human
cauagagugauguaagguaugu

SEQ ID NO: 386231 - RNA, 22 nt, Human
caggguuucaccauguuagcag

SEQ ID NO: 386232 - RNA, 22 nt, Human
ggagaggugaauggcugcucua

SEQ ID NO: 386233 - RNA, 22 nt, Human
acucugccccgaguucugggaa

SEQ ID NO: 386234 - RNA, 19 nt, Human
agggaguuuauauuugcac

SEQ ID NO: 386235 - RNA, 22 nt, Human
aggagagcuggugucuggaauc

SEQ ID NO: 386236 - RNA, 23 nt, Human
agguucaggagauggaggaacaa

SEQ ID NO: 386237 - RNA, 22 nt, Human
ucugggugaugaaaugcacugu

SEQ ID NO: 386238 - RNA, 22 nt, Human
acauuucuaauuuaauguaaca

SEQ ID NO: 386239 - RNA, 22 nt, Human
cucaggaaaggccaugcaaggg

SEQ ID NO: 386240 - RNA, 22 nt, Human
uucuuucccaguagaugugaaa

SEQ ID NO: 386241 - RNA, 22 nt, Human
aggucaaguuuagauagaguua

SEQ ID NO: 386242 - RNA, 22 nt, Human
aaaugcacagaggccagagagg

SEQ ID NO: 386243 - RNA, 22 nt, Human
uugcagagugguugugaggauu

SEQ ID NO: 386244 - RNA, 21 nt, Human
ugagccaggcugacggcugug

SEQ ID NO: 386245 - RNA, 22 nt, Human
gggaaccagccgcuuccgccuc

SEQ ID NO: 386246 - RNA, 22 nt, Human
uuugaaagagcugauacaugaa

SEQ ID NO: 386247 - RNA, 22 nt, Human
cauggagauaaacugaaauauu

SEQ ID NO: 386248 - RNA, 22 nt, Human
gaagaacaccugcugcccagug

SEQ ID NO: 386249 - RNA, 22 nt, Human
cugccuggcauggagaagagaa

SEQ ID NO: 386250 - RNA, 22 nt, Human
caugaguucaucugcuucucuu

SEQ ID NO: 386251 - RNA, 22 nt, Human
acuggaagccaguugacaauca

SEQ ID NO: 386252 - RNA, 22 nt, Human
agggucccgaaggagacagcaa

SEQ ID NO: 386253 - RNA, 22 nt, Human
guggcagguuauaagcaucuca

SEQ ID NO: 386254 - RNA, 22 nt, Human
aaaugcauggcuguuuuaaagc

SEQ ID NO: 386255 - RNA, 22 nt, Human
uuaauuacaaaacacauagguu

SEQ ID NO: 386256 - RNA, 22 nt, Human
cgccucagccguggucaucuuc

SEQ ID NO: 386257 - RNA, 22 nt, Human
uuccaggaagcaguuagcagcc

SEQ ID NO: 386258 - RNA, 22 nt, Human
auuauccucagaaaacauguga

SEQ ID NO: 386259 - RNA, 22 nt, Human
cuuuggcaaugaaacacaagaa

SEQ ID NO: 386260 - RNA, 22 nt, Human
cuuagggaauugggaggaugcc

SEQ ID NO: 386261 - RNA, 22 nt, Human
uuugaaaggugucgagaugugu

SEQ ID NO: 386262 - RNA, 22 nt, Human
ugcagagaaaguguagacaggc

SEQ ID NO: 386263 - RNA, 22 nt, Human
ugaaauauuuagagaguaaguu

SEQ ID NO: 386264 - RNA, 22 nt, Human
cuguguggacugguugaggccc

SEQ ID NO: 386265 - RNA, 22 nt, Human
cugagcacugggcacauagcug

SEQ ID NO: 386266 - RNA, 22 nt, Human
ugcugcuccugccuggcuccca

SEQ ID NO: 386267 - RNA, 17 nt, Human
agcugccagggagugug

SEQ ID NO: 386268 - RNA, 22 nt, Human
gcugaagcugcagcaggaggaa

SEQ ID NO: 386269 - RNA, 22 nt, Human
ggaagggcaauaaaaucucagg

SEQ ID NO: 386270 - RNA, 22 nt, Human
ugcuuuaacauaagauaucuuu

SEQ ID NO: 386271 - RNA, 22 nt, Human
agggcugacaguaaaaguauga

SEQ ID NO: 386272 - RNA, 22 nt, Human
auaaagaggauguauuuacagc

SEQ ID NO: 386273 - RNA, 22 nt, Human
agagcuguucaacguagcaaug

SEQ ID NO: 386274 - RNA, 22 nt, Human
caaggagaaaacggcuucugaa

SEQ ID NO: 386275 - RNA, 22 nt, Human
ggagcagccacgucucagggca

SEQ ID NO: 386276 - RNA, 22 nt, Human
cccaaaguacaaguaaacaugu

SEQ ID NO: 386277 - RNA, 22 nt, Human
cucuucucugcagccuuugaag

SEQ ID NO: 386278 - RNA, 22 nt, Human
ugccaggccucaggagucucca

SEQ ID NO: 386279 - RNA, 22 nt, Human
uguucacaagaugucuguggcu

SEQ ID NO: 386280 - RNA, 22 nt, Human
gaaggagaggauugugaggcug

SEQ ID NO: 386281 - RNA, 22 nt, Human
aaggcugaauucaaggguaggc

SEQ ID NO: 386282 - RNA, 22 nt, Human
cagaggcagaggucaucucugg

SEQ ID NO: 386283 - RNA, 22 nt, Human
uggauuuaauggaugaggggca

SEQ ID NO: 386284 - RNA, 22 nt, Human
uucaagauggcugcaaauacuu

SEQ ID NO: 386285 - RNA, 22 nt, Human
ugauuuuuagcuauucugaaga

SEQ ID NO: 386286 - RNA, 22 nt, Human
ucuggcucuaacuaggcaucag

SEQ ID NO: 386287 - RNA, 22 nt, Human
uguccucagauaugucuacucu

SEQ ID NO: 386288 - RNA, 21 nt, Human
ucucacaauaugaugccagau

SEQ ID NO: 386289 - RNA, 22 nt, Human
cagggcucccucuggcucccag

SEQ ID NO: 386290 - RNA, 22 nt, Human
aaaugucuaucuggcauauucc

SEQ ID NO: 386291 - RNA, 22 nt, Human
ucuaaacaguuucacucuuaau

SEQ ID NO: 386292 - RNA, 19 nt, Human
uggcagggagaguuugaag

SEQ ID NO: 386293 - RNA, 22 nt, Human
acaauguaggauauguacuugu

SEQ ID NO: 386294 - RNA, 22 nt, Human
uaucaagugacuaucacagaac

SEQ ID NO: 386295 - RNA, 22 nt, Human
ucaaggugcugugcugugcuag

SEQ ID NO: 386296 - RNA, 22 nt, Human
uugaagcaaauucugugcagua

SEQ ID NO: 386297 - RNA, 22 nt, Human
uuccucaucugugcaccucacu

SEQ ID NO: 386298 - RNA, 22 nt, Human
gccaggaguguguggcuauguu

SEQ ID NO: 386299 - RNA, 22 nt, Human
ugggcagacgggagcuugccuu

SEQ ID NO: 386300 - RNA, 22 nt, Human
uuucuucucgacaccuuauccc

SEQ ID NO: 386301 - RNA, 22 nt, Human
agcacauaccagaaccacaggu

SEQ ID NO: 386302 - RNA, 22 nt, Human
caggaaugacugcagauggggc

SEQ ID NO: 386303 - RNA, 22 nt, Human
uguuaggguccugugcaggggc

SEQ ID NO: 386304 - RNA, 22 nt, Human
agagcugaauuuggguggugga

SEQ ID NO: 386305 - RNA, 22 nt, Human
gcuggaccaggugugcacaggc

SEQ ID NO: 386306 - RNA, 22 nt, Human
acaguggagcucagaugaaaau

SEQ ID NO: 386307 - RNA, 22 nt, Human
cguccuuacagagggucacagc

SEQ ID NO: 386308 - RNA, 23 nt, Human
agcacagacuagaaaggucuuuc

SEQ ID NO: 386309 - RNA, 22 nt, Human
ccagugcauaaucaauacagcc

SEQ ID NO: 386310 - RNA, 22 nt, Human
agcaguggcugaagauguuccu

SEQ ID NO: 386311 - RNA, 22 nt, Human
aagggcucuucuauuuauggcc

SEQ ID NO: 386312 - RNA, 22 nt, Human
cagggcagugaagaacacacgu

SEQ ID NO: 386313 - RNA, 18 nt, Human
gcagugaagaaagagcuu

SEQ ID NO: 386314 - RNA, 22 nt, Human
gagauuggccuggcuugccaac

SEQ ID NO: 386315 - RNA, 22 nt, Human
ucaaaugcuguauuguaguaau

SEQ ID NO: 386316 - RNA, 22 nt, Human
cagcugaguuuccaagucugcc

SEQ ID NO: 386317 - RNA, 22 nt, Human
cuccucuuuacccgcauggucu

SEQ ID NO: 386318 - RNA, 22 nt, Human
auuuuacuacuccaauuaauga

SEQ ID NO: 386319 - RNA, 22 nt, Human
agcagaggaggauuuaguuagg

SEQ ID NO: 386320 - RNA, 22 nt, Human
gaauucugucgcuuacuagaug

SEQ ID NO: 386321 - RNA, 22 nt, Human
ucucuuaaaagauuuuaaugac

SEQ ID NO: 386322 - RNA, 19 nt, Human
acagggcagcaauaggaua

SEQ ID NO: 386323 - RNA, 22 nt, Human
uugaaaguccuucuugaguuac

SEQ ID NO: 386324 - RNA, 22 nt, Human
gagcagaacuacucacauaucg

SEQ ID NO: 386325 - RNA, 22 nt, Human
aacagugaguugaugacugaau

SEQ ID NO: 386326 - RNA, 22 nt, Human
cuggcccauggugagcucuggg

SEQ ID NO: 386327 - RNA, 22 nt, Human
uugcauguuauuuaaucuguau

SEQ ID NO: 386328 - RNA, 22 nt, Human
auuucagaugaccaaauggaaa

SEQ ID NO: 386329 - RNA, 19 nt, Human
uuugcagugguuccuuugu

SEQ ID NO: 386330 - RNA, 22 nt, Human
caaaguauauuggauugaaugg

SEQ ID NO: 386331 - RNA, 22 nt, Human
auuucuuuucaagagggugcuu

SEQ ID NO: 386332 - RNA, 22 nt, Human
auaauaaaccaggaugggucug

SEQ ID NO: 386333 - RNA, 22 nt, Human
acagagguguuccagaccuagg

SEQ ID NO: 386334 - RNA, 22 nt, Human
aagauuuacuagcauaauagcu

SEQ ID NO: 386335 - RNA, 22 nt, Human
gcugcagccaaauucauuguca

SEQ ID NO: 386336 - RNA, 22 nt, Human
aggaggugacagccugcaucug

SEQ ID NO: 386337 - RNA, 22 nt, Human
guggaggacaaaagaagccuuu

SEQ ID NO: 386338 - RNA, 22 nt, Human
cugggguggauggguccaaguu

SEQ ID NO: 386339 - RNA, 22 nt, Human
aggcucagcugguggugaucgc

SEQ ID NO: 386340 - RNA, 22 nt, Human
gagcugaguuaccuccagauca

SEQ ID NO: 386341 - RNA, 22 nt, Human
uggcuuaauauuucauauuuaa

SEQ ID NO: 386342 - RNA, 22 nt, Human
ugaggcucagaagugccaagug

SEQ ID NO: 386343 - RNA, 17 nt, Human
agaacuguaguagcucc

SEQ ID NO: 386344 - RNA, 18 nt, Human
ucugagggugcgggagcu

SEQ ID NO: 386345 - RNA, 22 nt, Human
uuuuccucugcagagcaguuag

SEQ ID NO: 386346 - RNA, 22 nt, Human
uggucaggcugcucugcggcgu

SEQ ID NO: 386347 - RNA, 22 nt, Human
aaagguuaagguguucaagaaa

SEQ ID NO: 386348 - RNA, 22 nt, Human
ucaggggacuuaggagagaagu

SEQ ID NO: 386349 - RNA, 22 nt, Human
cuuccuggccauugccauggca

SEQ ID NO: 386350 - RNA, 22 nt, Human
aaggaagguucauagucaaaga

SEQ ID NO: 386351 - RNA, 22 nt, Human
gcuggagguuucaccugaguuu

SEQ ID NO: 386352 - RNA, 22 nt, Human
ugcugaaggcaggggagguggc

SEQ ID NO: 386353 - RNA, 22 nt, Human
uguucuuucaguuagacacagu

SEQ ID NO: 386354 - RNA, 18 nt, Human
gugugcaguugcaggggu

SEQ ID NO: 386355 - RNA, 22 nt, Human
accauuuaauaaguauuuccau

SEQ ID NO: 386356 - RNA, 22 nt, Human
gagcugagaucgugccauugca

SEQ ID NO: 386357 - RNA, 22 nt, Human
ccaggagagcauugcacagagg

SEQ ID NO: 386358 - RNA, 23 nt, Human
ugcagggcaaguuagagacccca

SEQ ID NO: 386359 - RNA, 17 nt, Human
uagcuguguuucagcua

SEQ ID NO: 386360 - RNA, 22 nt, Human
uugcaacaucugaacauuuauc

SEQ ID NO: 386361 - RNA, 22 nt, Human
agugucauaugccacugcaucc

SEQ ID NO: 386362 - RNA, 22 nt, Human
ucagcuuugccaccagcuguaa

SEQ ID NO: 386363 - RNA, 22 nt, Human
gaggcacauauauacagagccc

SEQ ID NO: 386364 - RNA, 22 nt, Human
aggcucagauucacauuugguu

SEQ ID NO: 386365 - RNA, 22 nt, Human
gauuuauaguaugugcuuucag

SEQ ID NO: 386366 - RNA, 22 nt, Human
ugacaugcuuguuuuccuugaa

SEQ ID NO: 386367 - RNA, 22 nt, Human
uuuuucauauuccccucucugg

SEQ ID NO: 386368 - RNA, 16 nt, Human
aggaggggaauuagga

SEQ ID NO: 386369 - RNA, 22 nt, Human
uaauguguugaauauuuguaca

SEQ ID NO: 386370 - RNA, 22 nt, Human
cuggacucugcagagaaaagua

SEQ ID NO: 386371 - RNA, 22 nt, Human
uuagccauauagaaaaagagcu

SEQ ID NO: 386372 - RNA, 22 nt, Human
gugauuccuauuaguacaugca

SEQ ID NO: 386373 - RNA, 20 nt, Human
agcuucuucugucuaauuuu

SEQ ID NO: 386374 - RNA, 22 nt, Human
aaagaacaauguggaaucuccu

SEQ ID NO: 386375 - RNA, 22 nt, Human
aucuucaacuugaucauuugaa

SEQ ID NO: 386376 - RNA, 22 nt, Human
cccaagagguggagguugcagu

SEQ ID NO: 386377 - RNA, 22 nt, Human
acaaaauuguguuaaacuuuau

SEQ ID NO: 386378 - RNA, 22 nt, Human
auuaaauuggaucugcauaguu

SEQ ID NO: 386379 - RNA, 19 nt, Human
cuuugucagaacaugcuuc

SEQ ID NO: 386380 - RNA, 22 nt, Human
uuauuccagcuaagaguccugg

SEQ ID NO: 386381 - RNA, 22 nt, Human
uuaugaaagacauuucuguugg

SEQ ID NO: 386382 - RNA, 22 nt, Human
ucccuggacaacagacuucacu

SEQ ID NO: 386383 - RNA, 22 nt, Human
agaggccacuuugccugugaug

SEQ ID NO: 386384 - RNA, 22 nt, Human
caucuggcuagcuaucauugug

SEQ ID NO: 386385 - RNA, 22 nt, Human
ggcucuggugugaagcagccuc

SEQ ID NO: 386386 - RNA, 22 nt, Human
acaaaugucuccucuuuuguua

SEQ ID NO: 386387 - RNA, 20 nt, Human
ccagacagcaccugccuggu

SEQ ID NO: 386388 - RNA, 22 nt, Human
cuccagggggcauccacacagc

SEQ ID NO: 386389 - RNA, 22 nt, Human
gugccugggguugagcuaugaa

SEQ ID NO: 386390 - RNA, 22 nt, Human
ugugggaggaauuagaauggga

SEQ ID NO: 386391 - RNA, 22 nt, Human
uaaauuguuuucuagaaguugu

SEQ ID NO: 386392 - RNA, 22 nt, Human
ucaggcaggcucagaggaaaac

SEQ ID NO: 386393 - RNA, 23 nt, Human
uggggccaagugaggaagggucu

SEQ ID NO: 386394 - RNA, 22 nt, Human
cagcccucagguccucagcagc

SEQ ID NO: 386395 - RNA, 22 nt, Human
cagagcaggcccacugcccucc

SEQ ID NO: 386396 - RNA, 22 nt, Human
cugggccucaaucucagaguuu

SEQ ID NO: 386397 - RNA, 22 nt, Human
caggcagcucgaugccuuguug

SEQ ID NO: 386398 - RNA, 22 nt, Human
uguuccaagcugcuggauaagc

SEQ ID NO: 386399 - RNA, 22 nt, Human
caguaaauacauaucagagaag

SEQ ID NO: 386400 - RNA, 22 nt, Human
cagaugagaguggccaggguuc

SEQ ID NO: 386401 - RNA, 22 nt, Human
uccuugaaugaagagaggugac

SEQ ID NO: 386402 - RNA, 22 nt, Human
gcugucaccaaagcaggcacug

SEQ ID NO: 386403 - RNA, 20 nt, Human
cccugagacaaaggaggggc

SEQ ID NO: 386404 - RNA, 22 nt, Human
ucucaaacuaacaaugauuaua

SEQ ID NO: 386405 - RNA, 22 nt, Human
gcaguggggcgcugggaguugg

SEQ ID NO: 386406 - RNA, 22 nt, Human
ccucaggggcuuuucguuguug

SEQ ID NO: 386407 - RNA, 22 nt, Human
agggccugggucuguacuccuc

SEQ ID NO: 386408 - RNA, 22 nt, Human
cuggcagguccagcuggacuca

SEQ ID NO: 386409 - RNA, 22 nt, Human
gauuucuguaacacuucagaua

SEQ ID NO: 386410 - RNA, 22 nt, Human
caaauguguuuuuucuucuaca

SEQ ID NO: 386411 - RNA, 22 nt, Human
ggaugcuggggaccaaucucug

SEQ ID NO: 386412 - RNA, 22 nt, Human
aagccagcauuuucccauuccu

SEQ ID NO: 386413 - RNA, 18 nt, Human
aguggucuguuauaucau

SEQ ID NO: 386414 - RNA, 22 nt, Human
ugccugggccuucccaccucug

SEQ ID NO: 386415 - RNA, 22 nt, Human
uacagagauuuauugcuaaggc

SEQ ID NO: 386416 - RNA, 22 nt, Human
ugucacaaacauacauuauaga

SEQ ID NO: 386417 - RNA, 22 nt, Human
uguggcuuaagaaugccuuuaa

SEQ ID NO: 386418 - RNA, 22 nt, Human
ucaguuucuucaucucccuaac

SEQ ID NO: 386419 - RNA, 22 nt, Human
ugguuuaaccugucucuuauua

SEQ ID NO: 386420 - RNA, 22 nt, Human
ucagcugcucaaauuuauguca

SEQ ID NO: 386421 - RNA, 22 nt, Human
cacagcuucccaaaguggaccu

SEQ ID NO: 386422 - RNA, 23 nt, Human
uggcaaggaaugggauggagacu

SEQ ID NO: 386423 - RNA, 22 nt, Human
ccugucuggccaccagggcgau

SEQ ID NO: 386424 - RNA, 22 nt, Human
ugucugguggguugacaggcag

SEQ ID NO: 386425 - RNA, 22 nt, Human
uacauugugauguuucaauaca

SEQ ID NO: 386426 - RNA, 22 nt, Human
gugaggggaguaaagccauguu

SEQ ID NO: 386427 - RNA, 22 nt, Human
uggaauggaaacaaacugagga

SEQ ID NO: 386428 - RNA, 22 nt, Human
auguagcagauauuugugcaca

SEQ ID NO: 386429 - RNA, 22 nt, Human
ggcagggugccuggcuccuguu

SEQ ID NO: 386430 - RNA, 20 nt, Human
uggcaggaggcagcagugga

SEQ ID NO: 386431 - RNA, 22 nt, Human
ggggauggugggaaggcaaucu

SEQ ID NO: 386432 - RNA, 22 nt, Human
cccaggagaauauaauguucuu

SEQ ID NO: 386433 - RNA, 22 nt, Human
agaauaauacugaaaugcugaa

SEQ ID NO: 386434 - RNA, 22 nt, Human
auaaguaggaaaauuugaauau

SEQ ID NO: 386435 - RNA, 22 nt, Human
ccaggcagagugcuccagaaag

SEQ ID NO: 386436 - RNA, 22 nt, Human
caggacauugauccauuggcac

SEQ ID NO: 386437 - RNA, 22 nt, Human
gaguccuuaauacacuggugga

SEQ ID NO: 386438 - RNA, 22 nt, Human
auguuacauaguccuuauuugu

SEQ ID NO: 386439 - RNA, 22 nt, Human
caguuaaaggcccaauaucugg

SEQ ID NO: 386440 - RNA, 22 nt, Human
uacacacaugcauuugccuuau

SEQ ID NO: 386441 - RNA, 22 nt, Human
ucaaaugcugccuuugugugcc

SEQ ID NO: 386442 - RNA, 20 nt, Human
gggugagauguaggagaggg

SEQ ID NO: 386443 - RNA, 22 nt, Human
aggcaguuucugggacagcaua

SEQ ID NO: 386444 - RNA, 22 nt, Human
ucucuuuuauguacacccugac

SEQ ID NO: 386445 - RNA, 22 nt, Human
agcaugaaagcauaggacaguc

SEQ ID NO: 386446 - RNA, 22 nt, Human
ucaaagcaucagucaauuuagg

SEQ ID NO: 386447 - RNA, 22 nt, Human
ccugccugcaccuucucugggg

SEQ ID NO: 386448 - RNA, 22 nt, Human
gcucaaagaauauucagaauga

SEQ ID NO: 386449 - RNA, 22 nt, Human
cugccaggacugacgucuucag

SEQ ID NO: 386450 - RNA, 22 nt, Human
gcaugagggggguuaggaaguu

SEQ ID NO: 386451 - RNA, 22 nt, Human
auauuucuccaaauguuuucaa

SEQ ID NO: 386452 - RNA, 22 nt, Human
gugagggcagcuuggucagugu

SEQ ID NO: 386453 - RNA, 22 nt, Human
gugucccagccccacaggccug

SEQ ID NO: 386454 - RNA, 22 nt, Human
uggagcagccaugaugacagag

SEQ ID NO: 386455 - RNA, 22 nt, Human
cauuaucugccauugacaccau

SEQ ID NO: 386456 - RNA, 22 nt, Human
uggagaagucaaagugaacagg

SEQ ID NO: 386457 - RNA, 22 nt, Human
ggagaaggaauauuggaguagg

SEQ ID NO: 386458 - RNA, 22 nt, Human
ggagccuggccuggcucugugu

SEQ ID NO: 386459 - RNA, 18 nt, Human
gggaucaggcugccuagg

SEQ ID NO: 386460 - RNA, 22 nt, Human
cacagaguggaggcuuggccug

SEQ ID NO: 386461 - RNA, 22 nt, Human
gcagagccaggagagacccuug

SEQ ID NO: 386462 - RNA, 22 nt, Human
gugggcuucuguuagggaggcu

SEQ ID NO: 386463 - RNA, 22 nt, Human
gccucugccaagggggcugcgg

SEQ ID NO: 386464 - RNA, 22 nt, Human
cacagugcaugaugggcagaag

SEQ ID NO: 386465 - RNA, 17 nt, Human
uccaggagaggcaaugg

SEQ ID NO: 386466 - RNA, 22 nt, Human
gcugagagugggugcagugcuu

SEQ ID NO: 386467 - RNA, 19 nt, Human
uccaggagcaaagccaguu

SEQ ID NO: 386468 - RNA, 19 nt, Human
cagaguacaccagauagga

SEQ ID NO: 386469 - RNA, 22 nt, Human
gguugccggggcaggacuggaa

SEQ ID NO: 386470 - RNA, 22 nt, Human
gccuggaguuguggugaagcca

SEQ ID NO: 386471 - RNA, 22 nt, Human
caugcacuuaccugaaauucaa

SEQ ID NO: 386472 - RNA, 22 nt, Human
agggcugagacuaaggccagau

SEQ ID NO: 386473 - RNA, 18 nt, Human
uguacaguuaugagcauu

SEQ ID NO: 386474 - RNA, 20 nt, Human
ucuggcucuuugcuccuccc

SEQ ID NO: 386475 - RNA, 22 nt, Human
ucacacacauggauaguauuuu

SEQ ID NO: 386476 - RNA, 23 nt, Human
gcauugucuccccacuucugggc

SEQ ID NO: 386477 - RNA, 22 nt, Human
uaaugcuuuuccuucaaauaag

SEQ ID NO: 386478 - RNA, 22 nt, Human
uccaguggugguuugaagggca

SEQ ID NO: 386479 - RNA, 18 nt, Human
agucuucugauccauuuu

SEQ ID NO: 386480 - RNA, 22 nt, Human
acagggcaaccucugggagacu

SEQ ID NO: 386481 - RNA, 22 nt, Human
augcuuuuccuaaaaugaugcc

SEQ ID NO: 386482 - RNA, 22 nt, Human
ccagagagaguacugggcucug

SEQ ID NO: 386483 - RNA, 22 nt, Human
aggaugagccgcgcaagcugac

SEQ ID NO: 386484 - RNA, 22 nt, Human
aagcacagaaaaggagcaugga

SEQ ID NO: 386485 - RNA, 22 nt, Human
uggagcccagggugagaaggag

SEQ ID NO: 386486 - RNA, 22 nt, Human
agccagagagccccagguucua

SEQ ID NO: 386487 - RNA, 22 nt, Human
gcucagagaugucugcugccuu

SEQ ID NO: 386488 - RNA, 20 nt, Human
uggcaggaauagggccagag

SEQ ID NO: 386489 - RNA, 22 nt, Human
ucagcuccucaugcaggggaua

SEQ ID NO: 386490 - RNA, 22 nt, Human
caccagguggaaaugucacagc

SEQ ID NO: 386491 - RNA, 22 nt, Human
aaucuuuaaggacucagucucu

SEQ ID NO: 386492 - RNA, 22 nt, Human
agccauccucccaccucagccu

SEQ ID NO: 386493 - RNA, 22 nt, Human
caaaagucuuccuauucucuua

SEQ ID NO: 386494 - RNA, 22 nt, Human
agcuugccucuuaaucaccuca

SEQ ID NO: 386495 - RNA, 22 nt, Human
gcuccagguauuugcccuuuua

SEQ ID NO: 386496 - RNA, 22 nt, Human
ucaggagucugugcaguuccac

SEQ ID NO: 386497 - RNA, 22 nt, Human
gggaggaaaugugcagcgaauu

SEQ ID NO: 386498 - RNA, 22 nt, Human
ugcacauuaguguuugagaugc

SEQ ID NO: 386499 - RNA, 22 nt, Human
cagagcugacccaaggauugaa

SEQ ID NO: 386500 - RNA, 22 nt, Human
ugcaggaagcaaccagguccaa

SEQ ID NO: 386501 - RNA, 22 nt, Human
acucagaaugacugaugcugug

SEQ ID NO: 386502 - RNA, 18 nt, Human
uggcagggaggaaauaua

SEQ ID NO: 386503 - RNA, 22 nt, Human
caucagaaucugagucucugcc

SEQ ID NO: 386504 - RNA, 22 nt, Human
gaggccugaggcugccuggagc

SEQ ID NO: 386505 - RNA, 22 nt, Human
ccagagaguaggaggcauuauu

SEQ ID NO: 386506 - RNA, 22 nt, Human
ccagguggugaaagugggcccu

SEQ ID NO: 386507 - RNA, 19 nt, Human
ggagaagcaucuagaaaua

SEQ ID NO: 386508 - RNA, 22 nt, Human
cugauacauaguagcaugucau

SEQ ID NO: 386509 - RNA, 20 nt, Human
ccuaggcaugcugagucucc

SEQ ID NO: 386510 - RNA, 22 nt, Human
ucccuccuggugagcaggggcu

SEQ ID NO: 386511 - RNA, 22 nt, Human
agggagcuaggauccugaaggu

SEQ ID NO: 386512 - RNA, 22 nt, Human
ccagcucugcagggccuggggu

SEQ ID NO: 386513 - RNA, 22 nt, Human
gcucucuggguggugggcaaca

SEQ ID NO: 386514 - RNA, 20 nt, Human
ucacuaguaaccaucugcuu

SEQ ID NO: 386515 - RNA, 23 nt, Human
gacacaggagcacccagcugagc

SEQ ID NO: 386516 - RNA, 22 nt, Human
uggagaagcuguagguggacuc

SEQ ID NO: 386517 - RNA, 22 nt, Human
uaggccaggacagagcuuccag

SEQ ID NO: 386518 - RNA, 22 nt, Human
aaaugcauugguuucuacuugu

SEQ ID NO: 386519 - RNA, 22 nt, Human
ucuagaaacaugacauugaucu

SEQ ID NO: 386520 - RNA, 22 nt, Human
uuugaaagcaccauuugaguag

SEQ ID NO: 386521 - RNA, 22 nt, Human
gaggaagccccauugaagccag

SEQ ID NO: 386522 - RNA, 22 nt, Human
ucauuuauaaggaugcaauuaa

SEQ ID NO: 386523 - RNA, 21 nt, Human
ggagcugcaggagccgaaggc

SEQ ID NO: 386524 - RNA, 22 nt, Human
uggcuggggagccccgacuccc

SEQ ID NO: 386525 - RNA, 22 nt, Human
gucauuccuauccauuugauac

SEQ ID NO: 386526 - RNA, 22 nt, Human
aaagucaucauuucuuuucaaa

SEQ ID NO: 386527 - RNA, 22 nt, Human
cccaggaagaggggucaggugu

SEQ ID NO: 386528 - RNA, 22 nt, Human
ugcacuggggucccagcgcacg

SEQ ID NO: 386529 - RNA, 22 nt, Human
gagcaggcauucuaguggcuga

SEQ ID NO: 386530 - RNA, 22 nt, Human
agagcuguuuggacaucugagu

SEQ ID NO: 386531 - RNA, 22 nt, Human
cagcuggccugaucccuguggc

SEQ ID NO: 386532 - RNA, 22 nt, Human
aagggcucugggcuacgcacug

SEQ ID NO: 386533 - RNA, 22 nt, Human
agugaaauaaagcugccuaugg

SEQ ID NO: 386534 - RNA, 22 nt, Human
uuuccucuuccgagggggaggc

SEQ ID NO: 386535 - RNA, 22 nt, Human
ggaguaggaguagaacucauca

SEQ ID NO: 386536 - RNA, 22 nt, Human
agccugcaggaugggcagcacc

SEQ ID NO: 386537 - RNA, 22 nt, Human
ugcauuaucuuuaauguucuca

SEQ ID NO: 386538 - RNA, 22 nt, Human
cuuaacagauacaucugugguu

SEQ ID NO: 386539 - RNA, 22 nt, Human
uccaggcaucuguauuuuuuaa

SEQ ID NO: 386540 - RNA, 22 nt, Human
gccagaagggguggauccaggc

SEQ ID NO: 386541 - RNA, 22 nt, Human
aguaaacauaauuuaccuguag

SEQ ID NO: 386542 - RNA, 22 nt, Human
agugacugggcagggcagggcc

SEQ ID NO: 386543 - RNA, 22 nt, Human
aguaaacaguaucuuuaguguc

SEQ ID NO: 386544 - RNA, 22 nt, Human
cagagugaacagugggaugugc

SEQ ID NO: 386545 - RNA, 22 nt, Human
gccugguguccagaggcgagug

SEQ ID NO: 386546 - RNA, 22 nt, Human
uuaaacagagucugaaauguaa

SEQ ID NO: 386547 - RNA, 23 nt, Human
ugggucagcugccuccaggacaa

SEQ ID NO: 386548 - RNA, 22 nt, Human
uaucuauuccaaauaucagcgu

SEQ ID NO: 386549 - RNA, 22 nt, Human
agaggggaaguaaugaaugaua

SEQ ID NO: 386550 - RNA, 22 nt, Human
agugaaauuccuggucuuuguu

SEQ ID NO: 386551 - RNA, 22 nt, Human
cagcuuuagagaaaacauauuu

SEQ ID NO: 386552 - RNA, 22 nt, Human
aggcacuggguaauuaguagcu

SEQ ID NO: 386553 - RNA, 22 nt, Human
uggccuuguguuuuagagaaag

SEQ ID NO: 386554 - RNA, 22 nt, Human
cugagauggaguuucgcucuuc

SEQ ID NO: 386555 - RNA, 22 nt, Human
uggccugccccgagauccuggc

SEQ ID NO: 386556 - RNA, 22 nt, Human
ccagggugggguccaggaacca

SEQ ID NO: 386557 - RNA, 22 nt, Human
auuuuacuuugugaauauugac

SEQ ID NO: 386558 - RNA, 19 nt, Human
ccagagagcuagguacaga

SEQ ID NO: 386559 - RNA, 22 nt, Human
agaggccuuucuguugagugaa

SEQ ID NO: 386560 - RNA, 22 nt, Human
uuguuugaggucacugauauuu

SEQ ID NO: 386561 - RNA, 19 nt, Human
ucuaacagaagugucgucc

SEQ ID NO: 386562 - RNA, 22 nt, Human
gcccuggaaucucuccauggga

SEQ ID NO: 386563 - RNA, 22 nt, Human
cagagugaaaacugagcucaaa

SEQ ID NO: 386564 - RNA, 22 nt, Human
ugucucuggcccaugagcagag

SEQ ID NO: 386565 - RNA, 22 nt, Human
cuuauguauauuuggaacguac

SEQ ID NO: 386566 - RNA, 22 nt, Human
aagggcucucugcauugaaauu

SEQ ID NO: 386567 - RNA, 22 nt, Human
aagucagcacuccaggaagcca

SEQ ID NO: 386568 - RNA, 22 nt, Human
aggcacuguggguguggccgga

SEQ ID NO: 386569 - RNA, 22 nt, Human
ccugucauacuaacguaguggg

SEQ ID NO: 386570 - RNA, 22 nt, Human
uccuucagcuuauuucuuagga

SEQ ID NO: 386571 - RNA, 22 nt, Human
ugggcagaaugugggauccaga

SEQ ID NO: 386572 - RNA, 22 nt, Human
agaggcagccguauuucaaagg

SEQ ID NO: 386573 - RNA, 22 nt, Human
ucaccaggauugggcuguaggc

SEQ ID NO: 386574 - RNA, 21 nt, Human
ucauucacaggguauuguaua

SEQ ID NO: 386575 - RNA, 22 nt, Human
ucugggcugggagcguguggac

SEQ ID NO: 386576 - RNA, 22 nt, Human
aggcccugcccagagcuccucg

SEQ ID NO: 386577 - RNA, 22 nt, Human
agggaggucuuugaggggcuua

SEQ ID NO: 386578 - RNA, 22 nt, Human
ugaaugaguuuggcugcuguuc

SEQ ID NO: 386579 - RNA, 22 nt, Human
ucagcuuuugucagaaauugua

SEQ ID NO: 386580 - RNA, 22 nt, Human
aaauguguuuagaugguuuauu

SEQ ID NO: 386581 - RNA, 22 nt, Human
gcagagcaccaaagugaaagau

SEQ ID NO: 386582 - RNA, 22 nt, Human
uucagaaacccauugggucucu

SEQ ID NO: 386583 - RNA, 22 nt, Human
acagaauugaaaguauaaucug

SEQ ID NO: 386584 - RNA, 22 nt, Human
ccugggugaugugcugcccucg

SEQ ID NO: 386585 - RNA, 22 nt, Human
uuugacaaaggaaaaaugcaca

SEQ ID NO: 386586 - RNA, 22 nt, Human
cauugcacuucugcuuuuccuc

SEQ ID NO: 386587 - RNA, 22 nt, Human
cauaugaaauaugaguugaaca

SEQ ID NO: 386588 - RNA, 22 nt, Human
cagcugacccagugaggaggca

SEQ ID NO: 386589 - RNA, 22 nt, Human
uuuaucuuuaggacuuugcaga

SEQ ID NO: 386590 - RNA, 21 nt, Human
aaaggccauaaucacggagca

SEQ ID NO: 386591 - RNA, 22 nt, Human
cugccagguuggcgcucgcucu

SEQ ID NO: 386592 - RNA, 22 nt, Human
aaucccagcuacucaggaaguu

SEQ ID NO: 386593 - RNA, 22 nt, Human
uuccaaagugcuggaauuacau

SEQ ID NO: 386594 - RNA, 22 nt, Human
uggcaggaaaaacauuggagau

SEQ ID NO: 386595 - RNA, 22 nt, Human
agcucccugagaugccacagca

SEQ ID NO: 386596 - RNA, 17 nt, Human
gcgcagcuccuggcgcg

SEQ ID NO: 386597 - RNA, 22 nt, Human
agcagcauguaugagggugaac

SEQ ID NO: 386598 - RNA, 19 nt, Human
gcugucugaugcugagguc

SEQ ID NO: 386599 - RNA, 22 nt, Human
cacaucuucuuaacuccaaagu

SEQ ID NO: 386600 - RNA, 19 nt, Human
acagcagggauuuuuggag

SEQ ID NO: 386601 - RNA, 22 nt, Human
uggggugggcaugcgcuguccu

SEQ ID NO: 386602 - RNA, 22 nt, Human
ucuuugcagaauuuaacuuugc

SEQ ID NO: 386603 - RNA, 22 nt, Human
gaggaaccaaaucagcuugcac

SEQ ID NO: 386604 - RNA, 22 nt, Human
cauuuguaguaucuguuuauau

SEQ ID NO: 386605 - RNA, 22 nt, Human
aagcagccuggacuugggcugg

SEQ ID NO: 386606 - RNA, 22 nt, Human
gccuuggccaacaccuugcaaa

SEQ ID NO: 386607 - RNA, 22 nt, Human
uucauuccuucuguaccuugcc

SEQ ID NO: 386608 - RNA, 23 nt, Human
ccacagagcugccaauuccugug

SEQ ID NO: 386609 - RNA, 22 nt, Human
uuucacaaucaaauggugaaau

SEQ ID NO: 386610 - RNA, 22 nt, Human
agagaacaaauuaaaggugguu

SEQ ID NO: 386611 - RNA, 22 nt, Human
gcagcuuuggagguggaacucu

SEQ ID NO: 386612 - RNA, 21 nt, Human
aauuacagauggaauuacaga

SEQ ID NO: 386613 - RNA, 22 nt, Human
ucucagagagaugaaacuucca

SEQ ID NO: 386614 - RNA, 22 nt, Human
ucucccacgguacaggauaaac

SEQ ID NO: 386615 - RNA, 22 nt, Human
cuguguuggcuuuucucuugua

SEQ ID NO: 386616 - RNA, 18 nt, Human
gaaagccaugcagcagug

SEQ ID NO: 386617 - RNA, 22 nt, Human
gcaggagcucguuuccaggcug

SEQ ID NO: 386618 - RNA, 22 nt, Human
aaggacuccaauucuuucaucu

SEQ ID NO: 386619 - RNA, 22 nt, Human
gauggcuucacuuacauggcug

SEQ ID NO: 386620 - RNA, 22 nt, Human
cacagcauaaugaaauauacuu

SEQ ID NO: 386621 - RNA, 22 nt, Human
agagcuuauaucuuggccaucc

SEQ ID NO: 386622 - RNA, 21 nt, Human
agguggggcugcaccucugcu

SEQ ID NO: 386623 - RNA, 22 nt, Human
gaggccagcgcgcagcacuuuu

SEQ ID NO: 386624 - RNA, 19 nt, Human
uggagacugagagugagca

SEQ ID NO: 386625 - RNA, 22 nt, Human
gggggcaguaaccucaaagugu

SEQ ID NO: 386626 - RNA, 23 nt, Human
aaucuauacuuaggcugguaaua

SEQ ID NO: 386627 - RNA, 21 nt, Human
aggcagcuggaaggccuggcu

SEQ ID NO: 386628 - RNA, 18 nt, Human
uuccaugauuccuuucac

SEQ ID NO: 386629 - RNA, 21 nt, Human
uccagaaaagaggucauuagc

SEQ ID NO: 386630 - RNA, 22 nt, Human
gaaggccaagaggcuccaagau

SEQ ID NO: 386631 - RNA, 22 nt, Human
gaggcagagucacaaagagucu

SEQ ID NO: 386632 - RNA, 22 nt, Human
guucucucugcuuccaagaugg

SEQ ID NO: 386633 - RNA, 20 nt, Human
guggcaggcagugaaggagc

SEQ ID NO: 386634 - RNA, 22 nt, Human
uagccgcuuaauuauuugguga

SEQ ID NO: 386635 - RNA, 22 nt, Human
gccuuucaguuccaucaaagga

SEQ ID NO: 386636 - RNA, 22 nt, Human
gggaagcagcauugugcuggcu

SEQ ID NO: 386637 - RNA, 21 nt, Human
ucucugggcccuccugugggg

SEQ ID NO: 386638 - RNA, 22 nt, Human
gguagcacauugcauuaggaga

SEQ ID NO: 386639 - RNA, 22 nt, Human
acuuucugcaguguuggaaaug

SEQ ID NO: 386640 - RNA, 22 nt, Human
cuggagagggagcccuggcagu

SEQ ID NO: 386641 - RNA, 22 nt, Human
cauucacagagggggaagcauc

SEQ ID NO: 386642 - RNA, 22 nt, Human
gggagagagaaaacguggcgca

SEQ ID NO: 386643 - RNA, 20 nt, Human
uguuccaugacuauuuggau

SEQ ID NO: 386644 - RNA, 22 nt, Human
uccuauugguagacauuucugu

SEQ ID NO: 386645 - RNA, 22 nt, Human
gggcugcuuuuaagggucucag

SEQ ID NO: 386646 - RNA, 22 nt, Human
cugcuggggucagagcacuggg

SEQ ID NO: 386647 - RNA, 22 nt, Human
cacaggagcuguggggcagugu

SEQ ID NO: 386648 - RNA, 22 nt, Human
guggcagggugcucaucaugca

SEQ ID NO: 386649 - RNA, 22 nt, Human
gccaugcuugguaugcugugag

SEQ ID NO: 386650 - RNA, 22 nt, Human
gagcugccuacauugccaagag

SEQ ID NO: 386651 - RNA, 22 nt, Human
ggcccugggcagaggagugggc

SEQ ID NO: 386652 - RNA, 22 nt, Human
aggcugaaaacgagauggcaau

SEQ ID NO: 386653 - RNA, 22 nt, Human
auguggaggaaaugaguguaca

SEQ ID NO: 386654 - RNA, 22 nt, Human
ucaggcugcccguucagggcuc

SEQ ID NO: 386655 - RNA, 22 nt, Human
ugcacagugaccccuggugacu

SEQ ID NO: 386656 - RNA, 22 nt, Human
ugggccaggauuucaagacccu

SEQ ID NO: 386657 - RNA, 22 nt, Human
uggcugcucaagggaggaggcu

SEQ ID NO: 386658 - RNA, 22 nt, Human
ucccagacaaucauuggccacc

SEQ ID NO: 386659 - RNA, 22 nt, Human
cagcuggcaaguggagcagggu

SEQ ID NO: 386660 - RNA, 22 nt, Human
cugccuuggaaaaugugguaau

SEQ ID NO: 386661 - RNA, 17 nt, Human
gcuguaguuugauaaga

SEQ ID NO: 386662 - RNA, 22 nt, Human
aucaggaugcugucaguuacca

SEQ ID NO: 386663 - RNA, 22 nt, Human
ggaccuggcaauuugcaucucu

SEQ ID NO: 386664 - RNA, 22 nt, Human
gcagaggcaaucagguaugugg

SEQ ID NO: 386665 - RNA, 20 nt, Human
agacccuguguccuguggcc

SEQ ID NO: 386666 - RNA, 22 nt, Human
acagcagggggagcuguuggac

SEQ ID NO: 386667 - RNA, 22 nt, Human
guguaauugaaauugagaacca

SEQ ID NO: 386668 - RNA, 22 nt, Human
gcuguggcuguacagagaccau

SEQ ID NO: 386669 - RNA, 22 nt, Human
auuggcaggaaccgaggagggg

SEQ ID NO: 386670 - RNA, 22 nt, Human
gcuguggucugugagcuccaaa

SEQ ID NO: 386671 - RNA, 22 nt, Human
aggucaggguauucacgucugu

SEQ ID NO: 386672 - RNA, 22 nt, Human
uccugcaggccuguucccagua

SEQ ID NO: 386673 - RNA, 22 nt, Human
cccuggagugugacgaggcauu

SEQ ID NO: 386674 - RNA, 22 nt, Human
gcucuggaagcaucugagagga

SEQ ID NO: 386675 - RNA, 22 nt, Human
ggccccaggaccuccacggucc

SEQ ID NO: 386676 - RNA, 22 nt, Human
ucagaggucacacagcaaguuu

SEQ ID NO: 386677 - RNA, 22 nt, Human
guuauguaugagggaaugauua

SEQ ID NO: 386678 - RNA, 19 nt, Human
acaaaugauguugcacuga

SEQ ID NO: 386679 - RNA, 22 nt, Human
cugaggucaauuaaucaacaac

SEQ ID NO: 386680 - RNA, 22 nt, Human
aucagcaucuuuaacaauuacc

SEQ ID NO: 386681 - RNA, 22 nt, Human
aggcucagcccaagguggagag

SEQ ID NO: 386682 - RNA, 22 nt, Human
auggacaggaacucccuuggca

SEQ ID NO: 386683 - RNA, 22 nt, Human
aaacuuuguucgucugaugugg

SEQ ID NO: 386684 - RNA, 23 nt, Human
ucaggauauugugugccaaggug

SEQ ID NO: 386685 - RNA, 23 nt, Human
aaaguugauuugcaguuuaagag

SEQ ID NO: 386686 - RNA, 22 nt, Human
aggaagcugcuggaguagugug

SEQ ID NO: 386687 - RNA, 22 nt, Human
agggcugcccagugugagagcu

SEQ ID NO: 386688 - RNA, 18 nt, Human
ucuggcucaggacugaac

SEQ ID NO: 386689 - RNA, 19 nt, Human
cucugccucuggcuguggc

SEQ ID NO: 386690 - RNA, 22 nt, Human
cagaauaugacaagauuuuccu

SEQ ID NO: 386691 - RNA, 22 nt, Human
acagagagguaaaauauauagu

SEQ ID NO: 386692 - RNA, 22 nt, Human
cccucccagaugggcuugaggu

SEQ ID NO: 386693 - RNA, 22 nt, Human
gcuggccagggcugcucgcgga

SEQ ID NO: 386694 - RNA, 22 nt, Human
uaaugugugucaucaguagagu

SEQ ID NO: 386695 - RNA, 22 nt, Human
cuaaagaagcuagcaaucuaua

SEQ ID NO: 386696 - RNA, 22 nt, Human
augguuuuccucugcugcuuaa

SEQ ID NO: 386697 - RNA, 22 nt, Human
ucuggcucccagccugcucuca

SEQ ID NO: 386698 - RNA, 22 nt, Human
ugcugugguucccagaguggau

SEQ ID NO: 386699 - RNA, 22 nt, Human
acugggccuggauuggcguguc

SEQ ID NO: 386700 - RNA, 22 nt, Human
augaggcaucugcagucacuag

SEQ ID NO: 386701 - RNA, 18 nt, Human
caggaugagugaugggga

SEQ ID NO: 386702 - RNA, 22 nt, Human
auggaucagaaucccgggaggg

SEQ ID NO: 386703 - RNA, 22 nt, Human
agcaggagaacacuguggcucu

SEQ ID NO: 386704 - RNA, 22 nt, Human
uuucucugaggcuggccucccu

SEQ ID NO: 386705 - RNA, 22 nt, Human
uuagaaaggagcuuauuucuuu

SEQ ID NO: 386706 - RNA, 22 nt, Human
agaggaggcuggguccagauaa

SEQ ID NO: 386707 - RNA, 22 nt, Human
ugucuuccucuuggcuugagcu

SEQ ID NO: 386708 - RNA, 22 nt, Human
aucacauuguuagcauagacug

SEQ ID NO: 386709 - RNA, 22 nt, Human
caggcagaaggaaguaccaggc

SEQ ID NO: 386710 - RNA, 22 nt, Human
cugaauaaagcccucgcgcgcu

SEQ ID NO: 386711 - RNA, 18 nt, Human
ugugaacacauuuuucug

SEQ ID NO: 386712 - RNA, 22 nt, Human
cucagcccagcccaggaccagg

SEQ ID NO: 386713 - RNA, 22 nt, Human
ucacagaacaauguuuaguucu

SEQ ID NO: 386714 - RNA, 22 nt, Human
gucuuguuugggauguggaugg

SEQ ID NO: 386715 - RNA, 22 nt, Human
ugaaagguagcuggccucauag

SEQ ID NO: 386716 - RNA, 22 nt, Human
aaaugcuagggagaaacucucc

SEQ ID NO: 386717 - RNA, 22 nt, Human
ucucugagguuguuuccagcac

SEQ ID NO: 386718 - RNA, 22 nt, Human
caaagucagccagcuaguaggu

SEQ ID NO: 386719 - RNA, 22 nt, Human
gggcacugcuuugcucugucac

SEQ ID NO: 386720 - RNA, 22 nt, Human
cacauaauaaauguuccugaug

SEQ ID NO: 386721 - RNA, 22 nt, Human
uagacagauuucuuguuagaca

SEQ ID NO: 386722 - RNA, 22 nt, Human
uggagauggguuaauggagaga

SEQ ID NO: 386723 - RNA, 22 nt, Human
ugcaggaauagcuacagagcug

SEQ ID NO: 386724 - RNA, 22 nt, Human
aaugauguauuaguacaacaca

SEQ ID NO: 386725 - RNA, 22 nt, Human
cagcaggauaugguggagagag

SEQ ID NO: 386726 - RNA, 22 nt, Human
ugucucugugacuccuuccgcc

SEQ ID NO: 386727 - RNA, 22 nt, Human
gcugcagcagcugcaggguugu

SEQ ID NO: 386728 - RNA, 22 nt, Human
cugcccugcccaggccuugggc

SEQ ID NO: 386729 - RNA, 22 nt, Human
gauuucaagcccccagagauuc

SEQ ID NO: 386730 - RNA, 22 nt, Human
ccagcugaggcagccacacagg

SEQ ID NO: 386731 - RNA, 22 nt, Human
cagcaggaccauugaggcauca

SEQ ID NO: 386732 - RNA, 17 nt, Human
cugaagauaauggcaac

SEQ ID NO: 386733 - RNA, 22 nt, Human
aaggggaaguagcaccagaggu

SEQ ID NO: 386734 - RNA, 22 nt, Human
cauuaucucuucuauaugcuag

SEQ ID NO: 386735 - RNA, 22 nt, Human
aaauuguugaucuacaguaagg

SEQ ID NO: 386736 - RNA, 22 nt, Human
ugcucugguaacucacuuccau

SEQ ID NO: 386737 - RNA, 22 nt, Human
uuugaaagggacaaagucacug

SEQ ID NO: 386738 - RNA, 22 nt, Human
uucaugaaaguguaucuugugg

SEQ ID NO: 386739 - RNA, 22 nt, Human
aaagauuucacaucccaagccu

SEQ ID NO: 386740 - RNA, 22 nt, Human
acacugugucuagcauuuuaca

SEQ ID NO: 386741 - RNA, 22 nt, Human
augacagaggagugcaggugau

SEQ ID NO: 386742 - RNA, 22 nt, Human
ccaggccaaauucagucagcag

SEQ ID NO: 386743 - RNA, 22 nt, Human
cauuugcaagagauaaauguuu

SEQ ID NO: 386744 - RNA, 22 nt, Human
gccacugcacuccagcccaggc

SEQ ID NO: 386745 - RNA, 22 nt, Human
aagccaggccauucucugguuc

SEQ ID NO: 386746 - RNA, 22 nt, Human
auaauuuaauuuucacaguggu

SEQ ID NO: 386747 - RNA, 22 nt, Human
gcugccuguugaagggucugug

SEQ ID NO: 386748 - RNA, 22 nt, Human
uccugccucacaguugaaguuu

SEQ ID NO: 386749 - RNA, 22 nt, Human
agcugccgaugcccagcugcau

SEQ ID NO: 386750 - RNA, 22 nt, Human
aauaaugucuuuggcuugacca

SEQ ID NO: 386751 - RNA, 22 nt, Human
agcuguggcaaccuugucagac

SEQ ID NO: 386752 - RNA, 22 nt, Human
aggucaaggccaaaagaguggu

SEQ ID NO: 386753 - RNA, 21 nt, Human
aggcaucuaaagagaguagac

SEQ ID NO: 386754 - RNA, 22 nt, Human
uuagaaacccagacucuuaggu

SEQ ID NO: 386755 - RNA, 22 nt, Human
aaaguguaaaagcauguuaggg

SEQ ID NO: 386756 - RNA, 18 nt, Human
uggcaggaaaugcacuuu

SEQ ID NO: 386757 - RNA, 22 nt, Human
agagggcuggacgcagguugga

SEQ ID NO: 386758 - RNA, 22 nt, Human
gugugcagaagacacaagacau

SEQ ID NO: 386759 - RNA, 22 nt, Human
aggcacugaaggaagcuugcgc

SEQ ID NO: 386760 - RNA, 22 nt, Human
gggaccugaggcccugcuccac

SEQ ID NO: 386761 - RNA, 22 nt, Human
acaaagucugaaaccugaggca

SEQ ID NO: 386762 - RNA, 22 nt, Human
uggcagaguucgcugugccuuu

SEQ ID NO: 386763 - RNA, 22 nt, Human
auauaugcauguguacuuaugu

SEQ ID NO: 386764 - RNA, 22 nt, Human
cuuagaaaugcagauucucagg

SEQ ID NO: 386765 - RNA, 20 nt, Human
ucucugagcuucucuugggg

SEQ ID NO: 386766 - RNA, 22 nt, Human
cugcugcugcuaucuacccagg

SEQ ID NO: 386767 - RNA, 22 nt, Human
ugccucuguggaaauggugguc

SEQ ID NO: 386768 - RNA, 22 nt, Human
ccugugaggucaucugugguaa

SEQ ID NO: 386769 - RNA, 22 nt, Human
ucaaaggcccauugucccguug

SEQ ID NO: 386770 - RNA, 22 nt, Human
cacugaaggacaguaggaaggg

SEQ ID NO: 386771 - RNA, 22 nt, Human
gaguccuuuguuccuugccaca

SEQ ID NO: 386772 - RNA, 22 nt, Human
aggcagaccaugaaucaugacc

SEQ ID NO: 386773 - RNA, 22 nt, Human
cugggcacuuuggggagccuac

SEQ ID NO: 386774 - RNA, 22 nt, Human
ucccagagccaagcuauggaug

SEQ ID NO: 386775 - RNA, 22 nt, Human
uagggcagagcuuguacacgau

SEQ ID NO: 386776 - RNA, 22 nt, Human
ugaggcucaaggucugguggag

SEQ ID NO: 386777 - RNA, 22 nt, Human
caguggccaugguggcaggggu

SEQ ID NO: 386778 - RNA, 22 nt, Human
ucugaaggucugagaaccagga

SEQ ID NO: 386779 - RNA, 22 nt, Human
uccaggagggguaggcaguaug

SEQ ID NO: 386780 - RNA, 22 nt, Human
uggcccugccacucacugcuga

SEQ ID NO: 386781 - RNA, 22 nt, Human
gccuuuuuuguugcucugucac

SEQ ID NO: 386782 - RNA, 22 nt, Human
aaggcagaaagggaugugagug

SEQ ID NO: 386783 - RNA, 18 nt, Human
gaaaugugauucuagggc

SEQ ID NO: 386784 - RNA, 22 nt, Human
agcagaacugaugagacuugag

SEQ ID NO: 386785 - RNA, 22 nt, Human
gcugccaguguggcaugaugca

SEQ ID NO: 386786 - RNA, 22 nt, Human
ugaccaaagaguugcuuguauu

SEQ ID NO: 386787 - RNA, 22 nt, Human
ugguuuauuucucugaaagguu

SEQ ID NO: 386788 - RNA, 22 nt, Human
uccuggaggcaaaugagcacau

SEQ ID NO: 386789 - RNA, 22 nt, Human
ggaggggucucuagcgaggaga

SEQ ID NO: 386790 - RNA, 22 nt, Human
gaaugaaagauuugcauucuau

SEQ ID NO: 386791 - RNA, 22 nt, Human
ucagggcaagauugguuaauaa

SEQ ID NO: 386792 - RNA, 22 nt, Human
uguggcugcucaggugcagacc

SEQ ID NO: 386793 - RNA, 22 nt, Human
acaggauuagcaaguaaucagg

SEQ ID NO: 386794 - RNA, 22 nt, Human
gcagugggaagguuggcacaug

SEQ ID NO: 386795 - RNA, 22 nt, Human
cugccucuauaggaguccacca

SEQ ID NO: 386796 - RNA, 22 nt, Human
cagcaggaaguacuagcuuuga

SEQ ID NO: 386797 - RNA, 22 nt, Human
aggcgugggaggaucugaggcc

SEQ ID NO: 386798 - RNA, 20 nt, Human
gcccaagguccagaaggggg

SEQ ID NO: 386799 - RNA, 22 nt, Human
ucuggcucuuugggugauugua

SEQ ID NO: 386800 - RNA, 22 nt, Human
uuagccauuaaauuacaaggug

SEQ ID NO: 386801 - RNA, 22 nt, Human
cuguuuauuacacuggauagca

SEQ ID NO: 386802 - RNA, 22 nt, Human
gcugucugggaugucacugcug

SEQ ID NO: 386803 - RNA, 22 nt, Human
uuauaugaguaucauaucacuu

SEQ ID NO: 386804 - RNA, 22 nt, Human
caggcagcugcgacaagagagc

SEQ ID NO: 386805 - RNA, 22 nt, Human
uugcagcugcaguaaauguuca

SEQ ID NO: 386806 - RNA, 22 nt, Human
ccagggccaguaagauuggcau

SEQ ID NO: 386807 - RNA, 22 nt, Human
acaggcuguugggguccagggu

SEQ ID NO: 386808 - RNA, 22 nt, Human
uaauuuaauuucaugccagccu

SEQ ID NO: 386809 - RNA, 22 nt, Human
gaggaaaauauucagggagguu

SEQ ID NO: 386810 - RNA, 22 nt, Human
cugggccagcaacugcaaugga

SEQ ID NO: 386811 - RNA, 22 nt, Human
ccacagcugaccgcaggugagc

SEQ ID NO: 386812 - RNA, 22 nt, Human
ucagaggacaagcucccuggug

SEQ ID NO: 386813 - RNA, 22 nt, Human
aagaaucauccugcaagagucu

SEQ ID NO: 386814 - RNA, 22 nt, Human
cugugcaagacuuacuuuaaua

SEQ ID NO: 386815 - RNA, 22 nt, Human
uggagcaggcaucuuucucucu

SEQ ID NO: 386816 - RNA, 22 nt, Human
gcgucugaguugcgggggcuca

SEQ ID NO: 386817 - RNA, 22 nt, Human
agccuccaaaugucaggucccg

SEQ ID NO: 386818 - RNA, 22 nt, Human
augguuuuguccucuuugguuc

SEQ ID NO: 386819 - RNA, 22 nt, Human
aaggcacugaaaaauugugugu

SEQ ID NO: 386820 - RNA, 22 nt, Human
ccuaggcccuaggcuuccauca

SEQ ID NO: 386821 - RNA, 22 nt, Human
agcagggccuggcacuccuggg

SEQ ID NO: 386822 - RNA, 22 nt, Human
uccaggcuggacaugaggcggg

SEQ ID NO: 386823 - RNA, 22 nt, Human
acagccuguguaccagcuggga

SEQ ID NO: 386824 - RNA, 22 nt, Human
guuugcauauuugcacaggaau

SEQ ID NO: 386825 - RNA, 22 nt, Human
aaaugcacagaaaggaugugga

SEQ ID NO: 386826 - RNA, 22 nt, Human
uuuguucaugccuauauucuca

SEQ ID NO: 386827 - RNA, 22 nt, Human
guggguggaggcgucgagggca

SEQ ID NO: 386828 - RNA, 22 nt, Human
cacaggaaugaacagggaaaga

SEQ ID NO: 386829 - RNA, 22 nt, Human
agagccugugauugucaucacc

SEQ ID NO: 386830 - RNA, 22 nt, Human
gccugccuggagcuugagguga

SEQ ID NO: 386831 - RNA, 22 nt, Human
cuucucuucccagggacacagg

SEQ ID NO: 386832 - RNA, 22 nt, Human
aaggcuaugaucuuuuucauga

SEQ ID NO: 386833 - RNA, 22 nt, Human
auaucacaguaguuguuuaguu

SEQ ID NO: 386834 - RNA, 22 nt, Human
gaguguucccacaccccaguug

SEQ ID NO: 386835 - RNA, 21 nt, Human
gcugcccaacccugcaucucc

SEQ ID NO: 386836 - RNA, 22 nt, Human
gaucagaaugggacauauccug

SEQ ID NO: 386837 - RNA, 22 nt, Human
uuggaaggugagucccuggguu

SEQ ID NO: 386838 - RNA, 22 nt, Human
aagagguaaccauagcaaccac

SEQ ID NO: 386839 - RNA, 22 nt, Human
aaggccauuauucugauauauu

SEQ ID NO: 386840 - RNA, 22 nt, Human
ucuggcucugacacuacuguua

SEQ ID NO: 386841 - RNA, 22 nt, Human
gucuggaggaggaagaaggcac

SEQ ID NO: 386842 - RNA, 22 nt, Human
gacuuucucuccucccaggugu

SEQ ID NO: 386843 - RNA, 22 nt, Human
gggccuggggacaccaccauga

SEQ ID NO: 386844 - RNA, 22 nt, Human
uccaugaggcagggaggcuggc

SEQ ID NO: 386845 - RNA, 22 nt, Human
gccuggagcuacuggacacuga

SEQ ID NO: 386846 - RNA, 20 nt, Human
ugcagggccuaaaaagggaa

SEQ ID NO: 386847 - RNA, 22 nt, Human
gguggccucugcaggccucgac

SEQ ID NO: 386848 - RNA, 22 nt, Human
ccagcuccuucugucuguggag

SEQ ID NO: 386849 - RNA, 22 nt, Human
cagcaggguagguuguaucagu

SEQ ID NO: 386850 - RNA, 22 nt, Human
acaaaugccauauauaaauucu

SEQ ID NO: 386851 - RNA, 22 nt, Human
cagcugugcuguauuaagcucu

SEQ ID NO: 386852 - RNA, 22 nt, Human
aaucuucuacuugacaguucuc

SEQ ID NO: 386853 - RNA, 17 nt, Human
ccuuucucuuucaucuc

SEQ ID NO: 386854 - RNA, 22 nt, Human
agaugcugggaggcugagugca

SEQ ID NO: 386855 - RNA, 22 nt, Human
cccucuggcucuucucaggccg

SEQ ID NO: 386856 - RNA, 22 nt, Human
caaucaguaaccggaucauggu

SEQ ID NO: 386857 - RNA, 22 nt, Human
ggaugcugggagacagcaggca

SEQ ID NO: 386858 - RNA, 22 nt, Human
ggcucugcagugacuugagggg

SEQ ID NO: 386859 - RNA, 22 nt, Human
ucacugcugcugccaugaugga

SEQ ID NO: 386860 - RNA, 22 nt, Human
agacaucauguuacagauuaag

SEQ ID NO: 386861 - RNA, 22 nt, Human
acugaaggguaaugugggagcc

SEQ ID NO: 386862 - RNA, 22 nt, Human
gaauuucaagcagugcaauguu

SEQ ID NO: 386863 - RNA, 22 nt, Human
ucuuuucaucauuuaauaggua

SEQ ID NO: 386864 - RNA, 22 nt, Human
cauuuguuuagaagucuuuaua

SEQ ID NO: 386865 - RNA, 23 nt, Human
uggaauaauaagguacauuaaca

SEQ ID NO: 386866 - RNA, 23 nt, Human
uccaagggcuacaaacacagacc

SEQ ID NO: 386867 - RNA, 22 nt, Human
gauauuuugagaaauccuauga

SEQ ID NO: 386868 - RNA, 22 nt, Human
ggugcagaaggaagggagcugg

SEQ ID NO: 386869 - RNA, 20 nt, Human
accauaauguuaauuacaaa

SEQ ID NO: 386870 - RNA, 22 nt, Human
ccagcuuuccugcgaguugauu

SEQ ID NO: 386871 - RNA, 22 nt, Human
uuugaauagaggccccucagaa

SEQ ID NO: 386872 - RNA, 22 nt, Human
caucauaaaauugagauaacug

SEQ ID NO: 386873 - RNA, 22 nt, Human
ucaccaggcuccuguuaagaug

SEQ ID NO: 386874 - RNA, 22 nt, Human
gaggaagaagggauuagaacuc

SEQ ID NO: 386875 - RNA, 22 nt, Human
aaguccuuggagaauagaaagg

SEQ ID NO: 386876 - RNA, 23 nt, Human
ucucagaggauuccugggccuug

SEQ ID NO: 386877 - RNA, 22 nt, Human
ugugggcucccccucacucugu

SEQ ID NO: 386878 - RNA, 22 nt, Human
acacuguguggucucucucgga

SEQ ID NO: 386879 - RNA, 17 nt, Human
agccgggcauggaccag

SEQ ID NO: 386880 - RNA, 22 nt, Human
ccagcaccuugaucuuggaguu

SEQ ID NO: 386881 - RNA, 22 nt, Human
aauauccacacugugucccugc

SEQ ID NO: 386882 - RNA, 22 nt, Human
gagaagccgagucagcugagcc

SEQ ID NO: 386883 - RNA, 22 nt, Human
uaggcagcgcuuggcugugcuu

SEQ ID NO: 386884 - RNA, 17 nt, Human
uggcacagaggugcuau

SEQ ID NO: 386885 - RNA, 22 nt, Human
gcccaugcacuuucugugaugg

SEQ ID NO: 386886 - RNA, 22 nt, Human
cagaaucagcccuugcuauuaa

SEQ ID NO: 386887 - RNA, 22 nt, Human
uaaagccaauauaccuagcaua

SEQ ID NO: 386888 - RNA, 22 nt, Human
auaauguagguauguguauuua

SEQ ID NO: 386889 - RNA, 22 nt, Human
cugccuggggaaugugaggauu

SEQ ID NO: 386890 - RNA, 22 nt, Human
cugaaggauuuaguucuuugcu

SEQ ID NO: 386891 - RNA, 22 nt, Human
uucaggaugcucagaguagucu

SEQ ID NO: 386892 - RNA, 22 nt, Human
gcucagccgaacuucagagcag

SEQ ID NO: 386893 - RNA, 22 nt, Human
aggguggggugcuacaucuuua

SEQ ID NO: 386894 - RNA, 22 nt, Human
caaggccauauugccuguaugu

SEQ ID NO: 386895 - RNA, 22 nt, Human
gacuaugugaagugugaauagg

SEQ ID NO: 386896 - RNA, 22 nt, Human
ggggcagaguagcuggggugug

SEQ ID NO: 386897 - RNA, 22 nt, Human
ggugaggaaagauggugacagu

SEQ ID NO: 386898 - RNA, 22 nt, Human
accagagauggggcuucucugu

SEQ ID NO: 386899 - RNA, 22 nt, Human
gugugccaacaaaagacagugc

SEQ ID NO: 386900 - RNA, 22 nt, Human
gaggggaagacuucuggacagu

SEQ ID NO: 386901 - RNA, 22 nt, Human
gccagaagacuggagucagcug

SEQ ID NO: 386902 - RNA, 16 nt, Human
aaggagggaagagaau

SEQ ID NO: 386903 - RNA, 20 nt, Human
gcuuccuucccagcccccac

SEQ ID NO: 386904 - RNA, 22 nt, Human
uugaauaguguuuucaguauac

SEQ ID NO: 386905 - RNA, 22 nt, Human
uacauauuugucuuuguacugu

SEQ ID NO: 386906 - RNA, 20 nt, Human
agaguaacuggcacauaggg

SEQ ID NO: 386907 - RNA, 22 nt, Human
uuugaauaaucacugggcauua

SEQ ID NO: 386908 - RNA, 22 nt, Human
cugggcuguaauguggcacuga

SEQ ID NO: 386909 - RNA, 22 nt, Human
uggcagagucugggcuugggca

SEQ ID NO: 386910 - RNA, 22 nt, Human
aguguguccagaaaucuguauu

SEQ ID NO: 386911 - RNA, 22 nt, Human
uccugccuagcaggugaccuau

SEQ ID NO: 386912 - RNA, 20 nt, Human
acauugauuauguuuguaga

SEQ ID NO: 386913 - RNA, 22 nt, Human
aauucuugguccuaguguauaa

SEQ ID NO: 386914 - RNA, 22 nt, Human
aggcccagagcaggaaaggguu

SEQ ID NO: 386915 - RNA, 22 nt, Human
uuugagauggagucuugcucug

SEQ ID NO: 386916 - RNA, 20 nt, Human
uucugcuugcaaauaucaag

SEQ ID NO: 386917 - RNA, 22 nt, Human
gcagccugaggcccuuucuggc

SEQ ID NO: 386918 - RNA, 22 nt, Human
uggcaaggccacaggugcaguu

SEQ ID NO: 386919 - RNA, 22 nt, Human
aagucuggaagucucaguuuuc

SEQ ID NO: 386920 - RNA, 22 nt, Human
ugcagggccaugguggcggcug

SEQ ID NO: 386921 - RNA, 22 nt, Human
gaggcccaggucaagcagccac

SEQ ID NO: 386922 - RNA, 18 nt, Human
ugcccagaaaagcaggga

SEQ ID NO: 386923 - RNA, 22 nt, Human
aaaucucaguguucuaagcauu

SEQ ID NO: 386924 - RNA, 22 nt, Human
gcuguucccauguggggcucag

SEQ ID NO: 386925 - RNA, 22 nt, Human
cagucccaaggaggaagcaguc

SEQ ID NO: 386926 - RNA, 22 nt, Human
acaguaaaucaacagaauaucu

SEQ ID NO: 386927 - RNA, 22 nt, Human
ucucugggauaaacugggccag

SEQ ID NO: 386928 - RNA, 22 nt, Human
cccagcccccgagugucuggaa

SEQ ID NO: 386929 - RNA, 22 nt, Human
gacauguugaagaauauuugga

SEQ ID NO: 386930 - RNA, 22 nt, Human
ccugguguugugaaguagccgu

SEQ ID NO: 386931 - RNA, 22 nt, Human
acaaggcugaacagugaagccg

SEQ ID NO: 386932 - RNA, 22 nt, Human
aagauauacuauuaaguaccau

SEQ ID NO: 386933 - RNA, 22 nt, Human
ggagcugugcagugacuacaga

SEQ ID NO: 386934 - RNA, 22 nt, Human
ugucauaaucaguuuugcaugu

SEQ ID NO: 386935 - RNA, 22 nt, Human
cagagcugguguuacaagucca

SEQ ID NO: 386936 - RNA, 22 nt, Human
aacuagaaaacaagaugcugau

SEQ ID NO: 386937 - RNA, 22 nt, Human
uuuucauuuacauuagggaaga

SEQ ID NO: 386938 - RNA, 22 nt, Human
ucauccuuuugcaugggaaggc

SEQ ID NO: 386939 - RNA, 22 nt, Human
gggcaguggguggcugcagccu

SEQ ID NO: 386940 - RNA, 22 nt, Human
ucaaugauagacaagaucuaag

SEQ ID NO: 386941 - RNA, 22 nt, Human
cuggccagggugcgaucguggu

SEQ ID NO: 386942 - RNA, 22 nt, Human
ugaggaaguugaucucaucagu

SEQ ID NO: 386943 - RNA, 22 nt, Human
gcucugagucucagcuaccaca

SEQ ID NO: 386944 - RNA, 22 nt, Human
uaauuucuucaucucugcagcu

SEQ ID NO: 386945 - RNA, 23 nt, Human
uccagggauuaaugaagucaguc

SEQ ID NO: 386946 - RNA, 22 nt, Human
ugcuggggcucugaccacucca

SEQ ID NO: 386947 - RNA, 22 nt, Human
aggagcugcauggauaccuggu

SEQ ID NO: 386948 - RNA, 22 nt, Human
aagaauguucauuaaacuguug

SEQ ID NO: 386949 - RNA, 22 nt, Human
uccagggaaggugugaggcugg

SEQ ID NO: 386950 - RNA, 22 nt, Human
cccaggcagucuggcucuaaag

SEQ ID NO: 386951 - RNA, 22 nt, Human
cacugcucgcugcagcauggcc

SEQ ID NO: 386952 - RNA, 22 nt, Human
ggguaauuggggccuugcagug

SEQ ID NO: 386953 - RNA, 22 nt, Human
aguguuagauucuuacucaguu

SEQ ID NO: 386954 - RNA, 23 nt, Human
ugcuguccaacagacuggccaug

SEQ ID NO: 386955 - RNA, 22 nt, Human
uaaggcagaaauaugagcaggg

SEQ ID NO: 386956 - RNA, 22 nt, Human
ccuggcaguuuugcccaggauu

SEQ ID NO: 386957 - RNA, 22 nt, Human
auuugaagaaaguuuucuagau

SEQ ID NO: 386958 - RNA, 22 nt, Human
augucccaagauacagcuagag

SEQ ID NO: 386959 - RNA, 20 nt, Human
acuggaucuggcuggagcug

SEQ ID NO: 386960 - RNA, 18 nt, Human
uaaauauauuucccccuu

SEQ ID NO: 386961 - RNA, 22 nt, Human
ggcuugcuucuuguccaggaau

SEQ ID NO: 386962 - RNA, 22 nt, Human
cagaaagaccugggcucaagag

SEQ ID NO: 386963 - RNA, 22 nt, Human
gccuucugugcuccuggccuuu

SEQ ID NO: 386964 - RNA, 22 nt, Human
caguacuuuucaaccaguauga

SEQ ID NO: 386965 - RNA, 22 nt, Human
caaaguuuaaaguagauuucag

SEQ ID NO: 386966 - RNA, 22 nt, Human
acaguaauaaguguuggugagg

SEQ ID NO: 386967 - RNA, 22 nt, Human
gggaccuggcgagggucacaca

SEQ ID NO: 386968 - RNA, 22 nt, Human
agcagcucuuaacaaagcaugg

SEQ ID NO: 386969 - RNA, 22 nt, Human
gagcuuccacucuagaaggagu

SEQ ID NO: 386970 - RNA, 22 nt, Human
uuuccucacuucaugagaguuu

SEQ ID NO: 386971 - RNA, 21 nt, Human
uccuguaagcuuggguggcuc

SEQ ID NO: 386972 - RNA, 22 nt, Human
gcugcucucagagcucaugcug

SEQ ID NO: 386973 - RNA, 22 nt, Human
uuuccucuuauacaguguuuau

SEQ ID NO: 386974 - RNA, 22 nt, Human
gcucugugggugaguagaaucu

SEQ ID NO: 386975 - RNA, 22 nt, Human
agcagagguuuguuggaaaccu

SEQ ID NO: 386976 - RNA, 22 nt, Human
auuugucuuuggaccugugaga

SEQ ID NO: 386977 - RNA, 22 nt, Human
gaaaccagcuagaggcagaggg

SEQ ID NO: 386978 - RNA, 22 nt, Human
agggagcaugggugaagcaggc

SEQ ID NO: 386979 - RNA, 22 nt, Human
agagcugaggauccagcugagc

SEQ ID NO: 386980 - RNA, 22 nt, Human
guaaauuauuucaagaucaucu

SEQ ID NO: 386981 - RNA, 22 nt, Human
cugagcagcaacccagagccuc

SEQ ID NO: 386982 - RNA, 19 nt, Human
cucucacucgccacauccu

SEQ ID NO: 386983 - RNA, 22 nt, Human
gagccuggauagccuuguucca

SEQ ID NO: 386984 - RNA, 22 nt, Human
augaggcauuccacucaaacuc

SEQ ID NO: 386985 - RNA, 22 nt, Human
acaggcugcccgcuccccaccu

SEQ ID NO: 386986 - RNA, 22 nt, Human
ugcuggggucauggggcgcccg

SEQ ID NO: 386987 - RNA, 22 nt, Human
uuauccaagcagaagcugcaca

SEQ ID NO: 386988 - RNA, 20 nt, Human
uaugaguauuacuuucagga

SEQ ID NO: 386989 - RNA, 22 nt, Human
cugaggagagaucacguggugu

SEQ ID NO: 386990 - RNA, 22 nt, Human
ggccuggcucuugcccagccug

SEQ ID NO: 386991 - RNA, 22 nt, Human
uagcagaaacuguuacagaagg

SEQ ID NO: 386992 - RNA, 22 nt, Human
gcugaaggcccggaggacaggg

SEQ ID NO: 386993 - RNA, 23 nt, Human
ucuggcucuaugugacagcucuc

SEQ ID NO: 386994 - RNA, 22 nt, Human
cuauuagguaugcagccuauuu

SEQ ID NO: 386995 - RNA, 22 nt, Human
uagagcaguuggcagcuguauu

SEQ ID NO: 386996 - RNA, 22 nt, Human
uaccaggcagcugcacagaggc

SEQ ID NO: 386997 - RNA, 22 nt, Human
cuguguccucccgcugcaccca

SEQ ID NO: 386998 - RNA, 22 nt, Human
acagaaagaagguguauuugag

SEQ ID NO: 386999 - RNA, 20 nt, Human
guauuaggagguaaauguaa

SEQ ID NO: 387000 - RNA, 22 nt, Human
uucauucuuauuugugaucugg

SEQ ID NO: 387001 - RNA, 22 nt, Human
ucacccuugauaauguucuucu

SEQ ID NO: 387002 - RNA, 22 nt, Human
cuuuccaaugucacuaugaauc

SEQ ID NO: 387003 - RNA, 22 nt, Human
ggcgcucaguguugccccagag

SEQ ID NO: 387004 - RNA, 22 nt, Human
aaaugcacaauaaaguaaaggc

SEQ ID NO: 387005 - RNA, 22 nt, Human
ugaagccuuguguggccucucu

SEQ ID NO: 387006 - RNA, 22 nt, Human
uugaauaauguguauguuguua

SEQ ID NO: 387007 - RNA, 22 nt, Human
ugcugccagggcucugcccaca

SEQ ID NO: 387008 - RNA, 20 nt, Human
aguggggagucaggagugcc

SEQ ID NO: 387009 - RNA, 22 nt, Human
agccuggagcuugaguuaugag

SEQ ID NO: 387010 - RNA, 18 nt, Human
acugugugaauuagcucc

SEQ ID NO: 387011 - RNA, 22 nt, Human
guucuucacauuucauugagga

SEQ ID NO: 387012 - RNA, 20 nt, Human
aggcaguuagaaggagauga

SEQ ID NO: 387013 - RNA, 22 nt, Human
augaaggcuguguagauggaug

SEQ ID NO: 387014 - RNA, 22 nt, Human
auacagaagccuguauuucugg

SEQ ID NO: 387015 - RNA, 22 nt, Human
gaggccuggcugggaggaggug

SEQ ID NO: 387016 - RNA, 22 nt, Human
cuggagugaagucuggcagcuu

SEQ ID NO: 387017 - RNA, 22 nt, Human
ggugaggaauuggggacugacc

SEQ ID NO: 387018 - RNA, 22 nt, Human
ugcagccauuuucugccaaugc

SEQ ID NO: 387019 - RNA, 22 nt, Human
gggaagggacuuguuuaagguc

SEQ ID NO: 387020 - RNA, 22 nt, Human
augcagcuucaggauuaugaug

SEQ ID NO: 387021 - RNA, 22 nt, Human
uguaacaaaauaccuuggauug

SEQ ID NO: 387022 - RNA, 22 nt, Human
cgcuggggcuuuuugcuugaga

SEQ ID NO: 387023 - RNA, 22 nt, Human
cugggacuuuacccuguggccc

SEQ ID NO: 387024 - RNA, 22 nt, Human
agggaguuccgaucugugcacc

SEQ ID NO: 387025 - RNA, 22 nt, Human
cauuuguauagugcuuagacca

SEQ ID NO: 387026 - RNA, 22 nt, Human
ugucagagcaaggccaggccag

SEQ ID NO: 387027 - RNA, 19 nt, Human
ugaggggaggagaggccug

SEQ ID NO: 387028 - RNA, 22 nt, Human
gaaaugcauaaucuuaguagau

SEQ ID NO: 387029 - RNA, 22 nt, Human
ggcuuuaucaaaugagacccug

SEQ ID NO: 387030 - RNA, 22 nt, Human
cccagcagcuugcacagugcug

SEQ ID NO: 387031 - RNA, 22 nt, Human
ucccugcucagcucaccuggca

SEQ ID NO: 387032 - RNA, 22 nt, Human
cuuacaaaggagaggagauagg

SEQ ID NO: 387033 - RNA, 22 nt, Human
ucauguuauugacucauaauau

SEQ ID NO: 387034 - RNA, 17 nt, Human
cugucugcgcaugaggu

SEQ ID NO: 387035 - RNA, 22 nt, Human
cagggcagccaggccccguggg

SEQ ID NO: 387036 - RNA, 22 nt, Human
ggaggcucccacgcagcucaca

SEQ ID NO: 387037 - RNA, 22 nt, Human
gagggcugcugccagauaugcc

SEQ ID NO: 387038 - RNA, 22 nt, Human
uuuuaucuaccuaugcucauuu

SEQ ID NO: 387039 - RNA, 22 nt, Human
ggcucacgcaauuaucccggcc

SEQ ID NO: 387040 - RNA, 22 nt, Human
agggcagagacaugcuuccuga

SEQ ID NO: 387041 - RNA, 20 nt, Human
cagagaccaggccagguguc

SEQ ID NO: 387042 - RNA, 22 nt, Human
uguguacacaaugauugcagag

SEQ ID NO: 387043 - RNA, 22 nt, Human
acaacaaaaucacuagucuucc

SEQ ID NO: 387044 - RNA, 22 nt, Human
aaucuggcauguaagcuuagag

SEQ ID NO: 387045 - RNA, 22 nt, Human
uucuuaaaacuuauggacaggu

SEQ ID NO: 387046 - RNA, 22 nt, Human
gcagccacucucauuccacgug

SEQ ID NO: 387047 - RNA, 23 nt, Human
gcagacagagcagacuaagacaa

SEQ ID NO: 387048 - RNA, 19 nt, Human
agagaaggauccuaugguu

SEQ ID NO: 387049 - RNA, 21 nt, Human
aaaguguucagaccaguucug

SEQ ID NO: 387050 - RNA, 22 nt, Human
uuuccaaaggaggaaccaguuu

SEQ ID NO: 387051 - RNA, 22 nt, Human
auuccauuguguaaggauaucg

SEQ ID NO: 387052 - RNA, 22 nt, Human
gggcugagcuaagcuggguuga

SEQ ID NO: 387053 - RNA, 22 nt, Human
guguccagggccguguugucuu

SEQ ID NO: 387054 - RNA, 18 nt, Human
uacagauuauagauacau

SEQ ID NO: 387055 - RNA, 20 nt, Human
ugcuuuaugcuauacuuugu

SEQ ID NO: 387056 - RNA, 22 nt, Human
caaaacugucuagagagagaag

SEQ ID NO: 387057 - RNA, 22 nt, Human
ccagguggaaggucugugcucu

SEQ ID NO: 387058 - RNA, 22 nt, Human
ggucucagcuggaguccuuggu

SEQ ID NO: 387059 - RNA, 21 nt, Human
aggcccagagucuugggggga

SEQ ID NO: 387060 - RNA, 22 nt, Human
uggaagcuguggcauaacugag

SEQ ID NO: 387061 - RNA, 20 nt, Human
ucagccagcuaacaugggga

SEQ ID NO: 387062 - RNA, 22 nt, Human
ucacuugccuagcccaguucag

SEQ ID NO: 387063 - RNA, 19 nt, Human
agcuccugggcucugggcc

SEQ ID NO: 387064 - RNA, 22 nt, Human
ggcagcugaccuagcaccaucc

SEQ ID NO: 387065 - RNA, 22 nt, Human
acaggagugaaucuggcacuua

SEQ ID NO: 387066 - RNA, 22 nt, Human
gggcagcugccagaggccaugg

SEQ ID NO: 387067 - RNA, 20 nt, Human
ggcagccaaucagcgugccg

SEQ ID NO: 387068 - RNA, 22 nt, Human
uaauacagaaguguauuaaaau

SEQ ID NO: 387069 - RNA, 22 nt, Human
cauuucaauacaguuuguaaau

SEQ ID NO: 387070 - RNA, 22 nt, Human
uuuauccaccuuacccuguucc

SEQ ID NO: 387071 - RNA, 22 nt, Human
gcucugcugucuucuugcaggc

SEQ ID NO: 387072 - RNA, 22 nt, Human
ccauaauauuaaaugcuuuugu

SEQ ID NO: 387073 - RNA, 22 nt, Human
uuuaugagcaaugcugagggga

SEQ ID NO: 387074 - RNA, 22 nt, Human
aaggcacuuuuccugagaugau

SEQ ID NO: 387075 - RNA, 22 nt, Human
cucuugaagcaggggccaguuc

SEQ ID NO: 387076 - RNA, 22 nt, Human
ugucaguguauacauacaguau

SEQ ID NO: 387077 - RNA, 22 nt, Human
uaauuccaaguugagacaugca

SEQ ID NO: 387078 - RNA, 22 nt, Human
ccacaucucgguccccucuuug

SEQ ID NO: 387079 - RNA, 21 nt, Human
gccaaggggguagcuauuccu

SEQ ID NO: 387080 - RNA, 22 nt, Human
uuguuauaaagacuaaauaugu

SEQ ID NO: 387081 - RNA, 22 nt, Human
aaaugcaugagaaaguauucug

SEQ ID NO: 387082 - RNA, 18 nt, Human
aaagaaggauuggagagc

SEQ ID NO: 387083 - RNA, 22 nt, Human
gcugcugugaauuuuuuaaaug

SEQ ID NO: 387084 - RNA, 22 nt, Human
aagacaagcaucaaaucaggca

SEQ ID NO: 387085 - RNA, 22 nt, Human
agaaugcauuuuguguagcuau

SEQ ID NO: 387086 - RNA, 20 nt, Human
aacauugcuucaauguaacc

SEQ ID NO: 387087 - RNA, 22 nt, Human
uacauguuugguaaaugauggc

SEQ ID NO: 387088 - RNA, 22 nt, Human
cagcuuuccagagaccugcccc

SEQ ID NO: 387089 - RNA, 22 nt, Human
gccaggcagcaggaagccagug

SEQ ID NO: 387090 - RNA, 22 nt, Human
uuuuucaagacaaccugcaugu

SEQ ID NO: 387091 - RNA, 20 nt, Human
cacugaagacuucuugcuca

SEQ ID NO: 387092 - RNA, 22 nt, Human
uggcaggagacacauggcauag

SEQ ID NO: 387093 - RNA, 22 nt, Human
gcacugcagguggguggagagg

SEQ ID NO: 387094 - RNA, 22 nt, Human
uuuccaaaggaguaccacgcau

SEQ ID NO: 387095 - RNA, 22 nt, Human
caguccuuucugaaauccuaua

SEQ ID NO: 387096 - RNA, 22 nt, Human
cuuuuaaugggagcaguauuug

SEQ ID NO: 387097 - RNA, 22 nt, Human
uucaggauaguggugaguggca

SEQ ID NO: 387098 - RNA, 22 nt, Human
uaauuuuaugacaguguauuuu

SEQ ID NO: 387099 - RNA, 22 nt, Human
cucagaguccccaguggguuug

SEQ ID NO: 387100 - RNA, 21 nt, Human
ccaggcuccugaggcugguca

SEQ ID NO: 387101 - RNA, 22 nt, Human
ccugucagaugaaguaauugug

SEQ ID NO: 387102 - RNA, 23 nt, Human
agucagagagugugagacaacug

SEQ ID NO: 387103 - RNA, 22 nt, Human
acagugaaugcccaagaaaagu

SEQ ID NO: 387104 - RNA, 22 nt, Human
cuucuucauaggcaguccuguu

SEQ ID NO: 387105 - RNA, 18 nt, Human
cccucuccugcuaguggg

SEQ ID NO: 387106 - RNA, 22 nt, Human
ugcagggccuugggucuuucuu

SEQ ID NO: 387107 - RNA, 22 nt, Human
ucuggagccuuggaugggaaag

SEQ ID NO: 387108 - RNA, 22 nt, Human
aggccagcucacccuggcuccu

SEQ ID NO: 387109 - RNA, 22 nt, Human
ucagaauuuugguuugguuggu

SEQ ID NO: 387110 - RNA, 22 nt, Human
caaugauggcuaggcagcugcu

SEQ ID NO: 387111 - RNA, 22 nt, Human
cauaaguuggguaauauaauga

SEQ ID NO: 387112 - RNA, 22 nt, Human
uauucaaaguaccuucauugcc

SEQ ID NO: 387113 - RNA, 22 nt, Human
uuugcacuagcauuuguccaug

SEQ ID NO: 387114 - RNA, 22 nt, Human
auggagggugguaagacagaga

SEQ ID NO: 387115 - RNA, 22 nt, Human
cuggcugguuacuauuucuggu

SEQ ID NO: 387116 - RNA, 22 nt, Human
ugacuccaaacagaaaacgaau

SEQ ID NO: 387117 - RNA, 22 nt, Human
gccaggccugcaagugcuggug

SEQ ID NO: 387118 - RNA, 22 nt, Human
agccaggccagacucacacccu

SEQ ID NO: 387119 - RNA, 22 nt, Human
ucucagucuuugcaaggaugcu

SEQ ID NO: 387120 - RNA, 22 nt, Human
auauguguauuugguuagccua

SEQ ID NO: 387121 - RNA, 22 nt, Human
guuuacaaauauuuuaaauggu

SEQ ID NO: 387122 - RNA, 22 nt, Human
cagugggaagggcagaggcuuu

SEQ ID NO: 387123 - RNA, 22 nt, Human
aagugacaccucuucccuuucc

SEQ ID NO: 387124 - RNA, 22 nt, Human
gaagagcugcaguuuccugggc

SEQ ID NO: 387125 - RNA, 22 nt, Human
gcagcuuuuuggaugucaguua

SEQ ID NO: 387126 - RNA, 21 nt, Human
gcaaguacuaucaucauuauc

SEQ ID NO: 387127 - RNA, 22 nt, Human
agggaggagaauggacuccuuc

SEQ ID NO: 387128 - RNA, 22 nt, Human
ugucaccacauuugucaauauc

SEQ ID NO: 387129 - RNA, 22 nt, Human
ucacaugcuacugagccagacc

SEQ ID NO: 387130 - RNA, 22 nt, Human
auaacagaugugaagugcuaau

SEQ ID NO: 387131 - RNA, 21 nt, Human
aaauggauagggcaauggaag

SEQ ID NO: 387132 - RNA, 22 nt, Human
aaaggccacacugcucuuucuc

SEQ ID NO: 387133 - RNA, 22 nt, Human
uggcuggacagugggcagugga

SEQ ID NO: 387134 - RNA, 22 nt, Human
gggcugacaccacccaggcgca

SEQ ID NO: 387135 - RNA, 22 nt, Human
uugauguacagaauuguucaca

SEQ ID NO: 387136 - RNA, 23 nt, Human
cagggcugguagggaagagcgug

SEQ ID NO: 387137 - RNA, 22 nt, Human
ccaggcauccauugcuuccucu

SEQ ID NO: 387138 - RNA, 22 nt, Human
uauggaaauaauuagacaagug

SEQ ID NO: 387139 - RNA, 22 nt, Human
gcccagcacagcuggaagaguc

SEQ ID NO: 387140 - RNA, 22 nt, Human
gucaggaugagggaugaggagu

SEQ ID NO: 387141 - RNA, 22 nt, Human
gucuccugagccuugacugcaa

SEQ ID NO: 387142 - RNA, 21 nt, Human
ucagaguggaagacaguuuga

SEQ ID NO: 387143 - RNA, 22 nt, Human
ggauggcaggacaaggacccag

SEQ ID NO: 387144 - RNA, 22 nt, Human
ucuucucuccugcuuggcagaa

SEQ ID NO: 387145 - RNA, 18 nt, Human
agcuucccucugagaggg

SEQ ID NO: 387146 - RNA, 22 nt, Human
gagaggucaucucccaucagca

SEQ ID NO: 387147 - RNA, 22 nt, Human
ucaugcaaggcugaaacauggu

SEQ ID NO: 387148 - RNA, 22 nt, Human
aggcugaggcagguggaucacc

SEQ ID NO: 387149 - RNA, 22 nt, Human
uccuuucaccaaaaaguguugu

SEQ ID NO: 387150 - RNA, 22 nt, Human
gcuggauccugauucgucuuug

SEQ ID NO: 387151 - RNA, 20 nt, Human
uauuccaaggguagagaaaa

SEQ ID NO: 387152 - RNA, 22 nt, Human
uucucuuuugugaugugagaug

SEQ ID NO: 387153 - RNA, 22 nt, Human
acuguucaucucuuagaaagua

SEQ ID NO: 387154 - RNA, 22 nt, Human
aaggcugugucagaagcucccu

SEQ ID NO: 387155 - RNA, 22 nt, Human
cugcugcaggaugggcacucug

SEQ ID NO: 387156 - RNA, 22 nt, Human
uuuaggcagaagcccugcugau

SEQ ID NO: 387157 - RNA, 22 nt, Human
cauuaugugggaaaauguucuu

SEQ ID NO: 387158 - RNA, 22 nt, Human
guggagacuucuacuagagacc

SEQ ID NO: 387159 - RNA, 22 nt, Human
uguaugcagcaaaacaauuagu

SEQ ID NO: 387160 - RNA, 22 nt, Human
ggcucuggagcacagacgucug

SEQ ID NO: 387161 - RNA, 22 nt, Human
agauuguagaaacuguagcauu

SEQ ID NO: 387162 - RNA, 22 nt, Human
ugggcagagaucuggaucaaac

SEQ ID NO: 387163 - RNA, 23 nt, Human
acagggcauugcuggccucgagg

SEQ ID NO: 387164 - RNA, 22 nt, Human
aggcucagggacggggccccuu

SEQ ID NO: 387165 - RNA, 22 nt, Human
gugcaugucggggugcauguca

SEQ ID NO: 387166 - RNA, 22 nt, Human
cucuacucuuaacacagcuagg

SEQ ID NO: 387167 - RNA, 22 nt, Human
uacauuccauguguguguauuc

SEQ ID NO: 387168 - RNA, 22 nt, Human
cagagcagaagcgguccucaca

SEQ ID NO: 387169 - RNA, 22 nt, Human
gccugucugcagggcugucauu

SEQ ID NO: 387170 - RNA, 23 nt, Human
ggagugcaauggcgccaucucgg

SEQ ID NO: 387171 - RNA, 22 nt, Human
ucaguuaagaggccacggcagu

SEQ ID NO: 387172 - RNA, 22 nt, Human
ucucagagaugucaagagucua

SEQ ID NO: 387173 - RNA, 22 nt, Human
ucagcuuugaucucaggcaauc

SEQ ID NO: 387174 - RNA, 22 nt, Human
gcaggccuuggcaaugagccug

SEQ ID NO: 387175 - RNA, 20 nt, Human
cuguggcucaugcaucugcc

SEQ ID NO: 387176 - RNA, 22 nt, Human
ccuuuauucaauuaguccuaau

SEQ ID NO: 387177 - RNA, 22 nt, Human
aauggcugccagggcaggaggu

SEQ ID NO: 387178 - RNA, 22 nt, Human
agggcugacaguggcguggcgu

SEQ ID NO: 387179 - RNA, 22 nt, Human
uaucagaaggcacauggagucu

SEQ ID NO: 387180 - RNA, 22 nt, Human
gagggguguggagccaucaguu

SEQ ID NO: 387181 - RNA, 22 nt, Human
auuucucaguuccuacuguuua

SEQ ID NO: 387182 - RNA, 22 nt, Human
cuuucucuguguuucacaugcu

SEQ ID NO: 387183 - RNA, 22 nt, Human
agagcccucucauuggcuuauu

SEQ ID NO: 387184 - RNA, 22 nt, Human
cagcaaaagccagcauaagcuc

SEQ ID NO: 387185 - RNA, 22 nt, Human
cagcuuuguggccuugaccucg

SEQ ID NO: 387186 - RNA, 22 nt, Human
cagagccauccaggugccuguu

SEQ ID NO: 387187 - RNA, 21 nt, Human
ggcaggauggcaguggacccc

SEQ ID NO: 387188 - RNA, 22 nt, Human
gaggaggcacuaguuagugaca

SEQ ID NO: 387189 - RNA, 22 nt, Human
ugggccuguugccugaguccau

SEQ ID NO: 387190 - RNA, 22 nt, Human
ggggaaggauugaguugaccca

SEQ ID NO: 387191 - RNA, 22 nt, Human
aaggcuuucagcuaacuugauu

SEQ ID NO: 387192 - RNA, 22 nt, Human
agccuucaaccuagcuagagca

SEQ ID NO: 387193 - RNA, 18 nt, Human
accugccuguucuucucu

SEQ ID NO: 387194 - RNA, 22 nt, Human
acagaauugauggaaaucucag

SEQ ID NO: 387195 - RNA, 22 nt, Human
gggcugacgaaggccaugugug

SEQ ID NO: 387196 - RNA, 22 nt, Human
ggaggcaggaaagacagguuca

SEQ ID NO: 387197 - RNA, 22 nt, Human
ggagcuggucagccuugagcau

SEQ ID NO: 387198 - RNA, 21 nt, Human
gggugggaggacacagcaggc

SEQ ID NO: 387199 - RNA, 22 nt, Human
ggcaucuccaaaacaugaacuc

SEQ ID NO: 387200 - RNA, 22 nt, Human
agcgagggaggucugaggacag

SEQ ID NO: 387201 - RNA, 22 nt, Human
ucuguccuguuuccuccugaca

SEQ ID NO: 387202 - RNA, 22 nt, Human
acugcuuuagaccuagagcucu

SEQ ID NO: 387203 - RNA, 22 nt, Human
augcuguguuuuaaauggaaau

SEQ ID NO: 387204 - RNA, 23 nt, Human
ugcugggcagagcuggugcugag

SEQ ID NO: 387205 - RNA, 22 nt, Human
uuuuuccuuagggguuacucac

SEQ ID NO: 387206 - RNA, 21 nt, Human
cagaggcaggcucugugugug

SEQ ID NO: 387207 - RNA, 22 nt, Human
acauuucugcuagaauagguga

SEQ ID NO: 387208 - RNA, 22 nt, Human
uguccuuauauuguggaagggg

SEQ ID NO: 387209 - RNA, 22 nt, Human
agggugcauguuugcaagagug

SEQ ID NO: 387210 - RNA, 22 nt, Human
cgccugggaguccacaccugcu

SEQ ID NO: 387211 - RNA, 22 nt, Human
cauauaaauacaacauguguua

SEQ ID NO: 387212 - RNA, 22 nt, Human
uccaggcaaggauaauaaacau

SEQ ID NO: 387213 - RNA, 22 nt, Human
ugggcagaggacagggaagauc

SEQ ID NO: 387214 - RNA, 20 nt, Human
gacaggagaguuagguaggu

SEQ ID NO: 387215 - RNA, 22 nt, Human
agcugcccuguggggaggguug

SEQ ID NO: 387216 - RNA, 22 nt, Human
ucuggagauaagacagacagau

SEQ ID NO: 387217 - RNA, 22 nt, Human
ccugucugcaugaucccugcca

SEQ ID NO: 387218 - RNA, 22 nt, Human
ugagaagcaguuucaguaagaa

SEQ ID NO: 387219 - RNA, 22 nt, Human
cugaaaggguuacauaguaagu

SEQ ID NO: 387220 - RNA, 18 nt, Human
agggagagaccgcggguc

SEQ ID NO: 387221 - RNA, 22 nt, Human
uguccuuaucuccaaacaauca

SEQ ID NO: 387222 - RNA, 22 nt, Human
ggagauagacuuggugagccac

SEQ ID NO: 387223 - RNA, 22 nt, Human
acagaauucucucugcagaggc

SEQ ID NO: 387224 - RNA, 22 nt, Human
agcagcuguacuuucaucuguu

SEQ ID NO: 387225 - RNA, 22 nt, Human
gaggaaacauuguagaagcagu

SEQ ID NO: 387226 - RNA, 22 nt, Human
cagugcauagauccugaggccu

SEQ ID NO: 387227 - RNA, 22 nt, Human
ccaagggcucugacuugccugc

SEQ ID NO: 387228 - RNA, 22 nt, Human
aaauucaguuuuaauaaucacu

SEQ ID NO: 387229 - RNA, 22 nt, Human
ugagccugcugucgcuggaccc

SEQ ID NO: 387230 - RNA, 19 nt, Human
acacagggcuagaguuaca

SEQ ID NO: 387231 - RNA, 22 nt, Human
ugcaccauuuugucaggcuacu

SEQ ID NO: 387232 - RNA, 22 nt, Human
caucagaacgugagcuccuugu

SEQ ID NO: 387233 - RNA, 22 nt, Human
ucuucaaacugaaaauuuagaa

SEQ ID NO: 387234 - RNA, 22 nt, Human
gcucugaggcugggagcacucu

SEQ ID NO: 387235 - RNA, 22 nt, Human
uuacauuuugggguaaggauaa

SEQ ID NO: 387236 - RNA, 22 nt, Human
gggucucucucggcuccacgcg

SEQ ID NO: 387237 - RNA, 20 nt, Human
cccucugcacauggcugugg

SEQ ID NO: 387238 - RNA, 22 nt, Human
uaucuguugucuuuuacaugua

SEQ ID NO: 387239 - RNA, 22 nt, Human
acucacauuucaucaggccaag

SEQ ID NO: 387240 - RNA, 17 nt, Human
ucuggccuuccugaacu

SEQ ID NO: 387241 - RNA, 22 nt, Human
ccagcuuuagguugccugccag

SEQ ID NO: 387242 - RNA, 22 nt, Human
uaguggaggggaugcaaagcuu

SEQ ID NO: 387243 - RNA, 22 nt, Human
guccucugcuucaugcccugau

SEQ ID NO: 387244 - RNA, 22 nt, Human
agauacaaaagauaagauuuag

SEQ ID NO: 387245 - RNA, 22 nt, Human
gcuguccucugaucucuggagg

SEQ ID NO: 387246 - RNA, 22 nt, Human
guggcugcuguccucucugguu

SEQ ID NO: 387247 - RNA, 22 nt, Human
cauggcagagaaggggaacugg

SEQ ID NO: 387248 - RNA, 22 nt, Human
caggccuggggcuggcuuccag

SEQ ID NO: 387249 - RNA, 22 nt, Human
ucaggcugaggucaucugcauc

SEQ ID NO: 387250 - RNA, 22 nt, Human
aggcuagcuuuggcucaguaaa

SEQ ID NO: 387251 - RNA, 22 nt, Human
ugcacagagagaugagacacgu

SEQ ID NO: 387252 - RNA, 22 nt, Human
ucucagagaacaguuggugcuu

SEQ ID NO: 387253 - RNA, 22 nt, Human
ucugcaggcuuauaggaugggu

SEQ ID NO: 387254 - RNA, 22 nt, Human
caguggcaugguugacugcagu

SEQ ID NO: 387255 - RNA, 22 nt, Human
uuuuugcaccaaccuaauagaa

SEQ ID NO: 387256 - RNA, 17 nt, Human
aggcaggagauuggaga

SEQ ID NO: 387257 - RNA, 22 nt, Human
uucagagcaucucuaaagccag

SEQ ID NO: 387258 - RNA, 22 nt, Human
auaaagcauacuuuguaugacu

SEQ ID NO: 387259 - RNA, 22 nt, Human
ucauccaguucacauggugagu

SEQ ID NO: 387260 - RNA, 22 nt, Human
uccaguggguugcugagggagg

SEQ ID NO: 387261 - RNA, 22 nt, Human
ggugcagcugcagccugggagc

SEQ ID NO: 387262 - RNA, 22 nt, Human
aggcucaggaggagcugccgga

SEQ ID NO: 387263 - RNA, 22 nt, Human
guguacauauugagucugcuga

SEQ ID NO: 387264 - RNA, 22 nt, Human
uaggcagauguuaacaggaaaa

SEQ ID NO: 387265 - RNA, 22 nt, Human
guggggggacguuggucacuuu

SEQ ID NO: 387266 - RNA, 22 nt, Human
agcacaggaccaaggaagcugu

SEQ ID NO: 387267 - RNA, 22 nt, Human
ugcaggaaaaccaacacgccuu

SEQ ID NO: 387268 - RNA, 22 nt, Human
ugcuuaaaaugaugauuauuuu

SEQ ID NO: 387269 - RNA, 19 nt, Human
gguguccuagagauaagag

SEQ ID NO: 387270 - RNA, 22 nt, Human
ggcauccaaauaccaagaugua

SEQ ID NO: 387271 - RNA, 22 nt, Human
ccugauggagcccugcugcaug

SEQ ID NO: 387272 - RNA, 22 nt, Human
auacauacauguaugcacauac

SEQ ID NO: 387273 - RNA, 22 nt, Human
cagucccaucucccagguggcu

SEQ ID NO: 387274 - RNA, 22 nt, Human
uuaggaaaaucaugagagauga

SEQ ID NO: 387275 - RNA, 22 nt, Human
cuucuuaaugcauaaacugugu

SEQ ID NO: 387276 - RNA, 22 nt, Human
ugaaggagcugauguaaggggu

SEQ ID NO: 387277 - RNA, 22 nt, Human
auguuuccauuuucuuguauca

SEQ ID NO: 387278 - RNA, 22 nt, Human
acaguaauuaaaauggaucugc

SEQ ID NO: 387279 - RNA, 22 nt, Human
ccagcccuucccaacuggccag

SEQ ID NO: 387280 - RNA, 20 nt, Human
ugggccuguggcagaagucu

SEQ ID NO: 387281 - RNA, 22 nt, Human
acaaugcaccagcaucuucacc

SEQ ID NO: 387282 - RNA, 22 nt, Human
uugaacugguaguuggaaaucu

SEQ ID NO: 387283 - RNA, 17 nt, Human
cugcuuugugcaacgcu

SEQ ID NO: 387284 - RNA, 22 nt, Human
cccaggcuggagugcaauggca

SEQ ID NO: 387285 - RNA, 22 nt, Human
auccugggcagugugucacucu

SEQ ID NO: 387286 - RNA, 22 nt, Human
uuuaccaagcuuuaauuacaua

SEQ ID NO: 387287 - RNA, 17 nt, Human
gcaguggagggguaguu

SEQ ID NO: 387288 - RNA, 22 nt, Human
ggcccagcacagugcuuggggg

SEQ ID NO: 387289 - RNA, 22 nt, Human
gccaaaucuugcacacucuugu

SEQ ID NO: 387290 - RNA, 22 nt, Human
uuugaaagcuacuuucggguca

SEQ ID NO: 387291 - RNA, 22 nt, Human
uuaauuacuaagcacaaugcaa

SEQ ID NO: 387292 - RNA, 22 nt, Human
ggcuucccuuuccgagaggaga

SEQ ID NO: 387293 - RNA, 19 nt, Human
ucugaggguccagaugcau

SEQ ID NO: 387294 - RNA, 22 nt, Human
uaaguggaagguuauaugcuaa

SEQ ID NO: 387295 - RNA, 22 nt, Human
cagaggacaauagaauggaaag

SEQ ID NO: 387296 - RNA, 22 nt, Human
cccagcacaggcaauuccauac

SEQ ID NO: 387297 - RNA, 22 nt, Human
agccuggaccaggggccucaga

SEQ ID NO: 387298 - RNA, 22 nt, Human
uaucuacaggugucagguaaga

SEQ ID NO: 387299 - RNA, 22 nt, Human
caggggcaagaaugcugucagc

SEQ ID NO: 387300 - RNA, 23 nt, Human
cacaccaggagccgucugggcca

SEQ ID NO: 387301 - RNA, 22 nt, Human
gugcaggguagcgacggcagga

SEQ ID NO: 387302 - RNA, 22 nt, Human
aagcugccugggaggaagggcu

SEQ ID NO: 387303 - RNA, 22 nt, Human
aucuagaaguggcaugaauuac

SEQ ID NO: 387304 - RNA, 22 nt, Human
accagagcuuacaugcuagaaa

SEQ ID NO: 387305 - RNA, 22 nt, Human
agcaggaaggggaugaugggca

SEQ ID NO: 387306 - RNA, 22 nt, Human
ccaggagcagauauggacauaa

SEQ ID NO: 387307 - RNA, 22 nt, Human
uguaugcuuguguauaauauaa

SEQ ID NO: 387308 - RNA, 22 nt, Human
agggccugcucuaucacucuca

SEQ ID NO: 387309 - RNA, 22 nt, Human
ggcagggaggaggugaaaguga

SEQ ID NO: 387310 - RNA, 22 nt, Human
augcaucauggaaaacucaguu

SEQ ID NO: 387311 - RNA, 22 nt, Human
aaaguguugauaugugacaucc

SEQ ID NO: 387312 - RNA, 17 nt, Human
aggugcuggagcaucag

SEQ ID NO: 387313 - RNA, 22 nt, Human
caguacuucuuggaaacuggau

SEQ ID NO: 387314 - RNA, 22 nt, Human
gaagagcuguagccugcucuuu

SEQ ID NO: 387315 - RNA, 22 nt, Human
uuaaauauuauguugucugcaa

SEQ ID NO: 387316 - RNA, 22 nt, Human
gugggcuggacccuccugcucc

SEQ ID NO: 387317 - RNA, 22 nt, Human
gcagggaccucacuacccccag

SEQ ID NO: 387318 - RNA, 22 nt, Human
cacaccagagguuaccugcaaa

SEQ ID NO: 387319 - RNA, 21 nt, Human
agacagaacaacugcucucca

SEQ ID NO: 387320 - RNA, 20 nt, Human
auguagaugaaagcaaaggc

SEQ ID NO: 387321 - RNA, 18 nt, Human
ucuuggaguaaugaucaa

SEQ ID NO: 387322 - RNA, 22 nt, Human
ucugggagagcugcugucagag

SEQ ID NO: 387323 - RNA, 22 nt, Human
ucugucuccugccagugccucu

SEQ ID NO: 387324 - RNA, 22 nt, Human
ugcucuucggggccacugcuug

SEQ ID NO: 387325 - RNA, 22 nt, Human
cagaggccauauuucuucacuc

SEQ ID NO: 387326 - RNA, 22 nt, Human
uuugcaaagaaauuauugcugu

SEQ ID NO: 387327 - RNA, 22 nt, Human
cccaggaguaagugacauuguu

SEQ ID NO: 387328 - RNA, 22 nt, Human
gagcugcccugagcuuugcaug

SEQ ID NO: 387329 - RNA, 22 nt, Human
caagaaauuucuuaagaacuaa

SEQ ID NO: 387330 - RNA, 22 nt, Human
guguaaggugaaaucaacaaau

SEQ ID NO: 387331 - RNA, 22 nt, Human
gaggaaccacucugagaagcca

SEQ ID NO: 387332 - RNA, 22 nt, Human
gaacagcccuguuaagucuguu

SEQ ID NO: 387333 - RNA, 22 nt, Human
uggcagaggcucugugauguug

SEQ ID NO: 387334 - RNA, 22 nt, Human
auaguguuacccuucuuaaagu

SEQ ID NO: 387335 - RNA, 22 nt, Human
gccaggcaauguguuagaagcg

SEQ ID NO: 387336 - RNA, 21 nt, Human
caugaagccgguucccuguuu

SEQ ID NO: 387337 - RNA, 22 nt, Human
uugaauaggacucagcagugau

SEQ ID NO: 387338 - RNA, 22 nt, Human
ucaggaugagcucauaacuaug

SEQ ID NO: 387339 - RNA, 22 nt, Human
caggccagggagaauaugaagc

SEQ ID NO: 387340 - RNA, 19 nt, Human
ggucucagugcagcugcag

SEQ ID NO: 387341 - RNA, 22 nt, Human
cugaaagguauaaauaagacuu

SEQ ID NO: 387342 - RNA, 22 nt, Human
agcuggcauacuuugcuaggaa

SEQ ID NO: 387343 - RNA, 22 nt, Human
ucucuucucuagugagcaacug

SEQ ID NO: 387344 - RNA, 22 nt, Human
cccaagcagggugcagaggcau

SEQ ID NO: 387345 - RNA, 22 nt, Human
uguuuucuauuaccugagauug

SEQ ID NO: 387346 - RNA, 22 nt, Human
cucaguuucugacauuaaaauc

SEQ ID NO: 387347 - RNA, 22 nt, Human
gcaaggcugcugccacccaucu

SEQ ID NO: 387348 - RNA, 22 nt, Human
aggcagguccccuggaaggcac

SEQ ID NO: 387349 - RNA, 22 nt, Human
cagcuacuccucccaugacuuc

SEQ ID NO: 387350 - RNA, 22 nt, Human
cagggccagagagggcuggcug

SEQ ID NO: 387351 - RNA, 22 nt, Human
cuggggcugcgguggaggagcc

SEQ ID NO: 387352 - RNA, 22 nt, Human
caugcacaacauacucaagagg

SEQ ID NO: 387353 - RNA, 22 nt, Human
auugaaaauauaauucuaggag

SEQ ID NO: 387354 - RNA, 22 nt, Human
augguuuuagaaucaggaaaaa

SEQ ID NO: 387355 - RNA, 22 nt, Human
ugaaaugauguacaagaaggca

SEQ ID NO: 387356 - RNA, 22 nt, Human
cugccucuggccucaggcccag

SEQ ID NO: 387357 - RNA, 22 nt, Human
ugggcuggcugaggcauucacu

SEQ ID NO: 387358 - RNA, 22 nt, Human
agaggcuccuucacucuggcac

SEQ ID NO: 387359 - RNA, 22 nt, Human
guccuggcccacuggcaggcug

SEQ ID NO: 387360 - RNA, 22 nt, Human
caauuucaagauucuguucuuu

SEQ ID NO: 387361 - RNA, 22 nt, Human
uugguccacugugaaauuggga

SEQ ID NO: 387362 - RNA, 22 nt, Human
ccuggagcgcgggucaagcugg

SEQ ID NO: 387363 - RNA, 22 nt, Human
cauguacacucauguaacuaua

SEQ ID NO: 387364 - RNA, 22 nt, Human
caaggaaacaugaaaugcauug

SEQ ID NO: 387365 - RNA, 22 nt, Human
uaaugaauaaacuugagaguca

SEQ ID NO: 387366 - RNA, 22 nt, Human
uuuuccaaaguaccaugucccu

SEQ ID NO: 387367 - RNA, 22 nt, Human
ugauuuccugugcgcccuuagg

SEQ ID NO: 387368 - RNA, 22 nt, Human
ugaaggugaaugucuaugggga

SEQ ID NO: 387369 - RNA, 22 nt, Human
uuauucagucugucuagggagu

SEQ ID NO: 387370 - RNA, 22 nt, Human
aaaucacuaaguuauagugugg

SEQ ID NO: 387371 - RNA, 22 nt, Human
caggcacucauucagagaggug

SEQ ID NO: 387372 - RNA, 22 nt, Human
caaaguccauaguuuacaauag

SEQ ID NO: 387373 - RNA, 22 nt, Human
cuugcuucauuagugucuuagu

SEQ ID NO: 387374 - RNA, 22 nt, Human
uugcugugucauuuguuuaauc

SEQ ID NO: 387375 - RNA, 22 nt, Human
agaauaguggcaaugacugcac

SEQ ID NO: 387376 - RNA, 22 nt, Human
agguggcuccucccauggcugg

SEQ ID NO: 387377 - RNA, 22 nt, Human
cagcaguggaacuacccaggga

SEQ ID NO: 387378 - RNA, 22 nt, Human
uuuagggaagaagcccauggcc

SEQ ID NO: 387379 - RNA, 22 nt, Human
caggccucaggggcucaggcug

SEQ ID NO: 387380 - RNA, 22 nt, Human
auaugcauaugucaaaacuuau

SEQ ID NO: 387381 - RNA, 22 nt, Human
uggcugagggggcucugcucag

SEQ ID NO: 387382 - RNA, 22 nt, Human
aggaugaggcuggcaggucuug

SEQ ID NO: 387383 - RNA, 22 nt, Human
gccauuuucugucuuguuuauu

SEQ ID NO: 387384 - RNA, 22 nt, Human
ggggcccagcaccccuccucgc

SEQ ID NO: 387385 - RNA, 23 nt, Human
aguacaauaaguauaauucuuuc

SEQ ID NO: 387386 - RNA, 22 nt, Human
cacaaauggccguguucaaaga

SEQ ID NO: 387387 - RNA, 22 nt, Human
cauggcuuguaauaaauuuaua

SEQ ID NO: 387388 - RNA, 22 nt, Human
gcagccagguuugaggaccacu

SEQ ID NO: 387389 - RNA, 22 nt, Human
ucuucauuuuauagcaucugug

SEQ ID NO: 387390 - RNA, 22 nt, Human
ugcuuagacgucaaguacagcc

SEQ ID NO: 387391 - RNA, 22 nt, Human
gcucccugccuacacggaccuu

SEQ ID NO: 387392 - RNA, 22 nt, Human
ugaacaguuucaagaaaacuuu

SEQ ID NO: 387393 - RNA, 22 nt, Human
cuguuuauacgacagguggagg

SEQ ID NO: 387394 - RNA, 22 nt, Human
uagauuuuacuucugucauuac

SEQ ID NO: 387395 - RNA, 17 nt, Human
ucagcaaagacaaagga

SEQ ID NO: 387396 - RNA, 22 nt, Human
gcacagaacuucucuuaguagg

SEQ ID NO: 387397 - RNA, 22 nt, Human
agauguuccagccaaugggaau

SEQ ID NO: 387398 - RNA, 22 nt, Human
ugaaaucuccucuuuauauauc

SEQ ID NO: 387399 - RNA, 22 nt, Human
ugggcugccagcucuccagaug

SEQ ID NO: 387400 - RNA, 22 nt, Human
caagaauuguacaaacugggug

SEQ ID NO: 387401 - RNA, 22 nt, Human
cuggccuggcagggagggcaug

SEQ ID NO: 387402 - RNA, 22 nt, Human
ugccagggcugcuacuggcuga

SEQ ID NO: 387403 - RNA, 22 nt, Human
ggguggaggagaacaggcccca

SEQ ID NO: 387404 - RNA, 22 nt, Human
gaaugcuaagcaugugggaguu

SEQ ID NO: 387405 - RNA, 22 nt, Human
ggcugcagcagagggacucacg

SEQ ID NO: 387406 - RNA, 22 nt, Human
uugauuucuuacucuuccaagg

SEQ ID NO: 387407 - RNA, 22 nt, Human
uaugaagacaaugauagcauga

SEQ ID NO: 387408 - RNA, 22 nt, Human
cccuggaggucagaggccuggg

SEQ ID NO: 387409 - RNA, 22 nt, Human
cagccagagaaagggcacugcc

SEQ ID NO: 387410 - RNA, 22 nt, Human
agugcugucccgacaacugagg

SEQ ID NO: 387411 - RNA, 22 nt, Human
gcagcuggucuggccuagagua

SEQ ID NO: 387412 - RNA, 22 nt, Human
ccucaggggucacugugaggag

SEQ ID NO: 387413 - RNA, 22 nt, Human
gcccuuccuuagacagcaggau

SEQ ID NO: 387414 - RNA, 22 nt, Human
agagcagcugugacauggacag

SEQ ID NO: 387415 - RNA, 22 nt, Human
ugcaggaaaacaccuaucaccc

SEQ ID NO: 387416 - RNA, 22 nt, Human
augauucagcaauuuuauaucu

SEQ ID NO: 387417 - RNA, 22 nt, Human
caggguggcacucagcgcaucu

SEQ ID NO: 387418 - RNA, 22 nt, Human
acuguugucaggcugcuuugga

SEQ ID NO: 387419 - RNA, 22 nt, Human
uaaguuuuaagcaaucugauaa

SEQ ID NO: 387420 - RNA, 19 nt, Human
ggcagucucaagcagcaca

SEQ ID NO: 387421 - RNA, 22 nt, Human
gaaacccaaacuaagacaguag

SEQ ID NO: 387422 - RNA, 22 nt, Human
gcuggcugcgucaucacagggc

SEQ ID NO: 387423 - RNA, 23 nt, Human
acauacauggagauaaagugaug

SEQ ID NO: 387424 - RNA, 22 nt, Human
gagagugucgggggccccagga

SEQ ID NO: 387425 - RNA, 22 nt, Human
cuggggcuucaaugcuucggug

SEQ ID NO: 387426 - RNA, 22 nt, Human
ggcucaguguuuguggaacaua

SEQ ID NO: 387427 - RNA, 22 nt, Human
cugugugcugaaaugcagugag

SEQ ID NO: 387428 - RNA, 22 nt, Human
caguggcgugaucucugcucac

SEQ ID NO: 387429 - RNA, 22 nt, Human
gaaguggaagccaucggcaguc

SEQ ID NO: 387430 - RNA, 22 nt, Human
cagcccuggccccagguggucu

SEQ ID NO: 387431 - RNA, 22 nt, Human
cugaggucucuuuccauaguga

SEQ ID NO: 387432 - RNA, 22 nt, Human
cuuuccaaugcauuuccaaugu

SEQ ID NO: 387433 - RNA, 22 nt, Human
ugaauaaacuaugaggaggaau

SEQ ID NO: 387434 - RNA, 21 nt, Human
uuuaguucaaguacagaacca

SEQ ID NO: 387435 - RNA, 22 nt, Human
gacagcugugcaggagaagggg

SEQ ID NO: 387436 - RNA, 22 nt, Human
cccagcuugcgggcggcaggag

SEQ ID NO: 387437 - RNA, 22 nt, Human
uuaguaaauaaagucuacuuuc

SEQ ID NO: 387438 - RNA, 22 nt, Human
cagaaggcuggcagauugagau

SEQ ID NO: 387439 - RNA, 22 nt, Human
uagggcucagcucuagcuccug

SEQ ID NO: 387440 - RNA, 22 nt, Human
ucagcuuuuaaaaacaagaagu

SEQ ID NO: 387441 - RNA, 22 nt, Human
aaagccuugcccgucacuggga

SEQ ID NO: 387442 - RNA, 22 nt, Human
ggaggacacuggcucugccuuc

SEQ ID NO: 387443 - RNA, 19 nt, Human
ucccuggcgccucucgggc

SEQ ID NO: 387444 - RNA, 22 nt, Human
gaggcuggcagaaaagcacagg

SEQ ID NO: 387445 - RNA, 22 nt, Human
ggccagcucugcacagcagcug

SEQ ID NO: 387446 - RNA, 22 nt, Human
ucaaaugcuucuacuccuaaga

SEQ ID NO: 387447 - RNA, 22 nt, Human
gcagguggcagaggugggaucu

SEQ ID NO: 387448 - RNA, 22 nt, Human
aguggcagaucucuggucugga

SEQ ID NO: 387449 - RNA, 22 nt, Human
ucauucuccucuggaaaaggca

SEQ ID NO: 387450 - RNA, 22 nt, Human
aggcaagcccccagugaggcuc

SEQ ID NO: 387451 - RNA, 22 nt, Human
cuuuggcaaggguuuuaauugu

SEQ ID NO: 387452 - RNA, 22 nt, Human
ugggcucugaagucagucugcu

SEQ ID NO: 387453 - RNA, 22 nt, Human
caggagaagguuuggagugcag

SEQ ID NO: 387454 - RNA, 22 nt, Human
uccugccugcaaucccagcacu

SEQ ID NO: 387455 - RNA, 22 nt, Human
aaugaacagauacacauaggca

SEQ ID NO: 387456 - RNA, 22 nt, Human
gcuuaauucuggcucaguuucc

SEQ ID NO: 387457 - RNA, 22 nt, Human
aaggcacugagccagccgucuc

SEQ ID NO: 387458 - RNA, 22 nt, Human
ggauucagugucuguuaauagu

SEQ ID NO: 387459 - RNA, 21 nt, Human
acaggcuuuagaaaaugacuc

SEQ ID NO: 387460 - RNA, 22 nt, Human
caaggcaguuccccagagggcu

SEQ ID NO: 387461 - RNA, 22 nt, Human
accaggagguguuugcucaagu

SEQ ID NO: 387462 - RNA, 23 nt, Human
agccuucaggcaaugucaguaga

SEQ ID NO: 387463 - RNA, 16 nt, Human
uggcagagguucagcc

SEQ ID NO: 387464 - RNA, 22 nt, Human
ccagcuuuucuuaucauuauaa

SEQ ID NO: 387465 - RNA, 22 nt, Human
aguccuuagaacacuguaucug

SEQ ID NO: 387466 - RNA, 22 nt, Human
uccagucaggcugaauucaagg

SEQ ID NO: 387467 - RNA, 22 nt, Human
cggcagcuccgcgccguaggac

SEQ ID NO: 387468 - RNA, 22 nt, Human
aaguucaauggaaaagcuuuag

SEQ ID NO: 387469 - RNA, 22 nt, Human
gaaaugcaggcuuggauucagc

SEQ ID NO: 387470 - RNA, 22 nt, Human
uccugcagccacugcaggcaga

SEQ ID NO: 387471 - RNA, 22 nt, Human
aagguacagaaauuaacaagga

SEQ ID NO: 387472 - RNA, 22 nt, Human
agagcagcacguuguccccaca

SEQ ID NO: 387473 - RNA, 22 nt, Human
ucucugucccuaggagccuugc

SEQ ID NO: 387474 - RNA, 22 nt, Human
guuuuauaggcuguugcuauau

SEQ ID NO: 387475 - RNA, 22 nt, Human
cucaggcccacagcagacccac

SEQ ID NO: 387476 - RNA, 22 nt, Human
gcagcuggagcaucuucucauc

SEQ ID NO: 387477 - RNA, 22 nt, Human
ggaccagagcucgggcuucuca

SEQ ID NO: 387478 - RNA, 22 nt, Human
caagagcugugaccucauucac

SEQ ID NO: 387479 - RNA, 22 nt, Human
gcugcccacaaugauuacaugg

SEQ ID NO: 387480 - RNA, 22 nt, Human
uggccuuggacagagcgcuccu

SEQ ID NO: 387481 - RNA, 22 nt, Human
uggaaagaugaagauguuuaag

SEQ ID NO: 387482 - RNA, 22 nt, Human
guccaggucuggacccugagcc

SEQ ID NO: 387483 - RNA, 22 nt, Human
gacucagugauuugacaugccu

SEQ ID NO: 387484 - RNA, 22 nt, Human
gggagagagagcucauguugaa

SEQ ID NO: 387485 - RNA, 22 nt, Human
uggcucaggcuugaaaauagau

SEQ ID NO: 387486 - RNA, 23 nt, Human
ugcaggggaggcuuaaagcaggu

SEQ ID NO: 387487 - RNA, 22 nt, Human
agucauaugacccuucacaaac

SEQ ID NO: 387488 - RNA, 22 nt, Human
caggaagauuagaccaagagcu

SEQ ID NO: 387489 - RNA, 22 nt, Human
gcuccucuucucccacugaaug

SEQ ID NO: 387490 - RNA, 22 nt, Human
uccauugucuuugguccuagcc

SEQ ID NO: 387491 - RNA, 22 nt, Human
uuguuuucuccacugcaucuua

SEQ ID NO: 387492 - RNA, 22 nt, Human
ccagaggagggcucugaugagg

SEQ ID NO: 387493 - RNA, 22 nt, Human
gaagagcuauguccagggagca

SEQ ID NO: 387494 - RNA, 22 nt, Human
uagaauucauguuacuguuagc

SEQ ID NO: 387495 - RNA, 22 nt, Human
uggcugagaaugggaugaugcc

SEQ ID NO: 387496 - RNA, 18 nt, Human
ccuggcagccaugcgcgc

SEQ ID NO: 387497 - RNA, 22 nt, Human
ugggccuggagcccuggagagu

SEQ ID NO: 387498 - RNA, 22 nt, Human
ggucagguuuuuaggagugacc

SEQ ID NO: 387499 - RNA, 22 nt, Human
cuggcucagacagcugugcagu

SEQ ID NO: 387500 - RNA, 23 nt, Human
ucccaggaaucugcauuuuuaac

SEQ ID NO: 387501 - RNA, 22 nt, Human
ugugugacccccagugaagccu

SEQ ID NO: 387502 - RNA, 22 nt, Human
cagugaggaagcugucuggacc

SEQ ID NO: 387503 - RNA, 22 nt, Human
gacacagcacuguacaaggaau

SEQ ID NO: 387504 - RNA, 22 nt, Human
ugaagcccugugucagcuucca

SEQ ID NO: 387505 - RNA, 22 nt, Human
aggggccucgcaggaccgcucc

SEQ ID NO: 387506 - RNA, 22 nt, Human
aggccuggcaugagaccugaga

SEQ ID NO: 387507 - RNA, 22 nt, Human
uccagaauauuugggaaagaug

SEQ ID NO: 387508 - RNA, 22 nt, Human
guuuuucuaggaccaugugauu

SEQ ID NO: 387509 - RNA, 22 nt, Human
cuucagaagaaaagcagugugu

SEQ ID NO: 387510 - RNA, 21 nt, Human
agagaauugccuuagauguuc

SEQ ID NO: 387511 - RNA, 22 nt, Human
ugguggcaauguccuggagaag

SEQ ID NO: 387512 - RNA, 22 nt, Human
gccagcugguaggcaccuagcc

SEQ ID NO: 387513 - RNA, 22 nt, Human
aggcacaggccucagcacccag

SEQ ID NO: 387514 - RNA, 22 nt, Human
ugcagcuguaacagaggccuca

SEQ ID NO: 387515 - RNA, 22 nt, Human
cccagcccaucucaaaggucua

SEQ ID NO: 387516 - RNA, 22 nt, Human
auugucuguacuuuaaaaaugu

SEQ ID NO: 387517 - RNA, 22 nt, Human
cuuccugcauugugccagaguu

SEQ ID NO: 387518 - RNA, 22 nt, Human
cccugcaggggaccugcagccu

SEQ ID NO: 387519 - RNA, 22 nt, Human
aagcagagcaagcguauuuauu

SEQ ID NO: 387520 - RNA, 22 nt, Human
cagggcugaacugagcuuguga

SEQ ID NO: 387521 - RNA, 20 nt, Human
ucacaucuggcagcugauga

SEQ ID NO: 387522 - RNA, 22 nt, Human
auuauuagauucuuaauuguaa

SEQ ID NO: 387523 - RNA, 22 nt, Human
uccuggauaucaaacaaacauu

SEQ ID NO: 387524 - RNA, 22 nt, Human
auguucuuucagccagugcauc

SEQ ID NO: 387525 - RNA, 22 nt, Human
uccaaaguguugggauuauagg

SEQ ID NO: 387526 - RNA, 22 nt, Human
aucaggaucacugggagucuug

SEQ ID NO: 387527 - RNA, 22 nt, Human
cuuccaaacccaggguaugggc

SEQ ID NO: 387528 - RNA, 22 nt, Human
ucauuucccuccuacaaagagg

SEQ ID NO: 387529 - RNA, 22 nt, Human
aauaauuuccagccaacuggaa

SEQ ID NO: 387530 - RNA, 22 nt, Human
auggcauuugaaucugucuuuu

SEQ ID NO: 387531 - RNA, 22 nt, Human
uauuucuggcuuugagggugau

SEQ ID NO: 387532 - RNA, 22 nt, Human
agggaaaggcugaugcuguggg

SEQ ID NO: 387533 - RNA, 22 nt, Human
aaguuuuccuguguccaagaug

SEQ ID NO: 387534 - RNA, 22 nt, Human
gaagucugcugcucaggaguuu

SEQ ID NO: 387535 - RNA, 22 nt, Human
cucuucuuggcccccaugaggg

SEQ ID NO: 387536 - RNA, 22 nt, Human
gucaggauuuuaaaaucccagu

SEQ ID NO: 387537 - RNA, 22 nt, Human
ugguacuuggaggcagaaaaau

SEQ ID NO: 387538 - RNA, 22 nt, Human
uuuugaaagggugauuuggcuu

SEQ ID NO: 387539 - RNA, 22 nt, Human
auaguacacauccuacaauguu

SEQ ID NO: 387540 - RNA, 22 nt, Human
cacacauugaauucauucuugu

SEQ ID NO: 387541 - RNA, 22 nt, Human
gagcuuggugaugccuccuggu

SEQ ID NO: 387542 - RNA, 22 nt, Human
gccuuccuuuuaccaccagcca

SEQ ID NO: 387543 - RNA, 22 nt, Human
uuucaagcauaacugggaagag

SEQ ID NO: 387544 - RNA, 22 nt, Human
ggcuuuauaggguagaggauca

SEQ ID NO: 387545 - RNA, 22 nt, Human
aucagcaaucaaauugcagagu

SEQ ID NO: 387546 - RNA, 22 nt, Human
agggcagagggugccucaccug

SEQ ID NO: 387547 - RNA, 22 nt, Human
uggugugggcguggcaggcaag

SEQ ID NO: 387548 - RNA, 22 nt, Human
guuuucaauuauaagauggcuu

SEQ ID NO: 387549 - RNA, 22 nt, Human
auucaagagcccauguuuccug

SEQ ID NO: 387550 - RNA, 22 nt, Human
cugugaggcccugggugcugga

SEQ ID NO: 387551 - RNA, 22 nt, Human
caggagugaguuggggucuaca

SEQ ID NO: 387552 - RNA, 22 nt, Human
caguaugucuacuggacaaagu

SEQ ID NO: 387553 - RNA, 22 nt, Human
ccugagccugaguggugcaggg

SEQ ID NO: 387554 - RNA, 22 nt, Human
gcaagcugcucuuauguggagg

SEQ ID NO: 387555 - RNA, 22 nt, Human
cacuuaagcaguuaauuuaucu

SEQ ID NO: 387556 - RNA, 22 nt, Human
aagaaacaaccacugcucuccu

SEQ ID NO: 387557 - RNA, 17 nt, Human
uccauacaauucucucu

SEQ ID NO: 387558 - RNA, 22 nt, Human
gcugucugggaggccuccacuu

SEQ ID NO: 387559 - RNA, 22 nt, Human
aguuauaugugaaaacacguau

SEQ ID NO: 387560 - RNA, 20 nt, Human
gaaaugugaccucuucugug

SEQ ID NO: 387561 - RNA, 22 nt, Human
guggccugggguuuguucugag

SEQ ID NO: 387562 - RNA, 22 nt, Human
uggcuuuagguugcauguuucu

SEQ ID NO: 387563 - RNA, 22 nt, Human
cccuccccacaaagcuucacac

SEQ ID NO: 387564 - RNA, 22 nt, Human
uucuuaaucccacaaaucuuca

SEQ ID NO: 387565 - RNA, 19 nt, Human
augauacaggugaaaauug

SEQ ID NO: 387566 - RNA, 22 nt, Human
agaagucauuuauguuagauga

SEQ ID NO: 387567 - RNA, 17 nt, Human
gagacagcaggagcccc

SEQ ID NO: 387568 - RNA, 22 nt, Human
aucacaaaggucucagagcaca

SEQ ID NO: 387569 - RNA, 22 nt, Human
uaucuguuccaggcacucagcu

SEQ ID NO: 387570 - RNA, 22 nt, Human
ucccagcccagauuugugugac

SEQ ID NO: 387571 - RNA, 22 nt, Human
cuuauacacccucuucccaggc

SEQ ID NO: 387572 - RNA, 22 nt, Human
cugucuccagggcaggugcagg

SEQ ID NO: 387573 - RNA, 22 nt, Human
aaggcacucagccuugggacag

SEQ ID NO: 387574 - RNA, 22 nt, Human
aaagccauaagccuaauacuaa

SEQ ID NO: 387575 - RNA, 22 nt, Human
aagacauuuauuugaaucaauu

SEQ ID NO: 387576 - RNA, 22 nt, Human
ucugagcuacgaugccugucac

SEQ ID NO: 387577 - RNA, 22 nt, Human
cagcugcuuuaguuuuccaucc

SEQ ID NO: 387578 - RNA, 22 nt, Human
gugcaguggcagauccuagcuc

SEQ ID NO: 387579 - RNA, 22 nt, Human
acuggacagaggaaauauggag

SEQ ID NO: 387580 - RNA, 22 nt, Human
ccagcuuuuggggugacaauuu

SEQ ID NO: 387581 - RNA, 22 nt, Human
agcuuuaccugccuuggggcac

SEQ ID NO: 387582 - RNA, 22 nt, Human
ccuggagcacucucccuggcug

SEQ ID NO: 387583 - RNA, 22 nt, Human
ugcauuuccagauuucuggagu

SEQ ID NO: 387584 - RNA, 22 nt, Human
gcucccagaaccaaggcugggg

SEQ ID NO: 387585 - RNA, 22 nt, Human
agccacagucugaugccugaga

SEQ ID NO: 387586 - RNA, 22 nt, Human
uggcuucuugggaugggucauu

SEQ ID NO: 387587 - RNA, 17 nt, Human
ucuguucaagugagagg

SEQ ID NO: 387588 - RNA, 22 nt, Human
ucacaguaucacacaaggauua

SEQ ID NO: 387589 - RNA, 22 nt, Human
aggcaggugggucacuugaguc

SEQ ID NO: 387590 - RNA, 21 nt, Human
uccuuccuugagguccuuucc

SEQ ID NO: 387591 - RNA, 22 nt, Human
agcuuuaucagaggagucucua

SEQ ID NO: 387592 - RNA, 22 nt, Human
cacauaauacauguuccacuua

SEQ ID NO: 387593 - RNA, 22 nt, Human
aggcugcagugcagguaggauu

SEQ ID NO: 387594 - RNA, 22 nt, Human
uguuuuuaaauaaugauagaaa

SEQ ID NO: 387595 - RNA, 22 nt, Human
ugcuuugggucucucuaguuuc

SEQ ID NO: 387596 - RNA, 22 nt, Human
cuuguauuccccuaucucuaaa

SEQ ID NO: 387597 - RNA, 22 nt, Human
uaauuguagcuuuguaaucagc

SEQ ID NO: 387598 - RNA, 22 nt, Human
cuguuuauaaauagaggggagu

SEQ ID NO: 387599 - RNA, 22 nt, Human
uacaaagccugguagauaucug

SEQ ID NO: 387600 - RNA, 22 nt, Human
ugaucagucccaugaucuucca

SEQ ID NO: 387601 - RNA, 22 nt, Human
gggagggaaggaccuuaugaau

SEQ ID NO: 387602 - RNA, 22 nt, Human
ucagucuucccuccagugcaac

SEQ ID NO: 387603 - RNA, 22 nt, Human
cuccucugucuaccacgagggu

SEQ ID NO: 387604 - RNA, 19 nt, Human
gcugcucugggucucaucu

SEQ ID NO: 387605 - RNA, 22 nt, Human
aauuaauggaaaguaaggaagg

SEQ ID NO: 387606 - RNA, 22 nt, Human
acaguggaauggugggccugca

SEQ ID NO: 387607 - RNA, 22 nt, Human
gcugggagccccgagccagcgc

SEQ ID NO: 387608 - RNA, 22 nt, Human
ggcagggcccugauuccugggg

SEQ ID NO: 387609 - RNA, 22 nt, Human
cagaggcagacccuccagggcg

SEQ ID NO: 387610 - RNA, 22 nt, Human
uuucucaguuacuagcuguggu

SEQ ID NO: 387611 - RNA, 22 nt, Human
uugcaaaggggaauaaagcaau

SEQ ID NO: 387612 - RNA, 22 nt, Human
aggcagcaaagaaaugaugcug

SEQ ID NO: 387613 - RNA, 22 nt, Human
uggagcaggacggggaguggua

SEQ ID NO: 387614 - RNA, 22 nt, Human
aggcuuccucgugccuuagaua

SEQ ID NO: 387615 - RNA, 22 nt, Human
gcugccaccguggagaugagug

SEQ ID NO: 387616 - RNA, 22 nt, Human
acaucagauuaugcuuugcuua

SEQ ID NO: 387617 - RNA, 22 nt, Human
agcagcauuaagggaacugcag

SEQ ID NO: 387618 - RNA, 22 nt, Human
cccaggcagaauuaguguuuca

SEQ ID NO: 387619 - RNA, 22 nt, Human
ccugucugcagauaucucaggu

SEQ ID NO: 387620 - RNA, 22 nt, Human
aaaugcuuagagguguucaaau

SEQ ID NO: 387621 - RNA, 22 nt, Human
uuguuuugcuaaagggucauca

SEQ ID NO: 387622 - RNA, 22 nt, Human
uggagaaggacagccugagaaa

SEQ ID NO: 387623 - RNA, 22 nt, Human
ugccuugcacauaauauacauu

SEQ ID NO: 387624 - RNA, 22 nt, Human
gcagccccaggagacgcccagg

SEQ ID NO: 387625 - RNA, 22 nt, Human
uggagccauaacccuuucguac

SEQ ID NO: 387626 - RNA, 22 nt, Human
aagacaugcaauuagcaaggaa

SEQ ID NO: 387627 - RNA, 22 nt, Human
uuuguacauauauaaaaucugu

SEQ ID NO: 387628 - RNA, 22 nt, Human
uucaaaauuguucuaagcucug

SEQ ID NO: 387629 - RNA, 22 nt, Human
aaaugcaauuguauguacucca

SEQ ID NO: 387630 - RNA, 22 nt, Human
agguagaggccuccaggcagca

SEQ ID NO: 387631 - RNA, 22 nt, Human
acuguguccuauuuccuugaca

SEQ ID NO: 387632 - RNA, 22 nt, Human
gggcagcugccaagugcaucgc

SEQ ID NO: 387633 - RNA, 22 nt, Human
agcugggaggugggcagugaga

SEQ ID NO: 387634 - RNA, 18 nt, Human
cugcuugggagacgucag

SEQ ID NO: 387635 - RNA, 22 nt, Human
cagggcucaccacugggauccu

SEQ ID NO: 387636 - RNA, 22 nt, Human
uccuggagagugggcgagcaca

SEQ ID NO: 387637 - RNA, 22 nt, Human
agcccaggaaucugcaucuuga

SEQ ID NO: 387638 - RNA, 22 nt, Human
ccacuugugaaauaaucaaaua

SEQ ID NO: 387639 - RNA, 22 nt, Human
acauuuaaauaccuauguuucu

SEQ ID NO: 387640 - RNA, 22 nt, Human
ggcucaggcuggagugcagugg

SEQ ID NO: 387641 - RNA, 22 nt, Human
ucaccacugaacagaccuuugg

SEQ ID NO: 387642 - RNA, 22 nt, Human
gggaccuggggacuccuuguuc

SEQ ID NO: 387643 - RNA, 22 nt, Human
caagggcucuuuugaggaaugu

SEQ ID NO: 387644 - RNA, 22 nt, Human
gaggagcugggcugagaggguc

SEQ ID NO: 387645 - RNA, 22 nt, Human
ugcagcauuauucacaguagcc

SEQ ID NO: 387646 - RNA, 22 nt, Human
agaugcugcuccacaggccagg

SEQ ID NO: 387647 - RNA, 22 nt, Human
ccagucccgcaugguccagaau

SEQ ID NO: 387648 - RNA, 22 nt, Human
aggcugagcuggcccuugaaau

SEQ ID NO: 387649 - RNA, 22 nt, Human
aaggcaggaugggaaaagauuu

SEQ ID NO: 387650 - RNA, 22 nt, Human
gagcugccuguugcauagcaac

SEQ ID NO: 387651 - RNA, 22 nt, Human
uccugcagaucaaagccuuuga

SEQ ID NO: 387652 - RNA, 22 nt, Human
ccucauggaccucagacugucc

SEQ ID NO: 387653 - RNA, 22 nt, Human
uccaggagucuagccucaggcc

SEQ ID NO: 387654 - RNA, 18 nt, Human
cuuucagauggauaugcu

SEQ ID NO: 387655 - RNA, 22 nt, Human
agugaaauaugcccauugcugu

SEQ ID NO: 387656 - RNA, 22 nt, Human
gggcuggaggugagcaggacag

SEQ ID NO: 387657 - RNA, 22 nt, Human
cccauuuaaacacaagcuuuca

SEQ ID NO: 387658 - RNA, 22 nt, Human
augcuguggaaguuccugaagc

SEQ ID NO: 387659 - RNA, 22 nt, Human
agcugggcagacugcagugguu

SEQ ID NO: 387660 - RNA, 19 nt, Human
cauuuuaagcauccccagu

SEQ ID NO: 387661 - RNA, 22 nt, Human
guauuugauacaugaaauggug

SEQ ID NO: 387662 - RNA, 22 nt, Human
aagcacuuagaagagugccugc

SEQ ID NO: 387663 - RNA, 23 nt, Human
ucuuuccucagcacacaccaaga

SEQ ID NO: 387664 - RNA, 22 nt, Human
cagagugaaauaggggaucaag

SEQ ID NO: 387665 - RNA, 22 nt, Human
guaucuuuuacaccaggaaauu

SEQ ID NO: 387666 - RNA, 22 nt, Human
uccuucaguuaucacaguacug

SEQ ID NO: 387667 - RNA, 22 nt, Human
cagaggaaggcucugggaaugu

SEQ ID NO: 387668 - RNA, 22 nt, Human
cagaggcugggaccucaggcau

SEQ ID NO: 387669 - RNA, 22 nt, Human
acagggccauuaucuguucuag

SEQ ID NO: 387670 - RNA, 22 nt, Human
cuuuggcaugguccucacuaua

SEQ ID NO: 387671 - RNA, 22 nt, Human
ggaggggaggauuaaugacaaa

SEQ ID NO: 387672 - RNA, 23 nt, Human
agcagcaaaaauuuaucuuucug

SEQ ID NO: 387673 - RNA, 20 nt, Human
aagcagaagcugcucucagc

SEQ ID NO: 387674 - RNA, 22 nt, Human
gaacaauagugguaacaaagcc

SEQ ID NO: 387675 - RNA, 22 nt, Human
ugaagccagucaauguuaaguu

SEQ ID NO: 387676 - RNA, 22 nt, Human
gcuucccacagcuggacugggg

SEQ ID NO: 387677 - RNA, 22 nt, Human
aaaauugaagugaucaggaacu

SEQ ID NO: 387678 - RNA, 22 nt, Human
ggcucaggccagaccacgacuc

SEQ ID NO: 387679 - RNA, 22 nt, Human
gccgugcgugcgcaggugcugu

SEQ ID NO: 387680 - RNA, 22 nt, Human
uaagaacaucuguccccagauu

SEQ ID NO: 387681 - RNA, 22 nt, Human
aggacuucaucaccuguauaaa

SEQ ID NO: 387682 - RNA, 22 nt, Human
gagagcugcaagguagggcggg

SEQ ID NO: 387683 - RNA, 22 nt, Human
cuacuucuaaguacauggugau

SEQ ID NO: 387684 - RNA, 22 nt, Human
uacaguuuguuacauuguuagu

SEQ ID NO: 387685 - RNA, 17 nt, Human
ggcaccagacggagagu

SEQ ID NO: 387686 - RNA, 22 nt, Human
caggccucuauggucagcugag

SEQ ID NO: 387687 - RNA, 22 nt, Human
gaaggcuugcagcucuguggca

SEQ ID NO: 387688 - RNA, 17 nt, Human
gagugcugguggagcuc

SEQ ID NO: 387689 - RNA, 22 nt, Human
aggggccugguuggccucuguu

SEQ ID NO: 387690 - RNA, 22 nt, Human
gagcuggugugugcccgagcac

SEQ ID NO: 387691 - RNA, 22 nt, Human
cucaucugauaaaucacucuua

SEQ ID NO: 387692 - RNA, 22 nt, Human
aacaugucuggguauucacaag

SEQ ID NO: 387693 - RNA, 22 nt, Human
uuccucagccaaggcugggauc

SEQ ID NO: 387694 - RNA, 22 nt, Human
gagacaaaaguuggagugcaag

SEQ ID NO: 387695 - RNA, 22 nt, Human
gaguccaguaguuaggacagag

SEQ ID NO: 387696 - RNA, 22 nt, Human
acuccuggggauccauuccuuu

SEQ ID NO: 387697 - RNA, 22 nt, Human
uaaauucuacaacuucaaagau

SEQ ID NO: 387698 - RNA, 22 nt, Human
ccuggccagaggcgugccugug

SEQ ID NO: 387699 - RNA, 22 nt, Human
uaguccagccuuggguguagcc

SEQ ID NO: 387700 - RNA, 22 nt, Human
aguuggagugaacaugagauug

SEQ ID NO: 387701 - RNA, 22 nt, Human
cagccacguagcccuuggccgu

SEQ ID NO: 387702 - RNA, 22 nt, Human
uguauguaaaguuuguaauaga

SEQ ID NO: 387703 - RNA, 22 nt, Human
ugguaucagagccaucuguauu

SEQ ID NO: 387704 - RNA, 22 nt, Human
ucaguuuuaagguuugagaauu

SEQ ID NO: 387705 - RNA, 22 nt, Human
guuaaagaguuuggcuuucuuc

SEQ ID NO: 387706 - RNA, 22 nt, Human
ugccacaccaacaucuuucagc

SEQ ID NO: 387707 - RNA, 22 nt, Human
cucacagaugcugugggucagg

SEQ ID NO: 387708 - RNA, 22 nt, Human
cuccucugucuggcccugagcc

SEQ ID NO: 387709 - RNA, 22 nt, Human
ugggaccugcccuggccccauc

SEQ ID NO: 387710 - RNA, 22 nt, Human
ggccaggaagggaagaucagca

SEQ ID NO: 387711 - RNA, 22 nt, Human
aacagaaaucauuuagggcucu

SEQ ID NO: 387712 - RNA, 22 nt, Human
gccgaagcugccgucugguccu

SEQ ID NO: 387713 - RNA, 22 nt, Human
ggcagacuguaauaggagaauu

SEQ ID NO: 387714 - RNA, 22 nt, Human
cacugagaggucucauuuccaa

SEQ ID NO: 387715 - RNA, 22 nt, Human
gacccagccugguuuuuauagg

SEQ ID NO: 387716 - RNA, 22 nt, Human
ucaaugauaucagcaggaugug

SEQ ID NO: 387717 - RNA, 23 nt, Human
agaaaagcuuggacacauggccu

SEQ ID NO: 387718 - RNA, 22 nt, Human
aaaugaacaguugcauucucug

SEQ ID NO: 387719 - RNA, 21 nt, Human
uucucagaucgaguagugaga

SEQ ID NO: 387720 - RNA, 22 nt, Human
acaccauacucauguugguucc

SEQ ID NO: 387721 - RNA, 22 nt, Human
gcagcccagagcgcaggacccc

SEQ ID NO: 387722 - RNA, 22 nt, Human
ugcuuuauagacaaggaaguag

SEQ ID NO: 387723 - RNA, 19 nt, Human
guagggacagugguucuga

SEQ ID NO: 387724 - RNA, 22 nt, Human
ugggcagaguagcucagaagaa

SEQ ID NO: 387725 - RNA, 22 nt, Human
agaaaucugacugcugugcaca

SEQ ID NO: 387726 - RNA, 22 nt, Human
uagggcugugucuccaggacca

SEQ ID NO: 387727 - RNA, 22 nt, Human
gggccuguguguucaggagccu

SEQ ID NO: 387728 - RNA, 22 nt, Human
gcuccacuugcagcuaggcuug

SEQ ID NO: 387729 - RNA, 19 nt, Human
uccauaagcuuguguucau

SEQ ID NO: 387730 - RNA, 22 nt, Human
acauuucucuugaugucucuau

SEQ ID NO: 387731 - RNA, 22 nt, Human
aggaccugacauuguguuuucu

SEQ ID NO: 387732 - RNA, 22 nt, Human
agcugaggaggaaugaugggua

SEQ ID NO: 387733 - RNA, 22 nt, Human
gcaggugaaugauggacuagga

SEQ ID NO: 387734 - RNA, 22 nt, Human
uccaggcaugucugaguccuuc

SEQ ID NO: 387735 - RNA, 22 nt, Human
agucucagaaaagaagcaugga

SEQ ID NO: 387736 - RNA, 22 nt, Human
ccacagggcacaagggagguug

SEQ ID NO: 387737 - RNA, 22 nt, Human
cagagccagaacuagaccuugu

SEQ ID NO: 387738 - RNA, 20 nt, Human
aguaccuuuuguauguuacc

SEQ ID NO: 387739 - RNA, 22 nt, Human
gccugugcauagcagcggacuc

SEQ ID NO: 387740 - RNA, 22 nt, Human
cugcugggcuccucaugugacu

SEQ ID NO: 387741 - RNA, 22 nt, Human
agaucugaggguccaagggagg

SEQ ID NO: 387742 - RNA, 22 nt, Human
ggccugcuucucagugagcuug

SEQ ID NO: 387743 - RNA, 22 nt, Human
ucacaggguaucugggauggau

SEQ ID NO: 387744 - RNA, 22 nt, Human
gccaggagaaugcuagcagagg

SEQ ID NO: 387745 - RNA, 22 nt, Human
ugaggcuugucucagauggggg

SEQ ID NO: 387746 - RNA, 22 nt, Human
uuauuauugugaccugagaaug

SEQ ID NO: 387747 - RNA, 22 nt, Human
gcagugaaaaagugcacccugu

SEQ ID NO: 387748 - RNA, 22 nt, Human
uuccaaaggaauggggagcuau

SEQ ID NO: 387749 - RNA, 22 nt, Human
uagucuuuuuaauaaauaaugc

SEQ ID NO: 387750 - RNA, 22 nt, Human
uggacagcgaaagugccuggga

SEQ ID NO: 387751 - RNA, 22 nt, Human
cugccagcacugccuccugagg

SEQ ID NO: 387752 - RNA, 22 nt, Human
ggaugcaggaguugaagaagga

SEQ ID NO: 387753 - RNA, 22 nt, Human
aggccagcccugggcugagaga

SEQ ID NO: 387754 - RNA, 22 nt, Human
cccagccucagcuuuacuucca

SEQ ID NO: 387755 - RNA, 22 nt, Human
agcagggcuccugaaagccgcg

SEQ ID NO: 387756 - RNA, 22 nt, Human
gcuguccaugucuggccucagu

SEQ ID NO: 387757 - RNA, 22 nt, Human
uggccugaauuauggcagaucu

SEQ ID NO: 387758 - RNA, 22 nt, Human
gucucccaaccccugugcccag

SEQ ID NO: 387759 - RNA, 22 nt, Human
gacaugcaacaauuuggcauuu

SEQ ID NO: 387760 - RNA, 22 nt, Human
aagauuuccuucaguagagcua

SEQ ID NO: 387761 - RNA, 22 nt, Human
uggcaggauuugcccggaagga

SEQ ID NO: 387762 - RNA, 22 nt, Human
gagcagcucugugccuggagac

SEQ ID NO: 387763 - RNA, 22 nt, Human
ugcagggaagcaaggguggcuc

SEQ ID NO: 387764 - RNA, 22 nt, Human
agccagagcugaugucauucuc

SEQ ID NO: 387765 - RNA, 22 nt, Human
ugagagucucagaccuccuggu

SEQ ID NO: 387766 - RNA, 22 nt, Human
caguccugugucccuugguggg

SEQ ID NO: 387767 - RNA, 22 nt, Human
uaaguucaagucuuggauauaa

SEQ ID NO: 387768 - RNA, 22 nt, Human
aaagacauggaacuagagaugg

SEQ ID NO: 387769 - RNA, 22 nt, Human
ccaggaaugaaauguagauaaa

SEQ ID NO: 387770 - RNA, 21 nt, Human
agcugggccucagccugcagu

SEQ ID NO: 387771 - RNA, 22 nt, Human
augggcagacagggagcucacg

SEQ ID NO: 387772 - RNA, 22 nt, Human
agcuguguagggaaucagagaa

SEQ ID NO: 387773 - RNA, 22 nt, Human
uauaucuuauaugugcagguac

SEQ ID NO: 387774 - RNA, 22 nt, Human
aggcugcucaguagauggagcu

SEQ ID NO: 387775 - RNA, 22 nt, Human
cccaggaaugagcaggcagggg

SEQ ID NO: 387776 - RNA, 22 nt, Human
uaucuuugcaaauaucucuaag

SEQ ID NO: 387777 - RNA, 22 nt, Human
uggcuuccgccgcgggccucgg

SEQ ID NO: 387778 - RNA, 22 nt, Human
aaagucuuuauuuuguaucuuu

SEQ ID NO: 387779 - RNA, 22 nt, Human
caguaaauuaucucaucucugu

SEQ ID NO: 387780 - RNA, 22 nt, Human
ucuggagagucacagugccaga

SEQ ID NO: 387781 - RNA, 22 nt, Human
agugcaugccuuccuguggaug

SEQ ID NO: 387782 - RNA, 22 nt, Human
ugugcagcucuagagccaagcc

SEQ ID NO: 387783 - RNA, 22 nt, Human
cugcccaggaaccagaggggca

SEQ ID NO: 387784 - RNA, 22 nt, Human
agggacaguuacaucaucagac

SEQ ID NO: 387785 - RNA, 22 nt, Human
ugcucauuggcgaucugaggga

SEQ ID NO: 387786 - RNA, 22 nt, Human
gugcccugguccccagcauaua

SEQ ID NO: 387787 - RNA, 22 nt, Human
ggcagcagaacuggcccuguau

SEQ ID NO: 387788 - RNA, 22 nt, Human
uggcucaggauaauuuucccaa

SEQ ID NO: 387789 - RNA, 22 nt, Human
gccugugguuugauuaagcauu

SEQ ID NO: 387790 - RNA, 22 nt, Human
gaagucugacucuuuguaagcu

SEQ ID NO: 387791 - RNA, 22 nt, Human
ccaggaaauggcuugcuucuuu

SEQ ID NO: 387792 - RNA, 22 nt, Human
gccagagcugagugagguucuu

SEQ ID NO: 387793 - RNA, 22 nt, Human
ugggccuggaguuuguccagag

SEQ ID NO: 387794 - RNA, 22 nt, Human
cagggagcuggugccagccgac

SEQ ID NO: 387795 - RNA, 22 nt, Human
aaauaauugaguuggucaauau

SEQ ID NO: 387796 - RNA, 22 nt, Human
cagucccagacccagaaggugg

SEQ ID NO: 387797 - RNA, 22 nt, Human
gagcucugacugcugggugaca

SEQ ID NO: 387798 - RNA, 22 nt, Human
auuccaaacucuuucccugucg

SEQ ID NO: 387799 - RNA, 22 nt, Human
uaugcugugcuagauacaauau

SEQ ID NO: 387800 - RNA, 22 nt, Human
gcaaguuauuuccauuuaaagc

SEQ ID NO: 387801 - RNA, 22 nt, Human
cagagcugcuucccaguuugug

SEQ ID NO: 387802 - RNA, 22 nt, Human
uuaauuuauguccaaaccagau

SEQ ID NO: 387803 - RNA, 22 nt, Human
aaagucauguaaugauaugauu

SEQ ID NO: 387804 - RNA, 22 nt, Human
aauuucaauuacuuuugcacca

SEQ ID NO: 387805 - RNA, 22 nt, Human
cuuuucaugagucuguuauggg

SEQ ID NO: 387806 - RNA, 22 nt, Human
gcaugucaugucauguaggaau

SEQ ID NO: 387807 - RNA, 23 nt, Human
aggaacugaggccuagggaggua

SEQ ID NO: 387808 - RNA, 22 nt, Human
uguggcucucaugcacucccag

SEQ ID NO: 387809 - RNA, 17 nt, Human
ucaggcugggugcagug

SEQ ID NO: 387810 - RNA, 22 nt, Human
agcagagcggggccuccggaag

SEQ ID NO: 387811 - RNA, 22 nt, Human
ucuguucauacagaguauagua

SEQ ID NO: 387812 - RNA, 22 nt, Human
auucauuccaggucagucagac

SEQ ID NO: 387813 - RNA, 22 nt, Human
uggcagugccccuugaccagug

SEQ ID NO: 387814 - RNA, 21 nt, Human
ccuucuccacagggucuccgg

SEQ ID NO: 387815 - RNA, 22 nt, Human
uguuaaauguuccuuuacugga

SEQ ID NO: 387816 - RNA, 22 nt, Human
aauuuuaagcauaugacugguu

SEQ ID NO: 387817 - RNA, 21 nt, Human
ucuggagcccuaagcugagaa

SEQ ID NO: 387818 - RNA, 22 nt, Human
ugggguggauagaaagugaugu

SEQ ID NO: 387819 - RNA, 22 nt, Human
ugcugcuguauccuuaguguca

SEQ ID NO: 387820 - RNA, 22 nt, Human
ggcccagcccgagucagccuuc

SEQ ID NO: 387821 - RNA, 23 nt, Human
ccugcucaggcgugugcccugcu

SEQ ID NO: 387822 - RNA, 21 nt, Human
gcaugccugcaucuuaguguu

SEQ ID NO: 387823 - RNA, 22 nt, Human
aagcagaauuucccacuaguug

SEQ ID NO: 387824 - RNA, 22 nt, Human
acauuucugcaucucagagcua

SEQ ID NO: 387825 - RNA, 22 nt, Human
uggcucagagcagggacucugg

SEQ ID NO: 387826 - RNA, 22 nt, Human
gagauggggucagcugggacau

SEQ ID NO: 387827 - RNA, 22 nt, Human
uuuccaaaaugaaucuaaugca

SEQ ID NO: 387828 - RNA, 22 nt, Human
uuuccucuucuggcaggcaggg

SEQ ID NO: 387829 - RNA, 22 nt, Human
cacagcugaaguagccaugugg

SEQ ID NO: 387830 - RNA, 22 nt, Human
caaggccauaagagauacaaaa

SEQ ID NO: 387831 - RNA, 22 nt, Human
guuaggcaugaguguguauuaa

SEQ ID NO: 387832 - RNA, 22 nt, Human
ucuucagauaaagggagaguau

SEQ ID NO: 387833 - RNA, 22 nt, Human
uucauagugauuguucagauag

SEQ ID NO: 387834 - RNA, 22 nt, Human
aguuucuaccgguacauucagg

SEQ ID NO: 387835 - RNA, 22 nt, Human
ggaggggagauguuugggcuca

SEQ ID NO: 387836 - RNA, 22 nt, Human
aggcagaggagaaugaucuucc

SEQ ID NO: 387837 - RNA, 22 nt, Human
aaagggcugucaaauaagcaac

SEQ ID NO: 387838 - RNA, 22 nt, Human
uaacacaaaagaauaugugugu

SEQ ID NO: 387839 - RNA, 22 nt, Human
cagaggcugcucuggguggcau

SEQ ID NO: 387840 - RNA, 22 nt, Human
gcaggaugggagcuucacuuug

SEQ ID NO: 387841 - RNA, 22 nt, Human
gaaauuauugcuagagacugca

SEQ ID NO: 387842 - RNA, 22 nt, Human
caaauagugucacauugugagg

SEQ ID NO: 387843 - RNA, 22 nt, Human
cuccagugggggugagccuaga

SEQ ID NO: 387844 - RNA, 18 nt, Human
ccugccagucuggagcag

SEQ ID NO: 387845 - RNA, 22 nt, Human
cacuggaauauggcguugaacc

SEQ ID NO: 387846 - RNA, 22 nt, Human
cagacccugggccacagaggag

SEQ ID NO: 387847 - RNA, 20 nt, Human
gccaggagggugugaugagc

SEQ ID NO: 387848 - RNA, 22 nt, Human
cccugccucugaagcugcucag

SEQ ID NO: 387849 - RNA, 22 nt, Human
auuaaauuggacgcugggggaa

SEQ ID NO: 387850 - RNA, 22 nt, Human
gagagcugauagaugagcuacu

SEQ ID NO: 387851 - RNA, 22 nt, Human
agcugccaucugaagaacugca

SEQ ID NO: 387852 - RNA, 22 nt, Human
acaaacuaccuacagauguuca

SEQ ID NO: 387853 - RNA, 22 nt, Human
aauguacaaaagucagccaacu

SEQ ID NO: 387854 - RNA, 22 nt, Human
gaggccaggaagcccaagauca

SEQ ID NO: 387855 - RNA, 22 nt, Human
cucucugagugagggacaagcu

SEQ ID NO: 387856 - RNA, 22 nt, Human
cugcagcuauauuuucccacag

SEQ ID NO: 387857 - RNA, 22 nt, Human
aaguucaaguguaaucuuuauu

SEQ ID NO: 387858 - RNA, 22 nt, Human
auccuucagcugcccuguuacc

SEQ ID NO: 387859 - RNA, 22 nt, Human
ucagagaguccuggucauuugc

SEQ ID NO: 387860 - RNA, 22 nt, Human
gcugcucugcuguguaagcagg

SEQ ID NO: 387861 - RNA, 23 nt, Human
aggauuuaaaggcaaugcauuuu

SEQ ID NO: 387862 - RNA, 22 nt, Human
agcagggggccacagucacagc

SEQ ID NO: 387863 - RNA, 22 nt, Human
cauuuauuggcauguaguaggu

SEQ ID NO: 387864 - RNA, 19 nt, Human
uacuuuuucaggacagagu

SEQ ID NO: 387865 - RNA, 22 nt, Human
ucuccugugcacccucccugug

SEQ ID NO: 387866 - RNA, 18 nt, Human
ugcuggguaacuguaugg

SEQ ID NO: 387867 - RNA, 22 nt, Human
auaugagaauuggaaaauauca

SEQ ID NO: 387868 - RNA, 22 nt, Human
auugacaagacaauggcucuua

SEQ ID NO: 387869 - RNA, 22 nt, Human
ugcccaaguccuccaccgaggu

SEQ ID NO: 387870 - RNA, 22 nt, Human
ggugcuggacacguggcacucc

SEQ ID NO: 387871 - RNA, 22 nt, Human
gcagagguggcaucugggcucu

SEQ ID NO: 387872 - RNA, 22 nt, Human
ggaagccaguugcuuggugugg

SEQ ID NO: 387873 - RNA, 20 nt, Human
ccucucugaagaggucaucu

SEQ ID NO: 387874 - RNA, 22 nt, Human
uagucaccagcuacaggacagc

SEQ ID NO: 387875 - RNA, 22 nt, Human
cagggugccaaagaacaaauau

SEQ ID NO: 387876 - RNA, 19 nt, Human
augucuggguaacagcugc

SEQ ID NO: 387877 - RNA, 22 nt, Human
gccagcaguccugcugugugcc

SEQ ID NO: 387878 - RNA, 22 nt, Human
agcuuccucaccucagaggucu

SEQ ID NO: 387879 - RNA, 22 nt, Human
uauuuugacgauuuuaugcaaa

SEQ ID NO: 387880 - RNA, 22 nt, Human
agaaagaacgcacuugugcugc

SEQ ID NO: 387881 - RNA, 22 nt, Human
uuacuucuuacaaaagaaauau

SEQ ID NO: 387882 - RNA, 22 nt, Human
caggggaaggagccuugaaacu

SEQ ID NO: 387883 - RNA, 22 nt, Human
cuggaagaggaagccagcugga

SEQ ID NO: 387884 - RNA, 22 nt, Human
cagggccacuguagaugaggag

SEQ ID NO: 387885 - RNA, 22 nt, Human
ccagaaaaugcagaacauagaa

SEQ ID NO: 387886 - RNA, 22 nt, Human
gggagcugguuccugcccucca

SEQ ID NO: 387887 - RNA, 22 nt, Human
uagucaccuguugugugaugcc

SEQ ID NO: 387888 - RNA, 21 nt, Human
uuucugaaggcaacaucuauc

SEQ ID NO: 387889 - RNA, 22 nt, Human
gagagucuagugcaccuaguuu

SEQ ID NO: 387890 - RNA, 22 nt, Human
caaaugugguuucucagcauuc

SEQ ID NO: 387891 - RNA, 22 nt, Human
agcagcugccagagagaguucc

SEQ ID NO: 387892 - RNA, 22 nt, Human
cugaggcugggcugaggguaua

SEQ ID NO: 387893 - RNA, 22 nt, Human
ggcucuggguucugcaaugcgu

SEQ ID NO: 387894 - RNA, 22 nt, Human
agccagcuguucuggggcagca

SEQ ID NO: 387895 - RNA, 22 nt, Human
gccuucaggaggguuccagaca

SEQ ID NO: 387896 - RNA, 22 nt, Human
aaauuauuacaagcuaguuggc

SEQ ID NO: 387897 - RNA, 22 nt, Human
acuuucucaaaucagacuuuaa

SEQ ID NO: 387898 - RNA, 22 nt, Human
gcucccagauuucagccuugug

SEQ ID NO: 387899 - RNA, 21 nt, Human
acagggcaugcagcuggcugu

SEQ ID NO: 387900 - RNA, 22 nt, Human
ugugccagccucuggcuguguc

SEQ ID NO: 387901 - RNA, 22 nt, Human
acaugcuuuaacuuauuuugau

SEQ ID NO: 387902 - RNA, 22 nt, Human
ugucaaaaauaagagagauugu

SEQ ID NO: 387903 - RNA, 22 nt, Human
uaugugaauacagcaguggaug

SEQ ID NO: 387904 - RNA, 22 nt, Human
gauccuugcacuugacuuggca

SEQ ID NO: 387905 - RNA, 22 nt, Human
guauuagguuggugcaaaauug

SEQ ID NO: 387906 - RNA, 23 nt, Human
gcagauggccccagagugcugcc

SEQ ID NO: 387907 - RNA, 17 nt, Human
uauacacagacagacug

SEQ ID NO: 387908 - RNA, 22 nt, Human
uuugucaucccuuuugaaacug

SEQ ID NO: 387909 - RNA, 22 nt, Human
cagaucuagagcuuuuccaucu

SEQ ID NO: 387910 - RNA, 22 nt, Human
ucuucagauugcacugagcaag

SEQ ID NO: 387911 - RNA, 22 nt, Human
agcuggcagucauccuagugag

SEQ ID NO: 387912 - RNA, 22 nt, Human
uuauuuauuguguaccuacugu

SEQ ID NO: 387913 - RNA, 20 nt, Human
gaguuccccauuucuccugg

SEQ ID NO: 387914 - RNA, 22 nt, Human
cagcauggggaucacuguaggc

SEQ ID NO: 387915 - RNA, 22 nt, Human
uaccucaugcuguacagcacgu

SEQ ID NO: 387916 - RNA, 22 nt, Human
cugaggccucuguucaccagaa

SEQ ID NO: 387917 - RNA, 23 nt, Human
augaaugaauaaggcaggaaagc

SEQ ID NO: 387918 - RNA, 22 nt, Human
gcugggaggaucucucccuguc

SEQ ID NO: 387919 - RNA, 22 nt, Human
ccuggcugguggcagcgacaag

SEQ ID NO: 387920 - RNA, 22 nt, Human
uggcccugcuguaucaucugcu

SEQ ID NO: 387921 - RNA, 22 nt, Human
agggcugcaucugccuggugaa

SEQ ID NO: 387922 - RNA, 22 nt, Human
cuuucauuugauaagaaugcca

SEQ ID NO: 387923 - RNA, 23 nt, Human
ggauuuaguggaugagcugagug

SEQ ID NO: 387924 - RNA, 22 nt, Human
ugagccugcaauaagcacagcc

SEQ ID NO: 387925 - RNA, 22 nt, Human
uggagcagcuaagccucugaga

SEQ ID NO: 387926 - RNA, 22 nt, Human
gaggaggaaguucucuguaggc

SEQ ID NO: 387927 - RNA, 22 nt, Human
acccagagccagggucaggagc

SEQ ID NO: 387928 - RNA, 22 nt, Human
acguuuucuagagaauaugcag

SEQ ID NO: 387929 - RNA, 22 nt, Human
ugauuucauaguauauacauga

SEQ ID NO: 387930 - RNA, 22 nt, Human
gagcccagcuugcacauggagc

SEQ ID NO: 387931 - RNA, 22 nt, Human
aguaaacauagaauguucuucc

SEQ ID NO: 387932 - RNA, 22 nt, Human
cucugucccagacccaccucuc

SEQ ID NO: 387933 - RNA, 22 nt, Human
cgucccaguuccagccgcgcug

SEQ ID NO: 387934 - RNA, 22 nt, Human
gaggggcuggcuguggucccau

SEQ ID NO: 387935 - RNA, 22 nt, Human
auaacagagagcuacugaacug

SEQ ID NO: 387936 - RNA, 22 nt, Human
acacaaugcauauuuuuccaga

SEQ ID NO: 387937 - RNA, 22 nt, Human
uauugaaaugaaugacagugau

SEQ ID NO: 387938 - RNA, 22 nt, Human
gugugcaggugucagugcagcu

SEQ ID NO: 387939 - RNA, 22 nt, Human
gcucagaggcacgaccucuugg

SEQ ID NO: 387940 - RNA, 22 nt, Human
acugugcaaugaguaauaaacu

SEQ ID NO: 387941 - RNA, 22 nt, Human
gugccaggcccagggagcgggg

SEQ ID NO: 387942 - RNA, 22 nt, Human
cagaaggcaaacaaaaggauuu

SEQ ID NO: 387943 - RNA, 21 nt, Human
uagggcaggcauuggaagaga

SEQ ID NO: 387944 - RNA, 22 nt, Human
ucagcagugcagggugaggcag

SEQ ID NO: 387945 - RNA, 19 nt, Human
agauggggaagagugugag

SEQ ID NO: 387946 - RNA, 22 nt, Human
ggcccuguccuggcugucuccg

SEQ ID NO: 387947 - RNA, 22 nt, Human
cgagaguggacagggcgcagcu

SEQ ID NO: 387948 - RNA, 22 nt, Human
gagcugccugugugccaugaug

SEQ ID NO: 387949 - RNA, 20 nt, Human
aaaguguaagcauauaauua

SEQ ID NO: 387950 - RNA, 22 nt, Human
aggggugauuugggacaggaca

SEQ ID NO: 387951 - RNA, 22 nt, Human
aguuacagugaccauuuauuua

SEQ ID NO: 387952 - RNA, 22 nt, Human
aaaagcaguuaucugggaggaa

SEQ ID NO: 387953 - RNA, 22 nt, Human
agggaaggagguuagaacccac

SEQ ID NO: 387954 - RNA, 22 nt, Human
uauuaggguaaauuugacaugc

SEQ ID NO: 387955 - RNA, 22 nt, Human
uuucaguuagcugagacccagg

SEQ ID NO: 387956 - RNA, 22 nt, Human
cugcaguguucuggaaugcauu

SEQ ID NO: 387957 - RNA, 22 nt, Human
accagcucagaagccagaaaga

SEQ ID NO: 387958 - RNA, 22 nt, Human
uuagcucagaaaauuuaaacuu

SEQ ID NO: 387959 - RNA, 22 nt, Human
uuccucagcuggccugauuggg

SEQ ID NO: 387960 - RNA, 22 nt, Human
ucucugagcaugccauauugcu

SEQ ID NO: 387961 - RNA, 22 nt, Human
gaggguccccaugcagagcuca

SEQ ID NO: 387962 - RNA, 22 nt, Human
gaggcagcagggcugguuccuu

SEQ ID NO: 387963 - RNA, 20 nt, Human
uccaagcccuccuuccauuc

SEQ ID NO: 387964 - RNA, 22 nt, Human
cagauccacccuuguagugaca

SEQ ID NO: 387965 - RNA, 22 nt, Human
auucaguaggucuagaauaaga

SEQ ID NO: 387966 - RNA, 22 nt, Human
ucucaggaucuaauacauggua

SEQ ID NO: 387967 - RNA, 22 nt, Human
uccugggcugcagggaagagca

SEQ ID NO: 387968 - RNA, 22 nt, Human
ccuccucugggaagauucagag

SEQ ID NO: 387969 - RNA, 22 nt, Human
uuucccaagaaaaauaauugga

SEQ ID NO: 387970 - RNA, 22 nt, Human
cugccucuugacagaucguggc

SEQ ID NO: 387971 - RNA, 22 nt, Human
cuucuuaaucccuuauauauuu

SEQ ID NO: 387972 - RNA, 22 nt, Human
ggugccaggcucccagcucagg

SEQ ID NO: 387973 - RNA, 22 nt, Human
uaugccugauaacugugucucu

SEQ ID NO: 387974 - RNA, 22 nt, Human
cgaggcagggaagcugcaaaag

SEQ ID NO: 387975 - RNA, 22 nt, Human
ccaggccauucccagaguugcu

SEQ ID NO: 387976 - RNA, 22 nt, Human
gcucccagggaccgcagggcag

SEQ ID NO: 387977 - RNA, 22 nt, Human
uuuaggcaagaacucacugaga

SEQ ID NO: 387978 - RNA, 22 nt, Human
ggcugcugggaauaugccagcu

SEQ ID NO: 387979 - RNA, 22 nt, Human
uggagaggaaagugcaguuuug

SEQ ID NO: 387980 - RNA, 22 nt, Human
gccuggcuccuaaggacuggcu

SEQ ID NO: 387981 - RNA, 22 nt, Human
aggcacugagaggcuguguugc

SEQ ID NO: 387982 - RNA, 22 nt, Human
acuguguggaccacucugaggc

SEQ ID NO: 387983 - RNA, 22 nt, Human
gcuggcuccucuguccucacgg

SEQ ID NO: 387984 - RNA, 22 nt, Human
aaucucuugggaggaaugaauu

SEQ ID NO: 387985 - RNA, 22 nt, Human
aggcucugcagaccccagcugu

SEQ ID NO: 387986 - RNA, 22 nt, Human
cugggccuuggauugacacugu

SEQ ID NO: 387987 - RNA, 22 nt, Human
agggcuagaguugagaugggga

SEQ ID NO: 387988 - RNA, 22 nt, Human
agucucugagguucagaugccu

SEQ ID NO: 387989 - RNA, 22 nt, Human
accagagcucuucagcacagga

SEQ ID NO: 387990 - RNA, 22 nt, Human
cuacauuaaauuggcuuacuua

SEQ ID NO: 387991 - RNA, 22 nt, Human
agugaccaaucaugguuagauu

SEQ ID NO: 387992 - RNA, 22 nt, Human
caggggcugagaaggaacgucc

SEQ ID NO: 387993 - RNA, 22 nt, Human
gugcugugugauccaugcuggc

SEQ ID NO: 387994 - RNA, 22 nt, Human
gccuuaauuuaugucuaacaua

SEQ ID NO: 387995 - RNA, 21 nt, Human
agccagucuguuuucuagugc

SEQ ID NO: 387996 - RNA, 22 nt, Human
uuauuuugagagaaugugugcu

SEQ ID NO: 387997 - RNA, 22 nt, Human
cacccagcauuggcuaagagag

SEQ ID NO: 387998 - RNA, 23 nt, Human
aaggccagaauuucaauggugcc

SEQ ID NO: 387999 - RNA, 22 nt, Human
aguuuguaucaauuugcuuuau

SEQ ID NO: 388000 - RNA, 23 nt, Human
cugaggccugcugcguucagguu

SEQ ID NO: 388001 - RNA, 22 nt, Human
uuuauuauagugguggggacug

SEQ ID NO: 388002 - RNA, 22 nt, Human
gcucaggaaggcucaaccagga

SEQ ID NO: 388003 - RNA, 22 nt, Human
uaugcacaauaugaucuauuug

SEQ ID NO: 388004 - RNA, 22 nt, Human
uuugcagucaaauuugcuaaau

SEQ ID NO: 388005 - RNA, 22 nt, Human
aaaguccuguuugaaggaccug

SEQ ID NO: 388006 - RNA, 22 nt, Human
cuacauuuuucaccgagccucu

SEQ ID NO: 388007 - RNA, 23 nt, Human
guggagccacaucacaggcuccu

SEQ ID NO: 388008 - RNA, 22 nt, Human
ugagagggcccagagcacacca

SEQ ID NO: 388009 - RNA, 22 nt, Human
uuagggaaggcugcugucagcu

SEQ ID NO: 388010 - RNA, 23 nt, Human
aggcugcagaagaauagggucau

SEQ ID NO: 388011 - RNA, 22 nt, Human
gcugucccaugguugcaagaug

SEQ ID NO: 388012 - RNA, 22 nt, Human
aagaacugugcuccaggcucca

SEQ ID NO: 388013 - RNA, 21 nt, Human
cccaggaggcugagaagagca

SEQ ID NO: 388014 - RNA, 22 nt, Human
agaggggcucaagcaguggucu

SEQ ID NO: 388015 - RNA, 22 nt, Human
cagggcucacucggcuggcguc

SEQ ID NO: 388016 - RNA, 22 nt, Human
cucaggaugaaagucaugguga

SEQ ID NO: 388017 - RNA, 21 nt, Human
cagcuuugucugucuucgggg

SEQ ID NO: 388018 - RNA, 22 nt, Human
uuguguccugauuugacacaau

SEQ ID NO: 388019 - RNA, 22 nt, Human
aggggagcuaacaccagagccc

SEQ ID NO: 388020 - RNA, 22 nt, Human
gggacagacccaugggccaggu

SEQ ID NO: 388021 - RNA, 22 nt, Human
gucaccagugcuaagaggugga

SEQ ID NO: 388022 - RNA, 21 nt, Human
ugacugaggcuucuucacaca

SEQ ID NO: 388023 - RNA, 22 nt, Human
ugcagcugauuaaagggcagac

SEQ ID NO: 388024 - RNA, 19 nt, Human
acuuugcaugugugucuaa

SEQ ID NO: 388025 - RNA, 22 nt, Human
cccuccagagcuugaccugcug

SEQ ID NO: 388026 - RNA, 22 nt, Human
gcugccuugaacuuggccuggg

SEQ ID NO: 388027 - RNA, 22 nt, Human
auggagugggccaauuuuagug

SEQ ID NO: 388028 - RNA, 22 nt, Human
ggccugugagcccuugcaugua

SEQ ID NO: 388029 - RNA, 22 nt, Human
aacauuuaugauugagguaaau

SEQ ID NO: 388030 - RNA, 22 nt, Human
gagggcucuaccaaguaacucu

SEQ ID NO: 388031 - RNA, 22 nt, Human
aaguaacaaugcuguugaauug

SEQ ID NO: 388032 - RNA, 21 nt, Human
uugaaaguaaauucagcagcu

SEQ ID NO: 388033 - RNA, 22 nt, Human
cacaugaguccugccagguaug

SEQ ID NO: 388034 - RNA, 22 nt, Human
uuacaagauaaccugaugcugu

SEQ ID NO: 388035 - RNA, 22 nt, Human
guaaaauagaauaacguggcua

SEQ ID NO: 388036 - RNA, 22 nt, Human
ggaggaagagguuguucucuca

SEQ ID NO: 388037 - RNA, 22 nt, Human
agacaacaccaaaugcuagugu

SEQ ID NO: 388038 - RNA, 22 nt, Human
cauaauaucuccgauuacuugc

SEQ ID NO: 388039 - RNA, 22 nt, Human
ucacugcaaccucugccuuccg

SEQ ID NO: 388040 - RNA, 22 nt, Human
aagggaggaggauuuauuguac

SEQ ID NO: 388041 - RNA, 21 nt, Human
cacuauuuauauaugccagcu

SEQ ID NO: 388042 - RNA, 22 nt, Human
uucaaauuaccacauuugcuua

SEQ ID NO: 388043 - RNA, 22 nt, Human
aggcugggaagguaaaguugua

SEQ ID NO: 388044 - RNA, 22 nt, Human
ugaaaucuuuaguuucuguccc

SEQ ID NO: 388045 - RNA, 22 nt, Human
uccagcaguccaugugagacac

SEQ ID NO: 388046 - RNA, 19 nt, Human
ugcagcucagggcaggggc

SEQ ID NO: 388047 - RNA, 22 nt, Human
cauggucuacaauuucauuuua

SEQ ID NO: 388048 - RNA, 17 nt, Human
agcagcugaagcagcca

SEQ ID NO: 388049 - RNA, 22 nt, Human
uccagcuugccuggucuuuugg

SEQ ID NO: 388050 - RNA, 22 nt, Human
uccucaggucaaagcaggagaa

SEQ ID NO: 388051 - RNA, 22 nt, Human
uugugcaauuuaaaaucuuccu

SEQ ID NO: 388052 - RNA, 22 nt, Human
uaaguucauuagacuacagaua

SEQ ID NO: 388053 - RNA, 22 nt, Human
ggggcaggagcccuucuucagc

SEQ ID NO: 388054 - RNA, 22 nt, Human
ugggccugugaugcugggcuau

SEQ ID NO: 388055 - RNA, 23 nt, Human
agggcugaaugcagagaagcaga

SEQ ID NO: 388056 - RNA, 22 nt, Human
ggcagggaagcuggcaucacgg

SEQ ID NO: 388057 - RNA, 16 nt, Human
agcagggcgggaagga

SEQ ID NO: 388058 - RNA, 22 nt, Human
cacugcuuuaaggcugaguaac

SEQ ID NO: 388059 - RNA, 22 nt, Human
aaugcuuaauucaauacugugu

SEQ ID NO: 388060 - RNA, 19 nt, Human
ucagaggauuuggcuauga

SEQ ID NO: 388061 - RNA, 22 nt, Human
cucaaguaagaaacagaauugg

SEQ ID NO: 388062 - RNA, 22 nt, Human
aacacaaagaagcugcaggauc

SEQ ID NO: 388063 - RNA, 22 nt, Human
cagaggcucuuccucacugccc

SEQ ID NO: 388064 - RNA, 22 nt, Human
aaaggcuccuucucccaugacc

SEQ ID NO: 388065 - RNA, 22 nt, Human
agccuucacugggaccuuggau

SEQ ID NO: 388066 - RNA, 22 nt, Human
ugcuucucccaaccagggccug

SEQ ID NO: 388067 - RNA, 19 nt, Human
aagggcugggcaccucacu

SEQ ID NO: 388068 - RNA, 22 nt, Human
ccagcugacgaugccuggucuc

SEQ ID NO: 388069 - RNA, 22 nt, Human
uauuuccauguuagaacuaagu

SEQ ID NO: 388070 - RNA, 22 nt, Human
ccagcaggagaugccugugucu

SEQ ID NO: 388071 - RNA, 22 nt, Human
ucucugcugagaagggcuggca

SEQ ID NO: 388072 - RNA, 22 nt, Human
cagugcagccaaggacaggcac

SEQ ID NO: 388073 - RNA, 21 nt, Human
acagccugucaucucaugguc

SEQ ID NO: 388074 - RNA, 22 nt, Human
auuucuguaacuuaugaaaguu

SEQ ID NO: 388075 - RNA, 22 nt, Human
guggccuuuccugaagaaauga

SEQ ID NO: 388076 - RNA, 22 nt, Human
cuuucacaguccugacugagcg

SEQ ID NO: 388077 - RNA, 22 nt, Human
cugagauggaguuuugcucuug

SEQ ID NO: 388078 - RNA, 22 nt, Human
gaggagaagcuauuggaaggac

SEQ ID NO: 388079 - RNA, 22 nt, Human
ugggcagauguccucugaagug

SEQ ID NO: 388080 - RNA, 22 nt, Human
ucucagucagccuugauguccc

SEQ ID NO: 388081 - RNA, 22 nt, Human
cugcccucuagaggaggacuga

SEQ ID NO: 388082 - RNA, 20 nt, Human
cauuuguuagcuuucuacug

SEQ ID NO: 388083 - RNA, 22 nt, Human
uuccaggauagcuuucaggaau

SEQ ID NO: 388084 - RNA, 22 nt, Human
uggcagcuggagggcaauggcc

SEQ ID NO: 388085 - RNA, 22 nt, Human
ugaagcaggaaccagcagcauu

SEQ ID NO: 388086 - RNA, 22 nt, Human
ugcagagaaaccaguggaggac

SEQ ID NO: 388087 - RNA, 22 nt, Human
acagccuguuugaucuggugcu

SEQ ID NO: 388088 - RNA, 21 nt, Human
ucugucugguuuuagaguggc

SEQ ID NO: 388089 - RNA, 22 nt, Human
gaggagcuggcugucgggaggc

SEQ ID NO: 388090 - RNA, 22 nt, Human
uggccucuggcugaggacuaac

SEQ ID NO: 388091 - RNA, 22 nt, Human
uucuuacuaguauguuucagca

SEQ ID NO: 388092 - RNA, 23 nt, Human
ccugaagggucaggguccucagc

SEQ ID NO: 388093 - RNA, 22 nt, Human
uugaaaggugacauuguuagag

SEQ ID NO: 388094 - RNA, 19 nt, Human
gugcuuuuuaagagcucag

SEQ ID NO: 388095 - RNA, 22 nt, Human
ccaaagagcuagaauuauaggc

SEQ ID NO: 388096 - RNA, 22 nt, Human
uuccauaaugagauucccagcc

SEQ ID NO: 388097 - RNA, 21 nt, Human
gcccagcaaggugagaaggcc

SEQ ID NO: 388098 - RNA, 22 nt, Human
uccaggagacacaagguacaua

SEQ ID NO: 388099 - RNA, 22 nt, Human
cagcuccugccugggcagcugu

SEQ ID NO: 388100 - RNA, 22 nt, Human
uccaugaggaccaaauucguag

SEQ ID NO: 388101 - RNA, 22 nt, Human
agaggcuggauugagcauagac

SEQ ID NO: 388102 - RNA, 22 nt, Human
cuccuguauguugggcuucaca

SEQ ID NO: 388103 - RNA, 22 nt, Human
aaaugugucauauucaaaguca

SEQ ID NO: 388104 - RNA, 22 nt, Human
agcucccauuaucuucugaaac

SEQ ID NO: 388105 - RNA, 22 nt, Human
aauaauuagugggacagagaac

SEQ ID NO: 388106 - RNA, 22 nt, Human
augcagaaggagccaugcuugc

SEQ ID NO: 388107 - RNA, 22 nt, Human
gcuggccugcaaagcccggcug

SEQ ID NO: 388108 - RNA, 22 nt, Human
gcugagcugcuguucauccugc

SEQ ID NO: 388109 - RNA, 22 nt, Human
uccucccugaguggggacagcu

SEQ ID NO: 388110 - RNA, 17 nt, Human
cgagggcuugcuggcuc

SEQ ID NO: 388111 - RNA, 22 nt, Human
gagugcaguuggggugagggga

SEQ ID NO: 388112 - RNA, 22 nt, Human
uggagccaaggccaguucucag

SEQ ID NO: 388113 - RNA, 22 nt, Human
acccugagggguauagcagaag

SEQ ID NO: 388114 - RNA, 21 nt, Human
agaaaaacacgauauaagccc

SEQ ID NO: 388115 - RNA, 22 nt, Human
cuucugugcuucacaguugcca

SEQ ID NO: 388116 - RNA, 22 nt, Human
ccuuggcccuagccucaggcaa

SEQ ID NO: 388117 - RNA, 22 nt, Human
cugcuucugggaugauggagua

SEQ ID NO: 388118 - RNA, 22 nt, Human
aaggcagcuuuaaaaaagaugc

SEQ ID NO: 388119 - RNA, 22 nt, Human
gcuggccugaccugaggcuggg

SEQ ID NO: 388120 - RNA, 22 nt, Human
gggccugggaacuugcauuuag

SEQ ID NO: 388121 - RNA, 22 nt, Human
cugggcagcugugcaaacaaua

SEQ ID NO: 388122 - RNA, 22 nt, Human
aagaugcagcuuccacuuuugc

SEQ ID NO: 388123 - RNA, 22 nt, Human
acaggcagguaauuuacauauu

SEQ ID NO: 388124 - RNA, 22 nt, Human
gucaggauuauaauccccaugg

SEQ ID NO: 388125 - RNA, 22 nt, Human
cucagagaaaugucacaacaau

SEQ ID NO: 388126 - RNA, 22 nt, Human
uguguacauaucuauccuagau

SEQ ID NO: 388127 - RNA, 22 nt, Human
gccuggaggggccaggguggua

SEQ ID NO: 388128 - RNA, 22 nt, Human
uggagcugggguuugaaucugg

SEQ ID NO: 388129 - RNA, 22 nt, Human
gagcccucucuguaggcaagua

SEQ ID NO: 388130 - RNA, 22 nt, Human
caaggccaguucaccaagggca

SEQ ID NO: 388131 - RNA, 20 nt, Human
cuguggaauuuuaccaugcg

SEQ ID NO: 388132 - RNA, 22 nt, Human
cugaauaauacagacuagcuuc

SEQ ID NO: 388133 - RNA, 22 nt, Human
agggcugcuccuccuucaggcc

SEQ ID NO: 388134 - RNA, 18 nt, Human
uaagucauuuugccagca

SEQ ID NO: 388135 - RNA, 22 nt, Human
gcuuuauguaaguccaaaggca

SEQ ID NO: 388136 - RNA, 22 nt, Human
accucugccaagaugugcuccc

SEQ ID NO: 388137 - RNA, 22 nt, Human
cuagggaccucagcuccuggag

SEQ ID NO: 388138 - RNA, 22 nt, Human
acuguggcgucaggaagaaauu

SEQ ID NO: 388139 - RNA, 19 nt, Human
cuucuggcccugagccacc

SEQ ID NO: 388140 - RNA, 22 nt, Human
uagcugucagcaaucaaguggu

SEQ ID NO: 388141 - RNA, 22 nt, Human
auccaaacauguaccacacuaa

SEQ ID NO: 388142 - RNA, 22 nt, Human
uaauguguccugaaagcuucug

SEQ ID NO: 388143 - RNA, 22 nt, Human
uagaaaguaaaucaguuuuauu

SEQ ID NO: 388144 - RNA, 22 nt, Human
cuuaggcauccaggguucuucc

SEQ ID NO: 388145 - RNA, 22 nt, Human
cccuggagugccggaaucaaga

SEQ ID NO: 388146 - RNA, 20 nt, Human
acugugaaugcugaauuagc

SEQ ID NO: 388147 - RNA, 22 nt, Human
cuugacauuaguuaugcagaua

SEQ ID NO: 388148 - RNA, 22 nt, Human
ucucagagauguuagggaagag

SEQ ID NO: 388149 - RNA, 21 nt, Human
auccuuagcacuuagaagagu

SEQ ID NO: 388150 - RNA, 22 nt, Human
ccaggagacccagggaaggagc

SEQ ID NO: 388151 - RNA, 19 nt, Human
ggcagcuggacgcuguuca

SEQ ID NO: 388152 - RNA, 22 nt, Human
uggcagaguuggagguggaaga

SEQ ID NO: 388153 - RNA, 22 nt, Human
cccaggaacagggcucagaccc

SEQ ID NO: 388154 - RNA, 22 nt, Human
ccaggagagcucuaaauggcug

SEQ ID NO: 388155 - RNA, 22 nt, Human
aucaguuucuaccauguggaau

SEQ ID NO: 388156 - RNA, 22 nt, Human
gcagugaaucuggcaagaauuu

SEQ ID NO: 388157 - RNA, 22 nt, Human
uggcucaguuuagcagcucagu

SEQ ID NO: 388158 - RNA, 22 nt, Human
ugcuuuauucccuucugaugug

SEQ ID NO: 388159 - RNA, 22 nt, Human
uggaaagaaaguaaaggcguau

SEQ ID NO: 388160 - RNA, 22 nt, Human
aauagcucacugauuucucuuu

SEQ ID NO: 388161 - RNA, 22 nt, Human
agaagccaugguaugcaacuac

SEQ ID NO: 388162 - RNA, 22 nt, Human
ucaagagaagugcuccacagua

SEQ ID NO: 388163 - RNA, 22 nt, Human
cuggcagcuuccuuugcaucug

SEQ ID NO: 388164 - RNA, 22 nt, Human
aaacuucagugaaugacuuaug

SEQ ID NO: 388165 - RNA, 22 nt, Human
ucaucaguguccuuaucacuua

SEQ ID NO: 388166 - RNA, 22 nt, Human
augaagcuaaacccugcagcca

SEQ ID NO: 388167 - RNA, 22 nt, Human
acagaaugcguagugcauguug

SEQ ID NO: 388168 - RNA, 22 nt, Human
aaggcgacacaggcagcaggcc

SEQ ID NO: 388169 - RNA, 22 nt, Human
agcauugccugccuauugcuaa

SEQ ID NO: 388170 - RNA, 22 nt, Human
uugaucagguugcuguggugua

SEQ ID NO: 388171 - RNA, 22 nt, Human
gaagaauccaugcuaauuuacc

SEQ ID NO: 388172 - RNA, 22 nt, Human
aagcagggcuuuaagcgguuuu

SEQ ID NO: 388173 - RNA, 22 nt, Human
ccugcucagagcgucuugugug

SEQ ID NO: 388174 - RNA, 22 nt, Human
caggggcuguggcacauggugu

SEQ ID NO: 388175 - RNA, 22 nt, Human
uaaguuuaaauguacaugaagc

SEQ ID NO: 388176 - RNA, 22 nt, Human
agagccugggaauuugcauguu

SEQ ID NO: 388177 - RNA, 22 nt, Human
agccacgucccugucaggguca

SEQ ID NO: 388178 - RNA, 22 nt, Human
augcuguguggucaaguuaauu

SEQ ID NO: 388179 - RNA, 22 nt, Human
aaacacaccuuuggaacuguga

SEQ ID NO: 388180 - RNA, 19 nt, Human
gaggucagcaagaaguauu

SEQ ID NO: 388181 - RNA, 20 nt, Human
acaaaauagguacuggguag

SEQ ID NO: 388182 - RNA, 22 nt, Human
ccaggagagcgcccucccggcc

SEQ ID NO: 388183 - RNA, 22 nt, Human
ucugcagggaugugagggguga

SEQ ID NO: 388184 - RNA, 22 nt, Human
caaaugcaggucagcagguguc

SEQ ID NO: 388185 - RNA, 22 nt, Human
ggcaggagcucagguugguucc

SEQ ID NO: 388186 - RNA, 22 nt, Human
cagggcuguggcuuugugcugu

SEQ ID NO: 388187 - RNA, 22 nt, Human
uggguggcggccugguucugag

SEQ ID NO: 388188 - RNA, 22 nt, Human
aaaggaagaugccaggacucug

SEQ ID NO: 388189 - RNA, 22 nt, Human
auucacagggacaaugggagag

SEQ ID NO: 388190 - RNA, 22 nt, Human
ugccucugugugcaggugagca

SEQ ID NO: 388191 - RNA, 21 nt, Human
accaggcuugugggagggagc

SEQ ID NO: 388192 - RNA, 22 nt, Human
uuugaagucagacacugcuuug

SEQ ID NO: 388193 - RNA, 22 nt, Human
aaauacagauuccagggucuua

SEQ ID NO: 388194 - RNA, 22 nt, Human
gagcuuuaagggauaaaaugau

SEQ ID NO: 388195 - RNA, 22 nt, Human
ugcaggaaucagaggggaagcg

SEQ ID NO: 388196 - RNA, 22 nt, Human
augugcaaauccaaugugaaug

SEQ ID NO: 388197 - RNA, 22 nt, Human
uccuucaaagcuccuagugagc

SEQ ID NO: 388198 - RNA, 22 nt, Human
gcaucuaauccaguccagcauc

SEQ ID NO: 388199 - RNA, 22 nt, Human
ucuucaaauccuacagugucug

SEQ ID NO: 388200 - RNA, 22 nt, Human
gcagcguggggacaggagcuca

SEQ ID NO: 388201 - RNA, 22 nt, Human
guaacugaggcagcuuuuaaga

SEQ ID NO: 388202 - RNA, 22 nt, Human
cuugucugugucggauaaaacu

SEQ ID NO: 388203 - RNA, 22 nt, Human
cagcagagcugggcuuugaauu

SEQ ID NO: 388204 - RNA, 19 nt, Human
cugagagaugcuucacaca

SEQ ID NO: 388205 - RNA, 21 nt, Human
gagugcagcaagguagagucu

SEQ ID NO: 388206 - RNA, 22 nt, Human
ugucuucagcaaaugccuuucu

SEQ ID NO: 388207 - RNA, 22 nt, Human
ugggcugcagggguugagagcu

SEQ ID NO: 388208 - RNA, 22 nt, Human
ugugaaaagcguguguucuagg

SEQ ID NO: 388209 - RNA, 22 nt, Human
ucuauuuuauacucaaaucuuc

SEQ ID NO: 388210 - RNA, 22 nt, Human
aaaagucagucucuccuagcuc

SEQ ID NO: 388211 - RNA, 22 nt, Human
gcagggccagguacaagaagca

SEQ ID NO: 388212 - RNA, 22 nt, Human
uuauuaggaacucaggauuuuu

SEQ ID NO: 388213 - RNA, 22 nt, Human
ucagggugaaccaggcaggaau

SEQ ID NO: 388214 - RNA, 22 nt, Human
gaggcucacgacgggacgaacu

SEQ ID NO: 388215 - RNA, 22 nt, Human
agcugccacugagggugcacag

SEQ ID NO: 388216 - RNA, 22 nt, Human
auucuccaucaccacuggcacu

SEQ ID NO: 388217 - RNA, 22 nt, Human
caggcugcagugcaguggcuau

SEQ ID NO: 388218 - RNA, 22 nt, Human
agugggcaugaucuggugucug

SEQ ID NO: 388219 - RNA, 22 nt, Human
ucaggcaggacaauuauuuagg

SEQ ID NO: 388220 - RNA, 22 nt, Human
gcacagggaggcuggccuggcc

SEQ ID NO: 388221 - RNA, 22 nt, Human
ugccaggccaauucuauuugac

SEQ ID NO: 388222 - RNA, 22 nt, Human
uggcagagguauauugggagga

SEQ ID NO: 388223 - RNA, 22 nt, Human
agggccaggaacaccugaaggg

SEQ ID NO: 388224 - RNA, 22 nt, Human
ggggcagccuccaggaaagcug

SEQ ID NO: 388225 - RNA, 22 nt, Human
uggcccugcagaacuagccugg

SEQ ID NO: 388226 - RNA, 22 nt, Human
gucaggaucaaauugaaguuau

SEQ ID NO: 388227 - RNA, 17 nt, Human
aaugaaugaauucuuug

SEQ ID NO: 388228 - RNA, 22 nt, Human
auuuaguguauucuaauaugug

SEQ ID NO: 388229 - RNA, 22 nt, Human
uugaagcauuucuuugagcuuc

SEQ ID NO: 388230 - RNA, 22 nt, Human
acguggagagaauagggcacca

SEQ ID NO: 388231 - RNA, 22 nt, Human
guuuacauguacucauuauacu

SEQ ID NO: 388232 - RNA, 22 nt, Human
ugcccaggaucuggcgaugcuc

SEQ ID NO: 388233 - RNA, 22 nt, Human
cacagacccagaagggaugaag

SEQ ID NO: 388234 - RNA, 22 nt, Human
agaccaagacuauaaugagagg

SEQ ID NO: 388235 - RNA, 22 nt, Human
ugccagugggugugcagagacu

SEQ ID NO: 388236 - RNA, 22 nt, Human
ucccaggcugggggccugaagu

SEQ ID NO: 388237 - RNA, 22 nt, Human
ggcaguggugggaggcucgcuc

SEQ ID NO: 388238 - RNA, 18 nt, Human
cagcugccagcucaugga

SEQ ID NO: 388239 - RNA, 22 nt, Human
cagagcucuauguucauggagg

SEQ ID NO: 388240 - RNA, 22 nt, Human
uugcucugacuggagugcagug

SEQ ID NO: 388241 - RNA, 22 nt, Human
cucauacauaugccauuccugc

SEQ ID NO: 388242 - RNA, 22 nt, Human
gaggcugguaggaaaggaaaca

SEQ ID NO: 388243 - RNA, 18 nt, Human
gaugggagcaagagaaga

SEQ ID NO: 388244 - RNA, 23 nt, Human
ugcagagggacugaagccagcuu

SEQ ID NO: 388245 - RNA, 22 nt, Human
ucucucagaggaagaggcagug

SEQ ID NO: 388246 - RNA, 22 nt, Human
uuuuauguaauccuuacugucg

SEQ ID NO: 388247 - RNA, 22 nt, Human
ggagauggcucugcaaggucua

SEQ ID NO: 388248 - RNA, 22 nt, Human
cagccugcagggcugccuguug

SEQ ID NO: 388249 - RNA, 22 nt, Human
cucuccuccaacagcccugccg

SEQ ID NO: 388250 - RNA, 22 nt, Human
uuccaaaccucaaauaauuaau

SEQ ID NO: 388251 - RNA, 22 nt, Human
uuacagaaguuucagcguuuua

SEQ ID NO: 388252 - RNA, 22 nt, Human
ccugcagcuguaggagaaggcg

SEQ ID NO: 388253 - RNA, 22 nt, Human
uccaggagaaggccauccagcg

SEQ ID NO: 388254 - RNA, 22 nt, Human
cugacucccaaagaggacgcgu

SEQ ID NO: 388255 - RNA, 22 nt, Human
gcugaaggucucuggagagguc

SEQ ID NO: 388256 - RNA, 21 nt, Human
gcucuuggaaggggcucagcu

SEQ ID NO: 388257 - RNA, 22 nt, Human
acaugauuuuaguaucauaaua

SEQ ID NO: 388258 - RNA, 22 nt, Human
agccccaggcccggacgccucu

SEQ ID NO: 388259 - RNA, 22 nt, Human
agcagcugaccagugaguccug

SEQ ID NO: 388260 - RNA, 21 nt, Human
cugguguagcacucaggugcu

SEQ ID NO: 388261 - RNA, 22 nt, Human
caggaacacaaguucagggaug

SEQ ID NO: 388262 - RNA, 22 nt, Human
guuuucaaggggauuuaacuga

SEQ ID NO: 388263 - RNA, 22 nt, Human
aaaguauuugugauuuuuacca

SEQ ID NO: 388264 - RNA, 19 nt, Human
ugaggggcucacagucuca

SEQ ID NO: 388265 - RNA, 22 nt, Human
cccugcagaccaaugccauaga

SEQ ID NO: 388266 - RNA, 22 nt, Human
ccagcuuucugggugguuucug

SEQ ID NO: 388267 - RNA, 22 nt, Human
ggguacaaagauuucauaagau

SEQ ID NO: 388268 - RNA, 22 nt, Human
auuugucucugcacuuuacuca

SEQ ID NO: 388269 - RNA, 22 nt, Human
guauagaaacccagaaagauag

SEQ ID NO: 388270 - RNA, 22 nt, Human
ugcagccaucgcagagucugua

SEQ ID NO: 388271 - RNA, 22 nt, Human
aggccugucuggggcucagcca

SEQ ID NO: 388272 - RNA, 22 nt, Human
gaauuucagggucugguaggaa

SEQ ID NO: 388273 - RNA, 23 nt, Human
ucuguucaaggcuuucuccuuga

SEQ ID NO: 388274 - RNA, 22 nt, Human
gagugaaaaaggaagggccaua

SEQ ID NO: 388275 - RNA, 22 nt, Human
uggccuggaaccuggcagggac

SEQ ID NO: 388276 - RNA, 22 nt, Human
ucagagaacacagaggugaugu

SEQ ID NO: 388277 - RNA, 22 nt, Human
uccucaggaucuaggagugcuu

SEQ ID NO: 388278 - RNA, 22 nt, Human
guagccauuggcaaugaagccu

SEQ ID NO: 388279 - RNA, 22 nt, Human
caacuuucuguuaaauguuagu

SEQ ID NO: 388280 - RNA, 22 nt, Human
caggaugagaagggcucuuacg

SEQ ID NO: 388281 - RNA, 21 nt, Human
gcaggguccuuuccauuccua

SEQ ID NO: 388282 - RNA, 22 nt, Human
gaacagaauuaccgaagaucug

SEQ ID NO: 388283 - RNA, 22 nt, Human
agggcugggcugcuuguuguca

SEQ ID NO: 388284 - RNA, 22 nt, Human
agaugaaaauacgugacuuuaa

SEQ ID NO: 388285 - RNA, 22 nt, Human
gagaggccauggcugugcagug

SEQ ID NO: 388286 - RNA, 22 nt, Human
cacugaagguaggaccaaggcu

SEQ ID NO: 388287 - RNA, 22 nt, Human
ccagggcuggguuugucggugu

SEQ ID NO: 388288 - RNA, 22 nt, Human
gagugcaggccugagcaccauc

SEQ ID NO: 388289 - RNA, 22 nt, Human
uggauuagguacuaugaauaua

SEQ ID NO: 388290 - RNA, 22 nt, Human
gaagucuggcugacgagaguua

SEQ ID NO: 388291 - RNA, 22 nt, Human
uauuucuugaguggucaguuuc

SEQ ID NO: 388292 - RNA, 22 nt, Human
ucagaagcaaacaucacucuag

SEQ ID NO: 388293 - RNA, 22 nt, Human
ucccaggaauugaagccagugu

SEQ ID NO: 388294 - RNA, 22 nt, Human
acucagaggcagcugcucaccc

SEQ ID NO: 388295 - RNA, 18 nt, Human
ucauuuguuuugcaugaa

SEQ ID NO: 388296 - RNA, 22 nt, Human
agcuguguguuuccacugagcu

SEQ ID NO: 388297 - RNA, 22 nt, Human
uuaaagaguaaucauaggucaa

SEQ ID NO: 388298 - RNA, 21 nt, Human
gcagcuggucucagagcuugc

SEQ ID NO: 388299 - RNA, 22 nt, Human
agcagccaggaaucugcagagc

SEQ ID NO: 388300 - RNA, 22 nt, Human
ccagagccucgcccggagccuc

SEQ ID NO: 388301 - RNA, 22 nt, Human
gaugcagaaaguagacaccauc

SEQ ID NO: 388302 - RNA, 22 nt, Human
ugugugaaucuauugaauauau

SEQ ID NO: 388303 - RNA, 22 nt, Human
agaaauguauagugaauuuuuc

SEQ ID NO: 388304 - RNA, 20 nt, Human
uuccagagaucugcauuuua

SEQ ID NO: 388305 - RNA, 22 nt, Human
cccaggagauggugcguggucu

SEQ ID NO: 388306 - RNA, 22 nt, Human
auacuuuggggguuaguguaga

SEQ ID NO: 388307 - RNA, 22 nt, Human
ucaggagaaagccaauuagagu

SEQ ID NO: 388308 - RNA, 23 nt, Human
ugcucccaggugacgcugcuguu

SEQ ID NO: 388309 - RNA, 22 nt, Human
uuguaacaaucugucauaaaug

SEQ ID NO: 388310 - RNA, 22 nt, Human
caggcccagugaucagggcucu

SEQ ID NO: 388311 - RNA, 22 nt, Human
guauuuaauuccauuaaguuag

SEQ ID NO: 388312 - RNA, 22 nt, Human
gggucuggcaugcugagaugga

SEQ ID NO: 388313 - RNA, 22 nt, Human
uuagccauuaauguccugugca

SEQ ID NO: 388314 - RNA, 22 nt, Human
ccagaagacaagaauguucuua

SEQ ID NO: 388315 - RNA, 22 nt, Human
aaaugucuuucuucugcuacgu

SEQ ID NO: 388316 - RNA, 22 nt, Human
aggcccuggcacugccugggag

SEQ ID NO: 388317 - RNA, 22 nt, Human
aagcuuccugaaugcucauuua

SEQ ID NO: 388318 - RNA, 22 nt, Human
ccaguggacaauuucugaggaa

SEQ ID NO: 388319 - RNA, 22 nt, Human
ggcuucagugagcugagcucac

SEQ ID NO: 388320 - RNA, 22 nt, Human
acacacuguugcucauccaggc

SEQ ID NO: 388321 - RNA, 22 nt, Human
gaagccaggggccugacaggca

SEQ ID NO: 388322 - RNA, 22 nt, Human
acugagcugugacaaugcuuaa

SEQ ID NO: 388323 - RNA, 22 nt, Human
acagcacaaucugagucccaga

SEQ ID NO: 388324 - RNA, 22 nt, Human
gugacucacacaggccugggcu

SEQ ID NO: 388325 - RNA, 22 nt, Human
uacagaaaaacuggcauugaag

SEQ ID NO: 388326 - RNA, 22 nt, Human
aauguugaggauaucagaaaau

SEQ ID NO: 388327 - RNA, 22 nt, Human
cugcccuggcagccuaccaugg

SEQ ID NO: 388328 - RNA, 22 nt, Human
agcugaggcauggacaggcugc

SEQ ID NO: 388329 - RNA, 22 nt, Human
cagaauguagaucaucaucaag

SEQ ID NO: 388330 - RNA, 22 nt, Human
guuucaaagcacagcucacauu

SEQ ID NO: 388331 - RNA, 22 nt, Human
uucacaggcuuggagguggggg

SEQ ID NO: 388332 - RNA, 23 nt, Human
uggagcugggcucagacccuggg

SEQ ID NO: 388333 - RNA, 22 nt, Human
aagaacaguugggaggugagcc

SEQ ID NO: 388334 - RNA, 19 nt, Human
gagcccucuccauggccac

SEQ ID NO: 388335 - RNA, 22 nt, Human
ugggacacccucacgccugcac

SEQ ID NO: 388336 - RNA, 22 nt, Human
uuucugcugugcuuucuugcgu

SEQ ID NO: 388337 - RNA, 22 nt, Human
gaagccccaaacccucgccauc

SEQ ID NO: 388338 - RNA, 22 nt, Human
uguauuagagcaguagaauuau

SEQ ID NO: 388339 - RNA, 22 nt, Human
ccaggagagcagaagcccaggc

SEQ ID NO: 388340 - RNA, 22 nt, Human
ccucauggccuugagcugaggg

SEQ ID NO: 388341 - RNA, 22 nt, Human
uuucacauaaauauuaugccua

SEQ ID NO: 388342 - RNA, 22 nt, Human
gccaggagggaaaggacaauuu

SEQ ID NO: 388343 - RNA, 22 nt, Human
ugaaggccuaacuuccagugcu

SEQ ID NO: 388344 - RNA, 22 nt, Human
cauuuuauccucugggaagcua

SEQ ID NO: 388345 - RNA, 19 nt, Human
guggccagggcaggggcug

SEQ ID NO: 388346 - RNA, 22 nt, Human
gagucuuugguaaagucugcug

SEQ ID NO: 388347 - RNA, 22 nt, Human
uauuugaaaguguacaaaaacu

SEQ ID NO: 388348 - RNA, 22 nt, Human
uuuuuccuagcgauuugucagc

SEQ ID NO: 388349 - RNA, 22 nt, Human
ugaugcuucacgcugaauaugc

SEQ ID NO: 388350 - RNA, 22 nt, Human
ucuuuauugcuacugguuuguc

SEQ ID NO: 388351 - RNA, 22 nt, Human
ucugggagauccaagcagaacu

SEQ ID NO: 388352 - RNA, 22 nt, Human
ccaaaugcuccacugacuuugg

SEQ ID NO: 388353 - RNA, 22 nt, Human
ccagcagggaaaaacccaccaa

SEQ ID NO: 388354 - RNA, 23 nt, Human
gggauauggaccuuggaggaguc

SEQ ID NO: 388355 - RNA, 21 nt, Human
ugauuuccaucuuaaaauaaa

SEQ ID NO: 388356 - RNA, 22 nt, Human
cuaauacucauuucuguaacuc

SEQ ID NO: 388357 - RNA, 22 nt, Human
ggcucaggagaggggcuaaaag

SEQ ID NO: 388358 - RNA, 22 nt, Human
aguucccaggugaugcugaugu

SEQ ID NO: 388359 - RNA, 21 nt, Human
aaggcagaagcauggaaugag

SEQ ID NO: 388360 - RNA, 22 nt, Human
gggaccugccauugcucacagg

SEQ ID NO: 388361 - RNA, 22 nt, Human
aggggcugggacagagccaagc

SEQ ID NO: 388362 - RNA, 22 nt, Human
ucagaagcaggagugugcacaa

SEQ ID NO: 388363 - RNA, 22 nt, Human
agccucucuccagcuuggcaga

SEQ ID NO: 388364 - RNA, 22 nt, Human
gcaucuucacacaaagccagug

SEQ ID NO: 388365 - RNA, 22 nt, Human
gacccaggcccaaggcugccag

SEQ ID NO: 388366 - RNA, 22 nt, Human
auuucacaaaccauccugauuu

SEQ ID NO: 388367 - RNA, 22 nt, Human
gugcucacugugagacguccug

SEQ ID NO: 388368 - RNA, 22 nt, Human
agcucccagggcugggcaaguu

SEQ ID NO: 388369 - RNA, 22 nt, Human
cccuguccuggaugggagcacu

SEQ ID NO: 388370 - RNA, 22 nt, Human
acucaggagggaucagcuauca

SEQ ID NO: 388371 - RNA, 22 nt, Human
cugggcugugguguggcccaaa

SEQ ID NO: 388372 - RNA, 22 nt, Human
uuaucguacgcuucagaaauuu

SEQ ID NO: 388373 - RNA, 22 nt, Human
auccuugacacacuccaguacu

SEQ ID NO: 388374 - RNA, 22 nt, Human
ggagaaugauauauagcucagu

SEQ ID NO: 388375 - RNA, 22 nt, Human
aggcacugacucaagggagcca

SEQ ID NO: 388376 - RNA, 22 nt, Human
gcauggcugguguccugaggga

SEQ ID NO: 388377 - RNA, 22 nt, Human
gucucagauaacauguauucua

SEQ ID NO: 388378 - RNA, 22 nt, Human
auaaaacuuggguaugaucccu

SEQ ID NO: 388379 - RNA, 22 nt, Human
uugaaagaagaagcugcgaugu

SEQ ID NO: 388380 - RNA, 22 nt, Human
cagcuugggaguuugguuuuau

SEQ ID NO: 388381 - RNA, 22 nt, Human
ugggagagugcucaaugugcaa

SEQ ID NO: 388382 - RNA, 22 nt, Human
gaagaggaugacaggagccggu

SEQ ID NO: 388383 - RNA, 21 nt, Human
uucagcaguccucuagagaua

SEQ ID NO: 388384 - RNA, 22 nt, Human
acagaaauaacuuuuuauguuu

SEQ ID NO: 388385 - RNA, 22 nt, Human
gccaccuggacagcugugcccu

SEQ ID NO: 388386 - RNA, 22 nt, Human
aucaaaguucguaacugauaac

SEQ ID NO: 388387 - RNA, 22 nt, Human
ccagggcacguugggacaguac

SEQ ID NO: 388388 - RNA, 23 nt, Human
uuucauaugguguggaugaagaa

SEQ ID NO: 388389 - RNA, 22 nt, Human
ggagcugaugacgucaccaugg

SEQ ID NO: 388390 - RNA, 20 nt, Human
ccuguucacugcgcaguuuc

SEQ ID NO: 388391 - RNA, 23 nt, Human
augcucugggcugugggaccugc

SEQ ID NO: 388392 - RNA, 20 nt, Human
ugcguguguauuuauuuucu

SEQ ID NO: 388393 - RNA, 22 nt, Human
cuacccagauccaggauggcua

SEQ ID NO: 388394 - RNA, 22 nt, Human
gagcuggugaucagcuggagga

SEQ ID NO: 388395 - RNA, 22 nt, Human
augaacaagagagggaagauuc

SEQ ID NO: 388396 - RNA, 19 nt, Human
cucuggagcagacacugga

SEQ ID NO: 388397 - RNA, 22 nt, Human
aaggugucggcagagccgcuuc

SEQ ID NO: 388398 - RNA, 22 nt, Human
agccagagcagggaauuggaca

SEQ ID NO: 388399 - RNA, 22 nt, Human
cagcugccuucugcgggaaguc

SEQ ID NO: 388400 - RNA, 22 nt, Human
gcagacaggcccaguggaggga

SEQ ID NO: 388401 - RNA, 22 nt, Human
cucuucagauaaaagggauauu

SEQ ID NO: 388402 - RNA, 22 nt, Human
cccagacugcagagcgggcaga

SEQ ID NO: 388403 - RNA, 22 nt, Human
uuccgcuggggccgccuggcgg

SEQ ID NO: 388404 - RNA, 22 nt, Human
cagcaggaggugagaugugacc

SEQ ID NO: 388405 - RNA, 22 nt, Human
ugcugcucaaugagaugccauc

SEQ ID NO: 388406 - RNA, 22 nt, Human
ggcaggugugagaucgaggcca

SEQ ID NO: 388407 - RNA, 22 nt, Human
uguuuuaagagcgcacuuuaua

SEQ ID NO: 388408 - RNA, 22 nt, Human
cuccaguaucuguaggaaaagg

SEQ ID NO: 388409 - RNA, 22 nt, Human
ucacagaauagcacuguaagcg

SEQ ID NO: 388410 - RNA, 22 nt, Human
aggugcugccccgagaaggaug

SEQ ID NO: 388411 - RNA, 22 nt, Human
cagaucuguaguaaaagaucuc

SEQ ID NO: 388412 - RNA, 22 nt, Human
agaaagcaucuccauuguaggu

SEQ ID NO: 388413 - RNA, 22 nt, Human
uggccuggaaaaaugcagaugg

SEQ ID NO: 388414 - RNA, 22 nt, Human
ugccugaugcaggaguaucaga

SEQ ID NO: 388415 - RNA, 22 nt, Human
agggccagaaucccucagucua

SEQ ID NO: 388416 - RNA, 23 nt, Human
ugaaggccuggaggacgcguugu

SEQ ID NO: 388417 - RNA, 22 nt, Human
uucuucaacaaggacacuguua

SEQ ID NO: 388418 - RNA, 22 nt, Human
cacuggggugggccugguagag

SEQ ID NO: 388419 - RNA, 22 nt, Human
ggcugccucuggaagcuggaga

SEQ ID NO: 388420 - RNA, 22 nt, Human
ucucuuaacugguucagcaauu

SEQ ID NO: 388421 - RNA, 22 nt, Human
aaucagaacuucucaggguggg

SEQ ID NO: 388422 - RNA, 22 nt, Human
cagcccagcacuaaguagauuu

SEQ ID NO: 388423 - RNA, 22 nt, Human
ggcuguggucauuaggagguug

SEQ ID NO: 388424 - RNA, 22 nt, Human
acagcuuugggcaaugcuauga

SEQ ID NO: 388425 - RNA, 22 nt, Human
gggagccagcagggcauggagc

SEQ ID NO: 388426 - RNA, 18 nt, Human
acauuucuaggugaaagc

SEQ ID NO: 388427 - RNA, 22 nt, Human
acauuucuuuucaucucuauau

SEQ ID NO: 388428 - RNA, 22 nt, Human
acuugguugaugucauaagguu

SEQ ID NO: 388429 - RNA, 23 nt, Human
acagcaagaggaccagaugugag

SEQ ID NO: 388430 - RNA, 22 nt, Human
cagcugccagcuucucuccauc

SEQ ID NO: 388431 - RNA, 22 nt, Human
gagaaggggugauguggguaau

SEQ ID NO: 388432 - RNA, 22 nt, Human
ugggaccucucuugagagagca

SEQ ID NO: 388433 - RNA, 22 nt, Human
gcaggcagagguggaggagaca

SEQ ID NO: 388434 - RNA, 22 nt, Human
aguaaugucccuuaaauguggu

SEQ ID NO: 388435 - RNA, 22 nt, Human
ugcugcuccccagcacacagca

SEQ ID NO: 388436 - RNA, 22 nt, Human
agguaguguagcugagugggau

SEQ ID NO: 388437 - RNA, 22 nt, Human
ggccugcuauuggugggcagac

SEQ ID NO: 388438 - RNA, 22 nt, Human
agcuggcuccagaaggagucgu

SEQ ID NO: 388439 - RNA, 22 nt, Human
auaauucaugggccuuucaccu

SEQ ID NO: 388440 - RNA, 22 nt, Human
gcagcuuggugaaaggugaugg

SEQ ID NO: 388441 - RNA, 19 nt, Human
guccaguguuuuccaguca

SEQ ID NO: 388442 - RNA, 22 nt, Human
auggcuuucagauggugaaaga

SEQ ID NO: 388443 - RNA, 22 nt, Human
uguguaaauuuauuuacauaaa

SEQ ID NO: 388444 - RNA, 22 nt, Human
ugcagaagaaaacagcugugug

SEQ ID NO: 388445 - RNA, 22 nt, Human
uagcugccuagacagcuauagc

SEQ ID NO: 388446 - RNA, 19 nt, Human
uucauucucuuauuguugu

SEQ ID NO: 388447 - RNA, 22 nt, Human
ggcagaagaaaggcuaagucuc

SEQ ID NO: 388448 - RNA, 22 nt, Human
aaauucuucagguaauuuugau

SEQ ID NO: 388449 - RNA, 22 nt, Human
uuugaagugcaaugaggauucu

SEQ ID NO: 388450 - RNA, 22 nt, Human
aggcuucuaggguuggcagcgg

SEQ ID NO: 388451 - RNA, 18 nt, Human
ggcugagguugacuagaa

SEQ ID NO: 388452 - RNA, 22 nt, Human
aaggcagccaugugcuuugggu

SEQ ID NO: 388453 - RNA, 22 nt, Human
ugaggaagcaaaggcuugugug

SEQ ID NO: 388454 - RNA, 22 nt, Human
gugccagggggcacugaacaga

SEQ ID NO: 388455 - RNA, 22 nt, Human
uuaugacauaugaguacaagua

SEQ ID NO: 388456 - RNA, 22 nt, Human
cggagccugcuuguugcagcug

SEQ ID NO: 388457 - RNA, 22 nt, Human
uauuccuaagucccaacuacau

SEQ ID NO: 388458 - RNA, 22 nt, Human
ccagagcuucggggcggcugua

SEQ ID NO: 388459 - RNA, 22 nt, Human
cucaggaggugguagaggcccu

SEQ ID NO: 388460 - RNA, 21 nt, Human
acagucuccccagaucucucc

SEQ ID NO: 388461 - RNA, 22 nt, Human
gcuggugccuuguuguuguuac

SEQ ID NO: 388462 - RNA, 23 nt, Human
uggacgccgacuuuggaggcgcu

SEQ ID NO: 388463 - RNA, 22 nt, Human
guccaugauucugugacacccu

SEQ ID NO: 388464 - RNA, 22 nt, Human
auguuucaccagcaaauuaccu

SEQ ID NO: 388465 - RNA, 22 nt, Human
agugcagagaccuggucaggca

SEQ ID NO: 388466 - RNA, 22 nt, Human
aggaaggagggcagauauuaag

SEQ ID NO: 388467 - RNA, 22 nt, Human
uuauacuuuauacuacaucauu

SEQ ID NO: 388468 - RNA, 22 nt, Human
ccucuucuaggacguccuugug

SEQ ID NO: 388469 - RNA, 22 nt, Human
caaggccaagucucugugaaga

SEQ ID NO: 388470 - RNA, 21 nt, Human
gaaaggucuuaacuuacagag

SEQ ID NO: 388471 - RNA, 22 nt, Human
uaacauuagguagacauaagcc

SEQ ID NO: 388472 - RNA, 21 nt, Human
ucucuacacuuucacuaggcu

SEQ ID NO: 388473 - RNA, 22 nt, Human
uucaccgugaaccgauuccuca

SEQ ID NO: 388474 - RNA, 22 nt, Human
ucugagcuuuuauuaucaaccu

SEQ ID NO: 388475 - RNA, 22 nt, Human
cagggcuguuagcugcugcucu

SEQ ID NO: 388476 - RNA, 22 nt, Human
cuacacaguucugccuaauggc

SEQ ID NO: 388477 - RNA, 22 nt, Human
gaggcaggcagauugcuugagg

SEQ ID NO: 388478 - RNA, 22 nt, Human
uccugaaaaauuacauguucag

SEQ ID NO: 388479 - RNA, 18 nt, Human
uuaagagcugaaagggga

SEQ ID NO: 388480 - RNA, 22 nt, Human
aaguguuuauuuauaacgaucu

SEQ ID NO: 388481 - RNA, 23 nt, Human
ggacagggcccugcccuauggcc

SEQ ID NO: 388482 - RNA, 22 nt, Human
agucccagacuccaguuuucug

SEQ ID NO: 388483 - RNA, 21 nt, Human
augggcagaggcagagaggcu

SEQ ID NO: 388484 - RNA, 22 nt, Human
ucugccuggauuuuggaaagcu

SEQ ID NO: 388485 - RNA, 22 nt, Human
gauuucuuuaugaaguacagaa

SEQ ID NO: 388486 - RNA, 22 nt, Human
gaaggccacaaaaaaugucaua

SEQ ID NO: 388487 - RNA, 22 nt, Human
cccaggaaacccgaaggcgacc

SEQ ID NO: 388488 - RNA, 22 nt, Human
ccagggcauguaacuaauggug

SEQ ID NO: 388489 - RNA, 22 nt, Human
agugcugucuccuucccccggg

SEQ ID NO: 388490 - RNA, 21 nt, Human
ccauaauuuuguuucagaagu

SEQ ID NO: 388491 - RNA, 22 nt, Human
ggagccugacagugcccagcau

SEQ ID NO: 388492 - RNA, 22 nt, Human
uccaggagugauaaggccacug

SEQ ID NO: 388493 - RNA, 22 nt, Human
caaaggagguaaugggugugag

SEQ ID NO: 388494 - RNA, 22 nt, Human
agaggcggagcuugcagugagc

SEQ ID NO: 388495 - RNA, 22 nt, Human
gaaggcugaugacagauucugc

SEQ ID NO: 388496 - RNA, 22 nt, Human
ugggccacggggguggagagcu

SEQ ID NO: 388497 - RNA, 19 nt, Human
agaggcagucuccaacagg

SEQ ID NO: 388498 - RNA, 22 nt, Human
cacauuucugugagucaauauu

SEQ ID NO: 388499 - RNA, 22 nt, Human
uguggaaagucaaguuccagga

SEQ ID NO: 388500 - RNA, 22 nt, Human
ggggugggcgugcagggacacc

SEQ ID NO: 388501 - RNA, 22 nt, Human
uggcagcacaagguggcccaug

SEQ ID NO: 388502 - RNA, 22 nt, Human
agccaggauuggcugagccuua

SEQ ID NO: 388503 - RNA, 22 nt, Human
cugcagagcuaggcugagugaa

SEQ ID NO: 388504 - RNA, 22 nt, Human
agaggacagacggaaagugcca

SEQ ID NO: 388505 - RNA, 22 nt, Human
uacuuugucauucuaaccuucc

SEQ ID NO: 388506 - RNA, 22 nt, Human
guucuucaggcugugcucuaga

SEQ ID NO: 388507 - RNA, 22 nt, Human
cuggcagcucuacucagagccu

SEQ ID NO: 388508 - RNA, 22 nt, Human
ccuggcagguggcgcccucggc

SEQ ID NO: 388509 - RNA, 22 nt, Human
gauccuugcaacucugugaggu

SEQ ID NO: 388510 - RNA, 22 nt, Human
caagaacauugugaucacuuca

SEQ ID NO: 388511 - RNA, 22 nt, Human
ucagcagggcugugguguggcu

SEQ ID NO: 388512 - RNA, 22 nt, Human
cagcugacagugaggugggggc

SEQ ID NO: 388513 - RNA, 22 nt, Human
ccagccagucccgcaugaccgc

SEQ ID NO: 388514 - RNA, 20 nt, Human
agucucuguagugccugaga

SEQ ID NO: 388515 - RNA, 22 nt, Human
gaaaguuucuucauuaagaugu

SEQ ID NO: 388516 - RNA, 22 nt, Human
uggcaaggcugugggggcagag

SEQ ID NO: 388517 - RNA, 22 nt, Human
gaccucagugaauggucaugua

SEQ ID NO: 388518 - RNA, 22 nt, Human
uuggagagauuaucagaccagc

SEQ ID NO: 388519 - RNA, 22 nt, Human
aaucaugugggauagucugcuc

SEQ ID NO: 388520 - RNA, 22 nt, Human
gaauacaugauacaugaacugc

SEQ ID NO: 388521 - RNA, 22 nt, Human
cccaagggagugccuggucaac

SEQ ID NO: 388522 - RNA, 22 nt, Human
aggaccaacauagcagcagugg

SEQ ID NO: 388523 - RNA, 22 nt, Human
acuggaucuaauugguuauagu

SEQ ID NO: 388524 - RNA, 22 nt, Human
uucugcagcccaacaguaguuu

SEQ ID NO: 388525 - RNA, 22 nt, Human
accugcaggggugcucucuggg

SEQ ID NO: 388526 - RNA, 22 nt, Human
caugucuguguacacaugcaca

SEQ ID NO: 388527 - RNA, 22 nt, Human
ucugucuucaucagcaugugau

SEQ ID NO: 388528 - RNA, 22 nt, Human
cucagagucugcauuucuguca

SEQ ID NO: 388529 - RNA, 22 nt, Human
agcagggcuuugucucugugaa

SEQ ID NO: 388530 - RNA, 21 nt, Human
cuugaaagguagagucuacag

SEQ ID NO: 388531 - RNA, 22 nt, Human
ccagggugugggcgucggcacg

SEQ ID NO: 388532 - RNA, 22 nt, Human
auuuagaaauuccaaaaguauu

SEQ ID NO: 388533 - RNA, 22 nt, Human
caugcuuauucauucugcuaac

SEQ ID NO: 388534 - RNA, 22 nt, Human
uaggugucugcucuuauuuaac

SEQ ID NO: 388535 - RNA, 22 nt, Human
ucugcugcugagcacacuccua

SEQ ID NO: 388536 - RNA, 22 nt, Human
gcugccucccccauggcuggaa

SEQ ID NO: 388537 - RNA, 22 nt, Human
uagcuuuaaugaguugguaaga

SEQ ID NO: 388538 - RNA, 22 nt, Human
uuuccucugucaugacagcuga

SEQ ID NO: 388539 - RNA, 22 nt, Human
aaucuguucuacucuauucaga

SEQ ID NO: 388540 - RNA, 22 nt, Human
ucuuaauugagaacaguguagg

SEQ ID NO: 388541 - RNA, 22 nt, Human
guucacauccuugugaggauuu

SEQ ID NO: 388542 - RNA, 22 nt, Human
agaauucuggaguugggaggaa

SEQ ID NO: 388543 - RNA, 22 nt, Human
auuucaacauucucaguuguag

SEQ ID NO: 388544 - RNA, 22 nt, Human
ccuggaugauccaugucaugga

SEQ ID NO: 388545 - RNA, 22 nt, Human
ggcagaguggagugcggccucc

SEQ ID NO: 388546 - RNA, 22 nt, Human
caggcagauuugcugcccucca

SEQ ID NO: 388547 - RNA, 22 nt, Human
uacauauacugagugauuugcu

SEQ ID NO: 388548 - RNA, 22 nt, Human
gggacuguaaauucauauggcc

SEQ ID NO: 388549 - RNA, 22 nt, Human
gacaggaggcagagcucaggug

SEQ ID NO: 388550 - RNA, 22 nt, Human
agccuguggaucccugcacugg

SEQ ID NO: 388551 - RNA, 22 nt, Human
ucaauuaugccauugcaauauu

SEQ ID NO: 388552 - RNA, 22 nt, Human
caaaugcauaguuuauaagaag

SEQ ID NO: 388553 - RNA, 22 nt, Human
gucccagaaacauauugcuggu

SEQ ID NO: 388554 - RNA, 22 nt, Human
gguuggaggugggaauagcuag

SEQ ID NO: 388555 - RNA, 22 nt, Human
agcagcauuuaaggauccaagu

SEQ ID NO: 388556 - RNA, 22 nt, Human
gcuccuucaggugguagcuguu

SEQ ID NO: 388557 - RNA, 22 nt, Human
aggcagcuggacauaacuaacc

SEQ ID NO: 388558 - RNA, 22 nt, Human
ucuccuccuuuuuucaacauag

SEQ ID NO: 388559 - RNA, 22 nt, Human
gcagcugcaggcaggcuugcug

SEQ ID NO: 388560 - RNA, 22 nt, Human
agcauuuaguuaguaaauguuu

SEQ ID NO: 388561 - RNA, 22 nt, Human
aucaguuuuuauuaauguagcu

SEQ ID NO: 388562 - RNA, 22 nt, Human
cucuguccacagguuugucccu

SEQ ID NO: 388563 - RNA, 22 nt, Human
acuaagugauucuaagcaucuu

SEQ ID NO: 388564 - RNA, 22 nt, Human
ugagaagcugcuugugcuguau

SEQ ID NO: 388565 - RNA, 22 nt, Human
cagucaccuagacagaacuuac

SEQ ID NO: 388566 - RNA, 22 nt, Human
ggccauggaccccgagcugacc

SEQ ID NO: 388567 - RNA, 22 nt, Human
uaagaaucggucgcaacagagg

SEQ ID NO: 388568 - RNA, 22 nt, Human
uaggcuggaacuuaggcagagg

SEQ ID NO: 388569 - RNA, 22 nt, Human
cagggacaugacuggucucugu

SEQ ID NO: 388570 - RNA, 20 nt, Human
uguauauuuucugguguaaa

SEQ ID NO: 388571 - RNA, 22 nt, Human
agugcauuauauguuucaaugg

SEQ ID NO: 388572 - RNA, 22 nt, Human
cucuggccagagccugcgggaa

SEQ ID NO: 388573 - RNA, 22 nt, Human
gcauuccugagaaugcagagug

SEQ ID NO: 388574 - RNA, 22 nt, Human
cggcugaggaucuccaggccug

SEQ ID NO: 388575 - RNA, 22 nt, Human
aguauucuggaauucuauguga

SEQ ID NO: 388576 - RNA, 22 nt, Human
gccaggagcaugucauuguuga

SEQ ID NO: 388577 - RNA, 22 nt, Human
ucaacuuugaaaccauagugaa

SEQ ID NO: 388578 - RNA, 22 nt, Human
ccugccaggacauugcuugaag

SEQ ID NO: 388579 - RNA, 22 nt, Human
aguggcaguggcugggcagagc

SEQ ID NO: 388580 - RNA, 22 nt, Human
uauaagaaauugccaaccuguu

SEQ ID NO: 388581 - RNA, 22 nt, Human
ugccucagcugaggccgcucca

SEQ ID NO: 388582 - RNA, 22 nt, Human
ugaaggagcucaaugaugaugc

SEQ ID NO: 388583 - RNA, 22 nt, Human
auugacaauuagcccuuaggug

SEQ ID NO: 388584 - RNA, 22 nt, Human
cagggcaggaauuugacauugc

SEQ ID NO: 388585 - RNA, 22 nt, Human
ggucccaggauugguugcgcag

SEQ ID NO: 388586 - RNA, 22 nt, Human
guguccuuauaagaagagaugc

SEQ ID NO: 388587 - RNA, 22 nt, Human
uacaaagcuguauagccugguc

SEQ ID NO: 388588 - RNA, 22 nt, Human
ggcuccugauaggagaaugcgg

SEQ ID NO: 388589 - RNA, 22 nt, Human
agacagcugggaaauggagugu

SEQ ID NO: 388590 - RNA, 22 nt, Human
gcugcccaggagagguggggcu

SEQ ID NO: 388591 - RNA, 22 nt, Human
cccacagguccccaugaacucg

SEQ ID NO: 388592 - RNA, 22 nt, Human
agcccagggacagggcggaugu

SEQ ID NO: 388593 - RNA, 22 nt, Human
aaaucuaggcucauccuggucc

SEQ ID NO: 388594 - RNA, 23 nt, Human
aggcagugucucuuauccugucc

SEQ ID NO: 388595 - RNA, 22 nt, Human
aaacaucaccauuuuaccuaau

SEQ ID NO: 388596 - RNA, 22 nt, Human
aaagauuauggcauugaaauac

SEQ ID NO: 388597 - RNA, 22 nt, Human
uucagaaaaagaccauugcaau

SEQ ID NO: 388598 - RNA, 22 nt, Human
uuuauuugucuugccauuuagu

SEQ ID NO: 388599 - RNA, 22 nt, Human
ugcccuguuaucuuggaagagu

SEQ ID NO: 388600 - RNA, 22 nt, Human
ugaggcucaagaaucugcauuu

SEQ ID NO: 388601 - RNA, 22 nt, Human
uggcaguggcucagagugcaga

SEQ ID NO: 388602 - RNA, 22 nt, Human
ucaaaggcaccaaggucacugc

SEQ ID NO: 388603 - RNA, 22 nt, Human
gucuuuaugguaugaaaacuga

SEQ ID NO: 388604 - RNA, 22 nt, Human
ugcugggcuagaagcugaggcc

SEQ ID NO: 388605 - RNA, 22 nt, Human
uuuaaugauagcuguuucacau

SEQ ID NO: 388606 - RNA, 22 nt, Human
acaugauuggacuccuuccccu

SEQ ID NO: 388607 - RNA, 22 nt, Human
ggcuucuccccuuugagucuuc

SEQ ID NO: 388608 - RNA, 19 nt, Human
cugcagggaugugcagagu

SEQ ID NO: 388609 - RNA, 22 nt, Human
cuguagccaguuuggccucacc

SEQ ID NO: 388610 - RNA, 22 nt, Human
uuauucagauuggcuacaggau

SEQ ID NO: 388611 - RNA, 22 nt, Human
ucuggcuccacaccucacugca

SEQ ID NO: 388612 - RNA, 22 nt, Human
auuuuucucuuuccacugagau

SEQ ID NO: 388613 - RNA, 22 nt, Human
ggaccugccagaacucaggcua

SEQ ID NO: 388614 - RNA, 22 nt, Human
guauuagguuggugcaaaagua

SEQ ID NO: 388615 - RNA, 22 nt, Human
uaggcagccagcaucaguuggg

SEQ ID NO: 388616 - RNA, 22 nt, Human
auauuccauugguuucccuucu

SEQ ID NO: 388617 - RNA, 20 nt, Human
uccaguuuuggagacauucu

SEQ ID NO: 388618 - RNA, 22 nt, Human
cccagggcuuuucucacuagac

SEQ ID NO: 388619 - RNA, 22 nt, Human
gccuggcaaggcccuguugacu

SEQ ID NO: 388620 - RNA, 22 nt, Human
ugcuucaaguugaaauauucuu

SEQ ID NO: 388621 - RNA, 22 nt, Human
gccaagagaaugugagagaaau

SEQ ID NO: 388622 - RNA, 19 nt, Human
cagauguuuucaguucauu

SEQ ID NO: 388623 - RNA, 22 nt, Human
ucacugcaaggaggcuucucaa

SEQ ID NO: 388624 - RNA, 22 nt, Human
auucuucaguauguguggauug

SEQ ID NO: 388625 - RNA, 22 nt, Human
ugagccaggcucaagugauccu

SEQ ID NO: 388626 - RNA, 22 nt, Human
aacuagucagugauucucagaa

SEQ ID NO: 388627 - RNA, 22 nt, Human
ggccucuguuuggagccaggau

SEQ ID NO: 388628 - RNA, 22 nt, Human
agcucccagagcucgagaguaa

SEQ ID NO: 388629 - RNA, 22 nt, Human
auaauuuaaauuaguaugugau

SEQ ID NO: 388630 - RNA, 21 nt, Human
ccugggagaucagcugccuuc

SEQ ID NO: 388631 - RNA, 21 nt, Human
uugcaccaugauaaauucaga

SEQ ID NO: 388632 - RNA, 22 nt, Human
uuuaggcagcagugaggaugaa

SEQ ID NO: 388633 - RNA, 22 nt, Human
ucaaugaugcugaagguagcgu

SEQ ID NO: 388634 - RNA, 22 nt, Human
uugaaagugccaaguccuagug

SEQ ID NO: 388635 - RNA, 22 nt, Human
gcagagcucuguucuuaucucc

SEQ ID NO: 388636 - RNA, 20 nt, Human
ugaaaggugggaauuguggg

SEQ ID NO: 388637 - RNA, 22 nt, Human
gcccaggauaaugcugucccug

SEQ ID NO: 388638 - RNA, 22 nt, Human
ggcugccugcuccuccugcacg

SEQ ID NO: 388639 - RNA, 22 nt, Human
aauugugcuaugauuaugaaag

SEQ ID NO: 388640 - RNA, 22 nt, Human
aaacagcugucauuguuuuaaa

SEQ ID NO: 388641 - RNA, 22 nt, Human
ucacaggagggagagacaccca

SEQ ID NO: 388642 - RNA, 21 nt, Human
gcacagugccaggcacacagu

SEQ ID NO: 388643 - RNA, 22 nt, Human
ucagagaagcugccaggcgagc

SEQ ID NO: 388644 - RNA, 22 nt, Human
uggcucagaggggaagugguuu

SEQ ID NO: 388645 - RNA, 22 nt, Human
agagcccucuucacugccccuu

SEQ ID NO: 388646 - RNA, 22 nt, Human
cacccagcagcacuuaagacua

SEQ ID NO: 388647 - RNA, 22 nt, Human
cagcuguguagaugcaggguca

SEQ ID NO: 388648 - RNA, 22 nt, Human
cuacuuuaauuuucugcagaga

SEQ ID NO: 388649 - RNA, 22 nt, Human
cacagcuuguuuagugacucac

SEQ ID NO: 388650 - RNA, 22 nt, Human
cauugaaauauggaaacugaug

SEQ ID NO: 388651 - RNA, 22 nt, Human
ucccaggacaugggcucugcuc

SEQ ID NO: 388652 - RNA, 22 nt, Human
gcagaauuggauaguugugaua

SEQ ID NO: 388653 - RNA, 19 nt, Human
ucuggcuccugccaggcug

SEQ ID NO: 388654 - RNA, 22 nt, Human
aucuuucagggccauuuguauu

SEQ ID NO: 388655 - RNA, 22 nt, Human
uuuuccagagcugucucuugca

SEQ ID NO: 388656 - RNA, 22 nt, Human
ucugagcuggagcccaucaccu

SEQ ID NO: 388657 - RNA, 22 nt, Human
ugggggucaggaugaggccuug

SEQ ID NO: 388658 - RNA, 22 nt, Human
accaggcaaaaccacaggagca

SEQ ID NO: 388659 - RNA, 22 nt, Human
agcuugauuucucugcagugug

SEQ ID NO: 388660 - RNA, 22 nt, Human
aguaaaauuaauggaucagaag

SEQ ID NO: 388661 - RNA, 22 nt, Human
cucagcuggcaauucuggcucc

SEQ ID NO: 388662 - RNA, 22 nt, Human
gucccagggaagaaggcagcac

SEQ ID NO: 388663 - RNA, 22 nt, Human
ggaagagagggcugggccucaa

SEQ ID NO: 388664 - RNA, 22 nt, Human
cuggcuuucuguuauaaagaca

SEQ ID NO: 388665 - RNA, 17 nt, Human
ucugggcuucagugguc

SEQ ID NO: 388666 - RNA, 22 nt, Human
uaaaucaguuucucuuauuggu

SEQ ID NO: 388667 - RNA, 19 nt, Human
gcgaggaagucacuguggc

SEQ ID NO: 388668 - RNA, 21 nt, Human
cuguuucuugugaagugacac

SEQ ID NO: 388669 - RNA, 22 nt, Human
ucccucuguguugggcaugccu

SEQ ID NO: 388670 - RNA, 22 nt, Human
cuuccucccccacacacucacu

SEQ ID NO: 388671 - RNA, 21 nt, Human
ugggaccuagcuuugcacagg

SEQ ID NO: 388672 - RNA, 22 nt, Human
cuuggggcugucacucuggcau

SEQ ID NO: 388673 - RNA, 22 nt, Human
aagcagccucauuugugguaag

SEQ ID NO: 388674 - RNA, 22 nt, Human
uggagcagcaucacuuugagcu

SEQ ID NO: 388675 - RNA, 22 nt, Human
uauuucugucagccagauaugg

SEQ ID NO: 388676 - RNA, 22 nt, Human
auaacaugaccugugcuucaca

SEQ ID NO: 388677 - RNA, 22 nt, Human
ggagggcaucaaucaggccugg

SEQ ID NO: 388678 - RNA, 22 nt, Human
cuguagcagugugcucuuuuuc

SEQ ID NO: 388679 - RNA, 22 nt, Human
ugacagaaagaauaugucaauc

SEQ ID NO: 388680 - RNA, 22 nt, Human
ucaggaguccugccugcagccu

SEQ ID NO: 388681 - RNA, 22 nt, Human
ccugccuggcugucagcagagc

SEQ ID NO: 388682 - RNA, 22 nt, Human
gagcuuuagcugagaccugcuu

SEQ ID NO: 388683 - RNA, 22 nt, Human
gauuucuuuagguguaauagug

SEQ ID NO: 388684 - RNA, 22 nt, Human
uuacacaacaucuguauuauua

SEQ ID NO: 388685 - RNA, 22 nt, Human
cuggagccccaggcugugcaga

SEQ ID NO: 388686 - RNA, 22 nt, Human
ggcaaaguuuucaucucauaac

SEQ ID NO: 388687 - RNA, 22 nt, Human
ugcuguagcccugcacagugca

SEQ ID NO: 388688 - RNA, 22 nt, Human
ugcuggaggaguuuacuguggc

SEQ ID NO: 388689 - RNA, 22 nt, Human
aagaguuaagcaacagauacca

SEQ ID NO: 388690 - RNA, 22 nt, Human
uaggcagaauuguugaaugaag

SEQ ID NO: 388691 - RNA, 22 nt, Human
ucugagaguagagcugccucuu

SEQ ID NO: 388692 - RNA, 22 nt, Human
agaagccauguuuaguaggaug

SEQ ID NO: 388693 - RNA, 22 nt, Human
agugaagaggaaguggggcaca

SEQ ID NO: 388694 - RNA, 22 nt, Human
uccagcuugacaaaugauuuua

SEQ ID NO: 388695 - RNA, 22 nt, Human
cgucuuccucuuacgaugcgcu

SEQ ID NO: 388696 - RNA, 22 nt, Human
ugcagcaggagccaggccuggu

SEQ ID NO: 388697 - RNA, 16 nt, Human
ugggcagaugagaaga

SEQ ID NO: 388698 - RNA, 22 nt, Human
caaggccagggaauuuuucugg

SEQ ID NO: 388699 - RNA, 22 nt, Human
ugcuugagacacauaugaauuu

SEQ ID NO: 388700 - RNA, 22 nt, Human
ugcagcagacugaguaugagaa

SEQ ID NO: 388701 - RNA, 20 nt, Human
acagaauaugcugguugugg

SEQ ID NO: 388702 - RNA, 22 nt, Human
uccauguggccagacacuggca

SEQ ID NO: 388703 - RNA, 22 nt, Human
ugcaggaacagaacucacuccc

SEQ ID NO: 388704 - RNA, 22 nt, Human
cagugaggaguccagggcagag

SEQ ID NO: 388705 - RNA, 22 nt, Human
ugcuuuauaggggauugcaggc

SEQ ID NO: 388706 - RNA, 22 nt, Human
gaggagaggccaucguuguuau

SEQ ID NO: 388707 - RNA, 22 nt, Human
ucagcuuuggucacauugaguu

SEQ ID NO: 388708 - RNA, 22 nt, Human
cagcugagaaauggggaaaggg

SEQ ID NO: 388709 - RNA, 22 nt, Human
cuuauguaaaacggaaagggaa

SEQ ID NO: 388710 - RNA, 22 nt, Human
uuucaagaacaacauucauuca

SEQ ID NO: 388711 - RNA, 22 nt, Human
uggcugucagcugccuggugcg

SEQ ID NO: 388712 - RNA, 22 nt, Human
gcauguguugguuuaugcaugu

SEQ ID NO: 388713 - RNA, 22 nt, Human
ccacccagcagaggaggcaaga

SEQ ID NO: 388714 - RNA, 22 nt, Human
uucaagaugucuucacaauagu

SEQ ID NO: 388715 - RNA, 22 nt, Human
ucucagggccucccucuguuuc

SEQ ID NO: 388716 - RNA, 22 nt, Human
ucuauaaauuaugcagucucag

SEQ ID NO: 388717 - RNA, 23 nt, Human
aaauuauugcucuucaauugccu

SEQ ID NO: 388718 - RNA, 22 nt, Human
gcccagcuggcuuccagcacau

SEQ ID NO: 388719 - RNA, 22 nt, Human
uaguuaggguucugcagagaca

SEQ ID NO: 388720 - RNA, 22 nt, Human
uaagaagcuucugcuaaugccu

SEQ ID NO: 388721 - RNA, 22 nt, Human
agcuuuauucaugauuucaggg

SEQ ID NO: 388722 - RNA, 22 nt, Human
agggcccauagaucgucagcuu

SEQ ID NO: 388723 - RNA, 23 nt, Human
agggaaaguaguaauggccuuug

SEQ ID NO: 388724 - RNA, 22 nt, Human
aguccuuaugagaugcugccuu

SEQ ID NO: 388725 - RNA, 22 nt, Human
uacagucuuuggaaagagauag

SEQ ID NO: 388726 - RNA, 22 nt, Human
uaggcucagggcugggugacgg

SEQ ID NO: 388727 - RNA, 22 nt, Human
ggccucugguucguggugaccu

SEQ ID NO: 388728 - RNA, 22 nt, Human
cuggccuggggccucagcugcu

SEQ ID NO: 388729 - RNA, 22 nt, Human
ccugccaggagcuggugcugca

SEQ ID NO: 388730 - RNA, 22 nt, Human
gcucuguacgcaggaugagggg

SEQ ID NO: 388731 - RNA, 22 nt, Human
agugagggaugaagaacugcgg

SEQ ID NO: 388732 - RNA, 19 nt, Human
acauuuagaauguacuugc

SEQ ID NO: 388733 - RNA, 22 nt, Human
uuuauucuauaggcauuaagca

SEQ ID NO: 388734 - RNA, 22 nt, Human
cagcaggaaagacaucugagca

SEQ ID NO: 388735 - RNA, 22 nt, Human
ucauugcaguagggagagaccc

SEQ ID NO: 388736 - RNA, 22 nt, Human
uauccuuguacuauaguauuua

SEQ ID NO: 388737 - RNA, 22 nt, Human
agauuaugcuggcugcuacaag

SEQ ID NO: 388738 - RNA, 20 nt, Human
uugcauuggaugugcaggug

SEQ ID NO: 388739 - RNA, 22 nt, Human
ggaugcugcuaucaggcuucga

SEQ ID NO: 388740 - RNA, 20 nt, Human
ugcuugucaugcacucaggc

SEQ ID NO: 388741 - RNA, 22 nt, Human
cugccaggccucaucccagcca

SEQ ID NO: 388742 - RNA, 22 nt, Human
auggcagccuguggacagucaa

SEQ ID NO: 388743 - RNA, 22 nt, Human
cagaccagcucuaugaacccaa

SEQ ID NO: 388744 - RNA, 22 nt, Human
ucuuagaaauuccccaguggcu

SEQ ID NO: 388745 - RNA, 22 nt, Human
gagugcagaugaacagaagauu

SEQ ID NO: 388746 - RNA, 22 nt, Human
gcaggagaacaaagcaagcugc

SEQ ID NO: 388747 - RNA, 22 nt, Human
cauaagaaauaaugaugaugac

SEQ ID NO: 388748 - RNA, 22 nt, Human
gcaggagcugcucuccugacga

SEQ ID NO: 388749 - RNA, 23 nt, Human
uccaggagaaccccugucugucc

SEQ ID NO: 388750 - RNA, 19 nt, Human
aacuguaauuaauacccua

SEQ ID NO: 388751 - RNA, 22 nt, Human
uuggcugaagguuaagugcugg

SEQ ID NO: 388752 - RNA, 22 nt, Human
caguccuugcucaaagucuaca

SEQ ID NO: 388753 - RNA, 22 nt, Human
ucucagagcucacaccuccugg

SEQ ID NO: 388754 - RNA, 22 nt, Human
aaaggccaugguuggaguguuu

SEQ ID NO: 388755 - RNA, 22 nt, Human
uaucuaaaggauuuaauuuagu

SEQ ID NO: 388756 - RNA, 22 nt, Human
uccuuggcaugccgucuucucc

SEQ ID NO: 388757 - RNA, 22 nt, Human
acagggcagagggcaguuggua

SEQ ID NO: 388758 - RNA, 21 nt, Human
cagaggccucaugcucugugc

SEQ ID NO: 388759 - RNA, 22 nt, Human
ucaucaaagcgcuuggaguagg

SEQ ID NO: 388760 - RNA, 17 nt, Human
cagugaggccuuuccuc

SEQ ID NO: 388761 - RNA, 21 nt, Human
gaguggaacgcucuucacacc

SEQ ID NO: 388762 - RNA, 22 nt, Human
ggccaggcgaugaccccuccac

SEQ ID NO: 388763 - RNA, 19 nt, Human
aggagaagacucucucccc

SEQ ID NO: 388764 - RNA, 22 nt, Human
ucuucaaaugcuaguaauauca

SEQ ID NO: 388765 - RNA, 22 nt, Human
guguuuccaguucagaaagcaa

SEQ ID NO: 388766 - RNA, 22 nt, Human
acaguuugcccugacauucucc

SEQ ID NO: 388767 - RNA, 22 nt, Human
ggcagccauggacacuggcuag

SEQ ID NO: 388768 - RNA, 16 nt, Human
uggaaggggucuccgg

SEQ ID NO: 388769 - RNA, 22 nt, Human
cugcccagaaucacucacucga

SEQ ID NO: 388770 - RNA, 22 nt, Human
cucugagaggugagaagcagca

SEQ ID NO: 388771 - RNA, 22 nt, Human
ccugggagugugccaucucugu

SEQ ID NO: 388772 - RNA, 22 nt, Human
aauuucaaacuaauaggaacca

SEQ ID NO: 388773 - RNA, 22 nt, Human
ucuuagaaugucaacugauguu

SEQ ID NO: 388774 - RNA, 22 nt, Human
agcauuuauuucuuagaaauug

SEQ ID NO: 388775 - RNA, 22 nt, Human
aagagcuggaguuugcagcccu

SEQ ID NO: 388776 - RNA, 22 nt, Human
gaggccagaaugagcugaaugc

SEQ ID NO: 388777 - RNA, 22 nt, Human
aggcaaaauuacaaaguuauua

SEQ ID NO: 388778 - RNA, 22 nt, Human
ggcuggcacugaggagagcucu

SEQ ID NO: 388779 - RNA, 22 nt, Human
gagaaagggaacuuacagagug

SEQ ID NO: 388780 - RNA, 21 nt, Human
gcccucaggggaggauggccu

SEQ ID NO: 388781 - RNA, 22 nt, Human
uagugcuuuaggccugaguguc

SEQ ID NO: 388782 - RNA, 22 nt, Human
ccuggauccaugaaaaggcuac

SEQ ID NO: 388783 - RNA, 21 nt, Human
ucugggcccaugcugccucac

SEQ ID NO: 388784 - RNA, 22 nt, Human
ugaugguuuuauuaauaggacc

SEQ ID NO: 388785 - RNA, 22 nt, Human
aggagggagcuuaagccaggca

SEQ ID NO: 388786 - RNA, 22 nt, Human
cagaggcauacucccagucuug

SEQ ID NO: 388787 - RNA, 22 nt, Human
gccuggagggauagaaugcaag

SEQ ID NO: 388788 - RNA, 22 nt, Human
ccagcuccugggucuuagucag

SEQ ID NO: 388789 - RNA, 22 nt, Human
guccucugggcuuugagcaguc

SEQ ID NO: 388790 - RNA, 22 nt, Human
uggcagagaacacacaugauuc

SEQ ID NO: 388791 - RNA, 22 nt, Human
aggcacugacaauucuggacug

SEQ ID NO: 388792 - RNA, 22 nt, Human
uuaaaaucuaaagcaguugucu

SEQ ID NO: 388793 - RNA, 22 nt, Human
uccugccuugccugggacauca

SEQ ID NO: 388794 - RNA, 22 nt, Human
ugucccucugaggcuucccugg

SEQ ID NO: 388795 - RNA, 22 nt, Human
gcuggagcugaguucccugggc

SEQ ID NO: 388796 - RNA, 22 nt, Human
ccagggcagccaacccagaugc

SEQ ID NO: 388797 - RNA, 22 nt, Human
gcucagaggaugcuccuuuaug

SEQ ID NO: 388798 - RNA, 22 nt, Human
agggaccucauguaaguggauu

SEQ ID NO: 388799 - RNA, 22 nt, Human
agaauaucguagcauauuaucu

SEQ ID NO: 388800 - RNA, 22 nt, Human
aagugggaauagaaaugaaggu

SEQ ID NO: 388801 - RNA, 22 nt, Human
ggcagcaaauauugucagcugu

SEQ ID NO: 388802 - RNA, 22 nt, Human
uggccagaaccugcaguaggcc

SEQ ID NO: 388803 - RNA, 22 nt, Human
auuugugcauaucccauccacc

SEQ ID NO: 388804 - RNA, 22 nt, Human
uuugcauugcagugguuuacag

SEQ ID NO: 388805 - RNA, 22 nt, Human
ggcagggagagcaugcugauaa

SEQ ID NO: 388806 - RNA, 22 nt, Human
caggcuggagugaguguagugg

SEQ ID NO: 388807 - RNA, 22 nt, Human
gcaggcaguuauuuaguagaau

SEQ ID NO: 388808 - RNA, 22 nt, Human
cuggagcuaggaaguccaagau

SEQ ID NO: 388809 - RNA, 22 nt, Human
guccucagagugggcagguccu

SEQ ID NO: 388810 - RNA, 22 nt, Human
aaaugucagaggaacauauuga

SEQ ID NO: 388811 - RNA, 22 nt, Human
uuccaugagcucugaguucaca

SEQ ID NO: 388812 - RNA, 22 nt, Human
cagaguguggcaucuuccaacu

SEQ ID NO: 388813 - RNA, 22 nt, Human
cugaaggauucaaaauggcagg

SEQ ID NO: 388814 - RNA, 22 nt, Human
ccaggccuuccaguacgcagaa

SEQ ID NO: 388815 - RNA, 22 nt, Human
ugccuguccugaggaugagggu

SEQ ID NO: 388816 - RNA, 22 nt, Human
auguagcagaagauguuuuccu

SEQ ID NO: 388817 - RNA, 22 nt, Human
agcagggcaaagucaggcuaac

SEQ ID NO: 388818 - RNA, 22 nt, Human
gcccagcacuaaaagcuuugcu

SEQ ID NO: 388819 - RNA, 22 nt, Human
gcugauuauuacaugucugugg

SEQ ID NO: 388820 - RNA, 22 nt, Human
auucuguauggaaaagcacuau

SEQ ID NO: 388821 - RNA, 22 nt, Human
ccauggcucuagagauugaaaa

SEQ ID NO: 388822 - RNA, 22 nt, Human
ucucuguaguugggcagcugcu

SEQ ID NO: 388823 - RNA, 22 nt, Human
uaaagaacacagggaauagcac

SEQ ID NO: 388824 - RNA, 22 nt, Human
ucugcagcuucuugccagagag

SEQ ID NO: 388825 - RNA, 22 nt, Human
agauguaguagugggucuuuua

SEQ ID NO: 388826 - RNA, 22 nt, Human
uuucucaucuggaaacagugcu

SEQ ID NO: 388827 - RNA, 18 nt, Human
cguuuuuccgggauugca

SEQ ID NO: 388828 - RNA, 22 nt, Human
cuuccaaaauuuauauguugaa

SEQ ID NO: 388829 - RNA, 22 nt, Human
aauacaaucaaauucacuagca

SEQ ID NO: 388830 - RNA, 22 nt, Human
accagagaaaacacagcaggcu

SEQ ID NO: 388831 - RNA, 22 nt, Human
ucagagaguuuucacuagggug

SEQ ID NO: 388832 - RNA, 22 nt, Human
uuguauuagcuguaaauuuucu

SEQ ID NO: 388833 - RNA, 22 nt, Human
agcugcuccuuuccugcaggcg

SEQ ID NO: 388834 - RNA, 22 nt, Human
ggggcuggcucacuaagagacu

SEQ ID NO: 388835 - RNA, 22 nt, Human
uuuuugcugauaagcagaauuc

SEQ ID NO: 388836 - RNA, 22 nt, Human
gggcacagcugcuacccagugc

SEQ ID NO: 388837 - RNA, 22 nt, Human
uucaggauucuuucagacuggg

SEQ ID NO: 388838 - RNA, 22 nt, Human
augcaucuauucccaagggcag

SEQ ID NO: 388839 - RNA, 22 nt, Human
ucaugucaguuucuucuauaaa

SEQ ID NO: 388840 - RNA, 22 nt, Human
ugggggacugcacuggcgucag

SEQ ID NO: 388841 - RNA, 22 nt, Human
acagagaaagugggcugaagau

SEQ ID NO: 388842 - RNA, 22 nt, Human
agcagccauagauagcaugcaa

SEQ ID NO: 388843 - RNA, 22 nt, Human
uggagccagcccaggccccucu

SEQ ID NO: 388844 - RNA, 22 nt, Human
ucauugcagcuucagguguuca

SEQ ID NO: 388845 - RNA, 22 nt, Human
aaauguagaccuauagggaccu

SEQ ID NO: 388846 - RNA, 22 nt, Human
uugaagauggaucgccacucuc

SEQ ID NO: 388847 - RNA, 18 nt, Human
cccagcuuagcgccccuc

SEQ ID NO: 388848 - RNA, 22 nt, Human
gcacacacuguuuuccucacau

SEQ ID NO: 388849 - RNA, 22 nt, Human
gugccaggugcuaagcugugcu

SEQ ID NO: 388850 - RNA, 22 nt, Human
uguucccaagauaagauuauga

SEQ ID NO: 388851 - RNA, 22 nt, Human
gcuggccugaccagccacaggc

SEQ ID NO: 388852 - RNA, 22 nt, Human
acaauauuguacccagaaguuu

SEQ ID NO: 388853 - RNA, 17 nt, Human
aaguccagaguugagca

SEQ ID NO: 388854 - RNA, 22 nt, Human
ucugcaggcuguacaggaagca

SEQ ID NO: 388855 - RNA, 21 nt, Human
ucucugugucuuuaagcugga

SEQ ID NO: 388856 - RNA, 20 nt, Human
ugccaugguaacagagugug

SEQ ID NO: 388857 - RNA, 22 nt, Human
acugucuuguguuaaagaacca

SEQ ID NO: 388858 - RNA, 22 nt, Human
uggugcugacaguucugagugc

SEQ ID NO: 388859 - RNA, 22 nt, Human
guuguacagcauccagugcaga

SEQ ID NO: 388860 - RNA, 22 nt, Human
ugcucuguaaggucagaaaagg

SEQ ID NO: 388861 - RNA, 22 nt, Human
ggagccagaggcugcugcugug

SEQ ID NO: 388862 - RNA, 22 nt, Human
agggcugagugggagagaguug

SEQ ID NO: 388863 - RNA, 22 nt, Human
ccucuugccaaucagcuacaga

SEQ ID NO: 388864 - RNA, 22 nt, Human
ugagggagagggcgaaaaugaa

SEQ ID NO: 388865 - RNA, 22 nt, Human
ucagaggagaccaaggggaaua

SEQ ID NO: 388866 - RNA, 22 nt, Human
cagcagcugggaaggaggcuga

SEQ ID NO: 388867 - RNA, 21 nt, Human
uuugaaagcuacaucuauagc

SEQ ID NO: 388868 - RNA, 22 nt, Human
ucagggcauguauguuucuuua

SEQ ID NO: 388869 - RNA, 19 nt, Human
aguguguacugaaagcacu

SEQ ID NO: 388870 - RNA, 20 nt, Human
gcugccagugccugaugcuu

SEQ ID NO: 388871 - RNA, 22 nt, Human
uaacauguuaagaaauuagaua

SEQ ID NO: 388872 - RNA, 22 nt, Human
ucugucaccauucagcuugaau

SEQ ID NO: 388873 - RNA, 22 nt, Human
agaaauguuacaguuguuauuu

SEQ ID NO: 388874 - RNA, 22 nt, Human
acccagaggugucuagcaagcu

SEQ ID NO: 388875 - RNA, 22 nt, Human
gugcauugcgaugcagacgacc

SEQ ID NO: 388876 - RNA, 22 nt, Human
uccagggacagcgcuggagcua

SEQ ID NO: 388877 - RNA, 22 nt, Human
uaaaugcaaugugcuuuaccag

SEQ ID NO: 388878 - RNA, 22 nt, Human
uggcucuguugugcugagccag

SEQ ID NO: 388879 - RNA, 22 nt, Human
ugacagaacagguugggagcaa

SEQ ID NO: 388880 - RNA, 22 nt, Human
ugaggcaguauuuuagugacuu

SEQ ID NO: 388881 - RNA, 22 nt, Human
uccagggagauggcagaggcug

SEQ ID NO: 388882 - RNA, 22 nt, Human
ccaaggcuccucagcuggucuu

SEQ ID NO: 388883 - RNA, 22 nt, Human
acugggaggcaucuggagcuga

SEQ ID NO: 388884 - RNA, 22 nt, Human
cagagccuuccuagcagacucu

SEQ ID NO: 388885 - RNA, 22 nt, Human
cuggugcuggagccuagucccu

SEQ ID NO: 388886 - RNA, 22 nt, Human
gccugagagacccauggggcaa

SEQ ID NO: 388887 - RNA, 22 nt, Human
acacacaauuaguuuuaugcuu

SEQ ID NO: 388888 - RNA, 22 nt, Human
gccuggagcucaugugggcauu

SEQ ID NO: 388889 - RNA, 21 nt, Human
gccacugcacuccagccuggg

SEQ ID NO: 388890 - RNA, 22 nt, Human
gaggacagugugaucugccagc

SEQ ID NO: 388891 - RNA, 22 nt, Human
caggcagcguccugcuuccugu

SEQ ID NO: 388892 - RNA, 22 nt, Human
uugcagaggcaaaaaugaacuc

SEQ ID NO: 388893 - RNA, 20 nt, Human
caggcaguuugugguuaggg

SEQ ID NO: 388894 - RNA, 22 nt, Human
agugcuuuagagaaauggugcu

SEQ ID NO: 388895 - RNA, 21 nt, Human
aagcaggacauaugaugcccu

SEQ ID NO: 388896 - RNA, 22 nt, Human
cccagcaggucggugcugccug

SEQ ID NO: 388897 - RNA, 19 nt, Human
agccagggugagaaggagc

SEQ ID NO: 388898 - RNA, 22 nt, Human
gggaguggauuauguggaccca

SEQ ID NO: 388899 - RNA, 22 nt, Human
uagcagggucucaggagucagg

SEQ ID NO: 388900 - RNA, 22 nt, Human
uggccugcccagagcagcucug

SEQ ID NO: 388901 - RNA, 22 nt, Human
cccagcacuuugaauaugucac

SEQ ID NO: 388902 - RNA, 22 nt, Human
agcagggcuuugcagacuuggg

SEQ ID NO: 388903 - RNA, 22 nt, Human
auaauauaauccuacuucccau

SEQ ID NO: 388904 - RNA, 22 nt, Human
uagaggugucacuuugggaagu

SEQ ID NO: 388905 - RNA, 22 nt, Human
cugcuguguuccuccugcaucu

SEQ ID NO: 388906 - RNA, 22 nt, Human
cucagccccaauucuccccauu

SEQ ID NO: 388907 - RNA, 22 nt, Human
cccuguccuuggcugugaggcu

SEQ ID NO: 388908 - RNA, 22 nt, Human
gucuucaauagagccucaauuu

SEQ ID NO: 388909 - RNA, 19 nt, Human
uauggcaggccgaggcacu

SEQ ID NO: 388910 - RNA, 22 nt, Human
ggcaggcaaugaggaugggaag

SEQ ID NO: 388911 - RNA, 22 nt, Human
aauguaaacagcaagagaaggg

SEQ ID NO: 388912 - RNA, 22 nt, Human
agggcucccgugaggugacugc

SEQ ID NO: 388913 - RNA, 22 nt, Human
auugaauagaugcauuauacua

SEQ ID NO: 388914 - RNA, 22 nt, Human
agcugaagaaaugggaagcauu

SEQ ID NO: 388915 - RNA, 22 nt, Human
agucucugggcaugguugugac

SEQ ID NO: 388916 - RNA, 22 nt, Human
agaguccagaaaacagugugcu

SEQ ID NO: 388917 - RNA, 22 nt, Human
gguacaaugucuuacagaccca

SEQ ID NO: 388918 - RNA, 22 nt, Human
gaagaaggugccagaggcuuac

SEQ ID NO: 388919 - RNA, 22 nt, Human
aauugcaauuuucuuaaggucu

SEQ ID NO: 388920 - RNA, 22 nt, Human
guuuauuagaguuuucugucug

SEQ ID NO: 388921 - RNA, 22 nt, Human
gcuggccugucuagagccuuac

SEQ ID NO: 388922 - RNA, 22 nt, Human
auacaucuugucagauucaugu

SEQ ID NO: 388923 - RNA, 22 nt, Human
cauuuguuaaccaguguggauu

SEQ ID NO: 388924 - RNA, 22 nt, Human
aggcugucaucuuugcaggcag

SEQ ID NO: 388925 - RNA, 19 nt, Human
cagagcagugguuccugaa

SEQ ID NO: 388926 - RNA, 22 nt, Human
ugccaggcccagcuccagagcu

SEQ ID NO: 388927 - RNA, 22 nt, Human
cugaagccacgauagcuuccua

SEQ ID NO: 388928 - RNA, 20 nt, Human
cugcugugugugccucagcc

SEQ ID NO: 388929 - RNA, 22 nt, Human
uuucaaacauaucuucauuacu

SEQ ID NO: 388930 - RNA, 22 nt, Human
uagauuucgcugcaucucaauc

SEQ ID NO: 388931 - RNA, 22 nt, Human
acacaggaagucagcacugaug

SEQ ID NO: 388932 - RNA, 22 nt, Human
ucaaucacguguuccauguucu

SEQ ID NO: 388933 - RNA, 22 nt, Human
aaguuuuaacaaguacuuacua

SEQ ID NO: 388934 - RNA, 22 nt, Human
ucucuucugaaaccugucuuua

SEQ ID NO: 388935 - RNA, 22 nt, Human
uucucugaucuugcuagacuga

SEQ ID NO: 388936 - RNA, 22 nt, Human
gcugucugcugggucgcucagg

SEQ ID NO: 388937 - RNA, 22 nt, Human
ggggcuguuuuuggaauggcug

SEQ ID NO: 388938 - RNA, 22 nt, Human
aggagcagaacuguuguggagg

SEQ ID NO: 388939 - RNA, 22 nt, Human
guagaagugaugucauguuaua

SEQ ID NO: 388940 - RNA, 22 nt, Human
cuggcagcaguuaugaaacaau

SEQ ID NO: 388941 - RNA, 22 nt, Human
aguguacauguuuacagcaucu

SEQ ID NO: 388942 - RNA, 22 nt, Human
ugccagaagugcuuuauaagug

SEQ ID NO: 388943 - RNA, 22 nt, Human
agagugaaguaauuguuaggau

SEQ ID NO: 388944 - RNA, 22 nt, Human
cuccagggagcugcgggagcca

SEQ ID NO: 388945 - RNA, 22 nt, Human
ucucuggaagcgcagaucuguu

SEQ ID NO: 388946 - RNA, 22 nt, Human
ucugcuguaaagaauuucugcc

SEQ ID NO: 388947 - RNA, 22 nt, Human
acauuugacauuuaguaucagc

SEQ ID NO: 388948 - RNA, 22 nt, Human
agauaauuugaguaaauuaauu

SEQ ID NO: 388949 - RNA, 20 nt, Human
cagagaccugucuucacaga

SEQ ID NO: 388950 - RNA, 22 nt, Human
cugaggcugggcauggggucca

SEQ ID NO: 388951 - RNA, 22 nt, Human
aauggcuucugaagcacacuuu

SEQ ID NO: 388952 - RNA, 22 nt, Human
cguagguggcucagcaccuggg

SEQ ID NO: 388953 - RNA, 22 nt, Human
uugacaagaaucguugccuugg

SEQ ID NO: 388954 - RNA, 22 nt, Human
agggccucugacgcccccagcc

SEQ ID NO: 388955 - RNA, 22 nt, Human
cucuucaaaagucuaauccuua

SEQ ID NO: 388956 - RNA, 22 nt, Human
ugcaauaacuacuuuaauguug

SEQ ID NO: 388957 - RNA, 22 nt, Human
ugggugggagcacccugucugg

SEQ ID NO: 388958 - RNA, 22 nt, Human
cagagguauugcaaaagccuag

SEQ ID NO: 388959 - RNA, 21 nt, Human
cugcuuuacuucagaggaucu

SEQ ID NO: 388960 - RNA, 18 nt, Human
cuccagggaacucaguca

SEQ ID NO: 388961 - RNA, 22 nt, Human
cccugccugugggcaucaacau

SEQ ID NO: 388962 - RNA, 22 nt, Human
aguuaaagucugaaauagagaa

SEQ ID NO: 388963 - RNA, 22 nt, Human
ucaggggcccuucccucagcag

SEQ ID NO: 388964 - RNA, 22 nt, Human
cuacagaauggagggucagaga

SEQ ID NO: 388965 - RNA, 22 nt, Human
uaucauaaguuaauuaaacagu

SEQ ID NO: 388966 - RNA, 22 nt, Human
gccagggaacccaagggccuca

SEQ ID NO: 388967 - RNA, 22 nt, Human
cagaggauucccuagugaccug

SEQ ID NO: 388968 - RNA, 22 nt, Human
acagucuacuugagcuuguaua

SEQ ID NO: 388969 - RNA, 20 nt, Human
aaaggaauauaugaaguaua

SEQ ID NO: 388970 - RNA, 22 nt, Human
cacagaaaaaggcuugaaaauc

SEQ ID NO: 388971 - RNA, 22 nt, Human
caggccugagacaucugagaua

SEQ ID NO: 388972 - RNA, 22 nt, Human
caggcccugggcaggaucagcc

SEQ ID NO: 388973 - RNA, 22 nt, Human
ggcugccucugaugugcagacg

SEQ ID NO: 388974 - RNA, 22 nt, Human
aagcaaagaguuuaguggguga

SEQ ID NO: 388975 - RNA, 22 nt, Human
ucuguucaugaaauaucuuuuu

SEQ ID NO: 388976 - RNA, 21 nt, Human
gccaggaguagauuacauuua

SEQ ID NO: 388977 - RNA, 22 nt, Human
auccaugaagguacuucucagg

SEQ ID NO: 388978 - RNA, 22 nt, Human
ucauaaagcucuuccaaaugua

SEQ ID NO: 388979 - RNA, 22 nt, Human
ugcuggagaggaaggugggguc

SEQ ID NO: 388980 - RNA, 22 nt, Human
gaggcagccucaguggaccucg

SEQ ID NO: 388981 - RNA, 23 nt, Human
uggugccucagaagcagugggcu

SEQ ID NO: 388982 - RNA, 17 nt, Human
uccaugagacaugaaga

SEQ ID NO: 388983 - RNA, 22 nt, Human
gugaauaaagggaguuuucaaa

SEQ ID NO: 388984 - RNA, 23 nt, Human
aggucagcaggcaaggaaauggc

SEQ ID NO: 388985 - RNA, 22 nt, Human
uccaguggcacuggagacuaga

SEQ ID NO: 388986 - RNA, 20 nt, Human
gccugcagguuggaugggau

SEQ ID NO: 388987 - RNA, 22 nt, Human
uagagcuagcuucaaaaugcga

SEQ ID NO: 388988 - RNA, 22 nt, Human
aacaaucaaguuucuaaaugac

SEQ ID NO: 388989 - RNA, 22 nt, Human
ggcucaggacugcagcguagag

SEQ ID NO: 388990 - RNA, 22 nt, Human
uagggcagcugcaucaggcacu

SEQ ID NO: 388991 - RNA, 22 nt, Human
cauugaaaaacguugacugagu

SEQ ID NO: 388992 - RNA, 22 nt, Human
ggcuuccuggagaaggucugag

SEQ ID NO: 388993 - RNA, 22 nt, Human
gcagguggauuaucagaagugc

SEQ ID NO: 388994 - RNA, 22 nt, Human
ucucagagggaaacaugaguga

SEQ ID NO: 388995 - RNA, 22 nt, Human
gcugccugucccaggaugagga

SEQ ID NO: 388996 - RNA, 22 nt, Human
caggcagccaggggaccugucc

SEQ ID NO: 388997 - RNA, 22 nt, Human
cugcugccggcgagccucccuu

SEQ ID NO: 388998 - RNA, 18 nt, Human
aguccuuacgaggcuaua

SEQ ID NO: 388999 - RNA, 22 nt, Human
caggcacugugcuagauccuug

SEQ ID NO: 389000 - RNA, 22 nt, Human
ucauuuguugaacuuuagugcg

SEQ ID NO: 389001 - RNA, 22 nt, Human
gaagccagccuugucugccucu

SEQ ID NO: 389002 - RNA, 22 nt, Human
uucuccagagggcucugcagga

SEQ ID NO: 389003 - RNA, 22 nt, Human
ucaguagcagaaagcaaugagu

SEQ ID NO: 389004 - RNA, 22 nt, Human
aaagcagauucugaugcaguag

SEQ ID NO: 389005 - RNA, 22 nt, Human
augugaaauagcuggauaugaa

SEQ ID NO: 389006 - RNA, 22 nt, Human
gcauccagucuuggcuccugga

SEQ ID NO: 389007 - RNA, 22 nt, Human
ggcucccacccauagggcgagu

SEQ ID NO: 389008 - RNA, 22 nt, Human
agggccagaguacaucagggcu

SEQ ID NO: 389009 - RNA, 22 nt, Human
ucaguaaacagguuuaaguccu

SEQ ID NO: 389010 - RNA, 22 nt, Human
ugaggcuggcaaggcugguauu

SEQ ID NO: 389011 - RNA, 22 nt, Human
ggcucuggugggaagguuagau

SEQ ID NO: 389012 - RNA, 22 nt, Human
accagcagaguugaggaggaca

SEQ ID NO: 389013 - RNA, 22 nt, Human
aaaaguauuggccaccauuucu

SEQ ID NO: 389014 - RNA, 22 nt, Human
ccucaggcuuacgggcaaugga

SEQ ID NO: 389015 - RNA, 22 nt, Human
cauuauggcagccaggauauug

SEQ ID NO: 389016 - RNA, 22 nt, Human
aucuggcugacuuugugggaca

SEQ ID NO: 389017 - RNA, 22 nt, Human
auuauuagugauguuguuacug

SEQ ID NO: 389018 - RNA, 22 nt, Human
uuucacauacaguguauaguag

SEQ ID NO: 389019 - RNA, 22 nt, Human
aggcucagagagcuguguccau

SEQ ID NO: 389020 - RNA, 22 nt, Human
ccauggaguuccucuggucuau

SEQ ID NO: 389021 - RNA, 22 nt, Human
caggagcccagaguccucagcu

SEQ ID NO: 389022 - RNA, 22 nt, Human
ggucauuguucuuuucugugau

SEQ ID NO: 389023 - RNA, 22 nt, Human
uccugcagcucugagaagcauc

SEQ ID NO: 389024 - RNA, 22 nt, Human
guuagggaucaggaacaagagc

SEQ ID NO: 389025 - RNA, 18 nt, Human
aguaaagcuuauuacaug

SEQ ID NO: 389026 - RNA, 23 nt, Human
cccaggagccugaguccucucug

SEQ ID NO: 389027 - RNA, 22 nt, Human
auuuuucucucacacuuaccag

SEQ ID NO: 389028 - RNA, 22 nt, Human
cuucucucugcauaggcauggg

SEQ ID NO: 389029 - RNA, 22 nt, Human
agccaagcaccacuggcacucg

SEQ ID NO: 389030 - RNA, 22 nt, Human
ucuuagcauuucauaacaacug

SEQ ID NO: 389031 - RNA, 22 nt, Human
cccagcuccuuacagggccgaa

SEQ ID NO: 389032 - RNA, 22 nt, Human
ccucacagggccaggccccuca

SEQ ID NO: 389033 - RNA, 22 nt, Human
agcagcaucugguucugaugug

SEQ ID NO: 389034 - RNA, 22 nt, Human
auaaaugccucagaaucauccc

SEQ ID NO: 389035 - RNA, 22 nt, Human
uccaggagugcugguuagagua

SEQ ID NO: 389036 - RNA, 22 nt, Human
gucaacuuuaagaugaucuuuu

SEQ ID NO: 389037 - RNA, 22 nt, Human
caggaacauuuaaccacagggu

SEQ ID NO: 389038 - RNA, 22 nt, Human
guggccuggcgagcuggcgcgg

SEQ ID NO: 389039 - RNA, 22 nt, Human
aguuauucauuuauucuguaca

SEQ ID NO: 389040 - RNA, 22 nt, Human
gccauccucugagcacuaggca

SEQ ID NO: 389041 - RNA, 22 nt, Human
ggaggagggguuuacauuggaa

SEQ ID NO: 389042 - RNA, 22 nt, Human
ucagccucucugaguccagacc

SEQ ID NO: 389043 - RNA, 22 nt, Human
ggugagggaguggaacgaggug

SEQ ID NO: 389044 - RNA, 22 nt, Human
agugacagcugggaaggugaaa

SEQ ID NO: 389045 - RNA, 22 nt, Human
gacagccucaugaggagcaaaa

SEQ ID NO: 389046 - RNA, 22 nt, Human
cugccuuggcccuaguucaugg

SEQ ID NO: 389047 - RNA, 22 nt, Human
uauguguaggaggaggacaggg

SEQ ID NO: 389048 - RNA, 22 nt, Human
gcugagacuggcagcaggaagu

SEQ ID NO: 389049 - RNA, 17 nt, Human
cccagagaugcugccuu

SEQ ID NO: 389050 - RNA, 22 nt, Human
aggcagugccuggaccccagcu

SEQ ID NO: 389051 - RNA, 22 nt, Human
gaaaaaggauaaauacaguguu

SEQ ID NO: 389052 - RNA, 19 nt, Human
uggcagaggacaaggacuu

SEQ ID NO: 389053 - RNA, 22 nt, Human
cugggcacacagugacucugca

SEQ ID NO: 389054 - RNA, 22 nt, Human
ugcucuguugugcaugugggau

SEQ ID NO: 389055 - RNA, 22 nt, Human
aguguuccacacaucuggggaa

SEQ ID NO: 389056 - RNA, 19 nt, Human
ccuggguccacucagacua

SEQ ID NO: 389057 - RNA, 22 nt, Human
cugagcugcggcaggcaccugg

SEQ ID NO: 389058 - RNA, 22 nt, Human
ggaggccaaggcaggcggauca

SEQ ID NO: 389059 - RNA, 22 nt, Human
cacugaaggcuaggauuagaug

SEQ ID NO: 389060 - RNA, 22 nt, Human
gagagguccauuccccugucag

SEQ ID NO: 389061 - RNA, 22 nt, Human
cagaggcauauaauugcugggg

SEQ ID NO: 389062 - RNA, 22 nt, Human
ucuuuccuacuuuauugugaac

SEQ ID NO: 389063 - RNA, 22 nt, Human
gugcaugugucuuuauaguagc

SEQ ID NO: 389064 - RNA, 22 nt, Human
gcucagagauggggaaugaaaa

SEQ ID NO: 389065 - RNA, 22 nt, Human
guucauuuuacuguaaauagca

SEQ ID NO: 389066 - RNA, 22 nt, Human
gagccaggucgggccgcggcga

SEQ ID NO: 389067 - RNA, 22 nt, Human
caggugucuaauucucaccccc

SEQ ID NO: 389068 - RNA, 22 nt, Human
cagaguggcgacccccucagcu

SEQ ID NO: 389069 - RNA, 22 nt, Human
ucaaaguaaaaguauagaguuu

SEQ ID NO: 389070 - RNA, 22 nt, Human
ucacacacauuugcugucugau

SEQ ID NO: 389071 - RNA, 18 nt, Human
uggcagccagcugcuccu

SEQ ID NO: 389072 - RNA, 22 nt, Human
gggcucuggaaggugcaccaug

SEQ ID NO: 389073 - RNA, 22 nt, Human
ugcauauuuuauaaagauggaa

SEQ ID NO: 389074 - RNA, 22 nt, Human
aggaugggccugggauaugcuu

SEQ ID NO: 389075 - RNA, 22 nt, Human
acaguggaggccauaugguccu

SEQ ID NO: 389076 - RNA, 22 nt, Human
cagagggcucaguccugcugga

SEQ ID NO: 389077 - RNA, 22 nt, Human
aguuuauguaaaauuaguaaug

SEQ ID NO: 389078 - RNA, 22 nt, Human
cagagagagugggguguggauu

SEQ ID NO: 389079 - RNA, 22 nt, Human
aguuuuuccugauuuuacagaa

SEQ ID NO: 389080 - RNA, 22 nt, Human
aggcagcuuucagugucucuca

SEQ ID NO: 389081 - RNA, 22 nt, Human
cagaccuggaaaacaggcuugc

SEQ ID NO: 389082 - RNA, 22 nt, Human
ugcugcacucaccaacagauaa

SEQ ID NO: 389083 - RNA, 20 nt, Human
ugcagagcuggcuggcuccu

SEQ ID NO: 389084 - RNA, 22 nt, Human
ucuuuauuucugaaucccccau

SEQ ID NO: 389085 - RNA, 22 nt, Human
cacacaugaaucccuaguaccu

SEQ ID NO: 389086 - RNA, 20 nt, Human
uguucacaguaguugcugcu

SEQ ID NO: 389087 - RNA, 18 nt, Human
agugugugcccuuucagg

SEQ ID NO: 389088 - RNA, 22 nt, Human
gcuuuaaugaagucacgcaaag

SEQ ID NO: 389089 - RNA, 22 nt, Human
agacccugcaccucucgugggc

SEQ ID NO: 389090 - RNA, 23 nt, Human
cccaggaguuucacugcaaaggu

SEQ ID NO: 389091 - RNA, 22 nt, Human
acccuggggguggccagugcca

SEQ ID NO: 389092 - RNA, 22 nt, Human
cuccaggaaaauagggaaugag

SEQ ID NO: 389093 - RNA, 22 nt, Human
ggcagcuauuccaagcagcacu

SEQ ID NO: 389094 - RNA, 22 nt, Human
cuccccagguucaggagguggg

SEQ ID NO: 389095 - RNA, 22 nt, Human
uacagaguggugagaucuuuug

SEQ ID NO: 389096 - RNA, 22 nt, Human
cccaaggcugcagugagcauga

SEQ ID NO: 389097 - RNA, 22 nt, Human
caaaggcaacauauacuuguuu

SEQ ID NO: 389098 - RNA, 22 nt, Human
gacccagaaggagugcccuaga

SEQ ID NO: 389099 - RNA, 21 nt, Human
uccagaccucccucuccuagc

SEQ ID NO: 389100 - RNA, 22 nt, Human
gcucccaguucccaaagugacc

SEQ ID NO: 389101 - RNA, 22 nt, Human
acagaaauauagaagguaggaa

SEQ ID NO: 389102 - RNA, 22 nt, Human
aggucauuggggacuaucuccg

SEQ ID NO: 389103 - RNA, 22 nt, Human
uuugaaaguucuucugacacua

SEQ ID NO: 389104 - RNA, 22 nt, Human
cugccuuccaaccccagacucc

SEQ ID NO: 389105 - RNA, 22 nt, Human
ggcaggcaggagcgugcuuggg

SEQ ID NO: 389106 - RNA, 22 nt, Human
agaguggagagaaacaacucug

SEQ ID NO: 389107 - RNA, 22 nt, Human
uuuucauugagcaccugaguaa

SEQ ID NO: 389108 - RNA, 22 nt, Human
agccaggcggggcagguuuccu

SEQ ID NO: 389109 - RNA, 22 nt, Human
uccagagcagguggucagaagg

SEQ ID NO: 389110 - RNA, 22 nt, Human
cugcccugucuuuuucugauga

SEQ ID NO: 389111 - RNA, 22 nt, Human
aucuggcucacuuagucuagga

SEQ ID NO: 389112 - RNA, 22 nt, Human
ugcagccaggaaauauuugcug

SEQ ID NO: 389113 - RNA, 22 nt, Human
acagccaggaggaacucaguga

SEQ ID NO: 389114 - RNA, 20 nt, Human
uacuggauuagggcucaccc

SEQ ID NO: 389115 - RNA, 22 nt, Human
gagagcugggaaagccguggag

SEQ ID NO: 389116 - RNA, 22 nt, Human
ggggccuguagagcuucaggga

SEQ ID NO: 389117 - RNA, 22 nt, Human
gggcacuggaaggcucucaggc

SEQ ID NO: 389118 - RNA, 22 nt, Human
augcugugaaaaagaaggcuga

SEQ ID NO: 389119 - RNA, 22 nt, Human
acucaggaaauugagauaaugg

SEQ ID NO: 389120 - RNA, 22 nt, Human
aucaaaguggaaguuuacuagg

SEQ ID NO: 389121 - RNA, 22 nt, Human
uggaaagagguagaggaucugg

SEQ ID NO: 389122 - RNA, 22 nt, Human
gacagggcgagacucagucuca

SEQ ID NO: 389123 - RNA, 21 nt, Human
uuagaagcuaaugcagcuggu

SEQ ID NO: 389124 - RNA, 19 nt, Human
cauguuaugcuguaguauc

SEQ ID NO: 389125 - RNA, 22 nt, Human
ccagccacagcuuccagcuccu

SEQ ID NO: 389126 - RNA, 20 nt, Human
cagcugccuggcucugggau

SEQ ID NO: 389127 - RNA, 22 nt, Human
ggcagaagauaggacagggaau

SEQ ID NO: 389128 - RNA, 22 nt, Human
ccagggcuccauugcucauccu

SEQ ID NO: 389129 - RNA, 22 nt, Human
ccagguggcuucugcccgaugu

SEQ ID NO: 389130 - RNA, 21 nt, Human
agagagggagaugaaacaucc

SEQ ID NO: 389131 - RNA, 22 nt, Human
acaaaauuuuuagacaaggcuu

SEQ ID NO: 389132 - RNA, 22 nt, Human
ugccaggcucagccccuaucuu

SEQ ID NO: 389133 - RNA, 18 nt, Human
uugcuuuguaagcuugca

SEQ ID NO: 389134 - RNA, 19 nt, Human
cuuauuagagugagagcuu

SEQ ID NO: 389135 - RNA, 22 nt, Human
uauuccaguccuauccucuuuu

SEQ ID NO: 389136 - RNA, 22 nt, Human
uggguaggccaggaagcagugu

SEQ ID NO: 389137 - RNA, 22 nt, Human
gugcuucaaguucuuaauguuu

SEQ ID NO: 389138 - RNA, 20 nt, Human
ccagucccugagcaccaggg

SEQ ID NO: 389139 - RNA, 18 nt, Human
uccugcagcuucuaugua

SEQ ID NO: 389140 - RNA, 21 nt, Human
auacuuugaauuacagccuug

SEQ ID NO: 389141 - RNA, 22 nt, Human
caaauucucuuacuguuugaca

SEQ ID NO: 389142 - RNA, 20 nt, Human
uuacucaguuccugccaugc

SEQ ID NO: 389143 - RNA, 22 nt, Human
cgcagggauuucaaggggccuu

SEQ ID NO: 389144 - RNA, 22 nt, Human
uccuuagagauacugucuugaa

SEQ ID NO: 389145 - RNA, 22 nt, Human
cacugagcugauagaauuccag

SEQ ID NO: 389146 - RNA, 22 nt, Human
cugggccaucagaggggcugga

SEQ ID NO: 389147 - RNA, 22 nt, Human
cuacagaagccguggucaggaa

SEQ ID NO: 389148 - RNA, 22 nt, Human
ucuagaaaaaaacugcugugga

SEQ ID NO: 389149 - RNA, 22 nt, Human
guuauacauauguguuaacaaa

SEQ ID NO: 389150 - RNA, 22 nt, Human
agccacagagagggagcugcaa

SEQ ID NO: 389151 - RNA, 20 nt, Human
ugucagugccugaggcacag

SEQ ID NO: 389152 - RNA, 22 nt, Human
uuugaagucaggcuuucuaccc

SEQ ID NO: 389153 - RNA, 19 nt, Human
uggcaucuguaaaauggug

SEQ ID NO: 389154 - RNA, 20 nt, Human
uacuugaauguugcagcagu

SEQ ID NO: 389155 - RNA, 22 nt, Human
gauggguggucucagacuugcc

SEQ ID NO: 389156 - RNA, 22 nt, Human
cucagggucugguccuuagauu

SEQ ID NO: 389157 - RNA, 22 nt, Human
ugaaggaaaugacggcagaaga

SEQ ID NO: 389158 - RNA, 22 nt, Human
cuggaagugggguuggcuugaa

SEQ ID NO: 389159 - RNA, 22 nt, Human
gcuggcuguaucaccuggccag

SEQ ID NO: 389160 - RNA, 22 nt, Human
uugaagcaggaaaauuucuauu

SEQ ID NO: 389161 - RNA, 22 nt, Human
caggauggccccggggcugugc

SEQ ID NO: 389162 - RNA, 22 nt, Human
cagccugacaccagcuuugggc

SEQ ID NO: 389163 - RNA, 22 nt, Human
agagcagauggagcuggaagag

SEQ ID NO: 389164 - RNA, 22 nt, Human
aggcugaggcaagaggaucacu

SEQ ID NO: 389165 - RNA, 22 nt, Human
cccaggagguggagcuugcagu

SEQ ID NO: 389166 - RNA, 22 nt, Human
cccaggucugugccagcucuga

SEQ ID NO: 389167 - RNA, 22 nt, Human
uuccaggggcagcagugauggu

SEQ ID NO: 389168 - RNA, 21 nt, Human
cccaggagaagaaaagaugca

SEQ ID NO: 389169 - RNA, 22 nt, Human
acugcagggcauccuggccaag

SEQ ID NO: 389170 - RNA, 22 nt, Human
cagccagaaccuaggaugagcu

SEQ ID NO: 389171 - RNA, 22 nt, Human
aauuagggagagguagcuaggu

SEQ ID NO: 389172 - RNA, 22 nt, Human
gcuccagaugaaaggccagagg

SEQ ID NO: 389173 - RNA, 22 nt, Human
cagcuggcagaaccugcaucca

SEQ ID NO: 389174 - RNA, 22 nt, Human
ugcagaggagcuggaaggcugg

SEQ ID NO: 389175 - RNA, 22 nt, Human
acaggggcuccgaaggugaggg

SEQ ID NO: 389176 - RNA, 22 nt, Human
uggcagaggaggcucagauuga

SEQ ID NO: 389177 - RNA, 22 nt, Human
ggcugugagcaggcagaaugcu

SEQ ID NO: 389178 - RNA, 22 nt, Human
cagccuguagaauacaguaaau

SEQ ID NO: 389179 - RNA, 22 nt, Human
ccagcuggucugugcucauguu

SEQ ID NO: 389180 - RNA, 23 nt, Human
cauguacagaguuugauaaagug

SEQ ID NO: 389181 - RNA, 22 nt, Human
ugcccaggguuucuaagagcag

SEQ ID NO: 389182 - RNA, 20 nt, Human
gccagcccugacacaggagc

SEQ ID NO: 389183 - RNA, 22 nt, Human
gcagcugccuauucagggcuug

SEQ ID NO: 389184 - RNA, 22 nt, Human
aaguguuuacuuaaagucaugg

SEQ ID NO: 389185 - RNA, 22 nt, Human
uauugacaauuugugaaacuau

SEQ ID NO: 389186 - RNA, 22 nt, Human
acugcuuacaaaaggaaagaau

SEQ ID NO: 389187 - RNA, 22 nt, Human
gggcaggugccagcucccuguc

SEQ ID NO: 389188 - RNA, 23 nt, Human
aacaauagguuuuggcagaauag

SEQ ID NO: 389189 - RNA, 22 nt, Human
gugcuuccccaagccacagccu

SEQ ID NO: 389190 - RNA, 22 nt, Human
auguuaaaugguuuauuauuaa

SEQ ID NO: 389191 - RNA, 22 nt, Human
ucucagggccccaaaggcuagu

SEQ ID NO: 389192 - RNA, 17 nt, Human
ucauuuguugugacuag

SEQ ID NO: 389193 - RNA, 22 nt, Human
uaggcaggugugcacugcccac

SEQ ID NO: 389194 - RNA, 22 nt, Human
ugggcucuccuggaggacaaca

SEQ ID NO: 389195 - RNA, 22 nt, Human
uuugacagcuuguuacaaaguu

SEQ ID NO: 389196 - RNA, 22 nt, Human
uucuucuugaaacuuuagguug

SEQ ID NO: 389197 - RNA, 22 nt, Human
agcuuaggaggaugaugaacau

SEQ ID NO: 389198 - RNA, 22 nt, Human
cuggucugagggcucuugaggc

SEQ ID NO: 389199 - RNA, 22 nt, Human
aggcagcugaccacaguaugau

SEQ ID NO: 389200 - RNA, 22 nt, Human
uuuuuaagagauucuccagucu

SEQ ID NO: 389201 - RNA, 22 nt, Human
agcacauucugccuugcuuugc

SEQ ID NO: 389202 - RNA, 22 nt, Human
gagauuuaauuggauuaacuua

SEQ ID NO: 389203 - RNA, 22 nt, Human
ugguuuaauuuccauuuccuug

SEQ ID NO: 389204 - RNA, 21 nt, Human
uaaggccaagucuauuucugu

SEQ ID NO: 389205 - RNA, 22 nt, Human
cuacccaggcuuagagggcugg

SEQ ID NO: 389206 - RNA, 22 nt, Human
ucuguucaguuguaccuucccc

SEQ ID NO: 389207 - RNA, 22 nt, Human
ucagagugaccuuacauggucu

SEQ ID NO: 389208 - RNA, 22 nt, Human
uccagcagggaauuaguagucu

SEQ ID NO: 389209 - RNA, 22 nt, Human
caggggcuuuuccucuauaagg

SEQ ID NO: 389210 - RNA, 22 nt, Human
aauuuuaucucuaagcaggcuu

SEQ ID NO: 389211 - RNA, 19 nt, Human
auaaggcagugacuuuuuu

SEQ ID NO: 389212 - RNA, 22 nt, Human
cuucuucagcacaauauugaug

SEQ ID NO: 389213 - RNA, 22 nt, Human
cuggcagggugggcuuugcuuu

SEQ ID NO: 389214 - RNA, 22 nt, Human
ugauuucuuccuugucauuaga

SEQ ID NO: 389215 - RNA, 22 nt, Human
gagauucuguagucaggcaucu

SEQ ID NO: 389216 - RNA, 22 nt, Human
agcaauauuucagcuagcaggu

SEQ ID NO: 389217 - RNA, 20 nt, Human
gcccaggaucucugaggcau

SEQ ID NO: 389218 - RNA, 22 nt, Human
ggguccagcgacagcaggcuca

SEQ ID NO: 389219 - RNA, 22 nt, Human
ugcauguguguguauuuauaaa

SEQ ID NO: 389220 - RNA, 22 nt, Human
gagcagcugcagugcagacccu

SEQ ID NO: 389221 - RNA, 22 nt, Human
uguaggccuauguccagcaauu

SEQ ID NO: 389222 - RNA, 22 nt, Human
gcccaggaguucaaggcugcag

SEQ ID NO: 389223 - RNA, 22 nt, Human
uucuucagucccacuagccaca

SEQ ID NO: 389224 - RNA, 22 nt, Human
ggucccagcugcucaagaggcu

SEQ ID NO: 389225 - RNA, 19 nt, Human
auacacauacguaaacuga

SEQ ID NO: 389226 - RNA, 22 nt, Human
uauggcuuuaaacaacuuaggu

SEQ ID NO: 389227 - RNA, 22 nt, Human
caggggcagucugugugcgugg

SEQ ID NO: 389228 - RNA, 22 nt, Human
uccaggcauguugggaagauga

SEQ ID NO: 389229 - RNA, 22 nt, Human
uauaacacucagaaagaaucau

SEQ ID NO: 389230 - RNA, 22 nt, Human
gaaggcaacaccaggaugcacu

SEQ ID NO: 389231 - RNA, 22 nt, Human
cuagaaauauuuuacagucaag

SEQ ID NO: 389232 - RNA, 22 nt, Human
ccagcaggagacuagcaacaua

SEQ ID NO: 389233 - RNA, 22 nt, Human
gcuggcagagagcuggugagga

SEQ ID NO: 389234 - RNA, 20 nt, Human
uuuuuccuucucuacaggca

SEQ ID NO: 389235 - RNA, 22 nt, Human
caugauaauuguuaacaaagua

SEQ ID NO: 389236 - RNA, 22 nt, Human
uuucaacaccagagaccaugcg

SEQ ID NO: 389237 - RNA, 22 nt, Human
uaguggagguggucugugaacu

SEQ ID NO: 389238 - RNA, 22 nt, Human
gcaggcagucaucuuucauauu

SEQ ID NO: 389239 - RNA, 22 nt, Human
aggcugcuucagcugcagggag

SEQ ID NO: 389240 - RNA, 22 nt, Human
gcugccucaggcaccuccuggc

SEQ ID NO: 389241 - RNA, 22 nt, Human
gaaaacuaacggaaaaguuagg

SEQ ID NO: 389242 - RNA, 22 nt, Human
ggagaguggauuccagcuguau

SEQ ID NO: 389243 - RNA, 16 nt, Human
gggagggaguuggugg

SEQ ID NO: 389244 - RNA, 22 nt, Human
uggagcugagagccaggcuggc

SEQ ID NO: 389245 - RNA, 22 nt, Human
uuuuccuuucaucaggacaaag

SEQ ID NO: 389246 - RNA, 22 nt, Human
cugccaggggccucacaggcca

SEQ ID NO: 389247 - RNA, 22 nt, Human
uauuccuauuucuaaacauaug

SEQ ID NO: 389248 - RNA, 22 nt, Human
ugcagggcccuugggguugaac

SEQ ID NO: 389249 - RNA, 18 nt, Human
cagauccaggcagcuauu

SEQ ID NO: 389250 - RNA, 22 nt, Human
ccuggcacgaagggcugagguu

SEQ ID NO: 389251 - RNA, 22 nt, Human
auaaaaguuuccaaucaugccu

SEQ ID NO: 389252 - RNA, 22 nt, Human
uagaacagaguuccagugauca

SEQ ID NO: 389253 - RNA, 22 nt, Human
ucaaauaugugauagaagcuaa

SEQ ID NO: 389254 - RNA, 22 nt, Human
gcacacccucucaccagcacug

SEQ ID NO: 389255 - RNA, 22 nt, Human
cagaaaaggaagagcuauguaa

SEQ ID NO: 389256 - RNA, 21 nt, Human
ugcaggaaagugcugcgaccc

SEQ ID NO: 389257 - RNA, 22 nt, Human
ugauucuauggaaggcauaagg

SEQ ID NO: 389258 - RNA, 22 nt, Human
gagcccuggcagucugggaugg

SEQ ID NO: 389259 - RNA, 20 nt, Human
ugaggcucagagagguugag

SEQ ID NO: 389260 - RNA, 17 nt, Human
ugcugccaagucccaac

SEQ ID NO: 389261 - RNA, 22 nt, Human
ugagggcugcuuccagagcuag

SEQ ID NO: 389262 - RNA, 22 nt, Human
uacaguaaccagucuacuuaga

SEQ ID NO: 389263 - RNA, 17 nt, Human
ugguggcuggagucagg

SEQ ID NO: 389264 - RNA, 22 nt, Human
uaaucuaccacuauugcaauau

SEQ ID NO: 389265 - RNA, 20 nt, Human
gggagucuggaugaaagaug

SEQ ID NO: 389266 - RNA, 22 nt, Human
aaggcacuugcccagagcugca

SEQ ID NO: 389267 - RNA, 22 nt, Human
ucuugauuacaaauaacaucau

SEQ ID NO: 389268 - RNA, 22 nt, Human
uuuuuugucuugaagaaauggu

SEQ ID NO: 389269 - RNA, 21 nt, Human
gccagggaagagaguuggcug

SEQ ID NO: 389270 - RNA, 22 nt, Human
caaagaagagauuuacagagcu

SEQ ID NO: 389271 - RNA, 22 nt, Human
auuauucaacacuugagaaauu

SEQ ID NO: 389272 - RNA, 19 nt, Human
gcuccugggccucacucau

SEQ ID NO: 389273 - RNA, 22 nt, Human
cucugugagggucuguacagaa

SEQ ID NO: 389274 - RNA, 22 nt, Human
gaagugaagagauuagaaauca

SEQ ID NO: 389275 - RNA, 22 nt, Human
cuggcaggaaguuagaugguaa

SEQ ID NO: 389276 - RNA, 22 nt, Human
ggccugagcuugggcagcguau

SEQ ID NO: 389277 - RNA, 22 nt, Human
aagccagguuccauggaggagc

SEQ ID NO: 389278 - RNA, 22 nt, Human
aaaugucuuucaauagagaaau

SEQ ID NO: 389279 - RNA, 22 nt, Human
ucaugacaacuauauuauucca

SEQ ID NO: 389280 - RNA, 22 nt, Human
uuccagcaggcagacaggagau

SEQ ID NO: 389281 - RNA, 22 nt, Human
ccagccuggacugggucuugug

SEQ ID NO: 389282 - RNA, 19 nt, Human
ugaagcaggcagagaagau

SEQ ID NO: 389283 - RNA, 22 nt, Human
ccaaggagaaugacaccaugga

SEQ ID NO: 389284 - RNA, 21 nt, Human
accucaagcaacaaccaaggu

SEQ ID NO: 389285 - RNA, 22 nt, Human
gugguuuucuccaacccagaac

SEQ ID NO: 389286 - RNA, 22 nt, Human
aauucaugaguagaaucuauau

SEQ ID NO: 389287 - RNA, 22 nt, Human
uccagccaagccuugguagcug

SEQ ID NO: 389288 - RNA, 22 nt, Human
ucagaauuagagcucuucuuga

SEQ ID NO: 389289 - RNA, 22 nt, Human
gcucuaauugaaaaauacugca

SEQ ID NO: 389290 - RNA, 22 nt, Human
uccuugaagaaugauucuugga

SEQ ID NO: 389291 - RNA, 22 nt, Human
ucaacagaagugauagcuauua

SEQ ID NO: 389292 - RNA, 20 nt, Human
ccuggagccuggaaggaguc

SEQ ID NO: 389293 - RNA, 22 nt, Human
ucaccaggcuggaaugcagugg

SEQ ID NO: 389294 - RNA, 22 nt, Human
uaaggcacuucaauguuuagaa

SEQ ID NO: 389295 - RNA, 22 nt, Human
uggcugcagacaccuauggcag

SEQ ID NO: 389296 - RNA, 22 nt, Human
aagggcugccagggggugccag

SEQ ID NO: 389297 - RNA, 22 nt, Human
uagcagagcagggaucagagcc

SEQ ID NO: 389298 - RNA, 22 nt, Human
cacacaugucucuccaugcucu

SEQ ID NO: 389299 - RNA, 22 nt, Human
ugucaugccaccguuucccaga

SEQ ID NO: 389300 - RNA, 22 nt, Human
auuuaaaugcuuaagaggguuu

SEQ ID NO: 389301 - RNA, 22 nt, Human
aauuagggaaaauuuacuugua

SEQ ID NO: 389302 - RNA, 20 nt, Human
agaagcugauacugauggaa

SEQ ID NO: 389303 - RNA, 22 nt, Human
gcugugcuugggaagaaucucu

SEQ ID NO: 389304 - RNA, 22 nt, Human
caucagaaggaaggacgauuau

SEQ ID NO: 389305 - RNA, 22 nt, Human
ccaggcugagcaugauuggagc

SEQ ID NO: 389306 - RNA, 22 nt, Human
uccugagagcagaguccaggug

SEQ ID NO: 389307 - RNA, 22 nt, Human
gugugcaguagagaaagagcag

SEQ ID NO: 389308 - RNA, 17 nt, Human
cauuuguugaucaguug

SEQ ID NO: 389309 - RNA, 22 nt, Human
gcugugcuggaaggggaccugc

SEQ ID NO: 389310 - RNA, 22 nt, Human
agguuauaugucauacugaagu

SEQ ID NO: 389311 - RNA, 17 nt, Human
uuucuccuuccaucuca

SEQ ID NO: 389312 - RNA, 22 nt, Human
uggaagggggaagacagcucug

SEQ ID NO: 389313 - RNA, 22 nt, Human
ggcaagaaggcuucagguagcu

SEQ ID NO: 389314 - RNA, 22 nt, Human
augggaggcagcagagcccagc

SEQ ID NO: 389315 - RNA, 22 nt, Human
cucuccucagaacaggcccucu

SEQ ID NO: 389316 - RNA, 22 nt, Human
ggaggagguggguuaaguugua

SEQ ID NO: 389317 - RNA, 22 nt, Human
acauuucuaucauccuguaaug

SEQ ID NO: 389318 - RNA, 22 nt, Human
gcugccuguccugaggaguccg

SEQ ID NO: 389319 - RNA, 22 nt, Human
uuuauuccaugugucuaugacc

SEQ ID NO: 389320 - RNA, 22 nt, Human
aggacaguguggaagagggugc

SEQ ID NO: 389321 - RNA, 22 nt, Human
acaggcucucagccaguuggca

SEQ ID NO: 389322 - RNA, 22 nt, Human
ccccaggagcuuguuuuagaga

SEQ ID NO: 389323 - RNA, 22 nt, Human
aauuucaaugcacucaugguug

SEQ ID NO: 389324 - RNA, 21 nt, Human
uggcugccuacaugcugcagg

SEQ ID NO: 389325 - RNA, 22 nt, Human
accugagaccuaaucugacugu

SEQ ID NO: 389326 - RNA, 22 nt, Human
aggucaccauggcaugcuccac

SEQ ID NO: 389327 - RNA, 22 nt, Human
ucucuggagggcuccaggcggg

SEQ ID NO: 389328 - RNA, 22 nt, Human
ccagagcugcauccagcagguu

SEQ ID NO: 389329 - RNA, 22 nt, Human
agcacuuuccuggcaaaugugg

SEQ ID NO: 389330 - RNA, 22 nt, Human
agucaauuaucucuaggucauc

SEQ ID NO: 389331 - RNA, 22 nt, Human
cccaggcagccccagaagcuug

SEQ ID NO: 389332 - RNA, 22 nt, Human
ggcuggaaaagacaaagcuauu

SEQ ID NO: 389333 - RNA, 22 nt, Human
aagauguaucaguuaagucuuc

SEQ ID NO: 389334 - RNA, 17 nt, Human
uuccuggaagucauucc

SEQ ID NO: 389335 - RNA, 20 nt, Human
uuucugugagaaacacuguu

SEQ ID NO: 389336 - RNA, 22 nt, Human
cauuccuuaacguggggagucu

SEQ ID NO: 389337 - RNA, 22 nt, Human
gggaaauugugugagaucuuug

SEQ ID NO: 389338 - RNA, 22 nt, Human
gagaggcagaggccugaaaccg

SEQ ID NO: 389339 - RNA, 22 nt, Human
ggcuguccuuggccaaggcacu

SEQ ID NO: 389340 - RNA, 22 nt, Human
cuuccucaugugcaaugcaagc

SEQ ID NO: 389341 - RNA, 22 nt, Human
cccagccuuugcuuccugguuc

SEQ ID NO: 389342 - RNA, 19 nt, Human
guugaaaguaggugagggu

SEQ ID NO: 389343 - RNA, 22 nt, Human
gagaggggcccaagccacauag

SEQ ID NO: 389344 - RNA, 22 nt, Human
cagcuuguuuuauuuggggacc

SEQ ID NO: 389345 - RNA, 22 nt, Human
gcugcucugugacagccuccgg

SEQ ID NO: 389346 - RNA, 21 nt, Human
uucaagauauuuaaaaggugg

SEQ ID NO: 389347 - RNA, 22 nt, Human
gagccagcgccuugccucuggg

SEQ ID NO: 389348 - RNA, 23 nt, Human
ccagccucugggucuucauccag

SEQ ID NO: 389349 - RNA, 22 nt, Human
uuguuucauggggauguuuauu

SEQ ID NO: 389350 - RNA, 22 nt, Human
aaagccaguucuuagagaaagc

SEQ ID NO: 389351 - RNA, 22 nt, Human
uuucucuaaauagggaggcuua

SEQ ID NO: 389352 - RNA, 22 nt, Human
uacugccuggagcauuggugcu

SEQ ID NO: 389353 - RNA, 18 nt, Human
acucaggaaaugaugaca

SEQ ID NO: 389354 - RNA, 22 nt, Human
gaggagaaagcagugauuugug

SEQ ID NO: 389355 - RNA, 22 nt, Human
agcugccacagagccuggccag

SEQ ID NO: 389356 - RNA, 22 nt, Human
aggcuucuucuuccuauuuagu

SEQ ID NO: 389357 - RNA, 22 nt, Human
cacaggccugucucuuucuaac

SEQ ID NO: 389358 - RNA, 22 nt, Human
aaaguuugagugauuugacaca

SEQ ID NO: 389359 - RNA, 22 nt, Human
ugcauacacaugugcacauacg

SEQ ID NO: 389360 - RNA, 22 nt, Human
ucuggccauggcaagccgagug

SEQ ID NO: 389361 - RNA, 22 nt, Human
gcucccaccuuugcuaucagua

SEQ ID NO: 389362 - RNA, 22 nt, Human
ugcauggacucaucagacaaga

SEQ ID NO: 389363 - RNA, 22 nt, Human
cauugcacagcccuguggugau

SEQ ID NO: 389364 - RNA, 22 nt, Human
acuuugaaagccuuggccccgg

SEQ ID NO: 389365 - RNA, 22 nt, Human
cauggcugcgagaagagugggu

SEQ ID NO: 389366 - RNA, 22 nt, Human
acugucuuccaggucuggaggu

SEQ ID NO: 389367 - RNA, 22 nt, Human
cugggaggugaacagaaaaacu

SEQ ID NO: 389368 - RNA, 21 nt, Human
aagcuucccugcucuccaggg

SEQ ID NO: 389369 - RNA, 22 nt, Human
gagaggcugacuggcuguccug

SEQ ID NO: 389370 - RNA, 22 nt, Human
cagccagcugaauguaccauga

SEQ ID NO: 389371 - RNA, 22 nt, Human
uuuccauguuggugaaaugagg

SEQ ID NO: 389372 - RNA, 22 nt, Human
guccugggcccaggggcugccu

SEQ ID NO: 389373 - RNA, 22 nt, Human
gugccagcucuccccacaucug

SEQ ID NO: 389374 - RNA, 22 nt, Human
ggcaggguggcccuccagugag

SEQ ID NO: 389375 - RNA, 22 nt, Human
ggaggugggcuaaggacucucu

SEQ ID NO: 389376 - RNA, 22 nt, Human
cuggcuggucaucagcaguacg

SEQ ID NO: 389377 - RNA, 21 nt, Human
aggauuuacuauuaacugugu

SEQ ID NO: 389378 - RNA, 22 nt, Human
uuugaaaggagcuuuauccaga

SEQ ID NO: 389379 - RNA, 22 nt, Human
cugcagggcagaagggcauaga

SEQ ID NO: 389380 - RNA, 22 nt, Human
augaaacagugaauuagucaag

SEQ ID NO: 389381 - RNA, 22 nt, Human
cagcugagcaucacuagucugg

SEQ ID NO: 389382 - RNA, 22 nt, Human
cugggaggcagucucucuagaa

SEQ ID NO: 389383 - RNA, 22 nt, Human
cugagcagccccaccagccauu

SEQ ID NO: 389384 - RNA, 22 nt, Human
ggguacuuaauauuuacggggu

SEQ ID NO: 389385 - RNA, 22 nt, Human
agagggcaaguguaguccagua

SEQ ID NO: 389386 - RNA, 22 nt, Human
gccagcuggagugagagugggc

SEQ ID NO: 389387 - RNA, 22 nt, Human
accaguccgcggagcuccgggg

SEQ ID NO: 389388 - RNA, 22 nt, Human
caaaggcuucaucucagagcag

SEQ ID NO: 389389 - RNA, 22 nt, Human
cugggccauggaagucucugcc

SEQ ID NO: 389390 - RNA, 22 nt, Human
aaaagacauaugugggcauucu

SEQ ID NO: 389391 - RNA, 22 nt, Human
uggagcaggugggaugucguga

SEQ ID NO: 389392 - RNA, 22 nt, Human
ucaggaucggccuuuuuuuaag

SEQ ID NO: 389393 - RNA, 22 nt, Human
acagaauuaaugaaaauuacaa

SEQ ID NO: 389394 - RNA, 22 nt, Human
uucauucuugucuuuguauagu

SEQ ID NO: 389395 - RNA, 22 nt, Human
agcugcccccagggcugugcuu

SEQ ID NO: 389396 - RNA, 22 nt, Human
augguuuguaacccaauacucc

SEQ ID NO: 389397 - RNA, 22 nt, Human
ccaggacuucgaggcuacagug

SEQ ID NO: 389398 - RNA, 22 nt, Human
uaugagcuuccaguguugcaug

SEQ ID NO: 389399 - RNA, 22 nt, Human
agggcuguuuuuggcaccuggg

SEQ ID NO: 389400 - RNA, 22 nt, Human
gagccagccuucuucugagguc

SEQ ID NO: 389401 - RNA, 22 nt, Human
ggagaagggacagacucagcuu

SEQ ID NO: 389402 - RNA, 22 nt, Human
ugagcuuacuucuguacacaga

SEQ ID NO: 389403 - RNA, 22 nt, Human
gccagcagcccagaaggacuuu

SEQ ID NO: 389404 - RNA, 22 nt, Human
ggcuccuggcaucuggugggua

SEQ ID NO: 389405 - RNA, 22 nt, Human
ucagaaauagucuuuaaaauga

SEQ ID NO: 389406 - RNA, 22 nt, Human
uuccuuagacagagguggucau

SEQ ID NO: 389407 - RNA, 22 nt, Human
ccaggcugugguuuagauagag

SEQ ID NO: 389408 - RNA, 22 nt, Human
gagggaaagguuaauacaugau

SEQ ID NO: 389409 - RNA, 22 nt, Human
gggagacacgcugcaggcauaa

SEQ ID NO: 389410 - RNA, 22 nt, Human
cacauggaagagauacagugag

SEQ ID NO: 389411 - RNA, 22 nt, Human
uaauuuuacuuccugagcaccu

SEQ ID NO: 389412 - RNA, 20 nt, Human
ugggcugaggaucaggugcc

SEQ ID NO: 389413 - RNA, 22 nt, Human
uggcccugcuggccaaaggcua

SEQ ID NO: 389414 - RNA, 22 nt, Human
agagugauucuaguuagggaau

SEQ ID NO: 389415 - RNA, 20 nt, Human
gucucagaauggauuugcau

SEQ ID NO: 389416 - RNA, 22 nt, Human
gaggcagagugcaccccaggag

SEQ ID NO: 389417 - RNA, 22 nt, Human
ggguccagcuacaucagggugg

SEQ ID NO: 389418 - RNA, 22 nt, Human
uucuggagagaaaccuuacaaa

SEQ ID NO: 389419 - RNA, 22 nt, Human
agcaguccaacugagguggcau

SEQ ID NO: 389420 - RNA, 22 nt, Human
ucagagguaguagcagaguuga

SEQ ID NO: 389421 - RNA, 22 nt, Human
aggaccugacuggcuccugcuu

SEQ ID NO: 389422 - RNA, 22 nt, Human
agaggggaggcgaaccagaguc

SEQ ID NO: 389423 - RNA, 22 nt, Human
ccagggugugagaaggaaguag

SEQ ID NO: 389424 - RNA, 22 nt, Human
ugcucuggaguggcuugugcac

SEQ ID NO: 389425 - RNA, 22 nt, Human
acugcuuuaucugagaaguccu

SEQ ID NO: 389426 - RNA, 22 nt, Human
ugcagccaucuuucuuggagga

SEQ ID NO: 389427 - RNA, 20 nt, Human
uugauucaagggcugaugga

SEQ ID NO: 389428 - RNA, 15 nt, Human
cccaggaguucgaga

SEQ ID NO: 389429 - RNA, 22 nt, Human
auuuacugagguaaauaaacug

SEQ ID NO: 389430 - RNA, 22 nt, Human
agguauauauucugguccuuau

SEQ ID NO: 389431 - RNA, 22 nt, Human
gauagaaagguguugaaaucca

SEQ ID NO: 389432 - RNA, 22 nt, Human
cuguaguugaugauuucugaua

SEQ ID NO: 389433 - RNA, 22 nt, Human
cacguuuuaugacagaagaagc

SEQ ID NO: 389434 - RNA, 22 nt, Human
cuggagugaagcuuauuuuuca

SEQ ID NO: 389435 - RNA, 22 nt, Human
gcugcucugaaaaugacuguug

SEQ ID NO: 389436 - RNA, 22 nt, Human
ggagaugccagaauugcaaauu

SEQ ID NO: 389437 - RNA, 22 nt, Human
accaggcacuccugaggucuga

SEQ ID NO: 389438 - RNA, 22 nt, Human
gagcacagcuggagguagcauu

SEQ ID NO: 389439 - RNA, 20 nt, Human
cuucuucauuaacccuacug

SEQ ID NO: 389440 - RNA, 22 nt, Human
ccagcuuuaucaagucugagcu

SEQ ID NO: 389441 - RNA, 20 nt, Human
guauuagguguuccucuuuc

SEQ ID NO: 389442 - RNA, 22 nt, Human
aucagaaaaacauaauguuauu

SEQ ID NO: 389443 - RNA, 22 nt, Human
cugggaggcaccgcgucgugcu

SEQ ID NO: 389444 - RNA, 22 nt, Human
uauacaauggcugaaucaucca

SEQ ID NO: 389445 - RNA, 22 nt, Human
cggcagcucgagggccacccgu

SEQ ID NO: 389446 - RNA, 22 nt, Human
ccuucugcuggucaucccagug

SEQ ID NO: 389447 - RNA, 22 nt, Human
uacaguagaauuuuuaguaacu

SEQ ID NO: 389448 - RNA, 22 nt, Human
uaagaacuucggacauguuauc

SEQ ID NO: 389449 - RNA, 22 nt, Human
ugaagaaucagauuggccugcg

SEQ ID NO: 389450 - RNA, 22 nt, Human
gcugagccccccugcguggguc

SEQ ID NO: 389451 - RNA, 22 nt, Human
ccagggcaacgcugucucagag

SEQ ID NO: 389452 - RNA, 22 nt, Human
gcuggccugcgagggcaggcug

SEQ ID NO: 389453 - RNA, 20 nt, Human
aaaauauguauaacucuucu

SEQ ID NO: 389454 - RNA, 22 nt, Human
cuggguggaucgcagccccagg

SEQ ID NO: 389455 - RNA, 20 nt, Human
uauaacaguguugggugugu

SEQ ID NO: 389456 - RNA, 22 nt, Human
auacuaaaguauagaacuuagu

SEQ ID NO: 389457 - RNA, 22 nt, Human
gcaggaugccagggcagcagcg

SEQ ID NO: 389458 - RNA, 19 nt, Human
ccuguucaugacucugucc

SEQ ID NO: 389459 - RNA, 22 nt, Human
acuucauuguaauauuauagca

SEQ ID NO: 389460 - RNA, 19 nt, Human
uuuggcacucugaaguguu

SEQ ID NO: 389461 - RNA, 22 nt, Human
uuaggaaacgcugcuauugacu

SEQ ID NO: 389462 - RNA, 22 nt, Human
gucaggauguuuauucuccagu

SEQ ID NO: 389463 - RNA, 22 nt, Human
aaguccagaacuccugugauag

SEQ ID NO: 389464 - RNA, 22 nt, Human
acaggcagggaccuuggcuaag

SEQ ID NO: 389465 - RNA, 22 nt, Human
cccuuccuccucgccugucaga

SEQ ID NO: 389466 - RNA, 22 nt, Human
cugagcugggaguggauagugg

SEQ ID NO: 389467 - RNA, 22 nt, Human
ggucccaggaaucuguguucua

SEQ ID NO: 389468 - RNA, 22 nt, Human
cagugaaguuuaaaguguagau

SEQ ID NO: 389469 - RNA, 22 nt, Human
agcugccaucagccuuuggaug

SEQ ID NO: 389470 - RNA, 22 nt, Human
uaaugcuuaauuuucacaagcc

SEQ ID NO: 389471 - RNA, 22 nt, Human
acagaauuaucaggaaauguua

SEQ ID NO: 389472 - RNA, 22 nt, Human
ugaacuccaaauacugcugauu

SEQ ID NO: 389473 - RNA, 22 nt, Human
gcggcaggaagagcgcagcccc

SEQ ID NO: 389474 - RNA, 22 nt, Human
uggcagguuuccuccucauagu

SEQ ID NO: 389475 - RNA, 22 nt, Human
uccauggggcccaggaugagag

SEQ ID NO: 389476 - RNA, 23 nt, Human
ccagcugugccuggcccaggagc

SEQ ID NO: 389477 - RNA, 22 nt, Human
uaacagaaauuuuaguuagggg

SEQ ID NO: 389478 - RNA, 22 nt, Human
ccucucauagucuguauccuuu

SEQ ID NO: 389479 - RNA, 22 nt, Human
aggugcaggagcugugcaggga

SEQ ID NO: 389480 - RNA, 22 nt, Human
gaauuucaggacaacuggaagg

SEQ ID NO: 389481 - RNA, 22 nt, Human
aaaugcacacaccaggaaacua

SEQ ID NO: 389482 - RNA, 22 nt, Human
uggcacugccuggcagggcccc

SEQ ID NO: 389483 - RNA, 22 nt, Human
gcuucucuggccugcagggcau

SEQ ID NO: 389484 - RNA, 22 nt, Human
gcccaggauggcuggaggugcu

SEQ ID NO: 389485 - RNA, 22 nt, Human
auucaaauuaaguuaauucagc

SEQ ID NO: 389486 - RNA, 19 nt, Human
ugggcagcucccucugucc

SEQ ID NO: 389487 - RNA, 19 nt, Human
caguggccuggaggucucu

SEQ ID NO: 389488 - RNA, 22 nt, Human
uaucuguuugcucacagguguu

SEQ ID NO: 389489 - RNA, 20 nt, Human
agaggaggauuauuuuauuc

SEQ ID NO: 389490 - RNA, 21 nt, Human
ugggaugggucugggaccagc

SEQ ID NO: 389491 - RNA, 22 nt, Human
caucagaauguuauggggggcu

SEQ ID NO: 389492 - RNA, 22 nt, Human
cccaggaacuccagagcuccuc

SEQ ID NO: 389493 - RNA, 22 nt, Human
gaagaaucugaggacagucauu

SEQ ID NO: 389494 - RNA, 22 nt, Human
cauacauuuugcauauuuacca

SEQ ID NO: 389495 - RNA, 22 nt, Human
ugcaggaaauuccaggguggcc

SEQ ID NO: 389496 - RNA, 22 nt, Human
agccugagagccaagcugugca

SEQ ID NO: 389497 - RNA, 22 nt, Human
agaucuauuagcaaacugccau

SEQ ID NO: 389498 - RNA, 22 nt, Human
ugaagaauaaaugguugagacu

SEQ ID NO: 389499 - RNA, 22 nt, Human
ugcuggaggccugacuguguuu

SEQ ID NO: 389500 - RNA, 22 nt, Human
aggcuucuuagauuggcuggag

SEQ ID NO: 389501 - RNA, 22 nt, Human
caggaggcaguuucagaaguca

SEQ ID NO: 389502 - RNA, 22 nt, Human
aagagccagugggaaagucuug

SEQ ID NO: 389503 - RNA, 22 nt, Human
uggagcucaaaggccuguggga

SEQ ID NO: 389504 - RNA, 22 nt, Human
agccacagcccacaggacucuu

SEQ ID NO: 389505 - RNA, 16 nt, Human
ucccaggaggcggaac

SEQ ID NO: 389506 - RNA, 22 nt, Human
aggggaaggccagccuguagag

SEQ ID NO: 389507 - RNA, 22 nt, Human
auguagcaugaggcacugugcc

SEQ ID NO: 389508 - RNA, 23 nt, Human
uuagagaugauuaaaaaaucuug

SEQ ID NO: 389509 - RNA, 22 nt, Human
uagaaacagauguuuuugaaga

SEQ ID NO: 389510 - RNA, 22 nt, Human
ggggugggguuacucauugugc

SEQ ID NO: 389511 - RNA, 22 nt, Human
agcugcuacugcucugccagag

SEQ ID NO: 389512 - RNA, 22 nt, Human
agaggccaucugcucugugggg

SEQ ID NO: 389513 - RNA, 22 nt, Human
agccaagcacucaacuccugga

SEQ ID NO: 389514 - RNA, 22 nt, Human
ucugguaaccuuuaucccuccu

SEQ ID NO: 389515 - RNA, 22 nt, Human
ugggaccugcucuuggaaugag

SEQ ID NO: 389516 - RNA, 22 nt, Human
gaacaguaaauuuaugcagcac

SEQ ID NO: 389517 - RNA, 22 nt, Human
ggggcagagucuggacuguugu

SEQ ID NO: 389518 - RNA, 22 nt, Human
caucagcacuaugauuaaagua

SEQ ID NO: 389519 - RNA, 22 nt, Human
ccagcccugccagagagagcug

SEQ ID NO: 389520 - RNA, 22 nt, Human
uuccucucgcucuccggggccc

SEQ ID NO: 389521 - RNA, 22 nt, Human
gagcagcugguaggugaaccca

SEQ ID NO: 389522 - RNA, 17 nt, Human
gcucccugaggacagcu

SEQ ID NO: 389523 - RNA, 22 nt, Human
gcccugggauuggguggaggcu

SEQ ID NO: 389524 - RNA, 22 nt, Human
ucccagggacugggcuaggcuu

SEQ ID NO: 389525 - RNA, 22 nt, Human
aagauuuagggccaguuuacau

SEQ ID NO: 389526 - RNA, 22 nt, Human
aaggcaggagcuguaucuuauu

SEQ ID NO: 389527 - RNA, 22 nt, Human
aaaugcagguucuugagccaag

SEQ ID NO: 389528 - RNA, 22 nt, Human
cccuuagcuccaagggguuugg

SEQ ID NO: 389529 - RNA, 22 nt, Human
cccuggaguccggagcucaccu

SEQ ID NO: 389530 - RNA, 22 nt, Human
uucagaaguagcuaagcaguca

SEQ ID NO: 389531 - RNA, 22 nt, Human
ugggaguguucuuggcuugcuu

SEQ ID NO: 389532 - RNA, 22 nt, Human
gacagaggcuggagcaccuccu

SEQ ID NO: 389533 - RNA, 22 nt, Human
agcugcagauucuaucuagaag

SEQ ID NO: 389534 - RNA, 21 nt, Human
ugccaggccugagcugggguc

SEQ ID NO: 389535 - RNA, 22 nt, Human
gccugaagaacagcugugagga

SEQ ID NO: 389536 - RNA, 22 nt, Human
auagucuuagaucagauaaagu

SEQ ID NO: 389537 - RNA, 21 nt, Human
ugcaggcaggcagagaugcug

SEQ ID NO: 389538 - RNA, 22 nt, Human
agauguggauccuaggguagaa

SEQ ID NO: 389539 - RNA, 22 nt, Human
gccuggagggcucuagagaggc

SEQ ID NO: 389540 - RNA, 22 nt, Human
cagugcagaggccagggaggau

SEQ ID NO: 389541 - RNA, 22 nt, Human
gccaggcauuuauugauugaau

SEQ ID NO: 389542 - RNA, 22 nt, Human
ucauguaaguauagaaagcagu

SEQ ID NO: 389543 - RNA, 19 nt, Human
gggaaauucacuugcuucc

SEQ ID NO: 389544 - RNA, 22 nt, Human
gcucccaccuccagccugaguu

SEQ ID NO: 389545 - RNA, 22 nt, Human
accaaggagaaggugcaagcuu

SEQ ID NO: 389546 - RNA, 22 nt, Human
agcugugguucugggcagcgac

SEQ ID NO: 389547 - RNA, 22 nt, Human
acagugucaugucguguucccc

SEQ ID NO: 389548 - RNA, 22 nt, Human
ucagcaguuuuauaugcagcuu

SEQ ID NO: 389549 - RNA, 22 nt, Human
agccucucugaugugacagcua

SEQ ID NO: 389550 - RNA, 21 nt, Human
ccaggaaggacugagcucccu

SEQ ID NO: 389551 - RNA, 22 nt, Human
uaaagucaucuuuacaucuuug

SEQ ID NO: 389552 - RNA, 22 nt, Human
uuggaaagcaagcuggacauac

SEQ ID NO: 389553 - RNA, 22 nt, Human
ugucucagaauggcucauaaua

SEQ ID NO: 389554 - RNA, 20 nt, Human
gugaccagaagacagugggu

SEQ ID NO: 389555 - RNA, 22 nt, Human
gggagggaggugaugcuuggcu

SEQ ID NO: 389556 - RNA, 22 nt, Human
gugggcaaggucccugccagcu

SEQ ID NO: 389557 - RNA, 22 nt, Human
gcagccucaaacuccccagcuc

SEQ ID NO: 389558 - RNA, 20 nt, Human
agcugguuaucuuaauucuu

SEQ ID NO: 389559 - RNA, 22 nt, Human
uggcucaggggucuggcucugu

SEQ ID NO: 389560 - RNA, 22 nt, Human
cauugcaccacauugcaucccu

SEQ ID NO: 389561 - RNA, 22 nt, Human
gcuggguggaucggaggcucug

SEQ ID NO: 389562 - RNA, 22 nt, Human
aagugccugaccuagccuggag

SEQ ID NO: 389563 - RNA, 22 nt, Human
cuguacaucccgagagccagua

SEQ ID NO: 389564 - RNA, 22 nt, Human
uucacaguggcugugccauuug

SEQ ID NO: 389565 - RNA, 22 nt, Human
uaguccuuuccggcugcuauaa

SEQ ID NO: 389566 - RNA, 22 nt, Human
cagcuuuauugagguauaauug

SEQ ID NO: 389567 - RNA, 22 nt, Human
uggcucagccuggcccuuucau

SEQ ID NO: 389568 - RNA, 22 nt, Human
gcugcucugggucugcccagcu

SEQ ID NO: 389569 - RNA, 19 nt, Human
gaaggcugaaaugaagcac

SEQ ID NO: 389570 - RNA, 22 nt, Human
agucucagaaaauaugcuuuuu

SEQ ID NO: 389571 - RNA, 22 nt, Human
gucccacaccuugaggggucuu

SEQ ID NO: 389572 - RNA, 22 nt, Human
uucaauucuaaacuaauauucu

SEQ ID NO: 389573 - RNA, 22 nt, Human
gcuggagcuugagaggacaggg

SEQ ID NO: 389574 - RNA, 22 nt, Human
agagcaggcauaaagcuuugaa

SEQ ID NO: 389575 - RNA, 22 nt, Human
ugcuuaauguacgugaguguac

SEQ ID NO: 389576 - RNA, 22 nt, Human
gcuguguuugacaguagcagac

SEQ ID NO: 389577 - RNA, 22 nt, Human
cccaggagguggaguucacagu

SEQ ID NO: 389578 - RNA, 22 nt, Human
cgacccuacagacagugcugag

SEQ ID NO: 389579 - RNA, 22 nt, Human
aauuauccuuaaugcaguaagc

SEQ ID NO: 389580 - RNA, 22 nt, Human
uuucuaaaugguggcugcauug

SEQ ID NO: 389581 - RNA, 22 nt, Human
gcagccacuuugcaaccaagag

SEQ ID NO: 389582 - RNA, 22 nt, Human
ucagccaguugccccaguuagu

SEQ ID NO: 389583 - RNA, 22 nt, Human
acccugccgugggcugcuugug

SEQ ID NO: 389584 - RNA, 22 nt, Human
uggcagcagccauggaaggccc

SEQ ID NO: 389585 - RNA, 22 nt, Human
gggcaggaugcaguuucagaga

SEQ ID NO: 389586 - RNA, 22 nt, Human
aucuuguuauaagagauaaugg

SEQ ID NO: 389587 - RNA, 22 nt, Human
augaguaaaaccacuauuuaca

SEQ ID NO: 389588 - RNA, 22 nt, Human
uuacaguuuaguccaagccaga

SEQ ID NO: 389589 - RNA, 22 nt, Human
ggcaggguccacaccugggaaa

SEQ ID NO: 389590 - RNA, 22 nt, Human
ggagugucagaaacaguguccu

SEQ ID NO: 389591 - RNA, 22 nt, Human
ccugccagcauggcuuaucucc

SEQ ID NO: 389592 - RNA, 22 nt, Human
cggaggggauacauuuucugaa

SEQ ID NO: 389593 - RNA, 22 nt, Human
guggcagcugguaugcagacag

SEQ ID NO: 389594 - RNA, 22 nt, Human
gcugcugucacggugcuaaggg

SEQ ID NO: 389595 - RNA, 22 nt, Human
ucagaaaagagaaaaucuuaua

SEQ ID NO: 389596 - RNA, 22 nt, Human
gagcaugguuccauagguuggu

SEQ ID NO: 389597 - RNA, 22 nt, Human
ggaaggagggcggcaaugauga

SEQ ID NO: 389598 - RNA, 22 nt, Human
gggccucucccuucucacgcau

SEQ ID NO: 389599 - RNA, 22 nt, Human
ggcaggcaguguggugugaaac

SEQ ID NO: 389600 - RNA, 22 nt, Human
guuucgucaggcuuauucuauc

SEQ ID NO: 389601 - RNA, 22 nt, Human
gcucaaggcaggcagacaugag

SEQ ID NO: 389602 - RNA, 22 nt, Human
ugggcuguccagcaccugggcu

SEQ ID NO: 389603 - RNA, 21 nt, Human
ucuauucauuacaguuauuug

SEQ ID NO: 389604 - RNA, 22 nt, Human
uuuaguagaaugauacagggca

SEQ ID NO: 389605 - RNA, 22 nt, Human
ccugagggcgccgagcucccag

SEQ ID NO: 389606 - RNA, 22 nt, Human
ggcaauuucaugugguuuaaac

SEQ ID NO: 389607 - RNA, 22 nt, Human
agugcacaccuuaguacaaagu

SEQ ID NO: 389608 - RNA, 22 nt, Human
accucugcaacccuggaauggg

SEQ ID NO: 389609 - RNA, 23 nt, Human
gccugggacugguagugugaccu

SEQ ID NO: 389610 - RNA, 22 nt, Human
cagccaggagccucugcaacua

SEQ ID NO: 389611 - RNA, 22 nt, Human
uagaaagcuugggguguuuaaa

SEQ ID NO: 389612 - RNA, 22 nt, Human
gcaggagucacugacuuggucc

SEQ ID NO: 389613 - RNA, 22 nt, Human
gaaaagggcaagagagagggca

SEQ ID NO: 389614 - RNA, 22 nt, Human
agaccaugggcucugaagagca

SEQ ID NO: 389615 - RNA, 17 nt, Human
uaucagaauguguuuac

SEQ ID NO: 389616 - RNA, 22 nt, Human
ugcuuuaagagauuguuaguac

SEQ ID NO: 389617 - RNA, 22 nt, Human
agaaaucucaguaucucaggga

SEQ ID NO: 389618 - RNA, 22 nt, Human
agacuuugagcucuuagagaag

SEQ ID NO: 389619 - RNA, 22 nt, Human
uacaauacuuaaccuauuuugc

SEQ ID NO: 389620 - RNA, 22 nt, Human
ucacagggauggaauagaaaua

SEQ ID NO: 389621 - RNA, 22 nt, Human
ccagagccagagaggugccugc

SEQ ID NO: 389622 - RNA, 22 nt, Human
aaggagucugggccauucagag

SEQ ID NO: 389623 - RNA, 22 nt, Human
accaggcugugaagugagacua

SEQ ID NO: 389624 - RNA, 22 nt, Human
uacaaacuuguuuuaaguaagu

SEQ ID NO: 389625 - RNA, 22 nt, Human
ugcacacaguucucaggaaaga

SEQ ID NO: 389626 - RNA, 21 nt, Human
cauuuacaugacagauugguu

SEQ ID NO: 389627 - RNA, 22 nt, Human
uagaggugacacugagaccaua

SEQ ID NO: 389628 - RNA, 22 nt, Human
ucaagacaucacugugcauuuu

SEQ ID NO: 389629 - RNA, 22 nt, Human
cagucucucagcuuucagcugu

SEQ ID NO: 389630 - RNA, 21 nt, Human
gauuuuaaagagacugccaca

SEQ ID NO: 389631 - RNA, 22 nt, Human
cgggcagugcccagcggggcag

SEQ ID NO: 389632 - RNA, 22 nt, Human
uaauacuuaccuugcagagucu

SEQ ID NO: 389633 - RNA, 22 nt, Human
agcacccuccaacuucccugua

SEQ ID NO: 389634 - RNA, 22 nt, Human
aucugacaaccuauugacuuga

SEQ ID NO: 389635 - RNA, 22 nt, Human
gcugcaggagcuggagcugugg

SEQ ID NO: 389636 - RNA, 22 nt, Human
agggccuggcgcguggccgccg

SEQ ID NO: 389637 - RNA, 22 nt, Human
cugcugcauuacucuucucaag

SEQ ID NO: 389638 - RNA, 22 nt, Human
cugcuuccauaaauaaugugcu

SEQ ID NO: 389639 - RNA, 22 nt, Human
acagagagggagugauaaaucc

SEQ ID NO: 389640 - RNA, 23 nt, Human
ugacacauuuccuuuccacugca

SEQ ID NO: 389641 - RNA, 22 nt, Human
acagagccaaaaggacauagua

SEQ ID NO: 389642 - RNA, 22 nt, Human
ccauuugucaccucugcacucc

SEQ ID NO: 389643 - RNA, 22 nt, Human
cagggacauugguggccagguu

SEQ ID NO: 389644 - RNA, 22 nt, Human
agggcagcagcuccuccuagcu

SEQ ID NO: 389645 - RNA, 22 nt, Human
auguccuuccauuuugaucugu

SEQ ID NO: 389646 - RNA, 22 nt, Human
ugaggcagauauuuauuggguu

SEQ ID NO: 389647 - RNA, 22 nt, Human
uucuuuuccuacacagcgauuu

SEQ ID NO: 389648 - RNA, 22 nt, Human
gccuggagagcacugugcgcuu

SEQ ID NO: 389649 - RNA, 17 nt, Human
uccuucagggccucaca

SEQ ID NO: 389650 - RNA, 22 nt, Human
gaggccacgguuuuccuugggg

SEQ ID NO: 389651 - RNA, 22 nt, Human
cuggaagguuccucccagcucc

SEQ ID NO: 389652 - RNA, 22 nt, Human
ccaggcaggcgauggugcagug

SEQ ID NO: 389653 - RNA, 22 nt, Human
gucugcccucacgccagcuggg

SEQ ID NO: 389654 - RNA, 22 nt, Human
ucuggagcuggagggcaaggca

SEQ ID NO: 389655 - RNA, 22 nt, Human
ccuggaucagucacuguugcug

SEQ ID NO: 389656 - RNA, 19 nt, Human
caggagagcaugcacuuug

SEQ ID NO: 389657 - RNA, 22 nt, Human
uauaauuaguaaauggcagauu

SEQ ID NO: 389658 - RNA, 21 nt, Human
agcugcuccagggagcucagg

SEQ ID NO: 389659 - RNA, 22 nt, Human
agcaggugcauggcgagcgcgg

SEQ ID NO: 389660 - RNA, 22 nt, Human
uguauacauuuaacuagauaga

SEQ ID NO: 389661 - RNA, 22 nt, Human
caggcacugugcugagcucugc

SEQ ID NO: 389662 - RNA, 22 nt, Human
ggcagggaguggagacucccua

SEQ ID NO: 389663 - RNA, 22 nt, Human
aaauauagcaauuaugccuacu

SEQ ID NO: 389664 - RNA, 22 nt, Human
agugugcugcuuaaacaguugu

SEQ ID NO: 389665 - RNA, 22 nt, Human
caagaugggcaccccagcaccu

SEQ ID NO: 389666 - RNA, 22 nt, Human
uugguuuagagagugugguuac

SEQ ID NO: 389667 - RNA, 22 nt, Human
cuucucagaucucagcuuugag

SEQ ID NO: 389668 - RNA, 20 nt, Human
cccugagaccagagagcagc

SEQ ID NO: 389669 - RNA, 22 nt, Human
gaagccaguacugugcucugca

SEQ ID NO: 389670 - RNA, 20 nt, Human
ucccaggcugggcuccagcu

SEQ ID NO: 389671 - RNA, 22 nt, Human
uaaagguaguuuuaaaggugcu

SEQ ID NO: 389672 - RNA, 22 nt, Human
uagauuuaagacccugaauuug

SEQ ID NO: 389673 - RNA, 22 nt, Human
aauuuggcagugucuugaagua

SEQ ID NO: 389674 - RNA, 22 nt, Human
aucuuugaagaggacuugaagu

SEQ ID NO: 389675 - RNA, 22 nt, Human
gaggcagugucgguggcaggau

SEQ ID NO: 389676 - RNA, 22 nt, Human
aagggaggggauguaagccugg

SEQ ID NO: 389677 - RNA, 22 nt, Human
gcccagcaggacagagugguuu

SEQ ID NO: 389678 - RNA, 22 nt, Human
aaguggagagcccuggaggucu

SEQ ID NO: 389679 - RNA, 22 nt, Human
cucccuggcuuuguccugaggc

SEQ ID NO: 389680 - RNA, 22 nt, Human
ucagauggcacacagagccugc

SEQ ID NO: 389681 - RNA, 18 nt, Human
cgaggcaggcggaucacg

SEQ ID NO: 389682 - RNA, 22 nt, Human
cauuugaugacucaacucauaa

SEQ ID NO: 389683 - RNA, 22 nt, Human
uauuugagcgaagcaguguuuu

SEQ ID NO: 389684 - RNA, 22 nt, Human
uaagaaauuuaguuauagaaug

SEQ ID NO: 389685 - RNA, 22 nt, Human
aaucagaaaggcuaaggaagca

SEQ ID NO: 389686 - RNA, 23 nt, Human
aguuuguaaagaaauauuugcac

SEQ ID NO: 389687 - RNA, 19 nt, Human
agccuggagggcuggucac

SEQ ID NO: 389688 - RNA, 22 nt, Human
cagcuuuaccuuuaggaguaac

SEQ ID NO: 389689 - RNA, 22 nt, Human
ucuucaaagaauuuuaguaauu

SEQ ID NO: 389690 - RNA, 22 nt, Human
cacugaagccacuggaagagga

SEQ ID NO: 389691 - RNA, 23 nt, Human
cagggaggagauacuguguaucu

SEQ ID NO: 389692 - RNA, 22 nt, Human
gcugcagcaagcccuccagggg

SEQ ID NO: 389693 - RNA, 22 nt, Human
aggaccuguguuuuccuugaau

SEQ ID NO: 389694 - RNA, 22 nt, Human
guggauggacaugggcaagagg

SEQ ID NO: 389695 - RNA, 22 nt, Human
agcagcugggcucagagcuggg

SEQ ID NO: 389696 - RNA, 22 nt, Human
aacaaauggaacacaaaucuuu

SEQ ID NO: 389697 - RNA, 22 nt, Human
guaaacaugcuguguacucagc

SEQ ID NO: 389698 - RNA, 22 nt, Human
aggcagcuuucuguaggggugu

SEQ ID NO: 389699 - RNA, 22 nt, Human
agcuuuauagaaaggaucagug

SEQ ID NO: 389700 - RNA, 22 nt, Human
cagggccacccucugcugggug

SEQ ID NO: 389701 - RNA, 22 nt, Human
acacaagauuguguauugaauu

SEQ ID NO: 389702 - RNA, 22 nt, Human
gagcagugaagacagaaguaca

SEQ ID NO: 389703 - RNA, 22 nt, Human
gaaagaggaaggagauguauua

SEQ ID NO: 389704 - RNA, 22 nt, Human
cauuuacauuuaagguuaauau

SEQ ID NO: 389705 - RNA, 20 nt, Human
cugcccagccacugagggau

SEQ ID NO: 389706 - RNA, 22 nt, Human
uaucaacauuaauauuuucugg

SEQ ID NO: 389707 - RNA, 22 nt, Human
augaggcacaucacagccaaug

SEQ ID NO: 389708 - RNA, 22 nt, Human
ucagcuggauguggaagugcua

SEQ ID NO: 389709 - RNA, 22 nt, Human
aucuauacuacaaauggcuggu

SEQ ID NO: 389710 - RNA, 22 nt, Human
aaggacagggaugguugauugu

SEQ ID NO: 389711 - RNA, 22 nt, Human
guuggccugaauggucaagagg

SEQ ID NO: 389712 - RNA, 22 nt, Human
uguccuuauaagaaaaggaaau

SEQ ID NO: 389713 - RNA, 22 nt, Human
caguguguggauccucccagga

SEQ ID NO: 389714 - RNA, 22 nt, Human
ugccuggcaaugccagaagcca

SEQ ID NO: 389715 - RNA, 23 nt, Human
gccuggagaaaagcugcaguuca

SEQ ID NO: 389716 - RNA, 19 nt, Human
uugaggggccaggggagau

SEQ ID NO: 389717 - RNA, 22 nt, Human
cuucugcaauaaguuuuggucc

SEQ ID NO: 389718 - RNA, 22 nt, Human
ucagcugaguucuagagcacuc

SEQ ID NO: 389719 - RNA, 22 nt, Human
augacacaauuuuagagcugaa

SEQ ID NO: 389720 - RNA, 22 nt, Human
gccugccacgcaugcagaguca

SEQ ID NO: 389721 - RNA, 22 nt, Human
gccagagcagaauagaguggcc

SEQ ID NO: 389722 - RNA, 22 nt, Human
gggccaggucggugaaugguca

SEQ ID NO: 389723 - RNA, 22 nt, Human
agcagcaucucuuauugcagug

SEQ ID NO: 389724 - RNA, 22 nt, Human
ccuucauugcaucuuuaagaga

SEQ ID NO: 389725 - RNA, 22 nt, Human
uuuguaaaaggaggaagcaugg

SEQ ID NO: 389726 - RNA, 19 nt, Human
cuguccuuggcugcacugu

SEQ ID NO: 389727 - RNA, 22 nt, Human
gaauuuuucuggaagcaauuau

SEQ ID NO: 389728 - RNA, 22 nt, Human
uuucauguuuucuuaaauggca

SEQ ID NO: 389729 - RNA, 22 nt, Human
ggcuagaacuuuacacuuugca

SEQ ID NO: 389730 - RNA, 21 nt, Human
ggugucaguuuuggucauuag

SEQ ID NO: 389731 - RNA, 22 nt, Human
ccacugaggcaggcaguaucua

SEQ ID NO: 389732 - RNA, 20 nt, Human
ugccaggcugcacgccugcc

SEQ ID NO: 389733 - RNA, 22 nt, Human
uccuccagugucuggggccuug

SEQ ID NO: 389734 - RNA, 22 nt, Human
ucccagagcucuggagguugga

SEQ ID NO: 389735 - RNA, 21 nt, Human
gagugcaggucugaugccauc

SEQ ID NO: 389736 - RNA, 22 nt, Human
gcuuuaaugcaauuucaccuca

SEQ ID NO: 389737 - RNA, 22 nt, Human
ucauaacagcuaagucccuuuc

SEQ ID NO: 389738 - RNA, 22 nt, Human
cagagagaggccacugcuauua

SEQ ID NO: 389739 - RNA, 23 nt, Human
uugcauagacauccucauagauu

SEQ ID NO: 389740 - RNA, 22 nt, Human
uagaauaugugguaggaucugg

SEQ ID NO: 389741 - RNA, 22 nt, Human
aucacgucaugguuugaucugg

SEQ ID NO: 389742 - RNA, 22 nt, Human
agggacccauagagagaccagu

SEQ ID NO: 389743 - RNA, 22 nt, Human
cgcugggggaacagcgagggug

SEQ ID NO: 389744 - RNA, 22 nt, Human
uuugaagaccuuaucucuaaau

SEQ ID NO: 389745 - RNA, 22 nt, Human
guggcagcaaaugccuggacua

SEQ ID NO: 389746 - RNA, 23 nt, Human
uggcucuguggaucccucaggag

SEQ ID NO: 389747 - RNA, 22 nt, Human
ugcuagugcaggguuuucaguu

SEQ ID NO: 389748 - RNA, 22 nt, Human
uggagaggagcaccauggccau

SEQ ID NO: 389749 - RNA, 22 nt, Human
augaguucaauuguuucaguca

SEQ ID NO: 389750 - RNA, 22 nt, Human
auuucaaggcuauuaauauaaa

SEQ ID NO: 389751 - RNA, 22 nt, Human
cucucugguuucagcgaagggg

SEQ ID NO: 389752 - RNA, 22 nt, Human
uccugcaggccagaggggugag

SEQ ID NO: 389753 - RNA, 22 nt, Human
uacuauaccauguaagauauga

SEQ ID NO: 389754 - RNA, 22 nt, Human
caaaagauacuugcaucuaacu

SEQ ID NO: 389755 - RNA, 22 nt, Human
acagccagaggugguccugggu

SEQ ID NO: 389756 - RNA, 22 nt, Human
ucucucagaggccaggguccug

SEQ ID NO: 389757 - RNA, 23 nt, Human
ccaaagucgaagucuaguccaga

SEQ ID NO: 389758 - RNA, 22 nt, Human
ugcccaggcuggaaugcagugg

SEQ ID NO: 389759 - RNA, 22 nt, Human
cagagagagucaaaucuuugcu

SEQ ID NO: 389760 - RNA, 23 nt, Human
acagccaguucaccucuccuugg

SEQ ID NO: 389761 - RNA, 22 nt, Human
uugcaaaagccgaggcacucca

SEQ ID NO: 389762 - RNA, 22 nt, Human
ugcuggggauccguaccaaccc

SEQ ID NO: 389763 - RNA, 22 nt, Human
uucuuucucaacaugaauguuu

SEQ ID NO: 389764 - RNA, 22 nt, Human
uaggacaggugaggggcugugg

SEQ ID NO: 389765 - RNA, 22 nt, Human
cucucuggaagggggagcugau

SEQ ID NO: 389766 - RNA, 22 nt, Human
ggagcugcucagagccaguccc

SEQ ID NO: 389767 - RNA, 22 nt, Human
uagcuuuacaaagugcugcacc

SEQ ID NO: 389768 - RNA, 22 nt, Human
agauggggcugaaaguuccaau

SEQ ID NO: 389769 - RNA, 22 nt, Human
cagaauuugaaguaauauucca

SEQ ID NO: 389770 - RNA, 22 nt, Human
guuauguaaucuaacacucagu

SEQ ID NO: 389771 - RNA, 22 nt, Human
ggagcagacauaaccuuacaga

SEQ ID NO: 389772 - RNA, 22 nt, Human
ucugcuguucauucuuuuagcu

SEQ ID NO: 389773 - RNA, 22 nt, Human
ucaccgccuugcccggccgggc

SEQ ID NO: 389774 - RNA, 22 nt, Human
ugaagccacuuuccagaaucac

SEQ ID NO: 389775 - RNA, 22 nt, Human
gucaacuugcaagaugcugggc

SEQ ID NO: 389776 - RNA, 22 nt, Human
uggccuguggcuuaaggucugu

SEQ ID NO: 389777 - RNA, 22 nt, Human
uuaaagauucugaggcugauua

SEQ ID NO: 389778 - RNA, 22 nt, Human
auugacaaggaaacuauaccag

SEQ ID NO: 389779 - RNA, 22 nt, Human
ggccucuggucaagacaagcau

SEQ ID NO: 389780 - RNA, 22 nt, Human
ggcagccaugcacgcugccugg

SEQ ID NO: 389781 - RNA, 22 nt, Human
acacacagguaaaggagccugg

SEQ ID NO: 389782 - RNA, 22 nt, Human
uuacauuuggcuauguccucua

SEQ ID NO: 389783 - RNA, 22 nt, Human
ugccagcacuucuggcugucug

SEQ ID NO: 389784 - RNA, 22 nt, Human
cagggccaggcugauggccugg

SEQ ID NO: 389785 - RNA, 22 nt, Human
ggggcagaaagcccacagagug

SEQ ID NO: 389786 - RNA, 22 nt, Human
aagggcaggcacccacccucac

SEQ ID NO: 389787 - RNA, 22 nt, Human
aaauuucuugaggcucucuagc

SEQ ID NO: 389788 - RNA, 22 nt, Human
uacuuacagagcuuauaaguua

SEQ ID NO: 389789 - RNA, 22 nt, Human
gcucccaccaggcagaccuacc

SEQ ID NO: 389790 - RNA, 22 nt, Human
cagagcagggugcaccuugggc

SEQ ID NO: 389791 - RNA, 22 nt, Human
agcucccagaguccucugccca

SEQ ID NO: 389792 - RNA, 22 nt, Human
aaaggcaggcuuucacaucuca

SEQ ID NO: 389793 - RNA, 17 nt, Human
ugaggccugcaucagug

SEQ ID NO: 389794 - RNA, 19 nt, Human
gagcugccuuuugaagacc

SEQ ID NO: 389795 - RNA, 22 nt, Human
ccugucugagccagggugggca

SEQ ID NO: 389796 - RNA, 22 nt, Human
acaggggaauuuacugucauua

SEQ ID NO: 389797 - RNA, 22 nt, Human
acucugccuuucagcagaugaa

SEQ ID NO: 389798 - RNA, 21 nt, Human
aaagugguaaggauuauuuug

SEQ ID NO: 389799 - RNA, 21 nt, Human
aaagaaucauggguaauuuca

SEQ ID NO: 389800 - RNA, 22 nt, Human
ucagaagaagagacuccacagc

SEQ ID NO: 389801 - RNA, 22 nt, Human
uucauucccuuauauuagcauu

SEQ ID NO: 389802 - RNA, 22 nt, Human
gacucguucauaguuccaauuu

SEQ ID NO: 389803 - RNA, 22 nt, Human
gugugccaggaacuggcugcug

SEQ ID NO: 389804 - RNA, 22 nt, Human
cuggcaggagcauucacagagg

SEQ ID NO: 389805 - RNA, 22 nt, Human
accuuuuuguucuguucucagc

SEQ ID NO: 389806 - RNA, 22 nt, Human
aaauagcagccuuuaguuaaca

SEQ ID NO: 389807 - RNA, 22 nt, Human
cagagccacuuggagaugagaa

SEQ ID NO: 389808 - RNA, 22 nt, Human
gaggcaguuccugagugacaag

SEQ ID NO: 389809 - RNA, 22 nt, Human
ggugggcaggucacucugccuc

SEQ ID NO: 389810 - RNA, 22 nt, Human
uuugacaucaauacccuagaau

SEQ ID NO: 389811 - RNA, 22 nt, Human
ucugggcacugcugagccugua

SEQ ID NO: 389812 - RNA, 22 nt, Human
cugucccagauguucucagcac

SEQ ID NO: 389813 - RNA, 22 nt, Human
agggcagcuggaagguggcuuc

SEQ ID NO: 389814 - RNA, 22 nt, Human
agcugggccugagcuggaagcu

SEQ ID NO: 389815 - RNA, 22 nt, Human
aggcuccuuguucaucauccau

SEQ ID NO: 389816 - RNA, 22 nt, Human
ucaaaguccuugcuuuuucugu

SEQ ID NO: 389817 - RNA, 22 nt, Human
agcaggagagcagugcgugguc

SEQ ID NO: 389818 - RNA, 22 nt, Human
gggcugagcacauacugacagc

SEQ ID NO: 389819 - RNA, 22 nt, Human
guggcugcagagccagcaagcu

SEQ ID NO: 389820 - RNA, 22 nt, Human
auaucuuuguaugguucagcag

SEQ ID NO: 389821 - RNA, 22 nt, Human
cuggcugggagcgagcugcuca

SEQ ID NO: 389822 - RNA, 22 nt, Human
agagcugcaccuaugcagaccu

SEQ ID NO: 389823 - RNA, 22 nt, Human
aagaugcagcuuuacaauaagg

SEQ ID NO: 389824 - RNA, 22 nt, Human
guggcagcggcccaggccgucu

SEQ ID NO: 389825 - RNA, 22 nt, Human
ucagcuuggacagcuugguuga

SEQ ID NO: 389826 - RNA, 22 nt, Human
aagagaggacauggugaaccug

SEQ ID NO: 389827 - RNA, 22 nt, Human
caggggcucugagauugucuaa

SEQ ID NO: 389828 - RNA, 22 nt, Human
uggcucagagagggagugugga

SEQ ID NO: 389829 - RNA, 22 nt, Human
agaauguagucuuggagauuua

SEQ ID NO: 389830 - RNA, 22 nt, Human
cuggggcccaucgagggcugag

SEQ ID NO: 389831 - RNA, 20 nt, Human
agagccuugaggaagaugau

SEQ ID NO: 389832 - RNA, 22 nt, Human
gagagcugggggacuguggaug

SEQ ID NO: 389833 - RNA, 22 nt, Human
aaugggaaagagacuagaugcu

SEQ ID NO: 389834 - RNA, 22 nt, Human
cuugaaagaagggucuuuuaau

SEQ ID NO: 389835 - RNA, 22 nt, Human
auuaauuuuucugacagccaca

SEQ ID NO: 389836 - RNA, 22 nt, Human
uggccgggccgggcgccuccac

SEQ ID NO: 389837 - RNA, 22 nt, Human
ggaugcaggacggcauggaugu

SEQ ID NO: 389838 - RNA, 22 nt, Human
ggaagagccuggggugucaggc

SEQ ID NO: 389839 - RNA, 22 nt, Human
cauugcccaguaggaucaccag

SEQ ID NO: 389840 - RNA, 22 nt, Human
uccucaggaugugggguagaau

SEQ ID NO: 389841 - RNA, 22 nt, Human
ucaguucaguauacacuauucu

SEQ ID NO: 389842 - RNA, 22 nt, Human
acugguuuuccagguuacuucu

SEQ ID NO: 389843 - RNA, 22 nt, Human
gcucccugaaaagaacaaaguc

SEQ ID NO: 389844 - RNA, 18 nt, Human
caugggugacagguggau

SEQ ID NO: 389845 - RNA, 22 nt, Human
cugcagaggccucgccuccucu

SEQ ID NO: 389846 - RNA, 22 nt, Human
ccauggcaauggucagucuauu

SEQ ID NO: 389847 - RNA, 22 nt, Human
acaguguucacuuaacaaugga

SEQ ID NO: 389848 - RNA, 22 nt, Human
ucuggcucagggcucugaggga

SEQ ID NO: 389849 - RNA, 22 nt, Human
aucauucuauuguugagcugcc

SEQ ID NO: 389850 - RNA, 22 nt, Human
aucuuucagagcuccaucaggg

SEQ ID NO: 389851 - RNA, 22 nt, Human
caggaugggauguagugggccc

SEQ ID NO: 389852 - RNA, 22 nt, Human
ugcagcugcuugauucaucuug

SEQ ID NO: 389853 - RNA, 22 nt, Human
agugaaaugacugaaucagaua

SEQ ID NO: 389854 - RNA, 22 nt, Human
agggcagcccuucugggagggc

SEQ ID NO: 389855 - RNA, 22 nt, Human
agggcuccuaugccccauggac

SEQ ID NO: 389856 - RNA, 23 nt, Human
ccagcccuccaccagcucuaggc

SEQ ID NO: 389857 - RNA, 22 nt, Human
aagcaauaagccagauuuggau

SEQ ID NO: 389858 - RNA, 22 nt, Human
cugccuggucucaggcaugggg

SEQ ID NO: 389859 - RNA, 22 nt, Human
ggcuccacugcugaccacucca

SEQ ID NO: 389860 - RNA, 22 nt, Human
cugugacuagaccugcaggaga

SEQ ID NO: 389861 - RNA, 22 nt, Human
acuuuugguucuguaacuguga

SEQ ID NO: 389862 - RNA, 22 nt, Human
gcugaguguaaugauggcagag

SEQ ID NO: 389863 - RNA, 22 nt, Human
ugcuauugugaacagugccaca

SEQ ID NO: 389864 - RNA, 22 nt, Human
uuccauaauaggcuuaagugaa

SEQ ID NO: 389865 - RNA, 22 nt, Human
acauguuagaaaugcagaaucu

SEQ ID NO: 389866 - RNA, 22 nt, Human
aaagcagagcagggcacuuaug

SEQ ID NO: 389867 - RNA, 22 nt, Human
cauuucuguacauguuuuggug

SEQ ID NO: 389868 - RNA, 22 nt, Human
gaaagguugggugaauggugga

SEQ ID NO: 389869 - RNA, 22 nt, Human
gcuguccagagcaugggagcaa

SEQ ID NO: 389870 - RNA, 19 nt, Human
uuugaauccagcugguaac

SEQ ID NO: 389871 - RNA, 22 nt, Human
agucaccagguuuuagagaccu

SEQ ID NO: 389872 - RNA, 22 nt, Human
acagcagcuaaaggugucuccu

SEQ ID NO: 389873 - RNA, 22 nt, Human
cucugguucagggcucccuggc

SEQ ID NO: 389874 - RNA, 22 nt, Human
auacaaguugugauaauguaaa

SEQ ID NO: 389875 - RNA, 22 nt, Human
auguccagaguguccuggaaag

SEQ ID NO: 389876 - RNA, 22 nt, Human
uguguugugacauucuuggaug

SEQ ID NO: 389877 - RNA, 22 nt, Human
aggauuuacaaugauucuaggu

SEQ ID NO: 389878 - RNA, 22 nt, Human
uauguaaaguagauggcaggua

SEQ ID NO: 389879 - RNA, 22 nt, Human
ggcaugggagugagcaaccuua

SEQ ID NO: 389880 - RNA, 22 nt, Human
cagauacuguaaaauuucagua

SEQ ID NO: 389881 - RNA, 22 nt, Human
gagggcuccucacauucucuau

SEQ ID NO: 389882 - RNA, 18 nt, Human
gugcugugggcaguggcc

SEQ ID NO: 389883 - RNA, 22 nt, Human
cauagaaaagaguagguaaugu

SEQ ID NO: 389884 - RNA, 22 nt, Human
aagccagguguugugguaagag

SEQ ID NO: 389885 - RNA, 22 nt, Human
cugugcuucgcaacuccaaggu

SEQ ID NO: 389886 - RNA, 22 nt, Human
cagagccugcucacgucucugu

SEQ ID NO: 389887 - RNA, 22 nt, Human
ugcagggcacacgcacgggugu

SEQ ID NO: 389888 - RNA, 22 nt, Human
cagcaggacguccaagugcuau

SEQ ID NO: 389889 - RNA, 22 nt, Human
uucaggaucauuuguuuuaucu

SEQ ID NO: 389890 - RNA, 22 nt, Human
cuggccucaccucagacuuacu

SEQ ID NO: 389891 - RNA, 22 nt, Human
acauuucuuccacaugcugcug

SEQ ID NO: 389892 - RNA, 22 nt, Human
ggcugcagguugguuggcagcu

SEQ ID NO: 389893 - RNA, 22 nt, Human
acagaggccgccucucucacgg

SEQ ID NO: 389894 - RNA, 22 nt, Human
ugagccagaggaggcugugugg

SEQ ID NO: 389895 - RNA, 16 nt, Human
gcaggcagaucacaug

SEQ ID NO: 389896 - RNA, 22 nt, Human
uuuaagacuuagauuuauuggg

SEQ ID NO: 389897 - RNA, 22 nt, Human
uaagagaauguuguggcuaggu

SEQ ID NO: 389898 - RNA, 22 nt, Human
aagagaaggauucugagccugg

SEQ ID NO: 389899 - RNA, 22 nt, Human
cggagaggugggggcagcaucu

SEQ ID NO: 389900 - RNA, 22 nt, Human
gggcugagagugacuguucugu

SEQ ID NO: 389901 - RNA, 22 nt, Human
caggcagggagcuggaaaggau

SEQ ID NO: 389902 - RNA, 22 nt, Human
cacagcuggggaagcugaggcc

SEQ ID NO: 389903 - RNA, 22 nt, Human
gauuucaauccagcuuucuucu

SEQ ID NO: 389904 - RNA, 22 nt, Human
gagggucccgagcccugucaga

SEQ ID NO: 389905 - RNA, 22 nt, Human
ucugagaguacgggcugcgcgc

SEQ ID NO: 389906 - RNA, 22 nt, Human
augggcaguguauuggaaggaa

SEQ ID NO: 389907 - RNA, 22 nt, Human
cuccucccugcgauugcucugc

SEQ ID NO: 389908 - RNA, 22 nt, Human
gaaggcugcugggaaguguggu

SEQ ID NO: 389909 - RNA, 22 nt, Human
agcaccugccugcauuggcuau

SEQ ID NO: 389910 - RNA, 22 nt, Human
cauuuugugcuagacacuaugg

SEQ ID NO: 389911 - RNA, 22 nt, Human
uagaaaugaauguuuaaaaguc

SEQ ID NO: 389912 - RNA, 22 nt, Human
uccuugaauugugccacuuacc

SEQ ID NO: 389913 - RNA, 21 nt, Human
cuacuuaaguaggggauuagg

SEQ ID NO: 389914 - RNA, 22 nt, Human
cauuucaaacaguuacagcugc

SEQ ID NO: 389915 - RNA, 22 nt, Human
gauuucaaccuaacaguaugac

SEQ ID NO: 389916 - RNA, 22 nt, Human
ucacaggcuccagggccuggau

SEQ ID NO: 389917 - RNA, 22 nt, Human
gcugcucuuuucagagaugaga

SEQ ID NO: 389918 - RNA, 22 nt, Human
cauuuguuaauuacuauuaucu

SEQ ID NO: 389919 - RNA, 22 nt, Human
ucuaaagaagaggguucugcgg

SEQ ID NO: 389920 - RNA, 22 nt, Human
uauuuuaaagugaagggucuug

SEQ ID NO: 389921 - RNA, 22 nt, Human
ggccucucucccuggcuugcag

SEQ ID NO: 389922 - RNA, 22 nt, Human
gcuccucuauuccccacauuuu

SEQ ID NO: 389923 - RNA, 22 nt, Human
cuguggaguggggaguacuggu

SEQ ID NO: 389924 - RNA, 22 nt, Human
ucaaaguagggguaagccaggc

SEQ ID NO: 389925 - RNA, 22 nt, Human
cauacuuugggauaagagugga

SEQ ID NO: 389926 - RNA, 22 nt, Human
cuucaagagaaugcagggaugu

SEQ ID NO: 389927 - RNA, 22 nt, Human
uccaggagcauccaggugaagc

SEQ ID NO: 389928 - RNA, 22 nt, Human
ccuucucuacuccugaugcaug

SEQ ID NO: 389929 - RNA, 22 nt, Human
aagaacagauucagccugaacu

SEQ ID NO: 389930 - RNA, 22 nt, Human
uccagucaucucccuucacauu

SEQ ID NO: 389931 - RNA, 22 nt, Human
uaaguuuucuggaauaacuugg

SEQ ID NO: 389932 - RNA, 22 nt, Human
uuucuuuguuguuaucacauca

SEQ ID NO: 389933 - RNA, 22 nt, Human
cuucucagcaugguuacuguga

SEQ ID NO: 389934 - RNA, 22 nt, Human
cauaucauaggucuuggauaau

SEQ ID NO: 389935 - RNA, 22 nt, Human
gccugugacucgucuugggcca

SEQ ID NO: 389936 - RNA, 22 nt, Human
cagugaggcucugcugagcggu

SEQ ID NO: 389937 - RNA, 22 nt, Human
uugauacagcagccugugaucc

SEQ ID NO: 389938 - RNA, 22 nt, Human
cagcuugcaguacuuguuuuug

SEQ ID NO: 389939 - RNA, 22 nt, Human
agaaaugcauuagcacauauag

SEQ ID NO: 389940 - RNA, 22 nt, Human
ccagcagcucccucaggguccg

SEQ ID NO: 389941 - RNA, 22 nt, Human
ugcaggccucacaccuggcacc

SEQ ID NO: 389942 - RNA, 22 nt, Human
uucucuucaucucaguaaaugu

SEQ ID NO: 389943 - RNA, 22 nt, Human
uggcugagcucccuguguguug

SEQ ID NO: 389944 - RNA, 22 nt, Human
ggagaggcgaugagucacagcc

SEQ ID NO: 389945 - RNA, 22 nt, Human
ugaguaauaaacugucuugcuc

SEQ ID NO: 389946 - RNA, 22 nt, Human
ugaagaugucagcagggguggu

SEQ ID NO: 389947 - RNA, 22 nt, Human
cuuggcagauccaaaaaugaca

SEQ ID NO: 389948 - RNA, 22 nt, Human
gagggcucugaaaggaggucac

SEQ ID NO: 389949 - RNA, 16 nt, Human
ccuuucucugccuucc

SEQ ID NO: 389950 - RNA, 17 nt, Human
aggagucucagaugagc

SEQ ID NO: 389951 - RNA, 22 nt, Human
gcccaggauucuuucuuccuua

SEQ ID NO: 389952 - RNA, 22 nt, Human
uggaugcuguaggacacgcucu

SEQ ID NO: 389953 - RNA, 22 nt, Human
cagcaaucgggugauaugcaau

SEQ ID NO: 389954 - RNA, 22 nt, Human
uagcagggccaggcugggaacc

SEQ ID NO: 389955 - RNA, 22 nt, Human
aauuagggagccaucauaaggu

SEQ ID NO: 389956 - RNA, 22 nt, Human
aggagucagauaugggaaaguu

SEQ ID NO: 389957 - RNA, 22 nt, Human
uggagcugagaaguggagcucu

SEQ ID NO: 389958 - RNA, 21 nt, Human
aucacauuggcuguuauuauu

SEQ ID NO: 389959 - RNA, 22 nt, Human
aaaauaucagcaaagggugaca

SEQ ID NO: 389960 - RNA, 22 nt, Human
gggcuggcucccagguguugaa

SEQ ID NO: 389961 - RNA, 22 nt, Human
acagagcaugcucaguguguga

SEQ ID NO: 389962 - RNA, 22 nt, Human
cagcaggcagccauuucacugu

SEQ ID NO: 389963 - RNA, 22 nt, Human
uugcaccauuucacuuccauua

SEQ ID NO: 389964 - RNA, 22 nt, Human
uggggcagcagaccuuucuugg

SEQ ID NO: 389965 - RNA, 22 nt, Human
gugccugcugcagagucgcugu

SEQ ID NO: 389966 - RNA, 22 nt, Human
gggcuacauugugagagaaguu

SEQ ID NO: 389967 - RNA, 22 nt, Human
ugaaaugagagcacagaauaaa

SEQ ID NO: 389968 - RNA, 21 nt, Human
caggaaaagcggaagucuagc

SEQ ID NO: 389969 - RNA, 17 nt, Human
guuugcaugguguuaac

SEQ ID NO: 389970 - RNA, 22 nt, Human
caggcagcauuuacucugauga

SEQ ID NO: 389971 - RNA, 19 nt, Human
gcugcuggcucuggcugga

SEQ ID NO: 389972 - RNA, 22 nt, Human
agaagccaauccuugucucucu

SEQ ID NO: 389973 - RNA, 22 nt, Human
cagcugugcuagaagccacgaa

SEQ ID NO: 389974 - RNA, 22 nt, Human
gggcugacaguuuccccugaaa

SEQ ID NO: 389975 - RNA, 22 nt, Human
uguauuuugugaggaucacucu

SEQ ID NO: 389976 - RNA, 22 nt, Human
caaagggcucuagacucagcag

SEQ ID NO: 389977 - RNA, 22 nt, Human
uuugcauuacuugacuuuaguu

SEQ ID NO: 389978 - RNA, 22 nt, Human
gcacagccacugagugagaacc

SEQ ID NO: 389979 - RNA, 22 nt, Human
ccugaggcccuggcugugcuga

SEQ ID NO: 389980 - RNA, 22 nt, Human
aucuccaggcauuucaagagac

SEQ ID NO: 389981 - RNA, 22 nt, Human
gccuggugaaaggcagagagcg

SEQ ID NO: 389982 - RNA, 22 nt, Human
ggccucucuccagucagugcag

SEQ ID NO: 389983 - RNA, 22 nt, Human
aucaagaacuuauuuuggaaau

SEQ ID NO: 389984 - RNA, 22 nt, Human
uuucaguuacugcuauaucauu

SEQ ID NO: 389985 - RNA, 22 nt, Human
uguccucuuccagugcuccuuc

SEQ ID NO: 389986 - RNA, 22 nt, Human
cagcagugucuccagcaucaca

SEQ ID NO: 389987 - RNA, 22 nt, Human
gcugaggccucagaaggcugag

SEQ ID NO: 389988 - RNA, 22 nt, Human
aggcugagugcuccccuagaug

SEQ ID NO: 389989 - RNA, 22 nt, Human
aagcagcuuuugaagagugagg

SEQ ID NO: 389990 - RNA, 22 nt, Human
aagaaugauuacaaagcaacga

SEQ ID NO: 389991 - RNA, 22 nt, Human
ccaucuccacugucccugucaa

SEQ ID NO: 389992 - RNA, 22 nt, Human
accucuggccuucaggcaucau

SEQ ID NO: 389993 - RNA, 22 nt, Human
aggaaacuccccuacaucucaa

SEQ ID NO: 389994 - RNA, 21 nt, Human
cagaggggcuagccuggcugc

SEQ ID NO: 389995 - RNA, 22 nt, Human
gagguagccacagauagagacu

SEQ ID NO: 389996 - RNA, 22 nt, Human
uuggaggcaaugggaaggaggc

SEQ ID NO: 389997 - RNA, 22 nt, Human
aaagcaaugcuuguggaaugua

SEQ ID NO: 389998 - RNA, 22 nt, Human
gaugugagugguagcugggauu

SEQ ID NO: 389999 - RNA, 22 nt, Human
cuaaaauuaccuaccaguuuag

SEQ ID NO: 390000 - RNA, 22 nt, Human
aaggccuggauuuagguuguga

SEQ ID NO: 390001 - RNA, 22 nt, Human
ggcaaggccuugcccagcauuc

SEQ ID NO: 390002 - RNA, 20 nt, Human
gggcagccucgggagugggu

SEQ ID NO: 390003 - RNA, 22 nt, Human
uggccagguugggcuuugcagc

SEQ ID NO: 390004 - RNA, 22 nt, Human
uagcagagaggggacaguggca

SEQ ID NO: 390005 - RNA, 22 nt, Human
augagcugggccauccagugau

SEQ ID NO: 390006 - RNA, 22 nt, Human
cuggcagcgcagcaugaagucg

SEQ ID NO: 390007 - RNA, 18 nt, Human
gagcagaggcucaacugg

SEQ ID NO: 390008 - RNA, 22 nt, Human
ggcucugcugguaagaugccuc

SEQ ID NO: 390009 - RNA, 22 nt, Human
uuuucacacaaggugauaaguu

SEQ ID NO: 390010 - RNA, 22 nt, Human
uccucacagucaacacuuugag

SEQ ID NO: 390011 - RNA, 22 nt, Human
uucaagacugcgacuaaugccc

SEQ ID NO: 390012 - RNA, 22 nt, Human
uaugcuguggaaaauacaaaga

SEQ ID NO: 390013 - RNA, 22 nt, Human
uguauguguauguacauaugca

SEQ ID NO: 390014 - RNA, 22 nt, Human
ucaggcugagaaaaucuggacc

SEQ ID NO: 390015 - RNA, 22 nt, Human
cuagggacagaaagaggguaga

SEQ ID NO: 390016 - RNA, 22 nt, Human
ggcagggcagcgcugauuaggg

SEQ ID NO: 390017 - RNA, 22 nt, Human
ccugccugcaaaaugggacaag

SEQ ID NO: 390018 - RNA, 22 nt, Human
uauugaaauucuucauguccuc

SEQ ID NO: 390019 - RNA, 22 nt, Human
uuuuagaaauacugauuuagug

SEQ ID NO: 390020 - RNA, 17 nt, Human
aucuggcugcuucuaga

SEQ ID NO: 390021 - RNA, 22 nt, Human
auuuagaaguuggagggcaaga

SEQ ID NO: 390022 - RNA, 22 nt, Human
ugcuuuauuuauaaaauagcaa

SEQ ID NO: 390023 - RNA, 22 nt, Human
gaggcucagagggagcaugguc

SEQ ID NO: 390024 - RNA, 22 nt, Human
aucuucucaagcagcauccugu

SEQ ID NO: 390025 - RNA, 18 nt, Human
cccagcccaccauuucuc

SEQ ID NO: 390026 - RNA, 22 nt, Human
ggcuucccaaggagccaggaug

SEQ ID NO: 390027 - RNA, 20 nt, Human
uuucuguaaggcauuaaucu

SEQ ID NO: 390028 - RNA, 22 nt, Human
uuccaggaagauucaacaaaag

SEQ ID NO: 390029 - RNA, 22 nt, Human
ugccuggaugugcuggccucac

SEQ ID NO: 390030 - RNA, 22 nt, Human
gccuuugcaccaucagugcaau

SEQ ID NO: 390031 - RNA, 22 nt, Human
gugucauguagaaauugaugaa

SEQ ID NO: 390032 - RNA, 22 nt, Human
cauuucaagcauugacuucuau

SEQ ID NO: 390033 - RNA, 22 nt, Human
aaguccuuuauccuaaaagguc

SEQ ID NO: 390034 - RNA, 22 nt, Human
gggccagguggaccccagccuc

SEQ ID NO: 390035 - RNA, 22 nt, Human
gcuuccugauauucauacuguu

SEQ ID NO: 390036 - RNA, 22 nt, Human
auucaaguccagcuucucuaca

SEQ ID NO: 390037 - RNA, 22 nt, Human
uuuauguaaguggaaugaugcc

SEQ ID NO: 390038 - RNA, 22 nt, Human
gcuggcagaagagcugguucaa

SEQ ID NO: 390039 - RNA, 22 nt, Human
ucacauaaauuauacaauuuca

SEQ ID NO: 390040 - RNA, 22 nt, Human
ugaaaguuacaggaaaacagau

SEQ ID NO: 390041 - RNA, 22 nt, Human
uuaauuuuuauguauagugugu

SEQ ID NO: 390042 - RNA, 22 nt, Human
gcucugcucuugacuuaccagg

SEQ ID NO: 390043 - RNA, 22 nt, Human
gcugggagccguaccugucacg

SEQ ID NO: 390044 - RNA, 22 nt, Human
uggccuggugcucaggcaguag

SEQ ID NO: 390045 - RNA, 22 nt, Human
gcagccacagaggagggaugca

SEQ ID NO: 390046 - RNA, 22 nt, Human
gggggcuguccugugcauugua

SEQ ID NO: 390047 - RNA, 22 nt, Human
gaaccaaguaggauacaaggag

SEQ ID NO: 390048 - RNA, 22 nt, Human
gcuguggaaaugccuaacauga

SEQ ID NO: 390049 - RNA, 22 nt, Human
ugcagaggaccauuguccugga

SEQ ID NO: 390050 - RNA, 22 nt, Human
caaaugcagucccuuuguugcu

SEQ ID NO: 390051 - RNA, 22 nt, Human
ugggccuggguuccuccugggc

SEQ ID NO: 390052 - RNA, 21 nt, Human
ucagcagcuuuugcagucccu

SEQ ID NO: 390053 - RNA, 19 nt, Human
ugcagccacgugagagacu

SEQ ID NO: 390054 - RNA, 22 nt, Human
uuuccaaaaguuuguucugugc

SEQ ID NO: 390055 - RNA, 22 nt, Human
uccagggcuuggcugggacggu

SEQ ID NO: 390056 - RNA, 22 nt, Human
cagguggguacaucacagagac

SEQ ID NO: 390057 - RNA, 22 nt, Human
cuucccugauaagagccucaga

SEQ ID NO: 390058 - RNA, 22 nt, Human
guuugcauuucuugaacuauau

SEQ ID NO: 390059 - RNA, 23 nt, Human
cuggcucauccugguugcagugg

SEQ ID NO: 390060 - RNA, 22 nt, Human
gggggaagaaagaacauggcau

SEQ ID NO: 390061 - RNA, 22 nt, Human
augcuguguccuagugaaagaa

SEQ ID NO: 390062 - RNA, 22 nt, Human
cauuucugggagacaugcuaga

SEQ ID NO: 390063 - RNA, 22 nt, Human
gaggaccacagaugagccugca

SEQ ID NO: 390064 - RNA, 22 nt, Human
cacauuucuaggaaauuaaaug

SEQ ID NO: 390065 - RNA, 22 nt, Human
ugaaaugaaugugauucgauag

SEQ ID NO: 390066 - RNA, 22 nt, Human
cuuacauuuaaucaugugucau

SEQ ID NO: 390067 - RNA, 22 nt, Human
agcugcccuuaauaggcauuca

SEQ ID NO: 390068 - RNA, 19 nt, Human
cagaguccuugaccagucc

SEQ ID NO: 390069 - RNA, 22 nt, Human
aggcuccuugcucacaggcuca

SEQ ID NO: 390070 - RNA, 18 nt, Human
cagcagagacauucaaaa

SEQ ID NO: 390071 - RNA, 22 nt, Human
cugagaguguggcuuccaggcc

SEQ ID NO: 390072 - RNA, 22 nt, Human
uccagagggcgauggcuggggg

SEQ ID NO: 390073 - RNA, 22 nt, Human
uggcucagucauggaugaguaa

SEQ ID NO: 390074 - RNA, 22 nt, Human
cgcugccaggucaccaggggua

SEQ ID NO: 390075 - RNA, 22 nt, Human
uggcugaggcacagcugccgcc

SEQ ID NO: 390076 - RNA, 22 nt, Human
gagggaugguaguugacacuga

SEQ ID NO: 390077 - RNA, 22 nt, Human
gcucacagccggcuggcagggg

SEQ ID NO: 390078 - RNA, 22 nt, Human
gcaggcugauagaggauuccau

SEQ ID NO: 390079 - RNA, 22 nt, Human
cacuggcaugugaggcgguggc

SEQ ID NO: 390080 - RNA, 22 nt, Human
agccuggccugggcaggcacau

SEQ ID NO: 390081 - RNA, 22 nt, Human
acaggcugcugggcuccgugcu

SEQ ID NO: 390082 - RNA, 22 nt, Human
uccuggaguugugcagugcaca

SEQ ID NO: 390083 - RNA, 21 nt, Human
ccugcugugaucuuagugagu

SEQ ID NO: 390084 - RNA, 22 nt, Human
ucagcuuucucuucuaucgaua

SEQ ID NO: 390085 - RNA, 22 nt, Human
cuggccaguuguccuggcuugg

SEQ ID NO: 390086 - RNA, 22 nt, Human
ugcaaaauaaugaacgauuuuu

SEQ ID NO: 390087 - RNA, 22 nt, Human
cagaacugggcagggagcagag

SEQ ID NO: 390088 - RNA, 22 nt, Human
uauguacagggauagaacuuga

SEQ ID NO: 390089 - RNA, 22 nt, Human
ucugcucuccauacuuccgcac

SEQ ID NO: 390090 - RNA, 22 nt, Human
cccaaggacacgggcagggaca

SEQ ID NO: 390091 - RNA, 20 nt, Human
auacacauauucuugcaacu

SEQ ID NO: 390092 - RNA, 22 nt, Human
uuugaaugcaggacauacagaa

SEQ ID NO: 390093 - RNA, 22 nt, Human
ugccucugcugcuguggcauca

SEQ ID NO: 390094 - RNA, 22 nt, Human
ugauugaagaggugaggaaguu

SEQ ID NO: 390095 - RNA, 22 nt, Human
cagcagcuucuguugaucagaa

SEQ ID NO: 390096 - RNA, 22 nt, Human
caggaggcccaaagggcgcaga

SEQ ID NO: 390097 - RNA, 18 nt, Human
aagucaccccugcucccu

SEQ ID NO: 390098 - RNA, 22 nt, Human
agaauaaacugcuuuagggcag

SEQ ID NO: 390099 - RNA, 22 nt, Human
ugccuggguguaaagggccaac

SEQ ID NO: 390100 - RNA, 22 nt, Human
gccugagcccaggugugcagag

SEQ ID NO: 390101 - RNA, 22 nt, Human
cucccagagagcaggugggccg

SEQ ID NO: 390102 - RNA, 22 nt, Human
uaggagggcccugaaaauggca

SEQ ID NO: 390103 - RNA, 22 nt, Human
gaucagaaucuucauuuucagu

SEQ ID NO: 390104 - RNA, 21 nt, Human
ugguggagugugcugagcaug

SEQ ID NO: 390105 - RNA, 22 nt, Human
gcauaauauacaugcuugaucc

SEQ ID NO: 390106 - RNA, 22 nt, Human
cauuugcagagggugacacucu

SEQ ID NO: 390107 - RNA, 22 nt, Human
aaacagcuggucucaaauguuc

SEQ ID NO: 390108 - RNA, 17 nt, Human
ccaggugggaggugggg

SEQ ID NO: 390109 - RNA, 22 nt, Human
uccugcaggcuugaguccucag

SEQ ID NO: 390110 - RNA, 22 nt, Human
ugcugcauuuaucuucucaaac

SEQ ID NO: 390111 - RNA, 22 nt, Human
ggaggguuagcaaaggcacaga

SEQ ID NO: 390112 - RNA, 22 nt, Human
uuauuucauugauuucuaagac

SEQ ID NO: 390113 - RNA, 22 nt, Human
uuagccauuuuauacaagugua

SEQ ID NO: 390114 - RNA, 22 nt, Human
agaaaagaggcuuucuaagcau

SEQ ID NO: 390115 - RNA, 22 nt, Human
agagcagugcugaagaguaggg

SEQ ID NO: 390116 - RNA, 22 nt, Human
uuagagaaauucugguaaugua

SEQ ID NO: 390117 - RNA, 22 nt, Human
caggggcaggugugagaucauc

SEQ ID NO: 390118 - RNA, 22 nt, Human
auacagaaguuuuccacuuauu

SEQ ID NO: 390119 - RNA, 22 nt, Human
uagaaauaaaucugcagcuggg

SEQ ID NO: 390120 - RNA, 22 nt, Human
caggcagcugcuggguucagcc

SEQ ID NO: 390121 - RNA, 22 nt, Human
auaugaagaauuccaauuugga

SEQ ID NO: 390122 - RNA, 22 nt, Human
gugucccaauguucaggacggc

SEQ ID NO: 390123 - RNA, 22 nt, Human
cuccagugagugagcaggcgac

SEQ ID NO: 390124 - RNA, 22 nt, Human
auuaguaaaacauuguauaugu

SEQ ID NO: 390125 - RNA, 22 nt, Human
ugagccagucugucugggugaa

SEQ ID NO: 390126 - RNA, 22 nt, Human
agaaaucaauaucuauauguug

SEQ ID NO: 390127 - RNA, 22 nt, Human
gcuguggccaacaaaccacuuu

SEQ ID NO: 390128 - RNA, 22 nt, Human
gcuccucuccucggagucgggg

SEQ ID NO: 390129 - RNA, 22 nt, Human
acugccaggauggcacuagagg

SEQ ID NO: 390130 - RNA, 22 nt, Human
cauggcuucuaagugauaacgu

SEQ ID NO: 390131 - RNA, 22 nt, Human
accaggcaugauguggagcaca

SEQ ID NO: 390132 - RNA, 22 nt, Human
cagcuuuaccaauauuuggaaa

SEQ ID NO: 390133 - RNA, 21 nt, Human
ggcuuuaugcucacccagccu

SEQ ID NO: 390134 - RNA, 22 nt, Human
gccagcagguggagagaucaag

SEQ ID NO: 390135 - RNA, 22 nt, Human
cccuccagcucaaagcaaccgg

SEQ ID NO: 390136 - RNA, 22 nt, Human
gccagagcugagacacgagucc

SEQ ID NO: 390137 - RNA, 22 nt, Human
ucagccaggccaggcauucaca

SEQ ID NO: 390138 - RNA, 22 nt, Human
uggcagcagggccccuggagga

SEQ ID NO: 390139 - RNA, 22 nt, Human
ucugucucaaguucuugcacuc

SEQ ID NO: 390140 - RNA, 22 nt, Human
ucagucucaucaacucuauucc

SEQ ID NO: 390141 - RNA, 20 nt, Human
uccuucaggcagggccuagu

SEQ ID NO: 390142 - RNA, 22 nt, Human
ucucaagcuuguugguauguuu

SEQ ID NO: 390143 - RNA, 22 nt, Human
aggcucagacaggaaaaguaac

SEQ ID NO: 390144 - RNA, 22 nt, Human
caguacuuaacuuauaggagag

SEQ ID NO: 390145 - RNA, 22 nt, Human
cagcaggcccaggugcugguga

SEQ ID NO: 390146 - RNA, 22 nt, Human
guggcugcucgggcuccggccc

SEQ ID NO: 390147 - RNA, 22 nt, Human
uuagccaugcccuagaagagga

SEQ ID NO: 390148 - RNA, 19 nt, Human
cuucuucuuggcagccaag

SEQ ID NO: 390149 - RNA, 22 nt, Human
acauuucuggaguuucucaaca

SEQ ID NO: 390150 - RNA, 22 nt, Human
gccugagccgccugagcggcgg

SEQ ID NO: 390151 - RNA, 22 nt, Human
guguaucaaagcacagacuuca

SEQ ID NO: 390152 - RNA, 22 nt, Human
ugggcagggagcuggaaccaca

SEQ ID NO: 390153 - RNA, 22 nt, Human
cagccugcucucagauguugag

SEQ ID NO: 390154 - RNA, 22 nt, Human
ucaugccacuuacaaaauaaug

SEQ ID NO: 390155 - RNA, 22 nt, Human
uggcugaggcuuuucuuaaaga

SEQ ID NO: 390156 - RNA, 22 nt, Human
uaaaauguguuucuguaugguu

SEQ ID NO: 390157 - RNA, 22 nt, Human
augcuuuacaguuuuccaaaca

SEQ ID NO: 390158 - RNA, 22 nt, Human
acaaauauuuacugaauccacu

SEQ ID NO: 390159 - RNA, 22 nt, Human
ggcugccuacuuucccagaguu

SEQ ID NO: 390160 - RNA, 22 nt, Human
cccagcugcaccucuauggccu

SEQ ID NO: 390161 - RNA, 22 nt, Human
agucccagcccaguccuguaag

SEQ ID NO: 390162 - RNA, 22 nt, Human
agagacuggagaugggcagugu

SEQ ID NO: 390163 - RNA, 22 nt, Human
agagaaggucacuaaggaccca

SEQ ID NO: 390164 - RNA, 22 nt, Human
agaagucaauaguuguuugaug

SEQ ID NO: 390165 - RNA, 22 nt, Human
aauaaaaugaacugguagaguu

SEQ ID NO: 390166 - RNA, 22 nt, Human
gaucugaaucaauagaauaacu

SEQ ID NO: 390167 - RNA, 22 nt, Human
auugucgcuuauuuaggugcuu

SEQ ID NO: 390168 - RNA, 22 nt, Human
gugcauuuggugacucucaccc

SEQ ID NO: 390169 - RNA, 23 nt, Human
caguacuuaguguagcguuaauu

SEQ ID NO: 390170 - RNA, 22 nt, Human
uguauuuaagcuuuaccuaaaa

SEQ ID NO: 390171 - RNA, 22 nt, Human
augcccgauaccuaguuaacuc

SEQ ID NO: 390172 - RNA, 22 nt, Human
ggaggaggggcgcuuugucuau

SEQ ID NO: 390173 - RNA, 22 nt, Human
gcaggaguguauuugcauguaa

SEQ ID NO: 390174 - RNA, 22 nt, Human
caguacuuugaagauauuuuag

SEQ ID NO: 390175 - RNA, 22 nt, Human
uugccucccagcaugggcagcu

SEQ ID NO: 390176 - RNA, 22 nt, Human
aggccagaaauuuggaguaugu

SEQ ID NO: 390177 - RNA, 22 nt, Human
gggccuccggggugagcugugg

SEQ ID NO: 390178 - RNA, 22 nt, Human
acuuggcaaguaucuauaaagu

SEQ ID NO: 390179 - RNA, 22 nt, Human
auuggcaguuagugacgaggcu

SEQ ID NO: 390180 - RNA, 22 nt, Human
acaggagaauuaucuggaacaa

SEQ ID NO: 390181 - RNA, 22 nt, Human
ucaaauguucccuguacuggcc

SEQ ID NO: 390182 - RNA, 22 nt, Human
uuuuuuaguuaggucagaaugu

SEQ ID NO: 390183 - RNA, 22 nt, Human
uuacuuugcuuucucauuacag

SEQ ID NO: 390184 - RNA, 22 nt, Human
uguacaguauauuucaaagcca

SEQ ID NO: 390185 - RNA, 22 nt, Human
auuguaauuuuagagaaagugg

SEQ ID NO: 390186 - RNA, 22 nt, Human
auguuucaucaguaagguuuug

SEQ ID NO: 390187 - RNA, 22 nt, Human
ugcucuggggagcuccucugcg

SEQ ID NO: 390188 - RNA, 22 nt, Human
acaggacauguaccaggugguc

SEQ ID NO: 390189 - RNA, 20 nt, Human
uaucaaucagaaagaagacu

SEQ ID NO: 390190 - RNA, 22 nt, Human
agagccaggaugucuucugggg

SEQ ID NO: 390191 - RNA, 22 nt, Human
gggcaugagaggcaggcaagug

SEQ ID NO: 390192 - RNA, 22 nt, Human
ggcugugaacccuggcagugug

SEQ ID NO: 390193 - RNA, 22 nt, Human
gaaguucaggugggaauugagc

SEQ ID NO: 390194 - RNA, 22 nt, Human
gccuucccacccugcgaggcug

SEQ ID NO: 390195 - RNA, 22 nt, Human
ccaaaguccauaguuuacauaa

SEQ ID NO: 390196 - RNA, 22 nt, Human
ugaaguaacuguccaggaucca

SEQ ID NO: 390197 - RNA, 22 nt, Human
uuuccucuucgauuaaguuugg

SEQ ID NO: 390198 - RNA, 22 nt, Human
ucaaaaguuucacauagagaua

SEQ ID NO: 390199 - RNA, 22 nt, Human
uacugaaaagccacaaggacca

SEQ ID NO: 390200 - RNA, 22 nt, Human
uuuauuuauccuucuggauugc

SEQ ID NO: 390201 - RNA, 22 nt, Human
ccugggaguggcacucacagca

SEQ ID NO: 390202 - RNA, 22 nt, Human
gcagccuguuguaccagccugu

SEQ ID NO: 390203 - RNA, 22 nt, Human
ccauccuaucugaccuacuugu

SEQ ID NO: 390204 - RNA, 22 nt, Human
gucccagggagguucagggcuu

SEQ ID NO: 390205 - RNA, 22 nt, Human
ccagccucacuggcaucaccua

SEQ ID NO: 390206 - RNA, 22 nt, Human
gggcugggauugcuugcuguga

SEQ ID NO: 390207 - RNA, 22 nt, Human
ggcuggcauccagggaaaucca

SEQ ID NO: 390208 - RNA, 22 nt, Human
ccuggaucuuuguuguaaauau

SEQ ID NO: 390209 - RNA, 22 nt, Human
gauuuuauuagcccaaacuuug

SEQ ID NO: 390210 - RNA, 22 nt, Human
aaaguucagauuagacucaaga

SEQ ID NO: 390211 - RNA, 20 nt, Human
uggcccuguuuucuccaggc

SEQ ID NO: 390212 - RNA, 22 nt, Human
ugccagaagauucucuaucaga

SEQ ID NO: 390213 - RNA, 22 nt, Human
uacauaguuccauuuacaggaa

SEQ ID NO: 390214 - RNA, 22 nt, Human
auuucagcccaguaugagcccc

SEQ ID NO: 390215 - RNA, 22 nt, Human
uagcugccauugcuccaggaag

SEQ ID NO: 390216 - RNA, 22 nt, Human
uauuccagguuucuuguuguau

SEQ ID NO: 390217 - RNA, 22 nt, Human
agcaggagcugugggaagaugg

SEQ ID NO: 390218 - RNA, 22 nt, Human
gggcccuggggccugauuugca

SEQ ID NO: 390219 - RNA, 22 nt, Human
gccaggcagcuagcaaccccug

SEQ ID NO: 390220 - RNA, 22 nt, Human
cucugggcaaagaugccucauc

SEQ ID NO: 390221 - RNA, 19 nt, Human
aauacaguguuauagaauu

SEQ ID NO: 390222 - RNA, 22 nt, Human
agaaaguuuugugcuauauaug

SEQ ID NO: 390223 - RNA, 22 nt, Human
gagggcauaguuaaauaggagg

SEQ ID NO: 390224 - RNA, 22 nt, Human
cagaaauguuuauauguggugu

SEQ ID NO: 390225 - RNA, 22 nt, Human
gaaaaugugccuuuggguauug

SEQ ID NO: 390226 - RNA, 22 nt, Human
uaggaggguuagagggaaauau

SEQ ID NO: 390227 - RNA, 22 nt, Human
ucagagcuuuggagaccaggaa

SEQ ID NO: 390228 - RNA, 22 nt, Human
gagccuguguuuccuguagcca

SEQ ID NO: 390229 - RNA, 22 nt, Human
aguccagucucacucuuggcag

SEQ ID NO: 390230 - RNA, 22 nt, Human
uggcuuaagcgcaacucugucu

SEQ ID NO: 390231 - RNA, 22 nt, Human
aggucagcugcugauaggcagc

SEQ ID NO: 390232 - RNA, 22 nt, Human
auccuugagccaaugacugauu

SEQ ID NO: 390233 - RNA, 22 nt, Human
agcauauaaauggacauauuug

SEQ ID NO: 390234 - RNA, 22 nt, Human
gccagguguaguggccacaccu

SEQ ID NO: 390235 - RNA, 22 nt, Human
uguuccaugucuuuguaggacu

SEQ ID NO: 390236 - RNA, 22 nt, Human
uuccuuagccugccuuccaggg

SEQ ID NO: 390237 - RNA, 22 nt, Human
uccuaguucucugccagucgcu

SEQ ID NO: 390238 - RNA, 22 nt, Human
agggaccuugauggguuuggga

SEQ ID NO: 390239 - RNA, 22 nt, Human
gaguguuccagaaacuggcccu

SEQ ID NO: 390240 - RNA, 22 nt, Human
agggauggaagacuugaagacc

SEQ ID NO: 390241 - RNA, 22 nt, Human
aauguguguucggggcccagag

SEQ ID NO: 390242 - RNA, 22 nt, Human
acauuucuccuugcaggaguca

SEQ ID NO: 390243 - RNA, 22 nt, Human
uucuuuccaaccagauauuggu

SEQ ID NO: 390244 - RNA, 22 nt, Human
ccuggcugcuuucacuauggag

SEQ ID NO: 390245 - RNA, 22 nt, Human
ucuaguucuagaucccugagga

SEQ ID NO: 390246 - RNA, 22 nt, Human
agugaaaucagguuuugacugc

SEQ ID NO: 390247 - RNA, 22 nt, Human
ugaagaauguugcagugagcau

SEQ ID NO: 390248 - RNA, 22 nt, Human
cagugguggaaugaggaauugu

SEQ ID NO: 390249 - RNA, 22 nt, Human
uucaccacagucucaucuacgc

SEQ ID NO: 390250 - RNA, 22 nt, Human
gcucuggacuggggccugagaa

SEQ ID NO: 390251 - RNA, 22 nt, Human
accucccagcucugagcuuggg

SEQ ID NO: 390252 - RNA, 22 nt, Human
aaggcagcuucaccacagcauu

SEQ ID NO: 390253 - RNA, 18 nt, Human
ccagcaugccagaggcug

SEQ ID NO: 390254 - RNA, 22 nt, Human
guucuccauucagcuuccugug

SEQ ID NO: 390255 - RNA, 22 nt, Human
cuugcugugugguguucucaga

SEQ ID NO: 390256 - RNA, 22 nt, Human
gggaguguugagcgcccugcca

SEQ ID NO: 390257 - RNA, 22 nt, Human
cugggccucauccucagaguuu

SEQ ID NO: 390258 - RNA, 17 nt, Human
gcaaucucagucuccuu

SEQ ID NO: 390259 - RNA, 22 nt, Human
ucaguaaaugagcaaaaauuuc

SEQ ID NO: 390260 - RNA, 22 nt, Human
agccaggggauucaucagggac

SEQ ID NO: 390261 - RNA, 22 nt, Human
gugcugagcugcagaugcgcuc

SEQ ID NO: 390262 - RNA, 22 nt, Human
gaaggccuagggaugcucugcg

SEQ ID NO: 390263 - RNA, 22 nt, Human
ggcagccagcaaugagaaguuu

SEQ ID NO: 390264 - RNA, 22 nt, Human
gaagagcuaaaggcacaggcuu

SEQ ID NO: 390265 - RNA, 23 nt, Human
aggugccaacugagagcugagag

SEQ ID NO: 390266 - RNA, 22 nt, Human
uugugaaauguuucaaaauagu

SEQ ID NO: 390267 - RNA, 22 nt, Human
agcaccaugaccuugccauuga

SEQ ID NO: 390268 - RNA, 22 nt, Human
cccaagagcuucuaggacgcug

SEQ ID NO: 390269 - RNA, 22 nt, Human
acuugaauuauauuucuagaga

SEQ ID NO: 390270 - RNA, 22 nt, Human
auuuguaauuucuuaucugugu

SEQ ID NO: 390271 - RNA, 22 nt, Human
agcaccuggucuccuggcgcug

SEQ ID NO: 390272 - RNA, 22 nt, Human
ugagagugauugguucgaaugu

SEQ ID NO: 390273 - RNA, 22 nt, Human
agcuguggcagcacuuuggagu

SEQ ID NO: 390274 - RNA, 23 nt, Human
gggugggccaaauuagguagccu

SEQ ID NO: 390275 - RNA, 22 nt, Human
cagcaggagcagucagacuccu

SEQ ID NO: 390276 - RNA, 22 nt, Human
agcagcucuggcacuguagcau

SEQ ID NO: 390277 - RNA, 19 nt, Human
agcuguggggccuagcacc

SEQ ID NO: 390278 - RNA, 22 nt, Human
gccccagcucugccacaacuag

SEQ ID NO: 390279 - RNA, 22 nt, Human
agguaaggcuguaagcuaagcc

SEQ ID NO: 390280 - RNA, 22 nt, Human
aggagucacucagggcuucauc

SEQ ID NO: 390281 - RNA, 22 nt, Human
caguaaagcauguaugucuuca

SEQ ID NO: 390282 - RNA, 22 nt, Human
cucagcagagaccagggaggaa

SEQ ID NO: 390283 - RNA, 23 nt, Human
cagaaauaaacugguuuguagau

SEQ ID NO: 390284 - RNA, 20 nt, Human
acuugcugggcuuuguuacc

SEQ ID NO: 390285 - RNA, 22 nt, Human
uauuuauaaucugccaaagaga

SEQ ID NO: 390286 - RNA, 22 nt, Human
cugagagugcucuuugauguca

SEQ ID NO: 390287 - RNA, 22 nt, Human
aggcccugaagucggccccuca

SEQ ID NO: 390288 - RNA, 22 nt, Human
agccaggcucaaggccugcucc

SEQ ID NO: 390289 - RNA, 19 nt, Human
agaggcugucaccuguagc

SEQ ID NO: 390290 - RNA, 18 nt, Human
uccgaggcaccauaaaaa

SEQ ID NO: 390291 - RNA, 22 nt, Human
ugggacagggaaucugaucccc

SEQ ID NO: 390292 - RNA, 23 nt, Human
cacugcagcguggucuggcagga

SEQ ID NO: 390293 - RNA, 22 nt, Human
uccugccucuugccuucuucac

SEQ ID NO: 390294 - RNA, 22 nt, Human
auguacaaaauguuuugaaaug

SEQ ID NO: 390295 - RNA, 22 nt, Human
ggcuucagugacuggugcccuc

SEQ ID NO: 390296 - RNA, 22 nt, Human
ucuguggccuguguccaagugc

SEQ ID NO: 390297 - RNA, 22 nt, Human
cagggcugguuugucgaagaaa

SEQ ID NO: 390298 - RNA, 22 nt, Human
ccagcccuccuccaucagagga

SEQ ID NO: 390299 - RNA, 22 nt, Human
auuugcagagcucugaauuuug

SEQ ID NO: 390300 - RNA, 22 nt, Human
cccaggagaauauuuuuggguc

SEQ ID NO: 390301 - RNA, 22 nt, Human
agaagcugacagaugcagcagg

SEQ ID NO: 390302 - RNA, 22 nt, Human
guacaugucaaaaaaugcauaa

SEQ ID NO: 390303 - RNA, 22 nt, Human
uuaauuaaauucaugagcauug

SEQ ID NO: 390304 - RNA, 22 nt, Human
gccugaugagcuuccagcugag

SEQ ID NO: 390305 - RNA, 22 nt, Human
aucacauucuuucaaagcaguc

SEQ ID NO: 390306 - RNA, 22 nt, Human
cauuucugcagaauugcucuuc

SEQ ID NO: 390307 - RNA, 22 nt, Human
auacaucaugcuccauauauuu

SEQ ID NO: 390308 - RNA, 22 nt, Human
uaaucuacuguuuauaugaaau

SEQ ID NO: 390309 - RNA, 22 nt, Human
gaaauucugugucccagagugc

SEQ ID NO: 390310 - RNA, 22 nt, Human
aagcagaggaccgacggaggga

SEQ ID NO: 390311 - RNA, 19 nt, Human
caggaaggggcgaaucugg

SEQ ID NO: 390312 - RNA, 22 nt, Human
cacugcuuuuuuggcuauguac

SEQ ID NO: 390313 - RNA, 22 nt, Human
aucagcaaaaaugccuucagaa

SEQ ID NO: 390314 - RNA, 21 nt, Human
agcagccauggaugguaugua

SEQ ID NO: 390315 - RNA, 22 nt, Human
aaaacuaaauacgcuuugccuc

SEQ ID NO: 390316 - RNA, 22 nt, Human
aaaucaguuggaacacaagcag

SEQ ID NO: 390317 - RNA, 22 nt, Human
ucacugcagacaaccucaguca

SEQ ID NO: 390318 - RNA, 22 nt, Human
gagacauggcaaaagcacuggu

SEQ ID NO: 390319 - RNA, 19 nt, Human
gaucagagugucagcuugu

SEQ ID NO: 390320 - RNA, 22 nt, Human
uuucuuguaagauguuuauuaa

SEQ ID NO: 390321 - RNA, 20 nt, Human
uggcagaguugucccaccca

SEQ ID NO: 390322 - RNA, 22 nt, Human
aaaaugcaugagaaugugcucg

SEQ ID NO: 390323 - RNA, 22 nt, Human
agugacugacaccuguaauccc

SEQ ID NO: 390324 - RNA, 22 nt, Human
uuuuuauaugaaggauagugcg

SEQ ID NO: 390325 - RNA, 22 nt, Human
uuuccucuuuguaccuugacua

SEQ ID NO: 390326 - RNA, 22 nt, Human
acaacauucuuaaauacacuga

SEQ ID NO: 390327 - RNA, 22 nt, Human
aggagccaugagugacaucaca

SEQ ID NO: 390328 - RNA, 22 nt, Human
ccaggaggcggaagguacagug

SEQ ID NO: 390329 - RNA, 22 nt, Human
ccugugugcugaugacgacaga

SEQ ID NO: 390330 - RNA, 22 nt, Human
aggaagccuggggcugcccucg

SEQ ID NO: 390331 - RNA, 22 nt, Human
accagguggccccagcgugguu

SEQ ID NO: 390332 - RNA, 21 nt, Human
uccugcagggcagcagagugg

SEQ ID NO: 390333 - RNA, 22 nt, Human
uucucugagauagacuaagugg

SEQ ID NO: 390334 - RNA, 22 nt, Human
acacacacaagcagguugugga

SEQ ID NO: 390335 - RNA, 22 nt, Human
uagaauaugauuaauuuucuua

SEQ ID NO: 390336 - RNA, 22 nt, Human
ucuuacauauagcaugaguaca

SEQ ID NO: 390337 - RNA, 22 nt, Human
gguacaauggaccauaaaagcu

SEQ ID NO: 390338 - RNA, 22 nt, Human
uguaggacauguacuuguaaca

SEQ ID NO: 390339 - RNA, 22 nt, Human
caaaugaagggagcugaagucu

SEQ ID NO: 390340 - RNA, 22 nt, Human
gcccucagaugggaaaggaggg

SEQ ID NO: 390341 - RNA, 22 nt, Human
cccaucacagacacuggguuau

SEQ ID NO: 390342 - RNA, 22 nt, Human
aaggaagacuugagaagguucc

SEQ ID NO: 390343 - RNA, 22 nt, Human
ucccagagugugggcaucaagg

SEQ ID NO: 390344 - RNA, 22 nt, Human
auucucaaaacauaacuucacu

SEQ ID NO: 390345 - RNA, 22 nt, Human
cuggccugagcacagcggcugc

SEQ ID NO: 390346 - RNA, 22 nt, Human
gcuguucagaugcgauucagga

SEQ ID NO: 390347 - RNA, 22 nt, Human
gaggcaggcccugaaugaguca

SEQ ID NO: 390348 - RNA, 22 nt, Human
agcucccaggcagucaugagga

SEQ ID NO: 390349 - RNA, 22 nt, Human
ggggaccuggccacccauccuu

SEQ ID NO: 390350 - RNA, 22 nt, Human
auacagaauacuaauuccugag

SEQ ID NO: 390351 - RNA, 22 nt, Human
caggaaaggugugucaugaugg

SEQ ID NO: 390352 - RNA, 22 nt, Human
uaaagaucuuaggaagauuuuc

SEQ ID NO: 390353 - RNA, 22 nt, Human
gcacagcaauuucuauaagcuc

SEQ ID NO: 390354 - RNA, 22 nt, Human
uggacaggugagugacucaggg

SEQ ID NO: 390355 - RNA, 22 nt, Human
ugguacacauguccaaggucag

SEQ ID NO: 390356 - RNA, 22 nt, Human
gagaagcaaucaguggccaccc

SEQ ID NO: 390357 - RNA, 22 nt, Human
aauuccaaauguuuucaaucca

SEQ ID NO: 390358 - RNA, 22 nt, Human
uggcaauuuuaggugguuuagu

SEQ ID NO: 390359 - RNA, 22 nt, Human
accaggaggaaguguuaaugau

SEQ ID NO: 390360 - RNA, 22 nt, Human
aaauuauaggugccaccuugga

SEQ ID NO: 390361 - RNA, 22 nt, Human
uagggcugcugcagaugacagg

SEQ ID NO: 390362 - RNA, 22 nt, Human
guuuuuccugcugacuuggguc

SEQ ID NO: 390363 - RNA, 22 nt, Human
uaaauguguaaaccuccauuac

SEQ ID NO: 390364 - RNA, 19 nt, Human
gggcucuggccucaguggg

SEQ ID NO: 390365 - RNA, 22 nt, Human
aggacuucuccgauaagucaga

SEQ ID NO: 390366 - RNA, 22 nt, Human
aggaccagccuccaggucucuu

SEQ ID NO: 390367 - RNA, 22 nt, Human
ggaggugggauuaggaccuaaa

SEQ ID NO: 390368 - RNA, 22 nt, Human
ucaugcuuaaaagacacuugag

SEQ ID NO: 390369 - RNA, 22 nt, Human
ucucagggcagcaaggaagcau

SEQ ID NO: 390370 - RNA, 22 nt, Human
uguagcacagagcuuugacacu

SEQ ID NO: 390371 - RNA, 22 nt, Human
gugcagggagcccagaaggucc

SEQ ID NO: 390372 - RNA, 22 nt, Human
uuccauuuauucuuguccagau

SEQ ID NO: 390373 - RNA, 22 nt, Human
uuucauugcagagucugugugc

SEQ ID NO: 390374 - RNA, 22 nt, Human
accuggagucauuugaggagua

SEQ ID NO: 390375 - RNA, 22 nt, Human
aagccacugagauuucacugca

SEQ ID NO: 390376 - RNA, 19 nt, Human
gagaggccugugcuugaag

SEQ ID NO: 390377 - RNA, 22 nt, Human
gcuggugagcaaaggagaagga

SEQ ID NO: 390378 - RNA, 22 nt, Human
cagagcagaaaccugggugauu

SEQ ID NO: 390379 - RNA, 22 nt, Human
gcucuguguccacagcuggaaa

SEQ ID NO: 390380 - RNA, 22 nt, Human
cugcagggaacugaggcccaga

SEQ ID NO: 390381 - RNA, 22 nt, Human
gcagugccuugcuucucugucu

SEQ ID NO: 390382 - RNA, 20 nt, Human
gccugagcuccgccuccugu

SEQ ID NO: 390383 - RNA, 22 nt, Human
uggcugggugcuauccaguacu

SEQ ID NO: 390384 - RNA, 22 nt, Human
aguguggcugcguagggcucuc

SEQ ID NO: 390385 - RNA, 22 nt, Human
acaguggagaagcaaaugcagu

SEQ ID NO: 390386 - RNA, 22 nt, Human
caggaacacaaugagucucaaa

SEQ ID NO: 390387 - RNA, 22 nt, Human
cagagcugucauuugccaguga

SEQ ID NO: 390388 - RNA, 22 nt, Human
aagcccaguuucacacugagac

SEQ ID NO: 390389 - RNA, 22 nt, Human
acauuugaggauguuaagaaug

SEQ ID NO: 390390 - RNA, 22 nt, Human
augccuggacugacaugcacug

SEQ ID NO: 390391 - RNA, 22 nt, Human
agcaggaguuugaugcuuuuau

SEQ ID NO: 390392 - RNA, 22 nt, Human
agacaugucaccaauucuuacu

SEQ ID NO: 390393 - RNA, 22 nt, Human
uaugcauagguaucuauacuca

SEQ ID NO: 390394 - RNA, 22 nt, Human
gcuggccuuugaggaagcugcg

SEQ ID NO: 390395 - RNA, 21 nt, Human
uggagacucugguucuuugug

SEQ ID NO: 390396 - RNA, 22 nt, Human
caaaggcugccacuguggcugu

SEQ ID NO: 390397 - RNA, 16 nt, Human
gaggcuggcagauguc

SEQ ID NO: 390398 - RNA, 22 nt, Human
gccaggcucucagugacugccc

SEQ ID NO: 390399 - RNA, 22 nt, Human
ucccagccuuucuuuucugcug

SEQ ID NO: 390400 - RNA, 22 nt, Human
gcucccugacucaguuccugag

SEQ ID NO: 390401 - RNA, 22 nt, Human
augaacaauaaaauagaucaca

SEQ ID NO: 390402 - RNA, 22 nt, Human
cagaggcugccagccaugugca

SEQ ID NO: 390403 - RNA, 22 nt, Human
aggcuucagguuugcuuugcag

SEQ ID NO: 390404 - RNA, 22 nt, Human
uuugcauuauauuuauagaaga

SEQ ID NO: 390405 - RNA, 19 nt, Human
cucuuaaauugucucuugc

SEQ ID NO: 390406 - RNA, 22 nt, Human
uccuugaagcuuguaucuaaua

SEQ ID NO: 390407 - RNA, 18 nt, Human
cagaagcaggcagugcag

SEQ ID NO: 390408 - RNA, 22 nt, Human
agccaaggcagcuagagcucug

SEQ ID NO: 390409 - RNA, 22 nt, Human
caaaggcaggcccccugugcag

SEQ ID NO: 390410 - RNA, 22 nt, Human
cccaggaggugugcccaacucg

SEQ ID NO: 390411 - RNA, 22 nt, Human
gggucuccauguuaacaucacu

SEQ ID NO: 390412 - RNA, 22 nt, Human
cagucccagaagagccugggag

SEQ ID NO: 390413 - RNA, 22 nt, Human
gagagcaggaggcagcgggacg

SEQ ID NO: 390414 - RNA, 22 nt, Human
uuuauguaauuucauaggugug

SEQ ID NO: 390415 - RNA, 22 nt, Human
gugauuuucuccuccuagaagu

SEQ ID NO: 390416 - RNA, 22 nt, Human
gugaggcagagaugccaaaacu

SEQ ID NO: 390417 - RNA, 22 nt, Human
uccuucagucuucugagccaua

SEQ ID NO: 390418 - RNA, 22 nt, Human
uucacuuauagggauguuauug

SEQ ID NO: 390419 - RNA, 22 nt, Human
uguuucaggaccuaucuuuuag

SEQ ID NO: 390420 - RNA, 22 nt, Human
agaacagcagcacgucaagcug

SEQ ID NO: 390421 - RNA, 22 nt, Human
cccagugccaggcacaggcagc

SEQ ID NO: 390422 - RNA, 22 nt, Human
cucagggacguuagaggacagg

SEQ ID NO: 390423 - RNA, 22 nt, Human
ucucuggagcugcagauccagg

SEQ ID NO: 390424 - RNA, 22 nt, Human
acauugaucagccucccaugca

SEQ ID NO: 390425 - RNA, 22 nt, Human
ggagcugaaggggugggcucag

SEQ ID NO: 390426 - RNA, 22 nt, Human
ugccugucucugacugccauua

SEQ ID NO: 390427 - RNA, 22 nt, Human
agggccaccucucuggguuccc

SEQ ID NO: 390428 - RNA, 22 nt, Human
uuugaacuucuccauucugaug

SEQ ID NO: 390429 - RNA, 22 nt, Human
agggcuccaaggaaguguagcu

SEQ ID NO: 390430 - RNA, 22 nt, Human
aucaggaugacaacugcugggu

SEQ ID NO: 390431 - RNA, 17 nt, Human
uuucaucugggaccacc

SEQ ID NO: 390432 - RNA, 22 nt, Human
aaguggagcuauaggcucagau

SEQ ID NO: 390433 - RNA, 23 nt, Human
accaggagccaagaucucccugg

SEQ ID NO: 390434 - RNA, 22 nt, Human
uucuuuaaaauagugagaaaga

SEQ ID NO: 390435 - RNA, 22 nt, Human
uaaaggcuuuuacaggagugca

SEQ ID NO: 390436 - RNA, 22 nt, Human
gacagggcauggugcagaguuc

SEQ ID NO: 390437 - RNA, 22 nt, Human
auggcuuuguuccaauaaaacu

SEQ ID NO: 390438 - RNA, 22 nt, Human
cagagacaguuucacagggucu

SEQ ID NO: 390439 - RNA, 22 nt, Human
ugcauuaugcuugugcuguaua

SEQ ID NO: 390440 - RNA, 22 nt, Human
acacagggcagagagcuggcuc

SEQ ID NO: 390441 - RNA, 20 nt, Human
caguccacuggaguuccuac

SEQ ID NO: 390442 - RNA, 22 nt, Human
acacagggcugcgccugacccc

SEQ ID NO: 390443 - RNA, 22 nt, Human
aaucagaauuuauugaaucuuu

SEQ ID NO: 390444 - RNA, 22 nt, Human
aggcuagcaaugggagaugagu

SEQ ID NO: 390445 - RNA, 22 nt, Human
auuguauuagcacaauacaauu

SEQ ID NO: 390446 - RNA, 23 nt, Human
aaugauuucaugaugauagcagc

SEQ ID NO: 390447 - RNA, 23 nt, Human
agaggggagcaucugcuggcuga

SEQ ID NO: 390448 - RNA, 22 nt, Human
agaggaggcagcuuaacucagu

SEQ ID NO: 390449 - RNA, 22 nt, Human
gagagaagggggauaugagccu

SEQ ID NO: 390450 - RNA, 22 nt, Human
uaauccacaauagagauuaucu

SEQ ID NO: 390451 - RNA, 22 nt, Human
gggaagggagggaccucagucu

SEQ ID NO: 390452 - RNA, 22 nt, Human
ggcagagcuuguuccuucuguu

SEQ ID NO: 390453 - RNA, 22 nt, Human
aaguccuuguauacagaaucaa

SEQ ID NO: 390454 - RNA, 22 nt, Human
gccuccugagaagccacaggcu

SEQ ID NO: 390455 - RNA, 22 nt, Human
aagcugccuugcugaggagaaa

SEQ ID NO: 390456 - RNA, 22 nt, Human
ugagcagagucgcuccagagug

SEQ ID NO: 390457 - RNA, 22 nt, Human
uggcagcaguggagguagaaag

SEQ ID NO: 390458 - RNA, 18 nt, Human
gcuuuauuucuuggggaa

SEQ ID NO: 390459 - RNA, 22 nt, Human
agggaggaguccucaaagucau

SEQ ID NO: 390460 - RNA, 22 nt, Human
gcagggcaucccugagcgggug

SEQ ID NO: 390461 - RNA, 22 nt, Human
cagggcaguaacgggaacaucu

SEQ ID NO: 390462 - RNA, 22 nt, Human
gcagagacuaguagugcagacu

SEQ ID NO: 390463 - RNA, 22 nt, Human
agaacaucuaaauaucugagac

SEQ ID NO: 390464 - RNA, 23 nt, Human
auuugagaaaguauuuuuaagac

SEQ ID NO: 390465 - RNA, 22 nt, Human
ccaggagaauaauggcagauua

SEQ ID NO: 390466 - RNA, 23 nt, Human
agaugagccaacaccuccaugcc

SEQ ID NO: 390467 - RNA, 22 nt, Human
uuauacuaaaacgcauugaauu

SEQ ID NO: 390468 - RNA, 17 nt, Human
uuuucucucuuggauuc

SEQ ID NO: 390469 - RNA, 22 nt, Human
ugggcagcagcaaagccagacu

SEQ ID NO: 390470 - RNA, 22 nt, Human
aauuaaaugacaggggaagaug

SEQ ID NO: 390471 - RNA, 22 nt, Human
aucagaaaauacccaguguuua

SEQ ID NO: 390472 - RNA, 22 nt, Human
gccuggugcuaugagggccagc

SEQ ID NO: 390473 - RNA, 20 nt, Human
caaugcacacagcugcuucu

SEQ ID NO: 390474 - RNA, 22 nt, Human
ugagcaguaggucugaauagug

SEQ ID NO: 390475 - RNA, 22 nt, Human
aggucacacaacugucagaggc

SEQ ID NO: 390476 - RNA, 22 nt, Human
aaauguguuucuuugugaaugg

SEQ ID NO: 390477 - RNA, 22 nt, Human
auauaacauacauacagaaaag

SEQ ID NO: 390478 - RNA, 22 nt, Human
uccaggagauacacugcaccag

SEQ ID NO: 390479 - RNA, 22 nt, Human
cucuguccuccaccugcuuuca

SEQ ID NO: 390480 - RNA, 22 nt, Human
cagcccuggcuagggcgagggc

SEQ ID NO: 390481 - RNA, 22 nt, Human
gaaggccuaggaaggaagccuu

SEQ ID NO: 390482 - RNA, 22 nt, Human
caugcugugcaucuugaugacc

SEQ ID NO: 390483 - RNA, 22 nt, Human
aacaaauguaaaaugcagaugc

SEQ ID NO: 390484 - RNA, 22 nt, Human
acucucagaggguggcagcaau

SEQ ID NO: 390485 - RNA, 22 nt, Human
gcuggcaggagccuuucccuuu

SEQ ID NO: 390486 - RNA, 22 nt, Human
gccagccugugcuuggccaggc

SEQ ID NO: 390487 - RNA, 22 nt, Human
gcugucagugaggugagacaug

SEQ ID NO: 390488 - RNA, 22 nt, Human
gagcugccaagauuacaaucag

SEQ ID NO: 390489 - RNA, 22 nt, Human
guccucugcccaggucaagguu

SEQ ID NO: 390490 - RNA, 22 nt, Human
cagggcuggguuaaaagcaggg

SEQ ID NO: 390491 - RNA, 22 nt, Human
aagcagccagccaucaugcccg

SEQ ID NO: 390492 - RNA, 22 nt, Human
auagucuuagucuauaguuuug

SEQ ID NO: 390493 - RNA, 18 nt, Human
acagaaauagcugugccu

SEQ ID NO: 390494 - RNA, 21 nt, Human
auucagaaagggaauaaacuc

SEQ ID NO: 390495 - RNA, 22 nt, Human
ggagggagucagcugauuagaa

SEQ ID NO: 390496 - RNA, 22 nt, Human
ccagggcuggugggagaugcug

SEQ ID NO: 390497 - RNA, 22 nt, Human
auauucacugagcauaaagcca

SEQ ID NO: 390498 - RNA, 20 nt, Human
cacaggcuauaugagagcca

SEQ ID NO: 390499 - RNA, 20 nt, Human
acauccuggugacuagaacu

SEQ ID NO: 390500 - RNA, 22 nt, Human
agucuuaauagagaaaaacugu

SEQ ID NO: 390501 - RNA, 22 nt, Human
ccucugcucccuggugucugag

SEQ ID NO: 390502 - RNA, 22 nt, Human
aggccucacauugggcuucaag

SEQ ID NO: 390503 - RNA, 22 nt, Human
cugagcuggucuauggacuugg

SEQ ID NO: 390504 - RNA, 22 nt, Human
cagcaauauacacagucuaugg

SEQ ID NO: 390505 - RNA, 22 nt, Human
gccaggugggagacagacagca

SEQ ID NO: 390506 - RNA, 22 nt, Human
agggucagggagugaguauuua

SEQ ID NO: 390507 - RNA, 23 nt, Human
gggcagguuuuuauaggcuucag

SEQ ID NO: 390508 - RNA, 22 nt, Human
cagaguguauucugcaguugca

SEQ ID NO: 390509 - RNA, 22 nt, Human
gccaggcuggcaaaaggaaacc

SEQ ID NO: 390510 - RNA, 22 nt, Human
uuugucauaucacacaauuuug

SEQ ID NO: 390511 - RNA, 22 nt, Human
cugcuguguggugaaacucagu

SEQ ID NO: 390512 - RNA, 22 nt, Human
ucuccuucgaggcccagcuccc

SEQ ID NO: 390513 - RNA, 22 nt, Human
acaaaguccugguguauggcca

SEQ ID NO: 390514 - RNA, 22 nt, Human
uucagaauauuuguuuuacaug

SEQ ID NO: 390515 - RNA, 22 nt, Human
gcagugacagggcugcugccuu

SEQ ID NO: 390516 - RNA, 22 nt, Human
uucacauaaugauacaaagcuu

SEQ ID NO: 390517 - RNA, 22 nt, Human
aggcucaguauagcuggcaagu

SEQ ID NO: 390518 - RNA, 22 nt, Human
uagcagggguagauagagugug

SEQ ID NO: 390519 - RNA, 22 nt, Human
ggcagaccucuccagccccaca

SEQ ID NO: 390520 - RNA, 22 nt, Human
agccugucugucuccaaagcug

SEQ ID NO: 390521 - RNA, 22 nt, Human
cagcccagcagucuuagccugc

SEQ ID NO: 390522 - RNA, 22 nt, Human
gggcagugacaaaggggaugaa

SEQ ID NO: 390523 - RNA, 22 nt, Human
agauuugcggcuuuacuuugca

SEQ ID NO: 390524 - RNA, 22 nt, Human
ccuggcuccugccucugcaggg

SEQ ID NO: 390525 - RNA, 22 nt, Human
agaagccagauuguagugggac

SEQ ID NO: 390526 - RNA, 22 nt, Human
uaccuugggguuuuguugcucu

SEQ ID NO: 390527 - RNA, 23 nt, Human
gugcaugugucuuuacaguagca

SEQ ID NO: 390528 - RNA, 22 nt, Human
ccuggccuuaagggcagggagc

SEQ ID NO: 390529 - RNA, 22 nt, Human
ucucugcucugugccucaguuu

SEQ ID NO: 390530 - RNA, 22 nt, Human
uagggcaguuucauguuaucuu

SEQ ID NO: 390531 - RNA, 22 nt, Human
acagcuuuaguguggguggugc

SEQ ID NO: 390532 - RNA, 22 nt, Human
cucaggauccaucuccugcccu

SEQ ID NO: 390533 - RNA, 21 nt, Human
ucacagacuggucagugaggc

SEQ ID NO: 390534 - RNA, 22 nt, Human
ccuccagcgcgauccacuccgg

SEQ ID NO: 390535 - RNA, 22 nt, Human
cagagcugcaaaugccccuccg

SEQ ID NO: 390536 - RNA, 22 nt, Human
cagaucuguuugccagaucagc

SEQ ID NO: 390537 - RNA, 22 nt, Human
cuucagaaugggacuguguuug

SEQ ID NO: 390538 - RNA, 22 nt, Human
ugcagggagcucuggggugcag

SEQ ID NO: 390539 - RNA, 22 nt, Human
cauauaauguuugaagaugugg

SEQ ID NO: 390540 - RNA, 22 nt, Human
uggcucuggugcgggcuccugc

SEQ ID NO: 390541 - RNA, 22 nt, Human
caaagagcuguucagugucgcu

SEQ ID NO: 390542 - RNA, 22 nt, Human
cugcugucuuuauuucacugcu

SEQ ID NO: 390543 - RNA, 22 nt, Human
ugcuggcccuggcucagggaac

SEQ ID NO: 390544 - RNA, 22 nt, Human
gcagagugagccgaggcugcuc

SEQ ID NO: 390545 - RNA, 19 nt, Human
uggcuucuguuuucauguu

SEQ ID NO: 390546 - RNA, 22 nt, Human
ugagccugggagauggaggcug

SEQ ID NO: 390547 - RNA, 22 nt, Human
ugcaauaaguuguguuaucacu

SEQ ID NO: 390548 - RNA, 22 nt, Human
agaagaaaugugaaggccacug

SEQ ID NO: 390549 - RNA, 22 nt, Human
cugccucugcgucccacagagu

SEQ ID NO: 390550 - RNA, 22 nt, Human
accucugcucaagaccccuccg

SEQ ID NO: 390551 - RNA, 22 nt, Human
cauuaauauuguucuucuuuag

SEQ ID NO: 390552 - RNA, 22 nt, Human
uggcacugccaaccugcuaggu

SEQ ID NO: 390553 - RNA, 22 nt, Human
gugcaugugcauccauguguac

SEQ ID NO: 390554 - RNA, 22 nt, Human
caggaugugaggaggccauuug

SEQ ID NO: 390555 - RNA, 22 nt, Human
ucccaggaggugcuuccuagga

SEQ ID NO: 390556 - RNA, 22 nt, Human
guguacaugagaaaucaacuuu

SEQ ID NO: 390557 - RNA, 22 nt, Human
gcuguucugcgucccaggcugg

SEQ ID NO: 390558 - RNA, 22 nt, Human
ugggcaggauaauaucucaugu

SEQ ID NO: 390559 - RNA, 22 nt, Human
aagcugccacacggugaguacu

SEQ ID NO: 390560 - RNA, 22 nt, Human
uuugaacugauaaucuucuguu

SEQ ID NO: 390561 - RNA, 22 nt, Human
gccuucagcggccgcucgcugc

SEQ ID NO: 390562 - RNA, 22 nt, Human
gcuggccauggggagugaggag

SEQ ID NO: 390563 - RNA, 22 nt, Human
ucuggccugggccugccggugc

SEQ ID NO: 390564 - RNA, 22 nt, Human
cuagggacugggaccuuaguua

SEQ ID NO: 390565 - RNA, 22 nt, Human
cagguggcuucucccuaggcca

SEQ ID NO: 390566 - RNA, 22 nt, Human
acauuccaaaaacuagcagaua

SEQ ID NO: 390567 - RNA, 22 nt, Human
ccuggcagucaggggaguccuu

SEQ ID NO: 390568 - RNA, 22 nt, Human
cuugcugucccuugguaugaac

SEQ ID NO: 390569 - RNA, 22 nt, Human
cuauuaggcuuccauuucaugc

SEQ ID NO: 390570 - RNA, 22 nt, Human
agagugaaguuuuugaaaguga

SEQ ID NO: 390571 - RNA, 22 nt, Human
uccaggagugugugcuaauggg

SEQ ID NO: 390572 - RNA, 22 nt, Human
uuugcaguagacaucuuauuuu

SEQ ID NO: 390573 - RNA, 22 nt, Human
auuggcagaaacagcagggcca

SEQ ID NO: 390574 - RNA, 18 nt, Human
gggcucugauccuucacc

SEQ ID NO: 390575 - RNA, 22 nt, Human
uccaggcagucauuaaucucua

SEQ ID NO: 390576 - RNA, 22 nt, Human
gaagucuucauucucucugaga

SEQ ID NO: 390577 - RNA, 22 nt, Human
ugcagggcauaggguccaguuu

SEQ ID NO: 390578 - RNA, 22 nt, Human
uugcuuugccaccagaagucua

SEQ ID NO: 390579 - RNA, 22 nt, Human
ucauauaaguuuaaaacuaucu

SEQ ID NO: 390580 - RNA, 22 nt, Human
uuugaaguucccccauaucaga

SEQ ID NO: 390581 - RNA, 22 nt, Human
cucccagggccaucgagucacu

SEQ ID NO: 390582 - RNA, 22 nt, Human
acaguaaugauucugagucucu

SEQ ID NO: 390583 - RNA, 22 nt, Human
aagauacauaaagguagagucu

SEQ ID NO: 390584 - RNA, 22 nt, Human
cauucacagcaggucagcugaa

SEQ ID NO: 390585 - RNA, 22 nt, Human
gcaggccagcugugcagauggg

SEQ ID NO: 390586 - RNA, 20 nt, Human
ugucaugcauuagaugaaga

SEQ ID NO: 390587 - RNA, 22 nt, Human
ccugggaggcugugggucugcu

SEQ ID NO: 390588 - RNA, 22 nt, Human
agcagcucaaagccugcaagga

SEQ ID NO: 390589 - RNA, 21 nt, Human
gccugcaguuuugaagcccuu

SEQ ID NO: 390590 - RNA, 22 nt, Human
agaaagcuuaugaaugggcaag

SEQ ID NO: 390591 - RNA, 22 nt, Human
ggagcugucuguagggcacagg

SEQ ID NO: 390592 - RNA, 22 nt, Human
aucugaagggaaguggaaggca

SEQ ID NO: 390593 - RNA, 18 nt, Human
cuuuaugugcagagcuuu

SEQ ID NO: 390594 - RNA, 22 nt, Human
cuguuaaucugcuugcaugaug

SEQ ID NO: 390595 - RNA, 22 nt, Human
ugccaggccaaugaaggcaggg

SEQ ID NO: 390596 - RNA, 22 nt, Human
guccaaauuuuucacauguaga

SEQ ID NO: 390597 - RNA, 23 nt, Human
caggcaggaugaggacuacacuc

SEQ ID NO: 390598 - RNA, 22 nt, Human
acaaaggcagagaauucaacau

SEQ ID NO: 390599 - RNA, 22 nt, Human
gccaggcuguuuuuauuacugu

SEQ ID NO: 390600 - RNA, 22 nt, Human
ucucagagaccugaacucccug

SEQ ID NO: 390601 - RNA, 22 nt, Human
gagccugaaauacaggucacug

SEQ ID NO: 390602 - RNA, 23 nt, Human
cccagaccuugugcugcccuugg

SEQ ID NO: 390603 - RNA, 22 nt, Human
uagcuuuaagacauggugaaug

SEQ ID NO: 390604 - RNA, 22 nt, Human
ggaugcacgaaggcgccucgga

SEQ ID NO: 390605 - RNA, 22 nt, Human
acacaaguucuaaagauugcgc

SEQ ID NO: 390606 - RNA, 22 nt, Human
gcccagcuuuuugaggcaggca

SEQ ID NO: 390607 - RNA, 22 nt, Human
ggcagugaaucugagagccugg

SEQ ID NO: 390608 - RNA, 22 nt, Human
uguacuugaacuugacuguaga

SEQ ID NO: 390609 - RNA, 22 nt, Human
cagcuggcguggagugauugca

SEQ ID NO: 390610 - RNA, 22 nt, Human
cuggccuuggugcuugcagaca

SEQ ID NO: 390611 - RNA, 22 nt, Human
acacagggauauuucagguggu

SEQ ID NO: 390612 - RNA, 22 nt, Human
gccucugcccuccugggacugc

SEQ ID NO: 390613 - RNA, 22 nt, Human
uccucaggcggugaggaggggc

SEQ ID NO: 390614 - RNA, 22 nt, Human
aaagaacaucggagugggcggg

SEQ ID NO: 390615 - RNA, 22 nt, Human
gauuucaaggaguuuucacagu

SEQ ID NO: 390616 - RNA, 22 nt, Human
uaucagaaagauauuacugggg

SEQ ID NO: 390617 - RNA, 22 nt, Human
ccuggcugggguagaagugagg

SEQ ID NO: 390618 - RNA, 22 nt, Human
ccugucuguaucgguucagagu

SEQ ID NO: 390619 - RNA, 22 nt, Human
gcucuccaaacccuguggcuuu

SEQ ID NO: 390620 - RNA, 22 nt, Human
uuguuuguaugcugagaagaau

SEQ ID NO: 390621 - RNA, 22 nt, Human
gguacaaggagugaagguuugg

SEQ ID NO: 390622 - RNA, 22 nt, Human
uguguacuugaaagggcagguc

SEQ ID NO: 390623 - RNA, 22 nt, Human
cccacucuggcucccuucuagu

SEQ ID NO: 390624 - RNA, 22 nt, Human
guguauaacuaucuaucuagua

SEQ ID NO: 390625 - RNA, 22 nt, Human
cuggagcucuccagagccccgu

SEQ ID NO: 390626 - RNA, 22 nt, Human
cauggcccucuucuggagcaau

SEQ ID NO: 390627 - RNA, 22 nt, Human
ucccaggaaugucugaaaguga

SEQ ID NO: 390628 - RNA, 22 nt, Human
agaguccauaugugggaggagu

SEQ ID NO: 390629 - RNA, 18 nt, Human
gggaagccgggaagccgg

SEQ ID NO: 390630 - RNA, 22 nt, Human
ugcucuguaacaaauugacaug

SEQ ID NO: 390631 - RNA, 22 nt, Human
ugcagggauuagaggccgggga

SEQ ID NO: 390632 - RNA, 22 nt, Human
augaacacauguacacauuucu

SEQ ID NO: 390633 - RNA, 22 nt, Human
cagcugaguuacucugaggucu

SEQ ID NO: 390634 - RNA, 22 nt, Human
gcagaggagcaaguugcuacag

SEQ ID NO: 390635 - RNA, 22 nt, Human
gcauuccuacaggcugcuauga

SEQ ID NO: 390636 - RNA, 22 nt, Human
uccuguggagaggacuggaggu

SEQ ID NO: 390637 - RNA, 22 nt, Human
ucaggagcuugguagugugauu

SEQ ID NO: 390638 - RNA, 23 nt, Human
ggcaccaggccauggagcgggag

SEQ ID NO: 390639 - RNA, 22 nt, Human
cauuuauucaugaucuguagcu

SEQ ID NO: 390640 - RNA, 22 nt, Human
uaugcacaccuggguccuuguc

SEQ ID NO: 390641 - RNA, 22 nt, Human
cucaggaugcaggucacaggac

SEQ ID NO: 390642 - RNA, 22 nt, Human
uugaagcaugguacuuguucaa

SEQ ID NO: 390643 - RNA, 22 nt, Human
ugccugcugcuaagcucuuugu

SEQ ID NO: 390644 - RNA, 22 nt, Human
auuucccaugugaaucaauugg

SEQ ID NO: 390645 - RNA, 22 nt, Human
ugcucuggagggugaagcuuuu

SEQ ID NO: 390646 - RNA, 22 nt, Human
guuuuguugcugcagagcucaa

SEQ ID NO: 390647 - RNA, 22 nt, Human
gccaggaggcugcuguguaggc

SEQ ID NO: 390648 - RNA, 22 nt, Human
cagcucaaguuucccaggucag

SEQ ID NO: 390649 - RNA, 21 nt, Human
acuguucauuugaugaacugg

SEQ ID NO: 390650 - RNA, 22 nt, Human
gacccggcuccaggcccagcag

SEQ ID NO: 390651 - RNA, 22 nt, Human
aggcagcuuaagcccuggccca

SEQ ID NO: 390652 - RNA, 22 nt, Human
ccucagcucuucccugugcaca

SEQ ID NO: 390653 - RNA, 22 nt, Human
ugaggcaguugagcuuccugag

SEQ ID NO: 390654 - RNA, 22 nt, Human
uucuugcaggucacucacugag

SEQ ID NO: 390655 - RNA, 22 nt, Human
ugggcuacucugggagccuaac

SEQ ID NO: 390656 - RNA, 22 nt, Human
aucaaaguaggcauauguuuuu

SEQ ID NO: 390657 - RNA, 22 nt, Human
uauuucagcaagaagaaugugg

SEQ ID NO: 390658 - RNA, 22 nt, Human
uucuuccucagcagggcugccu

SEQ ID NO: 390659 - RNA, 22 nt, Human
aaggcccuaauagagcacauau

SEQ ID NO: 390660 - RNA, 22 nt, Human
gcagcuuucugggacagaaagg

SEQ ID NO: 390661 - RNA, 22 nt, Human
ccauuguaaagaguauacuuug

SEQ ID NO: 390662 - RNA, 22 nt, Human
aagcccagaugggagcauuuca

SEQ ID NO: 390663 - RNA, 22 nt, Human
agaugcugaauuauugugcuuu

SEQ ID NO: 390664 - RNA, 22 nt, Human
uggguacuccuauuaguucagu

SEQ ID NO: 390665 - RNA, 22 nt, Human
gugcuaggauuacaggcauggg

SEQ ID NO: 390666 - RNA, 22 nt, Human
aguaaaaucaccaucucuuugu

SEQ ID NO: 390667 - RNA, 22 nt, Human
ucugccugcggcugcagguggc

SEQ ID NO: 390668 - RNA, 22 nt, Human
aggcagcuggcagcacccaggg

SEQ ID NO: 390669 - RNA, 22 nt, Human
cccagcauuucugggcugcacu

SEQ ID NO: 390670 - RNA, 22 nt, Human
cuggaggcugaguugggucucc

SEQ ID NO: 390671 - RNA, 22 nt, Human
auucaaguggcugcuauguuaa

SEQ ID NO: 390672 - RNA, 22 nt, Human
gaugguuuaugauagaugggaa

SEQ ID NO: 390673 - RNA, 22 nt, Human
gaggcacaauacaugucucaag

SEQ ID NO: 390674 - RNA, 22 nt, Human
cugggcacaggggagcagaguc

SEQ ID NO: 390675 - RNA, 22 nt, Human
auuugagaugguaaauaacuuu

SEQ ID NO: 390676 - RNA, 22 nt, Human
cacccagugaaggagcaagagg

SEQ ID NO: 390677 - RNA, 22 nt, Human
aaucagucauuagcucugaccu

SEQ ID NO: 390678 - RNA, 22 nt, Human
uggugaagucagcggagcccgg

SEQ ID NO: 390679 - RNA, 22 nt, Human
cucccagagaccaagcugagaa

SEQ ID NO: 390680 - RNA, 22 nt, Human
augucuuuggcuuugacauggc

SEQ ID NO: 390681 - RNA, 20 nt, Human
cccaggagugagcagcuuua

SEQ ID NO: 390682 - RNA, 23 nt, Human
ccucagggucuagcagagagaag

SEQ ID NO: 390683 - RNA, 22 nt, Human
gcagccagggagagaaccaggg

SEQ ID NO: 390684 - RNA, 22 nt, Human
aaugcuuauaccuaaugaucuu

SEQ ID NO: 390685 - RNA, 20 nt, Human
cagagccaagagcagcaucu

SEQ ID NO: 390686 - RNA, 22 nt, Human
ugguuuugcuccaguauaaaua

SEQ ID NO: 390687 - RNA, 22 nt, Human
ugaggcagcaauugauuauuca

SEQ ID NO: 390688 - RNA, 22 nt, Human
uuccuuagugccucuuccgcug

SEQ ID NO: 390689 - RNA, 22 nt, Human
ugugaaagauacuaggcagagg

SEQ ID NO: 390690 - RNA, 22 nt, Human
aagagcaucgguggagccccca

SEQ ID NO: 390691 - RNA, 20 nt, Human
aggaacuggaagggaggaaa

SEQ ID NO: 390692 - RNA, 22 nt, Human
caucacuguccaaaguucaguu

SEQ ID NO: 390693 - RNA, 22 nt, Human
augggcaguaacaguggcaguc

SEQ ID NO: 390694 - RNA, 22 nt, Human
ccugggcaaaugccagagacaa

SEQ ID NO: 390695 - RNA, 19 nt, Human
ggccccucucacaggaguu

SEQ ID NO: 390696 - RNA, 22 nt, Human
uaguggaguagaaaccaaagaa

SEQ ID NO: 390697 - RNA, 22 nt, Human
auuuccaggagaaaggauuuua

SEQ ID NO: 390698 - RNA, 21 nt, Human
agaguaauuccugcuggaaag

SEQ ID NO: 390699 - RNA, 22 nt, Human
gaugagcauuguuucauguguu

SEQ ID NO: 390700 - RNA, 22 nt, Human
gagggcugccacguugggcgag

SEQ ID NO: 390701 - RNA, 22 nt, Human
uggcuccuaucaaggagugggu

SEQ ID NO: 390702 - RNA, 22 nt, Human
gccggggcuggggagagacaug

SEQ ID NO: 390703 - RNA, 22 nt, Human
uauaacaggaaguauucaaaca

SEQ ID NO: 390704 - RNA, 16 nt, Human
gagggcagaggcggaa

SEQ ID NO: 390705 - RNA, 22 nt, Human
ugaagccaccgaaccagaagag

SEQ ID NO: 390706 - RNA, 17 nt, Human
ugagacagggcaggccc

SEQ ID NO: 390707 - RNA, 22 nt, Human
gaggccuguagucauggaugua

SEQ ID NO: 390708 - RNA, 22 nt, Human
auaugauuccacuauuguaugg

SEQ ID NO: 390709 - RNA, 22 nt, Human
gauguagagggaagauuuuaaa

SEQ ID NO: 390710 - RNA, 22 nt, Human
uagggauguccugagacuuggc

SEQ ID NO: 390711 - RNA, 22 nt, Human
uuucuaguaaucaauauaaagu

SEQ ID NO: 390712 - RNA, 22 nt, Human
gcagcuccuccugggcuggaga

SEQ ID NO: 390713 - RNA, 22 nt, Human
ugacagcauaacacuggucuug

SEQ ID NO: 390714 - RNA, 22 nt, Human
gucccaggugggcuccaccucu

SEQ ID NO: 390715 - RNA, 22 nt, Human
ggcaggaggugaguggcgggug

SEQ ID NO: 390716 - RNA, 22 nt, Human
caaaauugaugaauguaugauu

SEQ ID NO: 390717 - RNA, 22 nt, Human
uucagaaaggauaauuggaagg

SEQ ID NO: 390718 - RNA, 22 nt, Human
ccagagaccagaacauggggau

SEQ ID NO: 390719 - RNA, 21 nt, Human
uggcagaguugaguaguuaug

SEQ ID NO: 390720 - RNA, 22 nt, Human
cacagggcaccaguuggccauc

SEQ ID NO: 390721 - RNA, 19 nt, Human
ugaaggagggggauggcca

SEQ ID NO: 390722 - RNA, 22 nt, Human
gcuaccugagcaagagcuucaa

SEQ ID NO: 390723 - RNA, 22 nt, Human
uccucugccccagaugaaauuu

SEQ ID NO: 390724 - RNA, 22 nt, Human
ccucugagagaaggccuucagc

SEQ ID NO: 390725 - RNA, 22 nt, Human
cccaggcugaugggaugggcca

SEQ ID NO: 390726 - RNA, 22 nt, Human
ggccuugggcagacacgucaca

SEQ ID NO: 390727 - RNA, 22 nt, Human
ggaggaggcggcagaaguuccu

SEQ ID NO: 390728 - RNA, 23 nt, Human
uggaggaaacacaucagaagacc

SEQ ID NO: 390729 - RNA, 22 nt, Human
uggcagcugucuguggggucuc

SEQ ID NO: 390730 - RNA, 22 nt, Human
aauuagggaaguauuuaguagu

SEQ ID NO: 390731 - RNA, 22 nt, Human
gccagguguccucacagugagg

SEQ ID NO: 390732 - RNA, 22 nt, Human
guuguuuugcaggauccuuaca

SEQ ID NO: 390733 - RNA, 22 nt, Human
acauuucuuucuauucaguagc

SEQ ID NO: 390734 - RNA, 22 nt, Human
accuuaaaacugacacauggag

SEQ ID NO: 390735 - RNA, 22 nt, Human
ccagcagagggucuuggccauu

SEQ ID NO: 390736 - RNA, 22 nt, Human
agggccugagcuggcugaccuc

SEQ ID NO: 390737 - RNA, 22 nt, Human
ucuggaucggguuccucagguc

SEQ ID NO: 390738 - RNA, 22 nt, Human
cagaauuuagcacaauguaugg

SEQ ID NO: 390739 - RNA, 22 nt, Human
uccugaggaaaguucaugaaug

SEQ ID NO: 390740 - RNA, 22 nt, Human
gagccauacaaccuauaaagug

SEQ ID NO: 390741 - RNA, 22 nt, Human
gcagggcucugcuguaguccua

SEQ ID NO: 390742 - RNA, 22 nt, Human
uuucucaaggugucauguauuu

SEQ ID NO: 390743 - RNA, 22 nt, Human
uggugcuguggaggggcagaag

SEQ ID NO: 390744 - RNA, 22 nt, Human
uugggugcugucauggggcacg

SEQ ID NO: 390745 - RNA, 22 nt, Human
caauguguuugcauauuaaaau

SEQ ID NO: 390746 - RNA, 23 nt, Human
aggcacugaaugugucagugagu

SEQ ID NO: 390747 - RNA, 22 nt, Human
uucaguaaaacacugcaauguc

SEQ ID NO: 390748 - RNA, 22 nt, Human
aaaauaacuucuacuauuugca

SEQ ID NO: 390749 - RNA, 22 nt, Human
acacugugacaaaggcuguucu

SEQ ID NO: 390750 - RNA, 22 nt, Human
gguggggccugcuccagcggcc

SEQ ID NO: 390751 - RNA, 22 nt, Human
uuccuggugguggugacagcac

SEQ ID NO: 390752 - RNA, 22 nt, Human
ugggauggagccugaguauagu

SEQ ID NO: 390753 - RNA, 22 nt, Human
acauuucucccugcaugccugc

SEQ ID NO: 390754 - RNA, 21 nt, Human
uccucagggccccagagcacu

SEQ ID NO: 390755 - RNA, 20 nt, Human
cucaggauugucuagccccu

SEQ ID NO: 390756 - RNA, 22 nt, Human
auuuucaugacuaccuuaaaua

SEQ ID NO: 390757 - RNA, 23 nt, Human
uugcuucugugcaauucaguacu

SEQ ID NO: 390758 - RNA, 22 nt, Human
aauuuacaguugcugaugguac

SEQ ID NO: 390759 - RNA, 20 nt, Human
uuucacaucugucccuuuaa

SEQ ID NO: 390760 - RNA, 22 nt, Human
cccagcuccagagccagaaaca

SEQ ID NO: 390761 - RNA, 20 nt, Human
uccugcagucgcuagcgccc

SEQ ID NO: 390762 - RNA, 22 nt, Human
ggcagcuguggacgucgucauu

SEQ ID NO: 390763 - RNA, 22 nt, Human
gucaggaugggcagccaaacua

SEQ ID NO: 390764 - RNA, 22 nt, Human
auacaaugagugagugaauggg

SEQ ID NO: 390765 - RNA, 22 nt, Human
gaugcagggcuggcaggagcuu

SEQ ID NO: 390766 - RNA, 22 nt, Human
ccuggagguggagguugcagug

SEQ ID NO: 390767 - RNA, 22 nt, Human
gcaggaugagugaguacauuua

SEQ ID NO: 390768 - RNA, 22 nt, Human
uuaucacuuaugagcuuuuugc

SEQ ID NO: 390769 - RNA, 22 nt, Human
uauaaagcugacucaugaaacu

SEQ ID NO: 390770 - RNA, 21 nt, Human
ggccugaguauaggacaggcc

SEQ ID NO: 390771 - RNA, 22 nt, Human
uuccauaauuaaguggagagaa

SEQ ID NO: 390772 - RNA, 22 nt, Human
uucucauucugacucaguguag

SEQ ID NO: 390773 - RNA, 22 nt, Human
ugcuuccuugagcucuccaauc

SEQ ID NO: 390774 - RNA, 22 nt, Human
uggaagcacuuggguuuuguug

SEQ ID NO: 390775 - RNA, 22 nt, Human
ggcugaaggaugaaagcugcag

SEQ ID NO: 390776 - RNA, 22 nt, Human
cacagggccuugugugacugca

SEQ ID NO: 390777 - RNA, 22 nt, Human
agggcugaugcaccauguagcc

SEQ ID NO: 390778 - RNA, 17 nt, Human
ugccagccugucccagg

SEQ ID NO: 390779 - RNA, 22 nt, Human
gcagggacagggcagggccuuu

SEQ ID NO: 390780 - RNA, 22 nt, Human
cugcucacgccaccguucauca

SEQ ID NO: 390781 - RNA, 22 nt, Human
acaguguguucugggaccucca

SEQ ID NO: 390782 - RNA, 22 nt, Human
cagagcagagugauuguucugg

SEQ ID NO: 390783 - RNA, 22 nt, Human
aggagcugcaaauauuaguaau

SEQ ID NO: 390784 - RNA, 22 nt, Human
auuugucuucaguagguucuuc

SEQ ID NO: 390785 - RNA, 22 nt, Human
ccuuuuucccuggagggacagc

SEQ ID NO: 390786 - RNA, 22 nt, Human
uuugggaagaggaaucucugga

SEQ ID NO: 390787 - RNA, 22 nt, Human
ucuggcuccguguccgcuccca

SEQ ID NO: 390788 - RNA, 22 nt, Human
acuuucauuuguaauaaacuuc

SEQ ID NO: 390789 - RNA, 22 nt, Human
cugcuuuguaaaauagacauaa

SEQ ID NO: 390790 - RNA, 22 nt, Human
cuacauaaucuggauuugucug

SEQ ID NO: 390791 - RNA, 22 nt, Human
gcaggagccacuucagggaugc

SEQ ID NO: 390792 - RNA, 22 nt, Human
gagccugaugaaacaggcagac

SEQ ID NO: 390793 - RNA, 22 nt, Human
caguguacuuggaauguaacag

SEQ ID NO: 390794 - RNA, 23 nt, Human
uugcuuucaucaugagaugcucc

SEQ ID NO: 390795 - RNA, 22 nt, Human
agaugcugauugaauagauuuc

SEQ ID NO: 390796 - RNA, 22 nt, Human
gacccugccaugagugacaggg

SEQ ID NO: 390797 - RNA, 22 nt, Human
gugauuuugagaccuauauagu

SEQ ID NO: 390798 - RNA, 22 nt, Human
ccagagggcaaaaugaagcuua

SEQ ID NO: 390799 - RNA, 21 nt, Human
ugcuccuuagcugccccugcc

SEQ ID NO: 390800 - RNA, 22 nt, Human
gauaaaauucuuauuuuacccg

SEQ ID NO: 390801 - RNA, 19 nt, Human
gcaggguguugacuguccc

SEQ ID NO: 390802 - RNA, 22 nt, Human
cauguauaguuggaacuacauc

SEQ ID NO: 390803 - RNA, 22 nt, Human
aauagguagccagauauauaaa

SEQ ID NO: 390804 - RNA, 22 nt, Human
uaacagaauccuguuauugcca

SEQ ID NO: 390805 - RNA, 22 nt, Human
uggcagcuuuuuguuucaggcu

SEQ ID NO: 390806 - RNA, 22 nt, Human
uggcauuugcucccuuguguuc

SEQ ID NO: 390807 - RNA, 18 nt, Human
uagggcucuagggaguga

SEQ ID NO: 390808 - RNA, 23 nt, Human
agggcaugaagcagaggacgugg

SEQ ID NO: 390809 - RNA, 20 nt, Human
augcuuucuugugugcugcu

SEQ ID NO: 390810 - RNA, 22 nt, Human
agugcugucaguuuuauagaua

SEQ ID NO: 390811 - RNA, 22 nt, Human
ucccaaagcuacucuucugacu

SEQ ID NO: 390812 - RNA, 21 nt, Human
ggacuuacauagguaaggggu

SEQ ID NO: 390813 - RNA, 22 nt, Human
ucuccaagcagggcugcaaggc

SEQ ID NO: 390814 - RNA, 22 nt, Human
gccuggaggggacagucucugg

SEQ ID NO: 390815 - RNA, 22 nt, Human
ugccucagagugggcuugcuau

SEQ ID NO: 390816 - RNA, 22 nt, Human
gcaagcugcuuaagcucauugu

SEQ ID NO: 390817 - RNA, 22 nt, Human
uggaggaaucagggcuuaggcu

SEQ ID NO: 390818 - RNA, 22 nt, Human
gccugagauucugcauuucuaa

SEQ ID NO: 390819 - RNA, 15 nt, Human
uucaggauaugacuc

SEQ ID NO: 390820 - RNA, 22 nt, Human
caaguccaggucaauuuaaagc

SEQ ID NO: 390821 - RNA, 22 nt, Human
auuaggcauauaugcuuuuaau

SEQ ID NO: 390822 - RNA, 22 nt, Human
accaggaggccuugguucugag

SEQ ID NO: 390823 - RNA, 22 nt, Human
cagcuugggucaggugccugcu

SEQ ID NO: 390824 - RNA, 22 nt, Human
gaaggccacaagagaaguuaag

SEQ ID NO: 390825 - RNA, 22 nt, Human
gcacugcagccucagauggugg

SEQ ID NO: 390826 - RNA, 22 nt, Human
gcuaggagauugagcucugaag

SEQ ID NO: 390827 - RNA, 22 nt, Human
cauugcacugcagcccgggcaa

SEQ ID NO: 390828 - RNA, 22 nt, Human
gcucccaggaagagaagggcca

SEQ ID NO: 390829 - RNA, 22 nt, Human
ggccagcugggccaccaggugc

SEQ ID NO: 390830 - RNA, 22 nt, Human
aggaggggcauagaaauguaau

SEQ ID NO: 390831 - RNA, 22 nt, Human
guuauugcaguauagaggucua

SEQ ID NO: 390832 - RNA, 20 nt, Human
uccaugaguuagagacuaua

SEQ ID NO: 390833 - RNA, 22 nt, Human
uucccucuccuacucaggaaag

SEQ ID NO: 390834 - RNA, 22 nt, Human
uuacauuagacccacuuucaug

SEQ ID NO: 390835 - RNA, 22 nt, Human
ccagcagcagcguccaaggaga

SEQ ID NO: 390836 - RNA, 22 nt, Human
ccacuucaucagugcuccauuu

SEQ ID NO: 390837 - RNA, 22 nt, Human
agcuggaggggccagcaggugu

SEQ ID NO: 390838 - RNA, 22 nt, Human
ccaggccagcaggcacaccugc

SEQ ID NO: 390839 - RNA, 22 nt, Human
uguggccuggaaggggcugcuc

SEQ ID NO: 390840 - RNA, 22 nt, Human
agagccuggucugagauaggac

SEQ ID NO: 390841 - RNA, 22 nt, Human
cugagagaugauauagcuuaau

SEQ ID NO: 390842 - RNA, 22 nt, Human
ucaaacuagccugacugguauu

SEQ ID NO: 390843 - RNA, 20 nt, Human
ucuguucaaaucuuaguucc

SEQ ID NO: 390844 - RNA, 22 nt, Human
ccuggcagcgugccgagcugcg

SEQ ID NO: 390845 - RNA, 20 nt, Human
ucacaggggaccaggagcag

SEQ ID NO: 390846 - RNA, 22 nt, Human
agaugugguaguugaagggaag

SEQ ID NO: 390847 - RNA, 22 nt, Human
gauagucaccucccuuaacuuu

SEQ ID NO: 390848 - RNA, 22 nt, Human
uuaggaaauuccaccuguauuc

SEQ ID NO: 390849 - RNA, 22 nt, Human
cagggccuuauccugccauuga

SEQ ID NO: 390850 - RNA, 22 nt, Human
aauuaugauuggucuaaaccag

SEQ ID NO: 390851 - RNA, 23 nt, Human
ucguugaauagcaauagcacaac

SEQ ID NO: 390852 - RNA, 22 nt, Human
gcugccagcuuuccuuggcuga

SEQ ID NO: 390853 - RNA, 22 nt, Human
cagcagcaugaauucgagccac

SEQ ID NO: 390854 - RNA, 22 nt, Human
auggagggugucagagagcgaa

SEQ ID NO: 390855 - RNA, 22 nt, Human
acagaccaaaaaaggauauugg

SEQ ID NO: 390856 - RNA, 22 nt, Human
cccaggaaugggaaggaggaau

SEQ ID NO: 390857 - RNA, 19 nt, Human
gagcagcugcacccauuga

SEQ ID NO: 390858 - RNA, 22 nt, Human
caccugggcuaaacuaugcagg

SEQ ID NO: 390859 - RNA, 22 nt, Human
uagcaguggaaucuuuugucca

SEQ ID NO: 390860 - RNA, 22 nt, Human
agcuuccuacaaccaucucaga

SEQ ID NO: 390861 - RNA, 22 nt, Human
ggccuggccuccagaugugggc

SEQ ID NO: 390862 - RNA, 22 nt, Human
uuuaucuuuggaucuucagaaa

SEQ ID NO: 390863 - RNA, 22 nt, Human
gggaagccaugcucagagguac

SEQ ID NO: 390864 - RNA, 22 nt, Human
gcagagcuccccaagacaccaa

SEQ ID NO: 390865 - RNA, 22 nt, Human
gugcauauaugcacauaugugu

SEQ ID NO: 390866 - RNA, 22 nt, Human
ccaggaggcagaaguugcagug

SEQ ID NO: 390867 - RNA, 22 nt, Human
acugugcaugaaccgaaacaaa

SEQ ID NO: 390868 - RNA, 23 nt, Human
ucagcugcuuccuccugccugcc

SEQ ID NO: 390869 - RNA, 22 nt, Human
ucagggacagggugcugcugcg

SEQ ID NO: 390870 - RNA, 22 nt, Human
ucucauugguauauacaugugu

SEQ ID NO: 390871 - RNA, 22 nt, Human
ccagcuggagccaagguggacu

SEQ ID NO: 390872 - RNA, 23 nt, Human
ucuguacaauugagaagagaaca

SEQ ID NO: 390873 - RNA, 22 nt, Human
ccgggccucgggacaccgggua

SEQ ID NO: 390874 - RNA, 22 nt, Human
gcauuuagcuuuaaaauauuuc

SEQ ID NO: 390875 - RNA, 22 nt, Human
auaauuuacaacugcuuuuaau

SEQ ID NO: 390876 - RNA, 22 nt, Human
aacagaaugcaggggaugcugc

SEQ ID NO: 390877 - RNA, 22 nt, Human
uaugcacagaaguuugcugaau

SEQ ID NO: 390878 - RNA, 22 nt, Human
aggaagcccaagucucaucuuc

SEQ ID NO: 390879 - RNA, 22 nt, Human
aguguuugagacacauuucacu

SEQ ID NO: 390880 - RNA, 22 nt, Human
aguuauauuccauagauucaga

SEQ ID NO: 390881 - RNA, 22 nt, Human
ugcaggcuguaaucugaggcua

SEQ ID NO: 390882 - RNA, 18 nt, Human
ugagagugugugcucuug

SEQ ID NO: 390883 - RNA, 22 nt, Human
ugguccaggguguaguacagag

SEQ ID NO: 390884 - RNA, 22 nt, Human
augggaggcagacacuaaguuc

SEQ ID NO: 390885 - RNA, 22 nt, Human
gcuguucaaaagccacaguuac

SEQ ID NO: 390886 - RNA, 18 nt, Human
aggaaagaaaggcaggug

SEQ ID NO: 390887 - RNA, 22 nt, Human
aaauuauuaugccccucuauaa

SEQ ID NO: 390888 - RNA, 22 nt, Human
ccugucaggguuugccucagaa

SEQ ID NO: 390889 - RNA, 22 nt, Human
guccucuguagggcugggccac

SEQ ID NO: 390890 - RNA, 22 nt, Human
uuccuuagggaaagggauaagg

SEQ ID NO: 390891 - RNA, 22 nt, Human
cagccucuuuccacaucaggca

SEQ ID NO: 390892 - RNA, 22 nt, Human
auacauaauuacuuccgauguu

SEQ ID NO: 390893 - RNA, 22 nt, Human
uaagucaucacauugcagagau

SEQ ID NO: 390894 - RNA, 22 nt, Human
uugggggaagaggauagacagu

SEQ ID NO: 390895 - RNA, 22 nt, Human
uaaggccaaguucauauacaac

SEQ ID NO: 390896 - RNA, 19 nt, Human
ggagccuggagcacgugcc

SEQ ID NO: 390897 - RNA, 22 nt, Human
gucuauauauugcuugaauaau

SEQ ID NO: 390898 - RNA, 22 nt, Human
cuggcuggccggaggcaucccu

SEQ ID NO: 390899 - RNA, 20 nt, Human
uccaggagguuaguguggcu

SEQ ID NO: 390900 - RNA, 22 nt, Human
gugaggugggcuggccagagac

SEQ ID NO: 390901 - RNA, 22 nt, Human
ugugccuggcauucugggcuuc

SEQ ID NO: 390902 - RNA, 22 nt, Human
ucuguucaugucuuuuuaagug

SEQ ID NO: 390903 - RNA, 22 nt, Human
ugggcaaguaucggacucugag

SEQ ID NO: 390904 - RNA, 22 nt, Human
agaauaaucacugaaguucaaa

SEQ ID NO: 390905 - RNA, 22 nt, Human
ucucccaguggugcagaaagca

SEQ ID NO: 390906 - RNA, 22 nt, Human
cagcaauaguguguuuguuuca

SEQ ID NO: 390907 - RNA, 17 nt, Human
agaugcuggccacaugu

SEQ ID NO: 390908 - RNA, 22 nt, Human
gagacguggccuuugccugagc

SEQ ID NO: 390909 - RNA, 22 nt, Human
gccugcaguucugugcuaggca

SEQ ID NO: 390910 - RNA, 22 nt, Human
ccuggcagguggagguugcagu

SEQ ID NO: 390911 - RNA, 18 nt, Human
uggcucuggacuugcucc

SEQ ID NO: 390912 - RNA, 22 nt, Human
cugaaggacuuggugauaguug

SEQ ID NO: 390913 - RNA, 22 nt, Human
caauuucaaugaggccacaggg

SEQ ID NO: 390914 - RNA, 22 nt, Human
aggaagcaaaaggcagggucua

SEQ ID NO: 390915 - RNA, 22 nt, Human
ucuguaguagguuguaguucuu

SEQ ID NO: 390916 - RNA, 22 nt, Human
augaugguuguccuaggugcau

SEQ ID NO: 390917 - RNA, 22 nt, Human
cuggcugcuggccugaggaugc

SEQ ID NO: 390918 - RNA, 22 nt, Human
gaaggggacuggcagcugcaga

SEQ ID NO: 390919 - RNA, 21 nt, Human
ggagucagggucuggcugggg

SEQ ID NO: 390920 - RNA, 22 nt, Human
cucaggagacaguguccacaug

SEQ ID NO: 390921 - RNA, 19 nt, Human
aguggcagaucuggaagua

SEQ ID NO: 390922 - RNA, 22 nt, Human
gcagggcagaccuccagccuau

SEQ ID NO: 390923 - RNA, 22 nt, Human
ggggacugccuuccacagacac

SEQ ID NO: 390924 - RNA, 22 nt, Human
gccuguguggaugcgccggugc

SEQ ID NO: 390925 - RNA, 22 nt, Human
auccucaguguuucugacaucu

SEQ ID NO: 390926 - RNA, 22 nt, Human
auuuucaaaacaucugcugugu

SEQ ID NO: 390927 - RNA, 22 nt, Human
gccaggaggcuuaacuggacag

SEQ ID NO: 390928 - RNA, 22 nt, Human
uucuaguguccuuggacuugcu

SEQ ID NO: 390929 - RNA, 22 nt, Human
aauaucaacaguguccuucuaa

SEQ ID NO: 390930 - RNA, 22 nt, Human
uuuggacaaguuacugguuucc

SEQ ID NO: 390931 - RNA, 22 nt, Human
acaugcuuccaaauuauguugg

SEQ ID NO: 390932 - RNA, 18 nt, Human
aucuuuccauagcauguu

SEQ ID NO: 390933 - RNA, 22 nt, Human
auccuugaacuuagacacuagg

SEQ ID NO: 390934 - RNA, 23 nt, Human
uugauacagaagaaucaguuugu

SEQ ID NO: 390935 - RNA, 18 nt, Human
ccuggaccugucuccuuu

SEQ ID NO: 390936 - RNA, 22 nt, Human
aagauauagauggugguauaaa

SEQ ID NO: 390937 - RNA, 22 nt, Human
gagaggcugaaaucacaggagc

SEQ ID NO: 390938 - RNA, 22 nt, Human
aguggcagaagucacuggguag

SEQ ID NO: 390939 - RNA, 22 nt, Human
agcauccaacaggagggaaggg

SEQ ID NO: 390940 - RNA, 22 nt, Human
gauuuuucaguauaaaauauau

SEQ ID NO: 390941 - RNA, 21 nt, Human
aggaggggucuuucccacuga

SEQ ID NO: 390942 - RNA, 22 nt, Human
agaaaaacuaagaguggguggu

SEQ ID NO: 390943 - RNA, 22 nt, Human
ggcacagggagccgcaguugca

SEQ ID NO: 390944 - RNA, 22 nt, Human
ggcagugaugucaaacagugaa

SEQ ID NO: 390945 - RNA, 22 nt, Human
caguaggaaggaugcagaaaaa

SEQ ID NO: 390946 - RNA, 22 nt, Human
caggaggggguggaguuucgcc

SEQ ID NO: 390947 - RNA, 22 nt, Human
uuagagucaagcugcauguucu

SEQ ID NO: 390948 - RNA, 22 nt, Human
cuccagugcacccagaggauuu

SEQ ID NO: 390949 - RNA, 22 nt, Human
auuaaauguuggacguauacau

SEQ ID NO: 390950 - RNA, 22 nt, Human
gcuggccaguguggugaccacc

SEQ ID NO: 390951 - RNA, 22 nt, Human
uuucuuauauucugucauuguu

SEQ ID NO: 390952 - RNA, 22 nt, Human
acaacaggguaaggcaggccau

SEQ ID NO: 390953 - RNA, 22 nt, Human
cugaagagcucuccuguccccu

SEQ ID NO: 390954 - RNA, 22 nt, Human
ggcuuucuaugaacucaaaggc

SEQ ID NO: 390955 - RNA, 22 nt, Human
uuaaacagucccagaggcugac

SEQ ID NO: 390956 - RNA, 22 nt, Human
uccugccuguuuaccuguacuu

SEQ ID NO: 390957 - RNA, 22 nt, Human
ugcuggccaauggcagaggcgg

SEQ ID NO: 390958 - RNA, 18 nt, Human
gucacuguguuucugagc

SEQ ID NO: 390959 - RNA, 22 nt, Human
ucaguuuuguauguuguaaguc

SEQ ID NO: 390960 - RNA, 22 nt, Human
uucugaggcacuggcucuccca

SEQ ID NO: 390961 - RNA, 22 nt, Human
ggcagugaaugaaacagaggcu

SEQ ID NO: 390962 - RNA, 21 nt, Human
cucuggagucaagagcuucca

SEQ ID NO: 390963 - RNA, 22 nt, Human
uccaggaggaggaaggcugcca

SEQ ID NO: 390964 - RNA, 22 nt, Human
ucacacagauugguagagcuga

SEQ ID NO: 390965 - RNA, 22 nt, Human
aaugugauuagccucuacugga

SEQ ID NO: 390966 - RNA, 22 nt, Human
agccuggccacucagggccuga

SEQ ID NO: 390967 - RNA, 22 nt, Human
gcugccugguuucucagcugca

SEQ ID NO: 390968 - RNA, 19 nt, Human
ccagcccugucacuucuug

SEQ ID NO: 390969 - RNA, 22 nt, Human
ugcaccauguaaguggccacgu

SEQ ID NO: 390970 - RNA, 22 nt, Human
aggcagcucuguggccucccag

SEQ ID NO: 390971 - RNA, 20 nt, Human
gcagcuacucugucucgcuc

SEQ ID NO: 390972 - RNA, 22 nt, Human
gugggccuugcagggugcaggg

SEQ ID NO: 390973 - RNA, 22 nt, Human
cugcagccucaaccuccugagc

SEQ ID NO: 390974 - RNA, 20 nt, Human
acaguggaaauugaugucug

SEQ ID NO: 390975 - RNA, 22 nt, Human
auacuuacuuuucuucagacua

SEQ ID NO: 390976 - RNA, 22 nt, Human
acaaugaacacacaaggaauuc

SEQ ID NO: 390977 - RNA, 22 nt, Human
agauguggccggcuagggagag

SEQ ID NO: 390978 - RNA, 22 nt, Human
uggcucagaguucaucuuuuag

SEQ ID NO: 390979 - RNA, 22 nt, Human
augcuguggccagaguucaacu

SEQ ID NO: 390980 - RNA, 22 nt, Human
uuuccaaauaaggucacauucu

SEQ ID NO: 390981 - RNA, 22 nt, Human
gcagggcaggauuugaacccag

SEQ ID NO: 390982 - RNA, 22 nt, Human
uccaggagaggccugaccaggu

SEQ ID NO: 390983 - RNA, 22 nt, Human
gcugccucuguagcuuuggacc

SEQ ID NO: 390984 - RNA, 18 nt, Human
acaggccucaguccugca

SEQ ID NO: 390985 - RNA, 22 nt, Human
aggggugaaagagggcccucaa

SEQ ID NO: 390986 - RNA, 22 nt, Human
ucucgacagccuggcacagugg

SEQ ID NO: 390987 - RNA, 22 nt, Human
uuugaaaguccuaggagagucc

SEQ ID NO: 390988 - RNA, 22 nt, Human
uggucucuucuuccaagauggc

SEQ ID NO: 390989 - RNA, 22 nt, Human
gggauggggagcuggaaagggg

SEQ ID NO: 390990 - RNA, 22 nt, Human
cagcaggacauggaggaguaaa

SEQ ID NO: 390991 - RNA, 22 nt, Human
ugcuguggcaguuuauguauag

SEQ ID NO: 390992 - RNA, 22 nt, Human
ggugaagguggaacgcagagca

SEQ ID NO: 390993 - RNA, 22 nt, Human
gaggugggagggcagucccuaa

SEQ ID NO: 390994 - RNA, 22 nt, Human
cacucugagaaguacaagcucc

SEQ ID NO: 390995 - RNA, 22 nt, Human
ucagcagggccuccuugugcag

SEQ ID NO: 390996 - RNA, 21 nt, Human
acuuuaauauacaugaggagg

SEQ ID NO: 390997 - RNA, 22 nt, Human
gcccaucaucacuguggaggcu

SEQ ID NO: 390998 - RNA, 22 nt, Human
gucuggaguggggccugagaau

SEQ ID NO: 390999 - RNA, 22 nt, Human
aaguaaaauguuuccuuuauua

SEQ ID NO: 391000 - RNA, 22 nt, Human
aaaacauguccauacagaaacu

SEQ ID NO: 391001 - RNA, 22 nt, Human
aacccuggggcagcugcuaggg

SEQ ID NO: 391002 - RNA, 22 nt, Human
aagacauugucauuuuauaauu

SEQ ID NO: 391003 - RNA, 22 nt, Human
gcuucucucucagacugcaagc

SEQ ID NO: 391004 - RNA, 22 nt, Human
uuggagguuugaaaauaugugu

SEQ ID NO: 391005 - RNA, 22 nt, Human
uaauuccaccuuuuuccaacuu

SEQ ID NO: 391006 - RNA, 22 nt, Human
uuucauuacguguuugacuugu

SEQ ID NO: 391007 - RNA, 22 nt, Human
cucacugcaaguuccaccuacc

SEQ ID NO: 391008 - RNA, 22 nt, Human
acagagagaauuggguuuacag

SEQ ID NO: 391009 - RNA, 22 nt, Human
acaaaggugcgucccuucagcu

SEQ ID NO: 391010 - RNA, 22 nt, Human
agcugucugucuccugaggaga

SEQ ID NO: 391011 - RNA, 22 nt, Human
uucagagagaccaaguggcgug

SEQ ID NO: 391012 - RNA, 22 nt, Human
aggcagcuuuaacugguaguag

SEQ ID NO: 391013 - RNA, 22 nt, Human
uagaacacuugaccacugcucc

SEQ ID NO: 391014 - RNA, 22 nt, Human
uuugugaagggaacagaagugu

SEQ ID NO: 391015 - RNA, 22 nt, Human
ccucccacuucuugcugagguc

SEQ ID NO: 391016 - RNA, 22 nt, Human
accugcagcugagaaaaugacu

SEQ ID NO: 391017 - RNA, 22 nt, Human
ugaggccaggaucccaggcucu

SEQ ID NO: 391018 - RNA, 22 nt, Human
ggagagaaauugagguagcaag

SEQ ID NO: 391019 - RNA, 22 nt, Human
acuucaugcagaagagagcugu

SEQ ID NO: 391020 - RNA, 22 nt, Human
uggcugaguaaguugugauaug

SEQ ID NO: 391021 - RNA, 22 nt, Human
uuuauuugaaucaggggagaau

SEQ ID NO: 391022 - RNA, 22 nt, Human
gcugcuccgucugagcucuggu

SEQ ID NO: 391023 - RNA, 22 nt, Human
aucucccagccacagcauucuu

SEQ ID NO: 391024 - RNA, 21 nt, Human
ucuuugcaucaguuguuuucu

SEQ ID NO: 391025 - RNA, 22 nt, Human
cucugagcugaaacaugagcau

SEQ ID NO: 391026 - RNA, 22 nt, Human
uaagaaucugcauuuuaacaag

SEQ ID NO: 391027 - RNA, 22 nt, Human
aacaaaugaccugauuucuucc

SEQ ID NO: 391028 - RNA, 22 nt, Human
cugggcugucccaaccccaucc

SEQ ID NO: 391029 - RNA, 22 nt, Human
ucuguucaguugauuagacaga

SEQ ID NO: 391030 - RNA, 22 nt, Human
gucaaacagccuccuguucuaa

SEQ ID NO: 391031 - RNA, 22 nt, Human
aaaaauagcuucucuugucccu

SEQ ID NO: 391032 - RNA, 22 nt, Human
uuaugaaggaucagguacuugg

SEQ ID NO: 391033 - RNA, 22 nt, Human
ugaggcagaaauuccuguuuuc

SEQ ID NO: 391034 - RNA, 22 nt, Human
gcagagcuaucuucuggauuug

SEQ ID NO: 391035 - RNA, 22 nt, Human
gaaggaaaucugugauuuaugc

SEQ ID NO: 391036 - RNA, 22 nt, Human
gcugagaguccaggaaaacauc

SEQ ID NO: 391037 - RNA, 22 nt, Human
uggcugggccgggccuugugcc

SEQ ID NO: 391038 - RNA, 22 nt, Human
acaaaaagggagaugagguaga

SEQ ID NO: 391039 - RNA, 22 nt, Human
agaccagcugccucccagggcc

SEQ ID NO: 391040 - RNA, 22 nt, Human
cuggcagcauuaacagagagca

SEQ ID NO: 391041 - RNA, 22 nt, Human
cagcugagcucccaggccauca

SEQ ID NO: 391042 - RNA, 22 nt, Human
ggccagagucuauaugcagaca

SEQ ID NO: 391043 - RNA, 22 nt, Human
uuucuucauagaccuugucuug

SEQ ID NO: 391044 - RNA, 23 nt, Human
uuuaacuuuccaauaauucauug

SEQ ID NO: 391045 - RNA, 22 nt, Human
ccugggcaacauagugagaccc

SEQ ID NO: 391046 - RNA, 18 nt, Human
uggugaaggguggaggag

SEQ ID NO: 391047 - RNA, 22 nt, Human
aggcacagcacaccuggccccc

SEQ ID NO: 391048 - RNA, 22 nt, Human
gguuugaacagcuuuggagaag

SEQ ID NO: 391049 - RNA, 22 nt, Human
gaggagcacaugaggcugaggg

SEQ ID NO: 391050 - RNA, 22 nt, Human
ggcacugacacuagcauggcac

SEQ ID NO: 391051 - RNA, 22 nt, Human
cugucuguuucugauucaaccu

SEQ ID NO: 391052 - RNA, 22 nt, Human
ccuccaaguuugacucaggaca

SEQ ID NO: 391053 - RNA, 22 nt, Human
gccaccucuuugucucugccgc

SEQ ID NO: 391054 - RNA, 22 nt, Human
aagaggaaaugauugacuauau

SEQ ID NO: 391055 - RNA, 22 nt, Human
agaauuucaaauggaaguuuua

SEQ ID NO: 391056 - RNA, 22 nt, Human
aaggccaugcacauccuaggca

SEQ ID NO: 391057 - RNA, 22 nt, Human
uuuucuaacaucuaguaauuug

SEQ ID NO: 391058 - RNA, 22 nt, Human
uccagagguauguagagaguau

SEQ ID NO: 391059 - RNA, 22 nt, Human
cugccaucugagccaaaagugc

SEQ ID NO: 391060 - RNA, 23 nt, Human
ugccagaggcagucacaguggug

SEQ ID NO: 391061 - RNA, 22 nt, Human
uuaaaaugaauauugauuagca

SEQ ID NO: 391062 - RNA, 20 nt, Human
aggaaaaauggaaacuggag

SEQ ID NO: 391063 - RNA, 20 nt, Human
gagauggcuaagugcugaac

SEQ ID NO: 391064 - RNA, 22 nt, Human
uccagucaagcuugagaauuuc

SEQ ID NO: 391065 - RNA, 22 nt, Human
aguucacagccauguucaugug

SEQ ID NO: 391066 - RNA, 22 nt, Human
auaaaaguaggaccaacuuaca

SEQ ID NO: 391067 - RNA, 22 nt, Human
aucaggauuacacggggaugcu

SEQ ID NO: 391068 - RNA, 22 nt, Human
uccaucaccacagaggacagag

SEQ ID NO: 391069 - RNA, 22 nt, Human
aaauucuaugucaauguuuauu

SEQ ID NO: 391070 - RNA, 22 nt, Human
gauuucaaagguucugcaugcc

SEQ ID NO: 391071 - RNA, 22 nt, Human
auuuguuccacacauauuuacu

SEQ ID NO: 391072 - RNA, 22 nt, Human
cagugaggugcccagccugccc

SEQ ID NO: 391073 - RNA, 22 nt, Human
ccaggaguggcuggugaccuuc

SEQ ID NO: 391074 - RNA, 22 nt, Human
aaggcagccgugugacugcaug

SEQ ID NO: 391075 - RNA, 22 nt, Human
caaauacuggguaaguuaauuu

SEQ ID NO: 391076 - RNA, 20 nt, Human
caguccaaucagaggccacc

SEQ ID NO: 391077 - RNA, 22 nt, Human
aucuggcucuuccuggaguucc

SEQ ID NO: 391078 - RNA, 22 nt, Human
gauuucuugaccccugucucag

SEQ ID NO: 391079 - RNA, 22 nt, Human
uccauuuuguagguaugcuaca

SEQ ID NO: 391080 - RNA, 20 nt, Human
agagaauucccuuuggagau

SEQ ID NO: 391081 - RNA, 22 nt, Human
gucauauacacugcauguaauc

SEQ ID NO: 391082 - RNA, 22 nt, Human
cccugcugucaggugcugggag

SEQ ID NO: 391083 - RNA, 22 nt, Human
aaaugucuuugaguauuucugc

SEQ ID NO: 391084 - RNA, 22 nt, Human
gcuggggagcaagaguagugag

SEQ ID NO: 391085 - RNA, 21 nt, Human
ucagagaacccggcaggcaag

SEQ ID NO: 391086 - RNA, 22 nt, Human
cuuccccaaccccgacugugug

SEQ ID NO: 391087 - RNA, 22 nt, Human
gaggucaggcuugcagcagggu

SEQ ID NO: 391088 - RNA, 22 nt, Human
aucuugcauuugcuaaaaugca

SEQ ID NO: 391089 - RNA, 22 nt, Human
ucagcugagcuccagcucauag

SEQ ID NO: 391090 - RNA, 22 nt, Human
guuugucuuaauuaggcaucga

SEQ ID NO: 391091 - RNA, 20 nt, Human
aacacacugguggcaucagg

SEQ ID NO: 391092 - RNA, 21 nt, Human
aauccuuaaugaggaguuggu

SEQ ID NO: 391093 - RNA, 22 nt, Human
aaauugcagaugcuaaaugacu

SEQ ID NO: 391094 - RNA, 19 nt, Human
caucuggaugauucuccug

SEQ ID NO: 391095 - RNA, 23 nt, Human
ucuguacacaucagcaucuccca

SEQ ID NO: 391096 - RNA, 22 nt, Human
ugcagcuccucuggcugccuga

SEQ ID NO: 391097 - RNA, 22 nt, Human
accaggggaugguuggcacugu

SEQ ID NO: 391098 - RNA, 22 nt, Human
cccaggaggcagaaguugcagu

SEQ ID NO: 391099 - RNA, 22 nt, Human
uuuaucacagaauaagaaguca

SEQ ID NO: 391100 - RNA, 22 nt, Human
aagcagcacaguaauauuggug

SEQ ID NO: 391101 - RNA, 22 nt, Human
gacuacucaaacuuucucuaua

SEQ ID NO: 391102 - RNA, 22 nt, Human
guggauggauuuugaggaaugg

SEQ ID NO: 391103 - RNA, 22 nt, Human
gcagggcagcuuagucccuguc

SEQ ID NO: 391104 - RNA, 22 nt, Human
ucauggauggccgggaggugau

SEQ ID NO: 391105 - RNA, 21 nt, Human
gaaggagaaagcaagugcugc

SEQ ID NO: 391106 - RNA, 22 nt, Human
auauuaaauggauuuugggagc

SEQ ID NO: 391107 - RNA, 22 nt, Human
ucaggagaacuuccuucuaccc

SEQ ID NO: 391108 - RNA, 22 nt, Human
aggaagcuccaugaaggcagag

SEQ ID NO: 391109 - RNA, 22 nt, Human
cauucacauucuucuuacuguu

SEQ ID NO: 391110 - RNA, 22 nt, Human
uccauuuucuaaguaucacuua

SEQ ID NO: 391111 - RNA, 22 nt, Human
cagggagggacaauugucaccu

SEQ ID NO: 391112 - RNA, 22 nt, Human
aaaggccacacagagcagggag

SEQ ID NO: 391113 - RNA, 22 nt, Human
cagcugaagaaagagugguuag

SEQ ID NO: 391114 - RNA, 22 nt, Human
aagcugccauagaacgagaggu

SEQ ID NO: 391115 - RNA, 22 nt, Human
cuacugaguccuucagcugcca

SEQ ID NO: 391116 - RNA, 22 nt, Human
uucuacaauaugaauaaugaag

SEQ ID NO: 391117 - RNA, 22 nt, Human
uggcuagcccuuguggggagag

SEQ ID NO: 391118 - RNA, 22 nt, Human
uggcagcugguacagugggucu

SEQ ID NO: 391119 - RNA, 22 nt, Human
gcccaggaagccaccgggaagu

SEQ ID NO: 391120 - RNA, 22 nt, Human
cuggcuccuccaaggccuggag

SEQ ID NO: 391121 - RNA, 22 nt, Human
agucccagugagaugaaccagg

SEQ ID NO: 391122 - RNA, 22 nt, Human
cuggggcuggugaggcaggcuc

SEQ ID NO: 391123 - RNA, 22 nt, Human
ggugggcacauucagucucugu

SEQ ID NO: 391124 - RNA, 19 nt, Human
cugaagucuuuucagcugg

SEQ ID NO: 391125 - RNA, 22 nt, Human
ggccaggcugguuccuugaccu

SEQ ID NO: 391126 - RNA, 21 nt, Human
gauuucacuuaccuucauuua

SEQ ID NO: 391127 - RNA, 22 nt, Human
uggagcaagcuggagagaacau

SEQ ID NO: 391128 - RNA, 20 nt, Human
auguaaaauuauaaggcuga

SEQ ID NO: 391129 - RNA, 22 nt, Human
uccaggcaugucccaagccgga

SEQ ID NO: 391130 - RNA, 22 nt, Human
cccaugagguggagguugcagu

SEQ ID NO: 391131 - RNA, 23 nt, Human
aaguacauauauuuagauaguga

SEQ ID NO: 391132 - RNA, 22 nt, Human
aaagguuaguucuuagaagugc

SEQ ID NO: 391133 - RNA, 19 nt, Human
ccaggccucuggggccugu

SEQ ID NO: 391134 - RNA, 20 nt, Human
aagagcauaguacaggaaga

SEQ ID NO: 391135 - RNA, 22 nt, Human
ucauuucaaugauacuacuaag

SEQ ID NO: 391136 - RNA, 22 nt, Human
uuucuucaauugcuaacaagga

SEQ ID NO: 391137 - RNA, 22 nt, Human
ucucagagagcuguguuuuccu

SEQ ID NO: 391138 - RNA, 22 nt, Human
aaaucaguaaauguucauuaac

SEQ ID NO: 391139 - RNA, 22 nt, Human
aagccacuauggugauucucaa

SEQ ID NO: 391140 - RNA, 22 nt, Human
ccaggagaugggagcaucuaaa

SEQ ID NO: 391141 - RNA, 22 nt, Human
agggugggcuagacucuucccc

SEQ ID NO: 391142 - RNA, 22 nt, Human
auauucuuccaaaacaucauuu

SEQ ID NO: 391143 - RNA, 22 nt, Human
ggagcacuauaauagagauuuu

SEQ ID NO: 391144 - RNA, 22 nt, Human
ggcuggcucagggcuugagaga

SEQ ID NO: 391145 - RNA, 19 nt, Human
acagaaauguaagugagac

SEQ ID NO: 391146 - RNA, 22 nt, Human
ugauuuccuggcuuuggaguuc

SEQ ID NO: 391147 - RNA, 22 nt, Human
ucagaaauuuucucaguaguuc

SEQ ID NO: 391148 - RNA, 22 nt, Human
ccaggguggggcaggcccacug

SEQ ID NO: 391149 - RNA, 22 nt, Human
gccuggagaccugcuccucuac

SEQ ID NO: 391150 - RNA, 22 nt, Human
ccccuuccuuccucagacagcc

SEQ ID NO: 391151 - RNA, 22 nt, Human
aggcugaggcgggaggaucacu

SEQ ID NO: 391152 - RNA, 22 nt, Human
gggcaguuuauucuagaugguu

SEQ ID NO: 391153 - RNA, 22 nt, Human
ucaggugggaccugcuaggaca

SEQ ID NO: 391154 - RNA, 22 nt, Human
gcuguccugggaacaggcacua

SEQ ID NO: 391155 - RNA, 23 nt, Human
gcccaugcuguugggcccgagca

SEQ ID NO: 391156 - RNA, 22 nt, Human
ccccaggacguggcccucauag

SEQ ID NO: 391157 - RNA, 22 nt, Human
gccaggcugcuggcugcugucc

SEQ ID NO: 391158 - RNA, 22 nt, Human
aggcacagagaaugcccuccau

SEQ ID NO: 391159 - RNA, 22 nt, Human
ucuuuccuaggugauaugcaau

SEQ ID NO: 391160 - RNA, 22 nt, Human
uuccuuguuuguagcucuggga

SEQ ID NO: 391161 - RNA, 22 nt, Human
caggcuggagugcaguugugca

SEQ ID NO: 391162 - RNA, 22 nt, Human
ugcugagaucugccaguagaug

SEQ ID NO: 391163 - RNA, 22 nt, Human
agccuucagcaguucaggugcc

SEQ ID NO: 391164 - RNA, 22 nt, Human
uggacagguugaguaggaggag

SEQ ID NO: 391165 - RNA, 22 nt, Human
cuucucaguugcaagugucaga

SEQ ID NO: 391166 - RNA, 22 nt, Human
agcagggcucugccaugggccc

SEQ ID NO: 391167 - RNA, 22 nt, Human
aggggagccccugguccuggug

SEQ ID NO: 391168 - RNA, 22 nt, Human
cugacuguaauucuguucuuaa

SEQ ID NO: 391169 - RNA, 22 nt, Human
gcagcuuuaaucugaauaagua

SEQ ID NO: 391170 - RNA, 22 nt, Human
uagcaggguaaauguagaugga

SEQ ID NO: 391171 - RNA, 19 nt, Human
cuggugcuugagugaguca

SEQ ID NO: 391172 - RNA, 22 nt, Human
gccugcagggccugggccuacc

SEQ ID NO: 391173 - RNA, 22 nt, Human
uuucauggcuaggacuagagug

SEQ ID NO: 391174 - RNA, 22 nt, Human
aggucaaaccacagcucuaggc

SEQ ID NO: 391175 - RNA, 22 nt, Human
cagggcagagggaaacuccuuu

SEQ ID NO: 391176 - RNA, 22 nt, Human
accugagggcccaaacuuggua

SEQ ID NO: 391177 - RNA, 22 nt, Human
acaggcucuggggcaggauggc

SEQ ID NO: 391178 - RNA, 23 nt, Human
ucucaggacacacaugucuauca

SEQ ID NO: 391179 - RNA, 22 nt, Human
guccucuuagccacuuaauuau

SEQ ID NO: 391180 - RNA, 19 nt, Human
ugcugaaguugucagucug

SEQ ID NO: 391181 - RNA, 19 nt, Human
ccaggccuccugggagguc

SEQ ID NO: 391182 - RNA, 20 nt, Human
ugaagcagccuugauucugu

SEQ ID NO: 391183 - RNA, 22 nt, Human
cagcucugaggaacacuccuuu

SEQ ID NO: 391184 - RNA, 22 nt, Human
guccuggggauuauagaguguu

SEQ ID NO: 391185 - RNA, 18 nt, Human
ggacaucaucaggugcuu

SEQ ID NO: 391186 - RNA, 22 nt, Human
ccagggcacuuaggcccagccc

SEQ ID NO: 391187 - RNA, 17 nt, Human
cuguuaauucauuuccc

SEQ ID NO: 391188 - RNA, 18 nt, Human
gagaggagccagaauuuu

SEQ ID NO: 391189 - RNA, 22 nt, Human
auuucucuuagcaagacauuac

SEQ ID NO: 391190 - RNA, 22 nt, Human
gaugccucuuuuggcugaauua

SEQ ID NO: 391191 - RNA, 22 nt, Human
uuuaauuuuccucuuccuggag

SEQ ID NO: 391192 - RNA, 22 nt, Human
cucgcaggacagugcuaggacu

SEQ ID NO: 391193 - RNA, 22 nt, Human
gagacugcauuguccaaggguu

SEQ ID NO: 391194 - RNA, 23 nt, Human
uuacaguaggaguuggaaaacca

SEQ ID NO: 391195 - RNA, 22 nt, Human
ccaggagcaccaggccugugcc

SEQ ID NO: 391196 - RNA, 21 nt, Human
gccaccccuggcacaggugcu

SEQ ID NO: 391197 - RNA, 22 nt, Human
ccaggugucuguggccagcccu

SEQ ID NO: 391198 - RNA, 22 nt, Human
uucacaauaggagcaugcaaau

SEQ ID NO: 391199 - RNA, 22 nt, Human
ccagcuuuuccucucauugcuu

SEQ ID NO: 391200 - RNA, 22 nt, Human
uccaugggaagauuuugagugg

SEQ ID NO: 391201 - RNA, 22 nt, Human
gaggcagagaccuucaggaccu

SEQ ID NO: 391202 - RNA, 22 nt, Human
acaaaggcaggauugacuuagu

SEQ ID NO: 391203 - RNA, 22 nt, Human
uuugcauuugcaaauaaugaaa

SEQ ID NO: 391204 - RNA, 18 nt, Human
caggucagccuggccuca

SEQ ID NO: 391205 - RNA, 21 nt, Human
guggcccugguguggcugcac

SEQ ID NO: 391206 - RNA, 22 nt, Human
gccaggagagcuccuucagguu

SEQ ID NO: 391207 - RNA, 22 nt, Human
cccagcauggagugaggacuca

SEQ ID NO: 391208 - RNA, 22 nt, Human
gaaggagagggucaaggauaau

SEQ ID NO: 391209 - RNA, 22 nt, Human
aaggcugccucugccagaggag

SEQ ID NO: 391210 - RNA, 22 nt, Human
ugaaaugagauaauuuaagugc

SEQ ID NO: 391211 - RNA, 22 nt, Human
caauuucagguggauagguuuu

SEQ ID NO: 391212 - RNA, 22 nt, Human
uucauucauuacgugccaggca

SEQ ID NO: 391213 - RNA, 22 nt, Human
ugcagggacacgaagacaaaua

SEQ ID NO: 391214 - RNA, 22 nt, Human
gcugucuggaggcucugaggga

SEQ ID NO: 391215 - RNA, 22 nt, Human
uggcucagugcauucacaguaa

SEQ ID NO: 391216 - RNA, 18 nt, Human
uggcagcuagguaaagaa

SEQ ID NO: 391217 - RNA, 21 nt, Human
cauuagggcagaagcaggaag

SEQ ID NO: 391218 - RNA, 22 nt, Human
gcaccugauugauuucacugcu

SEQ ID NO: 391219 - RNA, 22 nt, Human
ugggaaauguguuucuggacca

SEQ ID NO: 391220 - RNA, 22 nt, Human
cuggccacaugugugcugagca

SEQ ID NO: 391221 - RNA, 22 nt, Human
agccucugucaagcuuuucaaa

SEQ ID NO: 391222 - RNA, 22 nt, Human
uuuccauauuuggucuuuggga

SEQ ID NO: 391223 - RNA, 23 nt, Human
uuucuguuggguauauauccaag

SEQ ID NO: 391224 - RNA, 22 nt, Human
uggcauuucuggccauuugugu

SEQ ID NO: 391225 - RNA, 22 nt, Human
ucuuaaaccacaaaauucagag

SEQ ID NO: 391226 - RNA, 22 nt, Human
ugucuguaagguguuuauguua

SEQ ID NO: 391227 - RNA, 22 nt, Human
uccagaauacucugaaaucauu

SEQ ID NO: 391228 - RNA, 22 nt, Human
gaggaagaauugguuauuggag

SEQ ID NO: 391229 - RNA, 22 nt, Human
ugcuauacauguacauauuagu

SEQ ID NO: 391230 - RNA, 23 nt, Human
agaggcaggaguggcuugcccgg

SEQ ID NO: 391231 - RNA, 22 nt, Human
gaugggggccagggccugcuuu

SEQ ID NO: 391232 - RNA, 22 nt, Human
aaucaguuucuuggcaaguuua

SEQ ID NO: 391233 - RNA, 22 nt, Human
cagugcaugaaacaauaugcag

SEQ ID NO: 391234 - RNA, 22 nt, Human
ggccugaggcaauagucagaca

SEQ ID NO: 391235 - RNA, 22 nt, Human
uugcacaugauagaugauuucu

SEQ ID NO: 391236 - RNA, 22 nt, Human
uauacagaacugcacgugcacg

SEQ ID NO: 391237 - RNA, 22 nt, Human
cauguuuacuaccaggagaaug

SEQ ID NO: 391238 - RNA, 22 nt, Human
gucauuguguggacauggagaa

SEQ ID NO: 391239 - RNA, 22 nt, Human
agccaggauggucucgaucggc

SEQ ID NO: 391240 - RNA, 22 nt, Human
ggcucugguugaccaugauggc

SEQ ID NO: 391241 - RNA, 22 nt, Human
uccuggaggggacagcaugggc

SEQ ID NO: 391242 - RNA, 22 nt, Human
uuauguaccugaauuaguaaag

SEQ ID NO: 391243 - RNA, 19 nt, Human
ugcauaaauuauauacuuu

SEQ ID NO: 391244 - RNA, 22 nt, Human
ugggcugagcacugaggaagga

SEQ ID NO: 391245 - RNA, 22 nt, Human
caccagacagguguaugcauau

SEQ ID NO: 391246 - RNA, 22 nt, Human
uggccugaggcucggcaugggu

SEQ ID NO: 391247 - RNA, 22 nt, Human
ggcuucaccgcgggguugcagg

SEQ ID NO: 391248 - RNA, 23 nt, Human
ggcagcucucaucugaugacuga

SEQ ID NO: 391249 - RNA, 22 nt, Human
gcugggcuucucaaugcugccu

SEQ ID NO: 391250 - RNA, 22 nt, Human
agccuggacagcuacggagaac

SEQ ID NO: 391251 - RNA, 22 nt, Human
uccagggaucuuuagagucuuu

SEQ ID NO: 391252 - RNA, 22 nt, Human
uucuugcucaaugucuguuuaa

SEQ ID NO: 391253 - RNA, 22 nt, Human
acaaaguuauucuuucagagga

SEQ ID NO: 391254 - RNA, 22 nt, Human
ugaaggaaagagggaacauccc

SEQ ID NO: 391255 - RNA, 18 nt, Human
gccugggaggaggaaaug

SEQ ID NO: 391256 - RNA, 22 nt, Human
ccagagccggauugugaagugc

SEQ ID NO: 391257 - RNA, 22 nt, Human
aaaaacugcaauuacuuuuguc

SEQ ID NO: 391258 - RNA, 22 nt, Human
gcucugcugaagccccuugcau

SEQ ID NO: 391259 - RNA, 22 nt, Human
gcuguggccgucagggaaaugg

SEQ ID NO: 391260 - RNA, 22 nt, Human
auuucuguauccugcugucaga

SEQ ID NO: 391261 - RNA, 22 nt, Human
cccagccucuggauucugcccu

SEQ ID NO: 391262 - RNA, 22 nt, Human
ucugcaggacugaggccuguuu

SEQ ID NO: 391263 - RNA, 22 nt, Human
auaugcaagcacauagaauacu

SEQ ID NO: 391264 - RNA, 19 nt, Human
ugugaaagcuaguguucuu

SEQ ID NO: 391265 - RNA, 22 nt, Human
agcccagccggauucccaguuc

SEQ ID NO: 391266 - RNA, 22 nt, Human
cucaggccauucuuccagcugc

SEQ ID NO: 391267 - RNA, 23 nt, Human
cccuguagcccaggacaggcuuu

SEQ ID NO: 391268 - RNA, 22 nt, Human
agagccaggacugugucucacu

SEQ ID NO: 391269 - RNA, 22 nt, Human
augcaccugaacuccaucagcu

SEQ ID NO: 391270 - RNA, 22 nt, Human
ugggcagggucucuguuaucag

SEQ ID NO: 391271 - RNA, 22 nt, Human
gugcagagaaaugagaagucga

SEQ ID NO: 391272 - RNA, 22 nt, Human
uccugcagguggaugauucucu

SEQ ID NO: 391273 - RNA, 22 nt, Human
uuucacauaugguuguugauug

SEQ ID NO: 391274 - RNA, 22 nt, Human
uggcucagucuggguugacuga

SEQ ID NO: 391275 - RNA, 20 nt, Human
ugcucugucuaaaacuuccc

SEQ ID NO: 391276 - RNA, 22 nt, Human
gccuucagcccugacuggccag

SEQ ID NO: 391277 - RNA, 22 nt, Human
agagggauaauauguauuguaa

SEQ ID NO: 391278 - RNA, 22 nt, Human
ccucugcucugguccaugugcu

SEQ ID NO: 391279 - RNA, 22 nt, Human
aacccagccguguagcugccgc

SEQ ID NO: 391280 - RNA, 22 nt, Human
uaagagaacuggauagauagga

SEQ ID NO: 391281 - RNA, 22 nt, Human
caggguggggaaauagcgcccu

SEQ ID NO: 391282 - RNA, 22 nt, Human
ggcugccuccucgagacaggau

SEQ ID NO: 391283 - RNA, 22 nt, Human
uggcauuugggcuggcuuuucu

SEQ ID NO: 391284 - RNA, 22 nt, Human
gcaugugucuccccaguggagg

SEQ ID NO: 391285 - RNA, 22 nt, Human
gcccaggaagugacucagaugu

SEQ ID NO: 391286 - RNA, 22 nt, Human
accaaggagccacauacaaccu

SEQ ID NO: 391287 - RNA, 22 nt, Human
aggcagaggaaggguggauuug

SEQ ID NO: 391288 - RNA, 22 nt, Human
uguauguugggucaaaguacau

SEQ ID NO: 391289 - RNA, 22 nt, Human
aagccaaugagagaggccucag

SEQ ID NO: 391290 - RNA, 22 nt, Human
ucuguaucuaauuuuacaguag

SEQ ID NO: 391291 - RNA, 22 nt, Human
uccaggcaaagccuuguagacg

SEQ ID NO: 391292 - RNA, 20 nt, Human
ucccaagggcugagaggauc

SEQ ID NO: 391293 - RNA, 21 nt, Human
ccagccucagaucagggagcu

SEQ ID NO: 391294 - RNA, 22 nt, Human
ugauguucuguauaucauauag

SEQ ID NO: 391295 - RNA, 22 nt, Human
gagcuuccugaugccgaccagu

SEQ ID NO: 391296 - RNA, 22 nt, Human
uguguuuuacaaauucucuuaa

SEQ ID NO: 391297 - RNA, 22 nt, Human
agagccugcuguguaagucaca

SEQ ID NO: 391298 - RNA, 22 nt, Human
acccagagcugggcuuggcaaa

SEQ ID NO: 391299 - RNA, 22 nt, Human
ugaaacuaggccaaucaaauua

SEQ ID NO: 391300 - RNA, 22 nt, Human
cuuauuagugucugucugaguu

SEQ ID NO: 391301 - RNA, 22 nt, Human
aaggaggaauuucagggugaau

SEQ ID NO: 391302 - RNA, 22 nt, Human
guucaaggaagggaggaaagcc

SEQ ID NO: 391303 - RNA, 22 nt, Human
ugugcagcuaguccuggacuug

SEQ ID NO: 391304 - RNA, 22 nt, Human
aaguucaaggcucuagaguucc

SEQ ID NO: 391305 - RNA, 22 nt, Human
ugucucugauaaguaguucagu

SEQ ID NO: 391306 - RNA, 23 nt, Human
agcauggaauaggaaagaggcag

SEQ ID NO: 391307 - RNA, 22 nt, Human
aacaggcaggagaauucugccu

SEQ ID NO: 391308 - RNA, 22 nt, Human
uguacaauguguuuguuggcuu

SEQ ID NO: 391309 - RNA, 20 nt, Human
ggcugccuccuuccuuuccu

SEQ ID NO: 391310 - RNA, 22 nt, Human
auuccaaaggcuggccuggagg

SEQ ID NO: 391311 - RNA, 22 nt, Human
uaguuucagcuccuucauccug

SEQ ID NO: 391312 - RNA, 22 nt, Human
uuucacaacugcuuauuugaga

SEQ ID NO: 391313 - RNA, 22 nt, Human
ucuucuuccuccacagggccca

SEQ ID NO: 391314 - RNA, 22 nt, Human
caggagccccaggcugacaaua

SEQ ID NO: 391315 - RNA, 22 nt, Human
uggccaccccuuucucugcacu

SEQ ID NO: 391316 - RNA, 22 nt, Human
aagggacuuugucagcuuucca

SEQ ID NO: 391317 - RNA, 22 nt, Human
gaauuucagagguaacaucauc

SEQ ID NO: 391318 - RNA, 22 nt, Human
ucagaggagaugguuaccaggg

SEQ ID NO: 391319 - RNA, 22 nt, Human
uuuaaauaggacuccugggggu

SEQ ID NO: 391320 - RNA, 22 nt, Human
cagcucccgccaucgggaggca

SEQ ID NO: 391321 - RNA, 21 nt, Human
gcagccacugccuucaacaau

SEQ ID NO: 391322 - RNA, 22 nt, Human
gggaaggagccugcuugcuaga

SEQ ID NO: 391323 - RNA, 22 nt, Human
uuguaacaggcacucugugcca

SEQ ID NO: 391324 - RNA, 22 nt, Human
auuuccagugcacugaauagaa

SEQ ID NO: 391325 - RNA, 17 nt, Human
gcugccaccuuuggagc

SEQ ID NO: 391326 - RNA, 22 nt, Human
ugcagggccuucuagaccaugg

SEQ ID NO: 391327 - RNA, 22 nt, Human
ucuucuucccaucccucaaaug

SEQ ID NO: 391328 - RNA, 22 nt, Human
gcacccagagggcagggucucc

SEQ ID NO: 391329 - RNA, 22 nt, Human
cugcucugagaggcucuuccua

SEQ ID NO: 391330 - RNA, 19 nt, Human
aaucagaaauaucgaggcc

SEQ ID NO: 391331 - RNA, 22 nt, Human
ucauuuucacacauaaauagca

SEQ ID NO: 391332 - RNA, 19 nt, Human
ggaagagaggaaaggugga

SEQ ID NO: 391333 - RNA, 22 nt, Human
uggccucuuacgacauagccuu

SEQ ID NO: 391334 - RNA, 22 nt, Human
cauggccuugagugacugcacu

SEQ ID NO: 391335 - RNA, 22 nt, Human
aagauuauuuaagacaggaacc

SEQ ID NO: 391336 - RNA, 17 nt, Human
ggcugcugugcuggugc

SEQ ID NO: 391337 - RNA, 22 nt, Human
agcagccagaaagggcagucga

SEQ ID NO: 391338 - RNA, 16 nt, Human
ccaccugcagcucuca

SEQ ID NO: 391339 - RNA, 22 nt, Human
augugcaugcacuuacaugugu

SEQ ID NO: 391340 - RNA, 22 nt, Human
ugcagagggacagccacagcuc

SEQ ID NO: 391341 - RNA, 22 nt, Human
aaaaugugaucuacaaaugcaa

SEQ ID NO: 391342 - RNA, 22 nt, Human
gcaucuaaacuugcaucauugu

SEQ ID NO: 391343 - RNA, 22 nt, Human
aagucacaagcauauaugcauu

SEQ ID NO: 391344 - RNA, 22 nt, Human
uugcauuuccuguacuguuuga

SEQ ID NO: 391345 - RNA, 22 nt, Human
agcuggccuccgggugccuggg

SEQ ID NO: 391346 - RNA, 22 nt, Human
caguccuugcucugggaugaug

SEQ ID NO: 391347 - RNA, 22 nt, Human
gaguuauuucagaaggaaagau

SEQ ID NO: 391348 - RNA, 22 nt, Human
ggggauggaauguaguagugau

SEQ ID NO: 391349 - RNA, 22 nt, Human
ccaggcugcuuagccuuaucuu

SEQ ID NO: 391350 - RNA, 22 nt, Human
ugaaagguguccaauauuucuc

SEQ ID NO: 391351 - RNA, 22 nt, Human
uuagugucuucuucauccucug

SEQ ID NO: 391352 - RNA, 22 nt, Human
uuaggaaaggguuuucuaacag

SEQ ID NO: 391353 - RNA, 22 nt, Human
gggugggaacaggaugccagga

SEQ ID NO: 391354 - RNA, 22 nt, Human
aggagucagauuguuugaaugu

SEQ ID NO: 391355 - RNA, 22 nt, Human
gacagguggggaaacuaaggua

SEQ ID NO: 391356 - RNA, 22 nt, Human
guggugcauccuugaguaagcu

SEQ ID NO: 391357 - RNA, 22 nt, Human
uugauacauagcacaguuuagg

SEQ ID NO: 391358 - RNA, 22 nt, Human
uuuggaaugguaccuucaguug

SEQ ID NO: 391359 - RNA, 22 nt, Human
augguacaaaauguauaaaguc

SEQ ID NO: 391360 - RNA, 22 nt, Human
agaugcugugucuguucccuug

SEQ ID NO: 391361 - RNA, 22 nt, Human
uuucuguaaguggcaaauaaug

SEQ ID NO: 391362 - RNA, 22 nt, Human
uagcuuuaagaugagaugugga

SEQ ID NO: 391363 - RNA, 22 nt, Human
aauuaugagguagauaucacau

SEQ ID NO: 391364 - RNA, 22 nt, Human
aggagcuggaguccaggcaagu

SEQ ID NO: 391365 - RNA, 22 nt, Human
uuugaaaggguuaugagacuga

SEQ ID NO: 391366 - RNA, 20 nt, Human
agaggcuuccuugggaggag

SEQ ID NO: 391367 - RNA, 22 nt, Human
agaggugacauaggagaggcuc

SEQ ID NO: 391368 - RNA, 22 nt, Human
gcugccacauuuucaggacuaa

SEQ ID NO: 391369 - RNA, 22 nt, Human
ggccucugguucacagggagga

SEQ ID NO: 391370 - RNA, 22 nt, Human
caaauucaaugaacauguuuaa

SEQ ID NO: 391371 - RNA, 22 nt, Human
cagugcuccugauguacccuug

SEQ ID NO: 391372 - RNA, 22 nt, Human
gagacagaguuucacucuuguu

SEQ ID NO: 391373 - RNA, 22 nt, Human
cagggccugccugguuccugga

SEQ ID NO: 391374 - RNA, 22 nt, Human
guggcugcuaagucuccuuccu

SEQ ID NO: 391375 - RNA, 22 nt, Human
cucuuaguuuaucuuugacaaa

SEQ ID NO: 391376 - RNA, 22 nt, Human
aauuucaagucuugaagaagua

SEQ ID NO: 391377 - RNA, 22 nt, Human
gcccucuggcagccuuggcugg

SEQ ID NO: 391378 - RNA, 22 nt, Human
cggggcaggagucccuguagag

SEQ ID NO: 391379 - RNA, 18 nt, Human
gcccagaggucugggccc

SEQ ID NO: 391380 - RNA, 22 nt, Human
ggcugcugaguuggccaggaga

SEQ ID NO: 391381 - RNA, 22 nt, Human
gcagcagagcuuuguccuggcu

SEQ ID NO: 391382 - RNA, 22 nt, Human
agccuccuggaguuucugggau

SEQ ID NO: 391383 - RNA, 22 nt, Human
ucuucaauuuagaauggauuua

SEQ ID NO: 391384 - RNA, 22 nt, Human
uggagggcaucuguggucaggc

SEQ ID NO: 391385 - RNA, 22 nt, Human
agggcuggcuaggugcguuccc

SEQ ID NO: 391386 - RNA, 22 nt, Human
agcucccagcuccuuugagaga

SEQ ID NO: 391387 - RNA, 22 nt, Human
ucagcaaugagaacuggcauuu

SEQ ID NO: 391388 - RNA, 22 nt, Human
gaccugccugagcugccucugc

SEQ ID NO: 391389 - RNA, 22 nt, Human
ucacuguugaccuggaaguggg

SEQ ID NO: 391390 - RNA, 22 nt, Human
gggugaagcuccugcaggggcc

SEQ ID NO: 391391 - RNA, 22 nt, Human
acagagcaauucuuggguguuu

SEQ ID NO: 391392 - RNA, 20 nt, Human
gcacugaaauucaauguuug

SEQ ID NO: 391393 - RNA, 22 nt, Human
uuggcagugaugcagcuuguuc

SEQ ID NO: 391394 - RNA, 17 nt, Human
ugcauguccuuuguucc

SEQ ID NO: 391395 - RNA, 22 nt, Human
uacaacauuguguugcuucaua

SEQ ID NO: 391396 - RNA, 22 nt, Human
auugaaagagaauguagcucuu

SEQ ID NO: 391397 - RNA, 22 nt, Human
gggccacauugaagggugggua

SEQ ID NO: 391398 - RNA, 22 nt, Human
cuucauuaaugucuauaaguuu

SEQ ID NO: 391399 - RNA, 22 nt, Human
uguuccaucaguuuuugguuga

SEQ ID NO: 391400 - RNA, 22 nt, Human
gcagagaagaugcccaggcuuc

SEQ ID NO: 391401 - RNA, 22 nt, Human
uccagggcugacuugggagagg

SEQ ID NO: 391402 - RNA, 22 nt, Human
ucaugcccagagcaguaaauua

SEQ ID NO: 391403 - RNA, 20 nt, Human
ggcagcucacuacuuucugu

SEQ ID NO: 391404 - RNA, 22 nt, Human
caagcagacaguaggccuagaa

SEQ ID NO: 391405 - RNA, 22 nt, Human
caaguccucugguuucaaauag

SEQ ID NO: 391406 - RNA, 22 nt, Human
cgugucaucugagccuugggcg

SEQ ID NO: 391407 - RNA, 22 nt, Human
ccugggcucuauccugacccag

SEQ ID NO: 391408 - RNA, 22 nt, Human
cacagcugcccuacuccaugug

SEQ ID NO: 391409 - RNA, 22 nt, Human
gcugucugcugugcacugagca

SEQ ID NO: 391410 - RNA, 22 nt, Human
ggucccugaagaggccuggggu

SEQ ID NO: 391411 - RNA, 22 nt, Human
uagaaaugcccagauucugcua

SEQ ID NO: 391412 - RNA, 22 nt, Human
ugaaggcuguuggauggggaag

SEQ ID NO: 391413 - RNA, 23 nt, Human
aggcagcuggguagcaucuuucu

SEQ ID NO: 391414 - RNA, 22 nt, Human
gggucagcugcugggggcugac

SEQ ID NO: 391415 - RNA, 22 nt, Human
agccucucuuuauucccagcua

SEQ ID NO: 391416 - RNA, 17 nt, Human
acagagguuauacagac

SEQ ID NO: 391417 - RNA, 22 nt, Human
ggcugggccagggccuguggac

SEQ ID NO: 391418 - RNA, 22 nt, Human
aaaagccaugcauaccuaagag

SEQ ID NO: 391419 - RNA, 22 nt, Human
aaaagaggagugguuuaugaca

SEQ ID NO: 391420 - RNA, 22 nt, Human
uaugcacauucacacaaaaaug

SEQ ID NO: 391421 - RNA, 22 nt, Human
ccucacuuuccuuucuccuggg

SEQ ID NO: 391422 - RNA, 22 nt, Human
augggaggaagagaagaugucu

SEQ ID NO: 391423 - RNA, 22 nt, Human
aaguuucauuguucauguaaca

SEQ ID NO: 391424 - RNA, 22 nt, Human
agacagcugcucgcagagcuau

SEQ ID NO: 391425 - RNA, 21 nt, Human
uuuucccacugaaagcuccca

SEQ ID NO: 391426 - RNA, 22 nt, Human
ccuggagcucacugggagccgg

SEQ ID NO: 391427 - RNA, 22 nt, Human
aaggaaccuggaguagagggag

SEQ ID NO: 391428 - RNA, 21 nt, Human
agccaggcaagcacccccacu

SEQ ID NO: 391429 - RNA, 22 nt, Human
gaggggcugggguugacuccaa

SEQ ID NO: 391430 - RNA, 22 nt, Human
uuguaacagguacuaaauaacu

SEQ ID NO: 391431 - RNA, 22 nt, Human
ucuuagaaguuuauggcacgga

SEQ ID NO: 391432 - RNA, 22 nt, Human
uagcucuucauuucaucugauu

SEQ ID NO: 391433 - RNA, 22 nt, Human
uaaagacaauuucgagcuguag

SEQ ID NO: 391434 - RNA, 22 nt, Human
caguccuuggcaaguucucagu

SEQ ID NO: 391435 - RNA, 22 nt, Human
auaaguucagguaaagaaauca

SEQ ID NO: 391436 - RNA, 22 nt, Human
agucaggagcugcugcauugua

SEQ ID NO: 391437 - RNA, 22 nt, Human
ccugggcaacauagugagaccu

SEQ ID NO: 391438 - RNA, 17 nt, Human
gcagccagugcagcagg

SEQ ID NO: 391439 - RNA, 22 nt, Human
ugcccuuggguaacuugcugau

SEQ ID NO: 391440 - RNA, 20 nt, Human
acugagcugcauggagagga

SEQ ID NO: 391441 - RNA, 22 nt, Human
gguuucaaugagaagugcuugu

SEQ ID NO: 391442 - RNA, 22 nt, Human
acccagcuaacccuacccugga

SEQ ID NO: 391443 - RNA, 22 nt, Human
uuuuuauaacucuuuugugaca

SEQ ID NO: 391444 - RNA, 18 nt, Human
ggcagggaaaagauaggg

SEQ ID NO: 391445 - RNA, 22 nt, Human
cccuugcaucccauguguggcc

SEQ ID NO: 391446 - RNA, 22 nt, Human
auguaucaacaaauuguacagu

SEQ ID NO: 391447 - RNA, 20 nt, Human
uccugagauuuaagggguuc

SEQ ID NO: 391448 - RNA, 22 nt, Human
gguggcagucuuaagagaucuu

SEQ ID NO: 391449 - RNA, 20 nt, Human
gaaguccuguuauauccuuu

SEQ ID NO: 391450 - RNA, 22 nt, Human
ugccagccagguucugaggcua

SEQ ID NO: 391451 - RNA, 22 nt, Human
cauuuagacauuugauuugggg

SEQ ID NO: 391452 - RNA, 22 nt, Human
ugagcagaacacgggauccaug

SEQ ID NO: 391453 - RNA, 22 nt, Human
cugagagucagcuucuccuccu

SEQ ID NO: 391454 - RNA, 22 nt, Human
gaguccuuuucucuguccacug

SEQ ID NO: 391455 - RNA, 22 nt, Human
aaaaugaacagaacaaugggga

SEQ ID NO: 391456 - RNA, 22 nt, Human
aaguggacuaauacaaggacua

SEQ ID NO: 391457 - RNA, 22 nt, Human
aggcugaggcagguggaucauu

SEQ ID NO: 391458 - RNA, 22 nt, Human
ucaaguauaucuagucauuagg

SEQ ID NO: 391459 - RNA, 22 nt, Human
ccugugucagccccugccucca

SEQ ID NO: 391460 - RNA, 22 nt, Human
ugaggcagcccacuuuccuuag

SEQ ID NO: 391461 - RNA, 22 nt, Human
cucuaauccuuugucccugggu

SEQ ID NO: 391462 - RNA, 22 nt, Human
aaggcaguuaauuuggcuagaa

SEQ ID NO: 391463 - RNA, 22 nt, Human
cugggagcggcugucacugguu

SEQ ID NO: 391464 - RNA, 22 nt, Human
ggacuucuaagugccagacacu

SEQ ID NO: 391465 - RNA, 22 nt, Human
cugucugucaaguucaucucca

SEQ ID NO: 391466 - RNA, 22 nt, Human
cagccaggccuggugaccaaag

SEQ ID NO: 391467 - RNA, 22 nt, Human
auucacuggcagacagaacuca

SEQ ID NO: 391468 - RNA, 22 nt, Human
ugggccugggucuuugcugcca

SEQ ID NO: 391469 - RNA, 22 nt, Human
ucacaucucccuggaggacaca

SEQ ID NO: 391470 - RNA, 22 nt, Human
cugagguguugaugaccuaugc

SEQ ID NO: 391471 - RNA, 22 nt, Human
uucuucuuaauguccugggaac

SEQ ID NO: 391472 - RNA, 22 nt, Human
agauggguaacuggagucugcu

SEQ ID NO: 391473 - RNA, 23 nt, Human
aaucuggcugauguuuuuucucu

SEQ ID NO: 391474 - RNA, 22 nt, Human
aguccagugaacuguaaauagg

SEQ ID NO: 391475 - RNA, 21 nt, Human
gcugcaucaaucuacccaggg

SEQ ID NO: 391476 - RNA, 22 nt, Human
cccagggaaugacucuggccuu

SEQ ID NO: 391477 - RNA, 22 nt, Human
ccugugcccucagccuggcucu

SEQ ID NO: 391478 - RNA, 22 nt, Human
cauuggaaugcauuugaagaga

SEQ ID NO: 391479 - RNA, 22 nt, Human
ccucacugaagaggugacauuu

SEQ ID NO: 391480 - RNA, 22 nt, Human
aaggcaguaggaucuuccacag

SEQ ID NO: 391481 - RNA, 22 nt, Human
ccagggagccuggugugucagc

SEQ ID NO: 391482 - RNA, 21 nt, Human
gaugaagcaaucuuucuguug

SEQ ID NO: 391483 - RNA, 22 nt, Human
agggcucccgcgguguccggga

SEQ ID NO: 391484 - RNA, 22 nt, Human
aaauguuuugcucccauguggu

SEQ ID NO: 391485 - RNA, 22 nt, Human
gccuggcaggccugggccagca

SEQ ID NO: 391486 - RNA, 22 nt, Human
uagccggguguugugucaugca

SEQ ID NO: 391487 - RNA, 22 nt, Human
ggcaguagccagggacuggcag

SEQ ID NO: 391488 - RNA, 22 nt, Human
gggagccuugggagugccagcc

SEQ ID NO: 391489 - RNA, 22 nt, Human
uaugcacacaucgcagcaggaa

SEQ ID NO: 391490 - RNA, 22 nt, Human
cauaaaauggcuuguucuuuaa

SEQ ID NO: 391491 - RNA, 22 nt, Human
agcugaguuaauucaucacuua

SEQ ID NO: 391492 - RNA, 22 nt, Human
uguucagcccucuauuaaucag

SEQ ID NO: 391493 - RNA, 22 nt, Human
cuggcaggcggcagagcccagg

SEQ ID NO: 391494 - RNA, 22 nt, Human
gcagcugguuaaugggagaauu

SEQ ID NO: 391495 - RNA, 22 nt, Human
aggcuguccucucuugcucagu

SEQ ID NO: 391496 - RNA, 22 nt, Human
ugcugaugcuguucuguuagga

SEQ ID NO: 391497 - RNA, 22 nt, Human
aagaaauguagagccuaguaaa

SEQ ID NO: 391498 - RNA, 18 nt, Human
ugacucacccugucagug

SEQ ID NO: 391499 - RNA, 22 nt, Human
agugaaauacugucguuuuuag

SEQ ID NO: 391500 - RNA, 22 nt, Human
uccuucagcucucuauuuagau

SEQ ID NO: 391501 - RNA, 22 nt, Human
gucaggauuugaacucaggucu

SEQ ID NO: 391502 - RNA, 22 nt, Human
ccagcuuucauaucaugaggua

SEQ ID NO: 391503 - RNA, 22 nt, Human
ggaggccaaggugggcggauca

SEQ ID NO: 391504 - RNA, 22 nt, Human
acuuucuccagaaaaccaagga

SEQ ID NO: 391505 - RNA, 22 nt, Human
gcucaggaaauaguuuaguguu

SEQ ID NO: 391506 - RNA, 22 nt, Human
agugcaaaauucagaagcaauu

SEQ ID NO: 391507 - RNA, 22 nt, Human
aggcuggguaccugucauaugc

SEQ ID NO: 391508 - RNA, 22 nt, Human
guagggacuuguuuuacuagua

SEQ ID NO: 391509 - RNA, 19 nt, Human
ugaguucugugguucucaa

SEQ ID NO: 391510 - RNA, 22 nt, Human
cacauggggcgcugcauuggcc

SEQ ID NO: 391511 - RNA, 22 nt, Human
guagggacaugccauuaucuca

SEQ ID NO: 391512 - RNA, 22 nt, Human
accauguguuuuacacauggua

SEQ ID NO: 391513 - RNA, 22 nt, Human
aaucagaauuuguccccugagu

SEQ ID NO: 391514 - RNA, 17 nt, Human
aauagcugcucagagag

SEQ ID NO: 391515 - RNA, 22 nt, Human
ggcucagaccucccagcuccag

SEQ ID NO: 391516 - RNA, 22 nt, Human
cccucccaggaguggccagaga

SEQ ID NO: 391517 - RNA, 22 nt, Human
ucaaugauuagaguuuagugug

SEQ ID NO: 391518 - RNA, 19 nt, Human
ucaaagucugagucacuuu

SEQ ID NO: 391519 - RNA, 22 nt, Human
ugccaggcccugugcuggaugc

SEQ ID NO: 391520 - RNA, 22 nt, Human
ugccucugguuaucugguaccu

SEQ ID NO: 391521 - RNA, 22 nt, Human
augggaugaacuugaucugcuu

SEQ ID NO: 391522 - RNA, 22 nt, Human
cuuuggaagugaccacaauccu

SEQ ID NO: 391523 - RNA, 22 nt, Human
aaguccauucuuccagccagcu

SEQ ID NO: 391524 - RNA, 22 nt, Human
ccagugcaggugagcaccaggu

SEQ ID NO: 391525 - RNA, 21 nt, Human
ugcccacagcaaaugcagagg

SEQ ID NO: 391526 - RNA, 22 nt, Human
caaggagaguaauugaaugaga

SEQ ID NO: 391527 - RNA, 22 nt, Human
aagaugauagaucugucaaugu

SEQ ID NO: 391528 - RNA, 22 nt, Human
gcuggcuguguuccuucugcca

SEQ ID NO: 391529 - RNA, 22 nt, Human
aaagguuugcauggaauuuacc

SEQ ID NO: 391530 - RNA, 22 nt, Human
gcccaugcucucaggcgggccu

SEQ ID NO: 391531 - RNA, 22 nt, Human
uggccuggaagagaggucgagg

SEQ ID NO: 391532 - RNA, 22 nt, Human
cacuucaauuaacuucagcauu

SEQ ID NO: 391533 - RNA, 22 nt, Human
aguggcagggcuggcugcugca

SEQ ID NO: 391534 - RNA, 22 nt, Human
cauuaagauuuuuuucuacugg

SEQ ID NO: 391535 - RNA, 22 nt, Human
gccacacuuauucucaugcaca

SEQ ID NO: 391536 - RNA, 22 nt, Human
uugcauugggagugaggagacc

SEQ ID NO: 391537 - RNA, 22 nt, Human
cauuuccagcuccugcaucaug

SEQ ID NO: 391538 - RNA, 22 nt, Human
uugcacauguugguucuugaaa

SEQ ID NO: 391539 - RNA, 22 nt, Human
cugcuguggguuaagacacugu

SEQ ID NO: 391540 - RNA, 22 nt, Human
aaaguuagaaugauaucaacga

SEQ ID NO: 391541 - RNA, 22 nt, Human
uaaagucaucuuuaaacaugcc

SEQ ID NO: 391542 - RNA, 22 nt, Human
uacuaaacccucgauggaucuu

SEQ ID NO: 391543 - RNA, 22 nt, Human
uagagaaauaagcuuugccuug

SEQ ID NO: 391544 - RNA, 22 nt, Human
uauuaucauugguaauaugguc

SEQ ID NO: 391545 - RNA, 18 nt, Human
gugacagcugcuagcuca

SEQ ID NO: 391546 - RNA, 22 nt, Human
ggagcauguggggugagcaggg

SEQ ID NO: 391547 - RNA, 22 nt, Human
aggcuccuaucgcuuucagcaa

SEQ ID NO: 391548 - RNA, 22 nt, Human
acagcuuuugaaaaauuacugg

SEQ ID NO: 391549 - RNA, 22 nt, Human
uucuucuucauuucugacgaug

SEQ ID NO: 391550 - RNA, 22 nt, Human
ucugagcauugaauuuucuucc

SEQ ID NO: 391551 - RNA, 22 nt, Human
gugccugugccaggggugugcu

SEQ ID NO: 391552 - RNA, 22 nt, Human
cagcugaagagaggugcugagu

SEQ ID NO: 391553 - RNA, 22 nt, Human
uagaaaagauaacauucugugc

SEQ ID NO: 391554 - RNA, 22 nt, Human
gccucccuguucuuccacaaua

SEQ ID NO: 391555 - RNA, 22 nt, Human
gagcagcuuaugucaagccaga

SEQ ID NO: 391556 - RNA, 22 nt, Human
acacugaauaauugagaguuga

SEQ ID NO: 391557 - RNA, 22 nt, Human
cagcugggcuaagaguagaggc

SEQ ID NO: 391558 - RNA, 22 nt, Human
aagagcuguaugccauaugauu

SEQ ID NO: 391559 - RNA, 22 nt, Human
gggcugagaaguugaucccaag

SEQ ID NO: 391560 - RNA, 22 nt, Human
ggaggugaggccguagggugug

SEQ ID NO: 391561 - RNA, 22 nt, Human
caggugggaccaugauagggca

SEQ ID NO: 391562 - RNA, 22 nt, Human
caggagaagucucuagggggug

SEQ ID NO: 391563 - RNA, 22 nt, Human
cagggacccuacuagcucacac

SEQ ID NO: 391564 - RNA, 22 nt, Human
cucuucuuuaguccagaccauc

SEQ ID NO: 391565 - RNA, 22 nt, Human
cuggaguuagaguagacacuga

SEQ ID NO: 391566 - RNA, 22 nt, Human
ccauggcuuuugagucucaaga

SEQ ID NO: 391567 - RNA, 22 nt, Human
ugaaauaggaaacagauguuuc

SEQ ID NO: 391568 - RNA, 22 nt, Human
uaguggagaguuguuuugugca

SEQ ID NO: 391569 - RNA, 22 nt, Human
ugugcuucugcagagacuauuu

SEQ ID NO: 391570 - RNA, 22 nt, Human
agggaaggaaaagcugucgcuu

SEQ ID NO: 391571 - RNA, 22 nt, Human
cagcaggacccaggaauccugc

SEQ ID NO: 391572 - RNA, 22 nt, Human
uaaagcaggccacauaugugau

SEQ ID NO: 391573 - RNA, 22 nt, Human
agcugccauccuguucagcacc

SEQ ID NO: 391574 - RNA, 22 nt, Human
ggccuggcauggggacuaaggg

SEQ ID NO: 391575 - RNA, 22 nt, Human
ccacacagucaguuuccaagaa

SEQ ID NO: 391576 - RNA, 22 nt, Human
ucucaggaguagugggauccau

SEQ ID NO: 391577 - RNA, 22 nt, Human
caggggcuuaagugacagaagg

SEQ ID NO: 391578 - RNA, 23 nt, Human
cccagagcacagccuccagaugc

SEQ ID NO: 391579 - RNA, 22 nt, Human
uucaaucauuagaaucucaggc

SEQ ID NO: 391580 - RNA, 22 nt, Human
acagagauguggaugagggauu

SEQ ID NO: 391581 - RNA, 22 nt, Human
ucagaaauguaagcugaugacu

SEQ ID NO: 391582 - RNA, 22 nt, Human
caguuucuacgaaggucaaccc

SEQ ID NO: 391583 - RNA, 17 nt, Human
cccagcuggcagugccg

SEQ ID NO: 391584 - RNA, 22 nt, Human
cuucuuaaauuggauugcuauu

SEQ ID NO: 391585 - RNA, 22 nt, Human
acugugcuuucucuggaggcau

SEQ ID NO: 391586 - RNA, 22 nt, Human
acccugagucagacagccugac

SEQ ID NO: 391587 - RNA, 22 nt, Human
aggcugagccugggcguggugg

SEQ ID NO: 391588 - RNA, 22 nt, Human
aaaaguuuaagacucauucuag

SEQ ID NO: 391589 - RNA, 22 nt, Human
aagcuuuaugaucucucagcua

SEQ ID NO: 391590 - RNA, 22 nt, Human
guuccuauauagccuuaaggau

SEQ ID NO: 391591 - RNA, 22 nt, Human
ugacauuuaucuucuacaauga

SEQ ID NO: 391592 - RNA, 22 nt, Human
agggcuccugaggcccuucugg

SEQ ID NO: 391593 - RNA, 22 nt, Human
ucugcaggaggcuggcugcagg

SEQ ID NO: 391594 - RNA, 22 nt, Human
aggugucuggauggguguccuu

SEQ ID NO: 391595 - RNA, 22 nt, Human
ucagagaaaugaaguagggauu

SEQ ID NO: 391596 - RNA, 22 nt, Human
gaauuguagagggaacagaagc

SEQ ID NO: 391597 - RNA, 22 nt, Human
guagaaauuccauuuacuuuga

SEQ ID NO: 391598 - RNA, 22 nt, Human
aaagccauugaacuguacuuua

SEQ ID NO: 391599 - RNA, 22 nt, Human
gugucaugggguuuguuauaca

SEQ ID NO: 391600 - RNA, 23 nt, Human
ucaucaaacagcugcucaagaaa

SEQ ID NO: 391601 - RNA, 22 nt, Human
uugcauugaaaauauauuuuaa

SEQ ID NO: 391602 - RNA, 22 nt, Human
ucucagagaagugaugagcaau

SEQ ID NO: 391603 - RNA, 22 nt, Human
aaagccuucaaguagauguaag

SEQ ID NO: 391604 - RNA, 22 nt, Human
aguccaaggagagacagcauuu

SEQ ID NO: 391605 - RNA, 22 nt, Human
uucuuugaguuaguacagucca

SEQ ID NO: 391606 - RNA, 22 nt, Human
aagccgggccugagaaaugaca

SEQ ID NO: 391607 - RNA, 22 nt, Human
acguuuucagccuuaauguaga

SEQ ID NO: 391608 - RNA, 22 nt, Human
caagaucagggugccagaaugg

SEQ ID NO: 391609 - RNA, 18 nt, Human
gaaaggagagacaguagg

SEQ ID NO: 391610 - RNA, 23 nt, Human
acagacaacacugaugagagaaa

SEQ ID NO: 391611 - RNA, 22 nt, Human
cagcuggcuggucagugcacaa

SEQ ID NO: 391612 - RNA, 20 nt, Human
ccaggcacugucccaugcag

SEQ ID NO: 391613 - RNA, 22 nt, Human
aaugccucuuggaagaagacuu

SEQ ID NO: 391614 - RNA, 22 nt, Human
acacuuuacagcuuccuuugca

SEQ ID NO: 391615 - RNA, 21 nt, Human
uggagcugaauuuuuggcauc

SEQ ID NO: 391616 - RNA, 22 nt, Human
ccuggagcuuuuccauccugga

SEQ ID NO: 391617 - RNA, 20 nt, Human
caggcagaggaugcugacca

SEQ ID NO: 391618 - RNA, 22 nt, Human
uggccuggcagagcaaggccug

SEQ ID NO: 391619 - RNA, 22 nt, Human
uaaagguaacaugaacugcuuu

SEQ ID NO: 391620 - RNA, 22 nt, Human
ccacuguuuuucaguuaacuuu

SEQ ID NO: 391621 - RNA, 22 nt, Human
uguuccauaaguggugcuuugu

SEQ ID NO: 391622 - RNA, 22 nt, Human
uugcaucuaccauaucaaagau

SEQ ID NO: 391623 - RNA, 19 nt, Human
cccaggagcaguauugaug

SEQ ID NO: 391624 - RNA, 22 nt, Human
uccugagggcgauucagcaggu

SEQ ID NO: 391625 - RNA, 22 nt, Human
agcacagaguugcagagagcgu

SEQ ID NO: 391626 - RNA, 22 nt, Human
cuacauuuuaauaagcugcuua

SEQ ID NO: 391627 - RNA, 22 nt, Human
ccagcucuuggugcacuuacau

SEQ ID NO: 391628 - RNA, 22 nt, Human
cagaggccucacuuccagccag

SEQ ID NO: 391629 - RNA, 22 nt, Human
uagauauaucugucauacuggu

SEQ ID NO: 391630 - RNA, 22 nt, Human
acaguacauaauccugagucug

SEQ ID NO: 391631 - RNA, 22 nt, Human
ucuauaaaugcagauaugugug

SEQ ID NO: 391632 - RNA, 22 nt, Human
guacauuuuacuuuguuugaau

SEQ ID NO: 391633 - RNA, 22 nt, Human
cugcuuuggcucagugacauca

SEQ ID NO: 391634 - RNA, 22 nt, Human
ugcaugcagcuggugauaagaa

SEQ ID NO: 391635 - RNA, 22 nt, Human
gccaggcagcagcgaggauggu

SEQ ID NO: 391636 - RNA, 22 nt, Human
uguuacuuaucucacgugaugc

SEQ ID NO: 391637 - RNA, 22 nt, Human
ccagguaggagagagggauccu

SEQ ID NO: 391638 - RNA, 22 nt, Human
ucagauggguuuugaaggaugu

SEQ ID NO: 391639 - RNA, 22 nt, Human
caaagguaaagaucugcugugg

SEQ ID NO: 391640 - RNA, 22 nt, Human
gccaguggcuugccaggcagga

SEQ ID NO: 391641 - RNA, 22 nt, Human
uucagagacagcaaccaggaca

SEQ ID NO: 391642 - RNA, 22 nt, Human
ggcagcagcaagguuggagcug

SEQ ID NO: 391643 - RNA, 19 nt, Human
ggcuccuguggcugcagcc

SEQ ID NO: 391644 - RNA, 22 nt, Human
ugucucugccagcuagcagaau

SEQ ID NO: 391645 - RNA, 21 nt, Human
gggugcuguggucaugcagga

SEQ ID NO: 391646 - RNA, 22 nt, Human
ugcuuuauaacuuaguuuaugg

SEQ ID NO: 391647 - RNA, 22 nt, Human
gaggcugguucugaaguacugu

SEQ ID NO: 391648 - RNA, 22 nt, Human
cuguucacacacuuguacucuc

SEQ ID NO: 391649 - RNA, 19 nt, Human
ccauggcaaugaucugaug

SEQ ID NO: 391650 - RNA, 22 nt, Human
ucaagcaucuuggucuacgauc

SEQ ID NO: 391651 - RNA, 22 nt, Human
cuggccugaggccgccuucaga

SEQ ID NO: 391652 - RNA, 22 nt, Human
ugaaacaaugugaaguugcuga

SEQ ID NO: 391653 - RNA, 22 nt, Human
cccugggcaagcccuauuuucc

SEQ ID NO: 391654 - RNA, 22 nt, Human
agggaggaccaaugugugguua

SEQ ID NO: 391655 - RNA, 22 nt, Human
acagcagcuugcgugucugguc

SEQ ID NO: 391656 - RNA, 23 nt, Human
cccugcagucagggugagauggu

SEQ ID NO: 391657 - RNA, 22 nt, Human
cagcucugugcaggccugggga

SEQ ID NO: 391658 - RNA, 21 nt, Human
ugugucacuaacuagaggcua

SEQ ID NO: 391659 - RNA, 22 nt, Human
aggcagcuucugauuagcagcg

SEQ ID NO: 391660 - RNA, 18 nt, Human
uggagcagguaggcauga

SEQ ID NO: 391661 - RNA, 22 nt, Human
caucagaaagaguccuggacuu

SEQ ID NO: 391662 - RNA, 21 nt, Human
aggcagccagucaugcucccu

SEQ ID NO: 391663 - RNA, 22 nt, Human
uagcagaagaacaacaugaucu

SEQ ID NO: 391664 - RNA, 22 nt, Human
cacccaguugacuacaaagggg

SEQ ID NO: 391665 - RNA, 22 nt, Human
cuggcccagucucagaguguca

SEQ ID NO: 391666 - RNA, 22 nt, Human
gcaccaggaggcccuucucauc

SEQ ID NO: 391667 - RNA, 22 nt, Human
ggugcagugguguggcaaaggg

SEQ ID NO: 391668 - RNA, 22 nt, Human
acauuuuuauucaucaaagcag

SEQ ID NO: 391669 - RNA, 17 nt, Human
acaggcagaucaccuga

SEQ ID NO: 391670 - RNA, 22 nt, Human
aaggcagcaccgccuccugaaa

SEQ ID NO: 391671 - RNA, 22 nt, Human
uggauuaguuaagaaauguuag

SEQ ID NO: 391672 - RNA, 22 nt, Human
gaaaaugugucaucccuacugu

SEQ ID NO: 391673 - RNA, 22 nt, Human
auuuauguaucuguguagauca

SEQ ID NO: 391674 - RNA, 22 nt, Human
ucugaggcauacccaggccccc

SEQ ID NO: 391675 - RNA, 22 nt, Human
auggcagagaaagcgagccaca

SEQ ID NO: 391676 - RNA, 22 nt, Human
uggcugagagucauccugugug

SEQ ID NO: 391677 - RNA, 22 nt, Human
cuggcuuuaacccuacaaaccu

SEQ ID NO: 391678 - RNA, 22 nt, Human
uccauuuucaucucauguauaa

SEQ ID NO: 391679 - RNA, 22 nt, Human
cggcuggguagaggugccgggu

SEQ ID NO: 391680 - RNA, 22 nt, Human
uucuucuucuggcugcaccugg

SEQ ID NO: 391681 - RNA, 22 nt, Human
uguccucacaggaaugaacuuu

SEQ ID NO: 391682 - RNA, 22 nt, Human
ccagcagaggggcggagugcag

SEQ ID NO: 391683 - RNA, 22 nt, Human
ggcuucucucccccagcuccac

SEQ ID NO: 391684 - RNA, 22 nt, Human
cagccugcuagggcaaugccuu

SEQ ID NO: 391685 - RNA, 22 nt, Human
uuuguuuucaaugugucauuca

SEQ ID NO: 391686 - RNA, 22 nt, Human
ugguaaaguguacugaauauga

SEQ ID NO: 391687 - RNA, 22 nt, Human
ucugcugugggucuauauuuua

SEQ ID NO: 391688 - RNA, 22 nt, Human
aagggcugcuguagaagcagag

SEQ ID NO: 391689 - RNA, 22 nt, Human
acugugugaaacaucaaugugu

SEQ ID NO: 391690 - RNA, 22 nt, Human
gcugucugucucugucccacca

SEQ ID NO: 391691 - RNA, 22 nt, Human
cccagcaucccagugggcagca

SEQ ID NO: 391692 - RNA, 22 nt, Human
gcagcuuuaaaggaggcucuga

SEQ ID NO: 391693 - RNA, 22 nt, Human
gcuugcuggugccugcaggcuc

SEQ ID NO: 391694 - RNA, 22 nt, Human
guuuauaaggcccaauauuucu

SEQ ID NO: 391695 - RNA, 22 nt, Human
ccugccugucaucgccugcgcc

SEQ ID NO: 391696 - RNA, 22 nt, Human
ucccacacagcccgcucaccgg

SEQ ID NO: 391697 - RNA, 22 nt, Human
uuuggaaaguugucacuuuaga

SEQ ID NO: 391698 - RNA, 22 nt, Human
cucuggaggccuaaggaagugg

SEQ ID NO: 391699 - RNA, 22 nt, Human
gcugaaggaggcucugguacua

SEQ ID NO: 391700 - RNA, 22 nt, Human
ucccagaggaaauggcagcuga

SEQ ID NO: 391701 - RNA, 22 nt, Human
agccaggcgcaguggcuuaugc

SEQ ID NO: 391702 - RNA, 22 nt, Human
caggacagguguucuagaucag

SEQ ID NO: 391703 - RNA, 22 nt, Human
ugcuaaauaaguggaauagaca

SEQ ID NO: 391704 - RNA, 22 nt, Human
uagaaacauauaggauggcagg

SEQ ID NO: 391705 - RNA, 22 nt, Human
cagcucucacacccuccuccca

SEQ ID NO: 391706 - RNA, 22 nt, Human
agcaccugcacaguggaggaaa

SEQ ID NO: 391707 - RNA, 22 nt, Human
uugccaggagcucaucugaggg

SEQ ID NO: 391708 - RNA, 22 nt, Human
auguaacuucugugaaucugac

SEQ ID NO: 391709 - RNA, 22 nt, Human
cucccagggucuaggcugcugg

SEQ ID NO: 391710 - RNA, 22 nt, Human
ggggcagauggaacagagcaca

SEQ ID NO: 391711 - RNA, 22 nt, Human
cagggcucuuccggagcaggga

SEQ ID NO: 391712 - RNA, 22 nt, Human
ugccagcaguagcaguaggcca

SEQ ID NO: 391713 - RNA, 19 nt, Human
aggccugggguuuugcacu

SEQ ID NO: 391714 - RNA, 22 nt, Human
cagggccucauccucagagauu

SEQ ID NO: 391715 - RNA, 22 nt, Human
uuucacaauuuuaaggagcaaa

SEQ ID NO: 391716 - RNA, 22 nt, Human
gagucaccacugugauagucga

SEQ ID NO: 391717 - RNA, 22 nt, Human
gcaggcugggguagccccacuu

SEQ ID NO: 391718 - RNA, 22 nt, Human
aaacugugcuucccaaaugccc

SEQ ID NO: 391719 - RNA, 22 nt, Human
ugcagaagaauguaggcauaag

SEQ ID NO: 391720 - RNA, 22 nt, Human
ugauuucccuguagccucugaa

SEQ ID NO: 391721 - RNA, 19 nt, Human
ggcugcugguuacagaggc

SEQ ID NO: 391722 - RNA, 22 nt, Human
uucucagagcucacuguaguaa

SEQ ID NO: 391723 - RNA, 22 nt, Human
aggcacugaagaacucuuuuug

SEQ ID NO: 391724 - RNA, 22 nt, Human
agucucuuuaaucacagugucu

SEQ ID NO: 391725 - RNA, 22 nt, Human
gcagagugggagcccagggcug

SEQ ID NO: 391726 - RNA, 22 nt, Human
agcugccugcuuaugagcucca

SEQ ID NO: 391727 - RNA, 22 nt, Human
ucucuucuugauuuucacugga

SEQ ID NO: 391728 - RNA, 22 nt, Human
augcacagacccaaaggccauc

SEQ ID NO: 391729 - RNA, 20 nt, Human
aucagcaacugccacucagu

SEQ ID NO: 391730 - RNA, 22 nt, Human
uggagccagagcgcagccuggg

SEQ ID NO: 391731 - RNA, 22 nt, Human
gggcuggcucugucuagaaagg

SEQ ID NO: 391732 - RNA, 22 nt, Human
ucccugcagacguccugcgggu

SEQ ID NO: 391733 - RNA, 22 nt, Human
cagagcaguccuugucaaucag

SEQ ID NO: 391734 - RNA, 22 nt, Human
agucucagggccacccggggaa

SEQ ID NO: 391735 - RNA, 22 nt, Human
ucugagccaauuucugugucca

SEQ ID NO: 391736 - RNA, 22 nt, Human
cccugcagcauucucuaacugg

SEQ ID NO: 391737 - RNA, 22 nt, Human
acccuggguucccgcagcacca

SEQ ID NO: 391738 - RNA, 22 nt, Human
uguguaaauggcaucucucagc

SEQ ID NO: 391739 - RNA, 22 nt, Human
gagugucugaauuagagcacaa

SEQ ID NO: 391740 - RNA, 22 nt, Human
uuagauaacaguagaauaucaa

SEQ ID NO: 391741 - RNA, 22 nt, Human
cuucuuuccuuccuccaguggc

SEQ ID NO: 391742 - RNA, 22 nt, Human
cuguucaugcugauucuguaug

SEQ ID NO: 391743 - RNA, 22 nt, Human
acaacauuauacauagaaagcu

SEQ ID NO: 391744 - RNA, 22 nt, Human
ucaaauaccagcaauuucaugu

SEQ ID NO: 391745 - RNA, 22 nt, Human
aggaggccccuccuggguugcu

SEQ ID NO: 391746 - RNA, 22 nt, Human
ggagcugggguuggcaucuucc

SEQ ID NO: 391747 - RNA, 21 nt, Human
uggcucugaaagagugcugca

SEQ ID NO: 391748 - RNA, 22 nt, Human
ucugcagguguuggaaggguca

SEQ ID NO: 391749 - RNA, 22 nt, Human
gaucuguuauaaucucuuuuau

SEQ ID NO: 391750 - RNA, 22 nt, Human
aaauggauggaauugacauuua

SEQ ID NO: 391751 - RNA, 22 nt, Human
ggagccugugggaugagaugug

SEQ ID NO: 391752 - RNA, 22 nt, Human
agauacaucauuuauaccuuca

SEQ ID NO: 391753 - RNA, 22 nt, Human
ggcacagggaggcccuggugug

SEQ ID NO: 391754 - RNA, 22 nt, Human
cugucugcuagaacaucuauac

SEQ ID NO: 391755 - RNA, 22 nt, Human
gagucgagcagaaagccgucgg

SEQ ID NO: 391756 - RNA, 22 nt, Human
gaggcucacuuucauccucuuc

SEQ ID NO: 391757 - RNA, 22 nt, Human
aggcagcuggaaaacuccaggc

SEQ ID NO: 391758 - RNA, 22 nt, Human
caguuucuguuuuaaauagcag

SEQ ID NO: 391759 - RNA, 21 nt, Human
uuugaaagcccuauguuuuca

SEQ ID NO: 391760 - RNA, 22 nt, Human
cccagccagccucuucccauau

SEQ ID NO: 391761 - RNA, 22 nt, Human
uugcagagcaguaggaauauag

SEQ ID NO: 391762 - RNA, 22 nt, Human
gaggggcagagguagagaacaa

SEQ ID NO: 391763 - RNA, 22 nt, Human
cauacuuuugcccugacauucu

SEQ ID NO: 391764 - RNA, 20 nt, Human
gagccugggaagucuaaggu

SEQ ID NO: 391765 - RNA, 22 nt, Human
cagcuuccauaagagauggaga

SEQ ID NO: 391766 - RNA, 20 nt, Human
gagggcaggcacccauuuca

SEQ ID NO: 391767 - RNA, 19 nt, Human
ugcaagugucuuggacaag

SEQ ID NO: 391768 - RNA, 22 nt, Human
cauaauuacugauaugcugauu

SEQ ID NO: 391769 - RNA, 22 nt, Human
auugcaccuuggguuuugaaag

SEQ ID NO: 391770 - RNA, 18 nt, Human
aauuuccauaugaauugc

SEQ ID NO: 391771 - RNA, 22 nt, Human
agguggaacguucaggugcuag

SEQ ID NO: 391772 - RNA, 22 nt, Human
gccuucaguagugucagcugua

SEQ ID NO: 391773 - RNA, 22 nt, Human
gagucaccuuggccgcuguccc

SEQ ID NO: 391774 - RNA, 22 nt, Human
cugucuguucagauucauuacu

SEQ ID NO: 391775 - RNA, 22 nt, Human
auuuuccaaaauaauuguuacu

SEQ ID NO: 391776 - RNA, 22 nt, Human
agccuggaagaaccugaagucu

SEQ ID NO: 391777 - RNA, 22 nt, Human
ccaggcaucacgggcauguggc

SEQ ID NO: 391778 - RNA, 22 nt, Human
ggcuuuauuucacuguaccaua

SEQ ID NO: 391779 - RNA, 22 nt, Human
uccaggagacacccuugugugu

SEQ ID NO: 391780 - RNA, 22 nt, Human
cuguacaggugaggagggggcu

SEQ ID NO: 391781 - RNA, 22 nt, Human
ucacaggguguacaucaccuau

SEQ ID NO: 391782 - RNA, 22 nt, Human
uagcaucuguucuuucauuaaa

SEQ ID NO: 391783 - RNA, 22 nt, Human
agggagaaaauuggaugcacaa

SEQ ID NO: 391784 - RNA, 22 nt, Human
ggcugcagaaguacuuccggau

SEQ ID NO: 391785 - RNA, 22 nt, Human
uuucacaaaugucuuuaacuug

SEQ ID NO: 391786 - RNA, 22 nt, Human
ccagcugguguuccuuaggacc

SEQ ID NO: 391787 - RNA, 22 nt, Human
uuuaaagagaaugugaaggagu

SEQ ID NO: 391788 - RNA, 22 nt, Human
uccagggccaagucauggaacc

SEQ ID NO: 391789 - RNA, 22 nt, Human
ugaggcucagagcaccugcucc

SEQ ID NO: 391790 - RNA, 22 nt, Human
agugaaauggaugcugcuacug

SEQ ID NO: 391791 - RNA, 22 nt, Human
uagggacaaagagcugaggccu

SEQ ID NO: 391792 - RNA, 22 nt, Human
caguggcacccacgggcugggc

SEQ ID NO: 391793 - RNA, 22 nt, Human
ucucuucuaauuuucccgagua

SEQ ID NO: 391794 - RNA, 22 nt, Human
ugggaccaagucauuucuuuag

SEQ ID NO: 391795 - RNA, 22 nt, Human
ggaggggcagccauggaacucc

SEQ ID NO: 391796 - RNA, 22 nt, Human
uucagagagaaaccagugggaa

SEQ ID NO: 391797 - RNA, 22 nt, Human
gagauauguuagaaagcuauug

SEQ ID NO: 391798 - RNA, 22 nt, Human
acaugcuuugauguauuuugca

SEQ ID NO: 391799 - RNA, 22 nt, Human
uggaaagcgaggaguuggcauu

SEQ ID NO: 391800 - RNA, 22 nt, Human
uucauuaauucauucagugacu

SEQ ID NO: 391801 - RNA, 20 nt, Human
agcagcauuguucuagagca

SEQ ID NO: 391802 - RNA, 23 nt, Human
cagggcccugcucaauuucucca

SEQ ID NO: 391803 - RNA, 22 nt, Human
agagagcauugaggaaaucuuc

SEQ ID NO: 391804 - RNA, 22 nt, Human
cugugucccuugucccagagcc

SEQ ID NO: 391805 - RNA, 22 nt, Human
aagggagacaguugugugagga

SEQ ID NO: 391806 - RNA, 22 nt, Human
cucucugcuguauccuuaggcu

SEQ ID NO: 391807 - RNA, 22 nt, Human
agagcaauggcauccagcugau

SEQ ID NO: 391808 - RNA, 22 nt, Human
uggcagaaguacacaagcaugc

SEQ ID NO: 391809 - RNA, 22 nt, Human
cagaaacauguauaaaguugua

SEQ ID NO: 391810 - RNA, 22 nt, Human
uuugcagugauucuugcaguga

SEQ ID NO: 391811 - RNA, 22 nt, Human
ucugggcuugguuagggcuguu

SEQ ID NO: 391812 - RNA, 22 nt, Human
aagggcuccauccuuauaaaug

SEQ ID NO: 391813 - RNA, 22 nt, Human
cagggcuggauuucauuucuag

SEQ ID NO: 391814 - RNA, 22 nt, Human
aguucuucauaaccuuacugug

SEQ ID NO: 391815 - RNA, 22 nt, Human
aggugcagcugguggagucugg

SEQ ID NO: 391816 - RNA, 21 nt, Human
ccuggcuucagggugcacugg

SEQ ID NO: 391817 - RNA, 22 nt, Human
agcuuuauggugccucacuuga

SEQ ID NO: 391818 - RNA, 22 nt, Human
uugugucugggggagugacauc

SEQ ID NO: 391819 - RNA, 22 nt, Human
ugggcagacuaaggucaaagcu

SEQ ID NO: 391820 - RNA, 22 nt, Human
augcuguguggccaccuccaug

SEQ ID NO: 391821 - RNA, 22 nt, Human
aguuuccaaagcauguucacac

SEQ ID NO: 391822 - RNA, 22 nt, Human
agugauggugagugagaagcuc

SEQ ID NO: 391823 - RNA, 22 nt, Human
uauucacagcugccgcacucag

SEQ ID NO: 391824 - RNA, 22 nt, Human
auuuaugacuggugaauagaac

SEQ ID NO: 391825 - RNA, 22 nt, Human
cucugcagaggcccaaggcuga

SEQ ID NO: 391826 - RNA, 22 nt, Human
gcugagcugaggcagggcuggg

SEQ ID NO: 391827 - RNA, 22 nt, Human
gcucuguguugucagaggcacc

SEQ ID NO: 391828 - RNA, 19 nt, Human
cagaacagaggucauggcc

SEQ ID NO: 391829 - RNA, 22 nt, Human
ucaucacauguguagucauccc

SEQ ID NO: 391830 - RNA, 22 nt, Human
agagccccugguggagugagaa

SEQ ID NO: 391831 - RNA, 22 nt, Human
ccuggaaggcaggcauggauug

SEQ ID NO: 391832 - RNA, 22 nt, Human
ucugagagcuguagaagccuau

SEQ ID NO: 391833 - RNA, 23 nt, Human
guggccuccccggaaugccucgc

SEQ ID NO: 391834 - RNA, 20 nt, Human
caggccagagguuugauggc

SEQ ID NO: 391835 - RNA, 22 nt, Human
agggcugcugaggaagccuugc

SEQ ID NO: 391836 - RNA, 22 nt, Human
ggcgugggaaguggggcuucug

SEQ ID NO: 391837 - RNA, 23 nt, Human
cccagcuuucccacugccgagag

SEQ ID NO: 391838 - RNA, 22 nt, Human
ccacagccauuccagggaggcu

SEQ ID NO: 391839 - RNA, 22 nt, Human
ccuggcucucugcagauccugg

SEQ ID NO: 391840 - RNA, 22 nt, Human
uggaagcaucacuucuugccug

SEQ ID NO: 391841 - RNA, 22 nt, Human
auuuucucucaaaccuuaaaau

SEQ ID NO: 391842 - RNA, 22 nt, Human
auugucuuuccacugagaaguu

SEQ ID NO: 391843 - RNA, 22 nt, Human
ucuuuggaucccaacuggcugg

SEQ ID NO: 391844 - RNA, 22 nt, Human
agggcuggagccacagcuggga

SEQ ID NO: 391845 - RNA, 22 nt, Human
ucccagaggcaguugguaacuu

SEQ ID NO: 391846 - RNA, 22 nt, Human
aggcugagucgggaggaucacu

SEQ ID NO: 391847 - RNA, 22 nt, Human
gaagaacaagcagugcuuuccu

SEQ ID NO: 391848 - RNA, 22 nt, Human
agccuccaguagcugaagagac

SEQ ID NO: 391849 - RNA, 22 nt, Human
ucucaggagccacagcgggagu

SEQ ID NO: 391850 - RNA, 22 nt, Human
uaauccaggguauucuaguuuc

SEQ ID NO: 391851 - RNA, 22 nt, Human
guagggacuguucucaccugag

SEQ ID NO: 391852 - RNA, 16 nt, Human
ccacagggcaaggggc

SEQ ID NO: 391853 - RNA, 22 nt, Human
ucagccuuguggcccugcucca

SEQ ID NO: 391854 - RNA, 22 nt, Human
aaagggagcauggcugcaggga

SEQ ID NO: 391855 - RNA, 23 nt, Human
uugcauguagcccaugaguaacu

SEQ ID NO: 391856 - RNA, 22 nt, Human
aggcagcaugcucugcuucuac

SEQ ID NO: 391857 - RNA, 22 nt, Human
uuuauuuauaagccacuugcug

SEQ ID NO: 391858 - RNA, 22 nt, Human
uucagggagagcgggacgggug

SEQ ID NO: 391859 - RNA, 22 nt, Human
cccaggcacauccacucuguga

SEQ ID NO: 391860 - RNA, 22 nt, Human
gaacuuuaaaacaaaguacagu

SEQ ID NO: 391861 - RNA, 22 nt, Human
aucaguuuaacugucaagagcc

SEQ ID NO: 391862 - RNA, 22 nt, Human
guccucagggaauguggcgggu

SEQ ID NO: 391863 - RNA, 22 nt, Human
caguggguccuaaguacaguuc

SEQ ID NO: 391864 - RNA, 21 nt, Human
cagugcucaaucugacagugg

SEQ ID NO: 391865 - RNA, 22 nt, Human
ccuguucaagguauuaauuauc

SEQ ID NO: 391866 - RNA, 22 nt, Human
agcugcugagccaggcugaugu

SEQ ID NO: 391867 - RNA, 22 nt, Human
caucagcaggcaacacucuugg

SEQ ID NO: 391868 - RNA, 22 nt, Human
augguuuguguggcccagauga

SEQ ID NO: 391869 - RNA, 22 nt, Human
gaugauuuuaugucuugucauu

SEQ ID NO: 391870 - RNA, 22 nt, Human
uagaaacagaaaacuguaauag

SEQ ID NO: 391871 - RNA, 22 nt, Human
caccuagggcaucccugcccca

SEQ ID NO: 391872 - RNA, 22 nt, Human
ugggugaggaugaugaggcagc

SEQ ID NO: 391873 - RNA, 22 nt, Human
uggggacacagagccaaacuau

SEQ ID NO: 391874 - RNA, 22 nt, Human
ucugauaacucuggccccaggc

SEQ ID NO: 391875 - RNA, 22 nt, Human
ccccuuccgucucuugaguguc

SEQ ID NO: 391876 - RNA, 22 nt, Human
cagugguuauacuuacuguuuc

SEQ ID NO: 391877 - RNA, 22 nt, Human
auuuuccagccuuucuagaacu

SEQ ID NO: 391878 - RNA, 22 nt, Human
aagcagcuuaaauuagagccug

SEQ ID NO: 391879 - RNA, 22 nt, Human
caggguggcacaucacagcauu

SEQ ID NO: 391880 - RNA, 22 nt, Human
acagcuuuguguuaaugggaag

SEQ ID NO: 391881 - RNA, 22 nt, Human
ggugaagggugucauggcauuu

SEQ ID NO: 391882 - RNA, 22 nt, Human
uggagaauucuauguugagggg

SEQ ID NO: 391883 - RNA, 22 nt, Human
uaaacauggcuguuucaguuau

SEQ ID NO: 391884 - RNA, 22 nt, Human
uugggcucaggaguuugagacc

SEQ ID NO: 391885 - RNA, 22 nt, Human
ccugcuguucuguuuagugaac

SEQ ID NO: 391886 - RNA, 17 nt, Human
gcccaggaaggacggcc

SEQ ID NO: 391887 - RNA, 22 nt, Human
acacauauauacauauuugugc

SEQ ID NO: 391888 - RNA, 22 nt, Human
gauuuauugucccuguccugcu

SEQ ID NO: 391889 - RNA, 23 nt, Human
acacaaggguaacugccagccau

SEQ ID NO: 391890 - RNA, 22 nt, Human
aagagcaucaaugacucgcagu

SEQ ID NO: 391891 - RNA, 22 nt, Human
cugagcucuaaugucagccuug

SEQ ID NO: 391892 - RNA, 22 nt, Human
ucucaggccccugaguuucucu

SEQ ID NO: 391893 - RNA, 22 nt, Human
ccugggcagguguggcuucccc

SEQ ID NO: 391894 - RNA, 22 nt, Human
gugcccugaguggguaggagag

SEQ ID NO: 391895 - RNA, 23 nt, Human
aaagacugcugagaauuuuagga

SEQ ID NO: 391896 - RNA, 22 nt, Human
ugcugucuguuuacuggcuaua

SEQ ID NO: 391897 - RNA, 22 nt, Human
aggagguggccugagcgugccc

SEQ ID NO: 391898 - RNA, 22 nt, Human
agaaguuaccacauacuucucu

SEQ ID NO: 391899 - RNA, 22 nt, Human
ucacaagacagaaaacauuuag

SEQ ID NO: 391900 - RNA, 22 nt, Human
gcugcugugugggagacaggcg

SEQ ID NO: 391901 - RNA, 19 nt, Human
uccuucagucagaucuggg

SEQ ID NO: 391902 - RNA, 22 nt, Human
cuuucagagguuacucaggaaa

SEQ ID NO: 391903 - RNA, 22 nt, Human
cuuuccaagaaugcagauaccu

SEQ ID NO: 391904 - RNA, 22 nt, Human
auagaauagcauagaaaauuga

SEQ ID NO: 391905 - RNA, 23 nt, Human
acaacuuuacagauacauuuugu

SEQ ID NO: 391906 - RNA, 22 nt, Human
aaucaguucuacaucuuaucca

SEQ ID NO: 391907 - RNA, 22 nt, Human
caggucccgccccgggcugacc

SEQ ID NO: 391908 - RNA, 22 nt, Human
caguccuugauccaauaguggg

SEQ ID NO: 391909 - RNA, 19 nt, Human
agugcagggagcacccuca

SEQ ID NO: 391910 - RNA, 22 nt, Human
cucuccucugaaguggugaccc

SEQ ID NO: 391911 - RNA, 23 nt, Human
ucugcucugaaguucggcugagc

SEQ ID NO: 391912 - RNA, 22 nt, Human
ugugaagcuggauccuggagcu

SEQ ID NO: 391913 - RNA, 19 nt, Human
ugucuuaauuaacucagag

SEQ ID NO: 391914 - RNA, 18 nt, Human
aaguccuuccuuugcuuu

SEQ ID NO: 391915 - RNA, 22 nt, Human
ucuccucugcgcggcagugccc

SEQ ID NO: 391916 - RNA, 22 nt, Human
cggcagggcuccaugcauuucu

SEQ ID NO: 391917 - RNA, 22 nt, Human
gaaaggcaguacagcugagccu

SEQ ID NO: 391918 - RNA, 22 nt, Human
uacauucaacaugucacuaugu

SEQ ID NO: 391919 - RNA, 20 nt, Human
cuuccacacaagaagcacag

SEQ ID NO: 391920 - RNA, 22 nt, Human
aguguguguuugggcgguuuau

SEQ ID NO: 391921 - RNA, 22 nt, Human
gcagaggccuagguggaaggcc

SEQ ID NO: 391922 - RNA, 22 nt, Human
gucucccacuuucuggccucuu

SEQ ID NO: 391923 - RNA, 22 nt, Human
uguguacagcaggauuucucaa

SEQ ID NO: 391924 - RNA, 22 nt, Human
agguuuauguuuggugcaggag

SEQ ID NO: 391925 - RNA, 22 nt, Human
auguaguauuuggaaauguaaa

SEQ ID NO: 391926 - RNA, 22 nt, Human
uggcucuguucgccaucaggag

SEQ ID NO: 391927 - RNA, 22 nt, Human
caguccuuccuugccccuuggg

SEQ ID NO: 391928 - RNA, 23 nt, Human
gccugggacucaggaggagcuca

SEQ ID NO: 391929 - RNA, 22 nt, Human
cagugguauuugagagaaugga

SEQ ID NO: 391930 - RNA, 22 nt, Human
agaggagcugggaggcccucgu

SEQ ID NO: 391931 - RNA, 22 nt, Human
ccugccaggccagugagcuucc

SEQ ID NO: 391932 - RNA, 21 nt, Human
acagaguaguugaaacagaga

SEQ ID NO: 391933 - RNA, 22 nt, Human
cuugaaucuggcuuugccacuu

SEQ ID NO: 391934 - RNA, 22 nt, Human
ggaggccaaggcgggcggauca

SEQ ID NO: 391935 - RNA, 23 nt, Human
ccagcuccgugagccucgggcuc

SEQ ID NO: 391936 - RNA, 22 nt, Human
gucugcugcagagcauggcuuu

SEQ ID NO: 391937 - RNA, 22 nt, Human
cagagcccagggccuacguccc

SEQ ID NO: 391938 - RNA, 22 nt, Human
gacaguuuuuaauccuuucaug

SEQ ID NO: 391939 - RNA, 19 nt, Human
caguccuuuccgcuuucuc

SEQ ID NO: 391940 - RNA, 22 nt, Human
cugguucauccccuuccaggaa

SEQ ID NO: 391941 - RNA, 22 nt, Human
aucuagauuagguauaagagcu

SEQ ID NO: 391942 - RNA, 22 nt, Human
uaaaugcaagugcuccugggag

SEQ ID NO: 391943 - RNA, 22 nt, Human
ccaaaauguuugaaugcaugug

SEQ ID NO: 391944 - RNA, 22 nt, Human
agucucugcacaguaagaagca

SEQ ID NO: 391945 - RNA, 22 nt, Human
uucuuucagaacacaagugauu

SEQ ID NO: 391946 - RNA, 19 nt, Human
augauggucccauucaccu

SEQ ID NO: 391947 - RNA, 22 nt, Human
uuugaaguccaucuggcccagu

SEQ ID NO: 391948 - RNA, 22 nt, Human
uuccuuaggcuguuugcagugc

SEQ ID NO: 391949 - RNA, 22 nt, Human
uucaauucaauucuaaauauau

SEQ ID NO: 391950 - RNA, 21 nt, Human
ucagcagcaucugccuagagu

SEQ ID NO: 391951 - RNA, 22 nt, Human
uccaguucuaggucacucucug

SEQ ID NO: 391952 - RNA, 22 nt, Human
cagucaccuugaggacucagac

SEQ ID NO: 391953 - RNA, 22 nt, Human
acaguuaucuuugaaauagaga

SEQ ID NO: 391954 - RNA, 22 nt, Human
ccaggccuuucuucuuggucug

SEQ ID NO: 391955 - RNA, 22 nt, Human
ugaaauaauaucuggaucaauc

SEQ ID NO: 391956 - RNA, 22 nt, Human
guuaggcagugugguauagcag

SEQ ID NO: 391957 - RNA, 19 nt, Human
cccuggcaggcaagccugg

SEQ ID NO: 391958 - RNA, 22 nt, Human
gcaccuggcugcccagguggag

SEQ ID NO: 391959 - RNA, 22 nt, Human
aauuucagaacccaaauuagcg

SEQ ID NO: 391960 - RNA, 22 nt, Human
cuggcucaguucuugguuuuca

SEQ ID NO: 391961 - RNA, 22 nt, Human
uccucugccaaagggaguugcc

SEQ ID NO: 391962 - RNA, 22 nt, Human
uauggcuuuuaacugucguaug

SEQ ID NO: 391963 - RNA, 22 nt, Human
cugccuguuagucuagcaguua

SEQ ID NO: 391964 - RNA, 22 nt, Human
ucacugaagacugggcucuaaa

SEQ ID NO: 391965 - RNA, 22 nt, Human
gccugcaggcuguaguuuguga

SEQ ID NO: 391966 - RNA, 22 nt, Human
aguauuucugcucaugaaagag

SEQ ID NO: 391967 - RNA, 22 nt, Human
ucaucaaagucaaagaaugacu

SEQ ID NO: 391968 - RNA, 22 nt, Human
auucuucaccugagucagucua

SEQ ID NO: 391969 - RNA, 22 nt, Human
ggagagagaugccgccuugcuc

SEQ ID NO: 391970 - RNA, 22 nt, Human
agaggccaugcuagaggccugg

SEQ ID NO: 391971 - RNA, 22 nt, Human
uucacagagagaacucaaacca

SEQ ID NO: 391972 - RNA, 22 nt, Human
ugaucugaaggacaugggaccc

SEQ ID NO: 391973 - RNA, 22 nt, Human
gcuuuuucaaaugaaagcuggu

SEQ ID NO: 391974 - RNA, 22 nt, Human
aaauccuaagcagaggaauuua

SEQ ID NO: 391975 - RNA, 22 nt, Human
cagugagggaagaucucagcac

SEQ ID NO: 391976 - RNA, 21 nt, Human
gcaaggcuuuuguguuuccca

SEQ ID NO: 391977 - RNA, 22 nt, Human
gaguggagaucgugccacugca

SEQ ID NO: 391978 - RNA, 20 nt, Human
auugucagccuucagaggag

SEQ ID NO: 391979 - RNA, 20 nt, Human
cucugcagcaaggccugggu

SEQ ID NO: 391980 - RNA, 22 nt, Human
aagggcagcuauuaucgucauc

SEQ ID NO: 391981 - RNA, 22 nt, Human
gaggccagggaugcaaugagag

SEQ ID NO: 391982 - RNA, 23 nt, Human
gagggcucugagugcuugggcca

SEQ ID NO: 391983 - RNA, 22 nt, Human
ucucuggaguauaaccagggau

SEQ ID NO: 391984 - RNA, 22 nt, Human
ccucagaugucuuaaggcacug

SEQ ID NO: 391985 - RNA, 22 nt, Human
uggcauuuuguucaguauaugg

SEQ ID NO: 391986 - RNA, 22 nt, Human
uccucuggcccagcugccucug

SEQ ID NO: 391987 - RNA, 22 nt, Human
auuguaaguagaaauguuaugg

SEQ ID NO: 391988 - RNA, 22 nt, Human
acccaggacucucuuccaguag

SEQ ID NO: 391989 - RNA, 22 nt, Human
aggcacugaaagguggccagag

SEQ ID NO: 391990 - RNA, 22 nt, Human
agaggcaggagguugacuugag

SEQ ID NO: 391991 - RNA, 18 nt, Human
ccauuucaugauuauuac

SEQ ID NO: 391992 - RNA, 22 nt, Human
cugcuucuccaaaguaggacuu

SEQ ID NO: 391993 - RNA, 22 nt, Human
cccaagaucuuucgugcacuaa

SEQ ID NO: 391994 - RNA, 22 nt, Human
caguagcaggcacucagcacgu

SEQ ID NO: 391995 - RNA, 22 nt, Human
cagcagggaagcugugcuguuu

SEQ ID NO: 391996 - RNA, 22 nt, Human
gagugugggcacgggggccuug

SEQ ID NO: 391997 - RNA, 22 nt, Human
uggcccugcuaugauccugcaa

SEQ ID NO: 391998 - RNA, 22 nt, Human
gcucugucaacagcuagcugug

SEQ ID NO: 391999 - RNA, 22 nt, Human
ccuggcugucguuuugugaaau

SEQ ID NO: 392000 - RNA, 22 nt, Human
gccugccugaaggcuguaccag

SEQ ID NO: 392001 - RNA, 22 nt, Human
guugcacaguuccucaagcagg

SEQ ID NO: 392002 - RNA, 22 nt, Human
ucugaaagaagggcagucuuuu

SEQ ID NO: 392003 - RNA, 22 nt, Human
auggaaagggaagcaaggaaca

SEQ ID NO: 392004 - RNA, 22 nt, Human
cugucuccuccacugcauggga

SEQ ID NO: 392005 - RNA, 22 nt, Human
cugugccaggcccagcugacuu

SEQ ID NO: 392006 - RNA, 22 nt, Human
aaguaaaacacacaguccaccg

SEQ ID NO: 392007 - RNA, 23 nt, Human
gagagcugacugucaagacuguu

SEQ ID NO: 392008 - RNA, 22 nt, Human
uuguacuugccauagaacaaca

SEQ ID NO: 392009 - RNA, 22 nt, Human
aggccagcacgacagccgcagg

SEQ ID NO: 392010 - RNA, 22 nt, Human
ccagaucuaaguccaaaguacu

SEQ ID NO: 392011 - RNA, 22 nt, Human
ggcccagaauacuuuguaaaau

SEQ ID NO: 392012 - RNA, 22 nt, Human
ugaugggaggugcugcaggacc

SEQ ID NO: 392013 - RNA, 22 nt, Human
agugcauauaugaagaguauga

SEQ ID NO: 392014 - RNA, 22 nt, Human
cugaguccagggacagaggcgu

SEQ ID NO: 392015 - RNA, 22 nt, Human
ucuuuaauaucugccccagagc

SEQ ID NO: 392016 - RNA, 22 nt, Human
gcacagggcccugugcguaggu

SEQ ID NO: 392017 - RNA, 20 nt, Human
cugugccuaaaccuccgggu

SEQ ID NO: 392018 - RNA, 22 nt, Human
cgcuggccauagccuccugugu

SEQ ID NO: 392019 - RNA, 22 nt, Human
uugcuuccucgaggccagcgug

SEQ ID NO: 392020 - RNA, 22 nt, Human
ucucuggggauggaccugggag

SEQ ID NO: 392021 - RNA, 22 nt, Human
ccuguucaagggaugauugacc

SEQ ID NO: 392022 - RNA, 22 nt, Human
ugaguccaagagccagugggaa

SEQ ID NO: 392023 - RNA, 22 nt, Human
gcucagagcaucccagugaaug

SEQ ID NO: 392024 - RNA, 22 nt, Human
cacacuagucuauccauuagcu

SEQ ID NO: 392025 - RNA, 22 nt, Human
caaaguuuggcucucaugacau

SEQ ID NO: 392026 - RNA, 22 nt, Human
ugggagcaccuugagggcagaa

SEQ ID NO: 392027 - RNA, 22 nt, Human
aggccugaaggaagaugagcug

SEQ ID NO: 392028 - RNA, 22 nt, Human
uuaguuuucccaucuuuauggu

SEQ ID NO: 392029 - RNA, 22 nt, Human
uggaagcagugauucuugucug

SEQ ID NO: 392030 - RNA, 22 nt, Human
ucugccuuggcaaccacagcuu

SEQ ID NO: 392031 - RNA, 22 nt, Human
aguaaacacugucuuuauauau

SEQ ID NO: 392032 - RNA, 22 nt, Human
acagggcagcaacuuugugccu

SEQ ID NO: 392033 - RNA, 22 nt, Human
ccuccaggaacuugagagacac

SEQ ID NO: 392034 - RNA, 22 nt, Human
ucauucagguugggcaaguguc

SEQ ID NO: 392035 - RNA, 22 nt, Human
auuugcauaauagugauuugua

SEQ ID NO: 392036 - RNA, 22 nt, Human
uugcucuguaauaaucuggggu

SEQ ID NO: 392037 - RNA, 22 nt, Human
uuaaacagacaguaaaugaaac

SEQ ID NO: 392038 - RNA, 22 nt, Human
cagcuggguuuaguggggugug

SEQ ID NO: 392039 - RNA, 22 nt, Human
gggggacuggaccguccugggu

SEQ ID NO: 392040 - RNA, 22 nt, Human
gcccaggaaauaaaagugggcu

SEQ ID NO: 392041 - RNA, 23 nt, Human
cuguggcugaguccuguuggagu

SEQ ID NO: 392042 - RNA, 22 nt, Human
uccaggaggacugagggggcug

SEQ ID NO: 392043 - RNA, 22 nt, Human
aggaggcccuagagcucuagag

SEQ ID NO: 392044 - RNA, 22 nt, Human
aaaguucugggggagaagaacg

SEQ ID NO: 392045 - RNA, 19 nt, Human
ucugucacuggggguauuc

SEQ ID NO: 392046 - RNA, 22 nt, Human
ucaacacucuuuggcacaguua

SEQ ID NO: 392047 - RNA, 22 nt, Human
uuucuuauacuauauugucauc

SEQ ID NO: 392048 - RNA, 22 nt, Human
cuggagcuaauaauccaucuga

SEQ ID NO: 392049 - RNA, 22 nt, Human
caguagcacuagauaugugugg

SEQ ID NO: 392050 - RNA, 22 nt, Human
auaacaugagccagauugaaag

SEQ ID NO: 392051 - RNA, 20 nt, Human
acaggagaucugaggaaagg

SEQ ID NO: 392052 - RNA, 18 nt, Human
acauuucuccuucugacc

SEQ ID NO: 392053 - RNA, 22 nt, Human
ggauaagaaaauuguaauaacu

SEQ ID NO: 392054 - RNA, 22 nt, Human
aaauccuaauaaugcacuagug

SEQ ID NO: 392055 - RNA, 22 nt, Human
ugcaagcacucaaugcaaacag

SEQ ID NO: 392056 - RNA, 17 nt, Human
cucuccuuccucugagg

SEQ ID NO: 392057 - RNA, 22 nt, Human
acaauucugaugguuucccagu

SEQ ID NO: 392058 - RNA, 22 nt, Human
caggagacuauggcccaaggcc

SEQ ID NO: 392059 - RNA, 22 nt, Human
ugaaaucuuauacuuugguagu

SEQ ID NO: 392060 - RNA, 22 nt, Human
uggccuugggcagguggccugc

SEQ ID NO: 392061 - RNA, 19 nt, Human
ugucccagacuccgugucu

SEQ ID NO: 392062 - RNA, 22 nt, Human
ucccaggauguuggcggcaggu

SEQ ID NO: 392063 - RNA, 22 nt, Human
uuaaugauaccuauguuaauuu

SEQ ID NO: 392064 - RNA, 22 nt, Human
agggggugucucugauuggguu

SEQ ID NO: 392065 - RNA, 22 nt, Human
aucccaugagaccacguuggcu

SEQ ID NO: 392066 - RNA, 22 nt, Human
agucucugucguagaucagcgu

SEQ ID NO: 392067 - RNA, 22 nt, Human
aauaauuauuugagagcagacc

SEQ ID NO: 392068 - RNA, 22 nt, Human
acauuguauaaugauuaucaca

SEQ ID NO: 392069 - RNA, 22 nt, Human
ucaguuuucucauuuaugagau

SEQ ID NO: 392070 - RNA, 22 nt, Human
uuagggcaggcaugagagaacu

SEQ ID NO: 392071 - RNA, 22 nt, Human
uuggcuucucuuaacccuaaag

SEQ ID NO: 392072 - RNA, 22 nt, Human
ccaagggcugcugaggugucca

SEQ ID NO: 392073 - RNA, 21 nt, Human
auggagucaggggaaugggcc

SEQ ID NO: 392074 - RNA, 22 nt, Human
cucuggacacuggcaugggguc

SEQ ID NO: 392075 - RNA, 22 nt, Human
caaagaugcugauguuggauca

SEQ ID NO: 392076 - RNA, 22 nt, Human
acaaagcuagagaagagaauug

SEQ ID NO: 392077 - RNA, 22 nt, Human
aggcuucagaugaccuuagcau

SEQ ID NO: 392078 - RNA, 22 nt, Human
gggcagagaaauggacaguugg

SEQ ID NO: 392079 - RNA, 22 nt, Human
gccaggcauucuagaaguagug

SEQ ID NO: 392080 - RNA, 22 nt, Human
caguggcuguuucuggaaggca

SEQ ID NO: 392081 - RNA, 22 nt, Human
cauuucaaugccuucaacauag

SEQ ID NO: 392082 - RNA, 22 nt, Human
uuuuccucugcaauaaaagcag

SEQ ID NO: 392083 - RNA, 22 nt, Human
uagggacacugcucaugaguuc

SEQ ID NO: 392084 - RNA, 22 nt, Human
uaguaugggaagaacuuuguag

SEQ ID NO: 392085 - RNA, 22 nt, Human
ccaggugugcucugcaguggau

SEQ ID NO: 392086 - RNA, 22 nt, Human
cccaggcaggagugugguggcu

SEQ ID NO: 392087 - RNA, 22 nt, Human
uccaaacacccuccaugcugca

SEQ ID NO: 392088 - RNA, 22 nt, Human
ggccagagaauaugccuuacgu

SEQ ID NO: 392089 - RNA, 22 nt, Human
ccugaagcaaggguaggcaggu

SEQ ID NO: 392090 - RNA, 22 nt, Human
cccaggaggcagagguuggagc

SEQ ID NO: 392091 - RNA, 22 nt, Human
uugcauuugacaaauuauuuaa

SEQ ID NO: 392092 - RNA, 22 nt, Human
ccugggcuucugucuagauguu

SEQ ID NO: 392093 - RNA, 22 nt, Human
gcucugcuguguuuguucagca

SEQ ID NO: 392094 - RNA, 22 nt, Human
gcagcugaauguccauugcugc

SEQ ID NO: 392095 - RNA, 22 nt, Human
cauaucccauuggccaggacau

SEQ ID NO: 392096 - RNA, 21 nt, Human
ucucugggaggacuugugaga

SEQ ID NO: 392097 - RNA, 17 nt, Human
ccaggagagaugcuugu

SEQ ID NO: 392098 - RNA, 22 nt, Human
caggcacugugcaagggucucg

SEQ ID NO: 392099 - RNA, 22 nt, Human
ugggcacuguagcuggugcugg

SEQ ID NO: 392100 - RNA, 22 nt, Human
aggcugggaaaccugaaguugu

SEQ ID NO: 392101 - RNA, 22 nt, Human
agaauucucuuccauugaaaca

SEQ ID NO: 392102 - RNA, 22 nt, Human
uccaggcaaagugcugggcugc

SEQ ID NO: 392103 - RNA, 22 nt, Human
uccagccaugacucggacagug

SEQ ID NO: 392104 - RNA, 22 nt, Human
ccuguucacugcacaguuuccg

SEQ ID NO: 392105 - RNA, 22 nt, Human
gcugucacucuccggccuuccc

SEQ ID NO: 392106 - RNA, 22 nt, Human
uuuacagagaauguacauaaag

SEQ ID NO: 392107 - RNA, 22 nt, Human
aucuuucuccauauacaucuuu

SEQ ID NO: 392108 - RNA, 19 nt, Human
cagcugccuuuucuuugca

SEQ ID NO: 392109 - RNA, 22 nt, Human
gcucaggagcugacagccucaa

SEQ ID NO: 392110 - RNA, 22 nt, Human
auuucagguaccugugggaucc

SEQ ID NO: 392111 - RNA, 22 nt, Human
augcucugggcaggagcccugg

SEQ ID NO: 392112 - RNA, 22 nt, Human
ccugcuucagggaugauggcac

SEQ ID NO: 392113 - RNA, 22 nt, Human
ucagagaaguaagguggggugc

SEQ ID NO: 392114 - RNA, 22 nt, Human
ggaggccaaggcagguggaucg

SEQ ID NO: 392115 - RNA, 22 nt, Human
ugggcuccucgucacucgcugu

SEQ ID NO: 392116 - RNA, 22 nt, Human
ucaaaauucuagggagaauggu

SEQ ID NO: 392117 - RNA, 22 nt, Human
gggccagagcuuggcagcuggg

SEQ ID NO: 392118 - RNA, 17 nt, Human
agcugagcuggccaggg

SEQ ID NO: 392119 - RNA, 22 nt, Human
uccucugcuggaagggcaagag

SEQ ID NO: 392120 - RNA, 22 nt, Human
uagccgggugugguggaacucc

SEQ ID NO: 392121 - RNA, 22 nt, Human
agucuugcauuuucugaagaug

SEQ ID NO: 392122 - RNA, 22 nt, Human
uuucagacaggacuucauaugu

SEQ ID NO: 392123 - RNA, 23 nt, Human
gcucagagguuuuucucuggaug

SEQ ID NO: 392124 - RNA, 22 nt, Human
uugaagagugccuuccagacau

SEQ ID NO: 392125 - RNA, 22 nt, Human
acugaaggucucagcaaggaug

SEQ ID NO: 392126 - RNA, 22 nt, Human
guggcugcuacagagcuggagg

SEQ ID NO: 392127 - RNA, 22 nt, Human
agaagccacuggagguugagau

SEQ ID NO: 392128 - RNA, 22 nt, Human
gauaaaauauguggccuuuagu

SEQ ID NO: 392129 - RNA, 22 nt, Human
uuucucauagucaugccucuua

SEQ ID NO: 392130 - RNA, 22 nt, Human
cagcugcaugucuguggugguc

SEQ ID NO: 392131 - RNA, 22 nt, Human
gaggcaguuugccaugccagga

SEQ ID NO: 392132 - RNA, 22 nt, Human
aagaaaucagaaaagcauucgu

SEQ ID NO: 392133 - RNA, 20 nt, Human
ccucaggaugagggugagca

SEQ ID NO: 392134 - RNA, 22 nt, Human
gcagcuggugcaaaugucacuc

SEQ ID NO: 392135 - RNA, 22 nt, Human
gagagugauucccucccauaga

SEQ ID NO: 392136 - RNA, 22 nt, Human
ggcaccuggagguuuacuggau

SEQ ID NO: 392137 - RNA, 21 nt, Human
gccauuguuuucuaccuggag

SEQ ID NO: 392138 - RNA, 22 nt, Human
agucauaauuauaaacaucagu

SEQ ID NO: 392139 - RNA, 21 nt, Human
ugaggcuguuguaccagggag

SEQ ID NO: 392140 - RNA, 18 nt, Human
ugcucuggucucacuugg

SEQ ID NO: 392141 - RNA, 22 nt, Human
ugugugucagagucuccauggu

SEQ ID NO: 392142 - RNA, 22 nt, Human
guagaaaugguguguuucuucu

SEQ ID NO: 392143 - RNA, 22 nt, Human
cauuuacaauguacagguugug

SEQ ID NO: 392144 - RNA, 22 nt, Human
guuagaaacacauucuuauuga

SEQ ID NO: 392145 - RNA, 22 nt, Human
auauucguggucaaguaaggcc

SEQ ID NO: 392146 - RNA, 22 nt, Human
ugaggcagcauucuucaagaca

SEQ ID NO: 392147 - RNA, 22 nt, Human
gagucugaugucccccaggcca

SEQ ID NO: 392148 - RNA, 22 nt, Human
uuuaggcaagggcaagauuauc

SEQ ID NO: 392149 - RNA, 22 nt, Human
cucucagacugaagggccugug

SEQ ID NO: 392150 - RNA, 22 nt, Human
ggccaccucugcccuacugagu

SEQ ID NO: 392151 - RNA, 20 nt, Human
gccugcagagaaggucagag

SEQ ID NO: 392152 - RNA, 22 nt, Human
cuccaggcucguccaagaucga

SEQ ID NO: 392153 - RNA, 20 nt, Human
ggcagcaggaguuuccucuu

SEQ ID NO: 392154 - RNA, 19 nt, Human
ucaaugcaugaaaucagcc

SEQ ID NO: 392155 - RNA, 23 nt, Human
aggagacagggaagugccuggcu

SEQ ID NO: 392156 - RNA, 22 nt, Human
agaaccucuggauacaguuuaa

SEQ ID NO: 392157 - RNA, 22 nt, Human
ggccucugccucaucugggcac

SEQ ID NO: 392158 - RNA, 22 nt, Human
agggcuggcuccguuaccuuga

SEQ ID NO: 392159 - RNA, 22 nt, Human
aacauguaucgcuuuuuaauau

SEQ ID NO: 392160 - RNA, 21 nt, Human
cugagggccgcagcugggcuc

SEQ ID NO: 392161 - RNA, 22 nt, Human
cacaugcaucugucauguuugg

SEQ ID NO: 392162 - RNA, 22 nt, Human
aaaaucaguacacuuuauuuug

SEQ ID NO: 392163 - RNA, 22 nt, Human
aaguccagugcuuuagauucca

SEQ ID NO: 392164 - RNA, 22 nt, Human
ccagcccuugcugaaggguggc

SEQ ID NO: 392165 - RNA, 22 nt, Human
aggcacugggggaugagcaagg

SEQ ID NO: 392166 - RNA, 22 nt, Human
cugcugugcauauuuaucuagg

SEQ ID NO: 392167 - RNA, 22 nt, Human
augugcuuguaauguuaaaugu

SEQ ID NO: 392168 - RNA, 22 nt, Human
uuguuucugaguuuucauguau

SEQ ID NO: 392169 - RNA, 22 nt, Human
caggcagcgcucguggccuggc

SEQ ID NO: 392170 - RNA, 22 nt, Human
ugaaggccacuuccugugagcu

SEQ ID NO: 392171 - RNA, 22 nt, Human
ugaggcucugcuucuguggcuc

SEQ ID NO: 392172 - RNA, 22 nt, Human
auucaagauuaauucuauguca

SEQ ID NO: 392173 - RNA, 22 nt, Human
cacugcagaucagaggcugaga

SEQ ID NO: 392174 - RNA, 22 nt, Human
cacagggcagagaccugggugc

SEQ ID NO: 392175 - RNA, 22 nt, Human
ugcauuguuugauaggugaauu

SEQ ID NO: 392176 - RNA, 22 nt, Human
cagagcugcucaugguggccag

SEQ ID NO: 392177 - RNA, 19 nt, Human
ucucaauguucagaaagcu

SEQ ID NO: 392178 - RNA, 20 nt, Human
auaggaaagggaggggcuuu

SEQ ID NO: 392179 - RNA, 22 nt, Human
ucaucuucuauuaauagggaga

SEQ ID NO: 392180 - RNA, 22 nt, Human
auugcuguggaaauauaagaug

SEQ ID NO: 392181 - RNA, 22 nt, Human
ccucuggucccagcucugcugc

SEQ ID NO: 392182 - RNA, 22 nt, Human
aggcagagcuggguuuugaaau

SEQ ID NO: 392183 - RNA, 22 nt, Human
uccugcagagccgcccucaggu

SEQ ID NO: 392184 - RNA, 22 nt, Human
caggagcucucaucgucagggc

SEQ ID NO: 392185 - RNA, 22 nt, Human
gccugcuggauguggccaggcc

SEQ ID NO: 392186 - RNA, 22 nt, Human
aaugucuugagaagagaaaucu

SEQ ID NO: 392187 - RNA, 22 nt, Human
ugguggccaauucacagggcuc

SEQ ID NO: 392188 - RNA, 22 nt, Human
cugcccugggauggucugugcg

SEQ ID NO: 392189 - RNA, 23 nt, Human
uugaaagguagcuggcagcuaga

SEQ ID NO: 392190 - RNA, 22 nt, Human
uuugaagacagaucaauauaag

SEQ ID NO: 392191 - RNA, 22 nt, Human
uuugcauuuugauaagaucacu

SEQ ID NO: 392192 - RNA, 21 nt, Human
auuuucauuaauucagugugg

SEQ ID NO: 392193 - RNA, 22 nt, Human
agauuucccacuccauguauug

SEQ ID NO: 392194 - RNA, 22 nt, Human
uaccugcaaaguuccuuuugcc

SEQ ID NO: 392195 - RNA, 23 nt, Human
uuucacaaugagcauuacagaau

SEQ ID NO: 392196 - RNA, 21 nt, Human
gugguuauuuucauuagcauc

SEQ ID NO: 392197 - RNA, 22 nt, Human
gaaaauuauugaaaauggcucu

SEQ ID NO: 392198 - RNA, 22 nt, Human
gguggguauaguuagggccucu

SEQ ID NO: 392199 - RNA, 22 nt, Human
guuuaagaggguuucauuccca

SEQ ID NO: 392200 - RNA, 22 nt, Human
agugggcagcccaggaggucuu

SEQ ID NO: 392201 - RNA, 22 nt, Human
ugucccagauacuggacauaga

SEQ ID NO: 392202 - RNA, 20 nt, Human
gaugggaaucggagcuggua

SEQ ID NO: 392203 - RNA, 22 nt, Human
ggucucuguugccuccaucaag

SEQ ID NO: 392204 - RNA, 22 nt, Human
ugcaagagguaaaaugaaagga

SEQ ID NO: 392205 - RNA, 22 nt, Human
gcagcuuugucacggagugucg

SEQ ID NO: 392206 - RNA, 22 nt, Human
ccagcccucacugaggccucuc

SEQ ID NO: 392207 - RNA, 22 nt, Human
gaagcagccacggggagacaga

SEQ ID NO: 392208 - RNA, 22 nt, Human
gccucccugagucacccaagca

SEQ ID NO: 392209 - RNA, 22 nt, Human
cuucuuaaugacagauuaaaau

SEQ ID NO: 392210 - RNA, 22 nt, Human
cagcaggcguugggagaaagac

SEQ ID NO: 392211 - RNA, 22 nt, Human
ccuuccagaguucagucugccc

SEQ ID NO: 392212 - RNA, 15 nt, Human
cuccaugauuuugca

SEQ ID NO: 392213 - RNA, 22 nt, Human
uuuaacagguaaaguaaaugug

SEQ ID NO: 392214 - RNA, 22 nt, Human
caauuucaauacaaaauacauu

SEQ ID NO: 392215 - RNA, 22 nt, Human
accccaagacaguagaagagaa

SEQ ID NO: 392216 - RNA, 22 nt, Human
acagcagcacuauugacauuuu

SEQ ID NO: 392217 - RNA, 22 nt, Human
caauaugcaagcuauuaaguau

SEQ ID NO: 392218 - RNA, 22 nt, Human
uuugaaagaauuuauguacuuu

SEQ ID NO: 392219 - RNA, 21 nt, Human
aucucacagcccagagaagcc

SEQ ID NO: 392220 - RNA, 22 nt, Human
ugcaggaauuuuuugcagaaag

SEQ ID NO: 392221 - RNA, 22 nt, Human
ccaaagucagugcucagucguc

SEQ ID NO: 392222 - RNA, 22 nt, Human
cugcucuggggaagccagaugu

SEQ ID NO: 392223 - RNA, 22 nt, Human
uugaaucuauguauucagugua

SEQ ID NO: 392224 - RNA, 22 nt, Human
cuuaauuuaaaauaguucaggc

SEQ ID NO: 392225 - RNA, 22 nt, Human
ucagaggauuggacuuuuaugu

SEQ ID NO: 392226 - RNA, 22 nt, Human
uaaugcacauagaaguacuuag

SEQ ID NO: 392227 - RNA, 22 nt, Human
gaggcucagagaagucauggua

SEQ ID NO: 392228 - RNA, 22 nt, Human
uacacacagaggccaugggauu

SEQ ID NO: 392229 - RNA, 22 nt, Human
gcagggaggaagagaugcuucc

SEQ ID NO: 392230 - RNA, 21 nt, Human
uaaaucucuguauucuucagu

SEQ ID NO: 392231 - RNA, 22 nt, Human
acacaugagaaacaucaguugu

SEQ ID NO: 392232 - RNA, 22 nt, Human
cagcuugcuaauuuugacuuca

SEQ ID NO: 392233 - RNA, 22 nt, Human
auauacaguuuuacaggguuuc

SEQ ID NO: 392234 - RNA, 22 nt, Human
aaaggucauugaaaaggaggaa

SEQ ID NO: 392235 - RNA, 22 nt, Human
cuggcuccacucccugccugac

SEQ ID NO: 392236 - RNA, 22 nt, Human
ccaaggcuggagugcaguggcg

SEQ ID NO: 392237 - RNA, 22 nt, Human
ucuuaaaaguaugccaauugga

SEQ ID NO: 392238 - RNA, 22 nt, Human
aggcucaggcaggaauggcgga

SEQ ID NO: 392239 - RNA, 22 nt, Human
agcagggcugugcuccuuccga

SEQ ID NO: 392240 - RNA, 22 nt, Human
aguugaauaauuagacauaucu

SEQ ID NO: 392241 - RNA, 22 nt, Human
gcagggcaaugaucccgagagg

SEQ ID NO: 392242 - RNA, 22 nt, Human
gaaggagacccugaagaugcug

SEQ ID NO: 392243 - RNA, 22 nt, Human
gggcuccaacggugagcaugga

SEQ ID NO: 392244 - RNA, 22 nt, Human
cccccuggcaggcuggccucuc

SEQ ID NO: 392245 - RNA, 22 nt, Human
agaugcugccucuccucacaag

SEQ ID NO: 392246 - RNA, 22 nt, Human
aaaaaguuucaacugccaacuc

SEQ ID NO: 392247 - RNA, 22 nt, Human
aggccugagccccagguuuguu

SEQ ID NO: 392248 - RNA, 22 nt, Human
gaaggaagucauuagugcagac

SEQ ID NO: 392249 - RNA, 22 nt, Human
uuguuacaucuuauguaagugg

SEQ ID NO: 392250 - RNA, 22 nt, Human
cauuguuauagcauuacacacc

SEQ ID NO: 392251 - RNA, 22 nt, Human
gguuugcaugugauguugggca

SEQ ID NO: 392252 - RNA, 22 nt, Human
cugccuccugccgugcagcuuc

SEQ ID NO: 392253 - RNA, 22 nt, Human
agccagugcaacagcagugaag

SEQ ID NO: 392254 - RNA, 22 nt, Human
cucugggcaccaaagagcagcu

SEQ ID NO: 392255 - RNA, 22 nt, Human
ucccaggcuaggccucugcguu

SEQ ID NO: 392256 - RNA, 22 nt, Human
cccaguggagauaggagugugg

SEQ ID NO: 392257 - RNA, 22 nt, Human
ucuggcuuucauuuguuuaaag

SEQ ID NO: 392258 - RNA, 22 nt, Human
acauaucuuucccucuccugaa

SEQ ID NO: 392259 - RNA, 22 nt, Human
cagaaauguucuaaugauucag

SEQ ID NO: 392260 - RNA, 22 nt, Human
uauuuucuguggaggaccagau

SEQ ID NO: 392261 - RNA, 23 nt, Human
ucccuggaggcagguccagggcc

SEQ ID NO: 392262 - RNA, 22 nt, Human
acauuucuccuacuuguuauuu

SEQ ID NO: 392263 - RNA, 22 nt, Human
gccugagcaggcguggaccaug

SEQ ID NO: 392264 - RNA, 18 nt, Human
ggagagugagaucaaaca

SEQ ID NO: 392265 - RNA, 22 nt, Human
ucccuggggauguuggccugcc

SEQ ID NO: 392266 - RNA, 22 nt, Human
ccagggcaaaugagaucauagc

SEQ ID NO: 392267 - RNA, 22 nt, Human
ucagaggagaaguugggaaaau

SEQ ID NO: 392268 - RNA, 22 nt, Human
gcugaggccccagggugauggg

SEQ ID NO: 392269 - RNA, 21 nt, Human
gauugaaaccauggcagugag

SEQ ID NO: 392270 - RNA, 22 nt, Human
ggcagaggaaggaugaauucac

SEQ ID NO: 392271 - RNA, 22 nt, Human
acagccaggagccaugggcagg

SEQ ID NO: 392272 - RNA, 22 nt, Human
cuggcagguuuggugucuggug

SEQ ID NO: 392273 - RNA, 22 nt, Human
uguucacaaggugaugcuuuga

SEQ ID NO: 392274 - RNA, 22 nt, Human
ugagccuggggccugggcagcg

SEQ ID NO: 392275 - RNA, 22 nt, Human
ccuggcuguggcggugcucuca

SEQ ID NO: 392276 - RNA, 22 nt, Human
gcugugugacugagagccuggc

SEQ ID NO: 392277 - RNA, 22 nt, Human
ggagugaguacuggaguagcug

SEQ ID NO: 392278 - RNA, 22 nt, Human
gaggccaggagugcuguaaguu

SEQ ID NO: 392279 - RNA, 22 nt, Human
aaugucuuuaaagugcaauaga

SEQ ID NO: 392280 - RNA, 22 nt, Human
gucccagggaugcagacaugag

SEQ ID NO: 392281 - RNA, 21 nt, Human
uggaaagauucaaagaccagg

SEQ ID NO: 392282 - RNA, 22 nt, Human
acauuucucauucuccccuaac

SEQ ID NO: 392283 - RNA, 22 nt, Human
uaacagaaaagaacugaguuug

SEQ ID NO: 392284 - RNA, 22 nt, Human
acugccuuauaugcugugugug

SEQ ID NO: 392285 - RNA, 22 nt, Human
cugccucuauucacugaggcag

SEQ ID NO: 392286 - RNA, 22 nt, Human
gcccugagacugagcauggguu

SEQ ID NO: 392287 - RNA, 23 nt, Human
ucucaagaggaagcagggcucau

SEQ ID NO: 392288 - RNA, 22 nt, Human
gccuccuggauuuuagugccau

SEQ ID NO: 392289 - RNA, 22 nt, Human
uucagcagucguccaggaaaag

SEQ ID NO: 392290 - RNA, 22 nt, Human
cugugcuugacagugggaagca

SEQ ID NO: 392291 - RNA, 22 nt, Human
caguuucuuggaugccaauuuc

SEQ ID NO: 392292 - RNA, 22 nt, Human
aggcacaguggcucacaccugu

SEQ ID NO: 392293 - RNA, 22 nt, Human
caauuucacuaauaauauuuac

SEQ ID NO: 392294 - RNA, 22 nt, Human
uucucuuauucuggauaugcag

SEQ ID NO: 392295 - RNA, 22 nt, Human
auucuacaacccaauaauaauu

SEQ ID NO: 392296 - RNA, 22 nt, Human
gcauggcaagaucaggagacca

SEQ ID NO: 392297 - RNA, 22 nt, Human
ucccacugugaauccaaggccu

SEQ ID NO: 392298 - RNA, 22 nt, Human
gcagagcagugcuugcccagcg

SEQ ID NO: 392299 - RNA, 22 nt, Human
ccuuucucuaucgacccaucgc

SEQ ID NO: 392300 - RNA, 22 nt, Human
guacagaaugcuugguaaggca

SEQ ID NO: 392301 - RNA, 22 nt, Human
aaauucagcagugaaaugcccc

SEQ ID NO: 392302 - RNA, 22 nt, Human
aaguggagucccuacaaccagc

SEQ ID NO: 392303 - RNA, 22 nt, Human
ggcgaggccgggacaggcugga

SEQ ID NO: 392304 - RNA, 22 nt, Human
guagggagcccagagcccagug

SEQ ID NO: 392305 - RNA, 22 nt, Human
cugggaguugacgaggcuugua

SEQ ID NO: 392306 - RNA, 22 nt, Human
aucaggauguuuggcugucaua

SEQ ID NO: 392307 - RNA, 22 nt, Human
aaguccaugaucaagauguggc

SEQ ID NO: 392308 - RNA, 22 nt, Human
cacauccuucagcugagcccag

SEQ ID NO: 392309 - RNA, 22 nt, Human
caaugauugcuauuuacauaaa

SEQ ID NO: 392310 - RNA, 22 nt, Human
ucagaagcugguguccuuugaa

SEQ ID NO: 392311 - RNA, 22 nt, Human
aaaauacuguggaguguugaaa

SEQ ID NO: 392312 - RNA, 22 nt, Human
ucuggcucauacaagccugcaa

SEQ ID NO: 392313 - RNA, 22 nt, Human
uuucacaaguuucaggauucug

SEQ ID NO: 392314 - RNA, 22 nt, Human
cagaagucacccucagaauaac

SEQ ID NO: 392315 - RNA, 22 nt, Human
uaacagaaaggggacagaaaua

SEQ ID NO: 392316 - RNA, 22 nt, Human
ccccaggcagggccuaacagag

SEQ ID NO: 392317 - RNA, 22 nt, Human
ugugacagaucuuuaaauaaug

SEQ ID NO: 392318 - RNA, 22 nt, Human
ucagaguggugguuuugccuuc

SEQ ID NO: 392319 - RNA, 20 nt, Human
ggaccagguggggcgguggc

SEQ ID NO: 392320 - RNA, 22 nt, Human
ccuuuuucaauauagaauugca

SEQ ID NO: 392321 - RNA, 22 nt, Human
gagcagugggaaggaacagggu

SEQ ID NO: 392322 - RNA, 22 nt, Human
uaaguccuaacagacugggggc

SEQ ID NO: 392323 - RNA, 22 nt, Human
uuuuuguagucauuagaagagg

SEQ ID NO: 392324 - RNA, 22 nt, Human
agcuuccugaugcaagagggcu

SEQ ID NO: 392325 - RNA, 22 nt, Human
caguacuuugcaucauuccacu

SEQ ID NO: 392326 - RNA, 22 nt, Human
gggaugucacugugccuggcac

SEQ ID NO: 392327 - RNA, 22 nt, Human
ugcagggaaugcuugcagcaug

SEQ ID NO: 392328 - RNA, 22 nt, Human
gaaauauuguacuggagauguu

SEQ ID NO: 392329 - RNA, 22 nt, Human
acuuccugcuaugagcuucugu

SEQ ID NO: 392330 - RNA, 22 nt, Human
ggcuagaguggaacuggagcgg

SEQ ID NO: 392331 - RNA, 19 nt, Human
guuccaaaggccagaccuu

SEQ ID NO: 392332 - RNA, 22 nt, Human
agccagcucccuccccugcagg

SEQ ID NO: 392333 - RNA, 22 nt, Human
caacuuuaugauugguuuguca

SEQ ID NO: 392334 - RNA, 22 nt, Human
gugucccagcagcacauuggcu

SEQ ID NO: 392335 - RNA, 22 nt, Human
ucuccuuugaaaguuaggacug

SEQ ID NO: 392336 - RNA, 22 nt, Human
aaauguguauaugaaacaugau

SEQ ID NO: 392337 - RNA, 17 nt, Human
acaagcaguggccaugg

SEQ ID NO: 392338 - RNA, 22 nt, Human
caggcagcugacugucagauau

SEQ ID NO: 392339 - RNA, 18 nt, Human
gcugucugaggucugagg

SEQ ID NO: 392340 - RNA, 22 nt, Human
agccccucuguggcucugccuc

SEQ ID NO: 392341 - RNA, 22 nt, Human
uuacaagcagcuacauaucaca

SEQ ID NO: 392342 - RNA, 22 nt, Human
aggcucagccugggccuagagc

SEQ ID NO: 392343 - RNA, 22 nt, Human
cugcugugggcaggguagcugg

SEQ ID NO: 392344 - RNA, 22 nt, Human
uagcuguguaagcuugguaaga

SEQ ID NO: 392345 - RNA, 22 nt, Human
ccagcuucucucugaugcagcu

SEQ ID NO: 392346 - RNA, 20 nt, Human
auuccauaguuggcacuuuu

SEQ ID NO: 392347 - RNA, 22 nt, Human
cacagcagagggagccauugaa

SEQ ID NO: 392348 - RNA, 22 nt, Human
ugcuggcccaugaagacgcagu

SEQ ID NO: 392349 - RNA, 21 nt, Human
cugcaucucauagaacauguc

SEQ ID NO: 392350 - RNA, 22 nt, Human
ugagcccagucugucugacaug

SEQ ID NO: 392351 - RNA, 20 nt, Human
uauuugaaauggccaagugu

SEQ ID NO: 392352 - RNA, 22 nt, Human
uucagaaaugaauauugguauu

SEQ ID NO: 392353 - RNA, 22 nt, Human
augcuuaacucuguacauaguu

SEQ ID NO: 392354 - RNA, 22 nt, Human
cgcccagggcaggaggccgcuc

SEQ ID NO: 392355 - RNA, 22 nt, Human
ugcccuguuccugccuccagcu

SEQ ID NO: 392356 - RNA, 18 nt, Human
uggguggcuagggaguuu

SEQ ID NO: 392357 - RNA, 22 nt, Human
agauggcagggguaccuggaag

SEQ ID NO: 392358 - RNA, 23 nt, Human
cugcuguuuucuguaccugaagc

SEQ ID NO: 392359 - RNA, 22 nt, Human
agcagagcugcaguggccugcu

SEQ ID NO: 392360 - RNA, 22 nt, Human
gguggcuggaggagcugaugga

SEQ ID NO: 392361 - RNA, 22 nt, Human
caugucuugcccugauuaguag

SEQ ID NO: 392362 - RNA, 22 nt, Human
cuugugcaauugacauugaauc

SEQ ID NO: 392363 - RNA, 22 nt, Human
uuauucuuuaaacauauauguu

SEQ ID NO: 392364 - RNA, 20 nt, Human
aacuuguucuaccuguuuca

SEQ ID NO: 392365 - RNA, 22 nt, Human
uaacagaagaaaacauauugga

SEQ ID NO: 392366 - RNA, 22 nt, Human
auggcuuuucacagaggguucu

SEQ ID NO: 392367 - RNA, 22 nt, Human
acaguggaaaugugggagggga

SEQ ID NO: 392368 - RNA, 21 nt, Human
auuauuauuucuguguccagc

SEQ ID NO: 392369 - RNA, 18 nt, Human
ggucuuuaggucaguguc

SEQ ID NO: 392370 - RNA, 22 nt, Human
acugcuuuucagagucugccug

SEQ ID NO: 392371 - RNA, 22 nt, Human
ugauugaacugagcuucaagau

SEQ ID NO: 392372 - RNA, 22 nt, Human
gcagggcaaauguggaaaggag

SEQ ID NO: 392373 - RNA, 19 nt, Human
gcaggcacagcccugggug

SEQ ID NO: 392374 - RNA, 22 nt, Human
uggauuuauggagaccgaaagu

SEQ ID NO: 392375 - RNA, 22 nt, Human
caggugggcuugggagaacacu

SEQ ID NO: 392376 - RNA, 22 nt, Human
agcagccuuugaucaucuggga

SEQ ID NO: 392377 - RNA, 22 nt, Human
cugggcagagcuaacaccugag

SEQ ID NO: 392378 - RNA, 22 nt, Human
cuggccgguauuugccucuggg

SEQ ID NO: 392379 - RNA, 22 nt, Human
cucaggguaaugaaagacgaau

SEQ ID NO: 392380 - RNA, 22 nt, Human
auguacauuuguaguaauauca

SEQ ID NO: 392381 - RNA, 22 nt, Human
uuguccaaaguaacacaucuag

SEQ ID NO: 392382 - RNA, 22 nt, Human
uuuugcuuuuguaacacagugu

SEQ ID NO: 392383 - RNA, 22 nt, Human
guacuuccguggacuaauuguu

SEQ ID NO: 392384 - RNA, 22 nt, Human
uucaaugagcccaagaacguga

SEQ ID NO: 392385 - RNA, 22 nt, Human
gaaaugugugacaaguuucaau

SEQ ID NO: 392386 - RNA, 22 nt, Human
guggcugggcuccgagcggcuu

SEQ ID NO: 392387 - RNA, 22 nt, Human
augggcagaguggggacaggaa

SEQ ID NO: 392388 - RNA, 22 nt, Human
acauguguauagccuguauaga

SEQ ID NO: 392389 - RNA, 22 nt, Human
ccccagccuuccaugggaauug

SEQ ID NO: 392390 - RNA, 22 nt, Human
auguuuccagguucuuccuaug

SEQ ID NO: 392391 - RNA, 22 nt, Human
agaggacagguuuuccaugggc

SEQ ID NO: 392392 - RNA, 22 nt, Human
gaggacaggagacucacuguuu

SEQ ID NO: 392393 - RNA, 22 nt, Human
uagcagcuuaaguaauuagaau

SEQ ID NO: 392394 - RNA, 17 nt, Human
acucaggaucugggagu

SEQ ID NO: 392395 - RNA, 22 nt, Human
uagugcuugagucucuccguac

SEQ ID NO: 392396 - RNA, 22 nt, Human
aaugcagugagccauuaaaugg

SEQ ID NO: 392397 - RNA, 23 nt, Human
gggcugcuccaggccaaggcugg

SEQ ID NO: 392398 - RNA, 22 nt, Human
aaggcaggaugcggacccaucu

SEQ ID NO: 392399 - RNA, 22 nt, Human
ucagggcaggcgagcagcugcu

SEQ ID NO: 392400 - RNA, 22 nt, Human
caagcuggcugggagaggcacg

SEQ ID NO: 392401 - RNA, 22 nt, Human
agaaaauauucauugagaggcu

SEQ ID NO: 392402 - RNA, 22 nt, Human
ucaggcugugggcacuggccau

SEQ ID NO: 392403 - RNA, 17 nt, Human
ggccuuggggccucagu

SEQ ID NO: 392404 - RNA, 22 nt, Human
ucaggaugaccacgagccucua

SEQ ID NO: 392405 - RNA, 22 nt, Human
gccaggcuggccagcaccuucu

SEQ ID NO: 392406 - RNA, 22 nt, Human
aaaaugcuauuucauggaggag

SEQ ID NO: 392407 - RNA, 22 nt, Human
cauauuuauagaucuggcauuu

SEQ ID NO: 392408 - RNA, 22 nt, Human
cagucccuaguggagcucacag

SEQ ID NO: 392409 - RNA, 22 nt, Human
uguguaaaaucugauuaauacu

SEQ ID NO: 392410 - RNA, 22 nt, Human
aguaaagcagaguugcaguaca

SEQ ID NO: 392411 - RNA, 21 nt, Human
ugcugccauagaccugaggga

SEQ ID NO: 392412 - RNA, 22 nt, Human
uuaaauuuuagaaacagacucu

SEQ ID NO: 392413 - RNA, 22 nt, Human
gaaggccucacucugcagcaua

SEQ ID NO: 392414 - RNA, 21 nt, Human
gaguccuuccaauguccucag

SEQ ID NO: 392415 - RNA, 22 nt, Human
auggauuugcuuauacacaugu

SEQ ID NO: 392416 - RNA, 22 nt, Human
ccugggucacucaggcaggcgg

SEQ ID NO: 392417 - RNA, 22 nt, Human
agauguaaacucucaugucauu

SEQ ID NO: 392418 - RNA, 22 nt, Human
ccugcaguuuguugugaccccg

SEQ ID NO: 392419 - RNA, 22 nt, Human
cucagaauuacaucccauuuua

SEQ ID NO: 392420 - RNA, 22 nt, Human
uuugaaagucaaccuuccaguu

SEQ ID NO: 392421 - RNA, 22 nt, Human
gcagcuaccacccaggaaggac

SEQ ID NO: 392422 - RNA, 22 nt, Human
uauuuuguuaauaauccagucc

SEQ ID NO: 392423 - RNA, 22 nt, Human
ugcuggagaucauuaauguuca

SEQ ID NO: 392424 - RNA, 19 nt, Human
uggaggagaggaaaaguca

SEQ ID NO: 392425 - RNA, 18 nt, Human
gagaggcccggcugugcc

SEQ ID NO: 392426 - RNA, 22 nt, Human
agguggcaggaggucagagaaa

SEQ ID NO: 392427 - RNA, 22 nt, Human
gagacugauggggcucccagaa

SEQ ID NO: 392428 - RNA, 22 nt, Human
gcugccugccuugccuggagga

SEQ ID NO: 392429 - RNA, 22 nt, Human
uuccagugaugggcaauuuggu

SEQ ID NO: 392430 - RNA, 22 nt, Human
aacauguaaccagcauucaucu

SEQ ID NO: 392431 - RNA, 20 nt, Human
accucugcaucaauccuuug

SEQ ID NO: 392432 - RNA, 22 nt, Human
gaggcagcauucgcauagacag

SEQ ID NO: 392433 - RNA, 22 nt, Human
gccaggugcauggcugagucuc

SEQ ID NO: 392434 - RNA, 16 nt, Human
uggcugagagaggguu

SEQ ID NO: 392435 - RNA, 19 nt, Human
ccuuccuccccagggccau

SEQ ID NO: 392436 - RNA, 22 nt, Human
agagucugaaugcucagaguug

SEQ ID NO: 392437 - RNA, 22 nt, Human
ccugucuggccuuccacggggg

SEQ ID NO: 392438 - RNA, 22 nt, Human
ggagucaggagcaggcugggcu

SEQ ID NO: 392439 - RNA, 22 nt, Human
agaaaugcucuuccugaccaga

SEQ ID NO: 392440 - RNA, 22 nt, Human
ggcagcuuguccuucaggagag

SEQ ID NO: 392441 - RNA, 22 nt, Human
ucauuauccuaguaucuugaau

SEQ ID NO: 392442 - RNA, 21 nt, Human
uugaagcaaggguggcucuga

SEQ ID NO: 392443 - RNA, 22 nt, Human
gcugugugcucacguaguggaa

SEQ ID NO: 392444 - RNA, 22 nt, Human
uagggcucugcucaucaguugu

SEQ ID NO: 392445 - RNA, 22 nt, Human
aacucaguuacauauuagaaua

SEQ ID NO: 392446 - RNA, 22 nt, Human
gcauuuccugugcuuggcauau

SEQ ID NO: 392447 - RNA, 22 nt, Human
ucuuucaaugagcauucuuucc

SEQ ID NO: 392448 - RNA, 22 nt, Human
ucugcaggcuuggaguggcagc

SEQ ID NO: 392449 - RNA, 22 nt, Human
ucuuuaauuguggaagagcagc

SEQ ID NO: 392450 - RNA, 22 nt, Human
cccaggagaucuggaucucguc

SEQ ID NO: 392451 - RNA, 22 nt, Human
aucuggcucauucagggaacgg

SEQ ID NO: 392452 - RNA, 22 nt, Human
aguucucaagacaauuaccugu

SEQ ID NO: 392453 - RNA, 22 nt, Human
aggcagagcuaggaagaauugu

SEQ ID NO: 392454 - RNA, 22 nt, Human
uguacaaugccgagacuaacuc

SEQ ID NO: 392455 - RNA, 22 nt, Human
aggaggaggugggacacaguga

SEQ ID NO: 392456 - RNA, 20 nt, Human
ccugucugcaauggagguca

SEQ ID NO: 392457 - RNA, 22 nt, Human
ugggggugacuaucucgggaau

SEQ ID NO: 392458 - RNA, 22 nt, Human
uagggcucuggugggcucuguu

SEQ ID NO: 392459 - RNA, 22 nt, Human
uuucccaguucccugcucuaua

SEQ ID NO: 392460 - RNA, 22 nt, Human
cugugcauugucuugucuguag

SEQ ID NO: 392461 - RNA, 22 nt, Human
aguggcagagcugugucuugaa

SEQ ID NO: 392462 - RNA, 22 nt, Human
gcucucugucguuaugcuucau

SEQ ID NO: 392463 - RNA, 22 nt, Human
agguggggaggagugucucuuu

SEQ ID NO: 392464 - RNA, 22 nt, Human
auuagcugaccucuaaggagcc

SEQ ID NO: 392465 - RNA, 22 nt, Human
ugacauaauaauccaaacauac

SEQ ID NO: 392466 - RNA, 22 nt, Human
gccugagaguugaaguucagug

SEQ ID NO: 392467 - RNA, 22 nt, Human
aaguguuaaaagauuaaaugcu

SEQ ID NO: 392468 - RNA, 22 nt, Human
gaaggagcuaaagggagcccug

SEQ ID NO: 392469 - RNA, 22 nt, Human
cacauuucucuaccucacacaa

SEQ ID NO: 392470 - RNA, 22 nt, Human
ugcuauaagaauuauauuacuc

SEQ ID NO: 392471 - RNA, 22 nt, Human
acagcagccugcagcccugugu

SEQ ID NO: 392472 - RNA, 22 nt, Human
ucauuuguugcuguuaccugag

SEQ ID NO: 392473 - RNA, 22 nt, Human
caggccagcuuccugacauccu

SEQ ID NO: 392474 - RNA, 22 nt, Human
gcagcuuuguaaaguaugaagc

SEQ ID NO: 392475 - RNA, 23 nt, Human
agccagggcacugguggagauug

SEQ ID NO: 392476 - RNA, 22 nt, Human
aaaccaucagauaauucauacu

SEQ ID NO: 392477 - RNA, 22 nt, Human
uuucacauuuguuuuaagaagu

SEQ ID NO: 392478 - RNA, 22 nt, Human
aguagaauagauggauacuauu

SEQ ID NO: 392479 - RNA, 22 nt, Human
auaaaugauucagcaggaaaua

SEQ ID NO: 392480 - RNA, 22 nt, Human
ggccucagaccggagcuggcca

SEQ ID NO: 392481 - RNA, 22 nt, Human
gccucugcaucaucacuccagc

SEQ ID NO: 392482 - RNA, 22 nt, Human
ugaguuuuuucaacauaugaag

SEQ ID NO: 392483 - RNA, 22 nt, Human
agugggcaggcagggugcgcag

SEQ ID NO: 392484 - RNA, 22 nt, Human
agaaggccuaacuugggggcaa

SEQ ID NO: 392485 - RNA, 20 nt, Human
caccagucaugagucaauac

SEQ ID NO: 392486 - RNA, 22 nt, Human
ccacauuuuugauacucucacu

SEQ ID NO: 392487 - RNA, 22 nt, Human
ccuguguguaggccaggggagu

SEQ ID NO: 392488 - RNA, 22 nt, Human
ucagggcaucucuuaaguggug

SEQ ID NO: 392489 - RNA, 22 nt, Human
auccaaaucaugucagaagaac

SEQ ID NO: 392490 - RNA, 22 nt, Human
uucuugauuucaugcaguuaag

SEQ ID NO: 392491 - RNA, 22 nt, Human
cccuggaggcggagcuugcagu

SEQ ID NO: 392492 - RNA, 22 nt, Human
aaauugaaugauuaagugguga

SEQ ID NO: 392493 - RNA, 22 nt, Human
ccuggagcacagcccaguccca

SEQ ID NO: 392494 - RNA, 22 nt, Human
caaagccauagaguagauaaga

SEQ ID NO: 392495 - RNA, 22 nt, Human
uggcugagguuaugcugguugu

SEQ ID NO: 392496 - RNA, 22 nt, Human
agggagcucaguuggaagcggu

SEQ ID NO: 392497 - RNA, 22 nt, Human
aagagcuggcccaaucugagca

SEQ ID NO: 392498 - RNA, 22 nt, Human
aaaugccuguguaaauucuagc

SEQ ID NO: 392499 - RNA, 22 nt, Human
cugugccuggggggcagagcug

SEQ ID NO: 392500 - RNA, 22 nt, Human
aaauacuagaauucagaguuga

SEQ ID NO: 392501 - RNA, 22 nt, Human
gcagaacauuucacaguaucuu

SEQ ID NO: 392502 - RNA, 22 nt, Human
gguuucaaauuaaagucuuaag

SEQ ID NO: 392503 - RNA, 22 nt, Human
aaaauauuuuagggccaggaga

SEQ ID NO: 392504 - RNA, 22 nt, Human
gcucagagcacucagacucagc

SEQ ID NO: 392505 - RNA, 22 nt, Human
acucuucuugcugcucauuaau

SEQ ID NO: 392506 - RNA, 22 nt, Human
ugucucaguauacgaaacacuu

SEQ ID NO: 392507 - RNA, 22 nt, Human
ugcuuauuuauagucaauagag

SEQ ID NO: 392508 - RNA, 21 nt, Human
ucagagagucacagugaacug

SEQ ID NO: 392509 - RNA, 22 nt, Human
gaugcacugcaguauauacugu

SEQ ID NO: 392510 - RNA, 22 nt, Human
uuuuuccuagugcuuucuggua

SEQ ID NO: 392511 - RNA, 22 nt, Human
aggucauuccuugucuucuugc

SEQ ID NO: 392512 - RNA, 22 nt, Human
auaaagauuuuuaggcauuucu

SEQ ID NO: 392513 - RNA, 22 nt, Human
gccucugcacuguggcacacca

SEQ ID NO: 392514 - RNA, 20 nt, Human
ucuaauuaaaauugucuagu

SEQ ID NO: 392515 - RNA, 22 nt, Human
ugcugcucucagccaccaggaa

SEQ ID NO: 392516 - RNA, 22 nt, Human
agccagcugugggcucaggcgg

SEQ ID NO: 392517 - RNA, 22 nt, Human
aggugcuuggcucgugcacaca

SEQ ID NO: 392518 - RNA, 22 nt, Human
uccaaaaaacguuugaauaguu

SEQ ID NO: 392519 - RNA, 22 nt, Human
agggggugcuacuuccagaguu

SEQ ID NO: 392520 - RNA, 22 nt, Human
cuggugucugcucccucacagc

SEQ ID NO: 392521 - RNA, 22 nt, Human
gaugaaaaucuugagaugucga

SEQ ID NO: 392522 - RNA, 22 nt, Human
uggccugguuguugcugccguu

SEQ ID NO: 392523 - RNA, 22 nt, Human
gaaacugugaucguguucuggg

SEQ ID NO: 392524 - RNA, 21 nt, Human
uuccagagauuguuucaccug

SEQ ID NO: 392525 - RNA, 22 nt, Human
ccaggcagccaagugugugugu

SEQ ID NO: 392526 - RNA, 22 nt, Human
uucacagauguauuggaacucc

SEQ ID NO: 392527 - RNA, 22 nt, Human
caggagugaaaugaggcccagg

SEQ ID NO: 392528 - RNA, 20 nt, Human
aaaaacaguaaugcugaaga

SEQ ID NO: 392529 - RNA, 22 nt, Human
cccugcaggcucagacuggagu

SEQ ID NO: 392530 - RNA, 22 nt, Human
ccuggaaguuggagguugcagu

SEQ ID NO: 392531 - RNA, 22 nt, Human
uccaggagcucauccacgucaa

SEQ ID NO: 392532 - RNA, 22 nt, Human
agcugccaaguuggaguagcaa

SEQ ID NO: 392533 - RNA, 22 nt, Human
cucuuaaagcuuccaguuucaa

SEQ ID NO: 392534 - RNA, 22 nt, Human
aucaggaaauacuuauuuauaa

SEQ ID NO: 392535 - RNA, 22 nt, Human
uuugaaaauuuaagugcuacac

SEQ ID NO: 392536 - RNA, 22 nt, Human
uguacauagaucuugaaaauua

SEQ ID NO: 392537 - RNA, 23 nt, Human
aggagccaggaaccagcuucccc

SEQ ID NO: 392538 - RNA, 22 nt, Human
uuuacuuuugguaaggucauuu

SEQ ID NO: 392539 - RNA, 22 nt, Human
auggcuuucagauuucuauguu

SEQ ID NO: 392540 - RNA, 22 nt, Human
uuuuagauaguuuaacugcacu

SEQ ID NO: 392541 - RNA, 22 nt, Human
guggauggauugaggcaguggg

SEQ ID NO: 392542 - RNA, 19 nt, Human
ucauucaggaccaguggau

SEQ ID NO: 392543 - RNA, 22 nt, Human
uucauagaucucaauuuugagg

SEQ ID NO: 392544 - RNA, 22 nt, Human
gggcacuggaggccaaggagcu

SEQ ID NO: 392545 - RNA, 22 nt, Human
ccacucugauuuuggcuccacu

SEQ ID NO: 392546 - RNA, 22 nt, Human
augugucuuugagacucugcua

SEQ ID NO: 392547 - RNA, 22 nt, Human
uccugagauaaaucucauguga

SEQ ID NO: 392548 - RNA, 23 nt, Human
agaugaggcuucuccauguuggu

SEQ ID NO: 392549 - RNA, 22 nt, Human
ccagagagguagcuuacccucu

SEQ ID NO: 392550 - RNA, 22 nt, Human
acagcugggugcugcucagagc

SEQ ID NO: 392551 - RNA, 22 nt, Human
gaaggaggugucaguuggacug

SEQ ID NO: 392552 - RNA, 22 nt, Human
uuucaguuuccagcuuugucau

SEQ ID NO: 392553 - RNA, 22 nt, Human
gcaggggaguggcaggcccgga

SEQ ID NO: 392554 - RNA, 22 nt, Human
uuccauuguuucugucuucacu

SEQ ID NO: 392555 - RNA, 22 nt, Human
gacugucauucuagugcccaug

SEQ ID NO: 392556 - RNA, 22 nt, Human
uagaacuacaagcauuaaaagu

SEQ ID NO: 392557 - RNA, 22 nt, Human
uccaggagggauugggcugugg

SEQ ID NO: 392558 - RNA, 22 nt, Human
gggugcaggcagcccaggcagg

SEQ ID NO: 392559 - RNA, 22 nt, Human
acagccagaggagccaggcugg

SEQ ID NO: 392560 - RNA, 22 nt, Human
uacaguauuaugagugauugaa

SEQ ID NO: 392561 - RNA, 22 nt, Human
ucuacugugguccuuguaacca

SEQ ID NO: 392562 - RNA, 22 nt, Human
uuuagaaauucaucuauggccu

SEQ ID NO: 392563 - RNA, 22 nt, Human
caagaugugccuaaucagaccu

SEQ ID NO: 392564 - RNA, 22 nt, Human
cuuagaaauuguuacucauuca

SEQ ID NO: 392565 - RNA, 22 nt, Human
augaaauaucuugaagaaauuc

SEQ ID NO: 392566 - RNA, 22 nt, Human
acaggggauugauuggaagucu

SEQ ID NO: 392567 - RNA, 22 nt, Human
ggcucagguuaccagucccucc

SEQ ID NO: 392568 - RNA, 22 nt, Human
ccugccagggccuuggaagaaa

SEQ ID NO: 392569 - RNA, 22 nt, Human
aaggcugcuuuuaacaugcaua

SEQ ID NO: 392570 - RNA, 22 nt, Human
acucugccaucccaggugcugu

SEQ ID NO: 392571 - RNA, 22 nt, Human
gggcugagauuggugcccuguc

SEQ ID NO: 392572 - RNA, 22 nt, Human
agcugucuaccugcagaguccu

SEQ ID NO: 392573 - RNA, 22 nt, Human
aucaguuaguuacugcuaagau

SEQ ID NO: 392574 - RNA, 22 nt, Human
cuggggugugcucagagcaggg

SEQ ID NO: 392575 - RNA, 22 nt, Human
aagggcuggccacauucugggu

SEQ ID NO: 392576 - RNA, 22 nt, Human
augugaaaaauuucuuauuaca

SEQ ID NO: 392577 - RNA, 22 nt, Human
ccugccagcccgcguucaugcc

SEQ ID NO: 392578 - RNA, 20 nt, Human
cuguagggugcagcaggcuc

SEQ ID NO: 392579 - RNA, 22 nt, Human
uuaauauguugaaauuuauuag

SEQ ID NO: 392580 - RNA, 22 nt, Human
ugggugggagcgcccugucugg

SEQ ID NO: 392581 - RNA, 22 nt, Human
gcuggaaggcuaggcucaguug

SEQ ID NO: 392582 - RNA, 22 nt, Human
caggguggaauggaaugcuggc

SEQ ID NO: 392583 - RNA, 22 nt, Human
auugaggcagcauaguucaggg

SEQ ID NO: 392584 - RNA, 22 nt, Human
agggcaugugggagaggagccu

SEQ ID NO: 392585 - RNA, 22 nt, Human
gcccaggaguucaagucuagug

SEQ ID NO: 392586 - RNA, 22 nt, Human
ugaacaaacugcauucuucacu

SEQ ID NO: 392587 - RNA, 22 nt, Human
uaugaaacauucauacaaauaa

SEQ ID NO: 392588 - RNA, 22 nt, Human
cugcagagcagccaguccccca

SEQ ID NO: 392589 - RNA, 19 nt, Human
ugaagcaauaccauuuuug

SEQ ID NO: 392590 - RNA, 22 nt, Human
uggguuuaaacucaacucuaaa

SEQ ID NO: 392591 - RNA, 22 nt, Human
guguuccauguuugagguaguu

SEQ ID NO: 392592 - RNA, 22 nt, Human
aagcauuuuagauaaagcauca

SEQ ID NO: 392593 - RNA, 22 nt, Human
acagagcucccagccaucuccu

SEQ ID NO: 392594 - RNA, 22 nt, Human
aggcacugugcagucccaagca

SEQ ID NO: 392595 - RNA, 22 nt, Human
gcguggugcugcccugcacaca

SEQ ID NO: 392596 - RNA, 22 nt, Human
acugucaccaucagagcgggaa

SEQ ID NO: 392597 - RNA, 22 nt, Human
uucuuaacucaaauauauaucc

SEQ ID NO: 392598 - RNA, 22 nt, Human
uuugauuuacuggauauucuca

SEQ ID NO: 392599 - RNA, 22 nt, Human
caaggaaaaagcgagcucgggg

SEQ ID NO: 392600 - RNA, 22 nt, Human
aaaucucacuguagucaaagug

SEQ ID NO: 392601 - RNA, 22 nt, Human
agccacagagguugaugugguu

SEQ ID NO: 392602 - RNA, 22 nt, Human
uaagacaugguugaucuagugu

SEQ ID NO: 392603 - RNA, 22 nt, Human
aaguccuugaagaaacaguucu

SEQ ID NO: 392604 - RNA, 22 nt, Human
cagcauggggcuuggagucagc

SEQ ID NO: 392605 - RNA, 22 nt, Human
auguguaugcaugcacuaagau

SEQ ID NO: 392606 - RNA, 22 nt, Human
uaggaagaugaguaucaacuug

SEQ ID NO: 392607 - RNA, 22 nt, Human
uggccugccucccggcuucuuu

SEQ ID NO: 392608 - RNA, 22 nt, Human
uggucagacaaaggagaauguu

SEQ ID NO: 392609 - RNA, 22 nt, Human
ccagagccccugagcuucccug

SEQ ID NO: 392610 - RNA, 22 nt, Human
cagacuggccacaucugcacug

SEQ ID NO: 392611 - RNA, 22 nt, Human
ggcagcuggggcagugcccugu

SEQ ID NO: 392612 - RNA, 22 nt, Human
caguggaaaucagagugagagu

SEQ ID NO: 392613 - RNA, 22 nt, Human
cccaggaggaggaaaaagcucg

SEQ ID NO: 392614 - RNA, 22 nt, Human
cagguaagagacggauuggccc

SEQ ID NO: 392615 - RNA, 22 nt, Human
cuggugccuccucccugugcuu

SEQ ID NO: 392616 - RNA, 20 nt, Human
aagcacauuucuacaauaau

SEQ ID NO: 392617 - RNA, 22 nt, Human
ugcagcugaggccagcuaugcc

SEQ ID NO: 392618 - RNA, 22 nt, Human
uuacaaguauuuaagaugcugu

SEQ ID NO: 392619 - RNA, 22 nt, Human
uauuccaacugucauagucaua

SEQ ID NO: 392620 - RNA, 22 nt, Human
uggggacaggagacuuacagcu

SEQ ID NO: 392621 - RNA, 22 nt, Human
agaauucuguucuucgggugug

SEQ ID NO: 392622 - RNA, 22 nt, Human
acauaauaggugccugaauauu

SEQ ID NO: 392623 - RNA, 22 nt, Human
ugacuucaagguucagcaccuu

SEQ ID NO: 392624 - RNA, 22 nt, Human
cagaggaagcagacacaucuug

SEQ ID NO: 392625 - RNA, 22 nt, Human
aaggcagucugguuucaaagca

SEQ ID NO: 392626 - RNA, 22 nt, Human
aggcagcuuuguaguaaagcua

SEQ ID NO: 392627 - RNA, 22 nt, Human
uuuagaguugaguauucauugg

SEQ ID NO: 392628 - RNA, 22 nt, Human
gaugauaacagcauuucaacug

SEQ ID NO: 392629 - RNA, 22 nt, Human
aaauacugucucugagagagcc

SEQ ID NO: 392630 - RNA, 22 nt, Human
cucuguccuaugcuugauagaa

SEQ ID NO: 392631 - RNA, 22 nt, Human
uggagaaggccggccaggagug

SEQ ID NO: 392632 - RNA, 22 nt, Human
aggcagggucuugcuauguugc

SEQ ID NO: 392633 - RNA, 22 nt, Human
gcaaggcugagcacauuugcau

SEQ ID NO: 392634 - RNA, 22 nt, Human
aagagcuggauggaaucuggga

SEQ ID NO: 392635 - RNA, 22 nt, Human
aaaggccaccaacaugaagcau

SEQ ID NO: 392636 - RNA, 22 nt, Human
aaacauguuuucugaauauuuu

SEQ ID NO: 392637 - RNA, 18 nt, Human
cauaauuuucuuucuuua

SEQ ID NO: 392638 - RNA, 23 nt, Human
ugagcaucacaggagaaccaggc

SEQ ID NO: 392639 - RNA, 22 nt, Human
aagcuuucagagcagaauguga

SEQ ID NO: 392640 - RNA, 22 nt, Human
uucucacuauguauguagauug

SEQ ID NO: 392641 - RNA, 22 nt, Human
agccaugcaccuuacucuugcu

SEQ ID NO: 392642 - RNA, 22 nt, Human
gaucaaaagcuggguucuaaaa

SEQ ID NO: 392643 - RNA, 22 nt, Human
cugcuuugacuguuaagaacca

SEQ ID NO: 392644 - RNA, 22 nt, Human
aaagauuuaagaauaauuugug

SEQ ID NO: 392645 - RNA, 22 nt, Human
ccaugagccaggcugaggaagc

SEQ ID NO: 392646 - RNA, 20 nt, Human
ccugggcuccaggagccccg

SEQ ID NO: 392647 - RNA, 22 nt, Human
acccuggacuggggcugaggcu

SEQ ID NO: 392648 - RNA, 20 nt, Human
gaagcagcuucauguagaca

SEQ ID NO: 392649 - RNA, 22 nt, Human
gcaguccaaaguggcucucacc

SEQ ID NO: 392650 - RNA, 22 nt, Human
ccaaguacagauuccuccacug

SEQ ID NO: 392651 - RNA, 18 nt, Human
gggcacuggggacuggag

SEQ ID NO: 392652 - RNA, 22 nt, Human
ccugggucuugguucaugcucu

SEQ ID NO: 392653 - RNA, 22 nt, Human
cacaugcauaaggauaauuacu

SEQ ID NO: 392654 - RNA, 22 nt, Human
agcaggguuuggggauuggcac

SEQ ID NO: 392655 - RNA, 22 nt, Human
uagucaccuuuggcaccugcaa

SEQ ID NO: 392656 - RNA, 22 nt, Human
caagaauccuguucuugaagau

SEQ ID NO: 392657 - RNA, 18 nt, Human
ugagacagcuaccacuug

SEQ ID NO: 392658 - RNA, 22 nt, Human
augcuuuuccaggagaaauaua

SEQ ID NO: 392659 - RNA, 22 nt, Human
aagggcuggagacugggucuuc

SEQ ID NO: 392660 - RNA, 22 nt, Human
cccagacucaucccugggagcu

SEQ ID NO: 392661 - RNA, 22 nt, Human
ggacucuguuuuccugaucacu

SEQ ID NO: 392662 - RNA, 22 nt, Human
uauuuccaaaagccuauuauga

SEQ ID NO: 392663 - RNA, 22 nt, Human
cuggggugagcagaaacagggg

SEQ ID NO: 392664 - RNA, 22 nt, Human
cagcugugagcagccaguugcc

SEQ ID NO: 392665 - RNA, 19 nt, Human
cacacccaugcuugccaag

SEQ ID NO: 392666 - RNA, 22 nt, Human
aggcaggcugcuauggaguaga

SEQ ID NO: 392667 - RNA, 20 nt, Human
ucuggcaggugaacgagcug

SEQ ID NO: 392668 - RNA, 22 nt, Human
uggcuccuaggauggugccugg

SEQ ID NO: 392669 - RNA, 23 nt, Human
gaggccacauuccccugcuugag

SEQ ID NO: 392670 - RNA, 22 nt, Human
uggcacagacagaucaggaguc

SEQ ID NO: 392671 - RNA, 22 nt, Human
agaugaaaagauaagcagcaau

SEQ ID NO: 392672 - RNA, 22 nt, Human
cagggccucuccuccaggaacu

SEQ ID NO: 392673 - RNA, 22 nt, Human
uuucagcugguaaaggaguagc

SEQ ID NO: 392674 - RNA, 19 nt, Human
aaaaacuuaguccagaaag

SEQ ID NO: 392675 - RNA, 22 nt, Human
cagagcugugauaaauagauau

SEQ ID NO: 392676 - RNA, 22 nt, Human
gagccuggauugucaccgacuu

SEQ ID NO: 392677 - RNA, 22 nt, Human
aagggugggcccuggcagccau

SEQ ID NO: 392678 - RNA, 22 nt, Human
cagggcagggccacacccccug

SEQ ID NO: 392679 - RNA, 22 nt, Human
agcugggaugauaaccucaguc

SEQ ID NO: 392680 - RNA, 22 nt, Human
aagcccagcugaaagcauuuuu

SEQ ID NO: 392681 - RNA, 22 nt, Human
uacaguaacauguuguacaagc

SEQ ID NO: 392682 - RNA, 22 nt, Human
uuauuauugugguugcauuauc

SEQ ID NO: 392683 - RNA, 23 nt, Human
uccaggagaauuccagggcccgg

SEQ ID NO: 392684 - RNA, 22 nt, Human
cagaguucaaagccugcuggga

SEQ ID NO: 392685 - RNA, 22 nt, Human
ugaggcagugauguuuaagcac

SEQ ID NO: 392686 - RNA, 22 nt, Human
cucccaagggguaagggagcug

SEQ ID NO: 392687 - RNA, 22 nt, Human
cagggcuggauccuccagacuc

SEQ ID NO: 392688 - RNA, 22 nt, Human
gugcauuucucauacacuaaau

SEQ ID NO: 392689 - RNA, 22 nt, Human
cagagccucagaauccugugga

SEQ ID NO: 392690 - RNA, 22 nt, Human
uccuugaaaggggcugcagggc

SEQ ID NO: 392691 - RNA, 22 nt, Human
aggcacugauucuguuuuccau

SEQ ID NO: 392692 - RNA, 22 nt, Human
uucugcaucugaauuuaaguac

SEQ ID NO: 392693 - RNA, 19 nt, Human
ugagugggccccugcagac

SEQ ID NO: 392694 - RNA, 22 nt, Human
uuagucaauagugaauauagag

SEQ ID NO: 392695 - RNA, 22 nt, Human
cucuuccuacagucugcuaugc

SEQ ID NO: 392696 - RNA, 22 nt, Human
auucuucaccauggauaauuug

SEQ ID NO: 392697 - RNA, 22 nt, Human
auuucaguagaaaaucuugauu

SEQ ID NO: 392698 - RNA, 22 nt, Human
augcuuuaaacuauaaauccac

SEQ ID NO: 392699 - RNA, 22 nt, Human
ucuggcucaaaauacguacucu

SEQ ID NO: 392700 - RNA, 22 nt, Human
acaaaugcuuaguucaccaaaa

SEQ ID NO: 392701 - RNA, 21 nt, Human
guguuuccuguuuauggcuug

SEQ ID NO: 392702 - RNA, 22 nt, Human
gcuguggaugcuauggaucauc

SEQ ID NO: 392703 - RNA, 22 nt, Human
uggcugaguucuccaggaguag

SEQ ID NO: 392704 - RNA, 22 nt, Human
uaaacagaaagcagauguacuu

SEQ ID NO: 392705 - RNA, 22 nt, Human
gaagagcuccaaaaacagugag

SEQ ID NO: 392706 - RNA, 22 nt, Human
ucauaaaaauagacucuaaagu

SEQ ID NO: 392707 - RNA, 22 nt, Human
aaguauauuuuuugaagcauau

SEQ ID NO: 392708 - RNA, 23 nt, Human
aucaaaguggaaaucaauuaucu

SEQ ID NO: 392709 - RNA, 22 nt, Human
augcaagauguauagaagacuu

SEQ ID NO: 392710 - RNA, 22 nt, Human
ccuguggcugccacuuggguga

SEQ ID NO: 392711 - RNA, 22 nt, Human
gagggcucacugagaaagcagu

SEQ ID NO: 392712 - RNA, 22 nt, Human
agaggccaggcugcagagggau

SEQ ID NO: 392713 - RNA, 22 nt, Human
guaaacaucagccacucuauuu

SEQ ID NO: 392714 - RNA, 22 nt, Human
aagggcucugugcuugucccau

SEQ ID NO: 392715 - RNA, 22 nt, Human
ccuggcagcagcacaugccuuc

SEQ ID NO: 392716 - RNA, 22 nt, Human
agugcacuggcaccaucucagc

SEQ ID NO: 392717 - RNA, 20 nt, Human
aaaaucucccagaaacuuau

SEQ ID NO: 392718 - RNA, 22 nt, Human
cagaggaagagauacaagcccu

SEQ ID NO: 392719 - RNA, 18 nt, Human
agggaguuuuagggaagg

SEQ ID NO: 392720 - RNA, 22 nt, Human
cccaggaagagugaguggcauu

SEQ ID NO: 392721 - RNA, 22 nt, Human
gccaggaggggagaguguguca

SEQ ID NO: 392722 - RNA, 22 nt, Human
auuaaaagcuucccaagaguua

SEQ ID NO: 392723 - RNA, 22 nt, Human
cagagaccccgcugcccuucug

SEQ ID NO: 392724 - RNA, 22 nt, Human
uaaagacacugguuuuaaucau

SEQ ID NO: 392725 - RNA, 22 nt, Human
agggccagaugaagccacaagc

SEQ ID NO: 392726 - RNA, 22 nt, Human
caauuucacuaaugaugugggg

SEQ ID NO: 392727 - RNA, 22 nt, Human
cuguccagcuuggcuccugggg

SEQ ID NO: 392728 - RNA, 22 nt, Human
ucuguucauaguaguguauaug

SEQ ID NO: 392729 - RNA, 22 nt, Human
caggccucccggugcacacuga

SEQ ID NO: 392730 - RNA, 20 nt, Human
gccuggaggcagagauaaag

SEQ ID NO: 392731 - RNA, 22 nt, Human
cugcucuguuaauuaaacuuug

SEQ ID NO: 392732 - RNA, 22 nt, Human
cuaagacaugcccugcaugaua

SEQ ID NO: 392733 - RNA, 22 nt, Human
agguggggaaaccagcgauccc

SEQ ID NO: 392734 - RNA, 22 nt, Human
ggccuugggauguggcugcagc

SEQ ID NO: 392735 - RNA, 22 nt, Human
uuugcauuucuaaugagcuccg

SEQ ID NO: 392736 - RNA, 20 nt, Human
uaagaacaagacuaggaagc

SEQ ID NO: 392737 - RNA, 19 nt, Human
ucugaaguccagggcauac

SEQ ID NO: 392738 - RNA, 19 nt, Human
gguagaagggaaguguuuu

SEQ ID NO: 392739 - RNA, 23 nt, Human
agaucugauguuaccaagaauug

SEQ ID NO: 392740 - RNA, 22 nt, Human
uauacagauuaacagauuuaaa

SEQ ID NO: 392741 - RNA, 22 nt, Human
cagcuggaggagcagcuuccag

SEQ ID NO: 392742 - RNA, 22 nt, Human
aggggugaaggcccgauaggag

SEQ ID NO: 392743 - RNA, 22 nt, Human
gccugagaaggauaggaagcga

SEQ ID NO: 392744 - RNA, 22 nt, Human
cgaugguucuggcugcuuguau

SEQ ID NO: 392745 - RNA, 22 nt, Human
uauuuccaagcugaauccaaug

SEQ ID NO: 392746 - RNA, 22 nt, Human
ucaggagaaucagggcuguccu

SEQ ID NO: 392747 - RNA, 22 nt, Human
aagagcuggaagugaagauaac

SEQ ID NO: 392748 - RNA, 22 nt, Human
uauugacagagggucagaagag

SEQ ID NO: 392749 - RNA, 22 nt, Human
cugggguggaggagcuccccug

SEQ ID NO: 392750 - RNA, 22 nt, Human
aggagaggcaucaagaaaaucg

SEQ ID NO: 392751 - RNA, 22 nt, Human
agcaaagucaguggaaccaucc

SEQ ID NO: 392752 - RNA, 22 nt, Human
ucauccaguaugacuggugucu

SEQ ID NO: 392753 - RNA, 22 nt, Human
aaggcaguaaaaucuaccuugc

SEQ ID NO: 392754 - RNA, 22 nt, Human
uuucuucagagagagcuuuccc

SEQ ID NO: 392755 - RNA, 22 nt, Human
cugggcuggcgcauccgacacg

SEQ ID NO: 392756 - RNA, 22 nt, Human
acccagcucuuugauggucuug

SEQ ID NO: 392757 - RNA, 19 nt, Human
ccagucccauacaggagau

SEQ ID NO: 392758 - RNA, 22 nt, Human
gcucucugggugugucuagaua

SEQ ID NO: 392759 - RNA, 20 nt, Human
ggcugcugugggcagagagg

SEQ ID NO: 392760 - RNA, 19 nt, Human
aucagcaagguaggaugug

SEQ ID NO: 392761 - RNA, 22 nt, Human
cacugggcaauucugagccuaa

SEQ ID NO: 392762 - RNA, 18 nt, Human
cucagagaugcccuuauu

SEQ ID NO: 392763 - RNA, 22 nt, Human
uaaucugaagaaacaggacuug

SEQ ID NO: 392764 - RNA, 22 nt, Human
ugcagugguugagagcccagac

SEQ ID NO: 392765 - RNA, 22 nt, Human
agcuucuugaccaagccuguaa

SEQ ID NO: 392766 - RNA, 22 nt, Human
caaggcaggaagccugucuuau

SEQ ID NO: 392767 - RNA, 22 nt, Human
uggagcugacucacaccagcua

SEQ ID NO: 392768 - RNA, 22 nt, Human
cuacuucugugaugaaacuaca

SEQ ID NO: 392769 - RNA, 22 nt, Human
auguguuuguaccuuuaaauau

SEQ ID NO: 392770 - RNA, 22 nt, Human
ucagagugaggcccagcaaucu

SEQ ID NO: 392771 - RNA, 22 nt, Human
aguaaugugccugaaauacuug

SEQ ID NO: 392772 - RNA, 22 nt, Human
cucugcaugccuugcucagaca

SEQ ID NO: 392773 - RNA, 22 nt, Human
uacauuugcuuugauuuucagc

SEQ ID NO: 392774 - RNA, 22 nt, Human
aacugcauucagaaagcucacu

SEQ ID NO: 392775 - RNA, 22 nt, Human
cagcccagcagggucuggcccu

SEQ ID NO: 392776 - RNA, 22 nt, Human
aggcugugagcaagaacaccua

SEQ ID NO: 392777 - RNA, 19 nt, Human
agucucaguguacagaggc

SEQ ID NO: 392778 - RNA, 22 nt, Human
uacccaggaggaaacugaggcu

SEQ ID NO: 392779 - RNA, 22 nt, Human
uggcccugaggggcugugcccc

SEQ ID NO: 392780 - RNA, 22 nt, Human
ccugcccagcuucccgagugca

SEQ ID NO: 392781 - RNA, 21 nt, Human
uuucuuaggcucuaaaaugac

SEQ ID NO: 392782 - RNA, 22 nt, Human
cuggcuuucccuggacaacagc

SEQ ID NO: 392783 - RNA, 22 nt, Human
cacugccugugagcugugugcc

SEQ ID NO: 392784 - RNA, 22 nt, Human
aucaguuuguauaugaaacacu

SEQ ID NO: 392785 - RNA, 22 nt, Human
ggcugcaguuugucuuuugcuu

SEQ ID NO: 392786 - RNA, 19 nt, Human
gcaggcaguggcauucgga

SEQ ID NO: 392787 - RNA, 22 nt, Human
gucaccagucccagcuccugaa

SEQ ID NO: 392788 - RNA, 22 nt, Human
gaggaugugucuggucugggca

SEQ ID NO: 392789 - RNA, 22 nt, Human
cuuagaaauaaugguuucaguu

SEQ ID NO: 392790 - RNA, 22 nt, Human
caagaugaaacuacagggagga

SEQ ID NO: 392791 - RNA, 18 nt, Human
agggucagugucacuggc

SEQ ID NO: 392792 - RNA, 17 nt, Human
aaguccagccugcagcu

SEQ ID NO: 392793 - RNA, 22 nt, Human
ggcuggguuauuuauggccaag

SEQ ID NO: 392794 - RNA, 22 nt, Human
cccagggacagaugggcagcua

SEQ ID NO: 392795 - RNA, 20 nt, Human
gaaauucucguauuaguuua

SEQ ID NO: 392796 - RNA, 19 nt, Human
uuacaucugcaacacuggu

SEQ ID NO: 392797 - RNA, 22 nt, Human
cugcugggcagaggcugcauga

SEQ ID NO: 392798 - RNA, 22 nt, Human
uuugagaagcaucugguccacu

SEQ ID NO: 392799 - RNA, 22 nt, Human
cucaggauuuaaaggggcacuc

SEQ ID NO: 392800 - RNA, 17 nt, Human
ucaugcccaacuauuac

SEQ ID NO: 392801 - RNA, 22 nt, Human
cugccucuguugggcauggucu

SEQ ID NO: 392802 - RNA, 22 nt, Human
ugauuaacugucuauuaaucau

SEQ ID NO: 392803 - RNA, 22 nt, Human
caugaaugcuggguucauguaa

SEQ ID NO: 392804 - RNA, 22 nt, Human
ucacugggagaugugggaaggg

SEQ ID NO: 392805 - RNA, 22 nt, Human
uacaaaguagaaauucaguaaa

SEQ ID NO: 392806 - RNA, 22 nt, Human
auuuguacaaauuuauguuagu

SEQ ID NO: 392807 - RNA, 22 nt, Human
gggcagcugccacuccgcuugc

SEQ ID NO: 392808 - RNA, 22 nt, Human
ggagcugcuccuucagccaagu

SEQ ID NO: 392809 - RNA, 17 nt, Human
gagauggguggaucacc

SEQ ID NO: 392810 - RNA, 22 nt, Human
uaugaacauguucauugacuua

SEQ ID NO: 392811 - RNA, 22 nt, Human
cuggccacaacuagcccaggac

SEQ ID NO: 392812 - RNA, 23 nt, Human
ucuccuccuagauacagucaugg

SEQ ID NO: 392813 - RNA, 22 nt, Human
augcugugccuggaaagcggcu

SEQ ID NO: 392814 - RNA, 22 nt, Human
uaggcaggcugaauguagauuu

SEQ ID NO: 392815 - RNA, 22 nt, Human
cacugggcguguccugggugag

SEQ ID NO: 392816 - RNA, 22 nt, Human
ugcuguuauacuuagcugguua

SEQ ID NO: 392817 - RNA, 21 nt, Human
ugcugaugucagagaagcaag

SEQ ID NO: 392818 - RNA, 19 nt, Human
aggguccagggagcggcuc

SEQ ID NO: 392819 - RNA, 22 nt, Human
aguggaccagaagacugaagcu

SEQ ID NO: 392820 - RNA, 22 nt, Human
aaaaaaucagaucuuugguuaa

SEQ ID NO: 392821 - RNA, 22 nt, Human
uuuaauacuauggggaugaaca

SEQ ID NO: 392822 - RNA, 22 nt, Human
uugcauugauguuccuucuugc

SEQ ID NO: 392823 - RNA, 22 nt, Human
uguuccaauaaggaguugaaau

SEQ ID NO: 392824 - RNA, 22 nt, Human
uuauaacaucaaucagaguuaa

SEQ ID NO: 392825 - RNA, 22 nt, Human
gaaaggucaguuccacuuccau

SEQ ID NO: 392826 - RNA, 22 nt, Human
ccagggugagugucauggguua

SEQ ID NO: 392827 - RNA, 22 nt, Human
aggaaaaaagucugugauuaua

SEQ ID NO: 392828 - RNA, 22 nt, Human
ccuccugguccagcaucucuuu

SEQ ID NO: 392829 - RNA, 22 nt, Human
gagccagguuugaaucucaguc

SEQ ID NO: 392830 - RNA, 22 nt, Human
ggcucagagaccugcgaucuga

SEQ ID NO: 392831 - RNA, 19 nt, Human
aggcaggugcagagguccc

SEQ ID NO: 392832 - RNA, 22 nt, Human
aaagccuugggauuugugauca

SEQ ID NO: 392833 - RNA, 22 nt, Human
ccugggagagucuguggucucc

SEQ ID NO: 392834 - RNA, 22 nt, Human
aucuggcuuucuuaaugacuua

SEQ ID NO: 392835 - RNA, 22 nt, Human
aguuucaguucugucauuuaua

SEQ ID NO: 392836 - RNA, 22 nt, Human
cuguuuucccuggaguucagca

SEQ ID NO: 392837 - RNA, 22 nt, Human
gguggaaggccuggaaggaggc

SEQ ID NO: 392838 - RNA, 19 nt, Human
aaaguuuuauucucauuug

SEQ ID NO: 392839 - RNA, 20 nt, Human
gucagaggacccuagagcga

SEQ ID NO: 392840 - RNA, 22 nt, Human
agccagccaguucacuaggaaa

SEQ ID NO: 392841 - RNA, 22 nt, Human
cuagaaaaauacuuuauuguga

SEQ ID NO: 392842 - RNA, 20 nt, Human
ggucccugcccucugucauc

SEQ ID NO: 392843 - RNA, 22 nt, Human
accucugcaguagggcugugcc

SEQ ID NO: 392844 - RNA, 22 nt, Human
uguccugcaacugaaggagaag

SEQ ID NO: 392845 - RNA, 22 nt, Human
uccuuaauucugugcaauaugu

SEQ ID NO: 392846 - RNA, 22 nt, Human
acacugugcagauucccuguga

SEQ ID NO: 392847 - RNA, 22 nt, Human
caaaugcaaaauauaacccugu

SEQ ID NO: 392848 - RNA, 22 nt, Human
aauggccagcaacaggagugaa

SEQ ID NO: 392849 - RNA, 20 nt, Human
cacaggccuugugagcagac

SEQ ID NO: 392850 - RNA, 22 nt, Human
aguggcagagaccccagccagc

SEQ ID NO: 392851 - RNA, 22 nt, Human
uaauuucuaauucauuuucagu

SEQ ID NO: 392852 - RNA, 22 nt, Human
uguugaagauaaaguucucauu

SEQ ID NO: 392853 - RNA, 22 nt, Human
gccuuugccugcgacguggcug

SEQ ID NO: 392854 - RNA, 22 nt, Human
uauguacaaucagcaguucaua

SEQ ID NO: 392855 - RNA, 21 nt, Human
uggcugaguggaugcaugaau

SEQ ID NO: 392856 - RNA, 22 nt, Human
cugcugcugagagcucagccug

SEQ ID NO: 392857 - RNA, 19 nt, Human
gggcuucugggaucaagag

SEQ ID NO: 392858 - RNA, 22 nt, Human
cuggcucauccagguguugcuc

SEQ ID NO: 392859 - RNA, 22 nt, Human
ggaggggccggcugccugccac

SEQ ID NO: 392860 - RNA, 17 nt, Human
cucugcagugcauggcu

SEQ ID NO: 392861 - RNA, 22 nt, Human
acagugugguuugagcacuggg

SEQ ID NO: 392862 - RNA, 22 nt, Human
caaaugauagagccgauuauca

SEQ ID NO: 392863 - RNA, 22 nt, Human
gcagggcacagacagugccaag

SEQ ID NO: 392864 - RNA, 22 nt, Human
ucuguucagaauuguaacacuc

SEQ ID NO: 392865 - RNA, 21 nt, Human
uggcccuggccacggcugcca

SEQ ID NO: 392866 - RNA, 22 nt, Human
gcccaguaguucaagguugcag

SEQ ID NO: 392867 - RNA, 22 nt, Human
guuuuaguggguggccacugau

SEQ ID NO: 392868 - RNA, 20 nt, Human
guucucacugaucugcaggg

SEQ ID NO: 392869 - RNA, 20 nt, Human
acuguucaagggccuggugg

SEQ ID NO: 392870 - RNA, 22 nt, Human
cugagggccuuggcuccugccc

SEQ ID NO: 392871 - RNA, 22 nt, Human
acagaauuuacacaucucuaaa

SEQ ID NO: 392872 - RNA, 22 nt, Human
cugccucuccccagaguggccc

SEQ ID NO: 392873 - RNA, 22 nt, Human
ucagaccauccugcuguuagug

SEQ ID NO: 392874 - RNA, 22 nt, Human
ccuguguggccaggcuggaguc

SEQ ID NO: 392875 - RNA, 22 nt, Human
gguggagcuguggacaggaagg

SEQ ID NO: 392876 - RNA, 22 nt, Human
agagggcugccucagucagcua

SEQ ID NO: 392877 - RNA, 22 nt, Human
cagucaccugaagacuugacca

SEQ ID NO: 392878 - RNA, 22 nt, Human
guguccuuuuaugugacugguu

SEQ ID NO: 392879 - RNA, 22 nt, Human
ugcucccaggcauucucuguug

SEQ ID NO: 392880 - RNA, 18 nt, Human
uguagagccagguuugcc

SEQ ID NO: 392881 - RNA, 22 nt, Human
uagccuucucaagacaaaguug

SEQ ID NO: 392882 - RNA, 22 nt, Human
cauuugaaugagauugcuguaa

SEQ ID NO: 392883 - RNA, 19 nt, Human
gcucagagggcccugugcu

SEQ ID NO: 392884 - RNA, 22 nt, Human
aguguuucuggcaaaugaaagu

SEQ ID NO: 392885 - RNA, 22 nt, Human
cuagucacucagcacugacaaa

SEQ ID NO: 392886 - RNA, 22 nt, Human
uugcugaagugaagguauguuu

SEQ ID NO: 392887 - RNA, 22 nt, Human
uggaaagaauuccuaugguuca

SEQ ID NO: 392888 - RNA, 22 nt, Human
uugagaagaaauaguuugcaau

SEQ ID NO: 392889 - RNA, 19 nt, Human
gccucugcuggggacaggc

SEQ ID NO: 392890 - RNA, 22 nt, Human
ucuaaaaaagucuguucacuug

SEQ ID NO: 392891 - RNA, 22 nt, Human
acugaaauacugcucuuggauu

SEQ ID NO: 392892 - RNA, 22 nt, Human
gccugagaaggacacagcaggu

SEQ ID NO: 392893 - RNA, 21 nt, Human
ugggaccuauuucaacuggau

SEQ ID NO: 392894 - RNA, 22 nt, Human
aaugccuucaaguaucugagga

SEQ ID NO: 392895 - RNA, 21 nt, Human
ugaucauuuguguaaaggaga

SEQ ID NO: 392896 - RNA, 22 nt, Human
gcuuuauuuugugagggauuac

SEQ ID NO: 392897 - RNA, 22 nt, Human
cauuuauauaaaauguccagaa

SEQ ID NO: 392898 - RNA, 22 nt, Human
uuccaugaagggcagccucuca

SEQ ID NO: 392899 - RNA, 22 nt, Human
caguccuuaaggaaacauuugu

SEQ ID NO: 392900 - RNA, 22 nt, Human
uuuuugaaggcugaugugauua

SEQ ID NO: 392901 - RNA, 22 nt, Human
gguggccucgguggugcacagg

SEQ ID NO: 392902 - RNA, 22 nt, Human
uuuauccauucaccaguugaac

SEQ ID NO: 392903 - RNA, 22 nt, Human
ugccugugucacagugauguuu

SEQ ID NO: 392904 - RNA, 22 nt, Human
uaaacagaaugcguaagaagug

SEQ ID NO: 392905 - RNA, 22 nt, Human
guaaaauucuagcaucugaaag

SEQ ID NO: 392906 - RNA, 22 nt, Human
uaauaaaugaaagugcuggcau

SEQ ID NO: 392907 - RNA, 22 nt, Human
gugccugggcaugagcuuguug

SEQ ID NO: 392908 - RNA, 22 nt, Human
cccaggaggcagagauagcagu

SEQ ID NO: 392909 - RNA, 22 nt, Human
uuucugcucgcucucaaucagg

SEQ ID NO: 392910 - RNA, 23 nt, Human
acuauaaaguuguucugauuuac

SEQ ID NO: 392911 - RNA, 22 nt, Human
aaacaugagcauuucuguuuaa

SEQ ID NO: 392912 - RNA, 22 nt, Human
agggcuccuaugaugcucugcc

SEQ ID NO: 392913 - RNA, 22 nt, Human
gugccuggcaugcgccggugcu

SEQ ID NO: 392914 - RNA, 22 nt, Human
uuuccucugaugcugacuugga

SEQ ID NO: 392915 - RNA, 22 nt, Human
guaaaauugcaauuacuuuugc

SEQ ID NO: 392916 - RNA, 22 nt, Human
ugccuggaaggcccaugggaag

SEQ ID NO: 392917 - RNA, 22 nt, Human
uggcuucuuagaccaguggccu

SEQ ID NO: 392918 - RNA, 22 nt, Human
gugcugugcgcuuuuucuguau

SEQ ID NO: 392919 - RNA, 22 nt, Human
ggagcagggaauuacagcgcag

SEQ ID NO: 392920 - RNA, 20 nt, Human
cuucuucaguaguuuguucu

SEQ ID NO: 392921 - RNA, 22 nt, Human
aggagcccugcgggaggcagag

SEQ ID NO: 392922 - RNA, 22 nt, Human
uuaccuaaaauagcucaauuua

SEQ ID NO: 392923 - RNA, 22 nt, Human
agcccaggugagggguucgaaa

SEQ ID NO: 392924 - RNA, 22 nt, Human
ucuuuccucugagcuccuguag

SEQ ID NO: 392925 - RNA, 22 nt, Human
ucagagugugacuuggucauga

SEQ ID NO: 392926 - RNA, 22 nt, Human
aggggagguggcagaaaugugc

SEQ ID NO: 392927 - RNA, 22 nt, Human
ccaggauggggagcagauagaa

SEQ ID NO: 392928 - RNA, 20 nt, Human
cugagcccccagccugcagg

SEQ ID NO: 392929 - RNA, 22 nt, Human
gaggcucagagagguccacaua

SEQ ID NO: 392930 - RNA, 22 nt, Human
cggcugagcagugcugauggaa

SEQ ID NO: 392931 - RNA, 22 nt, Human
gauuucaaguaucuugggcgag

SEQ ID NO: 392932 - RNA, 23 nt, Human
agggugagcaagcuauggagacc

SEQ ID NO: 392933 - RNA, 22 nt, Human
gcuuucuugguucugcaggggc

SEQ ID NO: 392934 - RNA, 22 nt, Human
uauuucagcccuacuacuuggc

SEQ ID NO: 392935 - RNA, 22 nt, Human
acuggcaguagagggagcgcau

SEQ ID NO: 392936 - RNA, 22 nt, Human
cugucauugagccugucagggc

SEQ ID NO: 392937 - RNA, 22 nt, Human
ggccuugguaaagggaugcaug

SEQ ID NO: 392938 - RNA, 22 nt, Human
uggaaauguauuugggcaugcc

SEQ ID NO: 392939 - RNA, 22 nt, Human
ccuaggccuuacuuuccugugc

SEQ ID NO: 392940 - RNA, 22 nt, Human
uucacauuucauaccacagcuu

SEQ ID NO: 392941 - RNA, 22 nt, Human
uucuucuuuccuauaauuaauu

SEQ ID NO: 392942 - RNA, 22 nt, Human
ggcucaggaugagccuucucau

SEQ ID NO: 392943 - RNA, 23 nt, Human
gccucugcucugcguuggggacu

SEQ ID NO: 392944 - RNA, 22 nt, Human
aggacagcagugcuggcacuug

SEQ ID NO: 392945 - RNA, 22 nt, Human
acagcagcuaaccccugggcca

SEQ ID NO: 392946 - RNA, 22 nt, Human
ucagaauuugauuccugggaua

SEQ ID NO: 392947 - RNA, 22 nt, Human
aaugccuuuccacuggguauca

SEQ ID NO: 392948 - RNA, 22 nt, Human
aaggcugagacagcacaggucc

SEQ ID NO: 392949 - RNA, 22 nt, Human
guacauuggcaacucucuuaga

SEQ ID NO: 392950 - RNA, 22 nt, Human
ccucuccaguuuuaacgugacc

SEQ ID NO: 392951 - RNA, 22 nt, Human
agucucugcaugccugcugugc

SEQ ID NO: 392952 - RNA, 22 nt, Human
cuuugcauacaauuuuuagaaa

SEQ ID NO: 392953 - RNA, 22 nt, Human
gagggagggacuagcauucucu

SEQ ID NO: 392954 - RNA, 22 nt, Human
ugggccuggacaaggccacuag

SEQ ID NO: 392955 - RNA, 22 nt, Human
aggccagguggucaugcuugcu

SEQ ID NO: 392956 - RNA, 22 nt, Human
ccaguggacuucucccuguggu

SEQ ID NO: 392957 - RNA, 22 nt, Human
cccagggacagcuagguggggc

SEQ ID NO: 392958 - RNA, 22 nt, Human
gccugcagccagggaguucucu

SEQ ID NO: 392959 - RNA, 22 nt, Human
uccagggaccucccugagagcu

SEQ ID NO: 392960 - RNA, 22 nt, Human
ucagaggacagcagcuaaauaa

SEQ ID NO: 392961 - RNA, 22 nt, Human
uuucuguauuuaaaagaucugg

SEQ ID NO: 392962 - RNA, 22 nt, Human
acuggauuccauugugcaaaga

SEQ ID NO: 392963 - RNA, 22 nt, Human
gagacugcauagauggccacaa

SEQ ID NO: 392964 - RNA, 22 nt, Human
ggaagccaugagggacaguucu

SEQ ID NO: 392965 - RNA, 20 nt, Human
uguuccaagcuaaugaauga

SEQ ID NO: 392966 - RNA, 22 nt, Human
gaguccaguucuuuccagcagu

SEQ ID NO: 392967 - RNA, 22 nt, Human
aaacaugagcaucucuucaagc

SEQ ID NO: 392968 - RNA, 22 nt, Human
ggcucaccauuuucacucucug

SEQ ID NO: 392969 - RNA, 22 nt, Human
cagcaguguggaagcugagggg

SEQ ID NO: 392970 - RNA, 22 nt, Human
aguaaaaucuuaagcacagugg

SEQ ID NO: 392971 - RNA, 22 nt, Human
caacugcugacaccaucacucc

SEQ ID NO: 392972 - RNA, 22 nt, Human
gaugaggcucaugcacccugcg

SEQ ID NO: 392973 - RNA, 21 nt, Human
cccaggucguggucuucccag

SEQ ID NO: 392974 - RNA, 22 nt, Human
agugccuggaccccaugacaua

SEQ ID NO: 392975 - RNA, 22 nt, Human
guuuauuauucaacuucauguu

SEQ ID NO: 392976 - RNA, 22 nt, Human
agcugguaugaacaggauagga

SEQ ID NO: 392977 - RNA, 22 nt, Human
uaguccuugcugggcacagagu

SEQ ID NO: 392978 - RNA, 22 nt, Human
cugaggugcuauggaggauacg

SEQ ID NO: 392979 - RNA, 22 nt, Human
ggcucagaaacuaaaggcgcug

SEQ ID NO: 392980 - RNA, 22 nt, Human
auucuggccuuggcucugucac

SEQ ID NO: 392981 - RNA, 22 nt, Human
ucaaaagucugcauucuucaca

SEQ ID NO: 392982 - RNA, 20 nt, Human
aggcucagagcaguaguaca

SEQ ID NO: 392983 - RNA, 22 nt, Human
cacagcuucuccuugauaucgc

SEQ ID NO: 392984 - RNA, 22 nt, Human
ggccugcuuuccgagccugcag

SEQ ID NO: 392985 - RNA, 22 nt, Human
ucaaaauuaaaccaacguccag

SEQ ID NO: 392986 - RNA, 22 nt, Human
cagaggcucagauggcccuggc

SEQ ID NO: 392987 - RNA, 22 nt, Human
gcagcugcagacccucagugcu

SEQ ID NO: 392988 - RNA, 22 nt, Human
uaccuuggguugaguucauucu

SEQ ID NO: 392989 - RNA, 22 nt, Human
uacuuccagcaaucugcauauu

SEQ ID NO: 392990 - RNA, 22 nt, Human
uggcaguguauagguggcuccu

SEQ ID NO: 392991 - RNA, 22 nt, Human
gcacaugagcugcugggauggg

SEQ ID NO: 392992 - RNA, 22 nt, Human
uucuguauauuguaaagacuca

SEQ ID NO: 392993 - RNA, 22 nt, Human
agggcagaggcggacacggaag

SEQ ID NO: 392994 - RNA, 22 nt, Human
gagcuguccuaccaggaguccu

SEQ ID NO: 392995 - RNA, 22 nt, Human
gaaggcuguuucugguagugau

SEQ ID NO: 392996 - RNA, 22 nt, Human
uaggaaaagucuagauugauga

SEQ ID NO: 392997 - RNA, 22 nt, Human
ugaugguugauuauaaaucagu

SEQ ID NO: 392998 - RNA, 22 nt, Human
agaagccaccagcugaggaaga

SEQ ID NO: 392999 - RNA, 22 nt, Human
ugcaguggaggccgugagacag

SEQ ID NO: 393000 - RNA, 22 nt, Human
uugauacauuuuuaggauaaac

SEQ ID NO: 393001 - RNA, 22 nt, Human
caggguacagaguuuucuaaac

SEQ ID NO: 393002 - RNA, 22 nt, Human
ugcagggaggccccgcagcccu

SEQ ID NO: 393003 - RNA, 22 nt, Human
uuuguguuuguacaaugcacua

SEQ ID NO: 393004 - RNA, 22 nt, Human
cuugcaggauuuugcugcugua

SEQ ID NO: 393005 - RNA, 22 nt, Human
gugucacaagagcccaggaaac

SEQ ID NO: 393006 - RNA, 23 nt, Human
ggaaagagaggaguugugcauag

SEQ ID NO: 393007 - RNA, 22 nt, Human
aagucauuaucucuucuaaucu

SEQ ID NO: 393008 - RNA, 22 nt, Human
cuggcuuuggucaugugaucau

SEQ ID NO: 393009 - RNA, 22 nt, Human
cccuggagggcagacagaugcc

SEQ ID NO: 393010 - RNA, 22 nt, Human
cacugcaguaacucuaggacug

SEQ ID NO: 393011 - RNA, 22 nt, Human
agagagggcauagaaaaaggga

SEQ ID NO: 393012 - RNA, 22 nt, Human
gcagcuggcucagagagguggg

SEQ ID NO: 393013 - RNA, 22 nt, Human
uugaccauaccuccaggcaguu

SEQ ID NO: 393014 - RNA, 22 nt, Human
cacaauuuccuugcuucacuuu

SEQ ID NO: 393015 - RNA, 22 nt, Human
cagaggcaaaagagguggaggu

SEQ ID NO: 393016 - RNA, 22 nt, Human
aauuaguaaccuaauuccaucu

SEQ ID NO: 393017 - RNA, 22 nt, Human
cugcaggcaucuaacugugggc

SEQ ID NO: 393018 - RNA, 22 nt, Human
caggauggucuucauuuggcuc

SEQ ID NO: 393019 - RNA, 22 nt, Human
guggcacagugggagagcccca

SEQ ID NO: 393020 - RNA, 22 nt, Human
aggcuggaguacaguggcuauu

SEQ ID NO: 393021 - RNA, 22 nt, Human
caagaaucagaccugucagggu

SEQ ID NO: 393022 - RNA, 22 nt, Human
cgcaccacugaauuccagccug

SEQ ID NO: 393023 - RNA, 22 nt, Human
cagagcugguaagugguagagg

SEQ ID NO: 393024 - RNA, 22 nt, Human
ccugccuggaucagccauccug

SEQ ID NO: 393025 - RNA, 22 nt, Human
ugccugaguuuaacccucagag

SEQ ID NO: 393026 - RNA, 22 nt, Human
cuugcaggcagggccuccugga

SEQ ID NO: 393027 - RNA, 22 nt, Human
uggguggcacuucuggggucca

SEQ ID NO: 393028 - RNA, 22 nt, Human
ucuggagcgaggucccugucug

SEQ ID NO: 393029 - RNA, 21 nt, Human
ugcuucucuagaucaacuacu

SEQ ID NO: 393030 - RNA, 22 nt, Human
auugaaaauaaggccagaaaca

SEQ ID NO: 393031 - RNA, 22 nt, Human
aacagaaaagguagguggcuuu

SEQ ID NO: 393032 - RNA, 22 nt, Human
ucuggcucggauuugucuagca

SEQ ID NO: 393033 - RNA, 22 nt, Human
aaggcagauauaaagacuagag

SEQ ID NO: 393034 - RNA, 22 nt, Human
uucuggagaucugccuauggga

SEQ ID NO: 393035 - RNA, 22 nt, Human
caggagccgccaggcacguugg

SEQ ID NO: 393036 - RNA, 22 nt, Human
gcuguucauagaaauggucuca

SEQ ID NO: 393037 - RNA, 22 nt, Human
cagaaccaggaacugauggaga

SEQ ID NO: 393038 - RNA, 22 nt, Human
cuuuguagcugcuucugauuua

SEQ ID NO: 393039 - RNA, 22 nt, Human
acauaauagguaccugaauaau

SEQ ID NO: 393040 - RNA, 22 nt, Human
uugggcugaacccugcagcuga

SEQ ID NO: 393041 - RNA, 22 nt, Human
accaucagagcacaguccgugc

SEQ ID NO: 393042 - RNA, 19 nt, Human
uuugugaagaaaaugaugc

SEQ ID NO: 393043 - RNA, 22 nt, Human
ccagagugacgugaagugugaa

SEQ ID NO: 393044 - RNA, 22 nt, Human
gcucacugccauucucuagaug

SEQ ID NO: 393045 - RNA, 20 nt, Human
caagcccucuuuagccugcc

SEQ ID NO: 393046 - RNA, 22 nt, Human
gcaggugguccccguggagugg

SEQ ID NO: 393047 - RNA, 22 nt, Human
ucucaggggauucacuggcacc

SEQ ID NO: 393048 - RNA, 22 nt, Human
uaguuauuauuguuacuaucag

SEQ ID NO: 393049 - RNA, 22 nt, Human
ucucagagcaucauuuucuuag

SEQ ID NO: 393050 - RNA, 21 nt, Human
ccugagccuguuuauccagaa

SEQ ID NO: 393051 - RNA, 22 nt, Human
accccagaggcggaggcugcag

SEQ ID NO: 393052 - RNA, 22 nt, Human
gcugauccuuuuaugucuagcu

SEQ ID NO: 393053 - RNA, 22 nt, Human
caggccugugaguugaggcccc

SEQ ID NO: 393054 - RNA, 16 nt, Human
cagcuuuaugucagug

SEQ ID NO: 393055 - RNA, 21 nt, Human
accagcaggagaucagaagga

SEQ ID NO: 393056 - RNA, 22 nt, Human
aacuuugaggucacugaauucc

SEQ ID NO: 393057 - RNA, 22 nt, Human
gggcuggggcucaauaauuugu

SEQ ID NO: 393058 - RNA, 22 nt, Human
aaauauguaagauuagcacuag

SEQ ID NO: 393059 - RNA, 22 nt, Human
gaaaucugcccagugcacuggu

SEQ ID NO: 393060 - RNA, 22 nt, Human
ucugucaggagauuggcagcug

SEQ ID NO: 393061 - RNA, 22 nt, Human
agccuucaguaaauccacugug

SEQ ID NO: 393062 - RNA, 22 nt, Human
acccaggaggugacacagggcu

SEQ ID NO: 393063 - RNA, 22 nt, Human
agcauggggcaaugcaugugcu

SEQ ID NO: 393064 - RNA, 22 nt, Human
uaggagcuaaaauauuuuauau

SEQ ID NO: 393065 - RNA, 22 nt, Human
gucaggaugacaagugcuuuca

SEQ ID NO: 393066 - RNA, 19 nt, Human
gacucacaccuuccgcugu

SEQ ID NO: 393067 - RNA, 22 nt, Human
gcagaagggaauaaggagcuuu

SEQ ID NO: 393068 - RNA, 22 nt, Human
uuauguacucugcaauguuuga

SEQ ID NO: 393069 - RNA, 22 nt, Human
uggcaggggaggugcuugcuua

SEQ ID NO: 393070 - RNA, 21 nt, Human
gggccuggcugcgcaggacgg

SEQ ID NO: 393071 - RNA, 22 nt, Human
ugugccuggaucucugugacaa

SEQ ID NO: 393072 - RNA, 22 nt, Human
ggccucaguuucuccauggguu

SEQ ID NO: 393073 - RNA, 22 nt, Human
gguuucaaaguggacaguuagu

SEQ ID NO: 393074 - RNA, 23 nt, Human
uggcucagggucucuuaugaagu

SEQ ID NO: 393075 - RNA, 22 nt, Human
caggugcucccagagaagugcu

SEQ ID NO: 393076 - RNA, 22 nt, Human
acucacuuuccauucaagcacc

SEQ ID NO: 393077 - RNA, 22 nt, Human
aagggcaggagaagacggauau

SEQ ID NO: 393078 - RNA, 22 nt, Human
cccaggagccaucugucuuggc

SEQ ID NO: 393079 - RNA, 22 nt, Human
gggagguucuguucgcacuuga

SEQ ID NO: 393080 - RNA, 22 nt, Human
aaggccagcuuguagggcuggu

SEQ ID NO: 393081 - RNA, 21 nt, Human
agaaaaguagaguuuucagag

SEQ ID NO: 393082 - RNA, 22 nt, Human
cuggccuuuagccccagugucu

SEQ ID NO: 393083 - RNA, 22 nt, Human
aggcugaggggcgagggacccu

SEQ ID NO: 393084 - RNA, 22 nt, Human
uaggccagaggagcagcuuugg

SEQ ID NO: 393085 - RNA, 23 nt, Human
gccugccugaccugugcaaaguc

SEQ ID NO: 393086 - RNA, 22 nt, Human
uucaaugaggauagaacuggau

SEQ ID NO: 393087 - RNA, 22 nt, Human
auuuaaugucgagcuauuguag

SEQ ID NO: 393088 - RNA, 18 nt, Human
agagaugguguagaguuu

SEQ ID NO: 393089 - RNA, 22 nt, Human
ggcacugaaguggguguugggu

SEQ ID NO: 393090 - RNA, 22 nt, Human
uaugcacacaggcuuaauucau

SEQ ID NO: 393091 - RNA, 22 nt, Human
aaguaaauaucuguuuauagca

SEQ ID NO: 393092 - RNA, 18 nt, Human
gguggcucagucaugggg

SEQ ID NO: 393093 - RNA, 22 nt, Human
gcugccaugccacagcacucac

SEQ ID NO: 393094 - RNA, 19 nt, Human
uagcagcugccaaaggaga

SEQ ID NO: 393095 - RNA, 22 nt, Human
aggaaacuguccccucauccua

SEQ ID NO: 393096 - RNA, 22 nt, Human
ggcugcuguuucagagacuguu

SEQ ID NO: 393097 - RNA, 22 nt, Human
cugaauaauguucucuuguaug

SEQ ID NO: 393098 - RNA, 22 nt, Human
ucacuuauaaaaugcaagaucu

SEQ ID NO: 393099 - RNA, 22 nt, Human
ccaggugugccagcagggacug

SEQ ID NO: 393100 - RNA, 22 nt, Human
gcugcccucccagggcaagcuu

SEQ ID NO: 393101 - RNA, 19 nt, Human
uaaggccaaaaguaagugu

SEQ ID NO: 393102 - RNA, 22 nt, Human
cugagggcaugaacauuccaua

SEQ ID NO: 393103 - RNA, 23 nt, Human
aucaagauaauccagaugaccua

SEQ ID NO: 393104 - RNA, 22 nt, Human
ugcuuccugaggccgucuucuc

SEQ ID NO: 393105 - RNA, 22 nt, Human
gagcaggcucugccuguguguc

SEQ ID NO: 393106 - RNA, 22 nt, Human
cagaauaaagguacaauugagu

SEQ ID NO: 393107 - RNA, 22 nt, Human
cugugcuggagaugggccagag

SEQ ID NO: 393108 - RNA, 20 nt, Human
gaagccagaggggaaaggag

SEQ ID NO: 393109 - RNA, 22 nt, Human
aagcagcugauuucacagcuca

SEQ ID NO: 393110 - RNA, 22 nt, Human
ugggacuuguguggcaguauuu

SEQ ID NO: 393111 - RNA, 22 nt, Human
aauacugagaucccacaaagca

SEQ ID NO: 393112 - RNA, 22 nt, Human
gccaggcaggccacgcuguguu

SEQ ID NO: 393113 - RNA, 22 nt, Human
gucagaggggcagcugccaggc

SEQ ID NO: 393114 - RNA, 22 nt, Human
gagucaccacacggugcugacu

SEQ ID NO: 393115 - RNA, 22 nt, Human
agcagggcaugaauaaggguuu

SEQ ID NO: 393116 - RNA, 22 nt, Human
ggagguggcagagggacauucu

SEQ ID NO: 393117 - RNA, 22 nt, Human
caguggcaaugggacagagcac

SEQ ID NO: 393118 - RNA, 22 nt, Human
aagacugucuuuucugagugac

SEQ ID NO: 393119 - RNA, 22 nt, Human
gcugucccgaaccccugguaau

SEQ ID NO: 393120 - RNA, 22 nt, Human
ucaguuuuuaagaguuaugcga

SEQ ID NO: 393121 - RNA, 20 nt, Human
auucuaaagcucugcucuuu

SEQ ID NO: 393122 - RNA, 20 nt, Human
uggagcuccagcguccaugu

SEQ ID NO: 393123 - RNA, 22 nt, Human
uuccuuagcuccucauggccug

SEQ ID NO: 393124 - RNA, 22 nt, Human
cugggcagccucacacaauguu

SEQ ID NO: 393125 - RNA, 22 nt, Human
aaauaauguuaggccuuugcuc

SEQ ID NO: 393126 - RNA, 20 nt, Human
agaaaaaguguggaaauuuc

SEQ ID NO: 393127 - RNA, 18 nt, Human
gggcccuggcguccgccc

SEQ ID NO: 393128 - RNA, 22 nt, Human
uaauuucagugcaagcucacgg

SEQ ID NO: 393129 - RNA, 22 nt, Human
cugucucuguugccuguaggug

SEQ ID NO: 393130 - RNA, 22 nt, Human
aggcagccuuuagacagucugc

SEQ ID NO: 393131 - RNA, 22 nt, Human
gcagagccugggggucugcgga

SEQ ID NO: 393132 - RNA, 22 nt, Human
ugcuggccgugagcucucggga

SEQ ID NO: 393133 - RNA, 22 nt, Human
aucuauuaugcugagaaacugu

SEQ ID NO: 393134 - RNA, 22 nt, Human
acauuucuucccuuuagcagaa

SEQ ID NO: 393135 - RNA, 22 nt, Human
cauaauauacuacauugaugaa

SEQ ID NO: 393136 - RNA, 22 nt, Human
cagaagaguagcugaacaaguu

SEQ ID NO: 393137 - RNA, 22 nt, Human
auacaucucauguaagagauaa

SEQ ID NO: 393138 - RNA, 22 nt, Human
gggcugaccccaccccucacuc

SEQ ID NO: 393139 - RNA, 22 nt, Human
caaggaaaacagaugaucaaca

SEQ ID NO: 393140 - RNA, 22 nt, Human
gcugggcagccccuacagagag

SEQ ID NO: 393141 - RNA, 22 nt, Human
cauguuuuguguacagaauauu

SEQ ID NO: 393142 - RNA, 22 nt, Human
ugaaguuauauauguugaaaau

SEQ ID NO: 393143 - RNA, 22 nt, Human
uggcagcuaucuuuaaugagau

SEQ ID NO: 393144 - RNA, 22 nt, Human
uuucauaaugucacagucaaaa

SEQ ID NO: 393145 - RNA, 22 nt, Human
cugcucuggcguacucggcauc

SEQ ID NO: 393146 - RNA, 20 nt, Human
ccuggcugcauucaggacgg

SEQ ID NO: 393147 - RNA, 22 nt, Human
ucuuugcuccacacucuagaga

SEQ ID NO: 393148 - RNA, 22 nt, Human
gcuuuccuggcccugucccugc

SEQ ID NO: 393149 - RNA, 22 nt, Human
aagcugcccuguguuagaguuc

SEQ ID NO: 393150 - RNA, 22 nt, Human
ugcauugcauuugucaugaaga

SEQ ID NO: 393151 - RNA, 22 nt, Human
gggaggcuggcucuggccacag

SEQ ID NO: 393152 - RNA, 22 nt, Human
cuuuauguucaguacaaugcuu

SEQ ID NO: 393153 - RNA, 22 nt, Human
agaacagcaguuaugguucauu

SEQ ID NO: 393154 - RNA, 22 nt, Human
cagcugucuaaguugagcagga

SEQ ID NO: 393155 - RNA, 22 nt, Human
cccuggaggaccccaauguggc

SEQ ID NO: 393156 - RNA, 22 nt, Human
gugcuuucugcugcauuccucu

SEQ ID NO: 393157 - RNA, 22 nt, Human
ccuauacaggcuucuuuacaug

SEQ ID NO: 393158 - RNA, 22 nt, Human
ugaagccauuacuguguuaggg

SEQ ID NO: 393159 - RNA, 22 nt, Human
cagccagguaugggcgugcggg

SEQ ID NO: 393160 - RNA, 22 nt, Human
agccacagcuccuugguggaga

SEQ ID NO: 393161 - RNA, 22 nt, Human
agcuuuauauaaaagaguacau

SEQ ID NO: 393162 - RNA, 17 nt, Human
accagccucuccugggg

SEQ ID NO: 393163 - RNA, 22 nt, Human
ugaggcaggaguucaggcugcg

SEQ ID NO: 393164 - RNA, 22 nt, Human
uauuucugggaguucagaaauu

SEQ ID NO: 393165 - RNA, 22 nt, Human
aagcagaaaaacugagcuccaa

SEQ ID NO: 393166 - RNA, 22 nt, Human
augcuuaagcucaguuauauau

SEQ ID NO: 393167 - RNA, 22 nt, Human
acuuugugcccaacagaaagaa

SEQ ID NO: 393168 - RNA, 22 nt, Human
uagugaaauuuaugcacagcua

SEQ ID NO: 393169 - RNA, 22 nt, Human
ugggcacaaacaucugccuguu

SEQ ID NO: 393170 - RNA, 22 nt, Human
cagucucuugcuucauuaguug

SEQ ID NO: 393171 - RNA, 22 nt, Human
gggcugagacgauggggucuuc

SEQ ID NO: 393172 - RNA, 19 nt, Human
aggguggcaaaggagggug

SEQ ID NO: 393173 - RNA, 22 nt, Human
ggccgggcaggucucagccagc

SEQ ID NO: 393174 - RNA, 22 nt, Human
gcagaggaucaggcucuggaaa

SEQ ID NO: 393175 - RNA, 22 nt, Human
ugcauuccuccaccuccugcac

SEQ ID NO: 393176 - RNA, 22 nt, Human
uuccaugaaauguguuaugcuu

SEQ ID NO: 393177 - RNA, 18 nt, Human
gaggccugagaaccaggu

SEQ ID NO: 393178 - RNA, 18 nt, Human
gggcucacacaggucauc

SEQ ID NO: 393179 - RNA, 22 nt, Human
aagggcugagcacagugagcca

SEQ ID NO: 393180 - RNA, 22 nt, Human
auguuauuuuggaaaauacaaa

SEQ ID NO: 393181 - RNA, 22 nt, Human
uagaauaaguugaugauauaug

SEQ ID NO: 393182 - RNA, 22 nt, Human
caugagcugcugggagccuguc

SEQ ID NO: 393183 - RNA, 22 nt, Human
ggagccugggcauuaguaauuu

SEQ ID NO: 393184 - RNA, 20 nt, Human
agggcagagggauuacaggc

SEQ ID NO: 393185 - RNA, 22 nt, Human
uauuagggaacugcaagacuaa

SEQ ID NO: 393186 - RNA, 22 nt, Human
ucugugacuugcgggaggagaa

SEQ ID NO: 393187 - RNA, 22 nt, Human
cgcagcagccccgugguaggug

SEQ ID NO: 393188 - RNA, 23 nt, Human
ccagggccccuacaccacugucc

SEQ ID NO: 393189 - RNA, 22 nt, Human
uuacagaaagguugugggauag

SEQ ID NO: 393190 - RNA, 22 nt, Human
guuccaggcaagugggauagga

SEQ ID NO: 393191 - RNA, 22 nt, Human
ugcaggcaggggaugagcagcc

SEQ ID NO: 393192 - RNA, 22 nt, Human
uuacuuuguucucaagauaugu

SEQ ID NO: 393193 - RNA, 22 nt, Human
gcagugaacauaacacagaagg

SEQ ID NO: 393194 - RNA, 22 nt, Human
aagaaauuaaugugccauuacu

SEQ ID NO: 393195 - RNA, 22 nt, Human
gggcuccagcccgggaccaggu

SEQ ID NO: 393196 - RNA, 23 nt, Human
uggcucugagagguucagaugcu

SEQ ID NO: 393197 - RNA, 22 nt, Human
aaacagaaauuuccucaugcuc

SEQ ID NO: 393198 - RNA, 18 nt, Human
aggcacagagcauacaua

SEQ ID NO: 393199 - RNA, 18 nt, Human
aggcagacacuagagguc

SEQ ID NO: 393200 - RNA, 22 nt, Human
uugcuauuuugagagucauagu

SEQ ID NO: 393201 - RNA, 22 nt, Human
uacuuuaaaaacugauaauuca

SEQ ID NO: 393202 - RNA, 22 nt, Human
aucagcaagcauuuauugagug

SEQ ID NO: 393203 - RNA, 22 nt, Human
cuggagccaugucuugacugcu

SEQ ID NO: 393204 - RNA, 22 nt, Human
aacaggcaaacugugggauccc

SEQ ID NO: 393205 - RNA, 22 nt, Human
uccuucaagaugccacagcuuu

SEQ ID NO: 393206 - RNA, 18 nt, Human
cugugcagcaaacugagc

SEQ ID NO: 393207 - RNA, 22 nt, Human
uucuuagaugauuaaugauggg

SEQ ID NO: 393208 - RNA, 22 nt, Human
cacaauuuguuuuaucaguauu

SEQ ID NO: 393209 - RNA, 23 nt, Human
acuuaaaugguucuuuaucucag

SEQ ID NO: 393210 - RNA, 22 nt, Human
gaguccuugucauaauucagug

SEQ ID NO: 393211 - RNA, 22 nt, Human
aauaauguugacgauagucuua

SEQ ID NO: 393212 - RNA, 22 nt, Human
gaugaggggucauuggcuggga

SEQ ID NO: 393213 - RNA, 22 nt, Human
uuuucaguaaugucuacauaau

SEQ ID NO: 393214 - RNA, 22 nt, Human
gcuagaucucucauaaauucca

SEQ ID NO: 393215 - RNA, 22 nt, Human
caggggcuagcacuuaauguuu

SEQ ID NO: 393216 - RNA, 22 nt, Human
cucugaacucuugggcagcaug

SEQ ID NO: 393217 - RNA, 22 nt, Human
aaaugcaucagcucauaagaga

SEQ ID NO: 393218 - RNA, 22 nt, Human
ucccaggacuuccaguuggagg

SEQ ID NO: 393219 - RNA, 22 nt, Human
uccuggauucugcccugaaggc

SEQ ID NO: 393220 - RNA, 22 nt, Human
uccuucagggggccgccugcac

SEQ ID NO: 393221 - RNA, 22 nt, Human
uaagccacuagucuguuaugaa

SEQ ID NO: 393222 - RNA, 22 nt, Human
ggagccugugcccaagcccaga

SEQ ID NO: 393223 - RNA, 22 nt, Human
uccugcagccuugggcuggagc

SEQ ID NO: 393224 - RNA, 22 nt, Human
cccaggagauggagguugcagu

SEQ ID NO: 393225 - RNA, 16 nt, Human
agccaggcugccucgg

SEQ ID NO: 393226 - RNA, 22 nt, Human
cuggagcagcagguggccaggg

SEQ ID NO: 393227 - RNA, 22 nt, Human
aaggcagaaauucaacuacugg

SEQ ID NO: 393228 - RNA, 22 nt, Human
ugggaggcuuccagaccuugcu

SEQ ID NO: 393229 - RNA, 22 nt, Human
cucuuucaguucugauagucuc

SEQ ID NO: 393230 - RNA, 22 nt, Human
uauccaaacauauagucucucu

SEQ ID NO: 393231 - RNA, 22 nt, Human
aaaauacacauacuaggggaaa

SEQ ID NO: 393232 - RNA, 22 nt, Human
agcuccugaaaagcgcuugcuu

SEQ ID NO: 393233 - RNA, 22 nt, Human
cuccaggccagggaaguggaca

SEQ ID NO: 393234 - RNA, 22 nt, Human
ucauuuucaaguuugaacagga

SEQ ID NO: 393235 - RNA, 22 nt, Human
cagggccugagggcugcucugc

SEQ ID NO: 393236 - RNA, 22 nt, Human
agcagccauccuuagagaaaga

SEQ ID NO: 393237 - RNA, 18 nt, Human
ccugagcccugcuuacuu

SEQ ID NO: 393238 - RNA, 22 nt, Human
gccagcucagaugcaggaagga

SEQ ID NO: 393239 - RNA, 22 nt, Human
uggaggaaaauuacuggggucu

SEQ ID NO: 393240 - RNA, 22 nt, Human
aggcaggcacacuuccuccagg

SEQ ID NO: 393241 - RNA, 22 nt, Human
agggccugcaucaggagcuugg

SEQ ID NO: 393242 - RNA, 22 nt, Human
gagcaacaguuuaugguuuuuc

SEQ ID NO: 393243 - RNA, 22 nt, Human
acacugaauguuuaagaacuug

SEQ ID NO: 393244 - RNA, 22 nt, Human
uggcuuuacacauccacugccu

SEQ ID NO: 393245 - RNA, 22 nt, Human
gggagcaggagccugccugcca

SEQ ID NO: 393246 - RNA, 22 nt, Human
cacaggcagccuuguagaagaa

SEQ ID NO: 393247 - RNA, 22 nt, Human
gcagagcuguuaauggagcuga

SEQ ID NO: 393248 - RNA, 22 nt, Human
gcucugucauuuugcagacacu

SEQ ID NO: 393249 - RNA, 22 nt, Human
agaagugccgaaaggaagacag

SEQ ID NO: 393250 - RNA, 22 nt, Human
ggggaggcugaugugggcaaag

SEQ ID NO: 393251 - RNA, 22 nt, Human
ugaagccaucccucagauggcc

SEQ ID NO: 393252 - RNA, 19 nt, Human
ccucugcgcuguccugcuc

SEQ ID NO: 393253 - RNA, 22 nt, Human
ggaggcgauccugggaaacacc

SEQ ID NO: 393254 - RNA, 22 nt, Human
cccaggagaccuagaucuguuu

SEQ ID NO: 393255 - RNA, 22 nt, Human
gacagcuggcaguggaaaggug

SEQ ID NO: 393256 - RNA, 22 nt, Human
agggcagauggaacuuccccga

SEQ ID NO: 393257 - RNA, 22 nt, Human
cugggcacauuuugacuagugu

SEQ ID NO: 393258 - RNA, 22 nt, Human
caggguccggcugccuggcugu

SEQ ID NO: 393259 - RNA, 22 nt, Human
acuguucaagcaaaugacauug

SEQ ID NO: 393260 - RNA, 22 nt, Human
aacacuuugggcauggccuucc

SEQ ID NO: 393261 - RNA, 22 nt, Human
uccaggaggugaggggaccaaa

SEQ ID NO: 393262 - RNA, 22 nt, Human
ugcauaaacuucucugguguga

SEQ ID NO: 393263 - RNA, 22 nt, Human
cagccagggagcaaagaguuga

SEQ ID NO: 393264 - RNA, 22 nt, Human
agaccauagggaccucagguug

SEQ ID NO: 393265 - RNA, 20 nt, Human
cccaggcagagcuagcggca

SEQ ID NO: 393266 - RNA, 22 nt, Human
cccugggcagucugcacuucag

SEQ ID NO: 393267 - RNA, 22 nt, Human
cugugucccaguaccuugggua

SEQ ID NO: 393268 - RNA, 22 nt, Human
cauuuauugguuaggccagcag

SEQ ID NO: 393269 - RNA, 22 nt, Human
aacaugaagguaggaugguuuu

SEQ ID NO: 393270 - RNA, 22 nt, Human
cuggccuggagccucugggugg

SEQ ID NO: 393271 - RNA, 22 nt, Human
cugggcugcagcgggagcgacg

SEQ ID NO: 393272 - RNA, 22 nt, Human
agguggggccaaaugcuacagu

SEQ ID NO: 393273 - RNA, 22 nt, Human
ugaggcagugugagauaauaaa

SEQ ID NO: 393274 - RNA, 22 nt, Human
gaugccugcauuucaggagagu

SEQ ID NO: 393275 - RNA, 22 nt, Human
auacugaauuagguaaagcaua

SEQ ID NO: 393276 - RNA, 22 nt, Human
ccagcaggagagaacauuuccc

SEQ ID NO: 393277 - RNA, 22 nt, Human
gugggaugcaguggugaguggc

SEQ ID NO: 393278 - RNA, 22 nt, Human
guggagcccugccuugcucaug

SEQ ID NO: 393279 - RNA, 22 nt, Human
acagauauaaacuauaguagug

SEQ ID NO: 393280 - RNA, 22 nt, Human
ccagaaggcggagauugcagug

SEQ ID NO: 393281 - RNA, 22 nt, Human
cuuguagaauugaaauggucuc

SEQ ID NO: 393282 - RNA, 22 nt, Human
agcuggguguguaucagauaaa

SEQ ID NO: 393283 - RNA, 22 nt, Human
cuggccugagaaugcuacccuu

SEQ ID NO: 393284 - RNA, 22 nt, Human
acagagcuuaauucaggagcuu

SEQ ID NO: 393285 - RNA, 18 nt, Human
cugcccagagcacuugug

SEQ ID NO: 393286 - RNA, 22 nt, Human
ugcuggccaacaaggcuccaag

SEQ ID NO: 393287 - RNA, 22 nt, Human
uucucugaaggccaugcucacu

SEQ ID NO: 393288 - RNA, 22 nt, Human
gcccaggauggagaauaguggu

SEQ ID NO: 393289 - RNA, 22 nt, Human
aagaggaggacgguucccagaa

SEQ ID NO: 393290 - RNA, 22 nt, Human
ugagaaagugggugccuagcaa

SEQ ID NO: 393291 - RNA, 22 nt, Human
ugcugcucuucaccauggccuc

SEQ ID NO: 393292 - RNA, 22 nt, Human
aauaacagagaaggguggcuuc

SEQ ID NO: 393293 - RNA, 22 nt, Human
uuauaagaguauauaguguacu

SEQ ID NO: 393294 - RNA, 22 nt, Human
ggcacugagcgggcucugagcg

SEQ ID NO: 393295 - RNA, 22 nt, Human
acaacuuucuggguuaucugau

SEQ ID NO: 393296 - RNA, 22 nt, Human
agaagccaauucugugugaguc

SEQ ID NO: 393297 - RNA, 22 nt, Human
cuucuucaagagaaugggagac

SEQ ID NO: 393298 - RNA, 22 nt, Human
acagggcaccugagguaggaag

SEQ ID NO: 393299 - RNA, 22 nt, Human
aaguugagaugucauaggagac

SEQ ID NO: 393300 - RNA, 22 nt, Human
gaggcagagacuccaccuucag

SEQ ID NO: 393301 - RNA, 22 nt, Human
uuuuccuacugauaaacaguua

SEQ ID NO: 393302 - RNA, 22 nt, Human
gagcgauguggguauguagaag

SEQ ID NO: 393303 - RNA, 22 nt, Human
gggcaugagagggcagcuggca

SEQ ID NO: 393304 - RNA, 23 nt, Human
cccuggccuuggggcacaggcug

SEQ ID NO: 393305 - RNA, 22 nt, Human
gcagggcaaacccagguguuca

SEQ ID NO: 393306 - RNA, 22 nt, Human
ugcuuaauaggaguugaacauu

SEQ ID NO: 393307 - RNA, 22 nt, Human
aacaaccaaaaagaugaaugua

SEQ ID NO: 393308 - RNA, 22 nt, Human
caggaaccuaaagagacauuac

SEQ ID NO: 393309 - RNA, 22 nt, Human
caguuucuacgacuuaagcaca

SEQ ID NO: 393310 - RNA, 22 nt, Human
ugucccucauugacgcugugcc

SEQ ID NO: 393311 - RNA, 22 nt, Human
gaggcugaauggccagaagcca

SEQ ID NO: 393312 - RNA, 22 nt, Human
agcugccccaugagaggcaggu

SEQ ID NO: 393313 - RNA, 22 nt, Human
uguguucuggaaagcucacuga

SEQ ID NO: 393314 - RNA, 19 nt, Human
ccagaggacuguuaaugaa

SEQ ID NO: 393315 - RNA, 22 nt, Human
aaauuucaguuaccuuuacguu

SEQ ID NO: 393316 - RNA, 22 nt, Human
cagggccagcgcccaggcccag

SEQ ID NO: 393317 - RNA, 22 nt, Human
cugcuguguuucacaccucugg

SEQ ID NO: 393318 - RNA, 22 nt, Human
aaguccuuuccaguccugugau

SEQ ID NO: 393319 - RNA, 22 nt, Human
gggcagugucggggcccaggga

SEQ ID NO: 393320 - RNA, 17 nt, Human
gaggagcuccaguaggu

SEQ ID NO: 393321 - RNA, 22 nt, Human
aacaguaaugugguguuggguu

SEQ ID NO: 393322 - RNA, 22 nt, Human
augcuuuauuauuuugcaggga

SEQ ID NO: 393323 - RNA, 22 nt, Human
ccuagagcucugcuuuaucuaa

SEQ ID NO: 393324 - RNA, 22 nt, Human
acaugucuguaauuauuuuagg

SEQ ID NO: 393325 - RNA, 22 nt, Human
cccaggaggcagagcuugcagu

SEQ ID NO: 393326 - RNA, 22 nt, Human
caauuucagugcuguggagagg

SEQ ID NO: 393327 - RNA, 23 nt, Human
ucagaaugcacugaauuuacccu

SEQ ID NO: 393328 - RNA, 22 nt, Human
aaaugcaaggccaugugaagga

SEQ ID NO: 393329 - RNA, 22 nt, Human
cugcccugagggccuguguguu

SEQ ID NO: 393330 - RNA, 22 nt, Human
ggcauuuauuugucucauucuu

SEQ ID NO: 393331 - RNA, 22 nt, Human
ugcuuuaaccaucuuguuugga

SEQ ID NO: 393332 - RNA, 22 nt, Human
ucagcaguguaguuuaucauuc

SEQ ID NO: 393333 - RNA, 17 nt, Human
ggccuguguggcugcag

SEQ ID NO: 393334 - RNA, 22 nt, Human
cagagggcacaugguuuccuca

SEQ ID NO: 393335 - RNA, 22 nt, Human
gcaaagucugcaucuggaucag

SEQ ID NO: 393336 - RNA, 19 nt, Human
gcaucagagcagaaggggu

SEQ ID NO: 393337 - RNA, 22 nt, Human
uaaacaugugagugugcauaua

SEQ ID NO: 393338 - RNA, 22 nt, Human
gcugagcugggacaguccuggg

SEQ ID NO: 393339 - RNA, 23 nt, Human
cauuucugggagauuuauaaaau

SEQ ID NO: 393340 - RNA, 22 nt, Human
cagcaugcaaguccagaugugg

SEQ ID NO: 393341 - RNA, 22 nt, Human
gagaaggcugauccuuggaguu

SEQ ID NO: 393342 - RNA, 22 nt, Human
ugccaggcuccggaacgacagu

SEQ ID NO: 393343 - RNA, 22 nt, Human
cagggcugugcccaucuucccc

SEQ ID NO: 393344 - RNA, 22 nt, Human
ugagaacugaggauuugaauuc

SEQ ID NO: 393345 - RNA, 22 nt, Human
gcaguggauccaaugguaucuu

SEQ ID NO: 393346 - RNA, 22 nt, Human
caaggccacuccagagacuggu

SEQ ID NO: 393347 - RNA, 22 nt, Human
aggacucaucccugcuugucag

SEQ ID NO: 393348 - RNA, 22 nt, Human
gcagauggugccaugucuugug

SEQ ID NO: 393349 - RNA, 22 nt, Human
ucaguuuugaaaacauugaaug

SEQ ID NO: 393350 - RNA, 22 nt, Human
agccuggagaagauguguauug

SEQ ID NO: 393351 - RNA, 22 nt, Human
caugggcaccuuaaaaugaggc

SEQ ID NO: 393352 - RNA, 22 nt, Human
ggcagugagucccggagaggcc

SEQ ID NO: 393353 - RNA, 22 nt, Human
cacauacuuguguguacauaug

SEQ ID NO: 393354 - RNA, 22 nt, Human
ugagccuggcggaagcagcgug

SEQ ID NO: 393355 - RNA, 22 nt, Human
aauguguacaugacagauagaa

SEQ ID NO: 393356 - RNA, 20 nt, Human
uagggcucauuaugaucucc

SEQ ID NO: 393357 - RNA, 22 nt, Human
agcucugggccaggaacccuaa

SEQ ID NO: 393358 - RNA, 22 nt, Human
agagccugcagcugugaagaaa

SEQ ID NO: 393359 - RNA, 22 nt, Human
uucuuacagaguuuacagagcc

SEQ ID NO: 393360 - RNA, 22 nt, Human
aagguacaccaaaguucaaguu

SEQ ID NO: 393361 - RNA, 22 nt, Human
gcucucugccuuucucaaugac

SEQ ID NO: 393362 - RNA, 22 nt, Human
acucugggccccagguggagcu

SEQ ID NO: 393363 - RNA, 22 nt, Human
aagcaauagcaacaacuuuaca

SEQ ID NO: 393364 - RNA, 22 nt, Human
aucagcaagauugugucuugua

SEQ ID NO: 393365 - RNA, 22 nt, Human
acccaggaggcaagguugcagu

SEQ ID NO: 393366 - RNA, 22 nt, Human
gaccaaggaagaggggagccag

SEQ ID NO: 393367 - RNA, 22 nt, Human
aaagccuuggucaucugguucc

SEQ ID NO: 393368 - RNA, 22 nt, Human
caguagcacucugucagugaag

SEQ ID NO: 393369 - RNA, 22 nt, Human
aaucagaaauucuacaucacaa

SEQ ID NO: 393370 - RNA, 22 nt, Human
guucaagguuuuacagagugua

SEQ ID NO: 393371 - RNA, 22 nt, Human
aaaucagucccucuuggaauuu

SEQ ID NO: 393372 - RNA, 22 nt, Human
agcugccaggccccugagaacc

SEQ ID NO: 393373 - RNA, 22 nt, Human
uggcuuuacugucauucuuaug

SEQ ID NO: 393374 - RNA, 22 nt, Human
uucauucaucucuaaaaugccu

SEQ ID NO: 393375 - RNA, 22 nt, Human
gucaggaugcuauuguuauuaa

SEQ ID NO: 393376 - RNA, 22 nt, Human
caaagguauaaguuaauauaca

SEQ ID NO: 393377 - RNA, 16 nt, Human
ccccaggacuuggcac

SEQ ID NO: 393378 - RNA, 22 nt, Human
guguggcuaccucagaggagca

SEQ ID NO: 393379 - RNA, 22 nt, Human
cagcuccccucuguggggcagu

SEQ ID NO: 393380 - RNA, 22 nt, Human
ccacugucuuuuccaggcugaa

SEQ ID NO: 393381 - RNA, 22 nt, Human
ugagugaggaagcgguggagga

SEQ ID NO: 393382 - RNA, 22 nt, Human
uggcagagaacacggcugaucu

SEQ ID NO: 393383 - RNA, 22 nt, Human
caguucuuuguggggaguucuc

SEQ ID NO: 393384 - RNA, 17 nt, Human
ccucccacaccgcccug

SEQ ID NO: 393385 - RNA, 22 nt, Human
cccaggcauuuucaacuuuagu

SEQ ID NO: 393386 - RNA, 22 nt, Human
uggcagcuggcucugcgcaggc

SEQ ID NO: 393387 - RNA, 22 nt, Human
cugagagguaagcagcgcagug

SEQ ID NO: 393388 - RNA, 22 nt, Human
cagggcucaggcucugggauuc

SEQ ID NO: 393389 - RNA, 22 nt, Human
uuucacuagaacguucuuguuu

SEQ ID NO: 393390 - RNA, 22 nt, Human
uuucaaauaccauaaaccuaau

SEQ ID NO: 393391 - RNA, 22 nt, Human
uggagcugaacuuugaggccag

SEQ ID NO: 393392 - RNA, 22 nt, Human
aggcagcauccagaggagaaug

SEQ ID NO: 393393 - RNA, 22 nt, Human
aaauaauuauagcgagucuauc

SEQ ID NO: 393394 - RNA, 22 nt, Human
aucagaaauugcccagcuguuu

SEQ ID NO: 393395 - RNA, 22 nt, Human
agaggcaggaagagcugauuuu

SEQ ID NO: 393396 - RNA, 22 nt, Human
ugcauuguugaugaguugaaua

SEQ ID NO: 393397 - RNA, 22 nt, Human
uucaggaugaaagugugcaaca

SEQ ID NO: 393398 - RNA, 22 nt, Human
uucaagucaaggaaagaggucu

SEQ ID NO: 393399 - RNA, 22 nt, Human
ucauugcagaaauaaaggugaa

SEQ ID NO: 393400 - RNA, 22 nt, Human
uucaacuagauuuauacaauuc

SEQ ID NO: 393401 - RNA, 22 nt, Human
ccuguucacuuugacuucucca

SEQ ID NO: 393402 - RNA, 22 nt, Human
uggcucuguugagguauggauu

SEQ ID NO: 393403 - RNA, 17 nt, Human
ucugccgacugccagcu

SEQ ID NO: 393404 - RNA, 22 nt, Human
aaggagucucagcugggccuga

SEQ ID NO: 393405 - RNA, 22 nt, Human
aggcaguggagcuggaauaggc

SEQ ID NO: 393406 - RNA, 22 nt, Human
gcuggcagggacagcugcgugu

SEQ ID NO: 393407 - RNA, 22 nt, Human
cagcaauaagccagguuagaca

SEQ ID NO: 393408 - RNA, 22 nt, Human
acagcaggauuuggcgauguug

SEQ ID NO: 393409 - RNA, 22 nt, Human
acuguucacuagugaggguuga

SEQ ID NO: 393410 - RNA, 22 nt, Human
uaaggcacccgugagcugccag

SEQ ID NO: 393411 - RNA, 17 nt, Human
uguuccauuugaccacc

SEQ ID NO: 393412 - RNA, 22 nt, Human
cuucuucaguugcauguauugg

SEQ ID NO: 393413 - RNA, 22 nt, Human
uuuuuccaccguacuuccugag

SEQ ID NO: 393414 - RNA, 22 nt, Human
gaggcucacuaggcauccuggg

SEQ ID NO: 393415 - RNA, 22 nt, Human
aggagcagcuucugaaccaugu

SEQ ID NO: 393416 - RNA, 22 nt, Human
cagcugccacuugcucucggcu

SEQ ID NO: 393417 - RNA, 22 nt, Human
uggcugagaaaaaagagcuaua

SEQ ID NO: 393418 - RNA, 22 nt, Human
cagcuccccaugguuccugaag

SEQ ID NO: 393419 - RNA, 22 nt, Human
acccaggagacggaggugcagu

SEQ ID NO: 393420 - RNA, 22 nt, Human
uuaacauacaucaugaacaaug

SEQ ID NO: 393421 - RNA, 23 nt, Human
gccucugcagccuaguuaguguc

SEQ ID NO: 393422 - RNA, 22 nt, Human
auucauuagccacuaacuagca

SEQ ID NO: 393423 - RNA, 20 nt, Human
uggagcuguaaucuugucug

SEQ ID NO: 393424 - RNA, 22 nt, Human
cuguggcauugugaggacugca

SEQ ID NO: 393425 - RNA, 22 nt, Human
ggaggccagggacccagucagc

SEQ ID NO: 393426 - RNA, 22 nt, Human
gcacagggccuggcacauaaga

SEQ ID NO: 393427 - RNA, 22 nt, Human
gacagaguuguugauguaugcu

SEQ ID NO: 393428 - RNA, 22 nt, Human
acugucucucuagcaguucagg

SEQ ID NO: 393429 - RNA, 22 nt, Human
agcagcauuccuggcuucuauc

SEQ ID NO: 393430 - RNA, 22 nt, Human
ggaguuggugagcaccaggcuu

SEQ ID NO: 393431 - RNA, 22 nt, Human
uuuuucaucugauugauaacuc

SEQ ID NO: 393432 - RNA, 21 nt, Human
cagagcuguccaaacccugac

SEQ ID NO: 393433 - RNA, 22 nt, Human
ggugaaggcacaagagggcaag

SEQ ID NO: 393434 - RNA, 22 nt, Human
gaggcucaccuagggagcacug

SEQ ID NO: 393435 - RNA, 22 nt, Human
uaaggccaccguuauagaacca

SEQ ID NO: 393436 - RNA, 22 nt, Human
aaaugucagaagcuuuacuucu

SEQ ID NO: 393437 - RNA, 22 nt, Human
ucuguccucuuugaagcugcuc

SEQ ID NO: 393438 - RNA, 22 nt, Human
guaagagcacugucuccugcug

SEQ ID NO: 393439 - RNA, 22 nt, Human
gaauucugguuuugaaaugaau

SEQ ID NO: 393440 - RNA, 22 nt, Human
agguacagggugaaaguuuaug

SEQ ID NO: 393441 - RNA, 22 nt, Human
gcuggccucuacaggccggcca

SEQ ID NO: 393442 - RNA, 22 nt, Human
aagaaaucauaucauuucuugg

SEQ ID NO: 393443 - RNA, 22 nt, Human
ccuggagagagaggccaacugc

SEQ ID NO: 393444 - RNA, 22 nt, Human
uggcagcugugcuucauucuuu

SEQ ID NO: 393445 - RNA, 22 nt, Human
ggcuggccucaggguccucgcu

SEQ ID NO: 393446 - RNA, 22 nt, Human
acccuuucuuacucacacgcuc

SEQ ID NO: 393447 - RNA, 22 nt, Human
ccaggacuuuaaguccagcacu

SEQ ID NO: 393448 - RNA, 22 nt, Human
agcaggaaagaaaaaucugugu

SEQ ID NO: 393449 - RNA, 22 nt, Human
agcugcagugaacuguuuuguc

SEQ ID NO: 393450 - RNA, 22 nt, Human
uuagaaaacauaagugguaaag

SEQ ID NO: 393451 - RNA, 20 nt, Human
gcuguucacauuauuaguag

SEQ ID NO: 393452 - RNA, 21 nt, Human
agcaccuuacagcuauaaugg

SEQ ID NO: 393453 - RNA, 22 nt, Human
agccacagucaaccuguccaua

SEQ ID NO: 393454 - RNA, 19 nt, Human
acuuucuccaggaccuguu

SEQ ID NO: 393455 - RNA, 22 nt, Human
auuuauuaagcaucugcuaugu

SEQ ID NO: 393456 - RNA, 22 nt, Human
agucccaguucgguucuuccuc

SEQ ID NO: 393457 - RNA, 22 nt, Human
uugaaucuggguacuuguaaua

SEQ ID NO: 393458 - RNA, 22 nt, Human
cugccugcugccuguggagggu

SEQ ID NO: 393459 - RNA, 22 nt, Human
ggcuggcuuucucuccgcaccu

SEQ ID NO: 393460 - RNA, 22 nt, Human
acagagguguguguaggacagu

SEQ ID NO: 393461 - RNA, 22 nt, Human
agcugccuguccuaggccauca

SEQ ID NO: 393462 - RNA, 22 nt, Human
aaauuucaguuggaaugagcuc

SEQ ID NO: 393463 - RNA, 22 nt, Human
cagggcaggaugcugugauuau

SEQ ID NO: 393464 - RNA, 22 nt, Human
uacagggguaacaguggggaau

SEQ ID NO: 393465 - RNA, 20 nt, Human
gaguccuuaugggcugaggu

SEQ ID NO: 393466 - RNA, 22 nt, Human
acacauuucucuuuuuguaagu

SEQ ID NO: 393467 - RNA, 23 nt, Human
ccaggcaguagcuauugaaguga

SEQ ID NO: 393468 - RNA, 23 nt, Human
agaauuccaguuucuuaugucac

SEQ ID NO: 393469 - RNA, 22 nt, Human
uaauuuaauuccauggauucua

SEQ ID NO: 393470 - RNA, 22 nt, Human
agcuugaguuuuggaugaagug

SEQ ID NO: 393471 - RNA, 22 nt, Human
cuggagguaauguuauuuuugu

SEQ ID NO: 393472 - RNA, 22 nt, Human
uggcucagaugcucuuccagug

SEQ ID NO: 393473 - RNA, 22 nt, Human
agggcagaaguacagacacuua

SEQ ID NO: 393474 - RNA, 19 nt, Human
ugcagaagacacaguggug

SEQ ID NO: 393475 - RNA, 22 nt, Human
aagcaaaggcaggagcuuguga

SEQ ID NO: 393476 - RNA, 22 nt, Human
ggaagggcaaaagagaugaacu

SEQ ID NO: 393477 - RNA, 19 nt, Human
uuucccagcccuugcugug

SEQ ID NO: 393478 - RNA, 22 nt, Human
guuucacagucugcagaauuuu

SEQ ID NO: 393479 - RNA, 22 nt, Human
cuuccagguccuucuugagaag

SEQ ID NO: 393480 - RNA, 22 nt, Human
ucugcucuaguugcuuccugcc

SEQ ID NO: 393481 - RNA, 22 nt, Human
uguuuuaugagccauauaaccu

SEQ ID NO: 393482 - RNA, 22 nt, Human
gcagcuuggauuucuguaguuu

SEQ ID NO: 393483 - RNA, 22 nt, Human
cucacuggcaagacuacaggug

SEQ ID NO: 393484 - RNA, 22 nt, Human
agagacaggguuuugucguguu

SEQ ID NO: 393485 - RNA, 22 nt, Human
gucauuucuguuucuucagugc

SEQ ID NO: 393486 - RNA, 22 nt, Human
aagauuucugcuccugagagaa

SEQ ID NO: 393487 - RNA, 22 nt, Human
gaaugugugacucuauugagca

SEQ ID NO: 393488 - RNA, 22 nt, Human
gcagggaccuugcccacccucc

SEQ ID NO: 393489 - RNA, 22 nt, Human
uccugcagcugauaaauacagu

SEQ ID NO: 393490 - RNA, 22 nt, Human
auaucaaacgaaguuauuuuaa

SEQ ID NO: 393491 - RNA, 19 nt, Human
gaaaggcugcugcuaccug

SEQ ID NO: 393492 - RNA, 22 nt, Human
uaaugcaguacugauauaaaca

SEQ ID NO: 393493 - RNA, 18 nt, Human
gggcaagcggcugucacc

SEQ ID NO: 393494 - RNA, 18 nt, Human
aaguaacagaagagcaca

SEQ ID NO: 393495 - RNA, 22 nt, Human
cucagagaaaaggagcaagggu

SEQ ID NO: 393496 - RNA, 19 nt, Human
gcagcugugggaagagcca

SEQ ID NO: 393497 - RNA, 20 nt, Human
gcugaccccugcugucaugc

SEQ ID NO: 393498 - RNA, 22 nt, Human
caggcugccgugaagcaggccu

SEQ ID NO: 393499 - RNA, 22 nt, Human
uuauauuaguuagacuugcugu

SEQ ID NO: 393500 - RNA, 22 nt, Human
caagcccaggauuccccaguua

SEQ ID NO: 393501 - RNA, 22 nt, Human
cuauuucaaggcccagauauga

SEQ ID NO: 393502 - RNA, 22 nt, Human
auuauaaauauuuucuaggggu

SEQ ID NO: 393503 - RNA, 22 nt, Human
uuugggaacucuaucauggaaa

SEQ ID NO: 393504 - RNA, 22 nt, Human
aaaugcuuguaaauuuuccaug

SEQ ID NO: 393505 - RNA, 22 nt, Human
gagccagcuauguagcaagagg

SEQ ID NO: 393506 - RNA, 16 nt, Human
gcaacuuugggguuga

SEQ ID NO: 393507 - RNA, 21 nt, Human
acagugugcuucucucccucc

SEQ ID NO: 393508 - RNA, 23 nt, Human
gucagggcuggggucagagugac

SEQ ID NO: 393509 - RNA, 22 nt, Human
cccuggaguccuggcaguugau

SEQ ID NO: 393510 - RNA, 22 nt, Human
agaagcagacucugaggcaagg

SEQ ID NO: 393511 - RNA, 21 nt, Human
agaaaauggcguuuuagauuu

SEQ ID NO: 393512 - RNA, 22 nt, Human
ugcugccuuagcagccaggcaa

SEQ ID NO: 393513 - RNA, 22 nt, Human
uugaacagcuguuacauuguua

SEQ ID NO: 393514 - RNA, 22 nt, Human
acaaaggugagcagaagacaca

SEQ ID NO: 393515 - RNA, 22 nt, Human
acucaagauagggaaaguacaa

SEQ ID NO: 393516 - RNA, 22 nt, Human
ucauuuguucucauucucuacu

SEQ ID NO: 393517 - RNA, 22 nt, Human
aucagcuuuucucaucagaaau

SEQ ID NO: 393518 - RNA, 22 nt, Human
ggggacccucaggacugcgucu

SEQ ID NO: 393519 - RNA, 21 nt, Human
uuucccagcugaaaauaaaug

SEQ ID NO: 393520 - RNA, 22 nt, Human
uaaaaugacuuccuccaacauc

SEQ ID NO: 393521 - RNA, 20 nt, Human
cugagagucugugcuuaguc

SEQ ID NO: 393522 - RNA, 22 nt, Human
guguacauagaauugugcuuug

SEQ ID NO: 393523 - RNA, 22 nt, Human
aggcaguuguagagagggcucu

SEQ ID NO: 393524 - RNA, 22 nt, Human
cguauacaugaagacauugcug

SEQ ID NO: 393525 - RNA, 22 nt, Human
ugucaugccaggaaauaguccc

SEQ ID NO: 393526 - RNA, 22 nt, Human
uguggcugucuguucuccuagg

SEQ ID NO: 393527 - RNA, 22 nt, Human
aagcuggaacaucuugaggaag

SEQ ID NO: 393528 - RNA, 23 nt, Human
uucaaagcuuaagcucuuuccac

SEQ ID NO: 393529 - RNA, 22 nt, Human
gacaggggucccucugggcugu

SEQ ID NO: 393530 - RNA, 22 nt, Human
ggugaguugggguucacagguc

SEQ ID NO: 393531 - RNA, 22 nt, Human
uccagcagaccaucaaggcuca

SEQ ID NO: 393532 - RNA, 22 nt, Human
uuuauuagugcuuguaucacug

SEQ ID NO: 393533 - RNA, 22 nt, Human
gucccagaugucuggaacuccc

SEQ ID NO: 393534 - RNA, 22 nt, Human
aaugaacacagcccucuacuuu

SEQ ID NO: 393535 - RNA, 22 nt, Human
auacaaagacaaaucucaaucu

SEQ ID NO: 393536 - RNA, 22 nt, Human
uccucuggggucagggcacuac

SEQ ID NO: 393537 - RNA, 21 nt, Human
aggcucccagaaaugggcauc

SEQ ID NO: 393538 - RNA, 22 nt, Human
gcagggugugucucauacaguu

SEQ ID NO: 393539 - RNA, 22 nt, Human
auuuacagaagcauguaauagc

SEQ ID NO: 393540 - RNA, 22 nt, Human
gacccaggguauccagagcugc

SEQ ID NO: 393541 - RNA, 22 nt, Human
gcugggcugagcuagacuuggc

SEQ ID NO: 393542 - RNA, 22 nt, Human
gugcuuuccauccucccugcug

SEQ ID NO: 393543 - RNA, 22 nt, Human
gacccagcuaaccaggugggga

SEQ ID NO: 393544 - RNA, 18 nt, Human
ucucugaauauuuuaugu

SEQ ID NO: 393545 - RNA, 22 nt, Human
ugcucugguccucccucggcgc

SEQ ID NO: 393546 - RNA, 22 nt, Human
aacauaauguggccaaagucac

SEQ ID NO: 393547 - RNA, 23 nt, Human
uaauucacauauacauugcuuca

SEQ ID NO: 393548 - RNA, 22 nt, Human
ucuggcucccuggagcuccaca

SEQ ID NO: 393549 - RNA, 22 nt, Human
ucaccaggauuccuaucaguag

SEQ ID NO: 393550 - RNA, 22 nt, Human
cuuuucauuguuuguacaugca

SEQ ID NO: 393551 - RNA, 22 nt, Human
aauuccugucuuaacaguucug

SEQ ID NO: 393552 - RNA, 22 nt, Human
agccucaguuucaggccuccuc

SEQ ID NO: 393553 - RNA, 22 nt, Human
gaagggugugugugagggacac

SEQ ID NO: 393554 - RNA, 22 nt, Human
aggcuggggaauugaauuugcu

SEQ ID NO: 393555 - RNA, 22 nt, Human
aacaugcucuguuucuuggaug

SEQ ID NO: 393556 - RNA, 22 nt, Human
ggcuggcacucuguccaguguc

SEQ ID NO: 393557 - RNA, 22 nt, Human
caggcugucugaauggaggccc

SEQ ID NO: 393558 - RNA, 22 nt, Human
ggcucuggaaaguguccuugau

SEQ ID NO: 393559 - RNA, 22 nt, Human
gcucaggaucccaggggugugc

SEQ ID NO: 393560 - RNA, 22 nt, Human
ccucccugcgcuccugcggcgg

SEQ ID NO: 393561 - RNA, 22 nt, Human
uacuuuuuagcacagugugugc

SEQ ID NO: 393562 - RNA, 19 nt, Human
agaaaucucgagauuuguu

SEQ ID NO: 393563 - RNA, 22 nt, Human
ccagauaaggcuuuuuaaaagc

SEQ ID NO: 393564 - RNA, 22 nt, Human
uggcucugggcaccguguccac

SEQ ID NO: 393565 - RNA, 22 nt, Human
ugcccaagcagaggagugauuc

SEQ ID NO: 393566 - RNA, 22 nt, Human
uacaugcaugucacagaaugaa

SEQ ID NO: 393567 - RNA, 23 nt, Human
ugggaguguugggaucucugcuc

SEQ ID NO: 393568 - RNA, 22 nt, Human
agaagccauaguaucucagggu

SEQ ID NO: 393569 - RNA, 22 nt, Human
cugcgcagggguggcgccagaa

SEQ ID NO: 393570 - RNA, 22 nt, Human
ucacaggaaccaucagagaaau

SEQ ID NO: 393571 - RNA, 22 nt, Human
ucugucugcgcuugcccuggug

SEQ ID NO: 393572 - RNA, 22 nt, Human
ugggcugcggauaggccucgga

SEQ ID NO: 393573 - RNA, 22 nt, Human
gugcaggggccuccccuugcug

SEQ ID NO: 393574 - RNA, 22 nt, Human
gccuuccugcagcucugagcgu

SEQ ID NO: 393575 - RNA, 22 nt, Human
acucagaaccauuuacucugag

SEQ ID NO: 393576 - RNA, 22 nt, Human
uauacuuuccugcaacuuugau

SEQ ID NO: 393577 - RNA, 22 nt, Human
ccaggagaugauguuggggauu

SEQ ID NO: 393578 - RNA, 21 nt, Human
agagaagaggacuuucucaca

SEQ ID NO: 393579 - RNA, 22 nt, Human
cucuuaaugaccuuaauucaag

SEQ ID NO: 393580 - RNA, 22 nt, Human
auggggagagaagggcugagcu

SEQ ID NO: 393581 - RNA, 22 nt, Human
aaauuuucagagcacuagagaa

SEQ ID NO: 393582 - RNA, 22 nt, Human
gugauuuagauguugaaaguga

SEQ ID NO: 393583 - RNA, 22 nt, Human
caccagggacaaugcuaggggu

SEQ ID NO: 393584 - RNA, 22 nt, Human
acaaaguuugugguauuccaag

SEQ ID NO: 393585 - RNA, 22 nt, Human
cugagaggugacagcgugcugg

SEQ ID NO: 393586 - RNA, 22 nt, Human
aaguaaaagcuuuaccaugcgc

SEQ ID NO: 393587 - RNA, 22 nt, Human
aaaguccuagcgauccacagaa

SEQ ID NO: 393588 - RNA, 18 nt, Human
cagggcuguggggucacu

SEQ ID NO: 393589 - RNA, 22 nt, Human
ugucuguacaaauuuucugugu

SEQ ID NO: 393590 - RNA, 22 nt, Human
ucauuuguucaucugcucuucu

SEQ ID NO: 393591 - RNA, 20 nt, Human
ggggcccaagcccucuugcc

SEQ ID NO: 393592 - RNA, 22 nt, Human
ugcacuccaggcugggugacag

SEQ ID NO: 393593 - RNA, 22 nt, Human
uccaggaggcucugguugacgu

SEQ ID NO: 393594 - RNA, 22 nt, Human
agggucagguuaagggagucau

SEQ ID NO: 393595 - RNA, 22 nt, Human
aacaaauguguggcaguguggg

SEQ ID NO: 393596 - RNA, 21 nt, Human
uggcucugcucagagcagucc

SEQ ID NO: 393597 - RNA, 22 nt, Human
aagcagaggguauggccagguu

SEQ ID NO: 393598 - RNA, 22 nt, Human
gcaacuuucaagcaccaugggg

SEQ ID NO: 393599 - RNA, 22 nt, Human
aggccagaaaugucagggagug

SEQ ID NO: 393600 - RNA, 22 nt, Human
acugcaggagacacagcugcug

SEQ ID NO: 393601 - RNA, 22 nt, Human
aaacaucauaggcaugcaugau

SEQ ID NO: 393602 - RNA, 18 nt, Human
aggggcagcuugugugga

SEQ ID NO: 393603 - RNA, 22 nt, Human
ucccaggaaaacacucgaggac

SEQ ID NO: 393604 - RNA, 22 nt, Human
ucucccaggcuggagugcagug

SEQ ID NO: 393605 - RNA, 22 nt, Human
auuuugaugcuaucuaaugaau

SEQ ID NO: 393606 - RNA, 22 nt, Human
ucugucacaauuugcuuacucu

SEQ ID NO: 393607 - RNA, 22 nt, Human
guccucaguaagagggccucug

SEQ ID NO: 393608 - RNA, 22 nt, Human
auaugugugccauuucagcagu

SEQ ID NO: 393609 - RNA, 22 nt, Human
augacaaaagaagacaugaggu

SEQ ID NO: 393610 - RNA, 22 nt, Human
auggaaagugcauggaagucau

SEQ ID NO: 393611 - RNA, 22 nt, Human
auauacaggugguauguguaaa

SEQ ID NO: 393612 - RNA, 22 nt, Human
ugaggcuguucuaccagggcca

SEQ ID NO: 393613 - RNA, 22 nt, Human
cuugggagacacaagaagacau

SEQ ID NO: 393614 - RNA, 22 nt, Human
aggucacccguuugacuaucca

SEQ ID NO: 393615 - RNA, 22 nt, Human
gagcugucuggggacucugggu

SEQ ID NO: 393616 - RNA, 22 nt, Human
uucauuuguugacagagacaug

SEQ ID NO: 393617 - RNA, 22 nt, Human
gaauuucaaaagccagaacggg

SEQ ID NO: 393618 - RNA, 22 nt, Human
ucuucucucauguaggagggaa

SEQ ID NO: 393619 - RNA, 22 nt, Human
ccaauacacuuuauagaagaaa

SEQ ID NO: 393620 - RNA, 22 nt, Human
ugucaacacaccuaucucaauu

SEQ ID NO: 393621 - RNA, 22 nt, Human
ucuaugaaaagucuauucauuc

SEQ ID NO: 393622 - RNA, 22 nt, Human
gccugccuuugugaggaagcgg

SEQ ID NO: 393623 - RNA, 22 nt, Human
cuggagggugagccucaucucu

SEQ ID NO: 393624 - RNA, 22 nt, Human
cagcaggguuaagugacucacc

SEQ ID NO: 393625 - RNA, 22 nt, Human
ucucugguuauuaacuaacucc

SEQ ID NO: 393626 - RNA, 22 nt, Human
uccaggaggcaccuuuggacca

SEQ ID NO: 393627 - RNA, 22 nt, Human
uagcugccuuugggcuccugcu

SEQ ID NO: 393628 - RNA, 22 nt, Human
cauugcacaucugagaagagau

SEQ ID NO: 393629 - RNA, 22 nt, Human
gaugauggacaaagcauuggug

SEQ ID NO: 393630 - RNA, 22 nt, Human
gagcugccaguguaugaauucu

SEQ ID NO: 393631 - RNA, 22 nt, Human
cacagaagaaucaugcuguguu

SEQ ID NO: 393632 - RNA, 22 nt, Human
ucccugggccacagcugugagc

SEQ ID NO: 393633 - RNA, 22 nt, Human
cucuggagggaggcugagcugg

SEQ ID NO: 393634 - RNA, 22 nt, Human
agucucugccagcuuguccucu

SEQ ID NO: 393635 - RNA, 21 nt, Human
gcagccagccgagaccaugcc

SEQ ID NO: 393636 - RNA, 22 nt, Human
auuaauuuuaccuuuguaaaca

SEQ ID NO: 393637 - RNA, 22 nt, Human
aaucuggcauuugagaguagga

SEQ ID NO: 393638 - RNA, 22 nt, Human
ggcauguuucaucacaucaaga

SEQ ID NO: 393639 - RNA, 22 nt, Human
gugcucuggcuggucucccggu

SEQ ID NO: 393640 - RNA, 22 nt, Human
agugcacagcgugauguauugg

SEQ ID NO: 393641 - RNA, 20 nt, Human
uccucagaagacauuugggg

SEQ ID NO: 393642 - RNA, 22 nt, Human
gcagcuggacccacacggcuua

SEQ ID NO: 393643 - RNA, 22 nt, Human
caguagacacauuaauauggaa

SEQ ID NO: 393644 - RNA, 22 nt, Human
uucacaaagcuggagcauuucc

SEQ ID NO: 393645 - RNA, 22 nt, Human
gggcuuggcacaugggcucagc

SEQ ID NO: 393646 - RNA, 22 nt, Human
agaaaaggcuugaagagguuuu

SEQ ID NO: 393647 - RNA, 22 nt, Human
ggagcuguucaggacugcuuca

SEQ ID NO: 393648 - RNA, 22 nt, Human
gccucugcggagcuguacauca

SEQ ID NO: 393649 - RNA, 22 nt, Human
caaauaucuuuggcaaagagaa

SEQ ID NO: 393650 - RNA, 22 nt, Human
ccagcuuuggaguguuguugcu

SEQ ID NO: 393651 - RNA, 22 nt, Human
ccugagagcagcuuccugcuua

SEQ ID NO: 393652 - RNA, 22 nt, Human
uggcucaggugugagcugaaga

SEQ ID NO: 393653 - RNA, 22 nt, Human
cacuguaucuuuuccaaagucu

SEQ ID NO: 393654 - RNA, 22 nt, Human
ucagaggaauuugcuuuucaug

SEQ ID NO: 393655 - RNA, 19 nt, Human
gccagcagaaugaugaggc

SEQ ID NO: 393656 - RNA, 22 nt, Human
guaaaguucuauuugaauuuag

SEQ ID NO: 393657 - RNA, 22 nt, Human
ucccaggccauaaaacucagag

SEQ ID NO: 393658 - RNA, 18 nt, Human
ugggcugccuggccucug

SEQ ID NO: 393659 - RNA, 19 nt, Human
cagugcccgacgcaggucu

SEQ ID NO: 393660 - RNA, 23 nt, Human
agugagcagcuguagggcaagga

SEQ ID NO: 393661 - RNA, 23 nt, Human
uuaaaggcagauguugaguauua

SEQ ID NO: 393662 - RNA, 22 nt, Human
ugggccuguugggguugaguua

SEQ ID NO: 393663 - RNA, 22 nt, Human
uugaaaguagcagcugcauaug

SEQ ID NO: 393664 - RNA, 23 nt, Human
aguucacugagguugaccacugg

SEQ ID NO: 393665 - RNA, 20 nt, Human
ucauuguguugccaauuccc

SEQ ID NO: 393666 - RNA, 22 nt, Human
uggcucaggguccccaaauggu

SEQ ID NO: 393667 - RNA, 22 nt, Human
auuucauagauuguaaaucccu

SEQ ID NO: 393668 - RNA, 22 nt, Human
aaucacaauuacuuuugcacca

SEQ ID NO: 393669 - RNA, 22 nt, Human
gugcugaguagaaugaaugccu

SEQ ID NO: 393670 - RNA, 21 nt, Human
gauaaaaugggccuugguccu

SEQ ID NO: 393671 - RNA, 22 nt, Human
cuccaugaauuugagcuuugug

SEQ ID NO: 393672 - RNA, 19 nt, Human
gaaagucauagagcuuguc

SEQ ID NO: 393673 - RNA, 22 nt, Human
uugcauuucccauugaguaaug

SEQ ID NO: 393674 - RNA, 22 nt, Human
cuccagugcgcaggacagcccc

SEQ ID NO: 393675 - RNA, 19 nt, Human
uguggccaugguucagcug

SEQ ID NO: 393676 - RNA, 22 nt, Human
augauugcagcccuacagcugu

SEQ ID NO: 393677 - RNA, 22 nt, Human
agcaggugaauuccuggaugug

SEQ ID NO: 393678 - RNA, 22 nt, Human
uuugguccugagcaaaacuaug

SEQ ID NO: 393679 - RNA, 18 nt, Human
uaggagagaauuuauuua

SEQ ID NO: 393680 - RNA, 22 nt, Human
ggcugucugugguggagcguug

SEQ ID NO: 393681 - RNA, 22 nt, Human
accaucagucacauguagagaa

SEQ ID NO: 393682 - RNA, 22 nt, Human
ucaguuuugauuccugguucuc

SEQ ID NO: 393683 - RNA, 22 nt, Human
gucagcaggguccccuugagug

SEQ ID NO: 393684 - RNA, 22 nt, Human
uccagugguaguaaagaggucu

SEQ ID NO: 393685 - RNA, 22 nt, Human
ccucuuugugccugcaggcugc

SEQ ID NO: 393686 - RNA, 23 nt, Human
agacccagagacuggcucugcuc

SEQ ID NO: 393687 - RNA, 19 nt, Human
uggcucugucgaaggcaca

SEQ ID NO: 393688 - RNA, 22 nt, Human
gaggcagcuggguccggucggg

SEQ ID NO: 393689 - RNA, 22 nt, Human
gggcagguguugucaaucuaau

SEQ ID NO: 393690 - RNA, 20 nt, Human
ggaagccagcauccuugagg

SEQ ID NO: 393691 - RNA, 22 nt, Human
cuugccuguggcuaguuggcuc

SEQ ID NO: 393692 - RNA, 22 nt, Human
cuggccugggagcugcuagcgu

SEQ ID NO: 393693 - RNA, 22 nt, Human
cauguacaguuuuucuguccug

SEQ ID NO: 393694 - RNA, 22 nt, Human
auguacaaaaugccacugaauu

SEQ ID NO: 393695 - RNA, 22 nt, Human
cugggcacuugcucacagcucu

SEQ ID NO: 393696 - RNA, 22 nt, Human
uauuuaguuaucuuucauaaaa

SEQ ID NO: 393697 - RNA, 22 nt, Human
ucuuugaaagcuguucuagagu

SEQ ID NO: 393698 - RNA, 19 nt, Human
auaaggcaauuggauuugg

SEQ ID NO: 393699 - RNA, 20 nt, Human
cuguaucagguuacaaagua

SEQ ID NO: 393700 - RNA, 22 nt, Human
uggcaggaaaguaacagagcac

SEQ ID NO: 393701 - RNA, 22 nt, Human
ccagccagcugcccuuggggcc

SEQ ID NO: 393702 - RNA, 22 nt, Human
ucagaggaccuuacugagaacc

SEQ ID NO: 393703 - RNA, 22 nt, Human
caaguccucgcuucuagcugug

SEQ ID NO: 393704 - RNA, 22 nt, Human
cagggaggcugucuuaugccug

SEQ ID NO: 393705 - RNA, 22 nt, Human
cuguccccgcgaguccagagcu

SEQ ID NO: 393706 - RNA, 22 nt, Human
ugaggcucuccaagcagaugag

SEQ ID NO: 393707 - RNA, 22 nt, Human
acagaaauuagcagugaguuua

SEQ ID NO: 393708 - RNA, 22 nt, Human
guucagcccacagagggggccg

SEQ ID NO: 393709 - RNA, 22 nt, Human
uuaacagacauauauauuugua

SEQ ID NO: 393710 - RNA, 22 nt, Human
uggucaguugcaucagagaagu

SEQ ID NO: 393711 - RNA, 22 nt, Human
agaguguuucagucuuccuaga

SEQ ID NO: 393712 - RNA, 22 nt, Human
guauuaggagguggagccuuug

SEQ ID NO: 393713 - RNA, 19 nt, Human
gagguggguccccgcagcc

SEQ ID NO: 393714 - RNA, 22 nt, Human
uggccugauuuugcuaagagaa

SEQ ID NO: 393715 - RNA, 21 nt, Human
caaucaguuggcauuugagca

SEQ ID NO: 393716 - RNA, 22 nt, Human
ccaaggagcugcaggcacuugu

SEQ ID NO: 393717 - RNA, 22 nt, Human
cagaaagcuuaggcaaguugga

SEQ ID NO: 393718 - RNA, 22 nt, Human
cuggcagcucugagucccuucu

SEQ ID NO: 393719 - RNA, 22 nt, Human
ggcagcaguaggagcuaaucuu

SEQ ID NO: 393720 - RNA, 22 nt, Human
ccagcaggaaagugacguuuga

SEQ ID NO: 393721 - RNA, 19 nt, Human
augcuuuauguuauuucuu

SEQ ID NO: 393722 - RNA, 22 nt, Human
aaggcacuacgcugcuggggcg

SEQ ID NO: 393723 - RNA, 22 nt, Human
agcaauauaaauguuggguaga

SEQ ID NO: 393724 - RNA, 22 nt, Human
caggcagcaucagucugcugua

SEQ ID NO: 393725 - RNA, 22 nt, Human
uacauuuauaaggcuucucugu

SEQ ID NO: 393726 - RNA, 22 nt, Human
gggcacugugcuaggugcugag

SEQ ID NO: 393727 - RNA, 22 nt, Human
agggaugguggagguugcaagu

SEQ ID NO: 393728 - RNA, 22 nt, Human
aagacagugaucucugagagau

SEQ ID NO: 393729 - RNA, 22 nt, Human
aaaauccuuagccgagugaggu

SEQ ID NO: 393730 - RNA, 22 nt, Human
uuugcauuguaauauuuaguuc

SEQ ID NO: 393731 - RNA, 22 nt, Human
gugucacaugguuuacugcagc

SEQ ID NO: 393732 - RNA, 22 nt, Human
cagggcuccccagagagccucu

SEQ ID NO: 393733 - RNA, 22 nt, Human
ugaaaugacaaagguuuuucuu

SEQ ID NO: 393734 - RNA, 22 nt, Human
aaugagacacgugaagcagaug

SEQ ID NO: 393735 - RNA, 22 nt, Human
agcugcucuuugaaggacacuu

SEQ ID NO: 393736 - RNA, 22 nt, Human
agccaggcgggucuuugcuccu

SEQ ID NO: 393737 - RNA, 22 nt, Human
caauuuuuaaacuaugaaguug

SEQ ID NO: 393738 - RNA, 22 nt, Human
ccucagggaaugggaggcuggg

SEQ ID NO: 393739 - RNA, 22 nt, Human
aaucagaaagaucuugaugaga

SEQ ID NO: 393740 - RNA, 22 nt, Human
caguuuuuagauuaguuggugg

SEQ ID NO: 393741 - RNA, 20 nt, Human
cagccuccacucacucagcu

SEQ ID NO: 393742 - RNA, 21 nt, Human
ucaaagcacauauuugcacau

SEQ ID NO: 393743 - RNA, 22 nt, Human
gagggcugauaacaggaauaca

SEQ ID NO: 393744 - RNA, 22 nt, Human
uauacagucuuuugcuauauuc

SEQ ID NO: 393745 - RNA, 22 nt, Human
gggaaggacauucugggcucag

SEQ ID NO: 393746 - RNA, 21 nt, Human
uuuagggaccaggucauaggc

SEQ ID NO: 393747 - RNA, 22 nt, Human
aggcagauauuggggugaugug

SEQ ID NO: 393748 - RNA, 22 nt, Human
aaaaauguuaucuacuguccga

SEQ ID NO: 393749 - RNA, 22 nt, Human
aaugguuuucuagaacaugaaa

SEQ ID NO: 393750 - RNA, 22 nt, Human
gcagagccaugggagguuuuug

SEQ ID NO: 393751 - RNA, 22 nt, Human
aguggcagagguugacugcagu

SEQ ID NO: 393752 - RNA, 20 nt, Human
guggccuguccuguuguggg

SEQ ID NO: 393753 - RNA, 20 nt, Human
augauuuugcacuaacuuca

SEQ ID NO: 393754 - RNA, 22 nt, Human
gugcagugaaaaaagaaugucc

SEQ ID NO: 393755 - RNA, 22 nt, Human
uacagaagcugagacacugaga

SEQ ID NO: 393756 - RNA, 22 nt, Human
agguggagaagagaugggcagu

SEQ ID NO: 393757 - RNA, 22 nt, Human
caggugccucaggaugagacaa

SEQ ID NO: 393758 - RNA, 22 nt, Human
ggaagccaggccaaugagaaca

SEQ ID NO: 393759 - RNA, 22 nt, Human
cucuggaaaaccacuagcagga

SEQ ID NO: 393760 - RNA, 17 nt, Human
gccuggcccagccuggc

SEQ ID NO: 393761 - RNA, 22 nt, Human
cauucauuuaugaaauaucuau

SEQ ID NO: 393762 - RNA, 22 nt, Human
ucaggcugcagcugucagcagc

SEQ ID NO: 393763 - RNA, 22 nt, Human
ugggccugggagggcagacgcu

SEQ ID NO: 393764 - RNA, 22 nt, Human
ugugccagaaaauaugcugagg

SEQ ID NO: 393765 - RNA, 20 nt, Human
gcaaauggaucccacaagcc

SEQ ID NO: 393766 - RNA, 23 nt, Human
uuuuaauuuggacauaagaagau

SEQ ID NO: 393767 - RNA, 22 nt, Human
aaugucugcucuacucaggagg

SEQ ID NO: 393768 - RNA, 22 nt, Human
ggugugccuggggcuuagcugc

SEQ ID NO: 393769 - RNA, 22 nt, Human
cuggccuggcaggggaccucua

SEQ ID NO: 393770 - RNA, 22 nt, Human
gcaggccugacuguagggggca

SEQ ID NO: 393771 - RNA, 22 nt, Human
uuaauucuaguuuaacacuuag

SEQ ID NO: 393772 - RNA, 22 nt, Human
caggugggagcgaggagcuacu

SEQ ID NO: 393773 - RNA, 22 nt, Human
acuguucacccagcacuagcag

SEQ ID NO: 393774 - RNA, 22 nt, Human
uguaaucauuacaguacaugga

SEQ ID NO: 393775 - RNA, 22 nt, Human
cuggcaggcagacuucugcaag

SEQ ID NO: 393776 - RNA, 19 nt, Human
uggccagguacugucugcu

SEQ ID NO: 393777 - RNA, 22 nt, Human
uuauuccaguaaucucuguaau

SEQ ID NO: 393778 - RNA, 22 nt, Human
ggccaggcuggucucagacuuc

SEQ ID NO: 393779 - RNA, 22 nt, Human
aaguccuuaggaagcagucguu

SEQ ID NO: 393780 - RNA, 20 nt, Human
cccucugcuacacugggagc

SEQ ID NO: 393781 - RNA, 22 nt, Human
cagcaggcucugaguggcugcc

SEQ ID NO: 393782 - RNA, 22 nt, Human
gggugggguucaggaaucuuca

SEQ ID NO: 393783 - RNA, 22 nt, Human
uucacagaugccugaugugugg

SEQ ID NO: 393784 - RNA, 22 nt, Human
gcugccagucuaaugggaaaca

SEQ ID NO: 393785 - RNA, 22 nt, Human
acauacuaugaauacauguguc

SEQ ID NO: 393786 - RNA, 22 nt, Human
gaguaagagcuggcuuuggugu

SEQ ID NO: 393787 - RNA, 22 nt, Human
ugaacauauucaccucuaaaua

SEQ ID NO: 393788 - RNA, 21 nt, Human
agcagcugcaguuucuaucug

SEQ ID NO: 393789 - RNA, 23 nt, Human
accaggaguugucucaggaaaca

SEQ ID NO: 393790 - RNA, 22 nt, Human
ccagagggccuuuggaguuauc

SEQ ID NO: 393791 - RNA, 22 nt, Human
cuuucaaugugccugccuuggg

SEQ ID NO: 393792 - RNA, 21 nt, Human
aauaaaacaguuggugucaau

SEQ ID NO: 393793 - RNA, 22 nt, Human
gcucagaggagcaucauaagga

SEQ ID NO: 393794 - RNA, 22 nt, Human
cuuaacauccugcauuuuucuu

SEQ ID NO: 393795 - RNA, 22 nt, Human
ucaguggaguauggaugaaguc

SEQ ID NO: 393796 - RNA, 22 nt, Human
uucaagauggcaccagugagug

SEQ ID NO: 393797 - RNA, 22 nt, Human
ccucuucuagguuucagccugc

SEQ ID NO: 393798 - RNA, 22 nt, Human
uucaugugauaaaugugugacu

SEQ ID NO: 393799 - RNA, 20 nt, Human
uuccuuaggcauuggaagaa

SEQ ID NO: 393800 - RNA, 22 nt, Human
cuaauuauguuguuauaaucaa

SEQ ID NO: 393801 - RNA, 22 nt, Human
aggcagcaauugaaaucauugu

SEQ ID NO: 393802 - RNA, 22 nt, Human
uuaaugcuugucuagaucuucu

SEQ ID NO: 393803 - RNA, 17 nt, Human
acacagccagguucucc

SEQ ID NO: 393804 - RNA, 22 nt, Human
cagcagcccacgcgugcugucc

SEQ ID NO: 393805 - RNA, 22 nt, Human
ccugggcaggaugggcccggug

SEQ ID NO: 393806 - RNA, 17 nt, Human
uuaaaggaugcucucuc

SEQ ID NO: 393807 - RNA, 22 nt, Human
aaguccuucccaagcauguacc

SEQ ID NO: 393808 - RNA, 22 nt, Human
cugagccagagggagucggguc

SEQ ID NO: 393809 - RNA, 22 nt, Human
ccagagaggccaaggucguggu

SEQ ID NO: 393810 - RNA, 22 nt, Human
gcacugcaucuacuggcaagua

SEQ ID NO: 393811 - RNA, 22 nt, Human
ggagacagugguagggccuaag

SEQ ID NO: 393812 - RNA, 22 nt, Human
uggcccugacacgugguacugg

SEQ ID NO: 393813 - RNA, 19 nt, Human
aggcagaggcuuggcuagc

SEQ ID NO: 393814 - RNA, 20 nt, Human
uggcuccugcgguggaacca

SEQ ID NO: 393815 - RNA, 21 nt, Human
uuucuucacuuugccccaugu

SEQ ID NO: 393816 - RNA, 22 nt, Human
ggauccuucuuugaccucacag

SEQ ID NO: 393817 - RNA, 22 nt, Human
ucacuggggccuuuggucagga

SEQ ID NO: 393818 - RNA, 22 nt, Human
ggagggagcauccccuugcuga

SEQ ID NO: 393819 - RNA, 22 nt, Human
guccucuggaagaugaguucuu

SEQ ID NO: 393820 - RNA, 22 nt, Human
aggacccugaggucuccuguga

SEQ ID NO: 393821 - RNA, 22 nt, Human
agggcccuagggaaugagacau

SEQ ID NO: 393822 - RNA, 18 nt, Human
cccagcuccacuucccuc

SEQ ID NO: 393823 - RNA, 22 nt, Human
ccaggaagcugucugauaugaa

SEQ ID NO: 393824 - RNA, 22 nt, Human
aguucuuuugugaacauaugcu

SEQ ID NO: 393825 - RNA, 22 nt, Human
uacaaaugaaccaacuuugaug

SEQ ID NO: 393826 - RNA, 22 nt, Human
cugcugugacagcugccguguu

SEQ ID NO: 393827 - RNA, 22 nt, Human
aaggcagcaggauuuggugacu

SEQ ID NO: 393828 - RNA, 22 nt, Human
caaaggcuuugcuaugaugcau

SEQ ID NO: 393829 - RNA, 22 nt, Human
ccuggcugcauuuugcuggaug

SEQ ID NO: 393830 - RNA, 22 nt, Human
augggaggguggaaaggcucug

SEQ ID NO: 393831 - RNA, 22 nt, Human
aaaaguuaccucuguaauauaa

SEQ ID NO: 393832 - RNA, 21 nt, Human
agcugcuuucagcuccuagag

SEQ ID NO: 393833 - RNA, 22 nt, Human
uacuaaacaucuggcauuaaau

SEQ ID NO: 393834 - RNA, 22 nt, Human
agugacucacuagcucucagug

SEQ ID NO: 393835 - RNA, 22 nt, Human
ugcccauguuucucuguauccc

SEQ ID NO: 393836 - RNA, 22 nt, Human
ugucacagggauaccauggggc

SEQ ID NO: 393837 - RNA, 22 nt, Human
guggcuucuggcugggccucag

SEQ ID NO: 393838 - RNA, 22 nt, Human
agacacaggauucugcauuucu

SEQ ID NO: 393839 - RNA, 22 nt, Human
aucuggcuauugacauguuaua

SEQ ID NO: 393840 - RNA, 22 nt, Human
gauuuucugagccuucaaauuu

SEQ ID NO: 393841 - RNA, 22 nt, Human
gccaggcagacaggucaucagg

SEQ ID NO: 393842 - RNA, 22 nt, Human
uccugccugagcguggaggagg

SEQ ID NO: 393843 - RNA, 22 nt, Human
gccagagcacaggcugguagua

SEQ ID NO: 393844 - RNA, 22 nt, Human
uauggaaacuaauucauuuuuc

SEQ ID NO: 393845 - RNA, 22 nt, Human
cugcccuguggcucugagucau

SEQ ID NO: 393846 - RNA, 22 nt, Human
ucugccagaaguucugagagua

SEQ ID NO: 393847 - RNA, 22 nt, Human
uguauacaggauuacucauagc

SEQ ID NO: 393848 - RNA, 22 nt, Human
auguucuuccaaaucuguaaca

SEQ ID NO: 393849 - RNA, 22 nt, Human
ggagaggaaaugccagcacuuc

SEQ ID NO: 393850 - RNA, 21 nt, Human
gugcuuuuccuuaauguucuu

SEQ ID NO: 393851 - RNA, 22 nt, Human
uuccaaagucauguugcugaua

SEQ ID NO: 393852 - RNA, 22 nt, Human
cugccugugcaugcagucagaa

SEQ ID NO: 393853 - RNA, 22 nt, Human
gaaugaaaaccuuggcucaaau

SEQ ID NO: 393854 - RNA, 19 nt, Human
ucucccagcugagaagggc

SEQ ID NO: 393855 - RNA, 22 nt, Human
uuuacagauguggaaagugagc

SEQ ID NO: 393856 - RNA, 22 nt, Human
uggguagagcaggcuggggcuu

SEQ ID NO: 393857 - RNA, 22 nt, Human
caguguuuguauagaauaugca

SEQ ID NO: 393858 - RNA, 22 nt, Human
auaaggcagaaauagggaaagu

SEQ ID NO: 393859 - RNA, 22 nt, Human
gcagcugccccgacugugaguc

SEQ ID NO: 393860 - RNA, 22 nt, Human
gcucccagcauugcuucccagg

SEQ ID NO: 393861 - RNA, 22 nt, Human
caacugugaauuuuaugauacc

SEQ ID NO: 393862 - RNA, 18 nt, Human
cugcccagagcauuucau

SEQ ID NO: 393863 - RNA, 20 nt, Human
cccuggccuguuucaugccc

SEQ ID NO: 393864 - RNA, 22 nt, Human
aagggcaggcagagaucauaua

SEQ ID NO: 393865 - RNA, 22 nt, Human
ugcauaguucuccuuccuccuc

SEQ ID NO: 393866 - RNA, 22 nt, Human
uaucuguuaugggcugaauugc

SEQ ID NO: 393867 - RNA, 22 nt, Human
ucuggccuauuucugucagauc

SEQ ID NO: 393868 - RNA, 22 nt, Human
gccaccagguuagauccagccu

SEQ ID NO: 393869 - RNA, 22 nt, Human
ggcugagcacuuuaggcaggag

SEQ ID NO: 393870 - RNA, 22 nt, Human
gaaaggucuuccggucuuccag

SEQ ID NO: 393871 - RNA, 22 nt, Human
ugugaacuggcagguggacggg

SEQ ID NO: 393872 - RNA, 22 nt, Human
agaagccaacagggcaggagag

SEQ ID NO: 393873 - RNA, 22 nt, Human
caggggccaggcugucugcugu

SEQ ID NO: 393874 - RNA, 22 nt, Human
aggauuuaccuccagcuaggcu

SEQ ID NO: 393875 - RNA, 19 nt, Human
auucauuuuugccuucuaa

SEQ ID NO: 393876 - RNA, 22 nt, Human
gccuggagccucagcaaggagg

SEQ ID NO: 393877 - RNA, 21 nt, Human
gcuauacagaauggccagagg

SEQ ID NO: 393878 - RNA, 22 nt, Human
cuggcugcgucugcucugacag

SEQ ID NO: 393879 - RNA, 23 nt, Human
gggagccaggaccucgcgcccca

SEQ ID NO: 393880 - RNA, 22 nt, Human
aggccucacucucagagcuucu

SEQ ID NO: 393881 - RNA, 22 nt, Human
cauuguauugaggauacuuaag

SEQ ID NO: 393882 - RNA, 22 nt, Human
agguccagcuguugcagccucc

SEQ ID NO: 393883 - RNA, 19 nt, Human
agcauccagucaugggauc

SEQ ID NO: 393884 - RNA, 22 nt, Human
ucucagagcuucaguuauuuuc

SEQ ID NO: 393885 - RNA, 22 nt, Human
aagggcuccacuugaaucacac

SEQ ID NO: 393886 - RNA, 18 nt, Human
gagagggaucccucagga

SEQ ID NO: 393887 - RNA, 22 nt, Human
acugagcugcuugaagugaacu

SEQ ID NO: 393888 - RNA, 22 nt, Human
gucagcacuuuuccgaggcaga

SEQ ID NO: 393889 - RNA, 22 nt, Human
agggcugaccuaagcuccacuu

SEQ ID NO: 393890 - RNA, 22 nt, Human
uaauuucuggagggagaaagag

SEQ ID NO: 393891 - RNA, 22 nt, Human
ccagcuuuuagugggcuuauua

SEQ ID NO: 393892 - RNA, 22 nt, Human
augcacaagcaagagauaaugg

SEQ ID NO: 393893 - RNA, 22 nt, Human
uuccaagaguaaauucaaauug

SEQ ID NO: 393894 - RNA, 22 nt, Human
accccagcccugcuucugggag

SEQ ID NO: 393895 - RNA, 23 nt, Human
agcuuugugaaagcagacauggg

SEQ ID NO: 393896 - RNA, 16 nt, Human
agaggccuugaggaag

SEQ ID NO: 393897 - RNA, 20 nt, Human
ggcagggcaucaacagcucu

SEQ ID NO: 393898 - RNA, 22 nt, Human
gggcugagcuguucugaguuua

SEQ ID NO: 393899 - RNA, 22 nt, Human
ugccagagaagacccagucacu

SEQ ID NO: 393900 - RNA, 22 nt, Human
acaguggaaagaaacgaauuag

SEQ ID NO: 393901 - RNA, 22 nt, Human
cccuggagcuagucugagcaga

SEQ ID NO: 393902 - RNA, 22 nt, Human
gcccaggaucugcucagaucau

SEQ ID NO: 393903 - RNA, 22 nt, Human
uguggccuccuguuccugggua

SEQ ID NO: 393904 - RNA, 22 nt, Human
gagcuggcuaauacugacuuau

SEQ ID NO: 393905 - RNA, 22 nt, Human
gcugcccauuccacuggauggu

SEQ ID NO: 393906 - RNA, 22 nt, Human
gcucccagucugauggaggaga

SEQ ID NO: 393907 - RNA, 22 nt, Human
agcagggcuggauuuggcaaga

SEQ ID NO: 393908 - RNA, 18 nt, Human
gcacuucacccagcuagu

SEQ ID NO: 393909 - RNA, 22 nt, Human
ccucccucuguuagagcugucu

SEQ ID NO: 393910 - RNA, 22 nt, Human
ugcagggcuacaggacuacaac

SEQ ID NO: 393911 - RNA, 19 nt, Human
agcaaauacaucaaaauug

SEQ ID NO: 393912 - RNA, 22 nt, Human
ggagauggaauagauucugacu

SEQ ID NO: 393913 - RNA, 22 nt, Human
aucaggaucagggcuagcagag

SEQ ID NO: 393914 - RNA, 22 nt, Human
gugccugguuuggggaauguuc

SEQ ID NO: 393915 - RNA, 22 nt, Human
uugugaguagugccgcaauaaa

SEQ ID NO: 393916 - RNA, 22 nt, Human
ccaguggaguuuuuauacccag

SEQ ID NO: 393917 - RNA, 22 nt, Human
uaaaguuuggcagacaauaaca

SEQ ID NO: 393918 - RNA, 22 nt, Human
cugcucugugguccaugagaca

SEQ ID NO: 393919 - RNA, 22 nt, Human
aggauccuguauggagaagcug

SEQ ID NO: 393920 - RNA, 22 nt, Human
uuggaucauggaaugucugcuu

SEQ ID NO: 393921 - RNA, 20 nt, Human
gcuuuuucuaauagcagucc

SEQ ID NO: 393922 - RNA, 22 nt, Human
gguggccugcccugaucccugg

SEQ ID NO: 393923 - RNA, 22 nt, Human
gagccuggauugaagugggugg

SEQ ID NO: 393924 - RNA, 18 nt, Human
cucaccauucugcccaau

SEQ ID NO: 393925 - RNA, 22 nt, Human
gaaucucaguggaagcaggaag

SEQ ID NO: 393926 - RNA, 22 nt, Human
cacaaaugguuguagacauuaa

SEQ ID NO: 393927 - RNA, 22 nt, Human
ucagcagcagcucagcauguuu

SEQ ID NO: 393928 - RNA, 22 nt, Human
auaaagcaagcauaccauuaag

SEQ ID NO: 393929 - RNA, 22 nt, Human
aaggagaaaugguagaugugca

SEQ ID NO: 393930 - RNA, 22 nt, Human
gugcauguuaaugguguacaaa

SEQ ID NO: 393931 - RNA, 22 nt, Human
ccucuuccacugggccccaucc

SEQ ID NO: 393932 - RNA, 22 nt, Human
auguaguguagagauuagucuc

SEQ ID NO: 393933 - RNA, 22 nt, Human
uaguaucuauuaguaacaagag

SEQ ID NO: 393934 - RNA, 22 nt, Human
cuggagccggcgagccccagcc

SEQ ID NO: 393935 - RNA, 22 nt, Human
agaguguuauuugcucuguauu

SEQ ID NO: 393936 - RNA, 22 nt, Human
gcagcugcuguggcaucaagcu

SEQ ID NO: 393937 - RNA, 22 nt, Human
uuagaaauauggugcugccgcc

SEQ ID NO: 393938 - RNA, 22 nt, Human
gggcacuguggggcccaugcug

SEQ ID NO: 393939 - RNA, 20 nt, Human
gcucccagccugcagucccc

SEQ ID NO: 393940 - RNA, 22 nt, Human
gcaggaagccuuaccaagccca

SEQ ID NO: 393941 - RNA, 22 nt, Human
gaggcagccagagguucucauu

SEQ ID NO: 393942 - RNA, 22 nt, Human
gauacaaauucaugucugaauu

SEQ ID NO: 393943 - RNA, 22 nt, Human
auggcuuaugguaaauauuucu

SEQ ID NO: 393944 - RNA, 22 nt, Human
gggguugguuuaaaugcuugag

SEQ ID NO: 393945 - RNA, 22 nt, Human
gcucagggaacuuuuugcaggc

SEQ ID NO: 393946 - RNA, 22 nt, Human
uuauuuaggagaaggaacccug

SEQ ID NO: 393947 - RNA, 22 nt, Human
ugugauauuugaguauugucaa

SEQ ID NO: 393948 - RNA, 22 nt, Human
cugagccaguagucagggacaa

SEQ ID NO: 393949 - RNA, 23 nt, Human
cacacccaucacuaagagcuccu

SEQ ID NO: 393950 - RNA, 20 nt, Human
ucaaaggcaaaggugggugu

SEQ ID NO: 393951 - RNA, 22 nt, Human
uuccaggaggcacugacagagg

SEQ ID NO: 393952 - RNA, 22 nt, Human
ccagucugaggccuggugaggg

SEQ ID NO: 393953 - RNA, 22 nt, Human
ggcucaggggccaggccugucc

SEQ ID NO: 393954 - RNA, 22 nt, Human
gaaagccagagagaaagggcuc

SEQ ID NO: 393955 - RNA, 22 nt, Human
ggcuagaauaauugacuucauu

SEQ ID NO: 393956 - RNA, 22 nt, Human
cugcccugaccugccucagagu

SEQ ID NO: 393957 - RNA, 22 nt, Human
ccauccugcauugcuauucaga

SEQ ID NO: 393958 - RNA, 22 nt, Human
cccucugaccuccugccacagu

SEQ ID NO: 393959 - RNA, 22 nt, Human
cucccaggggaacuaucaagua

SEQ ID NO: 393960 - RNA, 22 nt, Human
uuguacaaauaggaaccucuga

SEQ ID NO: 393961 - RNA, 22 nt, Human
caggggacaguaugguggauga

SEQ ID NO: 393962 - RNA, 22 nt, Human
gccuuaauuuuuuauaaucucu

SEQ ID NO: 393963 - RNA, 22 nt, Human
guccuuaguuacuuuucauguc

SEQ ID NO: 393964 - RNA, 22 nt, Human
cagugagggcauucagugcugg

SEQ ID NO: 393965 - RNA, 22 nt, Human
uagccucuggaauccuuucucu

SEQ ID NO: 393966 - RNA, 20 nt, Human
ugcagggcucugcuucucuc

SEQ ID NO: 393967 - RNA, 22 nt, Human
agagccacggcaggccuaggaa

SEQ ID NO: 393968 - RNA, 22 nt, Human
ccuguucaaugcccuggcuuca

SEQ ID NO: 393969 - RNA, 22 nt, Human
uggagagcgugcuuagcacucu

SEQ ID NO: 393970 - RNA, 22 nt, Human
aguccuucaagaaaucuggaaa

SEQ ID NO: 393971 - RNA, 22 nt, Human
acaacuuuaauggguuucagcu

SEQ ID NO: 393972 - RNA, 22 nt, Human
uaguacuuaucucugucauugu

SEQ ID NO: 393973 - RNA, 22 nt, Human
aaguucaaucagaugaaaaagc

SEQ ID NO: 393974 - RNA, 22 nt, Human
uccuuccucggggacccagauc

SEQ ID NO: 393975 - RNA, 20 nt, Human
cagagacccaggcuucagcu

SEQ ID NO: 393976 - RNA, 22 nt, Human
aggcagaucacuugaggccagg

SEQ ID NO: 393977 - RNA, 22 nt, Human
auacagaagaccccuccgucau

SEQ ID NO: 393978 - RNA, 22 nt, Human
cgccaggcuugguagcucaugc

SEQ ID NO: 393979 - RNA, 22 nt, Human
aggucacacuuggaucauagaa

SEQ ID NO: 393980 - RNA, 22 nt, Human
gguaugaauucacuacuuccaa

SEQ ID NO: 393981 - RNA, 22 nt, Human
gaggcagcuuggggcugugggu

SEQ ID NO: 393982 - RNA, 22 nt, Human
uuagaaaaaggcuguggucuua

SEQ ID NO: 393983 - RNA, 22 nt, Human
agucaccauuuucaccugccuc

SEQ ID NO: 393984 - RNA, 22 nt, Human
uuuggaauguaguuuaaucauc

SEQ ID NO: 393985 - RNA, 22 nt, Human
gaaggccacuuuguguugagaa

SEQ ID NO: 393986 - RNA, 22 nt, Human
aaaugucuguuagucauaucau

SEQ ID NO: 393987 - RNA, 22 nt, Human
agggagacacaugaggaaguca

SEQ ID NO: 393988 - RNA, 22 nt, Human
agagugaaggccagguuacagu

SEQ ID NO: 393989 - RNA, 19 nt, Human
ccuuugaaucaggacacuu

SEQ ID NO: 393990 - RNA, 22 nt, Human
ucaguggagagcuuccaggauu

SEQ ID NO: 393991 - RNA, 22 nt, Human
uuuguuuagaaagagauuggug

SEQ ID NO: 393992 - RNA, 22 nt, Human
ccugcugugaccggggagcagg

SEQ ID NO: 393993 - RNA, 22 nt, Human
gaggccacagcuaucagggaca

SEQ ID NO: 393994 - RNA, 22 nt, Human
ucauccaguuguggagagggaa

SEQ ID NO: 393995 - RNA, 22 nt, Human
ucuuuccuguaacugcuguuca

SEQ ID NO: 393996 - RNA, 22 nt, Human
gagggagugccagagggccagc

SEQ ID NO: 393997 - RNA, 22 nt, Human
cugcucugcaaggcacagugau

SEQ ID NO: 393998 - RNA, 22 nt, Human
aucuuguuaaaaugcagaaacu

SEQ ID NO: 393999 - RNA, 22 nt, Human
cagucccacaagaucuccacaa

SEQ ID NO: 394000 - RNA, 22 nt, Human
ucugccuuccccauaaucugau

SEQ ID NO: 394001 - RNA, 22 nt, Human
ggcccaaggcccaggucgagcu

SEQ ID NO: 394002 - RNA, 20 nt, Human
ccucaguguccuggacuggg

SEQ ID NO: 394003 - RNA, 22 nt, Human
acagagccuccaggagugcugg

SEQ ID NO: 394004 - RNA, 22 nt, Human
gagggagggaaaguuuaacacu

SEQ ID NO: 394005 - RNA, 22 nt, Human
ucgccagggaugcuguaaggaa

SEQ ID NO: 394006 - RNA, 22 nt, Human
cagggccauuggcguggcuguc

SEQ ID NO: 394007 - RNA, 22 nt, Human
gagggaauggugugcaagaggu

SEQ ID NO: 394008 - RNA, 22 nt, Human
gguaaaaugcagauucuuagcc

SEQ ID NO: 394009 - RNA, 22 nt, Human
uaaaagcucuucuguugaguua

SEQ ID NO: 394010 - RNA, 22 nt, Human
ucaggagcagcaugggugagag

SEQ ID NO: 394011 - RNA, 22 nt, Human
ccaaagucuggagcagcagagc

SEQ ID NO: 394012 - RNA, 22 nt, Human
cccaggaaaugaacuucugauu

SEQ ID NO: 394013 - RNA, 22 nt, Human
aaguguuaaagacuugaacacu

SEQ ID NO: 394014 - RNA, 22 nt, Human
guggagcaaucagagggucagu

SEQ ID NO: 394015 - RNA, 22 nt, Human
cacagccuugagcgaggacaag

SEQ ID NO: 394016 - RNA, 22 nt, Human
uagcagugccaggauuuugcug

SEQ ID NO: 394017 - RNA, 22 nt, Human
uggcucugucaaacugcacaca

SEQ ID NO: 394018 - RNA, 22 nt, Human
auaugcacacucugcccacaga

SEQ ID NO: 394019 - RNA, 22 nt, Human
uguggcucucagauccuccaau

SEQ ID NO: 394020 - RNA, 22 nt, Human
agaggccagcagugccuaucug

SEQ ID NO: 394021 - RNA, 22 nt, Human
ucaggcugccuaucagacugug

SEQ ID NO: 394022 - RNA, 22 nt, Human
gauugaaacauaggcagucgag

SEQ ID NO: 394023 - RNA, 22 nt, Human
uauaucauggagauuaacauuc

SEQ ID NO: 394024 - RNA, 22 nt, Human
caugaagcauguuuugucauga

SEQ ID NO: 394025 - RNA, 20 nt, Human
gcaugaggaaucauugcagc

SEQ ID NO: 394026 - RNA, 22 nt, Human
ucucaggaauagaguggcagca

SEQ ID NO: 394027 - RNA, 22 nt, Human
ccuuaaauucuccauuugaaag

SEQ ID NO: 394028 - RNA, 22 nt, Human
accccagcucugagccacacca

SEQ ID NO: 394029 - RNA, 22 nt, Human
ugguuuugcuaaaauagaaaga

SEQ ID NO: 394030 - RNA, 22 nt, Human
cgaggcagacaaaaguuggaag

SEQ ID NO: 394031 - RNA, 22 nt, Human
cugucacacugauaucaggcuu

SEQ ID NO: 394032 - RNA, 22 nt, Human
agugugagccuacaggccaaag

SEQ ID NO: 394033 - RNA, 22 nt, Human
uggcagaaagaaccaugugcaa

SEQ ID NO: 394034 - RNA, 22 nt, Human
uaaacauggauucugaucacag

SEQ ID NO: 394035 - RNA, 22 nt, Human
auuuccauacacccauuucuga

SEQ ID NO: 394036 - RNA, 22 nt, Human
ucucuuucuauugcaccaugcu

SEQ ID NO: 394037 - RNA, 19 nt, Human
ccucccacggauuccuucc

SEQ ID NO: 394038 - RNA, 22 nt, Human
guaucuuuccacaucuucagua

SEQ ID NO: 394039 - RNA, 22 nt, Human
cuuauguauaauguuccacaua

SEQ ID NO: 394040 - RNA, 22 nt, Human
gggaaggagguggcuugaagug

SEQ ID NO: 394041 - RNA, 22 nt, Human
ugaaacaaauuuggaaaaucua

SEQ ID NO: 394042 - RNA, 20 nt, Human
ccaggccugggccugcucua

SEQ ID NO: 394043 - RNA, 22 nt, Human
cuggagccgcauggagcaggga

SEQ ID NO: 394044 - RNA, 22 nt, Human
uaaacaucugucauguguuuau

SEQ ID NO: 394045 - RNA, 22 nt, Human
cacucaggcugugucaggagga

SEQ ID NO: 394046 - RNA, 22 nt, Human
agggcugccauuucuggcccaa

SEQ ID NO: 394047 - RNA, 22 nt, Human
aggaccaguaugagagcaucug

SEQ ID NO: 394048 - RNA, 22 nt, Human
guuagggagucagguggcucuu

SEQ ID NO: 394049 - RNA, 22 nt, Human
gaagagcugugauucaggcuua

SEQ ID NO: 394050 - RNA, 22 nt, Human
uuuggaauuggaaagugcugug

SEQ ID NO: 394051 - RNA, 22 nt, Human
agggucagagucaggugcagua

SEQ ID NO: 394052 - RNA, 22 nt, Human
aggcugagcaaagggccuuacc

SEQ ID NO: 394053 - RNA, 22 nt, Human
guccucugggcagcugccccac

SEQ ID NO: 394054 - RNA, 22 nt, Human
aaucagaaucaguugacacagc

SEQ ID NO: 394055 - RNA, 22 nt, Human
ccucugcugcuguugagcaccg

SEQ ID NO: 394056 - RNA, 22 nt, Human
agaagaaaugaggccguucugc

SEQ ID NO: 394057 - RNA, 22 nt, Human
uuuaaaauuuagaccucuccac

SEQ ID NO: 394058 - RNA, 22 nt, Human
ugaagcagaggggucuugagcu

SEQ ID NO: 394059 - RNA, 22 nt, Human
aucugccuggcuccaggugagc

SEQ ID NO: 394060 - RNA, 22 nt, Human
gcucccugcacucugcagcccu

SEQ ID NO: 394061 - RNA, 19 nt, Human
ugcuuaauuccuaguaggu

SEQ ID NO: 394062 - RNA, 22 nt, Human
cauuucacaaauggccacauca

SEQ ID NO: 394063 - RNA, 22 nt, Human
gcuggauccacaaauaacuuug

SEQ ID NO: 394064 - RNA, 21 nt, Human
ucucuggaauuagaccauguu

SEQ ID NO: 394065 - RNA, 22 nt, Human
uguaugugcuugagaagguggg

SEQ ID NO: 394066 - RNA, 22 nt, Human
ugggccacuugaaaguggaugu

SEQ ID NO: 394067 - RNA, 22 nt, Human
ucuucucaguuucucuaggaug

SEQ ID NO: 394068 - RNA, 22 nt, Human
aggcagcuaagauggauaauga

SEQ ID NO: 394069 - RNA, 22 nt, Human
ugcagggccccucugcaugagu

SEQ ID NO: 394070 - RNA, 22 nt, Human
auauuaggcaaggagauuauuu

SEQ ID NO: 394071 - RNA, 20 nt, Human
cagucccaauccagggccag

SEQ ID NO: 394072 - RNA, 22 nt, Human
uggcuuaagauuuaugcuuuua

SEQ ID NO: 394073 - RNA, 22 nt, Human
acuguucauauucuuagaaauu

SEQ ID NO: 394074 - RNA, 22 nt, Human
ucugccuguugcuagaauguca

SEQ ID NO: 394075 - RNA, 22 nt, Human
cagugguugguagauacuugag

SEQ ID NO: 394076 - RNA, 21 nt, Human
cugcucugacagugaggccag

SEQ ID NO: 394077 - RNA, 22 nt, Human
ugaaaugcuguagagacuguau

SEQ ID NO: 394078 - RNA, 22 nt, Human
gggggaagacugggcuagugau

SEQ ID NO: 394079 - RNA, 22 nt, Human
uucuucaaauagcagggaguca

SEQ ID NO: 394080 - RNA, 22 nt, Human
agaucugaaucucauccgagga

SEQ ID NO: 394081 - RNA, 22 nt, Human
aggcagccaucugcaggaagga

SEQ ID NO: 394082 - RNA, 22 nt, Human
gcugagguaggagguugcagug

SEQ ID NO: 394083 - RNA, 22 nt, Human
uuuccaaagcugaguugagcaa

SEQ ID NO: 394084 - RNA, 22 nt, Human
gggcuacagacaugcucuaagc

SEQ ID NO: 394085 - RNA, 21 nt, Human
aggcagcucaggcccagagag

SEQ ID NO: 394086 - RNA, 22 nt, Human
ccuguucaaguugcagggcugg

SEQ ID NO: 394087 - RNA, 22 nt, Human
uugcauaaagauuuuauugcau

SEQ ID NO: 394088 - RNA, 22 nt, Human
guguguccaggcgggagucaag

SEQ ID NO: 394089 - RNA, 22 nt, Human
gaaauauugggacucagagcuu

SEQ ID NO: 394090 - RNA, 22 nt, Human
agggacacacuccaguguuauu

SEQ ID NO: 394091 - RNA, 22 nt, Human
ccagagccucuuaugaagaucg

SEQ ID NO: 394092 - RNA, 22 nt, Human
uuuaaucaggcaaagcauaaua

SEQ ID NO: 394093 - RNA, 20 nt, Human
uggagccaaggugugucugg

SEQ ID NO: 394094 - RNA, 22 nt, Human
gggauuuaguaggauaguauac

SEQ ID NO: 394095 - RNA, 22 nt, Human
uaugcacacauguaugcaugug

SEQ ID NO: 394096 - RNA, 22 nt, Human
cagaauggcuuuuauggcucag

SEQ ID NO: 394097 - RNA, 22 nt, Human
uuucaacauauaccauaaugcc

SEQ ID NO: 394098 - RNA, 22 nt, Human
cugaagaggacgcagcagcaag

SEQ ID NO: 394099 - RNA, 22 nt, Human
ugucagugaguuaguugcaagu

SEQ ID NO: 394100 - RNA, 22 nt, Human
ucucuucuuguguuuuccugcc

SEQ ID NO: 394101 - RNA, 23 nt, Human
ucuugaaaagccuacagcaguuc

SEQ ID NO: 394102 - RNA, 22 nt, Human
ugggccugacucaccugccucc

SEQ ID NO: 394103 - RNA, 22 nt, Human
uccuucuuucccccuagucauu

SEQ ID NO: 394104 - RNA, 22 nt, Human
aagagggaggugcgggugcaga

SEQ ID NO: 394105 - RNA, 22 nt, Human
aggcuucugcugauauuucauu

SEQ ID NO: 394106 - RNA, 22 nt, Human
agagaauuuuaaaagccuugaa

SEQ ID NO: 394107 - RNA, 22 nt, Human
cugcaggcucgaagacacggau

SEQ ID NO: 394108 - RNA, 22 nt, Human
caggcaggucagugaagaagga

SEQ ID NO: 394109 - RNA, 22 nt, Human
gagccugggacugggggucaug

SEQ ID NO: 394110 - RNA, 21 nt, Human
aacaaagggaugcucaucuuu

SEQ ID NO: 394111 - RNA, 22 nt, Human
cucaccaggaacagcugcggag

SEQ ID NO: 394112 - RNA, 23 nt, Human
agggagcuaaaaggcuggagcag

SEQ ID NO: 394113 - RNA, 22 nt, Human
ggagaaagcuguaguggaaugu

SEQ ID NO: 394114 - RNA, 22 nt, Human
gcucucugccauaugaggauac

SEQ ID NO: 394115 - RNA, 22 nt, Human
ccagaggcuggguucaccucag

SEQ ID NO: 394116 - RNA, 22 nt, Human
ccaggcucugcgcuggacaugg

SEQ ID NO: 394117 - RNA, 17 nt, Human
ggaaaaggaugauacag

SEQ ID NO: 394118 - RNA, 22 nt, Human
augaaaauguacauguguauaa

SEQ ID NO: 394119 - RNA, 22 nt, Human
acucaggaagaaagcagcuggu

SEQ ID NO: 394120 - RNA, 22 nt, Human
uaucuuuagaggaagagaaucu

SEQ ID NO: 394121 - RNA, 22 nt, Human
cugaauaauuuuauaguugcug

SEQ ID NO: 394122 - RNA, 22 nt, Human
uggcauuucaguauuuucauaa

SEQ ID NO: 394123 - RNA, 22 nt, Human
cagggcucagaagacagaccuc

SEQ ID NO: 394124 - RNA, 22 nt, Human
ugaggcagcaauuguauuguau

SEQ ID NO: 394125 - RNA, 22 nt, Human
cccuuagcucaauuucuugccc

SEQ ID NO: 394126 - RNA, 22 nt, Human
ucuuugcaucccuuccauaguu

SEQ ID NO: 394127 - RNA, 21 nt, Human
uauuugcugccaucuuugagg

SEQ ID NO: 394128 - RNA, 22 nt, Human
uuuuuccuuggaugugucucuc

SEQ ID NO: 394129 - RNA, 22 nt, Human
uaggccaguggcagguugugug

SEQ ID NO: 394130 - RNA, 22 nt, Human
cugcuguguuagcagguuuagu

SEQ ID NO: 394131 - RNA, 22 nt, Human
uaggcagggauuaggguugauu

SEQ ID NO: 394132 - RNA, 22 nt, Human
ucccagccuuccuuguggugaa

SEQ ID NO: 394133 - RNA, 21 nt, Human
agucuguuaggaugacucuga

SEQ ID NO: 394134 - RNA, 22 nt, Human
uccugaggcacaauccuagaau

SEQ ID NO: 394135 - RNA, 22 nt, Human
aagccagggauuccugagggag

SEQ ID NO: 394136 - RNA, 22 nt, Human
aauuucaaagcucacuggcaua

SEQ ID NO: 394137 - RNA, 22 nt, Human
ggcuguggcagcuggaaguggu

SEQ ID NO: 394138 - RNA, 22 nt, Human
aaaauuauucauggcuuuugga

SEQ ID NO: 394139 - RNA, 18 nt, Human
uggagccagcucuaggau

SEQ ID NO: 394140 - RNA, 23 nt, Human
ccugugugcccuuaauucacagc

SEQ ID NO: 394141 - RNA, 22 nt, Human
cuggagccacugggucuuguau

SEQ ID NO: 394142 - RNA, 22 nt, Human
uggccuggggaccugugagacc

SEQ ID NO: 394143 - RNA, 22 nt, Human
cuuccucccggcccaugcucug

SEQ ID NO: 394144 - RNA, 22 nt, Human
gucacuggggccacaugcagaa

SEQ ID NO: 394145 - RNA, 22 nt, Human
gugaacuauuggguaucauaaa

SEQ ID NO: 394146 - RNA, 22 nt, Human
agagccugucugccuuucuacc

SEQ ID NO: 394147 - RNA, 22 nt, Human
agccauggcgccacuagaggga

SEQ ID NO: 394148 - RNA, 22 nt, Human
guggcagagguuccucagugug

SEQ ID NO: 394149 - RNA, 22 nt, Human
agaggaugauuuuaaggacacu

SEQ ID NO: 394150 - RNA, 22 nt, Human
gcagcccaaaaaagagguagau

SEQ ID NO: 394151 - RNA, 22 nt, Human
ucucuucuaauuaggguccaug

SEQ ID NO: 394152 - RNA, 22 nt, Human
gaucuguuucauucacagucug

SEQ ID NO: 394153 - RNA, 22 nt, Human
uagaaauguuagauguauugag

SEQ ID NO: 394154 - RNA, 22 nt, Human
cacugcuuaguugguaaaugug

SEQ ID NO: 394155 - RNA, 22 nt, Human
uucauuacugcgguagucacac

SEQ ID NO: 394156 - RNA, 22 nt, Human
ccaggagagcaggcgugcagcu

SEQ ID NO: 394157 - RNA, 22 nt, Human
gccccagguugccugucccagg

SEQ ID NO: 394158 - RNA, 20 nt, Human
augugagggguugaaguggg

SEQ ID NO: 394159 - RNA, 22 nt, Human
uugacacagaucaauauucaac

SEQ ID NO: 394160 - RNA, 22 nt, Human
augcuuaacuuccuagucuaua

SEQ ID NO: 394161 - RNA, 22 nt, Human
auaaagauuucuuuuucucuac

SEQ ID NO: 394162 - RNA, 22 nt, Human
agaagccagucgcucucccgca

SEQ ID NO: 394163 - RNA, 22 nt, Human
cuuuucaugccagcccaucaca

SEQ ID NO: 394164 - RNA, 22 nt, Human
agggagugguuaagaaggugca

SEQ ID NO: 394165 - RNA, 22 nt, Human
gcagcuuugaagacuuauuugc

SEQ ID NO: 394166 - RNA, 22 nt, Human
ugccaggauauaagagugcgau

SEQ ID NO: 394167 - RNA, 22 nt, Human
auaugagagaggaaagauuuua

SEQ ID NO: 394168 - RNA, 20 nt, Human
ggcacuggaagcacacagga

SEQ ID NO: 394169 - RNA, 23 nt, Human
agcagugaguaaacagauaggau

SEQ ID NO: 394170 - RNA, 22 nt, Human
uccaggcuaauuuugcauuguu

SEQ ID NO: 394171 - RNA, 22 nt, Human
uguacacugcaggaugcauugc

SEQ ID NO: 394172 - RNA, 22 nt, Human
agggaggcaggaaaguugucug

SEQ ID NO: 394173 - RNA, 17 nt, Human
gcugacccuggagaagu

SEQ ID NO: 394174 - RNA, 23 nt, Human
gaaucaguggcuaacaaggaaac

SEQ ID NO: 394175 - RNA, 22 nt, Human
ucuucagaggaagucagucuuu

SEQ ID NO: 394176 - RNA, 22 nt, Human
caacauuucaaggucuuuagga

SEQ ID NO: 394177 - RNA, 22 nt, Human
ggcccaucucuugcucuggguu

SEQ ID NO: 394178 - RNA, 22 nt, Human
uccagaccaugugagaggcgca

SEQ ID NO: 394179 - RNA, 22 nt, Human
gcucugcugagauaucugggag

SEQ ID NO: 394180 - RNA, 22 nt, Human
gcccaggaaaugccccguggug

SEQ ID NO: 394181 - RNA, 22 nt, Human
cuuuuuccagcuucaggguggg

SEQ ID NO: 394182 - RNA, 22 nt, Human
gggggcucugacucccucagcu

SEQ ID NO: 394183 - RNA, 22 nt, Human
cagcccuguccagcagagggug

SEQ ID NO: 394184 - RNA, 22 nt, Human
agguagagcuccaguagaaaau

SEQ ID NO: 394185 - RNA, 22 nt, Human
auggacaggcugagcuuccuca

SEQ ID NO: 394186 - RNA, 22 nt, Human
ccagcugagaaguguaaaguga

SEQ ID NO: 394187 - RNA, 22 nt, Human
cuauuagguaugugguugcuau

SEQ ID NO: 394188 - RNA, 22 nt, Human
gugcaggagguaacauagcaaa

SEQ ID NO: 394189 - RNA, 22 nt, Human
cggcagcugauugcagagcacc

SEQ ID NO: 394190 - RNA, 22 nt, Human
ggcagggucuggacugaaagcu

SEQ ID NO: 394191 - RNA, 22 nt, Human
cucagaguggggcucccugagg

SEQ ID NO: 394192 - RNA, 22 nt, Human
auuuuuccaugauacuuaucug

SEQ ID NO: 394193 - RNA, 22 nt, Human
caggguggaagcuguagagugg

SEQ ID NO: 394194 - RNA, 22 nt, Human
aggcucagggacucccucccuc

SEQ ID NO: 394195 - RNA, 22 nt, Human
cugcccaguuugggagccuuuc

SEQ ID NO: 394196 - RNA, 22 nt, Human
uccugggccuguacuccauccg

SEQ ID NO: 394197 - RNA, 22 nt, Human
ccaggggaaacagggagcacuc

SEQ ID NO: 394198 - RNA, 22 nt, Human
uggcagggugccaguugcgagu

SEQ ID NO: 394199 - RNA, 23 nt, Human
cuggaagugcuuuuauagcuuug

SEQ ID NO: 394200 - RNA, 22 nt, Human
ggcaggugaccuggccucccag

SEQ ID NO: 394201 - RNA, 22 nt, Human
cagccaccauacagcagaagcu

SEQ ID NO: 394202 - RNA, 22 nt, Human
gugacagaguuuuagaucucau

SEQ ID NO: 394203 - RNA, 22 nt, Human
uugaagcauuugcuauagcauu

SEQ ID NO: 394204 - RNA, 22 nt, Human
gaaucauuuagcucugcaugga

SEQ ID NO: 394205 - RNA, 22 nt, Human
gugcauuugugcaugcacaugu

SEQ ID NO: 394206 - RNA, 17 nt, Human
uggcaagaauggaaaug

SEQ ID NO: 394207 - RNA, 22 nt, Human
aaggccaacuaggaugagcuag

SEQ ID NO: 394208 - RNA, 22 nt, Human
ucugaagggcugaguggaggag

SEQ ID NO: 394209 - RNA, 22 nt, Human
ugagacaaccuaauuaaacacc

SEQ ID NO: 394210 - RNA, 22 nt, Human
aggucccaggcauagcuggucu

SEQ ID NO: 394211 - RNA, 22 nt, Human
gccuuaggggucagacagagcu

SEQ ID NO: 394212 - RNA, 22 nt, Human
uucaggauucugugucugacaa

SEQ ID NO: 394213 - RNA, 22 nt, Human
gucccauaaguagugcaacuug

SEQ ID NO: 394214 - RNA, 22 nt, Human
cuuaaagaugucaaggcuguuu

SEQ ID NO: 394215 - RNA, 22 nt, Human
uggagcagagaugguggccuuc

SEQ ID NO: 394216 - RNA, 22 nt, Human
guugggaaggcaagaaguagaa

SEQ ID NO: 394217 - RNA, 22 nt, Human
guuugcauaaaguggaugcagg

SEQ ID NO: 394218 - RNA, 22 nt, Human
aggccaaguagcuagcauugaa

SEQ ID NO: 394219 - RNA, 22 nt, Human
agaaaguucugugaguuguuca

SEQ ID NO: 394220 - RNA, 22 nt, Human
uaaggccaaacuauuauaguuc

SEQ ID NO: 394221 - RNA, 22 nt, Human
cugcagaggguuugagcauccu

SEQ ID NO: 394222 - RNA, 19 nt, Human
uucuccaggcugcagaggg

SEQ ID NO: 394223 - RNA, 22 nt, Human
caagauuugccaguggccaacu

SEQ ID NO: 394224 - RNA, 22 nt, Human
gccuggagacaaggacaaaggg

SEQ ID NO: 394225 - RNA, 20 nt, Human
gucaucgccggcagcaaaga

SEQ ID NO: 394226 - RNA, 18 nt, Human
ucagagguacagaaaagu

SEQ ID NO: 394227 - RNA, 22 nt, Human
ggccagaggccauccuccugcu

SEQ ID NO: 394228 - RNA, 22 nt, Human
aggcacugcagauuacaggcgc

SEQ ID NO: 394229 - RNA, 22 nt, Human
uuaacagauguuuauggagcau

SEQ ID NO: 394230 - RNA, 21 nt, Human
gcuccuggugcugcguggcgc

SEQ ID NO: 394231 - RNA, 22 nt, Human
ugccugggaaccaauccuggcu

SEQ ID NO: 394232 - RNA, 22 nt, Human
ccaccagcuucagcagccgcgg

SEQ ID NO: 394233 - RNA, 22 nt, Human
auguccagaguaaagcacauuc

SEQ ID NO: 394234 - RNA, 22 nt, Human
uggcugcuuguuuuagugaggc

SEQ ID NO: 394235 - RNA, 22 nt, Human
uauugucuguccgggucaaagc

SEQ ID NO: 394236 - RNA, 22 nt, Human
guuaucaugcuucaucaucacu

SEQ ID NO: 394237 - RNA, 21 nt, Human
uggccucccacacuuccaugg

SEQ ID NO: 394238 - RNA, 22 nt, Human
ugcccaggguggagugcagcgg

SEQ ID NO: 394239 - RNA, 22 nt, Human
augggguggaguccgggcagcg

SEQ ID NO: 394240 - RNA, 23 nt, Human
ugagaagccaggggagcgugagg

SEQ ID NO: 394241 - RNA, 22 nt, Human
acacagggggcauucuaggagu

SEQ ID NO: 394242 - RNA, 22 nt, Human
uauuuccaccuauuauuuucug

SEQ ID NO: 394243 - RNA, 22 nt, Human
gguucacacuaagcuuaagugg

SEQ ID NO: 394244 - RNA, 22 nt, Human
aagaaaucugauauuuguuuca

SEQ ID NO: 394245 - RNA, 22 nt, Human
uuacaguauuguuaaacucuuu

SEQ ID NO: 394246 - RNA, 22 nt, Human
agagacaggaguucuguuucca

SEQ ID NO: 394247 - RNA, 22 nt, Human
uaacacugguauuucauuuagu

SEQ ID NO: 394248 - RNA, 22 nt, Human
cugggagggguagccaauccua

SEQ ID NO: 394249 - RNA, 22 nt, Human
acugcagccuagggaccacagu

SEQ ID NO: 394250 - RNA, 22 nt, Human
caggccaggguugagaagagaa

SEQ ID NO: 394251 - RNA, 22 nt, Human
gagggagagugauggaccauug

SEQ ID NO: 394252 - RNA, 22 nt, Human
ucaaagucauggcuaguaauga

SEQ ID NO: 394253 - RNA, 22 nt, Human
aucuuccuucacuuucucccac

SEQ ID NO: 394254 - RNA, 22 nt, Human
ucccagccugacagugcaucaa

SEQ ID NO: 394255 - RNA, 22 nt, Human
ucccuucacagaugcgauguuu

SEQ ID NO: 394256 - RNA, 22 nt, Human
cauggcagugauucagccuuug

SEQ ID NO: 394257 - RNA, 22 nt, Human
caggagauguaagacuucuguu

SEQ ID NO: 394258 - RNA, 22 nt, Human
gguggggcccuggcacugguau

SEQ ID NO: 394259 - RNA, 22 nt, Human
gaaggccugugguagugagacg

SEQ ID NO: 394260 - RNA, 22 nt, Human
aguggcagagcaggugcuggaa

SEQ ID NO: 394261 - RNA, 22 nt, Human
aacacuuucuauuauuaugguu

SEQ ID NO: 394262 - RNA, 22 nt, Human
cucugcagaauuugagcugcuc

SEQ ID NO: 394263 - RNA, 22 nt, Human
agcagggcccacuaggggagau

SEQ ID NO: 394264 - RNA, 22 nt, Human
gcuggccucuggagaagggcuu

SEQ ID NO: 394265 - RNA, 22 nt, Human
uugcacuaggaaaaggcagcca

SEQ ID NO: 394266 - RNA, 22 nt, Human
uccaggaggguuuucugccuuc

SEQ ID NO: 394267 - RNA, 22 nt, Human
uuuauccaaggguuuuaacugu

SEQ ID NO: 394268 - RNA, 22 nt, Human
cucacuguuuaauagcuggauc

SEQ ID NO: 394269 - RNA, 22 nt, Human
uggagggcaugcuguccauggg

SEQ ID NO: 394270 - RNA, 22 nt, Human
uggggugccgacagggagggca

SEQ ID NO: 394271 - RNA, 22 nt, Human
cugcucuggucucuucauguuu

SEQ ID NO: 394272 - RNA, 22 nt, Human
gaagaagcaggaguguguagca

SEQ ID NO: 394273 - RNA, 22 nt, Human
uggcagagaugaagaguuguuu

SEQ ID NO: 394274 - RNA, 22 nt, Human
ugauggcuaucccuggaagggc

SEQ ID NO: 394275 - RNA, 22 nt, Human
ggguggagcuuggacaccagua

SEQ ID NO: 394276 - RNA, 22 nt, Human
caggguugcaugcaucuguggg

SEQ ID NO: 394277 - RNA, 22 nt, Human
cagagggcucuuggcugccugc

SEQ ID NO: 394278 - RNA, 22 nt, Human
cagagggcucggcggccgcucc

SEQ ID NO: 394279 - RNA, 22 nt, Human
aaugggauaauuguucauggga

SEQ ID NO: 394280 - RNA, 22 nt, Human
aaaauggucucagcuggcacca

SEQ ID NO: 394281 - RNA, 22 nt, Human
aaaaucuaaguagcgaguaagg

SEQ ID NO: 394282 - RNA, 22 nt, Human
uucauaaugagguccuagaggc

SEQ ID NO: 394283 - RNA, 22 nt, Human
gcuccuggucuggagcuucaag

SEQ ID NO: 394284 - RNA, 22 nt, Human
ugacagggcuagaggcaaugca

SEQ ID NO: 394285 - RNA, 22 nt, Human
gggcucucaaggcagggcccca

SEQ ID NO: 394286 - RNA, 22 nt, Human
agggucaggagacacuggcaac

SEQ ID NO: 394287 - RNA, 22 nt, Human
auuacacuuguucaucaucacc

SEQ ID NO: 394288 - RNA, 22 nt, Human
ucccagagcccaaguuggagag

SEQ ID NO: 394289 - RNA, 22 nt, Human
auuguuaugaaaauaagauguu

SEQ ID NO: 394290 - RNA, 17 nt, Human
gagagcugcugcuuccg

SEQ ID NO: 394291 - RNA, 22 nt, Human
aggcagguuggugagaagacug

SEQ ID NO: 394292 - RNA, 22 nt, Human
acacacucaauugcauaagcac

SEQ ID NO: 394293 - RNA, 22 nt, Human
ggaggugggagacauaggcggc

SEQ ID NO: 394294 - RNA, 22 nt, Human
ggagauaguccaggugaaggga

SEQ ID NO: 394295 - RNA, 22 nt, Human
uggccucaagucugagggccuu

SEQ ID NO: 394296 - RNA, 22 nt, Human
ucccaagugucuuggaccaggg

SEQ ID NO: 394297 - RNA, 21 nt, Human
uccauaagagaccaucuccua

SEQ ID NO: 394298 - RNA, 22 nt, Human
uuauagaacagccuccucuaga

SEQ ID NO: 394299 - RNA, 22 nt, Human
uacuuguuaucaucuuuuccuu

SEQ ID NO: 394300 - RNA, 22 nt, Human
aagcucugcucagcagacuagg

SEQ ID NO: 394301 - RNA, 22 nt, Human
ccauaaucuggcuuugagagag

SEQ ID NO: 394302 - RNA, 22 nt, Human
ugacuuccugcacucaggugau

SEQ ID NO: 394303 - RNA, 22 nt, Human
ccugggcaucucaugcaccugc

SEQ ID NO: 394304 - RNA, 22 nt, Human
uccccagggcugcagagggugu

SEQ ID NO: 394305 - RNA, 22 nt, Human
cucugugcccuacugcucagcu

SEQ ID NO: 394306 - RNA, 22 nt, Human
aagcauuuauagauaagaauuu

SEQ ID NO: 394307 - RNA, 22 nt, Human
cuggcaggucucgcugacgugu

SEQ ID NO: 394308 - RNA, 22 nt, Human
cuggcagcuucaggacacucgg

SEQ ID NO: 394309 - RNA, 22 nt, Human
aauagaaaggaggggcucuugu

SEQ ID NO: 394310 - RNA, 22 nt, Human
ugcuggggguucagaugaguaa

SEQ ID NO: 394311 - RNA, 22 nt, Human
uggagcugguaaacagugacau

SEQ ID NO: 394312 - RNA, 22 nt, Human
cugggaggauucauugagguga

SEQ ID NO: 394313 - RNA, 22 nt, Human
auguauuucuauguagugaaga

SEQ ID NO: 394314 - RNA, 22 nt, Human
acccaggacuuggcaaccucau

SEQ ID NO: 394315 - RNA, 23 nt, Human
ugggcaucuccucugugccaggc

SEQ ID NO: 394316 - RNA, 22 nt, Human
ugaugauguuuaucuugguauu

SEQ ID NO: 394317 - RNA, 21 nt, Human
agggagcuuuagguagaaguu

SEQ ID NO: 394318 - RNA, 20 nt, Human
uugcagcagugaggugaagg

SEQ ID NO: 394319 - RNA, 22 nt, Human
cagaggguugaugugaggcuua

SEQ ID NO: 394320 - RNA, 22 nt, Human
uuugaacaggaguaucuauagu

SEQ ID NO: 394321 - RNA, 22 nt, Human
agccaaagaucagugugcaagu

SEQ ID NO: 394322 - RNA, 22 nt, Human
cacugaguucccugacauuuca

SEQ ID NO: 394323 - RNA, 22 nt, Human
aucaaaaccuugacuuuuaaug

SEQ ID NO: 394324 - RNA, 22 nt, Human
aaugcacauguuguaauaaaua

SEQ ID NO: 394325 - RNA, 22 nt, Human
gguaacaguauguagaguaaga

SEQ ID NO: 394326 - RNA, 18 nt, Human
gcagcuagccaggggggc

SEQ ID NO: 394327 - RNA, 22 nt, Human
acauuugagaugccuuuuaggu

SEQ ID NO: 394328 - RNA, 22 nt, Human
ccagcucugccaagcgucagcu

SEQ ID NO: 394329 - RNA, 22 nt, Human
gaaagccaucuggcugcuggga

SEQ ID NO: 394330 - RNA, 22 nt, Human
ucucacucauuuccuaggucuu

SEQ ID NO: 394331 - RNA, 22 nt, Human
cucuucuugccugaugaggcag

SEQ ID NO: 394332 - RNA, 22 nt, Human
agucccagugacuuggccagaa

SEQ ID NO: 394333 - RNA, 19 nt, Human
gcuguauuaaagauacaug

SEQ ID NO: 394334 - RNA, 22 nt, Human
aucuacagugcacaggacagcc

SEQ ID NO: 394335 - RNA, 23 nt, Human
ugucccagagggagggauaggcu

SEQ ID NO: 394336 - RNA, 22 nt, Human
aaagcagucacuccagugugau

SEQ ID NO: 394337 - RNA, 22 nt, Human
uggugguuaugcgcuuuguggg

SEQ ID NO: 394338 - RNA, 22 nt, Human
gggagcuguaagggacagguag

SEQ ID NO: 394339 - RNA, 22 nt, Human
gcucaggaccgaggggugggaa

SEQ ID NO: 394340 - RNA, 22 nt, Human
gagggagucugugcaaagaauu

SEQ ID NO: 394341 - RNA, 22 nt, Human
ggcagagacuggguuggcagag

SEQ ID NO: 394342 - RNA, 22 nt, Human
cuuaggcaaccaggucaaugcu

SEQ ID NO: 394343 - RNA, 22 nt, Human
gauuuauaaagguugcacugga

SEQ ID NO: 394344 - RNA, 20 nt, Human
acaauacagguugugucuga

SEQ ID NO: 394345 - RNA, 22 nt, Human
aagauucuacaguagguacauu

SEQ ID NO: 394346 - RNA, 22 nt, Human
gcugcucuacccaugcaucugu

SEQ ID NO: 394347 - RNA, 22 nt, Human
ggcugugccucaaggcuacuca

SEQ ID NO: 394348 - RNA, 22 nt, Human
gaggaagcugcguggcauuuca

SEQ ID NO: 394349 - RNA, 22 nt, Human
acccaggacacagagaugaccc

SEQ ID NO: 394350 - RNA, 22 nt, Human
gugcugucguggaacugggcug

SEQ ID NO: 394351 - RNA, 22 nt, Human
ugugggcaggcccgggucugag

SEQ ID NO: 394352 - RNA, 22 nt, Human
ggcccagcugugcuuccagccc

SEQ ID NO: 394353 - RNA, 22 nt, Human
ugggaugggaucucgcuguguc

SEQ ID NO: 394354 - RNA, 22 nt, Human
caggcagagugagguggucuaa

SEQ ID NO: 394355 - RNA, 22 nt, Human
guugaaaguagaugcuauuugg

SEQ ID NO: 394356 - RNA, 22 nt, Human
ccugagaccaaguugcagccau

SEQ ID NO: 394357 - RNA, 23 nt, Human
uggcuggcagaaacugaagcaug

SEQ ID NO: 394358 - RNA, 22 nt, Human
uccagucauuuccauuguuccc

SEQ ID NO: 394359 - RNA, 23 nt, Human
uccagcagagccuuccaggaggg

SEQ ID NO: 394360 - RNA, 22 nt, Human
gaaaugcauggaucuuggcaga

SEQ ID NO: 394361 - RNA, 22 nt, Human
uccucuggggcgugguccugga

SEQ ID NO: 394362 - RNA, 22 nt, Human
ugaaucugauuucccuggaggc

SEQ ID NO: 394363 - RNA, 22 nt, Human
ccagcuggcacuguggcugccc

SEQ ID NO: 394364 - RNA, 22 nt, Human
aacucaguguguuucuuaguau

SEQ ID NO: 394365 - RNA, 22 nt, Human
uguuaucugagcaacgucgacg

SEQ ID NO: 394366 - RNA, 22 nt, Human
cacaucagggcugcuugggggu

SEQ ID NO: 394367 - RNA, 22 nt, Human
ggagcugggaauuggaucaucu

SEQ ID NO: 394368 - RNA, 22 nt, Human
cugccucucaggucccugagau

SEQ ID NO: 394369 - RNA, 22 nt, Human
uaggggugaggccaggcaucag

SEQ ID NO: 394370 - RNA, 22 nt, Human
gagcugucucuauaugaaugcu

SEQ ID NO: 394371 - RNA, 22 nt, Human
uuauguaauuuguuugcucuuc

SEQ ID NO: 394372 - RNA, 22 nt, Human
auccuugagaaaauaaaugacc

SEQ ID NO: 394373 - RNA, 22 nt, Human
aauguugagcuugaaaguaggu

SEQ ID NO: 394374 - RNA, 22 nt, Human
ccagagaggggaagggcuugcc

SEQ ID NO: 394375 - RNA, 17 nt, Human
cagacagauauccuggg

SEQ ID NO: 394376 - RNA, 22 nt, Human
ugcucccagggacucuggcugg

SEQ ID NO: 394377 - RNA, 22 nt, Human
cuucacauguuggaguccuuug

SEQ ID NO: 394378 - RNA, 18 nt, Human
gcugccugcauuccucac

SEQ ID NO: 394379 - RNA, 22 nt, Human
gcugucaggaacaugccuuggu

SEQ ID NO: 394380 - RNA, 22 nt, Human
augcugugagugugccgcagag

SEQ ID NO: 394381 - RNA, 22 nt, Human
ugaacagauggcccagcagagg

SEQ ID NO: 394382 - RNA, 22 nt, Human
aggaguggaauuacuggguucu

SEQ ID NO: 394383 - RNA, 22 nt, Human
agugauuugggugucagaaagu

SEQ ID NO: 394384 - RNA, 22 nt, Human
ccuggcagcauugguagagauu

SEQ ID NO: 394385 - RNA, 22 nt, Human
ucugagagagggucagaugcua

SEQ ID NO: 394386 - RNA, 22 nt, Human
aaugaugguuucaucacuugaa

SEQ ID NO: 394387 - RNA, 22 nt, Human
uagcuuuaccauagaagaguau

SEQ ID NO: 394388 - RNA, 22 nt, Human
aaaaccugauugaauucuauuu

SEQ ID NO: 394389 - RNA, 22 nt, Human
auguucuuguucaaaugucagu

SEQ ID NO: 394390 - RNA, 19 nt, Human
acagaaauuaguuauuuuc

SEQ ID NO: 394391 - RNA, 22 nt, Human
gacagugcauuuccuggcaugg

SEQ ID NO: 394392 - RNA, 22 nt, Human
cccagcucugcagaccugcccu

SEQ ID NO: 394393 - RNA, 22 nt, Human
gccuggcacauugcaguggauu

SEQ ID NO: 394394 - RNA, 22 nt, Human
ugucagagagcaggcaguagaa

SEQ ID NO: 394395 - RNA, 22 nt, Human
aagcaauauacugauaugauua

SEQ ID NO: 394396 - RNA, 22 nt, Human
aaaaguaauugcaauuuuguag

SEQ ID NO: 394397 - RNA, 18 nt, Human
ggaaaccacaggguucug

SEQ ID NO: 394398 - RNA, 22 nt, Human
gcaggggcaggagaucucaggc

SEQ ID NO: 394399 - RNA, 22 nt, Human
ugcagggcaucuuugaagugug

SEQ ID NO: 394400 - RNA, 22 nt, Human
uguuucauuaguacugacaaua

SEQ ID NO: 394401 - RNA, 22 nt, Human
ucugugaacaucacauugacag

SEQ ID NO: 394402 - RNA, 20 nt, Human
agugucuggugcagggccuc

SEQ ID NO: 394403 - RNA, 22 nt, Human
cuggagccccagacagggagag

SEQ ID NO: 394404 - RNA, 22 nt, Human
uaauuacagguccaaaacaauc

SEQ ID NO: 394405 - RNA, 22 nt, Human
auaaaacuuauuagaauugugu

SEQ ID NO: 394406 - RNA, 23 nt, Human
cagugugacgaggugaggcaggc

SEQ ID NO: 394407 - RNA, 22 nt, Human
aggcagagcugauguucuguga

SEQ ID NO: 394408 - RNA, 22 nt, Human
caggagcaguuagaagcccacu

SEQ ID NO: 394409 - RNA, 22 nt, Human
ggccagaggugguacauagcuu

SEQ ID NO: 394410 - RNA, 22 nt, Human
ccagcaggcagucauauccuuu

SEQ ID NO: 394411 - RNA, 22 nt, Human
acaggcagagaacucagccaga

SEQ ID NO: 394412 - RNA, 22 nt, Human
ggucacugcucuaaacaaaagu

SEQ ID NO: 394413 - RNA, 22 nt, Human
cugaggaugguguggucuucuc

SEQ ID NO: 394414 - RNA, 22 nt, Human
cauagaaacuugcagcaagcac

SEQ ID NO: 394415 - RNA, 22 nt, Human
uccaggcaugguguaauuuugc

SEQ ID NO: 394416 - RNA, 22 nt, Human
agucccagugagaugagccacg

SEQ ID NO: 394417 - RNA, 23 nt, Human
agagcuuagggaauucacaugag

SEQ ID NO: 394418 - RNA, 22 nt, Human
cagagcggccacuagagggcgc

SEQ ID NO: 394419 - RNA, 22 nt, Human
ggccucaguuucuucaacugua

SEQ ID NO: 394420 - RNA, 22 nt, Human
gcuguucacggaggaggauggg

SEQ ID NO: 394421 - RNA, 22 nt, Human
gcagcagaugcuuucauggaca

SEQ ID NO: 394422 - RNA, 22 nt, Human
gccuggugugcgccgcgcagcu

SEQ ID NO: 394423 - RNA, 22 nt, Human
acagguggcauaggcaguuuga

SEQ ID NO: 394424 - RNA, 22 nt, Human
cugggcugcaggaguggggcaa

SEQ ID NO: 394425 - RNA, 22 nt, Human
gcaaaggcuucuuuuauucucc

SEQ ID NO: 394426 - RNA, 22 nt, Human
acaggccugacacacagagggc

SEQ ID NO: 394427 - RNA, 22 nt, Human
caggggcucugggugaugugag

SEQ ID NO: 394428 - RNA, 22 nt, Human
uaguuuuacuugcgaugauaau

SEQ ID NO: 394429 - RNA, 22 nt, Human
ucagaaaagguagcugugacaa

SEQ ID NO: 394430 - RNA, 22 nt, Human
ucauggcacuuagcacaguccu

SEQ ID NO: 394431 - RNA, 22 nt, Human
ggaggccaugaggcucuaggug

SEQ ID NO: 394432 - RNA, 22 nt, Human
aaugugaaaccgcacagaauaa

SEQ ID NO: 394433 - RNA, 22 nt, Human
gcauuucugugcauacacauga

SEQ ID NO: 394434 - RNA, 22 nt, Human
guaucuuucccaccaaucacaa

SEQ ID NO: 394435 - RNA, 22 nt, Human
ugcugggcuugaaagcugcuaa

SEQ ID NO: 394436 - RNA, 22 nt, Human
cuaaaauuaucaagauaauucc

SEQ ID NO: 394437 - RNA, 22 nt, Human
cagugcaguugguggcaggggu

SEQ ID NO: 394438 - RNA, 22 nt, Human
ugaagaagccaauugguaggcu

SEQ ID NO: 394439 - RNA, 22 nt, Human
gccuuggccuuccuaggccuga

SEQ ID NO: 394440 - RNA, 22 nt, Human
gugcauuggugcgccacuucac

SEQ ID NO: 394441 - RNA, 22 nt, Human
agucucuuuguggacucugccu

SEQ ID NO: 394442 - RNA, 22 nt, Human
aauucugugcaggcagagcuau

SEQ ID NO: 394443 - RNA, 20 nt, Human
cucugcuuuaggagagucag

SEQ ID NO: 394444 - RNA, 22 nt, Human
uuccuugguagagagaauauuu

SEQ ID NO: 394445 - RNA, 20 nt, Human
ugaugguucuuuccggguug

SEQ ID NO: 394446 - RNA, 22 nt, Human
ggcucagacucccaggcccucu

SEQ ID NO: 394447 - RNA, 21 nt, Human
agagaagggacucuuccaguc

SEQ ID NO: 394448 - RNA, 22 nt, Human
uuugaaaucuaaucaaggaaca

SEQ ID NO: 394449 - RNA, 22 nt, Human
cucauggauauaagaacuguuu

SEQ ID NO: 394450 - RNA, 22 nt, Human
cuuguggcccauggcuuccugc

SEQ ID NO: 394451 - RNA, 22 nt, Human
ccugcaggcugcaggccaguuc

SEQ ID NO: 394452 - RNA, 22 nt, Human
uaggcaacaugucgaauacugu

SEQ ID NO: 394453 - RNA, 22 nt, Human
caguguuugcuuaaguuauaug

SEQ ID NO: 394454 - RNA, 22 nt, Human
aguguuuagcaugaaguucauu

SEQ ID NO: 394455 - RNA, 22 nt, Human
aggcugagcggggucccagagc

SEQ ID NO: 394456 - RNA, 22 nt, Human
uccuggccugucuggaguagcu

SEQ ID NO: 394457 - RNA, 22 nt, Human
augguauugcaacaacugucau

SEQ ID NO: 394458 - RNA, 20 nt, Human
cccuggagagaagcuccacg

SEQ ID NO: 394459 - RNA, 22 nt, Human
ugacuucaaaggcucuacuccu

SEQ ID NO: 394460 - RNA, 22 nt, Human
auaugcacauacauacauaggu

SEQ ID NO: 394461 - RNA, 22 nt, Human
caaaugcaugagaaauaagagg

SEQ ID NO: 394462 - RNA, 22 nt, Human
agcagcugcagggagggucugc

SEQ ID NO: 394463 - RNA, 22 nt, Human
ugaggcaggaaguuauauaaug

SEQ ID NO: 394464 - RNA, 22 nt, Human
ugaacagaucaauagaacugac

SEQ ID NO: 394465 - RNA, 17 nt, Human
aguggcaggcagauggg

SEQ ID NO: 394466 - RNA, 22 nt, Human
aguuugaaaguauugacagaag

SEQ ID NO: 394467 - RNA, 22 nt, Human
auucuucauuguugauucaugu

SEQ ID NO: 394468 - RNA, 21 nt, Human
cauuucuauugaugagaaaag

SEQ ID NO: 394469 - RNA, 22 nt, Human
acuguucaaguuuuaugcugga

SEQ ID NO: 394470 - RNA, 22 nt, Human
gcacacaguauaugcucauuaa

SEQ ID NO: 394471 - RNA, 22 nt, Human
ugcuuucaaaggcuuucuagau

SEQ ID NO: 394472 - RNA, 22 nt, Human
ugccugggguuggcaaacugcu

SEQ ID NO: 394473 - RNA, 22 nt, Human
gaaauauuucucuugagccccu

SEQ ID NO: 394474 - RNA, 22 nt, Human
uucaagguaugguagcugguca

SEQ ID NO: 394475 - RNA, 22 nt, Human
gucugucucucuccagagugca

SEQ ID NO: 394476 - RNA, 19 nt, Human
ccugggagucagcugaagg

SEQ ID NO: 394477 - RNA, 22 nt, Human
agggcagcagcggcccaggccu

SEQ ID NO: 394478 - RNA, 22 nt, Human
agggcucugagugggaaagagg

SEQ ID NO: 394479 - RNA, 22 nt, Human
gcagugggcaacaagagcugga

SEQ ID NO: 394480 - RNA, 22 nt, Human
ugaaucauggauaaauagcuua

SEQ ID NO: 394481 - RNA, 22 nt, Human
ccuccaggauaagucagggccu

SEQ ID NO: 394482 - RNA, 19 nt, Human
ugcaagcuuuuucuuguua

SEQ ID NO: 394483 - RNA, 22 nt, Human
uaggccauucuuggagcuuacu

SEQ ID NO: 394484 - RNA, 22 nt, Human
guguaaggccccagguucuuua

SEQ ID NO: 394485 - RNA, 22 nt, Human
ccugccucaucaacuugucgug

SEQ ID NO: 394486 - RNA, 22 nt, Human
uuuccuaguucuaagaaaugua

SEQ ID NO: 394487 - RNA, 22 nt, Human
ggagccagggaagcugcuuccu

SEQ ID NO: 394488 - RNA, 21 nt, Human
ccccugggagcccugucagua

SEQ ID NO: 394489 - RNA, 22 nt, Human
ucuuugcaacucccauuuccau

SEQ ID NO: 394490 - RNA, 22 nt, Human
uccaugagagguaacuuuacaa

SEQ ID NO: 394491 - RNA, 17 nt, Human
ucuguccagggagugug

SEQ ID NO: 394492 - RNA, 22 nt, Human
cagagcagggguuucccagguu

SEQ ID NO: 394493 - RNA, 23 nt, Human
uccugagaugagacagugcugcc

SEQ ID NO: 394494 - RNA, 22 nt, Human
cagaaguaagauuacugugaga

SEQ ID NO: 394495 - RNA, 22 nt, Human
uuugcauuuccagaguagcaga

SEQ ID NO: 394496 - RNA, 22 nt, Human
cuggcuccauccuugagcucug

SEQ ID NO: 394497 - RNA, 22 nt, Human
ggaggccaucuggcuggaggcu

SEQ ID NO: 394498 - RNA, 19 nt, Human
gaucuuugccaauuuaagc

SEQ ID NO: 394499 - RNA, 22 nt, Human
caggcagagcaacugguccaga

SEQ ID NO: 394500 - RNA, 22 nt, Human
cagcagaggaaagcaaaucuaa

SEQ ID NO: 394501 - RNA, 22 nt, Human
ugcucucucaggccuggcccac

SEQ ID NO: 394502 - RNA, 21 nt, Human
caguguggugaccagggucuc

SEQ ID NO: 394503 - RNA, 22 nt, Human
aggcugcuuucauggccgcccc

SEQ ID NO: 394504 - RNA, 22 nt, Human
ucauuuguggaagugauugugg

SEQ ID NO: 394505 - RNA, 22 nt, Human
aacuagaacgucuaguugcugg

SEQ ID NO: 394506 - RNA, 19 nt, Human
aggcagcacccaguccuug

SEQ ID NO: 394507 - RNA, 22 nt, Human
uggaggaugccuggggaggccu

SEQ ID NO: 394508 - RNA, 22 nt, Human
augaggcagguggaggcugcca

SEQ ID NO: 394509 - RNA, 22 nt, Human
caggcugaucagggcugggaug

SEQ ID NO: 394510 - RNA, 22 nt, Human
caggggcugugggcggagccuc

SEQ ID NO: 394511 - RNA, 22 nt, Human
gcaugguggccuuaggguagcc

SEQ ID NO: 394512 - RNA, 22 nt, Human
ggaagccagaaagugagaauau

SEQ ID NO: 394513 - RNA, 22 nt, Human
acugaaggaaagccuuugcaug

SEQ ID NO: 394514 - RNA, 22 nt, Human
uaaggucauggugaauaauaag

SEQ ID NO: 394515 - RNA, 23 nt, Human
accaugaugggagugcaaauaag

SEQ ID NO: 394516 - RNA, 18 nt, Human
cagaggagagacauucag

SEQ ID NO: 394517 - RNA, 22 nt, Human
cugccaaggcuggggaggacaa

SEQ ID NO: 394518 - RNA, 22 nt, Human
guuuuuaucuaauagcaguuau

SEQ ID NO: 394519 - RNA, 22 nt, Human
uccuggaguauuucuguggugu

SEQ ID NO: 394520 - RNA, 22 nt, Human
caacagaaggaagcagggucag

SEQ ID NO: 394521 - RNA, 17 nt, Human
uccaggcagcaacugag

SEQ ID NO: 394522 - RNA, 22 nt, Human
uggccuggcugcccugucugga

SEQ ID NO: 394523 - RNA, 22 nt, Human
ggcucaggaccugggauugcca

SEQ ID NO: 394524 - RNA, 22 nt, Human
cacaagaaauaagcugccuuuc

SEQ ID NO: 394525 - RNA, 22 nt, Human
uuacaaaguucugaguucaaac

SEQ ID NO: 394526 - RNA, 22 nt, Human
uaucuguucaauggaagaugac

SEQ ID NO: 394527 - RNA, 22 nt, Human
aacuagaaccacuuguauuucc

SEQ ID NO: 394528 - RNA, 22 nt, Human
ucccaggaucugagggcagaga

SEQ ID NO: 394529 - RNA, 22 nt, Human
agaaaagggcaggagggauaca

SEQ ID NO: 394530 - RNA, 22 nt, Human
cagcagcaacaacggaagccuu

SEQ ID NO: 394531 - RNA, 22 nt, Human
ggcuucucucuucacauggcuu

SEQ ID NO: 394532 - RNA, 22 nt, Human
uuucuagugguuaagauuuaca

SEQ ID NO: 394533 - RNA, 22 nt, Human
ugcugaggucaccuugcugcua

SEQ ID NO: 394534 - RNA, 22 nt, Human
caggaacagcaccaggagcuag

SEQ ID NO: 394535 - RNA, 22 nt, Human
ggagaagcagcuucuugaugaa

SEQ ID NO: 394536 - RNA, 22 nt, Human
ggaagaggcugagccagguccc

SEQ ID NO: 394537 - RNA, 22 nt, Human
uaaggccaggcuguggucggca

SEQ ID NO: 394538 - RNA, 22 nt, Human
agggcugcaccggggcuucgcg

SEQ ID NO: 394539 - RNA, 22 nt, Human
aggcacuguggaagacaugguu

SEQ ID NO: 394540 - RNA, 22 nt, Human
ucacuguaucauguugcacuua

SEQ ID NO: 394541 - RNA, 22 nt, Human
gccaaaucuggauuuagcaaga

SEQ ID NO: 394542 - RNA, 22 nt, Human
uacaguaaccuuauuugucauu

SEQ ID NO: 394543 - RNA, 22 nt, Human
cuguacucaagguaaaccagga

SEQ ID NO: 394544 - RNA, 22 nt, Human
augucuuuuaugauuacgggau

SEQ ID NO: 394545 - RNA, 22 nt, Human
ucacauuuuuuacuggacuuaa

SEQ ID NO: 394546 - RNA, 19 nt, Human
uucccaggaaaggggugca

SEQ ID NO: 394547 - RNA, 21 nt, Human
aacugguucaauucaacuaga

SEQ ID NO: 394548 - RNA, 21 nt, Human
guauugcagaguuaugugcuc

SEQ ID NO: 394549 - RNA, 22 nt, Human
aauaucagcacuuuugugguau

SEQ ID NO: 394550 - RNA, 22 nt, Human
acacaaacugcuagaaaauugg

SEQ ID NO: 394551 - RNA, 22 nt, Human
aucauuccacauguaccacuag

SEQ ID NO: 394552 - RNA, 22 nt, Human
aucaguuuaaaugggcuguugg

SEQ ID NO: 394553 - RNA, 22 nt, Human
uagucaaaccucagaauacccc

SEQ ID NO: 394554 - RNA, 22 nt, Human
cuuuggcacagucucauuugau

SEQ ID NO: 394555 - RNA, 22 nt, Human
cugggcagugguggcaucuuug

SEQ ID NO: 394556 - RNA, 22 nt, Human
gcugucugucuucacaucucgc

SEQ ID NO: 394557 - RNA, 22 nt, Human
ucacauucucagcaucuauaca

SEQ ID NO: 394558 - RNA, 22 nt, Human
caggaacaauguaagucucauu

SEQ ID NO: 394559 - RNA, 22 nt, Human
cccuuucccuucuggcucaggg

SEQ ID NO: 394560 - RNA, 22 nt, Human
cagggcucagggacugcagaaa

SEQ ID NO: 394561 - RNA, 22 nt, Human
auggcuuuuuagacuuugguac

SEQ ID NO: 394562 - RNA, 22 nt, Human
uaaggccaaggggccauagucu

SEQ ID NO: 394563 - RNA, 20 nt, Human
gugccuggagaagaggcugu

SEQ ID NO: 394564 - RNA, 22 nt, Human
cugugucggacgugggcagcag

SEQ ID NO: 394565 - RNA, 22 nt, Human
cuuaaauuggaugaguuaaguu

SEQ ID NO: 394566 - RNA, 22 nt, Human
cacauguacagaagcaggcugg

SEQ ID NO: 394567 - RNA, 22 nt, Human
uucauucugggcucuaaggaac

SEQ ID NO: 394568 - RNA, 22 nt, Human
gaaugugucacccugucccaug

SEQ ID NO: 394569 - RNA, 22 nt, Human
cagguggagcugacugagggca

SEQ ID NO: 394570 - RNA, 22 nt, Human
ugaggcagguaagcaaguuuug

SEQ ID NO: 394571 - RNA, 22 nt, Human
gcaccaggcuuagagccccagg

SEQ ID NO: 394572 - RNA, 22 nt, Human
gcauucuuuuuaggagguuccu

SEQ ID NO: 394573 - RNA, 22 nt, Human
ugcugcacgauaaauaauuucu

SEQ ID NO: 394574 - RNA, 22 nt, Human
uggcagcauuuuuuccagaaca

SEQ ID NO: 394575 - RNA, 22 nt, Human
uggccucugcaauggauucacc

SEQ ID NO: 394576 - RNA, 22 nt, Human
agaaucugguagaaccaaggau

SEQ ID NO: 394577 - RNA, 22 nt, Human
aagcagugcgcucaucuaaggg

SEQ ID NO: 394578 - RNA, 22 nt, Human
aauucuauaggcaagcuauuuu

SEQ ID NO: 394579 - RNA, 22 nt, Human
cuccuuccugguuagcaccuua

SEQ ID NO: 394580 - RNA, 18 nt, Human
caaagcucacguuccauc

SEQ ID NO: 394581 - RNA, 22 nt, Human
ccaggccuagccccugagggua

SEQ ID NO: 394582 - RNA, 22 nt, Human
acagaaauugggcaaauggaag

SEQ ID NO: 394583 - RNA, 22 nt, Human
ccugcugggccugagcaaugag

SEQ ID NO: 394584 - RNA, 22 nt, Human
cugugggcugaaagugcucccg

SEQ ID NO: 394585 - RNA, 22 nt, Human
cuggugcaggaaggagcuggca

SEQ ID NO: 394586 - RNA, 22 nt, Human
gacccaggcucgugggacggcu

SEQ ID NO: 394587 - RNA, 22 nt, Human
cagagcaguaaaucuggggcac

SEQ ID NO: 394588 - RNA, 22 nt, Human
ggcugcucugccuuccagcugg

SEQ ID NO: 394589 - RNA, 22 nt, Human
uccaggcauuggagagauaaug

SEQ ID NO: 394590 - RNA, 22 nt, Human
aucccugcccucauggagcuua

SEQ ID NO: 394591 - RNA, 18 nt, Human
auccuugaugagaggucu

SEQ ID NO: 394592 - RNA, 22 nt, Human
agaguguuuuucugucaaggac

SEQ ID NO: 394593 - RNA, 22 nt, Human
ggcuggcuugccaagcucaggg

SEQ ID NO: 394594 - RNA, 22 nt, Human
accugccucagugcagcuggau

SEQ ID NO: 394595 - RNA, 22 nt, Human
cagggugcagugucgcugcuag

SEQ ID NO: 394596 - RNA, 22 nt, Human
uguggaaaauuggaacguuccu

SEQ ID NO: 394597 - RNA, 22 nt, Human
ucucagggcgcagugaggcagu

SEQ ID NO: 394598 - RNA, 22 nt, Human
caggcagaguuagagcaacugg

SEQ ID NO: 394599 - RNA, 22 nt, Human
uggccuggccacauccagcagg

SEQ ID NO: 394600 - RNA, 22 nt, Human
ucugcaggcucuagaugagguu

SEQ ID NO: 394601 - RNA, 22 nt, Human
auuuuuccaauuaggauaaaga

SEQ ID NO: 394602 - RNA, 22 nt, Human
uuuauugcauacacaaauguca

SEQ ID NO: 394603 - RNA, 22 nt, Human
agaagcugccuacaugaccagc

SEQ ID NO: 394604 - RNA, 19 nt, Human
cccaggagucuggcugguu

SEQ ID NO: 394605 - RNA, 22 nt, Human
aagccaggaagagagccuucac

SEQ ID NO: 394606 - RNA, 22 nt, Human
ggcaggagaauggcgugaacuc

SEQ ID NO: 394607 - RNA, 22 nt, Human
agcagggccaacaguaaacacc

SEQ ID NO: 394608 - RNA, 20 nt, Human
uguggcaggaugagggcgga

SEQ ID NO: 394609 - RNA, 22 nt, Human
cagguggguguaugaaugcaaa

SEQ ID NO: 394610 - RNA, 22 nt, Human
cacucugcagcugaagggcugg

SEQ ID NO: 394611 - RNA, 22 nt, Human
gcagggcuguggacacuuuggu

SEQ ID NO: 394612 - RNA, 22 nt, Human
uucaagaucgaguuuaaaguga

SEQ ID NO: 394613 - RNA, 22 nt, Human
gauuucaccugaucuugucauc

SEQ ID NO: 394614 - RNA, 22 nt, Human
agggccugacacccuugccagc

SEQ ID NO: 394615 - RNA, 22 nt, Human
aacauuucagcaaauaagaaca

SEQ ID NO: 394616 - RNA, 22 nt, Human
auauuagggucucuaaauucua

SEQ ID NO: 394617 - RNA, 17 nt, Human
ugagaaguaggcaucau

SEQ ID NO: 394618 - RNA, 22 nt, Human
uaaaauguagcuucuaggcugg

SEQ ID NO: 394619 - RNA, 22 nt, Human
guggcagcaaaauccugcauuc

SEQ ID NO: 394620 - RNA, 22 nt, Human
auuccaaacuuaccccagagga

SEQ ID NO: 394621 - RNA, 22 nt, Human
gagcuuuaccuuagguucuguu

SEQ ID NO: 394622 - RNA, 22 nt, Human
gauggggaugagaagugagcag

SEQ ID NO: 394623 - RNA, 22 nt, Human
agcaguggaccucagugcuauu

SEQ ID NO: 394624 - RNA, 22 nt, Human
cugccucaugcugccugcagcc

SEQ ID NO: 394625 - RNA, 22 nt, Human
gggagagaugcugauugccaau

SEQ ID NO: 394626 - RNA, 22 nt, Human
uagaaacugauagucuugugcu

SEQ ID NO: 394627 - RNA, 22 nt, Human
cagcuucuucaguccuggagcu

SEQ ID NO: 394628 - RNA, 22 nt, Human
uaguuuuuucaacaaauggugc

SEQ ID NO: 394629 - RNA, 22 nt, Human
cagguggggagaguguggagca

SEQ ID NO: 394630 - RNA, 22 nt, Human
caagagcuggagaggcagucua

SEQ ID NO: 394631 - RNA, 23 nt, Human
cccagcgcugagcccugcaggca

SEQ ID NO: 394632 - RNA, 22 nt, Human
uaugcauaauuggauaaguaga

SEQ ID NO: 394633 - RNA, 22 nt, Human
uccuuuuugguccaaggugacc

SEQ ID NO: 394634 - RNA, 22 nt, Human
ugaaggcccuaucuccauauac

SEQ ID NO: 394635 - RNA, 17 nt, Human
uuugaaaggaugucagu

SEQ ID NO: 394636 - RNA, 22 nt, Human
acagagcaguucuggagcuggc

SEQ ID NO: 394637 - RNA, 22 nt, Human
ccaaggagcaaggcucaacaag

SEQ ID NO: 394638 - RNA, 22 nt, Human
cagcuauuuucucauuaaggau

SEQ ID NO: 394639 - RNA, 22 nt, Human
uuacagaaaggaaggacugacu

SEQ ID NO: 394640 - RNA, 22 nt, Human
agugugagcccuggaguggugc

SEQ ID NO: 394641 - RNA, 20 nt, Human
agcagcuguguuuucauccu

SEQ ID NO: 394642 - RNA, 22 nt, Human
uucagaaaggauaauuggaagg

SEQ ID NO: 394643 - RNA, 22 nt, Human
gaaguucaaaagacagauuuga

SEQ ID NO: 394644 - RNA, 22 nt, Human
guucuaauauuuuaaaagccaa

SEQ ID NO: 394645 - RNA, 22 nt, Human
agcacauaccagaaccacaggu

SEQ ID NO: 394646 - RNA, 23 nt, Human
aaucuauacuuaggcugguaaua

SEQ ID NO: 394647 - RNA, 22 nt, Human
cauuuacauuuaagguuaauau

SEQ ID NO: 394648 - RNA, 23 nt, Human
guaaaauacgcagugcaguguga

SEQ ID NO: 394649 - RNA, 22 nt, Human
uauaaaauucucaguuuggggu

SEQ ID NO: 394650 - RNA, 22 nt, Human
uauuccaaaauaguuaagcacu

SEQ ID NO: 394651 - RNA, 22 nt, Human
uguccuuagaagaagugaaaga

SEQ ID NO: 394652 - RNA, 22 nt, Human
uuuacagauguggaaagugagc

SEQ ID NO: 394653 - RNA, 22 nt, Human
uuuucuuaggugcuccaaguag

SEQ ID NO: 394654 - RNA, 22 nt, Human
aagaaugauuacaaagcaacga

SEQ ID NO: 394655 - RNA, 22 nt, Human
uauuuaucgagugucuacuaug

SEQ ID NO: 394656 - RNA, 22 nt, Human
aucugacuucacgcccaugcca

SEQ ID NO: 394657 - RNA, 22 nt, Human
uuuccaaaggaguaccacgcau

SEQ ID NO: 394658 - RNA, 22 nt, Human
ucuuuaauucagcaugaugcgg

SEQ ID NO: 394659 - RNA, 22 nt, Human
auuuagccucauuuuugacaua

SEQ ID NO: 394660 - RNA, 22 nt, Human
caguccuugcucugggaugaug

SEQ ID NO: 394661 - RNA, 22 nt, Human
uguguaaaaucugauuaauacu

SEQ ID NO: 394662 - RNA, 22 nt, Human
acauucacgcucucaaagcuga

SEQ ID NO: 394663 - RNA, 22 nt, Human
uuuacagagaauguacauaaag

SEQ ID NO: 394664 - RNA, 22 nt, Human
uaaagccaauauaccuagcaua

SEQ ID NO: 394665 - RNA, 22 nt, Human
uagucaccucuuuaaauguccu

SEQ ID NO: 394666 - RNA, 22 nt, Human
cuggcuuuggucaugugaucau

SEQ ID NO: 394667 - RNA, 22 nt, Human
aggauuuauuccagaaaugcaa

SEQ ID NO: 394668 - RNA, 22 nt, Human
auuuaguguauucuaauaugug

SEQ ID NO: 394669 - RNA, 22 nt, Human
ugugugaaucuauugaauauau

SEQ ID NO: 394670 - RNA, 22 nt, Human
uuuaacuuaaucugcuugauga

SEQ ID NO: 394671 - RNA, 21 nt, Human
cucagagaaaugucugggagc

SEQ ID NO: 394672 - RNA, 22 nt, Human
uuucaguuagcugagacccagg

SEQ ID NO: 394673 - RNA, 22 nt, Human
auauuuaaacaggguaccaaua

SEQ ID NO: 394674 - RNA, 22 nt, Human
cucuuaaugaccuuaauucaag

SEQ ID NO: 394675 - RNA, 22 nt, Human
cauggcuuuuuagcauauucaa

SEQ ID NO: 394676 - RNA, 22 nt, Human
gcuuaauucuggcucaguuucc

SEQ ID NO: 394677 - RNA, 22 nt, Human
aauuuauauguaauuaggcaca

SEQ ID NO: 394678 - RNA, 22 nt, Human
aauuuacacuucauuuggaggg

SEQ ID NO: 394679 - RNA, 22 nt, Human
gagacaggauuuaaccaaagcu

SEQ ID NO: 394680 - RNA, 22 nt, Human
auucucaaaacauaacuucacu

SEQ ID NO: 394681 - RNA, 22 nt, Human
uuacagaaaggaaggacugacu

SEQ ID NO: 394682 - RNA, 20 nt, Human
uguaacaaucuggauguugc

SEQ ID NO: 394683 - RNA, 22 nt, Human
auggauuuggaugagauuacuu

SEQ ID NO: 394684 - RNA, 22 nt, Human
uauauuaaaugaccaguuuuaa

SEQ ID NO: 394685 - RNA, 22 nt, Human
caguccuuucaauggugaccuu

SEQ ID NO: 394686 - RNA, 22 nt, Human
cauggucuacaauuucauuuua

SEQ ID NO: 394687 - RNA, 22 nt, Human
gaguccuuuguuccuugccaca

SEQ ID NO: 394688 - RNA, 22 nt, Human
acacagauuuuacauguuaugc

SEQ ID NO: 394689 - RNA, 22 nt, Human
aacaugcuuugauaaauaaaag

SEQ ID NO: 394690 - RNA, 22 nt, Human
caauuucaugccauguauugcu

SEQ ID NO: 394691 - RNA, 22 nt, Human
gcuuuaaugaagucacgcaaag

SEQ ID NO: 394692 - RNA, 22 nt, Human
aggcuucugcugauauuucauu

SEQ ID NO: 394693 - RNA, 22 nt, Human
auacaugugggucuaaacauau

SEQ ID NO: 394694 - RNA, 22 nt, Human
aucuaaaguguuucaugaaaga

SEQ ID NO: 394695 - RNA, 22 nt, Human
aaaaucugcuuccuuuuacaga

SEQ ID NO: 394696 - RNA, 22 nt, Human
caguucacacugugcuaucugc

SEQ ID NO: 394697 - RNA, 19 nt, Human
aggauuuauuaugugcuca

SEQ ID NO: 394698 - RNA, 22 nt, Human
cuuucaacuacauacaggcgau

SEQ ID NO: 394699 - RNA, 22 nt, Human
caauuucauggauaaaagaugu

SEQ ID NO: 394700 - RNA, 22 nt, Human
uggauuuauuagguuggugaaa

SEQ ID NO: 394701 - RNA, 22 nt, Human
agucaccauuuucaccugccuc

SEQ ID NO: 394702 - RNA, 22 nt, Human
ucagaaaauaacuguuaguuug

SEQ ID NO: 394703 - RNA, 22 nt, Human
uaaacauggcuguuucaguuau

SEQ ID NO: 394704 - RNA, 22 nt, Human
guacagaaggauuucuaguagu

SEQ ID NO: 394705 - RNA, 22 nt, Human
auggcuuucucuaaugugguau

SEQ ID NO: 394706 - RNA, 22 nt, Human
uagaaacagaaaacuguaauag

SEQ ID NO: 394707 - RNA, 22 nt, Human
uuagaaauauggugcugccgcc

SEQ ID NO: 394708 - RNA, 22 nt, Human
uauguuaagugggauaaucaaa

SEQ ID NO: 394709 - RNA, 22 nt, Human
uacuaaacaucuggcauuaaau

SEQ ID NO: 394710 - RNA, 22 nt, Human
augaaaauugacagcggaagua

SEQ ID NO: 394711 - RNA, 22 nt, Human
ugcuuaauguacgugaguguac

SEQ ID NO: 394712 - RNA, 22 nt, Human
uucagaaacaucaguggaugga

SEQ ID NO: 394713 - RNA, 22 nt, Human
uugauccaguugaaagugauga

SEQ ID NO: 394714 - RNA, 22 nt, Human
acuuugaaagccuuggccccgg

SEQ ID NO: 394715 - RNA, 22 nt, Human
uguccuuaucuccaaacaauca

SEQ ID NO: 394716 - RNA, 22 nt, Human
acagaauuugcuugggcaaugg

SEQ ID NO: 394717 - RNA, 22 nt, Human
aguauuuagcauagugguuagu

SEQ ID NO: 394718 - RNA, 22 nt, Human
ugagacaaaauugacagacaaa

SEQ ID NO: 394719 - RNA, 21 nt, Human
ucuauucauuacaguuauuug

SEQ ID NO: 394720 - RNA, 22 nt, Human
aaaguccuugcaguuuccucuu

SEQ ID NO: 394721 - RNA, 22 nt, Human
ccuucaaucagcagucuagcuu

SEQ ID NO: 394722 - RNA, 22 nt, Human
cuuuaacaaaugacucuugucu

SEQ ID NO: 394723 - RNA, 22 nt, Human
aauaauuagugggacagagaac

SEQ ID NO: 394724 - RNA, 22 nt, Human
agauauaauaauuuacaagugu

SEQ ID NO: 394725 - RNA, 22 nt, Human
agcauuuaagcuucugcaaagc

SEQ ID NO: 394726 - RNA, 22 nt, Human
ucaguuucuaaaucuuaccaau

SEQ ID NO: 394727 - RNA, 22 nt, Human
auauaggcuaacaacuauugag

SEQ ID NO: 394728 - RNA, 22 nt, Human
uaaagacacugguuuuaaucau

SEQ ID NO: 394729 - RNA, 22 nt, Human
aagcccagcugaaagcauuuuu

SEQ ID NO: 394730 - RNA, 22 nt, Human
uggcuuuaggagcuauauaccu

SEQ ID NO: 394731 - RNA, 22 nt, Human
cagaauuuagcacaauguaugg

SEQ ID NO: 394732 - RNA, 22 nt, Human
gcauggcugguguccugaggga

SEQ ID NO: 394733 - RNA, 22 nt, Human
aacuggauuaacuggcucaaau

SEQ ID NO: 394734 - RNA, 22 nt, Human
caaguccaucagauaagcaaga

SEQ ID NO: 394735 - RNA, 22 nt, Human
auaaagucauuaugaagaucua

SEQ ID NO: 394736 - RNA, 22 nt, Human
aaguccuucuuuauaugagagu

SEQ ID NO: 394737 - RNA, 21 nt, Human
auacagaaggcagacucucuc

SEQ ID NO: 394738 - RNA, 22 nt, Human
aagucacccacaggcagcagaa

SEQ ID NO: 394739 - RNA, 22 nt, Human
gaauuucaacaguccucaaaug

SEQ ID NO: 394740 - RNA, 22 nt, Human
uucugaaaauugggucauacuu

SEQ ID NO: 394741 - RNA, 21 nt, Human
gauaaaaugggccuugguccu

SEQ ID NO: 394742 - RNA, 22 nt, Human
aaagucaucuaggagcagauuu

SEQ ID NO: 394743 - RNA, 22 nt, Human
ugaauaauccacagucauucau

SEQ ID NO: 394744 - RNA, 22 nt, Human
acaaaaagggagaugagguaga

SEQ ID NO: 394745 - RNA, 22 nt, Human
aggauuuagcaugaaaugugaa

SEQ ID NO: 394746 - RNA, 20 nt, Human
uacuggauuagggcucaccc

SEQ ID NO: 394747 - RNA, 22 nt, Human
auggcauuccaagucuucuuuu

SEQ ID NO: 394748 - RNA, 22 nt, Human
ucaaguuuaauugagauguuua

SEQ ID NO: 394749 - RNA, 22 nt, Human
cuauuacauuucuggacauuca

SEQ ID NO: 394750 - RNA, 22 nt, Human
ucagccaguugccccaguuagu

SEQ ID NO: 394751 - RNA, 22 nt, Human
uauauacuuucuuccuggguag

SEQ ID NO: 394752 - RNA, 22 nt, Human
aaagccauuacaaaauuucaua

SEQ ID NO: 394753 - RNA, 22 nt, Human
uuuaggcaaacucauugucaga

SEQ ID NO: 394754 - RNA, 22 nt, Human
agucaccaggguuugcuggguu

SEQ ID NO: 394755 - RNA, 22 nt, Human
cugaauaauacagacuagcuuc

SEQ ID NO: 394756 - RNA, 22 nt, Human
cuucuuaaaguugucacagcug

SEQ ID NO: 394757 - RNA, 22 nt, Human
aaguuucaugauguaauuauug

SEQ ID NO: 394758 - RNA, 22 nt, Human
uuuaggcagcuacauacuaacu

SEQ ID NO: 394759 - RNA, 22 nt, Human
auaaagcaucuagucugucacu

SEQ ID NO: 394760 - RNA, 20 nt, Human
agaagucagcucagaaguga

SEQ ID NO: 394761 - RNA, 22 nt, Human
gauuucaaggaguuuucacagu

SEQ ID NO: 394762 - RNA, 22 nt, Human
gaugggauuuuuuauguguuca

SEQ ID NO: 394763 - RNA, 22 nt, Human
acuauacagaagaggauaggaa

SEQ ID NO: 394764 - RNA, 22 nt, Human
auaaacucaugccaagaaauga

SEQ ID NO: 394765 - RNA, 22 nt, Human
ugugaaagagucuuauaguuuc

SEQ ID NO: 394766 - RNA, 22 nt, Human
gcaacuuuagggccagcaagua

SEQ ID NO: 394767 - RNA, 22 nt, Human
uagaacuacaagcauuaaaagu

SEQ ID NO: 394768 - RNA, 22 nt, Human
uucaacccaaguucuccauuuu

SEQ ID NO: 394769 - RNA, 22 nt, Human
uuaaagaauagugccccuauug

SEQ ID NO: 394770 - RNA, 22 nt, Human
uagcaucuggagaaacaagucc

SEQ ID NO: 394771 - RNA, 22 nt, Human
uaauuuaugaugcaaagaaaag

SEQ ID NO: 394772 - RNA, 22 nt, Human
aucagaaauugcccagcuguuu

SEQ ID NO: 394773 - RNA, 22 nt, Human
cagaaauaaacuucucacaucg

SEQ ID NO: 394774 - RNA, 22 nt, Human
ucagaauucuacaauagaucag

SEQ ID NO: 394775 - RNA, 22 nt, Human
ccaaacaaauccccauucuuag

SEQ ID NO: 394776 - RNA, 22 nt, Human
gaaaauagcagauagaccaaug

SEQ ID NO: 394777 - RNA, 22 nt, Human
guuauaaaaugcacaguuguuu

SEQ ID NO: 394778 - RNA, 22 nt, Human
cagauauuaggagcucaauaau

SEQ ID NO: 394779 - RNA, 21 nt, Human
ucauucacaggguauuguaua

SEQ ID NO: 394780 - RNA, 20 nt, Human
caucagaaauccugacccac

SEQ ID NO: 394781 - RNA, 22 nt, Human
uucauuugccaucaguguaaug

SEQ ID NO: 394782 - RNA, 22 nt, Human
augugaaagagguguucagugg

SEQ ID NO: 394783 - RNA, 22 nt, Human
cugugcagcuggcuuccuggaa

SEQ ID NO: 394784 - RNA, 22 nt, Human
ugaaacuaggccaaucaaauua

SEQ ID NO: 394785 - RNA, 22 nt, Human
aaugaaacuguauauagacugu

SEQ ID NO: 394786 - RNA, 22 nt, Human
aggauuuauuauaugcccucau

SEQ ID NO: 394787 - RNA, 22 nt, Human
caagauuugccaguggccaacu

SEQ ID NO: 394788 - RNA, 22 nt, Human
augaauaaaacauuuuaaucag

SEQ ID NO: 394789 - RNA, 22 nt, Human
guacagaaaugugaugacgcaa

SEQ ID NO: 394790 - RNA, 22 nt, Human
aauuucaaugcacucaugguug

SEQ ID NO: 394791 - RNA, 22 nt, Human
acuggaugaggggaaagagaca

SEQ ID NO: 394792 - RNA, 22 nt, Human
gugcauuugacgaauacucacu

SEQ ID NO: 394793 - RNA, 21 nt, Human
uguccuuaaugcaauguccuu

SEQ ID NO: 394794 - RNA, 22 nt, Human
auuucaacauucucaguuguag

SEQ ID NO: 394795 - RNA, 22 nt, Human
caaaauuguugaugcugcuuug

SEQ ID NO: 394796 - RNA, 22 nt, Human
aacauguaaauaucauuguacu

SEQ ID NO: 394797 - RNA, 22 nt, Human
auguuucaccagcaaauuaccu

SEQ ID NO: 394798 - RNA, 22 nt, Human
auucaacggguagaagggucuu

SEQ ID NO: 394799 - RNA, 22 nt, Human
aauaaaauggucaguuuucuca

SEQ ID NO: 394800 - RNA, 22 nt, Human
aaaugcuuauuagugucacaaa

SEQ ID NO: 394801 - RNA, 22 nt, Human
ucaauacuuaagcuuaauucua

SEQ ID NO: 394802 - RNA, 22 nt, Human
caugcuuaugauuugcuaagcc

SEQ ID NO: 394803 - RNA, 22 nt, Human
aaguccuuggagaauagaaagg

SEQ ID NO: 394804 - RNA, 22 nt, Human
ucauauaaguuuaaaacuaucu

SEQ ID NO: 394805 - RNA, 22 nt, Human
uguccuuaaggagcuuaauguc

SEQ ID NO: 394806 - RNA, 22 nt, Human
aaaugucagaagcuuuacuucu

SEQ ID NO: 394807 - RNA, 22 nt, Human
auacaaauuuauagaugcauuu

SEQ ID NO: 394808 - RNA, 22 nt, Human
uaugaaagaaucucagagcaca

SEQ ID NO: 394809 - RNA, 22 nt, Human
auuguuaauguugcacuaaggu

SEQ ID NO: 394810 - RNA, 22 nt, Human
cauuucaaugccuucaacauag

SEQ ID NO: 394811 - RNA, 22 nt, Human
ugcaggaauagcuacagagcug

SEQ ID NO: 394812 - RNA, 22 nt, Human
aaacaaacauagguuugaaagu

SEQ ID NO: 394813 - RNA, 22 nt, Human
uuuauuaugauggacaccuucg

SEQ ID NO: 394814 - RNA, 22 nt, Human
guagaaauuccauuuacuuuga

SEQ ID NO: 394815 - RNA, 22 nt, Human
ucauaaaaguacucauguucau

SEQ ID NO: 394816 - RNA, 22 nt, Human
acaggauuagcaaguaaucagg

SEQ ID NO: 394817 - RNA, 22 nt, Human
uguacaauggcuauaauacccu

SEQ ID NO: 394818 - RNA, 22 nt, Human
aagcauuuuguuuuaagaauga

SEQ ID NO: 394819 - RNA, 22 nt, Human
uuuagaaugugacuguauuuga

SEQ ID NO: 394820 - RNA, 22 nt, Human
caauuucaaugaggccacaggg

SEQ ID NO: 394821 - RNA, 19 nt, Human
ucucuacacuacauuucua

SEQ ID NO: 394822 - RNA, 22 nt, Human
uagaugcuguagaaauacuuau

SEQ ID NO: 394823 - RNA, 22 nt, Human
uauuacaauuuacauugcacuu

SEQ ID NO: 394824 - RNA, 22 nt, Human
uccuggauaucaaacaaacauu

SEQ ID NO: 394825 - RNA, 22 nt, Human
auucauuagccacuaacuagca

SEQ ID NO: 394826 - RNA, 22 nt, Human
aaagccaucaguaaaaugauuu

SEQ ID NO: 394827 - RNA, 22 nt, Human
gauggcuucacuuacauggcug

SEQ ID NO: 394828 - RNA, 22 nt, Human
cuuaggcauccaggguucuucc

SEQ ID NO: 394829 - RNA, 22 nt, Human
acaugcuuuaacuuauuuugau

SEQ ID NO: 394830 - RNA, 22 nt, Human
cagaauuuuucgaauguacugu

SEQ ID NO: 394831 - RNA, 22 nt, Human
uauuaaagagagaaucaucauc

SEQ ID NO: 394832 - RNA, 22 nt, Human
uaaagucagauaucuggguuga

SEQ ID NO: 394833 - RNA, 19 nt, Human
augcuuuauguuauuucuu

SEQ ID NO: 394834 - RNA, 22 nt, Human
uaaucauggccucaaauuuuau

SEQ ID NO: 394835 - RNA, 22 nt, Human
uucacagagaguaugcagagaa

SEQ ID NO: 394836 - RNA, 22 nt, Human
ccagcugucagugugaaaauaa

SEQ ID NO: 394837 - RNA, 22 nt, Human
uugaagaaauuauuuuauauag

SEQ ID NO: 394838 - RNA, 22 nt, Human
aaacagacugcacugccaguca

SEQ ID NO: 394839 - RNA, 22 nt, Human
ucacaucaacauuauagcauga

SEQ ID NO: 394840 - RNA, 22 nt, Human
acaaaauuguguuaaacuuuau

SEQ ID NO: 394841 - RNA, 22 nt, Human
uguagaaagaauauguuucaua

SEQ ID NO: 394842 - RNA, 22 nt, Human
uuauaacaacaguuuacuuuaa

SEQ ID NO: 394843 - RNA, 22 nt, Human
agaucauaugaaaaauuucaag

SEQ ID NO: 394844 - RNA, 22 nt, Human
uuaaaauuauggcccauuugga

SEQ ID NO: 394845 - RNA, 22 nt, Human
gaauuucauugcucugcugugu

SEQ ID NO: 394846 - RNA, 22 nt, Human
auuauaaauauuuucuaggggu

SEQ ID NO: 394847 - RNA, 22 nt, Human
ggcauuuacauaaucuuauuua

SEQ ID NO: 394848 - RNA, 22 nt, Human
ccagaucuaguguuguaaagcu

SEQ ID NO: 394849 - RNA, 22 nt, Human
ugugaauaaugccgcaauaaac

SEQ ID NO: 394850 - RNA, 22 nt, Human
aggcuucugugagcucauacaa

SEQ ID NO: 394851 - RNA, 22 nt, Human
aaucagaacuucucaggguggg

SEQ ID NO: 394852 - RNA, 23 nt, Human
cagaaauaaacugguuuguagau

SEQ ID NO: 394853 - RNA, 22 nt, Human
ugcuuauugcuuucaagacugu

SEQ ID NO: 394854 - RNA, 22 nt, Human
ccuggaucuuuguuguaaauau

SEQ ID NO: 394855 - RNA, 22 nt, Human
ggcauuuauuugucucauucuu

SEQ ID NO: 394856 - RNA, 22 nt, Human
uucaaacauucaaauaaaccgg

SEQ ID NO: 394857 - RNA, 22 nt, Human
uguaaauaaugcauguaaauca

SEQ ID NO: 394858 - RNA, 20 nt, Human
aucaaaggcugauucagucc

SEQ ID NO: 394859 - RNA, 22 nt, Human
aaguccuucccaagcauguacc

SEQ ID NO: 394860 - RNA, 22 nt, Human
uacagaauuagauuauuagaga

SEQ ID NO: 394861 - RNA, 22 nt, Human
auggcuuucagauuucuauguu

SEQ ID NO: 394862 - RNA, 22 nt, Human
auuaggcagacaacguagccgg

SEQ ID NO: 394863 - RNA, 22 nt, Human
auuauaaagaacaugugugugg

SEQ ID NO: 394864 - RNA, 22 nt, Human
uuacagaaaagggguuguccuu

SEQ ID NO: 394865 - RNA, 22 nt, Human
uaaagucaucuuuacaucuuug

SEQ ID NO: 394866 - RNA, 22 nt, Human
uaugaaaauuuagcugaagcau

SEQ ID NO: 394867 - RNA, 22 nt, Human
acaacuuuaauggguuucagcu

SEQ ID NO: 394868 - RNA, 22 nt, Human
uguagaaauuaguaagaucaac

SEQ ID NO: 394869 - RNA, 22 nt, Human
uuuaggcacagggaguugguuu

SEQ ID NO: 394870 - RNA, 22 nt, Human
aaucagaaauugagggucuggu

SEQ ID NO: 394871 - RNA, 19 nt, Human
ugcuuaauuccuaguaggu

SEQ ID NO: 394872 - RNA, 22 nt, Human
cugaauaauuuuauaguugcug

SEQ ID NO: 394873 - RNA, 22 nt, Human
cuagaaaucucuguuuacauca

SEQ ID NO: 394874 - RNA, 22 nt, Human
augugaaaccugugaguagagu

SEQ ID NO: 394875 - RNA, 22 nt, Human
auuaggcagugccauuguacgg

SEQ ID NO: 394876 - RNA, 22 nt, Human
uccagaauauuugggaaagaug

SEQ ID NO: 394877 - RNA, 22 nt, Human
auucuuaauugccaugcuguau

SEQ ID NO: 394878 - RNA, 22 nt, Human
gauuucaauccagcuuucuucu

SEQ ID NO: 394879 - RNA, 22 nt, Human
ucauagaaugaguuaaugaacu

SEQ ID NO: 394880 - RNA, 22 nt, Human
gugauuuagauguugaaaguga

SEQ ID NO: 394881 - RNA, 22 nt, Human
acaucugaccauuacaagacau

SEQ ID NO: 394882 - RNA, 22 nt, Human
aguccuuagaacacuguaucug

SEQ ID NO: 394883 - RNA, 22 nt, Human
acacaauacagggcucaaaaua

SEQ ID NO: 394884 - RNA, 22 nt, Human
aacaugucuggguauucacaag

SEQ ID NO: 394885 - RNA, 22 nt, Human
aaguguuaaagacuugaacacu

SEQ ID NO: 394886 - RNA, 22 nt, Human
uucaaacaguguagaauauaug

SEQ ID NO: 394887 - RNA, 22 nt, Human
uuauccaaacuggugaaucauu

SEQ ID NO: 394888 - RNA, 22 nt, Human
aucaaaaccuugacuuuuaaug

SEQ ID NO: 394889 - RNA, 22 nt, Human
guuaggcaauaccucuuacacc

SEQ ID NO: 394890 - RNA, 17 nt, Human
uaaguccuaguuauuuu

SEQ ID NO: 394891 - RNA, 22 nt, Human
ggccuuuaagcaauugaaaaga

SEQ ID NO: 394892 - RNA, 22 nt, Human
ggauucagugucuguuaauagu

SEQ ID NO: 394893 - RNA, 22 nt, Human
gucauaaagcuuguugcauuua

SEQ ID NO: 394894 - RNA, 22 nt, Human
auggcuuuucacagaggguucu

SEQ ID NO: 394895 - RNA, 22 nt, Human
gucaaacauagggacuuugugg

SEQ ID NO: 394896 - RNA, 22 nt, Human
agaauaucguagcauauuaucu

SEQ ID NO: 394897 - RNA, 22 nt, Human
gaguccuuuucucuguccacug

SEQ ID NO: 394898 - RNA, 22 nt, Human
gaauuucagagguaacaucauc

SEQ ID NO: 394899 - RNA, 23 nt, Human
uguaacaauucccagccuuugcc

SEQ ID NO: 394900 - RNA, 22 nt, Human
gauuuccauuuucaacuccugc

SEQ ID NO: 394901 - RNA, 22 nt, Human
acuuuaauuaaugaacuguggc

SEQ ID NO: 394902 - RNA, 22 nt, Human
acuauacaagauuagggauuug

SEQ ID NO: 394903 - RNA, 22 nt, Human
gaaagccagagagaaagggcuc

SEQ ID NO: 394904 - RNA, 22 nt, Human
ucaaaauucuagggagaauggu

SEQ ID NO: 394905 - RNA, 22 nt, Human
ugcagucuccaccuccugggug

SEQ ID NO: 394906 - RNA, 22 nt, Human
aaguccuuauguggaggggcua

SEQ ID NO: 394907 - RNA, 22 nt, Human
uaaaaguauacuuucaaaggag

SEQ ID NO: 394908 - RNA, 20 nt, Human
uuacagaaaugauguuauuu

SEQ ID NO: 394909 - RNA, 22 nt, Human
auuucaacagaguuugaaggca

SEQ ID NO: 394910 - RNA, 23 nt, Human
cauuucaacgaauuuuccuucug

SEQ ID NO: 394911 - RNA, 22 nt, Human
ucaauacauacaauguauagug

SEQ ID NO: 394912 - RNA, 22 nt, Human
caggccaggguugagaagagaa

SEQ ID NO: 394913 - RNA, 22 nt, Human
aaagccauugaacuguacuuua

SEQ ID NO: 394914 - RNA, 22 nt, Human
auaaaugccucagaaucauccc

SEQ ID NO: 394915 - RNA, 22 nt, Human
uuccauaauaggcuuaagugaa

SEQ ID NO: 394916 - RNA, 22 nt, Human
uaagacuucauuaguaauaugg

SEQ ID NO: 394917 - RNA, 22 nt, Human
uaaaguuuguagcaauugauau

SEQ ID NO: 394918 - RNA, 22 nt, Human
aguccuuacucgggggcccaga

SEQ ID NO: 394919 - RNA, 22 nt, Human
uuggaucacucugaagccuuac

SEQ ID NO: 394920 - RNA, 22 nt, Human
ucuauaaagggccagauaguag

SEQ ID NO: 394921 - RNA, 22 nt, Human
ccuggaucuaaggaagcuggga

SEQ ID NO: 394922 - RNA, 22 nt, Human
caaaauugaugaauguaugauu

SEQ ID NO: 394923 - RNA, 22 nt, Human
caguaaauuaucucaucucugu

SEQ ID NO: 394924 - RNA, 22 nt, Human
ucaguaaaguucuuucuugcug

SEQ ID NO: 394925 - RNA, 22 nt, Human
aagaaaucugauauuuguuuca

SEQ ID NO: 394926 - RNA, 22 nt, Human
uaguccuugcugggcacagagu

SEQ ID NO: 394927 - RNA, 22 nt, Human
aagauauacuauuaaguaccau

SEQ ID NO: 394928 - RNA, 22 nt, Human
aaaacaguuuuugcuaacugcu

SEQ ID NO: 394929 - RNA, 22 nt, Human
auuccaaacagugcugcagacu

SEQ ID NO: 394930 - RNA, 22 nt, Human
uuuauacauggagaauuuuugc

SEQ ID NO: 394931 - RNA, 22 nt, Human
ucuuaauucugugucuucacua

SEQ ID NO: 394932 - RNA, 22 nt, Human
uuccuuaguguuagauucugug

SEQ ID NO: 394933 - RNA, 22 nt, Human
cugaaagaauaagauguuuaca

SEQ ID NO: 394934 - RNA, 22 nt, Human
uaucagaaugcagccaugugca

SEQ ID NO: 394935 - RNA, 22 nt, Human
gugaacuauuggguaucauaaa

SEQ ID NO: 394936 - RNA, 22 nt, Human
agucauuuugccagucuucagg

SEQ ID NO: 394937 - RNA, 22 nt, Human
aggauuuauuggugggaaguua

SEQ ID NO: 394938 - RNA, 22 nt, Human
ugcaggaaaaccaacacgccuu

SEQ ID NO: 394939 - RNA, 22 nt, Human
uuacaagauuaauuauuggagu

SEQ ID NO: 394940 - RNA, 23 nt, Human
aagaaugcuucugaagagcugcc

SEQ ID NO: 394941 - RNA, 22 nt, Human
guuaaagaguuuggcuuucuuc

SEQ ID NO: 394942 - RNA, 20 nt, Human
aguacaauguaugauucaga

SEQ ID NO: 394943 - RNA, 22 nt, Human
augacaaaagaagacaugaggu

SEQ ID NO: 394944 - RNA, 22 nt, Human
gagauuuaauuggauuaacuua

SEQ ID NO: 394945 - RNA, 22 nt, Human
aaauaucauuuauaacuuuuaa

SEQ ID NO: 394946 - RNA, 22 nt, Human
guacagaaaguacccauagaag

SEQ ID NO: 394947 - RNA, 22 nt, Human
aucaguuaguuacugcuaagau

SEQ ID NO: 394948 - RNA, 22 nt, Human
aaagccaucuguauuaagugaa

SEQ ID NO: 394949 - RNA, 22 nt, Human
ccaugcacaccagcaggcagac

SEQ ID NO: 394950 - RNA, 22 nt, Human
uauggcuuuucauuccuaugug

SEQ ID NO: 394951 - RNA, 22 nt, Human
uuaggaaauuccaccuguauuc

SEQ ID NO: 394952 - RNA, 22 nt, Human
uuccuuagggaaagggauaagg

SEQ ID NO: 394953 - RNA, 22 nt, Human
uagaauucaagauucaacaggc

SEQ ID NO: 394954 - RNA, 22 nt, Human
ucauaauacaaagaguucugca

SEQ ID NO: 394955 - RNA, 22 nt, Human
aauuucaagucuugaagaagua

SEQ ID NO: 394956 - RNA, 22 nt, Human
uguccuuauaagaaaaggaaau

SEQ ID NO: 394957 - RNA, 22 nt, Human
cuuaggcaagcagagcccaucc

SEQ ID NO: 394958 - RNA, 22 nt, Human
uuaauauguugaaauuuauuag

SEQ ID NO: 394959 - RNA, 21 nt, Human
acaugucuggucauuuuuagc

SEQ ID NO: 394960 - RNA, 22 nt, Human
uaccaaaaccaagccauuaucu

SEQ ID NO: 394961 - RNA, 22 nt, Human
caaaacugucuagagagagaag

SEQ ID NO: 394962 - RNA, 22 nt, Human
ucacaucauuaagacuucuccu

SEQ ID NO: 394963 - RNA, 22 nt, Human
uuucaacuagccccuaaguccu

SEQ ID NO: 394964 - RNA, 22 nt, Human
caacagucugguuuauauaaua

SEQ ID NO: 394965 - RNA, 22 nt, Human
uacagagauuuauugcuaaggc

SEQ ID NO: 394966 - RNA, 22 nt, Human
gaaagccauagcccagcuuuac

SEQ ID NO: 394967 - RNA, 22 nt, Human
uugguacaaugugcuagguagg

SEQ ID NO: 394968 - RNA, 22 nt, Human
gaucagaauucuuguguguuuc

SEQ ID NO: 394969 - RNA, 22 nt, Human
aauaaccuuacuuauuacaugg

SEQ ID NO: 394970 - RNA, 22 nt, Human
uagaugcuacaauuuuguacuc

SEQ ID NO: 394971 - RNA, 22 nt, Human
guagaaauagugguugacagga

SEQ ID NO: 394972 - RNA, 23 nt, Human
gaaucaguggcuaacaaggaaac

SEQ ID NO: 394973 - RNA, 22 nt, Human
auacagaagaccccuccgucau

SEQ ID NO: 394974 - RNA, 19 nt, Human
gaaguccucuaguaaauuu

SEQ ID NO: 394975 - RNA, 22 nt, Human
acaacuuuguagcaauuccacg

SEQ ID NO: 394976 - RNA, 22 nt, Human
agguauuauuagcaucucuauu

SEQ ID NO: 394977 - RNA, 22 nt, Human
ucaccagucuuucuuaccauug

SEQ ID NO: 394978 - RNA, 22 nt, Human
aaauggauggaaagcaauuuuu

SEQ ID NO: 394979 - RNA, 22 nt, Human
gccuuaauuuuuuauaaucucu

SEQ ID NO: 394980 - RNA, 22 nt, Human
uuagaaaugucacagaucugau

SEQ ID NO: 394981 - RNA, 22 nt, Human
uuacagaaucuacucgugguga

SEQ ID NO: 394982 - RNA, 22 nt, Human
caauuucagucucagagaguuc

SEQ ID NO: 394983 - RNA, 22 nt, Human
aaauagcauaaaauaggaagcu

SEQ ID NO: 394984 - RNA, 22 nt, Human
ugcuuauuuauagucaauagag

SEQ ID NO: 394985 - RNA, 22 nt, Human
uaaagucaucuuuaaacaugcc

SEQ ID NO: 394986 - RNA, 19 nt, Human
aacuguaauuaauacccua

SEQ ID NO: 394987 - RNA, 22 nt, Human
ucuauaaaugcagauaugugug

SEQ ID NO: 394988 - RNA, 22 nt, Human
ucauaaaguucuaagaauugua

SEQ ID NO: 394989 - RNA, 22 nt, Human
cuacagaagccguggucaggaa

SEQ ID NO: 394990 - RNA, 22 nt, Human
caauuucacugacacccuggaa

SEQ ID NO: 394991 - RNA, 21 nt, Human
aauccuuaaugaggaguuggu

SEQ ID NO: 394992 - RNA, 22 nt, Human
uaaguaaauuuauaaugugauu

SEQ ID NO: 394993 - RNA, 22 nt, Human
gugaauaaccuacuccaggccu

SEQ ID NO: 394994 - RNA, 17 nt, Human
caauuucauagguuuug

SEQ ID NO: 394995 - RNA, 22 nt, Human
aaacggauauaacagcaaacgc

SEQ ID NO: 394996 - RNA, 22 nt, Human
aagacuuucaaguaugcaugca

SEQ ID NO: 394997 - RNA, 22 nt, Human
uguucacaaggugaugcuuuga

SEQ ID NO: 394998 - RNA, 22 nt, Human
uuuaaagaaauuccucaucuuu

SEQ ID NO: 394999 - RNA, 22 nt, Human
gaguccuugucauaauucagug

SEQ ID NO: 395000 - RNA, 22 nt, Human
aaauugaaugauuaagugguga

SEQ ID NO: 395001 - RNA, 22 nt, Human
cagaauaaaagucccaaggcau

SEQ ID NO: 395002 - RNA, 22 nt, Human
cuuaaccagaaaaugcacuugu

SEQ ID NO: 395003 - RNA, 23 nt, Human
cagaaaucugaaaucuagaaaug

SEQ ID NO: 395004 - RNA, 21 nt, Human
uguguaaaguugaaauccugu

SEQ ID NO: 395005 - RNA, 22 nt, Human
uugauggcugugauuuacucag

SEQ ID NO: 395006 - RNA, 22 nt, Human
uuugaagacauauuguuacaua

SEQ ID NO: 395007 - RNA, 22 nt, Human
gauuucaaaaguagauccauca

SEQ ID NO: 395008 - RNA, 22 nt, Human
ugcaggaaugagguucucaguu

SEQ ID NO: 395009 - RNA, 22 nt, Human
aaaagccaagguccucuucaga

SEQ ID NO: 395010 - RNA, 22 nt, Human
aucagaaacucuuagagcaggg

SEQ ID NO: 395011 - RNA, 22 nt, Human
caugguuuugagccuauuaugc

SEQ ID NO: 395012 - RNA, 22 nt, Human
aguucacagccauguucaugug

SEQ ID NO: 395013 - RNA, 20 nt, Human
gauuucaaagcagaguggcc

SEQ ID NO: 395014 - RNA, 22 nt, Human
uuacagaaaguuucccaugccg

SEQ ID NO: 395015 - RNA, 22 nt, Human
gauaaaauaacuauggaauacu

SEQ ID NO: 395016 - RNA, 22 nt, Human
uacugaaaguggucaacagugg

SEQ ID NO: 395017 - RNA, 22 nt, Human
auuucaggagcaguuucagugg

SEQ ID NO: 395018 - RNA, 22 nt, Human
ucaaacagaggaacaauuguuu

SEQ ID NO: 395019 - RNA, 22 nt, Human
aaaucaguuggaacacaagcag

SEQ ID NO: 395020 - RNA, 23 nt, Human
aucaaaggauguagagaagaagc

SEQ ID NO: 395021 - RNA, 22 nt, Human
cuuaggcaguuuaggaaagaga

SEQ ID NO: 395022 - RNA, 22 nt, Human
uagaauucauguuacuguuagc

SEQ ID NO: 395023 - RNA, 22 nt, Human
uuuauccauaucauuaaaaucu

SEQ ID NO: 395024 - RNA, 23 nt, Human
uacuuaggguuuagaucugacug

SEQ ID NO: 395025 - RNA, 23 nt, Human
uagaauucaaucuguuccacauc

SEQ ID NO: 395026 - RNA, 22 nt, Human
auaugcuugggacugauacagu

SEQ ID NO: 395027 - RNA, 22 nt, Human
aagaauucacugguagagucaa

SEQ ID NO: 395028 - RNA, 22 nt, Human
aaaucaguucacguucugaggu

SEQ ID NO: 395029 - RNA, 22 nt, Human
guaaacaacacaaaucauuuga

SEQ ID NO: 395030 - RNA, 22 nt, Human
guaaugaaugaaagaaacuggg

SEQ ID NO: 395031 - RNA, 22 nt, Human
ucagaauuuuuguuacccuuga

SEQ ID NO: 395032 - RNA, 22 nt, Human
cugaauaauauuccauuaugag

SEQ ID NO: 395033 - RNA, 22 nt, Human
guuaggcagcccaagaugucag

SEQ ID NO: 395034 - RNA, 22 nt, Human
auuccaaacuuaccccagagga

SEQ ID NO: 395035 - RNA, 22 nt, Human
ucccugggcuucuccagacuug

SEQ ID NO: 395036 - RNA, 22 nt, Human
auccaaagauggaaagaacuuu

SEQ ID NO: 395037 - RNA, 22 nt, Human
gagucaccuugggucagcgaua

SEQ ID NO: 395038 - RNA, 22 nt, Human
aaucagaaaauucaguggaauu

SEQ ID NO: 395039 - RNA, 22 nt, Human
agucaaaugaguaaauauauaa

SEQ ID NO: 395040 - RNA, 22 nt, Human
caacuuuaugauugguuuguca

SEQ ID NO: 395041 - RNA, 22 nt, Human
auagaaauguauuuuggacuag

SEQ ID NO: 395042 - RNA, 22 nt, Human
ucaauaaauagcuuggcucagc

SEQ ID NO: 395043 - RNA, 22 nt, Human
agaauuccucuaggaucugccc

SEQ ID NO: 395044 - RNA, 22 nt, Human
acuauaaccuguuagaauagau

SEQ ID NO: 395045 - RNA, 22 nt, Human
ugaucugaaggacaugggaccc

SEQ ID NO: 395046 - RNA, 22 nt, Human
uggauuuaauggaugaggggca

SEQ ID NO: 395047 - RNA, 22 nt, Human
augaaacaugcuuuguggauga

SEQ ID NO: 395048 - RNA, 22 nt, Human
gaaugaaaaccuuggcucaaau

SEQ ID NO: 395049 - RNA, 22 nt, Human
ugguuuaauuuccauuuccuug

SEQ ID NO: 395050 - RNA, 22 nt, Human
ucagccaggccaggcauucaca

SEQ ID NO: 395051 - RNA, 22 nt, Human
uuaagcaacacacauuaauuau

SEQ ID NO: 395052 - RNA, 15 nt, Human
aaucagaaguguggc

SEQ ID NO: 395053 - RNA, 22 nt, Human
caguaaaugcagauauagauac

SEQ ID NO: 395054 - RNA, 22 nt, Human
guacagaaugcuugguaaggca

SEQ ID NO: 395055 - RNA, 22 nt, Human
gaguguucccacaccccaguug

SEQ ID NO: 395056 - RNA, 21 nt, Human
cauuuacaugacagauugguu

SEQ ID NO: 395057 - RNA, 22 nt, Human
cuggauuuaggacuaguccaag

SEQ ID NO: 395058 - RNA, 22 nt, Human
cuacagaagaaacuaucacuau

SEQ ID NO: 395059 - RNA, 22 nt, Human
ucaguuucuucaucucccuaac

SEQ ID NO: 395060 - RNA, 22 nt, Human
ugaauaaucauguccauagugu

SEQ ID NO: 395061 - RNA, 22 nt, Human
cacaauuuccaagucauguuau

SEQ ID NO: 395062 - RNA, 22 nt, Human
aauuucaaguggcaucuuugau

SEQ ID NO: 395063 - RNA, 22 nt, Human
acaacuuuagucuggagggaaa

SEQ ID NO: 395064 - RNA, 22 nt, Human
caaaggcaggcccccugugcag

SEQ ID NO: 395065 - RNA, 22 nt, Human
gaugaaaaaagacgagcauaua

SEQ ID NO: 395066 - RNA, 22 nt, Human
uauuuauaccaggugaucggag

SEQ ID NO: 395067 - RNA, 19 nt, Human
guuccaaaggccagaccuu

SEQ ID NO: 395068 - RNA, 22 nt, Human
uguguaaauuuauuuacauaaa

SEQ ID NO: 395069 - RNA, 22 nt, Human
uaaagccaacacuuuacugcuc

SEQ ID NO: 395070 - RNA, 22 nt, Human
uuggaucaaauuucaugcuguc

SEQ ID NO: 395071 - RNA, 22 nt, Human
acauaauaccuaggacaguuug

SEQ ID NO: 395072 - RNA, 22 nt, Human
uaaauaugcauguauccuuauc

SEQ ID NO: 395073 - RNA, 22 nt, Human
acaugucuuuuaaagucuaaua

SEQ ID NO: 395074 - RNA, 22 nt, Human
guuccaaagcaaaggaggugag

SEQ ID NO: 395075 - RNA, 22 nt, Human
uucaauaggaugcaugauauaa

SEQ ID NO: 395076 - RNA, 22 nt, Human
gcagaauuuggggguaaccuuu

SEQ ID NO: 395077 - RNA, 23 nt, Human
uauggcuuacagugcuuuaggua

SEQ ID NO: 395078 - RNA, 22 nt, Human
uuuaggcagucauugaacaagu

SEQ ID NO: 395079 - RNA, 20 nt, Human
agaaucugacccagagagac

SEQ ID NO: 395080 - RNA, 22 nt, Human
caauuuuuaaacuaugaaguug

SEQ ID NO: 395081 - RNA, 22 nt, Human
uggguuuaaacucaacucuaaa

SEQ ID NO: 395082 - RNA, 22 nt, Human
agcacaauagagcaguuaaaaa

SEQ ID NO: 395083 - RNA, 22 nt, Human
auagacauagccguaauuuauu

SEQ ID NO: 395084 - RNA, 22 nt, Human
aggauuuaggagcuggcuaacg

SEQ ID NO: 395085 - RNA, 22 nt, Human
guauacagauacuuagacgugc

SEQ ID NO: 395086 - RNA, 22 nt, Human
aaaucauguuggcacaauaaaa

SEQ ID NO: 395087 - RNA, 22 nt, Human
gcuuuaaugcaauuucaccuca

SEQ ID NO: 395088 - RNA, 22 nt, Human
cauuuauauaaaauguccagaa

SEQ ID NO: 395089 - RNA, 22 nt, Human
uguguaaauggcaucucucagc

SEQ ID NO: 395090 - RNA, 22 nt, Human
caguccagcccccugcuaaaag

SEQ ID NO: 395091 - RNA, 22 nt, Human
caucagaauguuagagaaggga

SEQ ID NO: 395092 - RNA, 22 nt, Human
caucagaagauggcucuggaaa

SEQ ID NO: 395093 - RNA, 22 nt, Human
aauuccaaauguuuucaaucca

SEQ ID NO: 395094 - RNA, 22 nt, Human
ucaaaaguuucacauagagaua

SEQ ID NO: 395095 - RNA, 22 nt, Human
aguaaacacugucuuuauauau

SEQ ID NO: 395096 - RNA, 22 nt, Human
aucuauacucagaguuaauauc

SEQ ID NO: 395097 - RNA, 22 nt, Human
uuuaggcaagggcaagauuauc

SEQ ID NO: 395098 - RNA, 22 nt, Human
aaaauugaggcucauguuaaau

SEQ ID NO: 395099 - RNA, 22 nt, Human
uaguccuuuccggcugcuauaa

SEQ ID NO: 395100 - RNA, 22 nt, Human
ucugauaacucuggccccaggc

SEQ ID NO: 395101 - RNA, 22 nt, Human
cagagauuauuauaacuaauua

SEQ ID NO: 395102 - RNA, 22 nt, Human
ggcaauuucaugugguuuaaac

SEQ ID NO: 395103 - RNA, 22 nt, Human
aaaguccuagcgauccacagaa

SEQ ID NO: 395104 - RNA, 22 nt, Human
uggcuuaauauuucauauuuaa

SEQ ID NO: 395105 - RNA, 22 nt, Human
caucagaacaaaucgguuaaga

SEQ ID NO: 395106 - RNA, 22 nt, Human
gugcauuuaggucacaugaugu

SEQ ID NO: 395107 - RNA, 22 nt, Human
acuagaaauuacucagaauaaa

SEQ ID NO: 395108 - RNA, 22 nt, Human
uaguccuuuaauaguuaaugug

SEQ ID NO: 395109 - RNA, 22 nt, Human
uuuauaaaauagacugggucua

SEQ ID NO: 395110 - RNA, 22 nt, Human
ccagucacucugugagagcuac

SEQ ID NO: 395111 - RNA, 22 nt, Human
aauguucauugauuaaaugaau

SEQ ID NO: 395112 - RNA, 22 nt, Human
gaauuucaaaagccagaacggg

SEQ ID NO: 395113 - RNA, 22 nt, Human
uucuuuuacauuaagauuucag

SEQ ID NO: 395114 - RNA, 22 nt, Human
augaaaauacugugguugauag

SEQ ID NO: 395115 - RNA, 19 nt, Human
auucauuuuugccuucuaa

SEQ ID NO: 395116 - RNA, 22 nt, Human
ucaguaaacagguuuaaguccu

SEQ ID NO: 395117 - RNA, 22 nt, Human
gaagaaucugaggacagucauu

SEQ ID NO: 395118 - RNA, 22 nt, Human
uuuccaaagcugaguugagcaa

SEQ ID NO: 395119 - RNA, 22 nt, Human
caguccuucauuccuccuuuga

SEQ ID NO: 395120 - RNA, 20 nt, Human
aauaaacuacugagagaugu

SEQ ID NO: 395121 - RNA, 22 nt, Human
uuuacagagagagaacuggacu

SEQ ID NO: 395122 - RNA, 22 nt, Human
uguauguugggucaaaguacau

SEQ ID NO: 395123 - RNA, 22 nt, Human
uaauuguagcuuuguaaucagc

SEQ ID NO: 395124 - RNA, 22 nt, Human
uuccuuagauccuucaaucacg

SEQ ID NO: 395125 - RNA, 23 nt, Human
aggauuuaaaggcaaugcauuuu

SEQ ID NO: 395126 - RNA, 21 nt, Human
agaauaaugguaucauuugcu

SEQ ID NO: 395127 - RNA, 22 nt, Human
acugguuuuccagguuacuucu

SEQ ID NO: 395128 - RNA, 22 nt, Human
ucuuuaaugugauuguaauuau

SEQ ID NO: 395129 - RNA, 22 nt, Human
uuagaaaugcacccaagaccua

SEQ ID NO: 395130 - RNA, 22 nt, Human
ucaguaaaugagcaaaaauuuc

SEQ ID NO: 395131 - RNA, 22 nt, Human
gagucaccacugugauagucga

SEQ ID NO: 395132 - RNA, 22 nt, Human
uaauuacagguccaaaacaauc

SEQ ID NO: 395133 - RNA, 22 nt, Human
aacagugaguugaugacugaau

SEQ ID NO: 395134 - RNA, 22 nt, Human
ucagaaauacaaaacacuuacu

SEQ ID NO: 395135 - RNA, 22 nt, Human
caaugaaagcaacugccuauaa

SEQ ID NO: 395136 - RNA, 22 nt, Human
aaugucuugagaagagaaaucu

SEQ ID NO: 395137 - RNA, 22 nt, Human
aauguuaauuuacugucuucau

SEQ ID NO: 395138 - RNA, 22 nt, Human
uuggaucauggaaugucugcuu

SEQ ID NO: 395139 - RNA, 23 nt, Human
augguuuaugucacacuuuugau

SEQ ID NO: 395140 - RNA, 21 nt, Human
agaauucuuaaguauucuaau

SEQ ID NO: 395141 - RNA, 22 nt, Human
agucaccaucuguggcagccug

SEQ ID NO: 395142 - RNA, 22 nt, Human
uaucauaaguuaauuaaacagu

SEQ ID NO: 395143 - RNA, 22 nt, Human
uucuuaaucccacaaaucuuca

SEQ ID NO: 395144 - RNA, 19 nt, Human
cuauacagccucugaggaa

SEQ ID NO: 395145 - RNA, 22 nt, Human
ugcagagaagaggacaguucua

SEQ ID NO: 395146 - RNA, 22 nt, Human
auguuucauuuagauaucaggc

SEQ ID NO: 395147 - RNA, 22 nt, Human
auuaaacugagcaaauuaacau

SEQ ID NO: 395148 - RNA, 22 nt, Human
cacacuuugugcuaaucuauuu

SEQ ID NO: 395149 - RNA, 22 nt, Human
caguaaauacauaucagagaag

SEQ ID NO: 395150 - RNA, 19 nt, Human
agcaaauacaucaaaauug

SEQ ID NO: 395151 - RNA, 22 nt, Human
guuccaaacaagucauaaagua

SEQ ID NO: 395152 - RNA, 18 nt, Human
gcacuucacccagcuagu

SEQ ID NO: 395153 - RNA, 22 nt, Human
acuggaucuaauugguuauagu

SEQ ID NO: 395154 - RNA, 22 nt, Human
acuauacauugaauguuaaggu

SEQ ID NO: 395155 - RNA, 22 nt, Human
uacagaaaaacuggcauugaag

SEQ ID NO: 395156 - RNA, 22 nt, Human
ugcaggaacuugguuuuacuca

SEQ ID NO: 395157 - RNA, 22 nt, Human
caagaaucaacauuauuuagug

SEQ ID NO: 395158 - RNA, 22 nt, Human
ucagccaguuugauucuauuug

SEQ ID NO: 395159 - RNA, 22 nt, Human
agaaaucaugucuuauuucuau

SEQ ID NO: 395160 - RNA, 22 nt, Human
gcguuaauaacauuaauaaugc

SEQ ID NO: 395161 - RNA, 22 nt, Human
aaagccauaagccuaauacuaa

SEQ ID NO: 395162 - RNA, 22 nt, Human
gguacaauccacuguggguuag

SEQ ID NO: 395163 - RNA, 23 nt, Human
uaaagucacauauuagagugagc

SEQ ID NO: 395164 - RNA, 22 nt, Human
auguuucaaauauauagaguug

SEQ ID NO: 395165 - RNA, 22 nt, Human
gcaaacaaggacauacauccug

SEQ ID NO: 395166 - RNA, 22 nt, Human
aaaauugagagucuugugcaag

SEQ ID NO: 395167 - RNA, 21 nt, Human
cuacagaagcucuccuaucca

SEQ ID NO: 395168 - RNA, 22 nt, Human
uaacagaaauuuuaguuagggg

SEQ ID NO: 395169 - RNA, 22 nt, Human
aaaacuguaucuucuugggacu

SEQ ID NO: 395170 - RNA, 22 nt, Human
aaagucauugcuguuaucaaug

SEQ ID NO: 395171 - RNA, 22 nt, Human
gaauuucagggucugguaggaa

SEQ ID NO: 395172 - RNA, 20 nt, Human
guaaugaauguaaacaguaa

SEQ ID NO: 395173 - RNA, 22 nt, Human
caucagaaucugagucucugcc

SEQ ID NO: 395174 - RNA, 22 nt, Human
uaugcugugcuagauacaauau

SEQ ID NO: 395175 - RNA, 20 nt, Human
aaucagaaagugugagcucu

SEQ ID NO: 395176 - RNA, 22 nt, Human
ucaaauaccagcaauuucaugu

SEQ ID NO: 395177 - RNA, 22 nt, Human
gaauuacaugacccugaguaga

SEQ ID NO: 395178 - RNA, 18 nt, Human
aagucaccccugcucccu

SEQ ID NO: 395179 - RNA, 22 nt, Human
aaacuuuggauugugauugugc

SEQ ID NO: 395180 - RNA, 22 nt, Human
cuggcuuucauuucaagcacgu

SEQ ID NO: 395181 - RNA, 22 nt, Human
auacagaauucacuacaguuuc

SEQ ID NO: 395182 - RNA, 22 nt, Human
aaagacauggaacuagagaugg

SEQ ID NO: 395183 - RNA, 22 nt, Human
auggcauuugaccgcuuugugg

SEQ ID NO: 395184 - RNA, 22 nt, Human
guagaaauguaaccaggagaua

SEQ ID NO: 395185 - RNA, 22 nt, Human
uauggaaaaauguaucuuguca

SEQ ID NO: 395186 - RNA, 22 nt, Human
uuagaaaucugcugccaugcaa

SEQ ID NO: 395187 - RNA, 22 nt, Human
ugcaggaaaacaccuaucaccc

SEQ ID NO: 395188 - RNA, 22 nt, Human
guauuuaauuccauuaaguuag

SEQ ID NO: 395189 - RNA, 22 nt, Human
cuuccaaacccaggguaugggc

SEQ ID NO: 395190 - RNA, 22 nt, Human
auggcuuuccugggacaugggc

SEQ ID NO: 395191 - RNA, 22 nt, Human
uaauuucagugcaagcucacgg

SEQ ID NO: 395192 - RNA, 22 nt, Human
cuacagaaaaucagccacaggc

SEQ ID NO: 395193 - RNA, 22 nt, Human
guccuuaguuacuuuucauguc

SEQ ID NO: 395194 - RNA, 22 nt, Human
aauugcaauuuucuuaaggucu

SEQ ID NO: 395195 - RNA, 22 nt, Human
ucauaaagcucuuccaaaugua

SEQ ID NO: 395196 - RNA, 22 nt, Human
ugaaauagacacagugcuauac

SEQ ID NO: 395197 - RNA, 22 nt, Human
agauucuacucuagauccaugg

SEQ ID NO: 395198 - RNA, 20 nt, Human
uacagaaacaggacuuuugg

SEQ ID NO: 395199 - RNA, 22 nt, Human
ucauaaaaugcuccugauauug

SEQ ID NO: 395200 - RNA, 21 nt, Human
uucaauacuauuucaauaguc

SEQ ID NO: 395201 - RNA, 18 nt, Human
auauguuaauuagguagg

SEQ ID NO: 395202 - RNA, 22 nt, Human
aagcauuuuagauaaagcauca

SEQ ID NO: 395203 - RNA, 22 nt, Human
cauggauugaauauaaauuaga

SEQ ID NO: 395204 - RNA, 22 nt, Human
uuucauugaacuaaagaaucug

SEQ ID NO: 395205 - RNA, 22 nt, Human
uuuuauguuccucuuuaugcga

SEQ ID NO: 395206 - RNA, 22 nt, Human
ccuauacagccucagcugagau

SEQ ID NO: 395207 - RNA, 23 nt, Human
uuccuuaacuguuaagauugucu

SEQ ID NO: 395208 - RNA, 22 nt, Human
acuggauuccauugugcaaaga

SEQ ID NO: 395209 - RNA, 22 nt, Human
acuauacaguauguacgugcac

SEQ ID NO: 395210 - RNA, 22 nt, Human
agagaugaacauaaaacaagga

SEQ ID NO: 395211 - RNA, 22 nt, Human
ucaguguauggagugcuggauu

SEQ ID NO: 395212 - RNA, 22 nt, Human
aagccagauuucacucuuaauu

SEQ ID NO: 395213 - RNA, 22 nt, Human
guuuacauguacucauuauacu

SEQ ID NO: 395214 - RNA, 21 nt, Human
caaguccuuugccaaagugcu

SEQ ID NO: 395215 - RNA, 22 nt, Human
ucagagaaaugaaguagggauu

SEQ ID NO: 395216 - RNA, 22 nt, Human
aaagcuaugaggcaugcauuuc

SEQ ID NO: 395217 - RNA, 22 nt, Human
guuaggcaaauaacuguggagc

SEQ ID NO: 395218 - RNA, 22 nt, Human
aaagccuuugucucaggcucug

SEQ ID NO: 395219 - RNA, 22 nt, Human
aauaauauuugaagcuucaaag

SEQ ID NO: 395220 - RNA, 22 nt, Human
aaauugcaaaaguacuuuuagg

SEQ ID NO: 395221 - RNA, 22 nt, Human
aaauucaauuaacuuucaugcu

SEQ ID NO: 395222 - RNA, 22 nt, Human
acaaagucacaauaauuaaccu

SEQ ID NO: 395223 - RNA, 22 nt, Human
caucagaaccagcugggugagg

SEQ ID NO: 395224 - RNA, 22 nt, Human
uaccaaaagcuuguuucauaca

SEQ ID NO: 395225 - RNA, 22 nt, Human
uucuuaaucuguguggguucga

SEQ ID NO: 395226 - RNA, 22 nt, Human
uaagaaucggucgcaacagagg

SEQ ID NO: 395227 - RNA, 22 nt, Human
caauuucacuaaugaugugggg

SEQ ID NO: 395228 - RNA, 22 nt, Human
augguuuaguuagggcuuuuca

SEQ ID NO: 395229 - RNA, 22 nt, Human
uauacagaacugcacgugcacg

SEQ ID NO: 395230 - RNA, 22 nt, Human
guaaacaucagccacucuauuu

SEQ ID NO: 395231 - RNA, 22 nt, Human
auggcuuugcucaaguuuagcc

SEQ ID NO: 395232 - RNA, 22 nt, Human
uucuaacaaguggcuuguuagu

SEQ ID NO: 395233 - RNA, 22 nt, Human
ccuggauccaugaaaaggcuac

SEQ ID NO: 395234 - RNA, 22 nt, Human
cauacuuucuuuuucacgcaua

SEQ ID NO: 395235 - RNA, 22 nt, Human
uguaacaaaauaccuuggauug

SEQ ID NO: 395236 - RNA, 22 nt, Human
ucuaaacaguuucacucuuaau

SEQ ID NO: 395237 - RNA, 22 nt, Human
aauucucagguaaaaguuaagu

SEQ ID NO: 395238 - RNA, 22 nt, Human
augccaaagcccaaguucauca

SEQ ID NO: 395239 - RNA, 22 nt, Human
gauuucaaagguucugcaugcc

SEQ ID NO: 395240 - RNA, 23 nt, Human
uaagaacagacaagcauuuacau

SEQ ID NO: 395241 - RNA, 22 nt, Human
uuauaagaguauauaguguacu

SEQ ID NO: 395242 - RNA, 22 nt, Human
aaaugcuuguaaauuuuccaug

SEQ ID NO: 395243 - RNA, 22 nt, Human
agucuuaauagagaaaaacugu

SEQ ID NO: 395244 - RNA, 22 nt, Human
auuucaacacuuuuggaauuag

SEQ ID NO: 395245 - RNA, 22 nt, Human
ggcauuuaguuuucauauucug

SEQ ID NO: 395246 - RNA, 22 nt, Human
gauaaaauucuuauuuuacccg

SEQ ID NO: 395247 - RNA, 22 nt, Human
cauguauaguuggaacuacauc

SEQ ID NO: 395248 - RNA, 22 nt, Human
cacauuuagagguuagcauggu

SEQ ID NO: 395249 - RNA, 22 nt, Human
acuauacauaaaacauuugggu

SEQ ID NO: 395250 - RNA, 22 nt, Human
auauccaagaaacaauuaauuc

SEQ ID NO: 395251 - RNA, 22 nt, Human
uaaagacaaacccacuaggguu

SEQ ID NO: 395252 - RNA, 22 nt, Human
guaaacauuacugugcuguaua

SEQ ID NO: 395253 - RNA, 22 nt, Human
uuuauccaccuuacccuguucc

SEQ ID NO: 395254 - RNA, 22 nt, Human
aacuggauuuaggaacagagaa

SEQ ID NO: 395255 - RNA, 22 nt, Human
uacagaaguaaauaccaaaagc

SEQ ID NO: 395256 - RNA, 22 nt, Human
uaauuucacaguucaacgcaca

SEQ ID NO: 395257 - RNA, 22 nt, Human
cagaucuguaguaaaagaucuc

SEQ ID NO: 395258 - RNA, 20 nt, Human
uguuccaagcuaaugaauga

SEQ ID NO: 395259 - RNA, 17 nt, Human
aaucagauuucugagga

SEQ ID NO: 395260 - RNA, 22 nt, Human
ugcuauacggagcaucuucagg

SEQ ID NO: 395261 - RNA, 22 nt, Human
aauauuaucaaaagcuuuuuca

SEQ ID NO: 395262 - RNA, 22 nt, Human
cuggcuuucccuggacaacagc

SEQ ID NO: 395263 - RNA, 22 nt, Human
acauaauagcauuucuaauuug

SEQ ID NO: 395264 - RNA, 22 nt, Human
auggcuuucagauggugaaaga

SEQ ID NO: 395265 - RNA, 22 nt, Human
caugcuuuucaaucuaucuuaa

SEQ ID NO: 395266 - RNA, 22 nt, Human
aaaguccagagggcacacugaa

SEQ ID NO: 395267 - RNA, 22 nt, Human
uguacaaugcugagguuugggg

SEQ ID NO: 395268 - RNA, 22 nt, Human
guuaggcaguuuucuucauucu

SEQ ID NO: 395269 - RNA, 22 nt, Human
auuuccaagaaagcuuuaggau

SEQ ID NO: 395270 - RNA, 21 nt, Human
gaguccuuccaauguccucag

SEQ ID NO: 395271 - RNA, 17 nt, Human
ugcuuaauuuugacugg

SEQ ID NO: 395272 - RNA, 22 nt, Human
aaaaccugauugaauucuauuu

SEQ ID NO: 395273 - RNA, 22 nt, Human
agauuuacugagaacugauuac

SEQ ID NO: 395274 - RNA, 22 nt, Human
ucaguuucacagucugugcaga

SEQ ID NO: 395275 - RNA, 22 nt, Human
aauuucaaacucuugcccucag

SEQ ID NO: 395276 - RNA, 22 nt, Human
cuuccaaaauuuauauguugaa

SEQ ID NO: 395277 - RNA, 22 nt, Human
uacacaugaucauuuaguagca

SEQ ID NO: 395278 - RNA, 22 nt, Human
uagaauaaguugaugauauaug

SEQ ID NO: 395279 - RNA, 22 nt, Human
aagucacaagcauauaugcauu

SEQ ID NO: 395280 - RNA, 22 nt, Human
ccauggcuuucuuucauuguaa

SEQ ID NO: 395281 - RNA, 22 nt, Human
uauacagaaagaauucaagucu

SEQ ID NO: 395282 - RNA, 22 nt, Human
gaucugaagagcaaugaaauau

SEQ ID NO: 395283 - RNA, 22 nt, Human
aaucaugugggauagucugcuc

SEQ ID NO: 395284 - RNA, 22 nt, Human
aaucaagucaaccaucaugugc

SEQ ID NO: 395285 - RNA, 22 nt, Human
uagaaacagcauauauuagccc

SEQ ID NO: 395286 - RNA, 22 nt, Human
uuaaaaucuaaagcaguugucu

SEQ ID NO: 395287 - RNA, 22 nt, Human
aauaauaagauacuaagggagu

SEQ ID NO: 395288 - RNA, 22 nt, Human
auggcuuuuuagacuuugguac

SEQ ID NO: 395289 - RNA, 22 nt, Human
cugcagagaccuaggucagguu

SEQ ID NO: 395290 - RNA, 22 nt, Human
caggccagggagaauaugaagc

SEQ ID NO: 395291 - RNA, 22 nt, Human
agccaacuaggagauuaaggua

SEQ ID NO: 395292 - RNA, 22 nt, Human
caaauacuggguaaguuaauuu

SEQ ID NO: 395293 - RNA, 22 nt, Human
aguagaauagauggauacuauu

SEQ ID NO: 395294 - RNA, 22 nt, Human
aauacuaguuauuaaagcuuuu

SEQ ID NO: 395295 - RNA, 22 nt, Human
aaauauaguaaaugcauaguuc

SEQ ID NO: 395296 - RNA, 21 nt, Human
cauuucaaagagcuggaaauc

SEQ ID NO: 395297 - RNA, 22 nt, Human
augguuuauugcuuuaaugaaa

SEQ ID NO: 395298 - RNA, 22 nt, Human
uaaacauguugacaucuuaccu

SEQ ID NO: 395299 - RNA, 22 nt, Human
ucuuuaauguacuuucuuucac

SEQ ID NO: 395300 - RNA, 22 nt, Human
cguccuuacagagggucacagc

SEQ ID NO: 395301 - RNA, 22 nt, Human
auuaaagacagcagauggaugg

SEQ ID NO: 395302 - RNA, 22 nt, Human
auaaagucuaccguauuaaaga

SEQ ID NO: 395303 - RNA, 22 nt, Human
ugaaagguuaaaaguaguauug

SEQ ID NO: 395304 - RNA, 22 nt, Human
gaaacaacuacuauugauuucu

SEQ ID NO: 395305 - RNA, 22 nt, Human
ggauuuccucuugacucuaaag

SEQ ID NO: 395306 - RNA, 19 nt, Human
uccuucagucagaucuggg

SEQ ID NO: 395307 - RNA, 22 nt, Human
uggcauuuucuccuuugaguuu

SEQ ID NO: 395308 - RNA, 22 nt, Human
uacuucauuccuuuguaaaaug

SEQ ID NO: 395309 - RNA, 22 nt, Human
ucacagcaaaugcugcuucuca

SEQ ID NO: 395310 - RNA, 22 nt, Human
auguacaaaauguuuugaaaug

SEQ ID NO: 395311 - RNA, 22 nt, Human
acagaauucuaguauguggcuu

SEQ ID NO: 395312 - RNA, 22 nt, Human
uugauacuauuaagcacugggc

SEQ ID NO: 395313 - RNA, 22 nt, Human
uaacauguuaagaaauuagaua

SEQ ID NO: 395314 - RNA, 22 nt, Human
uuaaagucccugccuuaauucc

SEQ ID NO: 395315 - RNA, 22 nt, Human
gauuuagagcaggaaugcaugg

SEQ ID NO: 395316 - RNA, 22 nt, Human
ugaaauaauaucuggaucaauc

SEQ ID NO: 395317 - RNA, 22 nt, Human
aacauguaucgcuuuuuaauau

SEQ ID NO: 395318 - RNA, 22 nt, Human
uaaagucauaagaguggauccg

SEQ ID NO: 395319 - RNA, 22 nt, Human
ccagaucuaaguccaaaguacu

SEQ ID NO: 395320 - RNA, 22 nt, Human
uuaacacuccuaacuacagucu

SEQ ID NO: 395321 - RNA, 23 nt, Human
augaaugaauaaggcaggaaagc

SEQ ID NO: 395322 - RNA, 22 nt, Human
caucagaaggccagaggguagc

SEQ ID NO: 395323 - RNA, 22 nt, Human
aucuaaacagguguucuuuaga

SEQ ID NO: 395324 - RNA, 22 nt, Human
aaaucaguucucccuuucuuca

SEQ ID NO: 395325 - RNA, 22 nt, Human
cauaagaagguaacauccuuaa

SEQ ID NO: 395326 - RNA, 22 nt, Human
auuaggcacuagaaugucaauu

SEQ ID NO: 395327 - RNA, 22 nt, Human
uguucacaucgauggauuuugc

SEQ ID NO: 395328 - RNA, 22 nt, Human
uaauuucaauagcuugcauaau

SEQ ID NO: 395329 - RNA, 22 nt, Human
aaagaaucguguguaguuugaa

SEQ ID NO: 395330 - RNA, 19 nt, Human
gcaggaaaugagugauugc

SEQ ID NO: 395331 - RNA, 22 nt, Human
gaugaaaaauugcugugucaua

SEQ ID NO: 395332 - RNA, 22 nt, Human
aacauuggauauuuauuaaaag

SEQ ID NO: 395333 - RNA, 22 nt, Human
acaaugaacacacaaggaauuc

SEQ ID NO: 395334 - RNA, 22 nt, Human
caaagccaggcuuucuaaugua

SEQ ID NO: 395335 - RNA, 22 nt, Human
aaaaugcuauuucauggaggag

SEQ ID NO: 395336 - RNA, 22 nt, Human
gugaauaaagggaguuuucaaa

SEQ ID NO: 395337 - RNA, 22 nt, Human
cuaacuuuagcuuagauuauca

SEQ ID NO: 395338 - RNA, 22 nt, Human
uaauuucaccguugcuagaaau

SEQ ID NO: 395339 - RNA, 22 nt, Human
uuuauaaacaguaccacggugc

SEQ ID NO: 395340 - RNA, 22 nt, Human
gaauuucaaagagguuaagagg

SEQ ID NO: 395341 - RNA, 22 nt, Human
cauuucaaaagaauugccagaa

SEQ ID NO: 395342 - RNA, 22 nt, Human
uacagacaguuuuucagauauu

SEQ ID NO: 395343 - RNA, 19 nt, Human
uggauuuauauucuuuauc

SEQ ID NO: 395344 - RNA, 22 nt, Human
caucagaaggaaggacgauuau

SEQ ID NO: 395345 - RNA, 22 nt, Human
ugaaacaaauuuggaaaaucua

SEQ ID NO: 395346 - RNA, 22 nt, Human
agaucaguuagauagcuugaug

SEQ ID NO: 395347 - RNA, 22 nt, Human
caaacuggcuaugggaaucuug

SEQ ID NO: 395348 - RNA, 22 nt, Human
uucacagauuucccugcacaug

SEQ ID NO: 395349 - RNA, 22 nt, Human
augcuuaauacacuguuaaagg

SEQ ID NO: 395350 - RNA, 22 nt, Human
acaaaauuaccuaguuauuuuc

SEQ ID NO: 395351 - RNA, 22 nt, Human
ggauucuaacugaacagaauau

SEQ ID NO: 395352 - RNA, 22 nt, Human
agucaccaacaugguucccagg

SEQ ID NO: 395353 - RNA, 22 nt, Human
uggaauaaagugcuuugaucag

SEQ ID NO: 395354 - RNA, 22 nt, Human
uauaagaaacaaggcaaauuuu

SEQ ID NO: 395355 - RNA, 22 nt, Human
uuucacacaacgugaauauacu

SEQ ID NO: 395356 - RNA, 23 nt, Human
aguucacugagguugaccacugg

SEQ ID NO: 395357 - RNA, 22 nt, Human
gucaacuuuaagaugaucuuuu

SEQ ID NO: 395358 - RNA, 22 nt, Human
aaagucauuuguauauacccuu

SEQ ID NO: 395359 - RNA, 22 nt, Human
uuaaugauaccuauguuaauuu

SEQ ID NO: 395360 - RNA, 22 nt, Human
uaaagacaauuucgagcuguag

SEQ ID NO: 395361 - RNA, 22 nt, Human
agccauucauugugcucucaga

SEQ ID NO: 395362 - RNA, 22 nt, Human
ucuggaucuccagcacuuauca

SEQ ID NO: 395363 - RNA, 22 nt, Human
ugucaccaugcgaggcuaauuu

SEQ ID NO: 395364 - RNA, 22 nt, Human
aaucagucucauuuagcaggga

SEQ ID NO: 395365 - RNA, 22 nt, Human
agaaaucauugaauuauuugcu

SEQ ID NO: 395366 - RNA, 22 nt, Human
cuauagaaaauuguaucacacg

SEQ ID NO: 395367 - RNA, 22 nt, Human
uucauaaucaccaaaaacugga

SEQ ID NO: 395368 - RNA, 22 nt, Human
uaauauauuucugcuaagcuca

SEQ ID NO: 395369 - RNA, 22 nt, Human
auuucacaaaccauccugauuu

SEQ ID NO: 395370 - RNA, 22 nt, Human
cauuuacacacagaggugugcu

SEQ ID NO: 395371 - RNA, 17 nt, Human
uaucagaauguguuuac

SEQ ID NO: 395372 - RNA, 22 nt, Human
ugcuuuaaaauggacuguuuug

SEQ ID NO: 395373 - RNA, 22 nt, Human
ugaaugaauccuaacaaagaca

SEQ ID NO: 395374 - RNA, 22 nt, Human
caagaucagggugccagaaugg

SEQ ID NO: 395375 - RNA, 22 nt, Human
auauacugauagcugcacuucu

SEQ ID NO: 395376 - RNA, 22 nt, Human
uuccuuagcugucccuggaaau

SEQ ID NO: 395377 - RNA, 22 nt, Human
aggauuuauuacaagccauggu

SEQ ID NO: 395378 - RNA, 22 nt, Human
gauagaaagaauauagauucca

SEQ ID NO: 395379 - RNA, 23 nt, Human
uucaaaacuggaaaaucagaugc

SEQ ID NO: 395380 - RNA, 22 nt, Human
aaagaaggggucuacauccaau

SEQ ID NO: 395381 - RNA, 22 nt, Human
gagauuuagagagacuuaaaca

SEQ ID NO: 395382 - RNA, 22 nt, Human
auggaucagaaucccgggaggg

SEQ ID NO: 395383 - RNA, 22 nt, Human
aucagaaauagucauguuacuu

SEQ ID NO: 395384 - RNA, 22 nt, Human
auggguuucccucugaaauuau

SEQ ID NO: 395385 - RNA, 22 nt, Human
aauaauuuuagcucagaguugu

SEQ ID NO: 395386 - RNA, 22 nt, Human
augcuuuaaacuauaaauccac

SEQ ID NO: 395387 - RNA, 22 nt, Human
uacaagaaugucuuaaaagcuc

SEQ ID NO: 395388 - RNA, 22 nt, Human
agaugaaaagauaagcagcaau

SEQ ID NO: 395389 - RNA, 22 nt, Human
uuccuuaggcuguuugcagugc

SEQ ID NO: 395390 - RNA, 22 nt, Human
cagagacauucaguaaauuauc

SEQ ID NO: 395391 - RNA, 22 nt, Human
caaauacuaaacauaagauuuu

SEQ ID NO: 395392 - RNA, 22 nt, Human
agauaucaccaguuuuacauac

SEQ ID NO: 395393 - RNA, 22 nt, Human
gguuuaauggagauauuucaga

SEQ ID NO: 395394 - RNA, 22 nt, Human
aaacugugcuucccaaaugccc

SEQ ID NO: 395395 - RNA, 22 nt, Human
aaucuuuaaggacucagucucu

SEQ ID NO: 395396 - RNA, 22 nt, Human
caguccuugcucaaagucuaca

SEQ ID NO: 395397 - RNA, 22 nt, Human
uauaaagcugacucaugaaacu

SEQ ID NO: 395398 - RNA, 22 nt, Human
uuucaacuugaagaauugauac

SEQ ID NO: 395399 - RNA, 22 nt, Human
gcagggcaaacccagguguuca

SEQ ID NO: 395400 - RNA, 20 nt, Human
uacagaaugcaauaaaaugg

SEQ ID NO: 395401 - RNA, 22 nt, Human
aaguaaauaucuguuuauagca

SEQ ID NO: 395402 - RNA, 22 nt, Human
aggauuuagauuuggaggaacu

SEQ ID NO: 395403 - RNA, 22 nt, Human
acacaaacugcuagaaaauugg

SEQ ID NO: 395404 - RNA, 22 nt, Human
guuucacagaugguguucauau

SEQ ID NO: 395405 - RNA, 22 nt, Human
uaaaaugacuuccuccaacauc

SEQ ID NO: 395406 - RNA, 22 nt, Human
caucauaaaauugagauaacug

SEQ ID NO: 395407 - RNA, 22 nt, Human
gaacuuuaaaacaaaguacagu

SEQ ID NO: 395408 - RNA, 22 nt, Human
augguuuaaagaguaugacuuu

SEQ ID NO: 395409 - RNA, 22 nt, Human
auaauaaaccaggaugggucug

SEQ ID NO: 395410 - RNA, 22 nt, Human
uauggaaauaauuagacaagug

SEQ ID NO: 395411 - RNA, 22 nt, Human
ucuauaaauuaugcagucucag

SEQ ID NO: 395412 - RNA, 22 nt, Human
cagauuuaagagauaaacagug

SEQ ID NO: 395413 - RNA, 22 nt, Human
uacuuaaugccacugaauugua

SEQ ID NO: 395414 - RNA, 22 nt, Human
aucuagaacuuaaagucaguca

SEQ ID NO: 395415 - RNA, 22 nt, Human
uuacagaacugucuugaaauuu

SEQ ID NO: 395416 - RNA, 22 nt, Human
augguuuuucaaguauucagaa

SEQ ID NO: 395417 - RNA, 22 nt, Human
cauagaaaguauuauggaauuu

SEQ ID NO: 395418 - RNA, 22 nt, Human
acaauauuguacccagaaguuu

SEQ ID NO: 395419 - RNA, 22 nt, Human
aauuaauggaaaguaaggaagg

SEQ ID NO: 395420 - RNA, 22 nt, Human
augugaaauauuaagccgagga

SEQ ID NO: 395421 - RNA, 22 nt, Human
uucacagaauggcaaguuaugg

SEQ ID NO: 395422 - RNA, 22 nt, Human
aaauacugucucugagagagcc

SEQ ID NO: 395423 - RNA, 22 nt, Human
aauuccaaguagcaucccauca

SEQ ID NO: 395424 - RNA, 22 nt, Human
auuuacugagguaaauaaacug

SEQ ID NO: 395425 - RNA, 22 nt, Human
aaacugugaagcaaguacaagg

SEQ ID NO: 395426 - RNA, 22 nt, Human
caguccuuucugaaauccuaua

SEQ ID NO: 395427 - RNA, 22 nt, Human
augguuuugaagggaggucaaa

SEQ ID NO: 395428 - RNA, 22 nt, Human
cagaaucagcccuugcuauuaa

SEQ ID NO: 395429 - RNA, 22 nt, Human
ugugugaaggaauauauacuca

SEQ ID NO: 395430 - RNA, 22 nt, Human
aacauguaaccagcauucaucu

SEQ ID NO: 395431 - RNA, 22 nt, Human
gugaauaacuuucuauguuaau

SEQ ID NO: 395432 - RNA, 22 nt, Human
ucagaauucugaccuuggguca

SEQ ID NO: 395433 - RNA, 22 nt, Human
aagcauuuugccacuugaaguu

SEQ ID NO: 395434 - RNA, 22 nt, Human
uuauccaagcagaagcugcaca

SEQ ID NO: 395435 - RNA, 22 nt, Human
uggcuauugagugaucucuaga

SEQ ID NO: 395436 - RNA, 22 nt, Human
uuugaacaggaguaucuauagu

SEQ ID NO: 395437 - RNA, 22 nt, Human
cugauacauaguagcaugucau

SEQ ID NO: 395438 - RNA, 22 nt, Human
auggcauuauagcaaugguuug

SEQ ID NO: 395439 - RNA, 21 nt, Human
uuuaaagaauaggaagggagg

SEQ ID NO: 395440 - RNA, 22 nt, Human
aguaaaauuucugcugaggaga

SEQ ID NO: 395441 - RNA, 22 nt, Human
guacagaauuaugccaugaggg

SEQ ID NO: 395442 - RNA, 22 nt, Human
uacugaaauacuaagaaguuaa

SEQ ID NO: 395443 - RNA, 22 nt, Human
uuaacacuaucugucauaauua

SEQ ID NO: 395444 - RNA, 22 nt, Human
uaucaaaggcuaugugauuuuu

SEQ ID NO: 395445 - RNA, 22 nt, Human
auacaaugaaguauagaugaaa

SEQ ID NO: 395446 - RNA, 22 nt, Human
guaugaaaauuguaaaguucuu

SEQ ID NO: 395447 - RNA, 22 nt, Human
gucauuucuguuucuucagugc

SEQ ID NO: 395448 - RNA, 22 nt, Human
aaagucaucauuucuuuucaaa

SEQ ID NO: 395449 - RNA, 22 nt, Human
aagcccagaugggagcauuuca

SEQ ID NO: 395450 - RNA, 22 nt, Human
aaugaaaauuggacccuagaac

SEQ ID NO: 395451 - RNA, 22 nt, Human
caguccuuggcuucauccgagu

SEQ ID NO: 395452 - RNA, 22 nt, Human
gugcuucaaguucuuaauguuu

SEQ ID NO: 395453 - RNA, 22 nt, Human
cagaauuuaaguggauuauucu

SEQ ID NO: 395454 - RNA, 22 nt, Human
uuuaucuguuguacauuuaugc

SEQ ID NO: 395455 - RNA, 22 nt, Human
uagauauaagguccuuagaaca

SEQ ID NO: 395456 - RNA, 22 nt, Human
caaucaguaaccggaucauggu

SEQ ID NO: 395457 - RNA, 22 nt, Human
uucaacuuuaugcauauguauu

SEQ ID NO: 395458 - RNA, 22 nt, Human
ccagaauuuggaucaugauuuu

SEQ ID NO: 395459 - RNA, 22 nt, Human
caagucauuacugaaaugucac

SEQ ID NO: 395460 - RNA, 20 nt, Human
acuggaucuggcuggagcug

SEQ ID NO: 395461 - RNA, 22 nt, Human
aaggacagggaugguugauugu

SEQ ID NO: 395462 - RNA, 22 nt, Human
ugcuuaauacguauuugcugga

SEQ ID NO: 395463 - RNA, 22 nt, Human
uacaagaaauuucugcauauau

SEQ ID NO: 395464 - RNA, 22 nt, Human
uuuaggcagcagugaggaugaa

SEQ ID NO: 395465 - RNA, 22 nt, Human
aguuauccgaaggcacugagau

SEQ ID NO: 395466 - RNA, 22 nt, Human
uuuccaaaggcuaaacucaguu

SEQ ID NO: 395467 - RNA, 22 nt, Human
uuccaaaccucaaauaauuaau

SEQ ID NO: 395468 - RNA, 22 nt, Human
uaaguccuagcuuugguaggaa

SEQ ID NO: 395469 - RNA, 22 nt, Human
uagaacauaagucauucauuug

SEQ ID NO: 395470 - RNA, 22 nt, Human
aagccaaugagagaggccucag

SEQ ID NO: 395471 - RNA, 23 nt, Human
ugguucuaggccuauaauuauau

SEQ ID NO: 395472 - RNA, 22 nt, Human
aaugggauaggucuucaggaau

SEQ ID NO: 395473 - RNA, 22 nt, Human
caguaaauuugagggaucuaau

SEQ ID NO: 395474 - RNA, 22 nt, Human
gauuuucauuugcacucuagaa

SEQ ID NO: 395475 - RNA, 22 nt, Human
uucagaaaaaacuucaauaagu

SEQ ID NO: 395476 - RNA, 22 nt, Human
ucuagacacuacuaguaaccgg

SEQ ID NO: 395477 - RNA, 22 nt, Human
ccagcuauugcuguguaacagu

SEQ ID NO: 395478 - RNA, 22 nt, Human
aaguccuugaagaaacaguucu

SEQ ID NO: 395479 - RNA, 22 nt, Human
gagucaccacacggugcugacu

SEQ ID NO: 395480 - RNA, 22 nt, Human
uaagagaacuggauagauagga

SEQ ID NO: 395481 - RNA, 21 nt, Human
aaagaaucauggguaauuuca

SEQ ID NO: 395482 - RNA, 22 nt, Human
auaaagcauacuuuguaugacu

SEQ ID NO: 395483 - RNA, 18 nt, Human
uaaauauauuucccccuu

SEQ ID NO: 395484 - RNA, 22 nt, Human
uaaacauggauucugaucacag

SEQ ID NO: 395485 - RNA, 19 nt, Human
acaagucacuuacuuagua

SEQ ID NO: 395486 - RNA, 22 nt, Human
cagaagucacccucagaauaac

SEQ ID NO: 395487 - RNA, 22 nt, Human
aguaugaacggaaggccuggga

SEQ ID NO: 395488 - RNA, 22 nt, Human
gaucagaauuuacuuauaauug

SEQ ID NO: 395489 - RNA, 21 nt, Human
uuuaguucaaguacagaacca

SEQ ID NO: 395490 - RNA, 22 nt, Human
uuauauuaguuagacuugcugu

SEQ ID NO: 395491 - RNA, 22 nt, Human
auacagaacaagccucaccucc

SEQ ID NO: 395492 - RNA, 22 nt, Human
uugguccacugugaaauuggga

SEQ ID NO: 395493 - RNA, 22 nt, Human
agcauaaaggcacuagaaagag

SEQ ID NO: 395494 - RNA, 22 nt, Human
ugugaauaccuugaauucauca

SEQ ID NO: 395495 - RNA, 22 nt, Human
uuagaaauacaagugagguuga

SEQ ID NO: 395496 - RNA, 22 nt, Human
ugcagguaggccugacuuccag

SEQ ID NO: 395497 - RNA, 22 nt, Human
ugugaauacagcaugugcuucu

SEQ ID NO: 395498 - RNA, 22 nt, Human
uaauagaauaguggaaacauug

SEQ ID NO: 395499 - RNA, 22 nt, Human
cuuaauuacccaaugugguagg

SEQ ID NO: 395500 - RNA, 22 nt, Human
caguccuuagucuggauggcuu

SEQ ID NO: 395501 - RNA, 22 nt, Human
caaguccucugguuucaaauag

SEQ ID NO: 395502 - RNA, 23 nt, Human
uaucagugugaugaggcugcugc

SEQ ID NO: 395503 - RNA, 22 nt, Human
aaauuucaguuggaaugagcuc

SEQ ID NO: 395504 - RNA, 22 nt, Human
cugaaagguauaaauaagacuu

SEQ ID NO: 395505 - RNA, 22 nt, Human
agaaccucuggauacaguuuaa

SEQ ID NO: 395506 - RNA, 22 nt, Human
cacaaagucugcagcugcugua

SEQ ID NO: 395507 - RNA, 22 nt, Human
caggccagguggcaggcaaaac

SEQ ID NO: 395508 - RNA, 22 nt, Human
guacagaaggagcuuuggauuc

SEQ ID NO: 395509 - RNA, 22 nt, Human
ucacagaagagauauugacaga

SEQ ID NO: 395510 - RNA, 22 nt, Human
uacagauauagagauuuauaga

SEQ ID NO: 395511 - RNA, 22 nt, Human
uucagaaaucgaguuucauguc

SEQ ID NO: 395512 - RNA, 22 nt, Human
uucacagagagaacucaaacca

SEQ ID NO: 395513 - RNA, 22 nt, Human
uuaugaaggaucagguacuugg

SEQ ID NO: 395514 - RNA, 22 nt, Human
ucucacuuuguugcccagacuu

SEQ ID NO: 395515 - RNA, 22 nt, Human
uuccaaacugccaauucagaag

SEQ ID NO: 395516 - RNA, 22 nt, Human
uguacaaucugaugauguaugg

SEQ ID NO: 395517 - RNA, 22 nt, Human
auuacacuuguucaucaucacc

SEQ ID NO: 395518 - RNA, 22 nt, Human
aaucagaacgcucgaucuucgg

SEQ ID NO: 395519 - RNA, 22 nt, Human
uuauagaacagccuccucuaga

SEQ ID NO: 395520 - RNA, 22 nt, Human
cauggcuuguaauaaauuuaua

SEQ ID NO: 395521 - RNA, 18 nt, Human
auacaagaucaaguguuc

SEQ ID NO: 395522 - RNA, 22 nt, Human
caguuucagaaucaaaacauca

SEQ ID NO: 395523 - RNA, 22 nt, Human
auccauuugaaagaacagucca

SEQ ID NO: 395524 - RNA, 22 nt, Human
acagaauuuaaagcucuagacu

SEQ ID NO: 395525 - RNA, 22 nt, Human
uggagaauuuugucaccagaca

SEQ ID NO: 395526 - RNA, 22 nt, Human
acuuuaucaggaaucacacagc

SEQ ID NO: 395527 - RNA, 22 nt, Human
ugucaccaccggaagaaacugc

SEQ ID NO: 395528 - RNA, 22 nt, Human
cauuucaaguaacagauugcuu

SEQ ID NO: 395529 - RNA, 22 nt, Human
auaugaaaguaagcaugugugu

SEQ ID NO: 395530 - RNA, 22 nt, Human
aucacaaaggguuuucucugag

SEQ ID NO: 395531 - RNA, 23 nt, Human
augcaagaguuucucaaacugga

SEQ ID NO: 395532 - RNA, 22 nt, Human
uucuucaaaauccagcaugauu

SEQ ID NO: 395533 - RNA, 22 nt, Human
uucauacuguguuuccaaguuu

SEQ ID NO: 395534 - RNA, 22 nt, Human
ugcaggaacagaacucacuccc

SEQ ID NO: 395535 - RNA, 22 nt, Human
auucaagauuaauucuauguca

SEQ ID NO: 395536 - RNA, 22 nt, Human
uucaacucuucaagaucacauc

SEQ ID NO: 395537 - RNA, 22 nt, Human
ugagacaaccuaauuaaacacc

SEQ ID NO: 395538 - RNA, 22 nt, Human
aguguuuagcaugaaguucauu

SEQ ID NO: 395539 - RNA, 20 nt, Human
uggccuuuaaauaguauucc

SEQ ID NO: 395540 - RNA, 22 nt, Human
uaucuaaauggaauauuccaga

SEQ ID NO: 395541 - RNA, 22 nt, Human
auacuuaacuguggagucauug

SEQ ID NO: 395542 - RNA, 22 nt, Human
guagaaaugguguguuucuucu

SEQ ID NO: 395543 - RNA, 21 nt, Human
caauuucaugggaagauggga

SEQ ID NO: 395544 - RNA, 22 nt, Human
augugcuuguaauguuaaaugu

SEQ ID NO: 395545 - RNA, 22 nt, Human
aaaguguacuaugucaugaaca

SEQ ID NO: 395546 - RNA, 22 nt, Human
uaaaauugcggugaauauuucc

SEQ ID NO: 395547 - RNA, 20 nt, Human
acaauacagguugugucuga

SEQ ID NO: 395548 - RNA, 22 nt, Human
gucaacuugcaagaugcugggc

SEQ ID NO: 395549 - RNA, 22 nt, Human
gcaggcuccaaggccugggaga

SEQ ID NO: 395550 - RNA, 21 nt, Human
gcuauacagaauggccagagg

SEQ ID NO: 395551 - RNA, 23 nt, Human
uuaagacuggcugaacuuaguag

SEQ ID NO: 395552 - RNA, 22 nt, Human
uuuaggcauugggugcucaagu

SEQ ID NO: 395553 - RNA, 22 nt, Human
ggcuuaaugguucuuuuucuca

SEQ ID NO: 395554 - RNA, 22 nt, Human
aacuuugaggucacugaauucc

SEQ ID NO: 395555 - RNA, 22 nt, Human
uuuaggcagaacauggacuuug

SEQ ID NO: 395556 - RNA, 21 nt, Human
uucaaagacuugaugcugacc

SEQ ID NO: 395557 - RNA, 22 nt, Human
uccagaauacucugaaaucauu

SEQ ID NO: 395558 - RNA, 22 nt, Human
uaaguccuucaccuaauccuca

SEQ ID NO: 395559 - RNA, 19 nt, Human
gaaagucauagagcuuguc

SEQ ID NO: 395560 - RNA, 22 nt, Human
ucaaaauuagugaccaaaggca

SEQ ID NO: 395561 - RNA, 22 nt, Human
uucaauucaauucuaaauauau

SEQ ID NO: 395562 - RNA, 22 nt, Human
ggauuugaauuguugaaaugau

SEQ ID NO: 395563 - RNA, 22 nt, Human
auuaggcauauaugcuuuuaau

SEQ ID NO: 395564 - RNA, 17 nt, Human
uaaagccagucaaguca

SEQ ID NO: 395565 - RNA, 22 nt, Human
ugcuuaaacacauacauacaua

SEQ ID NO: 395566 - RNA, 22 nt, Human
agccagucggggccaugcuggg

SEQ ID NO: 395567 - RNA, 22 nt, Human
aggaucugugagugcugcagac

SEQ ID NO: 395568 - RNA, 22 nt, Human
auauuaaauggauuuugggagc

SEQ ID NO: 395569 - RNA, 22 nt, Human
uuauagugggcccaacauggcg

SEQ ID NO: 395570 - RNA, 22 nt, Human
acuuugaaggggaacauuuuaa

SEQ ID NO: 395571 - RNA, 22 nt, Human
uucauuuguugacagagacaug

SEQ ID NO: 395572 - RNA, 22 nt, Human
uuaguacugauagggucaauca

SEQ ID NO: 395573 - RNA, 22 nt, Human
ucaaaauuucagcacuagcccu

SEQ ID NO: 395574 - RNA, 21 nt, Human
uccagaaaagaggucauuagc

SEQ ID NO: 395575 - RNA, 22 nt, Human
ucuggaucucccucauccuggg

SEQ ID NO: 395576 - RNA, 22 nt, Human
gaguccuugacacauaguaggu

SEQ ID NO: 395577 - RNA, 22 nt, Human
uuauuauuccccaagucauuau

SEQ ID NO: 395578 - RNA, 22 nt, Human
uauuucaagaacuucuauccau

SEQ ID NO: 395579 - RNA, 22 nt, Human
uuucaaguguccugauuaaugg

SEQ ID NO: 395580 - RNA, 22 nt, Human
cagucaccuugaggacucagac

SEQ ID NO: 395581 - RNA, 22 nt, Human
uaauuauagccgcuauuuugcu

SEQ ID NO: 395582 - RNA, 20 nt, Human
auucuacaagaauaagcaug

SEQ ID NO: 395583 - RNA, 22 nt, Human
agccauuuuccugaaauauaac

SEQ ID NO: 395584 - RNA, 22 nt, Human
gauucaauguugcagauggaau

SEQ ID NO: 395585 - RNA, 22 nt, Human
uguucuagcaacacaguuuugg

SEQ ID NO: 395586 - RNA, 22 nt, Human
cccaaaguacaaguaaacaugu

SEQ ID NO: 395587 - RNA, 22 nt, Human
gcuuuaaugcuucguggggcca

SEQ ID NO: 395588 - RNA, 22 nt, Human
cuuacagagaagaaaauguagu

SEQ ID NO: 395589 - RNA, 23 nt, Human
acaacuuuacagauacauuuugu

SEQ ID NO: 395590 - RNA, 22 nt, Human
gauuuauaguaugugcuuucag

SEQ ID NO: 395591 - RNA, 22 nt, Human
uagcagaagaacaacaugaucu

SEQ ID NO: 395592 - RNA, 18 nt, Human
aaguccuuccuuugcuuu

SEQ ID NO: 395593 - RNA, 22 nt, Human
auacagaauacuaauuccugag

SEQ ID NO: 395594 - RNA, 22 nt, Human
uuucuagugguuaagauuuaca

SEQ ID NO: 395595 - RNA, 22 nt, Human
agucuuaacuaugcaaguacua

SEQ ID NO: 395596 - RNA, 22 nt, Human
agagaauuggagcagugacagg

SEQ ID NO: 395597 - RNA, 22 nt, Human
aagucauagucgggaaagacau

SEQ ID NO: 395598 - RNA, 22 nt, Human
auuuagcaaaaaaugaugaagc

SEQ ID NO: 395599 - RNA, 21 nt, Human
agagacugucacugcaguacc

SEQ ID NO: 395600 - RNA, 22 nt, Human
uuaauuaugcaaaaggccccau

SEQ ID NO: 395601 - RNA, 22 nt, Human
auuucauagauuguaaaucccu

SEQ ID NO: 395602 - RNA, 22 nt, Human
auuauucaacacuugagaaauu

SEQ ID NO: 395603 - RNA, 22 nt, Human
uaucugagaaagaagcaccaga

SEQ ID NO: 395604 - RNA, 22 nt, Human
aguauaauuagauaucaaaagu

SEQ ID NO: 395605 - RNA, 19 nt, Human
uacauacuuauucuaaaag

SEQ ID NO: 395606 - RNA, 22 nt, Human
cacccagugaaggagcaagagg

SEQ ID NO: 395607 - RNA, 22 nt, Human
gcagagaacccagcagauuggc

SEQ ID NO: 395608 - RNA, 22 nt, Human
acauaauaaaaauaacagcuca

SEQ ID NO: 395609 - RNA, 22 nt, Human
acuggaucagaaucugauuuuu

SEQ ID NO: 395610 - RNA, 22 nt, Human
cuuaggcagacugcugaugcag

SEQ ID NO: 395611 - RNA, 22 nt, Human
augguuuuagaaucaggaaaaa

SEQ ID NO: 395612 - RNA, 22 nt, Human
acagcauugagagcuaaauuua

SEQ ID NO: 395613 - RNA, 22 nt, Human
uauaacaggaaguauucaaaca

SEQ ID NO: 395614 - RNA, 22 nt, Human
acaacaaagacacuugaaauga

SEQ ID NO: 395615 - RNA, 22 nt, Human
aauuuacaggugcacucgccau

SEQ ID NO: 395616 - RNA, 22 nt, Human
cuuaaagaguauuuaauauaau

SEQ ID NO: 395617 - RNA, 22 nt, Human
ucaaaucagcaagcagcuuccc

SEQ ID NO: 395618 - RNA, 22 nt, Human
uaaauaucaccuggaauuguua

SEQ ID NO: 395619 - RNA, 22 nt, Human
uucacauaaugauacaaagcuu

SEQ ID NO: 395620 - RNA, 22 nt, Human
cuggcuuucuguuauaaagaca

SEQ ID NO: 395621 - RNA, 22 nt, Human
uuccugggacuggagcagccca

SEQ ID NO: 395622 - RNA, 22 nt, Human
acaaaguccugguguauggcca

SEQ ID NO: 395623 - RNA, 21 nt, Human
agucccauccgguaagcaagc

SEQ ID NO: 395624 - RNA, 22 nt, Human
agaaaugcucaggucaacuuaa

SEQ ID NO: 395625 - RNA, 22 nt, Human
gaacuuuaccauuuagguaacu

SEQ ID NO: 395626 - RNA, 22 nt, Human
ugauaauauuuugaaucauaag

SEQ ID NO: 395627 - RNA, 22 nt, Human
uacuaaacccucgauggaucuu

SEQ ID NO: 395628 - RNA, 22 nt, Human
auaaaaguaggaccaacuuaca

SEQ ID NO: 395629 - RNA, 22 nt, Human
aaaacugaaauacgauccaaug

SEQ ID NO: 395630 - RNA, 22 nt, Human
cuuugaauugccguuucaucug

SEQ ID NO: 395631 - RNA, 22 nt, Human
aucagaaaauacccaguguuua

SEQ ID NO: 395632 - RNA, 22 nt, Human
augguuuuccucugcugcuuaa

SEQ ID NO: 395633 - RNA, 22 nt, Human
cauuucaauuauuugcucuucu

SEQ ID NO: 395634 - RNA, 22 nt, Human
aaacuuuguucgucugaugugg

SEQ ID NO: 395635 - RNA, 22 nt, Human
uauaaaauggcaucagcuccaa

SEQ ID NO: 395636 - RNA, 22 nt, Human
uuuuccaaaguaccaugucccu

SEQ ID NO: 395637 - RNA, 22 nt, Human
gauaaugaugacaaugacaacc

SEQ ID NO: 395638 - RNA, 22 nt, Human
ucuaaacagccucuuaccaacu

SEQ ID NO: 395639 - RNA, 22 nt, Human
aguaaaauuaauggaucagaag

SEQ ID NO: 395640 - RNA, 22 nt, Human
aguguucauuuauucauucacu

SEQ ID NO: 395641 - RNA, 22 nt, Human
ugcacaaacuugugucccaggg

SEQ ID NO: 395642 - RNA, 22 nt, Human
augaaaacggaccagagcuauu

SEQ ID NO: 395643 - RNA, 22 nt, Human
uaauuauaacaguuacaucuua

SEQ ID NO: 395644 - RNA, 22 nt, Human
caauuucagugcuguggagagg

SEQ ID NO: 395645 - RNA, 22 nt, Human
auggcuuugaaguaauguaauu

SEQ ID NO: 395646 - RNA, 22 nt, Human
uuccuuagugacuucuagcuac

SEQ ID NO: 395647 - RNA, 22 nt, Human
aaguccuuucucauggaggaau

SEQ ID NO: 395648 - RNA, 22 nt, Human
aauuucaaagcucacuggcaua

SEQ ID NO: 395649 - RNA, 22 nt, Human
uuccaaagugcuggaauuacau

SEQ ID NO: 395650 - RNA, 22 nt, Human
uaacaagucauuuuaaauuaug

SEQ ID NO: 395651 - RNA, 22 nt, Human
uacuuugaagacaauaucugga

SEQ ID NO: 395652 - RNA, 22 nt, Human
agauuucacaugcugcucuauu

SEQ ID NO: 395653 - RNA, 23 nt, Human
ucuauacauacugcagccucugg

SEQ ID NO: 395654 - RNA, 22 nt, Human
gugaauaaucacccuucuggau

SEQ ID NO: 395655 - RNA, 22 nt, Human
uagauauaucugucauacuggu

SEQ ID NO: 395656 - RNA, 22 nt, Human
ucaguaaaugaaugaauauaug

SEQ ID NO: 395657 - RNA, 22 nt, Human
uucacagaguuauuuuuaugcu

SEQ ID NO: 395658 - RNA, 22 nt, Human
caguccuucuccauuaaggcuc

SEQ ID NO: 395659 - RNA, 22 nt, Human
uggcuuuacacauccacugccu

SEQ ID NO: 395660 - RNA, 22 nt, Human
gaauuucacaaggugaggauaa

SEQ ID NO: 395661 - RNA, 22 nt, Human
ucagaauuuugguuugguuggu

SEQ ID NO: 395662 - RNA, 22 nt, Human
uugaauaauuaauuacacucag

SEQ ID NO: 395663 - RNA, 22 nt, Human
ugaucugagagcagaucaccau

SEQ ID NO: 395664 - RNA, 22 nt, Human
auggcuuaagaaugcuuuugug

SEQ ID NO: 395665 - RNA, 22 nt, Human
uuuacagaauguugaauuuggg

SEQ ID NO: 395666 - RNA, 22 nt, Human
aaucagaauuuguccccugagu

SEQ ID NO: 395667 - RNA, 22 nt, Human
auuacaagaugcauccauauuu

SEQ ID NO: 395668 - RNA, 23 nt, Human
uuacagaaaguaugcuuuuguuu

SEQ ID NO: 395669 - RNA, 22 nt, Human
aauuccagcuaggaaaagcuuc

SEQ ID NO: 395670 - RNA, 22 nt, Human
cuggaucaugggaaagggauca

SEQ ID NO: 395671 - RNA, 22 nt, Human
uuauaacaucaaucagaguuaa

SEQ ID NO: 395672 - RNA, 22 nt, Human
aucagaaaguucaucauguuug

SEQ ID NO: 395673 - RNA, 22 nt, Human
agauuuccuaugguaauuauag

SEQ ID NO: 395674 - RNA, 22 nt, Human
gauggcuuugugcaccaugauu

SEQ ID NO: 395675 - RNA, 18 nt, Human
caauuucauccuuaagcc

SEQ ID NO: 395676 - RNA, 22 nt, Human
uccuuaauauggaagaguucuc

SEQ ID NO: 395677 - RNA, 22 nt, Human
gaauacaaacuuaaggcuuuac

SEQ ID NO: 395678 - RNA, 22 nt, Human
aagucauugguagcuugauagg

SEQ ID NO: 395679 - RNA, 22 nt, Human
aaucagcuaaauaaacuaguca

SEQ ID NO: 395680 - RNA, 22 nt, Human
augguauugcaacaacugucau

SEQ ID NO: 395681 - RNA, 22 nt, Human
uucauacucacuccaauaacug

SEQ ID NO: 395682 - RNA, 22 nt, Human
uaaagccacgcuggaaaucagg

SEQ ID NO: 395683 - RNA, 22 nt, Human
gcaaaauuuacacuccuucuuc

SEQ ID NO: 395684 - RNA, 22 nt, Human
ugaauaauuccuuuuugucaag

SEQ ID NO: 395685 - RNA, 22 nt, Human
uguauacaggcauaagagauac

SEQ ID NO: 395686 - RNA, 22 nt, Human
ucacauaaauuauacaauuuca

SEQ ID NO: 395687 - RNA, 22 nt, Human
uuccuuaggggacagggggaua

SEQ ID NO: 395688 - RNA, 22 nt, Human
uguuuauaccugcaaccuguca

SEQ ID NO: 395689 - RNA, 22 nt, Human
aaguccaugaucaagauguggc

SEQ ID NO: 395690 - RNA, 22 nt, Human
gaaugaaagauuugcauucuau

SEQ ID NO: 395691 - RNA, 22 nt, Human
ucagaaaugaucguuauucauu

SEQ ID NO: 395692 - RNA, 22 nt, Human
gcacaauaacagccaagguuau

SEQ ID NO: 395693 - RNA, 22 nt, Human
aaaguucaugguguuauagaaa

SEQ ID NO: 395694 - RNA, 22 nt, Human
uaucagaacacauguuuugcag

SEQ ID NO: 395695 - RNA, 22 nt, Human
ugcaacuuguuuggagagaaag

SEQ ID NO: 395696 - RNA, 22 nt, Human
uaacagaaauaguaggugaggg

SEQ ID NO: 395697 - RNA, 22 nt, Human
ugaaugaacuaaaucauaguuc

SEQ ID NO: 395698 - RNA, 22 nt, Human
gaaguccucaaugcauugucuu

SEQ ID NO: 395699 - RNA, 22 nt, Human
gugauuuaguguuaaguauguu

SEQ ID NO: 395700 - RNA, 22 nt, Human
auucauaacggcaaaugucacc

SEQ ID NO: 395701 - RNA, 22 nt, Human
cagaaagcuuaggcaaguugga

SEQ ID NO: 395702 - RNA, 22 nt, Human
agucauaaagccagugggaggc

SEQ ID NO: 395703 - RNA, 22 nt, Human
auuauucaaucauauuaaaagu

SEQ ID NO: 395704 - RNA, 22 nt, Human
gauaauaagcacagcaggaugu

SEQ ID NO: 395705 - RNA, 22 nt, Human
uuacagaagagaaagaauucag

SEQ ID NO: 395706 - RNA, 22 nt, Human
ugauuuaaaagaaacauugucu

SEQ ID NO: 395707 - RNA, 22 nt, Human
cagaaaaggaagagcuauguaa

SEQ ID NO: 395708 - RNA, 22 nt, Human
gaagaauccaugcuaauuuacc

SEQ ID NO: 395709 - RNA, 22 nt, Human
caucagaaugaauguucuggag

SEQ ID NO: 395710 - RNA, 22 nt, Human
gugaauaaaacaccugccaaga

SEQ ID NO: 395711 - RNA, 22 nt, Human
uuauacuuuauacuacaucauu

SEQ ID NO: 395712 - RNA, 22 nt, Human
agauaaaaugguucaaaggcua

SEQ ID NO: 395713 - RNA, 22 nt, Human
ccacuucaucagugcuccauuu

SEQ ID NO: 395714 - RNA, 22 nt, Human
aauacugucuuucacagauauu

SEQ ID NO: 395715 - RNA, 22 nt, Human
uuccuuaguugacugucuuagu

SEQ ID NO: 395716 - RNA, 22 nt, Human
auacaaugagugagugaauggg

SEQ ID NO: 395717 - RNA, 22 nt, Human
cacaagaaauaagcugccuuuc

SEQ ID NO: 395718 - RNA, 22 nt, Human
uaaauacagucauuugagccau

SEQ ID NO: 395719 - RNA, 22 nt, Human
gauggcuucagucuccuugggu

SEQ ID NO: 395720 - RNA, 22 nt, Human
gcaaacaagcugccugaagauu

SEQ ID NO: 395721 - RNA, 21 nt, Human
uuacagaauccaugggaaguc

SEQ ID NO: 395722 - RNA, 22 nt, Human
aggauuuaccgucauuuagucu

SEQ ID NO: 395723 - RNA, 22 nt, Human
uucagaaacagagugagugagu

SEQ ID NO: 395724 - RNA, 22 nt, Human
aagauauagauggugguauaaa

SEQ ID NO: 395725 - RNA, 19 nt, Human
aaucagaaauaucgaggcc

SEQ ID NO: 395726 - RNA, 22 nt, Human
auagcuuuacagaagaguuuag

SEQ ID NO: 395727 - RNA, 22 nt, Human
gaaauauacaugaagucggcug

SEQ ID NO: 395728 - RNA, 22 nt, Human
aaauuauaggugccaccuugga

SEQ ID NO: 395729 - RNA, 22 nt, Human
uuaggaaaggguuuucuaacag

SEQ ID NO: 395730 - RNA, 22 nt, Human
uuugaauagcauaggauuacau

SEQ ID NO: 395731 - RNA, 22 nt, Human
uuuauuauguacaggcacuaua

SEQ ID NO: 395732 - RNA, 22 nt, Human
uguauaaauuuaaauuccugcu

SEQ ID NO: 395733 - RNA, 22 nt, Human
uucauagaucucaauuuugagg

SEQ ID NO: 395734 - RNA, 20 nt, Human
caccagucaugagucaauac

SEQ ID NO: 395735 - RNA, 22 nt, Human
acaugcuuugauguauuuugca

SEQ ID NO: 395736 - RNA, 20 nt, Human
aacaguaccauuuaucucag

SEQ ID NO: 395737 - RNA, 22 nt, Human
uaaguccuagaugauucacaga

SEQ ID NO: 395738 - RNA, 22 nt, Human
gguacaauggaccauaaaagcu

SEQ ID NO: 395739 - RNA, 22 nt, Human
auuaggcagggcaugguggcuc

SEQ ID NO: 395740 - RNA, 22 nt, Human
cuuuacauccuguuucccguuu

SEQ ID NO: 395741 - RNA, 22 nt, Human
uuccuuagcagaccugguaucc

SEQ ID NO: 395742 - RNA, 22 nt, Human
caguccuugcuaugacccugag

SEQ ID NO: 395743 - RNA, 18 nt, Human
auuguuaauagaguacuu

SEQ ID NO: 395744 - RNA, 22 nt, Human
uuacagaaaagggcuuuaagag

SEQ ID NO: 395745 - RNA, 22 nt, Human
uuucaacauauaccauaaugcc

SEQ ID NO: 395746 - RNA, 20 nt, Human
ugcaggaauuugcauuccuu

SEQ ID NO: 395747 - RNA, 22 nt, Human
ucaacuuuaguguagcuauuua

SEQ ID NO: 395748 - RNA, 22 nt, Human
agucaccagguuuuagagaccu

SEQ ID NO: 395749 - RNA, 22 nt, Human
uuucagacaggacuucauaugu

SEQ ID NO: 395750 - RNA, 22 nt, Human
aagugauuuguacaaaaugucg

SEQ ID NO: 395751 - RNA, 22 nt, Human
ucuggauccuaugcacuggacu

SEQ ID NO: 395752 - RNA, 22 nt, Human
uaucagaagacuuacaguaucg

SEQ ID NO: 395753 - RNA, 22 nt, Human
auacaaguugugauaauguaaa

SEQ ID NO: 395754 - RNA, 22 nt, Human
uauggaaacuaauucauuuuuc

SEQ ID NO: 395755 - RNA, 22 nt, Human
cuagaaauauuuuacagucaag

SEQ ID NO: 395756 - RNA, 22 nt, Human
uuaaggauguugugauuuauua

SEQ ID NO: 395757 - RNA, 22 nt, Human
aaacaggcaucacucagcaaag

SEQ ID NO: 395758 - RNA, 22 nt, Human
cagcccagagauguuaucuagu

SEQ ID NO: 395759 - RNA, 22 nt, Human
cauuuacaauguacagguugug

SEQ ID NO: 395760 - RNA, 22 nt, Human
ugugaauagugccgcaauaaac

SEQ ID NO: 395761 - RNA, 22 nt, Human
auauuauucuaguaacagugau

SEQ ID NO: 395762 - RNA, 22 nt, Human
aaauagauugcugaggcauuac

SEQ ID NO: 395763 - RNA, 20 nt, Human
uuccuuaggcauuggaagaa

SEQ ID NO: 395764 - RNA, 22 nt, Human
aaagucaugcaguugaacuuuu

SEQ ID NO: 395765 - RNA, 22 nt, Human
uuugaauaucacaaacuuucaa

SEQ ID NO: 395766 - RNA, 22 nt, Human
ccuggaucgaugccgagggaaa

SEQ ID NO: 395767 - RNA, 21 nt, Human
caaagccaggcaacucucucc

SEQ ID NO: 395768 - RNA, 22 nt, Human
caucagaagaaagacaaaugau

SEQ ID NO: 395769 - RNA, 22 nt, Human
uaagucauaagucaugauguua

SEQ ID NO: 395770 - RNA, 22 nt, Human
acuaaacugaagcaugaaaagg

SEQ ID NO: 395771 - RNA, 22 nt, Human
auauacaaagggcaaccucgcu

SEQ ID NO: 395772 - RNA, 22 nt, Human
cuuaggcaaccaggucaaugcu

SEQ ID NO: 395773 - RNA, 22 nt, Human
aaaucaguuguuauauuaaaga

SEQ ID NO: 395774 - RNA, 22 nt, Human
uuucaucucucuaaaagacagu

SEQ ID NO: 395775 - RNA, 22 nt, Human
auaucaaagcuaguggaaauuu

SEQ ID NO: 395776 - RNA, 22 nt, Human
uuaaagauucugaggcugauua

SEQ ID NO: 395777 - RNA, 22 nt, Human
ccuggaucuuucugacugacaa

SEQ ID NO: 395778 - RNA, 22 nt, Human
cuagaaauucugauucaguagg

SEQ ID NO: 395779 - RNA, 22 nt, Human
gacaguccuugcccaguaucua

SEQ ID NO: 395780 - RNA, 22 nt, Human
acaugcuucauauuauaaccaa

SEQ ID NO: 395781 - RNA, 22 nt, Human
caauuucaucuugugcuucaau

SEQ ID NO: 395782 - RNA, 22 nt, Human
acuagaaacuaauggauuauua

SEQ ID NO: 395783 - RNA, 22 nt, Human
gaaagaggaaggagauguauua

SEQ ID NO: 395784 - RNA, 22 nt, Human
ucagaacauugacauucuuauu

SEQ ID NO: 395785 - RNA, 22 nt, Human
uuuauccaguguuggaauuuuu

SEQ ID NO: 395786 - RNA, 22 nt, Human
uacaguauguucuugaauuugg

SEQ ID NO: 395787 - RNA, 22 nt, Human
gaauuucauuuguuuccuacca

SEQ ID NO: 395788 - RNA, 22 nt, Human
aaguuucauuguucauguaaca

SEQ ID NO: 395789 - RNA, 22 nt, Human
aaucagaaaggcuaaggaagca

SEQ ID NO: 395790 - RNA, 22 nt, Human
auuaaauguuggacguauacau

SEQ ID NO: 395791 - RNA, 22 nt, Human
cuuuacagaauaagaauacugg

SEQ ID NO: 395792 - RNA, 22 nt, Human
guauagaaacccagaaagauag

SEQ ID NO: 395793 - RNA, 22 nt, Human
ccuggaucagucacuguugcug

SEQ ID NO: 395794 - RNA, 21 nt, Human
aggauuuacuauuaacugugu

SEQ ID NO: 395795 - RNA, 22 nt, Human
gcuauacaaguguagaauagag

SEQ ID NO: 395796 - RNA, 22 nt, Human
aaugcuuaauucaauacugugu

SEQ ID NO: 395797 - RNA, 22 nt, Human
auuccaaaaggauguuagaaug

SEQ ID NO: 395798 - RNA, 22 nt, Human
acagaauuaaugaaaauuacaa

SEQ ID NO: 395799 - RNA, 22 nt, Human
acauaauagguaccugaauaau

SEQ ID NO: 395800 - RNA, 18 nt, Human
uacagauuauagauacau

SEQ ID NO: 395801 - RNA, 22 nt, Human
ggaucugagagcaagcaggacc

SEQ ID NO: 395802 - RNA, 22 nt, Human
auagaaauggcagcuggugcua

SEQ ID NO: 395803 - RNA, 22 nt, Human
augaaauauuucagagcagagu

SEQ ID NO: 395804 - RNA, 21 nt, Human
auacagaacauugauccaaga

SEQ ID NO: 395805 - RNA, 22 nt, Human
ugauauuuaagcaaaaauaugg

SEQ ID NO: 395806 - RNA, 22 nt, Human
aaggcauaggacaaaucaguga

SEQ ID NO: 395807 - RNA, 22 nt, Human
uggauuuauggagaccgaaagu

SEQ ID NO: 395808 - RNA, 22 nt, Human
auuauagaggguuacaguuaau

SEQ ID NO: 395809 - RNA, 22 nt, Human
uagaaaucagcaggcauaugua

SEQ ID NO: 395810 - RNA, 22 nt, Human
augcaaaauaaggcagaaacau

SEQ ID NO: 395811 - RNA, 22 nt, Human
ugcuuuaacauaagauaucuuu

SEQ ID NO: 395812 - RNA, 22 nt, Human
ggcauuuagagggcuuuucuga

SEQ ID NO: 395813 - RNA, 22 nt, Human
ugugaaagcaagucuaguucuc

SEQ ID NO: 395814 - RNA, 22 nt, Human
augcuuaacucuguacauaguu

SEQ ID NO: 395815 - RNA, 22 nt, Human
ucaaacauguuagcagucugug

SEQ ID NO: 395816 - RNA, 21 nt, Human
ugaaagaaggugcagucugaa

SEQ ID NO: 395817 - RNA, 22 nt, Human
ucacagaagaugcuggauguug

SEQ ID NO: 395818 - RNA, 22 nt, Human
uaauuucaaauuucuuagcgug

SEQ ID NO: 395819 - RNA, 22 nt, Human
gcucuaauugaaaaauacugca

SEQ ID NO: 395820 - RNA, 22 nt, Human
cauaauuacugauaugcugauu

SEQ ID NO: 395821 - RNA, 16 nt, Human
ccuggauccccugugg

SEQ ID NO: 395822 - RNA, 22 nt, Human
uucuauacaaagauuucucaca

SEQ ID NO: 395823 - RNA, 22 nt, Human
uggcaauuuuaggugguuuagu

SEQ ID NO: 395824 - RNA, 23 nt, Human
ucuguacacaucagcaucuccca

SEQ ID NO: 395825 - RNA, 22 nt, Human
acagccaggaggaacucaguga

SEQ ID NO: 395826 - RNA, 22 nt, Human
caaugaaaauuuaaguugcagc

SEQ ID NO: 395827 - RNA, 22 nt, Human
cuauuauuuccucaucuauaaa

SEQ ID NO: 395828 - RNA, 22 nt, Human
uaugucaaaguuaagaaauagg

SEQ ID NO: 395829 - RNA, 22 nt, Human
aguacaacauuagaguaucuua

SEQ ID NO: 395830 - RNA, 22 nt, Human
caguccuuccuugccccuuggg

SEQ ID NO: 395831 - RNA, 22 nt, Human
uuuccaaagguggcaggaacaa

SEQ ID NO: 395832 - RNA, 22 nt, Human
uaauuuacuugcaaauaacaau

SEQ ID NO: 395833 - RNA, 18 nt, Human
ucauagaagugaaucaga

SEQ ID NO: 395834 - RNA, 22 nt, Human
aguaaaauuguauuggaaaaca

SEQ ID NO: 395835 - RNA, 22 nt, Human
uucaauacaaagaaaggaauuu

SEQ ID NO: 395836 - RNA, 20 nt, Human
gaaguccuuucacucuuccc

SEQ ID NO: 395837 - RNA, 22 nt, Human
uccauacauugaaauaccauuc

SEQ ID NO: 395838 - RNA, 22 nt, Human
cagauaaaggcuuacuaguagu

SEQ ID NO: 395839 - RNA, 22 nt, Human
aguguuuauauuauggaaauau

SEQ ID NO: 395840 - RNA, 22 nt, Human
uuugaagucaaagauugauucc

SEQ ID NO: 395841 - RNA, 22 nt, Human
uugguacaaaaguaacuguggu

SEQ ID NO: 395842 - RNA, 21 nt, Human
auuuccaaauaaggucacauu

SEQ ID NO: 395843 - RNA, 22 nt, Human
auggcuuaugaauaacaguagg

SEQ ID NO: 395844 - RNA, 22 nt, Human
uuagaaaaaacgucuucuagug

SEQ ID NO: 395845 - RNA, 22 nt, Human
aggaaaaauaaggcagcagggc

SEQ ID NO: 395846 - RNA, 22 nt, Human
uguucagcccucuauuaaucag

SEQ ID NO: 395847 - RNA, 22 nt, Human
caugauaauuguuaacaaagua

SEQ ID NO: 395848 - RNA, 22 nt, Human
cauuuacagugagaguuuuuac

SEQ ID NO: 395849 - RNA, 22 nt, Human
uaacagaagaaaacauauugga

SEQ ID NO: 395850 - RNA, 22 nt, Human
augaaauaucuugaagaaauuc

SEQ ID NO: 395851 - RNA, 22 nt, Human
aauuccaggaugcaggaggugc

SEQ ID NO: 395852 - RNA, 22 nt, Human
aaugccaacuuggauauacauu

SEQ ID NO: 395853 - RNA, 22 nt, Human
aaaacagacagccaguguagag

SEQ ID NO: 395854 - RNA, 22 nt, Human
cuuugaagauggcaaauuuaga

SEQ ID NO: 395855 - RNA, 23 nt, Human
ucagagaacucgggcagaugacc

SEQ ID NO: 395856 - RNA, 22 nt, Human
auauaauuguucugaaguguuu

SEQ ID NO: 395857 - RNA, 22 nt, Human
aaaucaguaaauguucauuaac

SEQ ID NO: 395858 - RNA, 22 nt, Human
ucugaagaacugaguaaacaug

SEQ ID NO: 395859 - RNA, 22 nt, Human
aggcuucuucuuccuauuuagu

SEQ ID NO: 395860 - RNA, 22 nt, Human
auuaaagaaacccagcauguga

SEQ ID NO: 395861 - RNA, 22 nt, Human
uagucaccuguugugugaugcc

SEQ ID NO: 395862 - RNA, 22 nt, Human
auaacaugagccagauugaaag

SEQ ID NO: 395863 - RNA, 18 nt, Human
gaaagccaugcagcagug

SEQ ID NO: 395864 - RNA, 22 nt, Human
augugcuuuauuaaguaaaaau

SEQ ID NO: 395865 - RNA, 22 nt, Human
aaagccagguugugugcaggaa

SEQ ID NO: 395866 - RNA, 22 nt, Human
guuaggcaugaguguguauuaa

SEQ ID NO: 395867 - RNA, 23 nt, Human
ggauuuaguggaugagcugagug

SEQ ID NO: 395868 - RNA, 22 nt, Human
auaaaaguucaagagaguacag

SEQ ID NO: 395869 - RNA, 22 nt, Human
gcacaauaauuuuuuuaagagg

SEQ ID NO: 395870 - RNA, 22 nt, Human
uagcagaaacuguuacagaagg

SEQ ID NO: 395871 - RNA, 22 nt, Human
aaaguccuguuaacuguuaaca

SEQ ID NO: 395872 - RNA, 22 nt, Human
aaagucauuggaauauuaauga

SEQ ID NO: 395873 - RNA, 22 nt, Human
aaaaauugcugagaacggaauu

SEQ ID NO: 395874 - RNA, 22 nt, Human
auuuccaggagaaaggauuuua

SEQ ID NO: 395875 - RNA, 22 nt, Human
auuccaaacgccucgcggacuu

SEQ ID NO: 395876 - RNA, 22 nt, Human
aaucaguguguaaaguggcugc

SEQ ID NO: 395877 - RNA, 22 nt, Human
uuuaaugauagcuguuucacau

SEQ ID NO: 395878 - RNA, 22 nt, Human
aauauuucugcagaaugguuuu

SEQ ID NO: 395879 - RNA, 22 nt, Human
uuugguccugagcaaaacuaug

SEQ ID NO: 395880 - RNA, 22 nt, Human
acaugucuguaauuauuuuagg

SEQ ID NO: 395881 - RNA, 22 nt, Human
ugaaacaagauccacagacuug

SEQ ID NO: 395882 - RNA, 22 nt, Human
gaaguccuccuaucuugcucuu

SEQ ID NO: 395883 - RNA, 22 nt, Human
gcuggauccugauucgucuuug

SEQ ID NO: 395884 - RNA, 22 nt, Human
auccaaacauguaccacacuaa

SEQ ID NO: 395885 - RNA, 22 nt, Human
caucagaaagaguccuggacuu

SEQ ID NO: 395886 - RNA, 22 nt, Human
gaguccuuuugugccacaggga

SEQ ID NO: 395887 - RNA, 22 nt, Human
cagaaacauguauaaaguugua

SEQ ID NO: 395888 - RNA, 22 nt, Human
uaaagcaguguugggucggacg

SEQ ID NO: 395889 - RNA, 22 nt, Human
auccuuaguuaagaacaggagu

SEQ ID NO: 395890 - RNA, 22 nt, Human
uuucaacguguaaucuuauuua

SEQ ID NO: 395891 - RNA, 22 nt, Human
cuucuuaaauuggauugcuauu

SEQ ID NO: 395892 - RNA, 22 nt, Human
uuaacacuugaacucuacaugu

SEQ ID NO: 395893 - RNA, 22 nt, Human
gaguccuucuggcuggcaggau

SEQ ID NO: 395894 - RNA, 22 nt, Human
aacagaauaguugauguacagu

SEQ ID NO: 395895 - RNA, 22 nt, Human
uguacaaugccagggaacacca

SEQ ID NO: 395896 - RNA, 20 nt, Human
ucuaauuaaaauugucuagu

SEQ ID NO: 395897 - RNA, 22 nt, Human
uuuaggcacaacuacucagcua

SEQ ID NO: 395898 - RNA, 22 nt, Human
ucuaaacacuaagucuugaugc

SEQ ID NO: 395899 - RNA, 22 nt, Human
caguccuuauuccuauauuccu

SEQ ID NO: 395900 - RNA, 22 nt, Human
uacuauaccauguaagauauga

SEQ ID NO: 395901 - RNA, 22 nt, Human
uacuagaaccucacaacaaucc

SEQ ID NO: 395902 - RNA, 22 nt, Human
aaugaacauauaaagagaucuu

SEQ ID NO: 395903 - RNA, 22 nt, Human
uuugaagauaaauauggagaaa

SEQ ID NO: 395904 - RNA, 22 nt, Human
uauggaaagggaguuuaauuug

SEQ ID NO: 395905 - RNA, 18 nt, Human
aauuuccauaugaauugc

SEQ ID NO: 395906 - RNA, 22 nt, Human
uggauuuaccacagggccacag

SEQ ID NO: 395907 - RNA, 22 nt, Human
uauacagauggaaagauacaca

SEQ ID NO: 395908 - RNA, 22 nt, Human
agaauuuccuaugagagauucc

SEQ ID NO: 395909 - RNA, 22 nt, Human
aucacaaaggucucagagcaca

SEQ ID NO: 395910 - RNA, 22 nt, Human
cacaauacuauuuuuaggucuu

SEQ ID NO: 395911 - RNA, 21 nt, Human
ucaguaaaccuaaagauugua

SEQ ID NO: 395912 - RNA, 22 nt, Human
caguccuugauccaauaguggg

SEQ ID NO: 395913 - RNA, 22 nt, Human
ggcauuuaauccaucugauuga

SEQ ID NO: 395914 - RNA, 22 nt, Human
aauaacagauuuucaagcugug

SEQ ID NO: 395915 - RNA, 22 nt, Human
gaagaaucaagcaguaauuugu

SEQ ID NO: 395916 - RNA, 22 nt, Human
aguaaacaguaucuuuaguguc

SEQ ID NO: 395917 - RNA, 22 nt, Human
uguggaaagucaaguuccagga

SEQ ID NO: 395918 - RNA, 22 nt, Human
ucagaaauagucuuuaaaauga

SEQ ID NO: 395919 - RNA, 22 nt, Human
ucauaaaguuaucaccaaaucc

SEQ ID NO: 395920 - RNA, 22 nt, Human
aaugaacagauacacauaggca

SEQ ID NO: 395921 - RNA, 22 nt, Human
ugcagagagauauggcaagagg

SEQ ID NO: 395922 - RNA, 22 nt, Human
uucagagaagcaaaggcagauu

SEQ ID NO: 395923 - RNA, 22 nt, Human
aauaauuacccaucuuuuugua

SEQ ID NO: 395924 - RNA, 22 nt, Human
gggauuuaguaggauaguauac

SEQ ID NO: 395925 - RNA, 22 nt, Human
caucagaaaccuugaggaaacu

SEQ ID NO: 395926 - RNA, 22 nt, Human
aaagucauguaaugauaugauu

SEQ ID NO: 395927 - RNA, 22 nt, Human
cuggcuuuaacccuacaaaccu

SEQ ID NO: 395928 - RNA, 22 nt, Human
uugaauaauaugcuucguucuc

SEQ ID NO: 395929 - RNA, 22 nt, Human
gcacaauaauucuuguuuugcu

SEQ ID NO: 395930 - RNA, 22 nt, Human
caucagaauuacuuggggagcu

SEQ ID NO: 395931 - RNA, 22 nt, Human
uaaguccuggcugguuugaagc

SEQ ID NO: 395932 - RNA, 22 nt, Human
gaaugaauucagcacauggaau

SEQ ID NO: 395933 - RNA, 22 nt, Human
uuuaggcauacuuuugggagaa

SEQ ID NO: 395934 - RNA, 22 nt, Human
auccuuagaagggagugaggac

SEQ ID NO: 395935 - RNA, 22 nt, Human
uuacagaaugugccauuugguc

SEQ ID NO: 395936 - RNA, 22 nt, Human
guuaauauuuaccugucaagaa

SEQ ID NO: 395937 - RNA, 22 nt, Human
cugaaaggguuacauaguaagu

SEQ ID NO: 395938 - RNA, 22 nt, Human
uuagaaaugauuucaccucuuu

SEQ ID NO: 395939 - RNA, 22 nt, Human
ucagccagcaucagcuaagugc

SEQ ID NO: 395940 - RNA, 16 nt, Human
uuuccaaagggcagcu

SEQ ID NO: 395941 - RNA, 22 nt, Human
caauuucagguggauagguuuu

SEQ ID NO: 395942 - RNA, 22 nt, Human
ugaaacaaugugaaguugcuga

SEQ ID NO: 395943 - RNA, 22 nt, Human
auguucaaacaaguuaaugcca

SEQ ID NO: 395944 - RNA, 22 nt, Human
agcauuuauuucuuagaaauug

SEQ ID NO: 395945 - RNA, 21 nt, Human
auucagaguaauucaucuuua

SEQ ID NO: 395946 - RNA, 22 nt, Human
acagauuuuugguaaauaauuu

SEQ ID NO: 395947 - RNA, 22 nt, Human
aaaacuuucagggauacagaaa

SEQ ID NO: 395948 - RNA, 22 nt, Human
ugaaauaggaaacagauguuuc

SEQ ID NO: 395949 - RNA, 22 nt, Human
acuuauuagcugugugaccuug

SEQ ID NO: 395950 - RNA, 22 nt, Human
aacuuuguguguuuaauauggc

SEQ ID NO: 395951 - RNA, 22 nt, Human
aaucaaaaccuacagagguaau

SEQ ID NO: 395952 - RNA, 22 nt, Human
aaagaaggaugggagaaauccu

SEQ ID NO: 395953 - RNA, 22 nt, Human
ucuauacacacaaagaaugcuu

SEQ ID NO: 395954 - RNA, 18 nt, Human
uaagucauuuugccagca

SEQ ID NO: 395955 - RNA, 22 nt, Human
cucuacucuuaacacagcuagg

SEQ ID NO: 395956 - RNA, 22 nt, Human
gcuggauccacaaauaacuuug

SEQ ID NO: 395957 - RNA, 22 nt, Human
uuuucauuuuuguagaugcaag

SEQ ID NO: 395958 - RNA, 22 nt, Human
ugcuuaauaggaguugaacauu

SEQ ID NO: 395959 - RNA, 22 nt, Human
uauacaaugaguacauucuggg

SEQ ID NO: 395960 - RNA, 22 nt, Human
gauuucaagcccccagagauuc

SEQ ID NO: 395961 - RNA, 22 nt, Human
uagaaacaucagcuaaccaaaa

SEQ ID NO: 395962 - RNA, 20 nt, Human
aaguuacauuguauuguacc

SEQ ID NO: 395963 - RNA, 22 nt, Human
ucaaaaguggccuguaaaaucu

SEQ ID NO: 395964 - RNA, 22 nt, Human
gccagucugcucccacaaguuc

SEQ ID NO: 395965 - RNA, 22 nt, Human
cauaagaauauuccauccuuug

SEQ ID NO: 395966 - RNA, 22 nt, Human
ucaauaaaauuguuuuccuauc

SEQ ID NO: 395967 - RNA, 22 nt, Human
aaucagaacuccuaccacagag

SEQ ID NO: 395968 - RNA, 22 nt, Human
aaaguccugacugcaggggaug

SEQ ID NO: 395969 - RNA, 22 nt, Human
aaaggcaugauuaauucugugu

SEQ ID NO: 395970 - RNA, 22 nt, Human
gcaggaaagguugagacuuugc

SEQ ID NO: 395971 - RNA, 22 nt, Human
augcuuaagcucaguuauauau

SEQ ID NO: 395972 - RNA, 22 nt, Human
ucuauacaugugcacacacauc

SEQ ID NO: 395973 - RNA, 22 nt, Human
auacagaaaaugaugcagaguu

SEQ ID NO: 395974 - RNA, 22 nt, Human
gcuggaucauauggugguucua

SEQ ID NO: 395975 - RNA, 22 nt, Human
auaacaugaccugugcuucaca

SEQ ID NO: 395976 - RNA, 22 nt, Human
cauuuacauaacaguaacgcug

SEQ ID NO: 395977 - RNA, 22 nt, Human
auuucacaucuaucucagauuu

SEQ ID NO: 395978 - RNA, 22 nt, Human
uggcauuugcucccuuguguuc

SEQ ID NO: 395979 - RNA, 22 nt, Human
uucaacuuuggagauuuaauaa

SEQ ID NO: 395980 - RNA, 22 nt, Human
ucccaaagcuacucuucugacu

SEQ ID NO: 395981 - RNA, 22 nt, Human
aggcagaccaugaaucaugacc

SEQ ID NO: 395982 - RNA, 22 nt, Human
uucaaagcugcagacuccuggg

SEQ ID NO: 395983 - RNA, 22 nt, Human
auucuaacacaugcucuaagaa

SEQ ID NO: 395984 - RNA, 22 nt, Human
acaagccaauuacugugccagg

SEQ ID NO: 395985 - RNA, 22 nt, Human
uacagaaaucacaucgcuuuga

SEQ ID NO: 395986 - RNA, 22 nt, Human
uucagaaagguaaauggauuuc

SEQ ID NO: 395987 - RNA, 18 nt, Human
aguccuuacgaggcuaua

SEQ ID NO: 395988 - RNA, 22 nt, Human
uuuccaaaggaggaaccaguuu

SEQ ID NO: 395989 - RNA, 19 nt, Human
aaaauugcguauuuugagg

SEQ ID NO: 395990 - RNA, 22 nt, Human
caauuucacuaauaauauuuac

SEQ ID NO: 395991 - RNA, 22 nt, Human
agauuuacuggagucuuuggug

SEQ ID NO: 395992 - RNA, 22 nt, Human
auuucauacuaaggcucaaaaa

SEQ ID NO: 395993 - RNA, 22 nt, Human
cauuuacagcagacugaugaaa

SEQ ID NO: 395994 - RNA, 22 nt, Human
ugaauaauuaugggaguccuaa

SEQ ID NO: 395995 - RNA, 22 nt, Human
augugaaaaauuucuuauuaca

SEQ ID NO: 395996 - RNA, 22 nt, Human
auggcuuaugguaaauauuucu

SEQ ID NO: 395997 - RNA, 22 nt, Human
aucuaacacuguaaacugucuu

SEQ ID NO: 395998 - RNA, 22 nt, Human
cagaauaaagguacaauugagu

SEQ ID NO: 395999 - RNA, 22 nt, Human
guccaaauuuuucacauguaga

SEQ ID NO: 396000 - RNA, 22 nt, Human
uaucagaacacagccacagcca

SEQ ID NO: 396001 - RNA, 22 nt, Human
uacacauguuuggcaaguaugu

SEQ ID NO: 396002 - RNA, 22 nt, Human
uguaaauaauuccuaggcuuuu

SEQ ID NO: 396003 - RNA, 22 nt, Human
ccaguacugucuccaauauucc

SEQ ID NO: 396004 - RNA, 22 nt, Human
ggagaaugauauauagcucagu

SEQ ID NO: 396005 - RNA, 22 nt, Human
ggcauuuaucuaauauaguuua

SEQ ID NO: 396006 - RNA, 22 nt, Human
ugucauaacuuagugacaaauc

SEQ ID NO: 396007 - RNA, 22 nt, Human
cuuaauuacuguccaauaugca

SEQ ID NO: 396008 - RNA, 22 nt, Human
cauagcuuagggguuaaacuca

SEQ ID NO: 396009 - RNA, 22 nt, Human
aauggcuucugaagcacacuuu

SEQ ID NO: 396010 - RNA, 22 nt, Human
caaugaaauugagauccagaga

SEQ ID NO: 396011 - RNA, 22 nt, Human
uuuccaaaguugccauaagcuu

SEQ ID NO: 396012 - RNA, 22 nt, Human
uauaauuaguaaauggcagauu

SEQ ID NO: 396013 - RNA, 22 nt, Human
uaaacagaaugcguaagaagug

SEQ ID NO: 396014 - RNA, 22 nt, Human
aauucacaaaaguuagauccau

SEQ ID NO: 396015 - RNA, 22 nt, Human
aaagucaucagaaccuuccaga

SEQ ID NO: 396016 - RNA, 22 nt, Human
cuacagaaucuaccucaagcca

SEQ ID NO: 396017 - RNA, 22 nt, Human
acauaaguuauggauaaaaugu

SEQ ID NO: 396018 - RNA, 22 nt, Human
ugucaccaguuccaggaaauaa

SEQ ID NO: 396019 - RNA, 22 nt, Human
gugaauaauuuuuuaguauaag

SEQ ID NO: 396020 - RNA, 22 nt, Human
gguacaauucugggguaugcuc

SEQ ID NO: 396021 - RNA, 20 nt, Human
uuccaacucacaucucuaca

SEQ ID NO: 396022 - RNA, 22 nt, Human
uaugaacauguucauugacuua

SEQ ID NO: 396023 - RNA, 22 nt, Human
uguccuuauauuguggaagggg

SEQ ID NO: 396024 - RNA, 22 nt, Human
cucuaauccuuugucccugggu

SEQ ID NO: 396025 - RNA, 22 nt, Human
uguauacauuuaacuagauaga

SEQ ID NO: 396026 - RNA, 22 nt, Human
uauacagauuaacagauuuaaa

SEQ ID NO: 396027 - RNA, 22 nt, Human
cuacagaaaccuuuuucauaca

SEQ ID NO: 396028 - RNA, 22 nt, Human
ccuuuaauuuacaauguuaauu

SEQ ID NO: 396029 - RNA, 22 nt, Human
ccagaucuucuuuucagugucu

SEQ ID NO: 396030 - RNA, 22 nt, Human
cagaauguagaucaucaucaag

SEQ ID NO: 396031 - RNA, 22 nt, Human
auggcauuugaaucugucuuuu

SEQ ID NO: 396032 - RNA, 22 nt, Human
uguaaauaguuagcuugccucu

SEQ ID NO: 396033 - RNA, 22 nt, Human
aauacauguuuucuacuauucu

SEQ ID NO: 396034 - RNA, 22 nt, Human
uauauguaagcuauguaagagu

SEQ ID NO: 396035 - RNA, 22 nt, Human
uaacagaagaugaaacuucuuu

SEQ ID NO: 396036 - RNA, 22 nt, Human
uuacagaaguuucagcguuuua

SEQ ID NO: 396037 - RNA, 22 nt, Human
cugaauaaagcccucgcgcgcu

SEQ ID NO: 396038 - RNA, 22 nt, Human
auguuaaauaaucccuuaaagc

SEQ ID NO: 396039 - RNA, 22 nt, Human
caaaagucuguccuuuaacuuc

SEQ ID NO: 396040 - RNA, 22 nt, Human
uagucaccuuuggcaccugcaa

SEQ ID NO: 396041 - RNA, 22 nt, Human
cacauacuuguguguacauaug

SEQ ID NO: 396042 - RNA, 22 nt, Human
ucaguuuccucaucuacaaaag

SEQ ID NO: 396043 - RNA, 22 nt, Human
guauuugcaaaucuaaaagaga

SEQ ID NO: 396044 - RNA, 22 nt, Human
aaugccuuuccacuggguauca

SEQ ID NO: 396045 - RNA, 22 nt, Human
uauuucaacguaugaaaagcug

SEQ ID NO: 396046 - RNA, 22 nt, Human
ucagcauaucuugagcuucaug

SEQ ID NO: 396047 - RNA, 22 nt, Human
uuucagaaccgcuaaaauaaau

SEQ ID NO: 396048 - RNA, 22 nt, Human
uucccaauauucugcuuuuaug

SEQ ID NO: 396049 - RNA, 22 nt, Human
uuuaggcacagaguugagggac

SEQ ID NO: 396050 - RNA, 22 nt, Human
aaaaguguucaggaagaauaau

SEQ ID NO: 396051 - RNA, 22 nt, Human
uguuuauaccuugguauaacca

SEQ ID NO: 396052 - RNA, 22 nt, Human
augaaaauguacauguguauaa

SEQ ID NO: 396053 - RNA, 22 nt, Human
auauaaagaaguggaaaaugag

SEQ ID NO: 396054 - RNA, 22 nt, Human
auggccuuagugaugauuaaua

SEQ ID NO: 396055 - RNA, 22 nt, Human
auguuaaaugguuuauuauuaa

SEQ ID NO: 396056 - RNA, 22 nt, Human
auguauccuuauacacauuuau

SEQ ID NO: 396057 - RNA, 22 nt, Human
cugaauaauguucucuuguaug

SEQ ID NO: 396058 - RNA, 22 nt, Human
auauauaaccuggauaaggcuu

SEQ ID NO: 396059 - RNA, 22 nt, Human
uacaugaaguugucuaaacugg

SEQ ID NO: 396060 - RNA, 22 nt, Human
auuuccagacuuuuuccaggaa

SEQ ID NO: 396061 - RNA, 19 nt, Human
uuucagacucaucuccagc

SEQ ID NO: 396062 - RNA, 22 nt, Human
gccuaauaacuagcuguguaac

SEQ ID NO: 396063 - RNA, 21 nt, Human
auggauuuaaacaggccacaa

SEQ ID NO: 396064 - RNA, 22 nt, Human
uguacaauagcuauuaucucca

SEQ ID NO: 396065 - RNA, 22 nt, Human
gauuuacagguuagguccugua

SEQ ID NO: 396066 - RNA, 22 nt, Human
aucauaaaauugcaccauuucu

SEQ ID NO: 396067 - RNA, 22 nt, Human
ucagccaguuuguuuauuccgg

SEQ ID NO: 396068 - RNA, 22 nt, Human
uauccaaaggaacaaucacagc

SEQ ID NO: 396069 - RNA, 22 nt, Human
ucacacauucuagguauguuga

SEQ ID NO: 396070 - RNA, 22 nt, Human
uaugaagaaaccuauccucuag

SEQ ID NO: 396071 - RNA, 22 nt, Human
auucuucacaaauauauagaag

SEQ ID NO: 396072 - RNA, 23 nt, Human
aaaugacauaugguuucugaagg

SEQ ID NO: 396073 - RNA, 22 nt, Human
gguacaaugguucauuuuaugu

SEQ ID NO: 396074 - RNA, 21 nt, Human
cuacagaaucgagcauucugg

SEQ ID NO: 396075 - RNA, 22 nt, Human
acuuugaaucucagauaaccaa

SEQ ID NO: 396076 - RNA, 22 nt, Human
ucauagaagcaccagaagauau

SEQ ID NO: 396077 - RNA, 22 nt, Human
aagcaauagcaacaacuuuaca

SEQ ID NO: 396078 - RNA, 22 nt, Human
gaauuucagaucagagaccauu

SEQ ID NO: 396079 - RNA, 21 nt, Human
uuucagaccuaucuuugaagg

SEQ ID NO: 396080 - RNA, 19 nt, Human
agauuuaccucauauaguu

SEQ ID NO: 396081 - RNA, 22 nt, Human
augguuuuguccucuuugguuc

SEQ ID NO: 396082 - RNA, 22 nt, Human
aaaucagugcucauuugaaagg

SEQ ID NO: 396083 - RNA, 22 nt, Human
augaacaauaaaauagaucaca

SEQ ID NO: 396084 - RNA, 22 nt, Human
uuacauaacgguaugaaaaaug

SEQ ID NO: 396085 - RNA, 22 nt, Human
aaaaagguugauccagauuagg

SEQ ID NO: 396086 - RNA, 22 nt, Human
uuacagaagugaaggccuuuaa

SEQ ID NO: 396087 - RNA, 22 nt, Human
acuuuuaaggggccuugauuua

SEQ ID NO: 396088 - RNA, 22 nt, Human
guuccaaaguuagaguguauug

SEQ ID NO: 396089 - RNA, 22 nt, Human
cuggacucugcagagaaaagua

SEQ ID NO: 396090 - RNA, 22 nt, Human
auuaggcauuauggggauaagg

SEQ ID NO: 396091 - RNA, 22 nt, Human
caauuuuuguacuuauaguacu

SEQ ID NO: 396092 - RNA, 22 nt, Human
aaaucagucccucuuggaauuu

SEQ ID NO: 396093 - RNA, 22 nt, Human
aaucagaaucaguugacacagc

SEQ ID NO: 396094 - RNA, 22 nt, Human
auagaauucuuugaaauuuaug

SEQ ID NO: 396095 - RNA, 21 nt, Human
aaaguguucagaccaguucug

SEQ ID NO: 396096 - RNA, 22 nt, Human
caucagaaccaguggggacauu

SEQ ID NO: 396097 - RNA, 22 nt, Human
uugguacagaugagguauucuc

SEQ ID NO: 396098 - RNA, 22 nt, Human
gcagagacuaguagugcagacu

SEQ ID NO: 396099 - RNA, 22 nt, Human
auaaagauuuuuaggcauuucu

SEQ ID NO: 396100 - RNA, 22 nt, Human
aaacugauaaaauaaguacauu

SEQ ID NO: 396101 - RNA, 22 nt, Human
ccaguuuaagacuuaucucaau

SEQ ID NO: 396102 - RNA, 22 nt, Human
uuugaauaaucacugggcauua

SEQ ID NO: 396103 - RNA, 22 nt, Human
uuacagaacugcccuaguuggc

SEQ ID NO: 396104 - RNA, 22 nt, Human
acaacuuuucuaucauguggaa

SEQ ID NO: 396105 - RNA, 22 nt, Human
caauuucauuaauagauauaga

SEQ ID NO: 396106 - RNA, 21 nt, Human
ugaucauuuguguaaaggaga

SEQ ID NO: 396107 - RNA, 22 nt, Human
ugaagaauaagauagauggagc

SEQ ID NO: 396108 - RNA, 22 nt, Human
cauagaaaucaggugagaaucu

SEQ ID NO: 396109 - RNA, 22 nt, Human
ggauuuacaaguuuaacucuca

SEQ ID NO: 396110 - RNA, 22 nt, Human
ucuggaucaccacuucugccuc

SEQ ID NO: 396111 - RNA, 22 nt, Human
auacacagcgaugagaggaggc

SEQ ID NO: 396112 - RNA, 22 nt, Human
auaugaaaagaagucaccauug

SEQ ID NO: 396113 - RNA, 22 nt, Human
uuuauuauucucuggagaaugu

SEQ ID NO: 396114 - RNA, 22 nt, Human
aucagaaaucuaggauucagaa

SEQ ID NO: 396115 - RNA, 22 nt, Human
ugcuuuaaccaucuuguuugga

SEQ ID NO: 396116 - RNA, 18 nt, Human
uauaaacacacuuagguu

SEQ ID NO: 396117 - RNA, 23 nt, Human
auauggcuguuguguguuaacau

SEQ ID NO: 396118 - RNA, 22 nt, Human
ugagauuuguuuuauaaaauag

SEQ ID NO: 396119 - RNA, 22 nt, Human
ugucaccacauuugucaauauc

SEQ ID NO: 396120 - RNA, 22 nt, Human
caaacauucaaguacaagucuu

SEQ ID NO: 396121 - RNA, 22 nt, Human
ggcaccagccaccuauuucuag

SEQ ID NO: 396122 - RNA, 22 nt, Human
ucuggaucgccggcgccugggc

SEQ ID NO: 396123 - RNA, 22 nt, Human
uccaauauggauaaaaggggcc

SEQ ID NO: 396124 - RNA, 22 nt, Human
ucagaauugcagggagggcagg

SEQ ID NO: 396125 - RNA, 22 nt, Human
auggcuuuguuccaauaaaacu

SEQ ID NO: 396126 - RNA, 22 nt, Human
aauguuaauguguuugcuuaug

SEQ ID NO: 396127 - RNA, 22 nt, Human
acauuccaaaaacuagcagaua

SEQ ID NO: 396128 - RNA, 22 nt, Human
gauuucaaguaucuugggcgag

SEQ ID NO: 396129 - RNA, 19 nt, Human
uggcauuuggaggcaaccu

SEQ ID NO: 396130 - RNA, 22 nt, Human
caacauuugaguaaagaaaugg

SEQ ID NO: 396131 - RNA, 23 nt, Human
caauuucauaugauucuaccuaa

SEQ ID NO: 396132 - RNA, 22 nt, Human
aguccagugaacuguaaauagg

SEQ ID NO: 396133 - RNA, 22 nt, Human
uaaagaucuuaggaagauuuuc

SEQ ID NO: 396134 - RNA, 22 nt, Human
ucagagaaauaauugcugaguu

SEQ ID NO: 396135 - RNA, 22 nt, Human
ucuuuaauaucugccccagagc

SEQ ID NO: 396136 - RNA, 22 nt, Human
agauuucagaugcucggcaguu

SEQ ID NO: 396137 - RNA, 22 nt, Human
uuccuuagggucagccagaucu

SEQ ID NO: 396138 - RNA, 22 nt, Human
ugcuauacauguacauauuagu

SEQ ID NO: 396139 - RNA, 22 nt, Human
gagauuuagcugcuuaacuccu

SEQ ID NO: 396140 - RNA, 23 nt, Human
ucaucaaacagcugcucaagaaa

SEQ ID NO: 396141 - RNA, 22 nt, Human
auccuuagguggugcaucaggg

SEQ ID NO: 396142 - RNA, 22 nt, Human
acagguuugucugauguaauga

SEQ ID NO: 396143 - RNA, 22 nt, Human
auuccaaagccugaauaaugga

SEQ ID NO: 396144 - RNA, 22 nt, Human
ucaccgucgggggucgcugucu

SEQ ID NO: 396145 - RNA, 22 nt, Human
aaaauacuguggaguguugaaa

SEQ ID NO: 396146 - RNA, 22 nt, Human
ucagccagaggcuucuugguuu

SEQ ID NO: 396147 - RNA, 22 nt, Human
ucagccuacacuccaacagcau

SEQ ID NO: 396148 - RNA, 22 nt, Human
caugcuuauucauucugcuaac

SEQ ID NO: 396149 - RNA, 22 nt, Human
gauuuauaaagguugcacugga

SEQ ID NO: 396150 - RNA, 22 nt, Human
cuggaucaugcauugcuugucc

SEQ ID NO: 396151 - RNA, 22 nt, Human
ugaaauagucuaaaaaaccaga

SEQ ID NO: 396152 - RNA, 22 nt, Human
ucagaauugucuggggaauguu

SEQ ID NO: 396153 - RNA, 22 nt, Human
uaguacaguuuaaauauuaaua

SEQ ID NO: 396154 - RNA, 22 nt, Human
caggaaacauaugugcuugagg

SEQ ID NO: 396155 - RNA, 22 nt, Human
uguacaaucuuggucccuuuau

SEQ ID NO: 396156 - RNA, 22 nt, Human
uuuaggcagcacgggcagcccu

SEQ ID NO: 396157 - RNA, 22 nt, Human
aauaaaaugaacugguagaguu

SEQ ID NO: 396158 - RNA, 22 nt, Human
aaacaaacaauuaguugugugg

SEQ ID NO: 396159 - RNA, 22 nt, Human
auaauucaugggccuuucaccu

SEQ ID NO: 396160 - RNA, 22 nt, Human
uaauuucagugggcucugggcu

SEQ ID NO: 396161 - RNA, 22 nt, Human
ugcuuaauauugugauguaaua

SEQ ID NO: 396162 - RNA, 22 nt, Human
uggcuuuacaucaaauugagua

SEQ ID NO: 396163 - RNA, 22 nt, Human
aguacaauuauauuuagauggu

SEQ ID NO: 396164 - RNA, 22 nt, Human
uuuaggcagaagcccugcugau

SEQ ID NO: 396165 - RNA, 18 nt, Human
agaugaaagcaaaugaca

SEQ ID NO: 396166 - RNA, 22 nt, Human
agauuggaucaagcagcaguug

SEQ ID NO: 396167 - RNA, 22 nt, Human
acaugcuuccaaauuauguugg

SEQ ID NO: 396168 - RNA, 22 nt, Human
uguacaauguggccaguguuaa

SEQ ID NO: 396169 - RNA, 22 nt, Human
acaaaauuaugaagaggccuug

SEQ ID NO: 396170 - RNA, 22 nt, Human
ccagaauucagaaagggcauaa

SEQ ID NO: 396171 - RNA, 22 nt, Human
gaucugaaucaauagaauaacu

SEQ ID NO: 396172 - RNA, 22 nt, Human
ucauacacaagagcauguaaca

SEQ ID NO: 396173 - RNA, 22 nt, Human
aagaaacaaccacugcucuccu

SEQ ID NO: 396174 - RNA, 17 nt, Human
uccauacaauucucucu

SEQ ID NO: 396175 - RNA, 22 nt, Human
uauccaaaguuucucagaaacu

SEQ ID NO: 396176 - RNA, 22 nt, Human
agagacaaugccaaugcacacg

SEQ ID NO: 396177 - RNA, 22 nt, Human
cauggcuuuguucauauaauuu

SEQ ID NO: 396178 - RNA, 22 nt, Human
cuuccaaagcacuuuauggacc

SEQ ID NO: 396179 - RNA, 22 nt, Human
acuauacaccaaaauauuaagg

SEQ ID NO: 396180 - RNA, 22 nt, Human
uuuaggcaagaacucacugaga

SEQ ID NO: 396181 - RNA, 19 nt, Human
cagaaauagcgaaguguaa

SEQ ID NO: 396182 - RNA, 22 nt, Human
augcuaaauggccaguaccaaa

SEQ ID NO: 396183 - RNA, 22 nt, Human
aaucagaauuuauugaaucuuu

SEQ ID NO: 396184 - RNA, 22 nt, Human
caauuucaagauucuguucuuu

SEQ ID NO: 396185 - RNA, 22 nt, Human
ccuggaucuccucuauucauau

SEQ ID NO: 396186 - RNA, 22 nt, Human
caguccuuggcaaguucucagu

SEQ ID NO: 396187 - RNA, 22 nt, Human
aucagcuuuucucaucagaaau

SEQ ID NO: 396188 - RNA, 22 nt, Human
ugacuucaagguucagcaccuu

SEQ ID NO: 396189 - RNA, 22 nt, Human
agccaacuaauuaaacaacuuu

SEQ ID NO: 396190 - RNA, 22 nt, Human
gcauaauauacaugcuugaucc

SEQ ID NO: 396191 - RNA, 22 nt, Human
cuuaaagaugucaaggcuguuu

SEQ ID NO: 396192 - RNA, 22 nt, Human
gaguccuuccagcaggcauuua

SEQ ID NO: 396193 - RNA, 22 nt, Human
agaauaauacugaaaugcugaa

SEQ ID NO: 396194 - RNA, 22 nt, Human
gccccagcguggcuguguuagg

SEQ ID NO: 396195 - RNA, 22 nt, Human
ugaauaaucuuggguauuaaua

SEQ ID NO: 396196 - RNA, 22 nt, Human
uaggaagaugaguaucaacuug

SEQ ID NO: 396197 - RNA, 22 nt, Human
uuuuaagaugcuaguauuucag

SEQ ID NO: 396198 - RNA, 22 nt, Human
auacuguaauaccuaaaugaac

SEQ ID NO: 396199 - RNA, 22 nt, Human
aagacagugaucucugagagau

SEQ ID NO: 396200 - RNA, 22 nt, Human
ucauaaaguuacccaaauuuua

SEQ ID NO: 396201 - RNA, 20 nt, Human
uuuaggcauuacucuuuugu

SEQ ID NO: 396202 - RNA, 22 nt, Human
aaagacauuagcuuagauguca

SEQ ID NO: 396203 - RNA, 22 nt, Human
cucuaacacuguaaugcuuucu

SEQ ID NO: 396204 - RNA, 22 nt, Human
aauauaaugcuguuuuaugcca

SEQ ID NO: 396205 - RNA, 22 nt, Human
uggcuuuauaaauccacugguu

SEQ ID NO: 396206 - RNA, 20 nt, Human
cuguaucagguuacaaagua

SEQ ID NO: 396207 - RNA, 22 nt, Human
cuaauuauguuguuauaaucaa

SEQ ID NO: 396208 - RNA, 22 nt, Human
ccagauaaggcuuuuuaaaagc

SEQ ID NO: 396209 - RNA, 22 nt, Human
gcaaaauuaaacuuagcaucau

SEQ ID NO: 396210 - RNA, 22 nt, Human
uaaagcacgucuauuuaaugau

SEQ ID NO: 396211 - RNA, 22 nt, Human
aguccuuaugagaugcugccuu

SEQ ID NO: 396212 - RNA, 22 nt, Human
uuaauaaaguaugaauuggaaa

SEQ ID NO: 396213 - RNA, 22 nt, Human
uuauuccauucaguucaacaag

SEQ ID NO: 396214 - RNA, 22 nt, Human
cauggcuuuguucuguuagaug

SEQ ID NO: 396215 - RNA, 22 nt, Human
aaauuucaagcaaaguagcuau

SEQ ID NO: 396216 - RNA, 19 nt, Human
ugcugaaguugucagucug

SEQ ID NO: 396217 - RNA, 22 nt, Human
ucagccaggccaccuucagcuu

SEQ ID NO: 396218 - RNA, 22 nt, Human
cuuaauuuaaaauaguucaggc

SEQ ID NO: 396219 - RNA, 22 nt, Human
uauggcuugucuuuauaccagg

SEQ ID NO: 396220 - RNA, 22 nt, Human
agagauucauguuuacuguagg

SEQ ID NO: 396221 - RNA, 22 nt, Human
agaauuucuggaagauugcaag

SEQ ID NO: 396222 - RNA, 22 nt, Human
ugcuuauucuuuccacaauuca

SEQ ID NO: 396223 - RNA, 22 nt, Human
uccuuguugcugcagucaccug

SEQ ID NO: 396224 - RNA, 22 nt, Human
acuuuagaccaucuuccacagu

SEQ ID NO: 396225 - RNA, 22 nt, Human
aaauagcagccuuuaguuaaca

SEQ ID NO: 396226 - RNA, 22 nt, Human
uuucaacuuguuugcuuccaua

SEQ ID NO: 396227 - RNA, 22 nt, Human
uaagaaacccaggaauuucuua

SEQ ID NO: 396228 - RNA, 22 nt, Human
augaacaagagagggaagauuc

SEQ ID NO: 396229 - RNA, 17 nt, Human
ugaaaucagcacccagg

SEQ ID NO: 396230 - RNA, 22 nt, Human
aaaucucaguguucuaagcauu

SEQ ID NO: 396231 - RNA, 22 nt, Human
aagcauuugugaaauucagaug

SEQ ID NO: 396232 - RNA, 22 nt, Human
ugcaggaacauagguuccuugg

SEQ ID NO: 396233 - RNA, 22 nt, Human
ccaauacacuuuauagaagaaa

SEQ ID NO: 396234 - RNA, 22 nt, Human
uagauuuaagacccugaauuug

SEQ ID NO: 396235 - RNA, 22 nt, Human
uuuuaugugcuggacuggcagu

SEQ ID NO: 396236 - RNA, 22 nt, Human
uaaucuaccacuauugcaauau

SEQ ID NO: 396237 - RNA, 22 nt, Human
uacacauguauuuauguguaca

SEQ ID NO: 396238 - RNA, 21 nt, Human
aaauacagaugcaaaucuguu

SEQ ID NO: 396239 - RNA, 17 nt, Human
cuguuaauucauuuccc

SEQ ID NO: 396240 - RNA, 22 nt, Human
uaaaaugcacagcaguugaaag

SEQ ID NO: 396241 - RNA, 22 nt, Human
aauacaagauuuauaguuguuu

SEQ ID NO: 396242 - RNA, 22 nt, Human
gauaucauaucagacaaccucu

SEQ ID NO: 396243 - RNA, 22 nt, Human
uguucacaagaugucuguggcu

SEQ ID NO: 396244 - RNA, 19 nt, Human
uacuaaacaugcauauugg

SEQ ID NO: 396245 - RNA, 22 nt, Human
agauaaugaaugccaugacauu

SEQ ID NO: 396246 - RNA, 22 nt, Human
guuauaaaugacugcaaaaguu

SEQ ID NO: 396247 - RNA, 22 nt, Human
acacaagauuguguauugaauu

SEQ ID NO: 396248 - RNA, 22 nt, Human
aucuaacagcaacaccagaaua

SEQ ID NO: 396249 - RNA, 22 nt, Human
ugaagaaucagauuggccugcg

SEQ ID NO: 396250 - RNA, 22 nt, Human
aaguccuuaggaagcagucguu

SEQ ID NO: 396251 - RNA, 22 nt, Human
uaaagacaauaggaaaguuguu

SEQ ID NO: 396252 - RNA, 22 nt, Human
aucuaaaaggagcucuuuaucu

SEQ ID NO: 396253 - RNA, 22 nt, Human
aguaaacauagaauguucuucc

SEQ ID NO: 396254 - RNA, 22 nt, Human
gcagggcagaccuccagccuau

SEQ ID NO: 396255 - RNA, 22 nt, Human
aaugccuucaaguaucugagga

SEQ ID NO: 396256 - RNA, 22 nt, Human
uguaacaauuucuuacuauugu

SEQ ID NO: 396257 - RNA, 22 nt, Human
cauauaauguuugaagaugugg

SEQ ID NO: 396258 - RNA, 22 nt, Human
uugaucaucuaagaguaauagu

SEQ ID NO: 396259 - RNA, 22 nt, Human
cuaucaaacagccauuaauaua

SEQ ID NO: 396260 - RNA, 23 nt, Human
agaucugauguuaccaagaauug

SEQ ID NO: 396261 - RNA, 22 nt, Human
ugaagaaucccagggaauuugg

SEQ ID NO: 396262 - RNA, 22 nt, Human
ggcgcacaaugugcagguuugu

SEQ ID NO: 396263 - RNA, 22 nt, Human
aaugcuuauaccuaaugaucuu

SEQ ID NO: 396264 - RNA, 22 nt, Human
augaauaaacaggugccucuuc

SEQ ID NO: 396265 - RNA, 22 nt, Human
acuucacacagcaaauuuaucu

SEQ ID NO: 396266 - RNA, 22 nt, Human
agcauuuagucuuuauugcagc

SEQ ID NO: 396267 - RNA, 22 nt, Human
aauugagugcagccagcccagu

SEQ ID NO: 396268 - RNA, 22 nt, Human
ugguuuuagaugccuuuacugc

SEQ ID NO: 396269 - RNA, 22 nt, Human
gucaaacagccuccuguucuaa

SEQ ID NO: 396270 - RNA, 22 nt, Human
gcugcaggcauuuuccugggca

SEQ ID NO: 396271 - RNA, 22 nt, Human
ucaaaauuaaaccaacguccag

SEQ ID NO: 396272 - RNA, 22 nt, Human
gucuaacaagcauuaggaaccc

SEQ ID NO: 396273 - RNA, 22 nt, Human
aauuaaaugacaggggaagaug

SEQ ID NO: 396274 - RNA, 22 nt, Human
uaagaaguacaaaaauuuucug

SEQ ID NO: 396275 - RNA, 22 nt, Human
uuguuaaaaauagauuuccagg

SEQ ID NO: 396276 - RNA, 22 nt, Human
caaguccuaaauguauuuguug

SEQ ID NO: 396277 - RNA, 22 nt, Human
caugcuuuuuucuaguauaaau

SEQ ID NO: 396278 - RNA, 22 nt, Human
auuaugcugguuuacacauuuu

SEQ ID NO: 396279 - RNA, 22 nt, Human
uuccuuaguuauuugguccccu

SEQ ID NO: 396280 - RNA, 21 nt, Human
uaaauaauaaguugcugagau

SEQ ID NO: 396281 - RNA, 22 nt, Human
uggcauuuuguucaguauaugg

SEQ ID NO: 396282 - RNA, 22 nt, Human
uuaauaaacaggugcagcugaa

SEQ ID NO: 396283 - RNA, 22 nt, Human
uucagaaaugaauauugguauu

SEQ ID NO: 396284 - RNA, 22 nt, Human
augaaaauucuaugcaggccag

SEQ ID NO: 396285 - RNA, 22 nt, Human
augaaacacacacgcgcauacu

SEQ ID NO: 396286 - RNA, 22 nt, Human
uaauuuuaugacaguguauuuu

SEQ ID NO: 396287 - RNA, 22 nt, Human
aauauaugagggagcuauuuga

SEQ ID NO: 396288 - RNA, 22 nt, Human
uuacagaauguucuuccaacag

SEQ ID NO: 396289 - RNA, 22 nt, Human
aaguccuuguauacagaaucaa

SEQ ID NO: 396290 - RNA, 22 nt, Human
cauuucaauacaguuuguaaau

SEQ ID NO: 396291 - RNA, 22 nt, Human
auaaaauuugcuacuguuaaau

SEQ ID NO: 396292 - RNA, 22 nt, Human
agacugaauaacaagcaaauaa

SEQ ID NO: 396293 - RNA, 22 nt, Human
ugauuuaugcauuauacuguug

SEQ ID NO: 396294 - RNA, 22 nt, Human
ucaauucaauugaacaguuacu

SEQ ID NO: 396295 - RNA, 22 nt, Human
ugcuuuaagacacuaaguuuga

SEQ ID NO: 396296 - RNA, 22 nt, Human
ucucuuaauuuuggaauagugu

SEQ ID NO: 396297 - RNA, 22 nt, Human
gcagaauugauggagaacuuaa

SEQ ID NO: 396298 - RNA, 22 nt, Human
ucauuucucccggccaaaaacu

SEQ ID NO: 396299 - RNA, 22 nt, Human
aaucagaaccuugggucauaac

SEQ ID NO: 396300 - RNA, 21 nt, Human
agaagucaauugaacugaaau

SEQ ID NO: 396301 - RNA, 22 nt, Human
augcuuaaccuugguguacaau

SEQ ID NO: 396302 - RNA, 22 nt, Human
agaaagcaucuccauuguaggu

SEQ ID NO: 396303 - RNA, 22 nt, Human
aauagaaaggaggggcucuugu

SEQ ID NO: 396304 - RNA, 22 nt, Human
ugcuggcuacauuauugcuguc

SEQ ID NO: 396305 - RNA, 22 nt, Human
auaaacaguagagaaagguggu

SEQ ID NO: 396306 - RNA, 22 nt, Human
auaaagcaaauaggacuauugc

SEQ ID NO: 396307 - RNA, 22 nt, Human
aagucacccuagggccuggacu

SEQ ID NO: 396308 - RNA, 22 nt, Human
uuggagagauuaucagaccagc

SEQ ID NO: 396309 - RNA, 22 nt, Human
uguacaauguguuuguuggcuu

SEQ ID NO: 396310 - RNA, 22 nt, Human
aaaucaguuaagaugaggccau

SEQ ID NO: 396311 - RNA, 22 nt, Human
ggcauuaagaauaucauuaaaa

SEQ ID NO: 396312 - RNA, 22 nt, Human
augaaacagugaauuagucaag

SEQ ID NO: 396313 - RNA, 22 nt, Human
ccauaauauuaaaugcuuuugu

SEQ ID NO: 396314 - RNA, 22 nt, Human
gauucuuacuucuaagcaagcu

SEQ ID NO: 396315 - RNA, 20 nt, Human
ucauaaagaggaaauaaaua

SEQ ID NO: 396316 - RNA, 22 nt, Human
uuccuuagccugccuuccaggg

SEQ ID NO: 396317 - RNA, 22 nt, Human
gcagaauuggauaguugugaua

SEQ ID NO: 396318 - RNA, 22 nt, Human
cuaaagaagcuagcaaucuaua

SEQ ID NO: 396319 - RNA, 22 nt, Human
acugcagagguggggugcagag

SEQ ID NO: 396320 - RNA, 22 nt, Human
agaauuucaaauggaaguuuua

SEQ ID NO: 396321 - RNA, 22 nt, Human
auucuacaacccaauaauaauu

SEQ ID NO: 396322 - RNA, 22 nt, Human
caucagaauagcucuguggaua

SEQ ID NO: 396323 - RNA, 22 nt, Human
aacacuuugggcauggccuucc

SEQ ID NO: 396324 - RNA, 22 nt, Human
cuuaauuuuuguaguagaugga

SEQ ID NO: 396325 - RNA, 22 nt, Human
aaguuacacauuuucauuguaa

SEQ ID NO: 396326 - RNA, 22 nt, Human
auuuaguuuaggaaaaguaggu

SEQ ID NO: 396327 - RNA, 22 nt, Human
uuggaucagaugauaucuuugu

SEQ ID NO: 396328 - RNA, 22 nt, Human
guuauaaaggugauaaugguca

SEQ ID NO: 396329 - RNA, 22 nt, Human
gaucagaaucuucauuuucagu

SEQ ID NO: 396330 - RNA, 22 nt, Human
uuuaggcaauagauggcagugu

SEQ ID NO: 396331 - RNA, 22 nt, Human
cauuucaaacaguuacagcugc

SEQ ID NO: 396332 - RNA, 22 nt, Human
aguguuagauucuuacucaguu

SEQ ID NO: 396333 - RNA, 22 nt, Human
auacagaagccuguauuucugg

SEQ ID NO: 396334 - RNA, 22 nt, Human
aaauuccagaaacucaguauau

SEQ ID NO: 396335 - RNA, 22 nt, Human
uugauuaaucccaugugaguag

SEQ ID NO: 396336 - RNA, 22 nt, Human
ucuuaauugagaacaguguagg

SEQ ID NO: 396337 - RNA, 22 nt, Human
auagaauuugcacuaaaucugc

SEQ ID NO: 396338 - RNA, 22 nt, Human
ugucaccaugccagcuucugcc

SEQ ID NO: 396339 - RNA, 22 nt, Human
agaaaaacuaagaguggguggu

SEQ ID NO: 396340 - RNA, 22 nt, Human
ucaagacaucacugugcauuuu

SEQ ID NO: 396341 - RNA, 22 nt, Human
aucauaaagugcuaucugauug

SEQ ID NO: 396342 - RNA, 22 nt, Human
aaaugccuguguaaauucuagc

SEQ ID NO: 396343 - RNA, 22 nt, Human
aauuccaggcagaaaugugagu

SEQ ID NO: 396344 - RNA, 22 nt, Human
cauuaauauuguucuucuuuag

SEQ ID NO: 396345 - RNA, 22 nt, Human
gcuggaucaaguccuucaccca

SEQ ID NO: 396346 - RNA, 22 nt, Human
uagcaucuguucuuucauuaaa

SEQ ID NO: 396347 - RNA, 22 nt, Human
ucuggaucggguuccucagguc

SEQ ID NO: 396348 - RNA, 22 nt, Human
ucauaaagcauuucagcuuuug

SEQ ID NO: 396349 - RNA, 22 nt, Human
aagucaccccacacucuuggga

SEQ ID NO: 396350 - RNA, 22 nt, Human
uauacagucuuuugcuauauuc

SEQ ID NO: 396351 - RNA, 22 nt, Human
augcacaagcaagagauaaugg

SEQ ID NO: 396352 - RNA, 22 nt, Human
aaguccauucuuccagccagcu

SEQ ID NO: 396353 - RNA, 22 nt, Human
uagaauaugauuaauuuucuua

SEQ ID NO: 396354 - RNA, 22 nt, Human
ugcuuaauagugcacugguuuc

SEQ ID NO: 396355 - RNA, 22 nt, Human
cuagaaauguagauucuuagug

SEQ ID NO: 396356 - RNA, 20 nt, Human
gaguccuuaugggcugaggu

SEQ ID NO: 396357 - RNA, 22 nt, Human
auuccaaacucuuucccugucg

SEQ ID NO: 396358 - RNA, 22 nt, Human
uauacaauggcugaaucaucca

SEQ ID NO: 396359 - RNA, 22 nt, Human
caauuuuuuccaugcucuuaca

SEQ ID NO: 396360 - RNA, 22 nt, Human
gucaaacaaauuaacauaucca

SEQ ID NO: 396361 - RNA, 22 nt, Human
uggcauuucaguauuuucauaa

SEQ ID NO: 396362 - RNA, 22 nt, Human
uaguccuuuaucaaacauuuau

SEQ ID NO: 396363 - RNA, 22 nt, Human
cagucaccauagaauaaaacau

SEQ ID NO: 396364 - RNA, 19 nt, Human
aucugagauuauaaacaga

SEQ ID NO: 396365 - RNA, 22 nt, Human
aggauuuacuagcaaggauucu

SEQ ID NO: 396366 - RNA, 22 nt, Human
aauuauauuguggugugaaugu

SEQ ID NO: 396367 - RNA, 22 nt, Human
aaugguuuucuagaacaugaaa

SEQ ID NO: 396368 - RNA, 22 nt, Human
uucaacacaggaacaugauaua

SEQ ID NO: 396369 - RNA, 22 nt, Human
aguaaacauuucagauuuauuu

SEQ ID NO: 396370 - RNA, 22 nt, Human
uucaaguuuugccuccccaucc

SEQ ID NO: 396371 - RNA, 21 nt, Human
aaauggauagggcaauggaag

SEQ ID NO: 396372 - RNA, 22 nt, Human
uaagaaucgauguuuauuuaga

SEQ ID NO: 396373 - RNA, 21 nt, Human
auccuuagcacuuagaagagu

SEQ ID NO: 396374 - RNA, 22 nt, Human
aaaucucacuguagucaaagug

SEQ ID NO: 396375 - RNA, 22 nt, Human
uuaaaacagcgugaaucuggca

SEQ ID NO: 396376 - RNA, 22 nt, Human
ugauuauauucuaacuucauaa

SEQ ID NO: 396377 - RNA, 22 nt, Human
ccauggcucuagagauugaaaa

SEQ ID NO: 396378 - RNA, 22 nt, Human
aguccuuagaacagugccuggg

SEQ ID NO: 396379 - RNA, 22 nt, Human
auggauuugcuuauacacaugu

SEQ ID NO: 396380 - RNA, 22 nt, Human
auucucaauggcuacuuucaua

SEQ ID NO: 396381 - RNA, 22 nt, Human
auacagaaguuuuccacuuauu

SEQ ID NO: 396382 - RNA, 22 nt, Human
uacugaaaagccacaaggacca

SEQ ID NO: 396383 - RNA, 22 nt, Human
cuagaaauacaggcacgugcca

SEQ ID NO: 396384 - RNA, 22 nt, Human
aaauggaucuguggaauacauu

SEQ ID NO: 396385 - RNA, 22 nt, Human
acuucacagaaauuuuaugagg

SEQ ID NO: 396386 - RNA, 22 nt, Human
uaauuucacugauaugaaguca

SEQ ID NO: 396387 - RNA, 22 nt, Human
aagguucuaagggaagccaugc

SEQ ID NO: 396388 - RNA, 22 nt, Human
guuaaagaagaauaguuccuuu

SEQ ID NO: 396389 - RNA, 22 nt, Human
caaucaguuucuguuguauaau

SEQ ID NO: 396390 - RNA, 22 nt, Human
cuucuuaacuguauauacuaug

SEQ ID NO: 396391 - RNA, 22 nt, Human
aucagaaaaacauaauguuauu

SEQ ID NO: 396392 - RNA, 22 nt, Human
uauuaaagggaaguuaugcaug

SEQ ID NO: 396393 - RNA, 22 nt, Human
gcauguuauguaucugcccagc

SEQ ID NO: 396394 - RNA, 22 nt, Human
uacaugaaccuuuaugugugau

SEQ ID NO: 396395 - RNA, 22 nt, Human
ugucaccagcugcuccucagga

SEQ ID NO: 396396 - RNA, 22 nt, Human
aauuaaauugguuuagagagga

SEQ ID NO: 396397 - RNA, 20 nt, Human
agaaaaaguguggaaauuuc

SEQ ID NO: 396398 - RNA, 22 nt, Human
auaucagaaauaguaagcagag

SEQ ID NO: 396399 - RNA, 22 nt, Human
uauaagaaauugccaaccuguu

SEQ ID NO: 396400 - RNA, 22 nt, Human
uguccuuacaaggucccuuucg

SEQ ID NO: 396401 - RNA, 22 nt, Human
uuugaagacagaucaauauaag

SEQ ID NO: 396402 - RNA, 22 nt, Human
cuagaaaugcucaagagaaagu

SEQ ID NO: 396403 - RNA, 22 nt, Human
uggcuuuacugucauucuuaug

SEQ ID NO: 396404 - RNA, 19 nt, Human
uuccaaaaucaggauuuga

SEQ ID NO: 396405 - RNA, 22 nt, Human
gguaugaauucacuacuuccaa

SEQ ID NO: 396406 - RNA, 22 nt, Human
uuuccaaauaaggucacacuca

SEQ ID NO: 396407 - RNA, 23 nt, Human
uguaacaauuucauauacaugca

SEQ ID NO: 396408 - RNA, 22 nt, Human
ucuaaacacgucucuuugaaua

SEQ ID NO: 396409 - RNA, 22 nt, Human
uucagaaacccauugggucucu

SEQ ID NO: 396410 - RNA, 23 nt, Human
cuuucauugugguuucacagagc

SEQ ID NO: 396411 - RNA, 22 nt, Human
uagucaccagcuacaggacagc

SEQ ID NO: 396412 - RNA, 22 nt, Human
aacagacaacuccuguggcuca

SEQ ID NO: 396413 - RNA, 22 nt, Human
ucccaguuuuucuccacuaagg

SEQ ID NO: 396414 - RNA, 22 nt, Human
caguccuuaaggaaacauuugu

SEQ ID NO: 396415 - RNA, 22 nt, Human
gugaauaauauuguuuauaaaa

SEQ ID NO: 396416 - RNA, 23 nt, Human
aaauaggaguaucuggaucauga

SEQ ID NO: 396417 - RNA, 22 nt, Human
ucacaccaguuuccuuucaauu

SEQ ID NO: 396418 - RNA, 22 nt, Human
cuucuuaaucccuuauauauuu

SEQ ID NO: 396419 - RNA, 22 nt, Human
cguauacaugaagacauugcug

SEQ ID NO: 396420 - RNA, 22 nt, Human
cuacagaaguuucccuugcuua

SEQ ID NO: 396421 - RNA, 22 nt, Human
aaaaggcauggagguugauagu

SEQ ID NO: 396422 - RNA, 22 nt, Human
gauagaaagguguugaaaucca

SEQ ID NO: 396423 - RNA, 22 nt, Human
aacauaauguggccaaagucac

SEQ ID NO: 396424 - RNA, 22 nt, Human
auauacaggugguauguguaaa

SEQ ID NO: 396425 - RNA, 22 nt, Human
caauauauaggaacaacuuagg

SEQ ID NO: 396426 - RNA, 23 nt, Human
aguacaauaaguauaauucuuuc

SEQ ID NO: 396427 - RNA, 22 nt, Human
ggcauuuagauugaauuucugu

SEQ ID NO: 396428 - RNA, 22 nt, Human
cuuaaagaaauugaggagagga

SEQ ID NO: 396429 - RNA, 22 nt, Human
uaacacaaaagaauaugugugu

SEQ ID NO: 396430 - RNA, 22 nt, Human
gugugaaaguuccuaagacuau

SEQ ID NO: 396431 - RNA, 22 nt, Human
ugugaaaagcguguguucuagg

SEQ ID NO: 396432 - RNA, 22 nt, Human
agaucugaaucucauccgagga

SEQ ID NO: 396433 - RNA, 22 nt, Human
uuuccauauuuaaucaaaauaa

SEQ ID NO: 396434 - RNA, 22 nt, Human
gcuuuuauugucuuuacgacga

SEQ ID NO: 396435 - RNA, 22 nt, Human
aaaagccaugcauaccuaagag

SEQ ID NO: 396436 - RNA, 22 nt, Human
aucaagaacuuauuuuggaaau

SEQ ID NO: 396437 - RNA, 22 nt, Human
augcugaauugaugcgagggag

SEQ ID NO: 396438 - RNA, 22 nt, Human
augcuuaacuuccuagucuaua

SEQ ID NO: 396439 - RNA, 22 nt, Human
aauacagaggggucacaauuca

SEQ ID NO: 396440 - RNA, 20 nt, Human
uauuuacaacuuagagccuc

SEQ ID NO: 396441 - RNA, 22 nt, Human
caaagauuuuagaauuugcaau

SEQ ID NO: 396442 - RNA, 22 nt, Human
ucagaauuagagcucuucuuga

SEQ ID NO: 396443 - RNA, 22 nt, Human
uucuuagaugauuaaugauggg

SEQ ID NO: 396444 - RNA, 22 nt, Human
aauguuuuaaaagagauugaga

SEQ ID NO: 396445 - RNA, 22 nt, Human
auuccaaaggcuggccuggagg

SEQ ID NO: 396446 - RNA, 22 nt, Human
aauguucaaacagaucacuuag

SEQ ID NO: 396447 - RNA, 22 nt, Human
uaucagaaggcacauggagucu

SEQ ID NO: 396448 - RNA, 23 nt, Human
agaauuccaguuucuuaugucac

SEQ ID NO: 396449 - RNA, 22 nt, Human
ugaaaagacugcaagagagcau

SEQ ID NO: 396450 - RNA, 22 nt, Human
aaaggcauuuuaauucuaaaga

SEQ ID NO: 396451 - RNA, 22 nt, Human
gauuucaaggauguuagaggug

SEQ ID NO: 396452 - RNA, 22 nt, Human
auguauaaugcuaauuagcuag

SEQ ID NO: 396453 - RNA, 22 nt, Human
aucuauacccaucaugauuuaa

SEQ ID NO: 396454 - RNA, 22 nt, Human
aaauaauguuaggccuuugcuc

SEQ ID NO: 396455 - RNA, 22 nt, Human
aaucagaaagaggucauguugc

SEQ ID NO: 396456 - RNA, 22 nt, Human
uuaacagagugccuggcaugua

SEQ ID NO: 396457 - RNA, 22 nt, Human
aguucucauugcaugagacaga

SEQ ID NO: 396458 - RNA, 22 nt, Human
gugaauaagaccuaaggaugaa

SEQ ID NO: 396459 - RNA, 22 nt, Human
gaauaaucaugaaauucaguga

SEQ ID NO: 396460 - RNA, 22 nt, Human
acuuuuaaaugaguuucaguug

SEQ ID NO: 396461 - RNA, 22 nt, Human
aaagaaucagaagucucaaaca

SEQ ID NO: 396462 - RNA, 22 nt, Human
acagaauuaucaggaaauguua

SEQ ID NO: 396463 - RNA, 22 nt, Human
uucaagacugcgacuaaugccc

SEQ ID NO: 396464 - RNA, 22 nt, Human
cauacuuugggauaagagugga

SEQ ID NO: 396465 - RNA, 19 nt, Human
uuccuuagaggaggcggug

SEQ ID NO: 396466 - RNA, 20 nt, Human
uauaacaguguugggugugu

SEQ ID NO: 396467 - RNA, 22 nt, Human
gcaacuuucaagcaccaugggg

SEQ ID NO: 396468 - RNA, 22 nt, Human
cauucauucuguaaguaacuau

SEQ ID NO: 396469 - RNA, 22 nt, Human
uuccuuagcuccucauggccug

SEQ ID NO: 396470 - RNA, 22 nt, Human
aaagucauuuuccagaccagua

SEQ ID NO: 396471 - RNA, 21 nt, Human
uucauaaaccauucucaugca

SEQ ID NO: 396472 - RNA, 22 nt, Human
aauuauccuuaaugcaguaagc

SEQ ID NO: 396473 - RNA, 23 nt, Human
aauaucaaggugauguucccaga

SEQ ID NO: 396474 - RNA, 19 nt, Human
acagaaauuaguuauuuuc

SEQ ID NO: 396475 - RNA, 22 nt, Human
gagcccagcuugcacauggagc

SEQ ID NO: 396476 - RNA, 22 nt, Human
uaaaacuuaacuauccagauua

SEQ ID NO: 396477 - RNA, 22 nt, Human
uguguacacagauaguaauggc

SEQ ID NO: 396478 - RNA, 22 nt, Human
uucauacuaaaguguaagaugu

SEQ ID NO: 396479 - RNA, 22 nt, Human
aggauuuacaaugauucuaggu

SEQ ID NO: 396480 - RNA, 22 nt, Human
uuucauaauacuguacaugaaa

SEQ ID NO: 396481 - RNA, 22 nt, Human
uaucaaaguuguccugugaagu

SEQ ID NO: 396482 - RNA, 22 nt, Human
uauauaacuacuauuuugcuca

SEQ ID NO: 396483 - RNA, 22 nt, Human
uaguccuuacuuacuagaauaa

SEQ ID NO: 396484 - RNA, 22 nt, Human
uuauauaaagauaacuuuucuu

SEQ ID NO: 396485 - RNA, 22 nt, Human
caggccagcuuccugacauccu

SEQ ID NO: 396486 - RNA, 22 nt, Human
agaucacagcccccagaugcca

SEQ ID NO: 396487 - RNA, 22 nt, Human
agcucacaguguccuuccucaa

SEQ ID NO: 396488 - RNA, 22 nt, Human
auagcuuucuuaaauauauaaa

SEQ ID NO: 396489 - RNA, 22 nt, Human
augugcuucauucuacaugaca

SEQ ID NO: 396490 - RNA, 22 nt, Human
agaaacauccugcuuuccauuu

SEQ ID NO: 396491 - RNA, 22 nt, Human
uuuccaaaaugaaucuaaugca

SEQ ID NO: 396492 - RNA, 22 nt, Human
cagaucuagagcuuuuccaucu

SEQ ID NO: 396493 - RNA, 22 nt, Human
uuuaggcaugcaguucuauuua

SEQ ID NO: 396494 - RNA, 22 nt, Human
uaucaagugacuaucacagaac

SEQ ID NO: 396495 - RNA, 22 nt, Human
ucacagaaauaagauaguuauu

SEQ ID NO: 396496 - RNA, 22 nt, Human
uuauuaaugaguacaaguuauu

SEQ ID NO: 396497 - RNA, 22 nt, Human
ugaaugaaugaauuaauagagu

SEQ ID NO: 396498 - RNA, 22 nt, Human
cuacagaaggagaaauggguaa

SEQ ID NO: 396499 - RNA, 22 nt, Human
auuauauaggacuugcccuucc

SEQ ID NO: 396500 - RNA, 22 nt, Human
agaauaaucacugaaguucaaa

SEQ ID NO: 396501 - RNA, 22 nt, Human
acagaaguuggaauuagauacu

SEQ ID NO: 396502 - RNA, 22 nt, Human
uaaugcuuuuccuucaaauaag

SEQ ID NO: 396503 - RNA, 22 nt, Human
aaaucucaauuugaauuguagc

SEQ ID NO: 396504 - RNA, 22 nt, Human
cagucaccuagacagaacuuac

SEQ ID NO: 396505 - RNA, 22 nt, Human
gaaauagacacuuucuaugaau

SEQ ID NO: 396506 - RNA, 22 nt, Human
caauuucaauacaaaauacauu

SEQ ID NO: 396507 - RNA, 21 nt, Human
agccagucuguuuucuagugc

SEQ ID NO: 396508 - RNA, 22 nt, Human
caugguuuauuagagcuuauuu

SEQ ID NO: 396509 - RNA, 22 nt, Human
agcaucuggcagaaagucagaa

SEQ ID NO: 396510 - RNA, 22 nt, Human
uauggcuuuuuauucaucuuac

SEQ ID NO: 396511 - RNA, 22 nt, Human
acacacucaauugcauaagcac

SEQ ID NO: 396512 - RNA, 22 nt, Human
aaaacauguccauacagaaacu

SEQ ID NO: 396513 - RNA, 22 nt, Human
uucaaacacagacagcagcaug

SEQ ID NO: 396514 - RNA, 22 nt, Human
guaggaaaguaaaugaaauaca

SEQ ID NO: 396515 - RNA, 23 nt, Human
acuuuauccuauaucuuuguucu

SEQ ID NO: 396516 - RNA, 22 nt, Human
ucauaaaaauagacucuaaagu

SEQ ID NO: 396517 - RNA, 22 nt, Human
ugagaaaagguugagaugauaa

SEQ ID NO: 396518 - RNA, 22 nt, Human
aguguuuaaacugaagugauga

SEQ ID NO: 396519 - RNA, 22 nt, Human
caaguccuccaugugacuaggu

SEQ ID NO: 396520 - RNA, 21 nt, Human
uuuuauugaugaauggccacu

SEQ ID NO: 396521 - RNA, 21 nt, Human
caaucaguuggcauuugagca

SEQ ID NO: 396522 - RNA, 22 nt, Human
ugcagagaaaguguagacaggc

SEQ ID NO: 396523 - RNA, 22 nt, Human
agaucuauuagcaaacugccau

SEQ ID NO: 396524 - RNA, 22 nt, Human
agcauauaaauggacauauuug

SEQ ID NO: 396525 - RNA, 22 nt, Human
uuuacagaaugucaauuucuau

SEQ ID NO: 396526 - RNA, 22 nt, Human
gaguccuuaauacacuggugga

SEQ ID NO: 396527 - RNA, 22 nt, Human
cuaaaauuaucaagauaauucc

SEQ ID NO: 396528 - RNA, 22 nt, Human
auauaugcauguguacuuaugu

SEQ ID NO: 396529 - RNA, 22 nt, Human
caagaaucagaccugucagggu

SEQ ID NO: 396530 - RNA, 22 nt, Human
gcagaauucuacagaugauaaa

SEQ ID NO: 396531 - RNA, 21 nt, Human
gagauuuagaaggaucaauuu

SEQ ID NO: 396532 - RNA, 22 nt, Human
aaagucauggaaaaucuuggaa

SEQ ID NO: 396533 - RNA, 22 nt, Human
auaaagcaagcauaccauuaag

SEQ ID NO: 396534 - RNA, 22 nt, Human
cuuccaaauguaaauaaguuuc

SEQ ID NO: 396535 - RNA, 22 nt, Human
aaaaccuucagguuuggaguuu

SEQ ID NO: 396536 - RNA, 21 nt, Human
auacagaagguggcaaaguac

SEQ ID NO: 396537 - RNA, 22 nt, Human
accagcugcugauugcuaaaug

SEQ ID NO: 396538 - RNA, 22 nt, Human
aaguccuuuauccuaaaagguc

SEQ ID NO: 396539 - RNA, 22 nt, Human
uggcuuaagcgcaacucugucu

SEQ ID NO: 396540 - RNA, 22 nt, Human
cuacagaauggagggucagaga

SEQ ID NO: 396541 - RNA, 22 nt, Human
acaugcuuguuuuucacaaccu

SEQ ID NO: 396542 - RNA, 19 nt, Human
acuguaaggcauuuuuuuc

SEQ ID NO: 396543 - RNA, 22 nt, Human
gauagaaagagugguucuuuuu

SEQ ID NO: 396544 - RNA, 22 nt, Human
acauaauaggugccugaauauu

SEQ ID NO: 396545 - RNA, 22 nt, Human
uaugaaaagguggccaauguag

SEQ ID NO: 396546 - RNA, 22 nt, Human
caagaaucuugcagcuuagacu

SEQ ID NO: 396547 - RNA, 22 nt, Human
caccagacagguguaugcauau

SEQ ID NO: 396548 - RNA, 22 nt, Human
gaaaaaggauaaauacaguguu

SEQ ID NO: 396549 - RNA, 22 nt, Human
uaaguccuaauggcagaagucu

SEQ ID NO: 396550 - RNA, 22 nt, Human
cuuuacauaaggauaaaccugg

SEQ ID NO: 396551 - RNA, 21 nt, Human
auggcuuuuuuaaagcuugug

SEQ ID NO: 396552 - RNA, 22 nt, Human
caauuucagaccuuuccuugga

SEQ ID NO: 396553 - RNA, 22 nt, Human
aagacagugacagucacaauug

SEQ ID NO: 396554 - RNA, 21 nt, Human
auuauuauaaagaccacaggg

SEQ ID NO: 396555 - RNA, 22 nt, Human
ugcaggaagcaaccagguccaa

SEQ ID NO: 396556 - RNA, 22 nt, Human
auagucacugccuuccauuugu

SEQ ID NO: 396557 - RNA, 20 nt, Human
uacaauacacaugcauauga

SEQ ID NO: 396558 - RNA, 22 nt, Human
cuacagaauucaacaaaugguu

SEQ ID NO: 396559 - RNA, 22 nt, Human
uccaaaguguugggauuauagg

SEQ ID NO: 396560 - RNA, 22 nt, Human
auacaucaugcuccauauauuu

SEQ ID NO: 396561 - RNA, 22 nt, Human
cauuuacacuucuaaccacaag

SEQ ID NO: 396562 - RNA, 22 nt, Human
auagaauucguguuuguaauuc

SEQ ID NO: 396563 - RNA, 22 nt, Human
augcuuuaaaugucuuuugcuu

SEQ ID NO: 396564 - RNA, 22 nt, Human
uuuacagaugaggaaacugaga

SEQ ID NO: 396565 - RNA, 20 nt, Human
uauggcuuggcaaagcuuca

SEQ ID NO: 396566 - RNA, 22 nt, Human
aaagcauuucaugucuagaaag

SEQ ID NO: 396567 - RNA, 22 nt, Human
aggauuuaucaggaacucucuu

SEQ ID NO: 396568 - RNA, 22 nt, Human
acaacaaaaucacuagucuucc

SEQ ID NO: 396569 - RNA, 22 nt, Human
uuacagaaagguugugggauag

SEQ ID NO: 396570 - RNA, 22 nt, Human
uucuuaauaccuauuuucuacc

SEQ ID NO: 396571 - RNA, 22 nt, Human
gaagugaagagauuagaaauca

SEQ ID NO: 396572 - RNA, 22 nt, Human
auacagaagaacuauagccacu

SEQ ID NO: 396573 - RNA, 22 nt, Human
cauaaaauggcuuguucuuuaa

SEQ ID NO: 396574 - RNA, 22 nt, Human
uucagaaagguuaaucuggauu

SEQ ID NO: 396575 - RNA, 22 nt, Human
gaaguccugguccucucauuca

SEQ ID NO: 396576 - RNA, 22 nt, Human
aauuucaauuacuuuugcacca

SEQ ID NO: 396577 - RNA, 22 nt, Human
gguacaaugucuuacagaccca

SEQ ID NO: 396578 - RNA, 22 nt, Human
gaguucuaaaggcagaacauaa

SEQ ID NO: 396579 - RNA, 22 nt, Human
uuggcuucuucgcacagcagua

SEQ ID NO: 396580 - RNA, 22 nt, Human
uuccauaauaaccugagagaaa

SEQ ID NO: 396581 - RNA, 22 nt, Human
acaaaauuuuuagacaaggcuu

SEQ ID NO: 396582 - RNA, 22 nt, Human
aguucacugcuuaagccuuuga

SEQ ID NO: 396583 - RNA, 22 nt, Human
uaguaucuauuaguaacaagag

SEQ ID NO: 396584 - RNA, 22 nt, Human
auuucuuacauaacaaauuguu

SEQ ID NO: 396585 - RNA, 22 nt, Human
aauaacuggcacauaucacaua

SEQ ID NO: 396586 - RNA, 22 nt, Human
aauuccagaggaggacaguccu

SEQ ID NO: 396587 - RNA, 18 nt, Human
ugaaacaagaauggugca

SEQ ID NO: 396588 - RNA, 23 nt, Human
uaauacugcuucagaggcuuaga

SEQ ID NO: 396589 - RNA, 22 nt, Human
guuccaaauuuggaucuuuagg

SEQ ID NO: 396590 - RNA, 19 nt, Human
caguccuuuccgcuuucuc

SEQ ID NO: 396591 - RNA, 22 nt, Human
cuggaagagcauuugcauaggg

SEQ ID NO: 396592 - RNA, 22 nt, Human
auauacaguuuuacaggguuuc

SEQ ID NO: 396593 - RNA, 22 nt, Human
gauuuccaggucauuaauaaag

SEQ ID NO: 396594 - RNA, 22 nt, Human
uuacaaaguguuaugauaaaca

SEQ ID NO: 396595 - RNA, 22 nt, Human
uuccaaaguuaguuauuagaaa

SEQ ID NO: 396596 - RNA, 22 nt, Human
aguuucaguucugucauuuaua

SEQ ID NO: 396597 - RNA, 22 nt, Human
agaaucugguagaaccaaggau

SEQ ID NO: 396598 - RNA, 22 nt, Human
auguuacacauaggcauaaaug

SEQ ID NO: 396599 - RNA, 22 nt, Human
gacaauacagaaagggacaugc

SEQ ID NO: 396600 - RNA, 22 nt, Human
auuauaaaccuuugaggguggg

SEQ ID NO: 396601 - RNA, 22 nt, Human
acuuugaaacuaaaauucauua

SEQ ID NO: 396602 - RNA, 22 nt, Human
acaugaaaaauguuugcaguuu

SEQ ID NO: 396603 - RNA, 22 nt, Human
aaagaaucuauauaucaccacc

SEQ ID NO: 396604 - RNA, 22 nt, Human
ugcuggaggauuaaacaaguca

SEQ ID NO: 396605 - RNA, 22 nt, Human
ugccauuuugagauguuaauga

SEQ ID NO: 396606 - RNA, 22 nt, Human
cuuauauuuuaggaacagacaa

SEQ ID NO: 396607 - RNA, 22 nt, Human
uguuuaauaauucuaugauagu

SEQ ID NO: 396608 - RNA, 22 nt, Human
ucuuuaauuguggaagagcagc

SEQ ID NO: 396609 - RNA, 22 nt, Human
aaguucuaauuuugcauucagg

SEQ ID NO: 396610 - RNA, 22 nt, Human
ccaaaauuauuacauuuguagg

SEQ ID NO: 396611 - RNA, 22 nt, Human
aaagaaucacauccuucagcaa

SEQ ID NO: 396612 - RNA, 22 nt, Human
aauucuaaauguaauuuagaau

SEQ ID NO: 396613 - RNA, 22 nt, Human
cuauacaguaaccacagugauu

SEQ ID NO: 396614 - RNA, 22 nt, Human
ucagccagugccuugaucuugc

SEQ ID NO: 396615 - RNA, 20 nt, Human
agaaaucagaccacacacua

SEQ ID NO: 396616 - RNA, 22 nt, Human
gaguccuuuucauagcaguggg

SEQ ID NO: 396617 - RNA, 22 nt, Human
acagcauugcuccaucucaaga

SEQ ID NO: 396618 - RNA, 22 nt, Human
uuuggacaaguuacugguuucc

SEQ ID NO: 396619 - RNA, 22 nt, Human
aagacuuucaaaccuauguuug

SEQ ID NO: 396620 - RNA, 22 nt, Human
uuuuuugucuugaagaaauggu

SEQ ID NO: 396621 - RNA, 22 nt, Human
ugcuuuaaauaugaauuagcau

SEQ ID NO: 396622 - RNA, 22 nt, Human
ccuucaaucuuaagucagccca

SEQ ID NO: 396623 - RNA, 22 nt, Human
augcaaaauuaccauucuguuc

SEQ ID NO: 396624 - RNA, 22 nt, Human
uaagaaucugcauuuuaacaag

SEQ ID NO: 396625 - RNA, 22 nt, Human
uggcauuuggcuuacuuauguu

SEQ ID NO: 396626 - RNA, 22 nt, Human
aaugggauaauuguucauggga

SEQ ID NO: 396627 - RNA, 22 nt, Human
caucagaauguuauggggggcu

SEQ ID NO: 396628 - RNA, 22 nt, Human
uggcuucaaaaucuaguggucu

SEQ ID NO: 396629 - RNA, 22 nt, Human
gaugauaacagcauuucaacug

SEQ ID NO: 396630 - RNA, 22 nt, Human
auccaaaggugacacagaauac

SEQ ID NO: 396631 - RNA, 22 nt, Human
auaacagauacucucugugagg

SEQ ID NO: 396632 - RNA, 22 nt, Human
gaauuucaggacaacuggaagg

SEQ ID NO: 396633 - RNA, 22 nt, Human
uguauuaacauuaauaaaaugg

SEQ ID NO: 396634 - RNA, 22 nt, Human
aagccauuuguuguccuucagg

SEQ ID NO: 396635 - RNA, 22 nt, Human
uuuaggaaugugguuuuugagc

SEQ ID NO: 396636 - RNA, 22 nt, Human
uauggcuuuaaacaacuuaggu

SEQ ID NO: 396637 - RNA, 22 nt, Human
cauuucaagcauugacuucuau

SEQ ID NO: 396638 - RNA, 22 nt, Human
auggaucacagugccgugggug

SEQ ID NO: 396639 - RNA, 22 nt, Human
aucuaucccaguuuaacucauu

SEQ ID NO: 396640 - RNA, 22 nt, Human
aaauacuguugaaugaaguaag

SEQ ID NO: 396641 - RNA, 22 nt, Human
cuuuuaaugggagcaguauuug

SEQ ID NO: 396642 - RNA, 22 nt, Human
uuuaauauucugcauucuccuu

SEQ ID NO: 396643 - RNA, 22 nt, Human
ccauggcucuuaccuuguuaua

SEQ ID NO: 396644 - RNA, 22 nt, Human
auugauggcggccucuccauau

SEQ ID NO: 396645 - RNA, 22 nt, Human
uaucagaaaugccuuaaauugg

SEQ ID NO: 396646 - RNA, 22 nt, Human
uaucagaaggaagugccuuuaa

SEQ ID NO: 396647 - RNA, 22 nt, Human
aguccuuacaccuggaaccuau

SEQ ID NO: 396648 - RNA, 22 nt, Human
uuuuugcugauaagcagaauuc

SEQ ID NO: 396649 - RNA, 22 nt, Human
acagaauuuacacaucucuaaa

SEQ ID NO: 396650 - RNA, 22 nt, Human
aucagaaaggugggcaagcaga

SEQ ID NO: 396651 - RNA, 22 nt, Human
acagcauucaauaaauaauaac

SEQ ID NO: 396652 - RNA, 22 nt, Human
cugcagagcuuucugaaugaag

SEQ ID NO: 396653 - RNA, 22 nt, Human
uuaauucugccuuucauguaac

SEQ ID NO: 396654 - RNA, 22 nt, Human
cuauaauuaugcucaaaaugua

SEQ ID NO: 396655 - RNA, 22 nt, Human
ucugaagauuaccagcuaaaug

SEQ ID NO: 396656 - RNA, 22 nt, Human
uuugaagauuaugccagaguga

SEQ ID NO: 396657 - RNA, 22 nt, Human
augguuuacugaucuuuuuggu

SEQ ID NO: 396658 - RNA, 22 nt, Human
caagaauccuguucuugaagau

SEQ ID NO: 396659 - RNA, 22 nt, Human
acaugcuuugcacuuacaucau

SEQ ID NO: 396660 - RNA, 21 nt, Human
gauuuauaagccuuaagccua

SEQ ID NO: 396661 - RNA, 22 nt, Human
gaagaauccuguccucuuuagg

SEQ ID NO: 396662 - RNA, 22 nt, Human
acagguuuuuguggauauaugu

SEQ ID NO: 396663 - RNA, 22 nt, Human
cuguuaauugugaauuuuacau

SEQ ID NO: 396664 - RNA, 22 nt, Human
uguggaaaauuggaacguuccu

SEQ ID NO: 396665 - RNA, 22 nt, Human
uggcauuugggcuggcuuuucu

SEQ ID NO: 396666 - RNA, 22 nt, Human
uaauacuuuugccuuguauuca

SEQ ID NO: 396667 - RNA, 22 nt, Human
uauccaaacauauagucucucu

SEQ ID NO: 396668 - RNA, 23 nt, Human
uggaauaauaagguacauuaaca

SEQ ID NO: 396669 - RNA, 22 nt, Human
aguaaacauuuucauauuuucu

SEQ ID NO: 396670 - RNA, 22 nt, Human
uggcuuuaaaucuguauucaua

SEQ ID NO: 396671 - RNA, 22 nt, Human
uccuuaauucugugcaauaugu

SEQ ID NO: 396672 - RNA, 22 nt, Human
ccaaaauuaagccucuuauguu

SEQ ID NO: 396673 - RNA, 22 nt, Human
cuacagaaacacuggacaugug

SEQ ID NO: 396674 - RNA, 22 nt, Human
gcuauacagcaggagaauggaa

SEQ ID NO: 396675 - RNA, 22 nt, Human
uaaagccauacugaaagccacu

SEQ ID NO: 396676 - RNA, 22 nt, Human
auuuccaauuucauccaugucc

SEQ ID NO: 396677 - RNA, 22 nt, Human
ucaguaaaugguugcuguuauu

SEQ ID NO: 396678 - RNA, 22 nt, Human
uaaucugaagaaacaggacuug

SEQ ID NO: 396679 - RNA, 20 nt, Human
aaaaacaguaaugcugaaga

SEQ ID NO: 396680 - RNA, 22 nt, Human
uuauuuauggcccucaccugau

SEQ ID NO: 396681 - RNA, 22 nt, Human
uguauacaauucacacuuccca

SEQ ID NO: 396682 - RNA, 22 nt, Human
guagaaauauuuaucucugaga

SEQ ID NO: 396683 - RNA, 22 nt, Human
aucauaaaccacuuuguaaucu

SEQ ID NO: 396684 - RNA, 22 nt, Human
uaaaugauuuauguaugugaaa

SEQ ID NO: 396685 - RNA, 22 nt, Human
uuucauaaggguuucuagacuu

SEQ ID NO: 396686 - RNA, 22 nt, Human
gauagucaccucccuuaacuuu

SEQ ID NO: 396687 - RNA, 22 nt, Human
uuacagaaaauguguuuuaacu

SEQ ID NO: 396688 - RNA, 22 nt, Human
cagauuucagcucauauauuau

SEQ ID NO: 396689 - RNA, 22 nt, Human
aaagccaugaauguuauagagg

SEQ ID NO: 396690 - RNA, 22 nt, Human
guuaggcagugugguauagcag

SEQ ID NO: 396691 - RNA, 22 nt, Human
uuugaagugcaaugaggauucu

SEQ ID NO: 396692 - RNA, 22 nt, Human
gcuucacaggcaaguuaagccu

SEQ ID NO: 396693 - RNA, 22 nt, Human
uggcauuucuguuagacucuca

SEQ ID NO: 396694 - RNA, 22 nt, Human
uuuccaaaaguuuguucugugc

SEQ ID NO: 396695 - RNA, 20 nt, Human
uucuauacauaucacugaaa

SEQ ID NO: 396696 - RNA, 22 nt, Human
acaguccuuguguggaacauua

SEQ ID NO: 396697 - RNA, 22 nt, Human
gcuagaucucucauaaauucca

SEQ ID NO: 396698 - RNA, 22 nt, Human
guuauaaauaccuaauaggauu

SEQ ID NO: 396699 - RNA, 22 nt, Human
aaagcaauggaugagaaucugu

SEQ ID NO: 396700 - RNA, 22 nt, Human
agacaacaucacuaaagcugag

SEQ ID NO: 396701 - RNA, 22 nt, Human
uacaaaaaauugauacugacga

SEQ ID NO: 396702 - RNA, 22 nt, Human
augaaacaguguguauagcaaa

SEQ ID NO: 396703 - RNA, 22 nt, Human
ucaauaaaucccucugacccug

SEQ ID NO: 396704 - RNA, 22 nt, Human
uuuuauauggcacauugguugg

SEQ ID NO: 396705 - RNA, 22 nt, Human
ugcagggcccucauuccugucc

SEQ ID NO: 396706 - RNA, 22 nt, Human
ucuggaucccaccgccacacac

SEQ ID NO: 396707 - RNA, 22 nt, Human
auuauccagcaccaaugucaga

SEQ ID NO: 396708 - RNA, 18 nt, Human
gcaggcuuuuccuggguc

SEQ ID NO: 396709 - RNA, 22 nt, Human
cauuucaauacuaucugagaau

SEQ ID NO: 396710 - RNA, 16 nt, Human
gcaacuuugggguuga

SEQ ID NO: 396711 - RNA, 22 nt, Human
auuaggcauucugaaugagguc

SEQ ID NO: 396712 - RNA, 22 nt, Human
acaaagucaaauugcagccgcc

SEQ ID NO: 396713 - RNA, 22 nt, Human
caaguccuuagaugguucuuug

SEQ ID NO: 396714 - RNA, 20 nt, Human
auacuuguuuucaggcuuuu

SEQ ID NO: 396715 - RNA, 22 nt, Human
agagugaaguuuuugaaaguga

SEQ ID NO: 396716 - RNA, 20 nt, Human
caauuucaucauuuccugug

SEQ ID NO: 396717 - RNA, 20 nt, Human
uauuccaaggguagagaaaa

SEQ ID NO: 396718 - RNA, 22 nt, Human
ucaacuuugaaaccauagugaa

SEQ ID NO: 396719 - RNA, 22 nt, Human
ucaauaauggcaggauaaauuu

SEQ ID NO: 396720 - RNA, 22 nt, Human
uccaaauacauuuacuguauuu

SEQ ID NO: 396721 - RNA, 22 nt, Human
aaaacaguuuaggcaucacagu

SEQ ID NO: 396722 - RNA, 22 nt, Human
uaucagaaagauauuacugggg

SEQ ID NO: 396723 - RNA, 18 nt, Human
aacaguuuccagauucuc

SEQ ID NO: 396724 - RNA, 22 nt, Human
agaacaucuaaauaucugagac

SEQ ID NO: 396725 - RNA, 22 nt, Human
uuucaagaacaacauucauuca

SEQ ID NO: 396726 - RNA, 22 nt, Human
ucuucaauuuagaauggauuua

SEQ ID NO: 396727 - RNA, 22 nt, Human
ucuauacugaugggauacuauu

SEQ ID NO: 396728 - RNA, 22 nt, Human
auauaacauacauacagaaaag

SEQ ID NO: 396729 - RNA, 22 nt, Human
aaguccuuuaauaucacauagu

SEQ ID NO: 396730 - RNA, 22 nt, Human
caaugucaugauuuuccauuag

SEQ ID NO: 396731 - RNA, 22 nt, Human
uaauuucaaguuuagggcucua

SEQ ID NO: 396732 - RNA, 22 nt, Human
aucagcaucuuuaacaauuacc

SEQ ID NO: 396733 - RNA, 22 nt, Human
uacauauacugagugauuugcu

SEQ ID NO: 396734 - RNA, 22 nt, Human
acagaugauuuuuaugaaaaca

SEQ ID NO: 396735 - RNA, 22 nt, Human
cucauacauaugccauuccugc

SEQ ID NO: 396736 - RNA, 22 nt, Human
cacccaguugacuacaaagggg

SEQ ID NO: 396737 - RNA, 22 nt, Human
aaugguuugauggacaaaauga

SEQ ID NO: 396738 - RNA, 22 nt, Human
uggcauuuagaaaacaacaugu

SEQ ID NO: 396739 - RNA, 22 nt, Human
gagucaccuuggccgcuguccc

SEQ ID NO: 396740 - RNA, 22 nt, Human
uucagaaaaagaccauugcaau

SEQ ID NO: 396741 - RNA, 22 nt, Human
ccuauacaggcuucuuuacaug

SEQ ID NO: 396742 - RNA, 22 nt, Human
uuuaauauuucuuuccugaagc

SEQ ID NO: 396743 - RNA, 22 nt, Human
aaaucaguuagugguaggauug

SEQ ID NO: 396744 - RNA, 22 nt, Human
auuccaaagcacaucagaacua

SEQ ID NO: 396745 - RNA, 22 nt, Human
guacauaaaggaggcucuuugc

SEQ ID NO: 396746 - RNA, 22 nt, Human
guaaacauuuucaucugugccc

SEQ ID NO: 396747 - RNA, 22 nt, Human
ugucaccaaguugaugaaugca

SEQ ID NO: 396748 - RNA, 22 nt, Human
ugucaccacuggcugaaacacc

SEQ ID NO: 396749 - RNA, 22 nt, Human
cacaauuuggugcuaaagaaag

SEQ ID NO: 396750 - RNA, 22 nt, Human
agaauucauaggaaguuuccua

SEQ ID NO: 396751 - RNA, 22 nt, Human
uuauaugaguaucauaucacuu

SEQ ID NO: 396752 - RNA, 22 nt, Human
cuugccuuugucuucaaaggcu

SEQ ID NO: 396753 - RNA, 22 nt, Human
cuggauuugccuauggugcuuu

SEQ ID NO: 396754 - RNA, 22 nt, Human
ucuuuaaucauaaccaagaugg

SEQ ID NO: 396755 - RNA, 22 nt, Human
aaagcaaugcuuguggaaugua

SEQ ID NO: 396756 - RNA, 22 nt, Human
aaaugcauggcuguuuuaaagc

SEQ ID NO: 396757 - RNA, 22 nt, Human
aaaauccugcugacucgagaug

SEQ ID NO: 396758 - RNA, 22 nt, Human
uuuauucugugcuacaugaaga

SEQ ID NO: 396759 - RNA, 22 nt, Human
uaauccaaaacugaaucugugg

SEQ ID NO: 396760 - RNA, 22 nt, Human
aaagucauuguaauauaugcua

SEQ ID NO: 396761 - RNA, 23 nt, Human
cauaaaauauuaguaugguagca

SEQ ID NO: 396762 - RNA, 22 nt, Human
augaauaaguaaacuccuuugg

SEQ ID NO: 396763 - RNA, 22 nt, Human
aaugcaaagcaagcagagauuu

SEQ ID NO: 396764 - RNA, 22 nt, Human
cauggcuucuaagugauaacgu

SEQ ID NO: 396765 - RNA, 22 nt, Human
ucagagaagcugccaggcgagc

SEQ ID NO: 396766 - RNA, 22 nt, Human
ugcagagacuugugugcauuug

SEQ ID NO: 396767 - RNA, 22 nt, Human
aaguccuuuccaguccugugau

SEQ ID NO: 396768 - RNA, 22 nt, Human
augcuuuagugucaaguuuggg

SEQ ID NO: 396769 - RNA, 22 nt, Human
auucacuggcagacagaacuca

SEQ ID NO: 396770 - RNA, 21 nt, Human
aacugguucaauucaacuaga

SEQ ID NO: 396771 - RNA, 22 nt, Human
aaaugcuuagagguguucaaau

SEQ ID NO: 396772 - RNA, 22 nt, Human
gauuuacagaucuaagggucac

SEQ ID NO: 396773 - RNA, 22 nt, Human
aaacaggcuuccauuagagcaa

SEQ ID NO: 396774 - RNA, 22 nt, Human
aaugucuuuaaagugcaauaga

SEQ ID NO: 396775 - RNA, 22 nt, Human
auauaauacaaccugcuaagug

SEQ ID NO: 396776 - RNA, 22 nt, Human
ugcauaauacguuuccuauaac

SEQ ID NO: 396777 - RNA, 22 nt, Human
gaaagccaucuggcugcuggga

SEQ ID NO: 396778 - RNA, 22 nt, Human
uuucuaguaaucaauauaaagu

SEQ ID NO: 396779 - RNA, 22 nt, Human
uaucagaaaucaacacacagug

SEQ ID NO: 396780 - RNA, 22 nt, Human
caaguccucgcuucuagcugug

SEQ ID NO: 396781 - RNA, 22 nt, Human
ccuggaucccgauggcugugag

SEQ ID NO: 396782 - RNA, 22 nt, Human
acaucagauuaugcuuugcuua

SEQ ID NO: 396783 - RNA, 22 nt, Human
uaagagaauguuguggcuaggu

SEQ ID NO: 396784 - RNA, 22 nt, Human
ucuaaagccuuccauauaacgc

SEQ ID NO: 396785 - RNA, 22 nt, Human
uaauuccaccuuuuuccaacuu

SEQ ID NO: 396786 - RNA, 22 nt, Human
uaggaaaacgugauuuucucac

SEQ ID NO: 396787 - RNA, 22 nt, Human
uuccuuagacagagguggucau

SEQ ID NO: 396788 - RNA, 18 nt, Human
caauuucaauggucugaa

SEQ ID NO: 396789 - RNA, 22 nt, Human
uaaucuacuguuuauaugaaau

SEQ ID NO: 396790 - RNA, 22 nt, Human
uuugaaguggaaaaggauuuaa

SEQ ID NO: 396791 - RNA, 22 nt, Human
uuaauuacaaaacacauagguu

SEQ ID NO: 396792 - RNA, 22 nt, Human
aaacauguaauucugcuuaaga

SEQ ID NO: 396793 - RNA, 22 nt, Human
aaauucuucagguaauuuugau

SEQ ID NO: 396794 - RNA, 22 nt, Human
ccguagcacaugcuccuggggc

SEQ ID NO: 396795 - RNA, 22 nt, Human
uuuauccagaaucaggauuuuu

SEQ ID NO: 396796 - RNA, 22 nt, Human
augguuuacaauguuuucaguu

SEQ ID NO: 396797 - RNA, 22 nt, Human
aaucagaaagaucuugaugaga

SEQ ID NO: 396798 - RNA, 22 nt, Human
auaaaaucagaguuggauugga

SEQ ID NO: 396799 - RNA, 22 nt, Human
agguacaaaagaguauaugaga

SEQ ID NO: 396800 - RNA, 22 nt, Human
uuacagaagaguaacuuggcaa

SEQ ID NO: 396801 - RNA, 22 nt, Human
auuuaucucuggaaacuaagca

SEQ ID NO: 396802 - RNA, 22 nt, Human
uuuacagaugaggauacugagg

SEQ ID NO: 396803 - RNA, 22 nt, Human
uaaaauguuugcaagagaccag

SEQ ID NO: 396804 - RNA, 22 nt, Human
ucagaauaugcuaaugacauuu

SEQ ID NO: 396805 - RNA, 22 nt, Human
uugaauaaaugagcagugaauu

SEQ ID NO: 396806 - RNA, 22 nt, Human
acauucacuauguccaaacucu

SEQ ID NO: 396807 - RNA, 22 nt, Human
aaaguccuguuugaaggaccug

SEQ ID NO: 396808 - RNA, 22 nt, Human
uauacuuuccugcaacuuugau

SEQ ID NO: 396809 - RNA, 22 nt, Human
cauagaaacugagacaaggauu

SEQ ID NO: 396810 - RNA, 22 nt, Human
auacuagacuguucuguuauca

SEQ ID NO: 396811 - RNA, 22 nt, Human
aggaaaaaagucugugauuaua

SEQ ID NO: 396812 - RNA, 22 nt, Human
caguaucugucaguaaucaggu

SEQ ID NO: 396813 - RNA, 22 nt, Human
uugaagaaagucauauauaaug

SEQ ID NO: 396814 - RNA, 22 nt, Human
agaaaagaggcuuucuaagcau

SEQ ID NO: 396815 - RNA, 22 nt, Human
uauguaaaguagauggcaggua

SEQ ID NO: 396816 - RNA, 22 nt, Human
auuacagaaugcaguuccuuau

SEQ ID NO: 396817 - RNA, 22 nt, Human
aaauacugggcucaaaaggguu

SEQ ID NO: 396818 - RNA, 23 nt, Human
uauuacaauuggucuuauuaaga

SEQ ID NO: 396819 - RNA, 22 nt, Human
caaguccuaggucugauugaac

SEQ ID NO: 396820 - RNA, 22 nt, Human
guuaggcauuugccuuaauuuu

SEQ ID NO: 396821 - RNA, 22 nt, Human
uaaguccuauuccaggucucuc

SEQ ID NO: 396822 - RNA, 22 nt, Human
ucaguucaguauacacuauucu

SEQ ID NO: 396823 - RNA, 22 nt, Human
cagauacuguaaaauuucagua

SEQ ID NO: 396824 - RNA, 19 nt, Human
uauuucaaagugccgucua

SEQ ID NO: 396825 - RNA, 22 nt, Human
uuaauucuaguuuaacacuuag

SEQ ID NO: 396826 - RNA, 22 nt, Human
uaggcaacaugucgaauacugu

SEQ ID NO: 396827 - RNA, 22 nt, Human
caaguccuuuucuuggcucagg

SEQ ID NO: 396828 - RNA, 22 nt, Human
uacuuguagcagguggcauuua

SEQ ID NO: 396829 - RNA, 22 nt, Human
auuuagaagcuaauuuuucaga

SEQ ID NO: 396830 - RNA, 23 nt, Human
ccaaagucgaagucuaguccaga

SEQ ID NO: 396831 - RNA, 22 nt, Human
aguacaauuuaaugaagauagc

SEQ ID NO: 396832 - RNA, 23 nt, Human
uuuaacuuuccaauaauucauug

SEQ ID NO: 396833 - RNA, 22 nt, Human
gcuucacacuaaaaauguuaaa

SEQ ID NO: 396834 - RNA, 20 nt, Human
uacagacaugacaauaaugg

SEQ ID NO: 396835 - RNA, 22 nt, Human
uuuaggcauugaauuagaauag

SEQ ID NO: 396836 - RNA, 22 nt, Human
uucugugacuccucagagauuu

SEQ ID NO: 396837 - RNA, 22 nt, Human
agaucugaggguccaagggagg

SEQ ID NO: 396838 - RNA, 22 nt, Human
ucucuuaacugguucagcaauu

SEQ ID NO: 396839 - RNA, 22 nt, Human
aaauccuuuucuauacagcaua

SEQ ID NO: 396840 - RNA, 22 nt, Human
auagacauuuugcauucaagca

SEQ ID NO: 396841 - RNA, 22 nt, Human
cuggauuuuagaaggcuuccua

SEQ ID NO: 396842 - RNA, 22 nt, Human
uuacagauggaucuagcaaaau

SEQ ID NO: 396843 - RNA, 22 nt, Human
uuuaggcaaauuucagaugugc

SEQ ID NO: 396844 - RNA, 22 nt, Human
caucagucuagauucuaguacc

SEQ ID NO: 396845 - RNA, 22 nt, Human
cuccuuagugccucugcacgag

SEQ ID NO: 396846 - RNA, 22 nt, Human
uggcuuuagguugcauguuucu

SEQ ID NO: 396847 - RNA, 22 nt, Human
agaagugagugugacucagcag

SEQ ID NO: 396848 - RNA, 22 nt, Human
uguuccaagcugcuggauaagc

SEQ ID NO: 396849 - RNA, 20 nt, Human
aacacacugguggcaucagg

SEQ ID NO: 396850 - RNA, 22 nt, Human
caaagaagagauuuacagagcu

SEQ ID NO: 396851 - RNA, 22 nt, Human
auuucaacguuagauguaauag

SEQ ID NO: 396852 - RNA, 22 nt, Human
uuugaacaugcugcaugauaau

SEQ ID NO: 396853 - RNA, 22 nt, Human
gaugaucaucuguaaaguuaga

SEQ ID NO: 396854 - RNA, 22 nt, Human
uuuccaaacccagcgagcuaca

SEQ ID NO: 396855 - RNA, 19 nt, Human
aacuggauaauggccacau

SEQ ID NO: 396856 - RNA, 22 nt, Human
guuuauaaggcccaauauuucu

SEQ ID NO: 396857 - RNA, 22 nt, Human
auagaauagcauagaaaauuga

SEQ ID NO: 396858 - RNA, 22 nt, Human
ugcugagaucugccaguagaug

SEQ ID NO: 396859 - RNA, 22 nt, Human
aaacuuugguauguagcaaaac

SEQ ID NO: 396860 - RNA, 22 nt, Human
guuuaaucagaggaauuauaga

SEQ ID NO: 396861 - RNA, 22 nt, Human
cagucaccaccagguggcagua

SEQ ID NO: 396862 - RNA, 22 nt, Human
auauacugaggagacuuuauau

SEQ ID NO: 396863 - RNA, 23 nt, Human
uuccagaggaagaagucaugacu

SEQ ID NO: 396864 - RNA, 23 nt, Human
gagauuuagcagacaaagcucuu

SEQ ID NO: 396865 - RNA, 22 nt, Human
uaauaaacugcuacgcuuaguu

SEQ ID NO: 396866 - RNA, 22 nt, Human
aaucagugguucccagcccagg

SEQ ID NO: 396867 - RNA, 23 nt, Human
aaaguguagccagguuaagaacc

SEQ ID NO: 396868 - RNA, 22 nt, Human
ccaaagcaagucacaugaucaa

SEQ ID NO: 396869 - RNA, 22 nt, Human
cagaaaauaaaguuucuacgca

SEQ ID NO: 396870 - RNA, 22 nt, Human
auacagaaaaguggauagccag

SEQ ID NO: 396871 - RNA, 22 nt, Human
caaguccaggucaauuuaaagc

SEQ ID NO: 396872 - RNA, 22 nt, Human
auuaggcauucaugcagcuccu

SEQ ID NO: 396873 - RNA, 22 nt, Human
aaaguccuuuuugccaugcaag

SEQ ID NO: 396874 - RNA, 22 nt, Human
acaaagaucuugcuuuccuacu

SEQ ID NO: 396875 - RNA, 22 nt, Human
aacacuuucuauuauuaugguu

SEQ ID NO: 396876 - RNA, 22 nt, Human
caaauucaaauuucaucagugu

SEQ ID NO: 396877 - RNA, 22 nt, Human
uggcauuucuggccauuugugu

SEQ ID NO: 396878 - RNA, 22 nt, Human
aggauuuaccuccagcuaggcu

SEQ ID NO: 396879 - RNA, 22 nt, Human
caaauucaaugaacauguuuaa

SEQ ID NO: 396880 - RNA, 22 nt, Human
guuccaaagucucugagcugag

SEQ ID NO: 396881 - RNA, 22 nt, Human
aagaaaucagaaaagcauucgu

SEQ ID NO: 396882 - RNA, 21 nt, Human
ucauuuauugagaaaugacug

SEQ ID NO: 396883 - RNA, 22 nt, Human
uuuaaugaauaauucaaaucug

SEQ ID NO: 396884 - RNA, 22 nt, Human
uuccuuagugccucuuccgcug

SEQ ID NO: 396885 - RNA, 22 nt, Human
ucaaguuucucucagauuaugg

SEQ ID NO: 396886 - RNA, 22 nt, Human
ugucauaaucaguuuugcaugu

SEQ ID NO: 396887 - RNA, 22 nt, Human
caacuuugugugaccuagauag

SEQ ID NO: 396888 - RNA, 22 nt, Human
cagauuucuauuucaaauacau

SEQ ID NO: 396889 - RNA, 22 nt, Human
uuguccaaaguaacacaucuag

SEQ ID NO: 396890 - RNA, 22 nt, Human
cuuauaaaguccaucugaacaa

SEQ ID NO: 396891 - RNA, 22 nt, Human
ggaucugauuaauaagguggac

SEQ ID NO: 396892 - RNA, 22 nt, Human
uuuauccaaggguuuuaacugu

SEQ ID NO: 396893 - RNA, 22 nt, Human
uaagaaucuauuaggaauaugu

SEQ ID NO: 396894 - RNA, 22 nt, Human
ugcaggaagacuucccaagcca

SEQ ID NO: 396895 - RNA, 22 nt, Human
aaacuuuguagagaaugcuggc

SEQ ID NO: 396896 - RNA, 22 nt, Human
uuacuacugcuuuacuacuggg

SEQ ID NO: 396897 - RNA, 22 nt, Human
uaacagaaaggggacagaaaua

SEQ ID NO: 396898 - RNA, 22 nt, Human
ucagaauuugauuccugggaua

SEQ ID NO: 396899 - RNA, 22 nt, Human
acaugcuuuucccacaauuaua

SEQ ID NO: 396900 - RNA, 22 nt, Human
cauagaaacuugcagcaagcac

SEQ ID NO: 396901 - RNA, 22 nt, Human
ugugaaagauacuaggcagagg

SEQ ID NO: 396902 - RNA, 22 nt, Human
aguuacagugaccauuuauuua

SEQ ID NO: 396903 - RNA, 23 nt, Human
auagaagauuauugcaacagucc

SEQ ID NO: 396904 - RNA, 22 nt, Human
aaacauguuuucugaauauuuu

SEQ ID NO: 396905 - RNA, 22 nt, Human
uccauuuagcuggcaaacaaug

SEQ ID NO: 396906 - RNA, 22 nt, Human
gagaagguggaccugaaggagc

SEQ ID NO: 396907 - RNA, 22 nt, Human
gaauauauuggugaaaauaguu

SEQ ID NO: 396908 - RNA, 22 nt, Human
caaguccucaaagggcucugcu

SEQ ID NO: 396909 - RNA, 22 nt, Human
ccuggaucagagccagagaagc

SEQ ID NO: 396910 - RNA, 22 nt, Human
aaauugcagaugcuaaaugacu

SEQ ID NO: 396911 - RNA, 20 nt, Human
auaaaauaacugccacaaga

SEQ ID NO: 396912 - RNA, 22 nt, Human
aauaacagagaaggguggcuuc

SEQ ID NO: 396913 - RNA, 23 nt, Human
uuaaacuucagugcagaacacuc

SEQ ID NO: 396914 - RNA, 22 nt, Human
uggauuagguacuaugaauaua

SEQ ID NO: 396915 - RNA, 22 nt, Human
uaauuuuuccacguacacuggg

SEQ ID NO: 396916 - RNA, 22 nt, Human
aaagcagucacuccagugugau

SEQ ID NO: 396917 - RNA, 22 nt, Human
auaucagacagaaagcauugac

SEQ ID NO: 396918 - RNA, 22 nt, Human
uagcauaacagguaagagugag

SEQ ID NO: 396919 - RNA, 22 nt, Human
uaggcagaauuguugaaugaag

SEQ ID NO: 396920 - RNA, 22 nt, Human
ucagaauucagagggagugggg

SEQ ID NO: 396921 - RNA, 22 nt, Human
acagaauugauggaaaucucag

SEQ ID NO: 396922 - RNA, 22 nt, Human
auagaauuauggaaagcaucuu

SEQ ID NO: 396923 - RNA, 18 nt, Human
aaaaagugcucaggccua

SEQ ID NO: 396924 - RNA, 21 nt, Human
acuuuaauauacaugaggagg

SEQ ID NO: 396925 - RNA, 23 nt, Human
uuccacaaugaaaauaaagcagg

SEQ ID NO: 396926 - RNA, 23 nt, Human
ucuaauacaugaaaccuagaugu

SEQ ID NO: 396927 - RNA, 22 nt, Human
auguucaaacuuuuuacacacc

SEQ ID NO: 396928 - RNA, 22 nt, Human
aggauuuaaauccuuaaccacu

SEQ ID NO: 396929 - RNA, 22 nt, Human
cauuucaaggaccacccuggga

SEQ ID NO: 396930 - RNA, 22 nt, Human
uuuauucuauaggcauuaagca

SEQ ID NO: 396931 - RNA, 22 nt, Human
aaucaguguggugacuugucug

SEQ ID NO: 396932 - RNA, 22 nt, Human
uuagaaaucaccucugaagauc

SEQ ID NO: 396933 - RNA, 22 nt, Human
caacuuucuguuaaauguuagu

SEQ ID NO: 396934 - RNA, 18 nt, Human
auagaaaccuuuaaucag

SEQ ID NO: 396935 - RNA, 22 nt, Human
aacaugaaaagcccagagaggu

SEQ ID NO: 396936 - RNA, 22 nt, Human
uaagaaucaguagauauagauu

SEQ ID NO: 396937 - RNA, 22 nt, Human
aagcucauuaauuagaagcuaa

SEQ ID NO: 396938 - RNA, 22 nt, Human
auacugaauuagguaaagcaua

SEQ ID NO: 396939 - RNA, 22 nt, Human
uuagacaagggcuccuuaaaag

SEQ ID NO: 396940 - RNA, 22 nt, Human
augaacaaguauuugcaugagc

SEQ ID NO: 396941 - RNA, 22 nt, Human
auuccaaagacagaagcagcug

SEQ ID NO: 396942 - RNA, 22 nt, Human
uucucuuagcuguaaagucaau

SEQ ID NO: 396943 - RNA, 22 nt, Human
uugaauaauguguauguuguua

SEQ ID NO: 396944 - RNA, 22 nt, Human
auucauaaguaaaugauuaccu

SEQ ID NO: 396945 - RNA, 22 nt, Human
uacacagaggcugaugucuuag

SEQ ID NO: 396946 - RNA, 22 nt, Human
ucaaacaggacuacauucucau

SEQ ID NO: 396947 - RNA, 22 nt, Human
uuauccaacaugacuuaugucc

SEQ ID NO: 396948 - RNA, 22 nt, Human
acauguauugacauuauauucu

SEQ ID NO: 396949 - RNA, 22 nt, Human
uacugugacagaguacuuaaac

SEQ ID NO: 396950 - RNA, 22 nt, Human
aauaagauccugaagauauguu

SEQ ID NO: 396951 - RNA, 22 nt, Human
uacaauacuuaaccuauuuugc

SEQ ID NO: 396952 - RNA, 22 nt, Human
acagaaugggauuugaauauuu

SEQ ID NO: 396953 - RNA, 22 nt, Human
augcuuaaugaggguauauaug

SEQ ID NO: 396954 - RNA, 21 nt, Human
caagccagaccaauagcagcc

SEQ ID NO: 396955 - RNA, 20 nt, Human
auaggaaagggaggggcuuu

SEQ ID NO: 396956 - RNA, 22 nt, Human
uaauauguguuacugacuuuuu

SEQ ID NO: 396957 - RNA, 22 nt, Human
guaaauuauuucaagaucaucu

SEQ ID NO: 396958 - RNA, 22 nt, Human
cagaucuguuugccagaucagc

SEQ ID NO: 396959 - RNA, 22 nt, Human
uuaauucagucaaagaaaccau

SEQ ID NO: 396960 - RNA, 22 nt, Human
uauaaaacagaaagcacuaccu

SEQ ID NO: 396961 - RNA, 22 nt, Human
caucagaacgugagcuccuugu

SEQ ID NO: 396962 - RNA, 22 nt, Human
aaagucaugaugaaccaccgua

SEQ ID NO: 396963 - RNA, 22 nt, Human
aagcauuugguucugaagacuc

SEQ ID NO: 396964 - RNA, 22 nt, Human
acaacuuucuggguuaucugau

SEQ ID NO: 396965 - RNA, 22 nt, Human
acaacuuugacccuuguucuua

SEQ ID NO: 396966 - RNA, 22 nt, Human
acagaacugggggcacagauag

SEQ ID NO: 396967 - RNA, 22 nt, Human
guucuaauaggagaaaagacag

SEQ ID NO: 396968 - RNA, 22 nt, Human
gaguccuuggcaucaucaguac

SEQ ID NO: 396969 - RNA, 22 nt, Human
aaauuucaguuaccuuuacguu

SEQ ID NO: 396970 - RNA, 22 nt, Human
uggauuaguuaagaaauguuag

SEQ ID NO: 396971 - RNA, 22 nt, Human
auacagaauuugcccuuuucau

SEQ ID NO: 396972 - RNA, 22 nt, Human
uaugaaauuuaaacacagauca

SEQ ID NO: 396973 - RNA, 22 nt, Human
acagaguucccacuccagaagc

SEQ ID NO: 396974 - RNA, 21 nt, Human
uaucagaagagaaagaaugau

SEQ ID NO: 396975 - RNA, 22 nt, Human
agaagucaauaguuguuugaug

SEQ ID NO: 396976 - RNA, 22 nt, Human
caauacaauuaccaguuaauca

SEQ ID NO: 396977 - RNA, 22 nt, Human
cuauacagagcauccuuaacuu

SEQ ID NO: 396978 - RNA, 22 nt, Human
guacagaaauggggccccaggu

SEQ ID NO: 396979 - RNA, 22 nt, Human
uuuauccagcagcuauucaaaa

SEQ ID NO: 396980 - RNA, 18 nt, Human
caagaaucucuaaagaag

SEQ ID NO: 396981 - RNA, 22 nt, Human
gaucagaaugggacauauccug

SEQ ID NO: 396982 - RNA, 22 nt, Human
ccauuucacucuuccugaagga

SEQ ID NO: 396983 - RNA, 22 nt, Human
cauuuaguuauacuaaaacauu

SEQ ID NO: 396984 - RNA, 22 nt, Human
uuccuuagaguuuccagaaagc

SEQ ID NO: 396985 - RNA, 22 nt, Human
aagcauuuauagauaagaauuu

SEQ ID NO: 396986 - RNA, 22 nt, Human
caguccuuagauuuuacugcca

SEQ ID NO: 396987 - RNA, 22 nt, Human
aaagucauccaaauuuuuaugu

SEQ ID NO: 396988 - RNA, 22 nt, Human
gcuauacacauuucuugguagu

SEQ ID NO: 396989 - RNA, 17 nt, Human
cuuuuaauuuacuuccc

SEQ ID NO: 396990 - RNA, 22 nt, Human
uaaagacaugguguaggugaac

SEQ ID NO: 396991 - RNA, 22 nt, Human
uuucagacagauucuucucagu

SEQ ID NO: 396992 - RNA, 22 nt, Human
cauaacaguggcuucagcaagu

SEQ ID NO: 396993 - RNA, 22 nt, Human
uucacagaauugucuugacugg

SEQ ID NO: 396994 - RNA, 17 nt, Human
uaaauacacaaggguau

SEQ ID NO: 396995 - RNA, 22 nt, Human
uaaugcuuaauuuucacaagcc

SEQ ID NO: 396996 - RNA, 21 nt, Human
accaaaaccuauacuuucugu

SEQ ID NO: 396997 - RNA, 22 nt, Human
ugaaauagaaaaacaggcuucu

SEQ ID NO: 396998 - RNA, 22 nt, Human
gauaaaauauguggccuuuagu

SEQ ID NO: 396999 - RNA, 22 nt, Human
cuuauacacccucuucccaggc

SEQ ID NO: 397000 - RNA, 22 nt, Human
uucaccacagucucaucuacgc

SEQ ID NO: 397001 - RNA, 22 nt, Human
cagaaaucauugugaugacagg

SEQ ID NO: 397002 - RNA, 22 nt, Human
cuuugaauuccaguacaauaac

SEQ ID NO: 397003 - RNA, 22 nt, Human
acagaaauaacuuuuuauguuu

SEQ ID NO: 397004 - RNA, 22 nt, Human
ucuuuaauauaaaggaaugaau

SEQ ID NO: 397005 - RNA, 22 nt, Human
uacagagauacucuagaucaaa

SEQ ID NO: 397006 - RNA, 22 nt, Human
uccaaaaaacguuugaauaguu

SEQ ID NO: 397007 - RNA, 22 nt, Human
agcaauuuucccuuagucuuug

SEQ ID NO: 397008 - RNA, 22 nt, Human
aaauacuguagauaauagaguu

SEQ ID NO: 397009 - RNA, 22 nt, Human
uucaauucuaaacuaauauucu

SEQ ID NO: 397010 - RNA, 20 nt, Human
aggauuuacuacuaccugcu

SEQ ID NO: 397011 - RNA, 22 nt, Human
uuaauuacuaagcacaaugcaa

SEQ ID NO: 397012 - RNA, 22 nt, Human
gccuuaauuuaugucuaacaua

SEQ ID NO: 397013 - RNA, 22 nt, Human
aaaaugcugggaaaguuggaau

SEQ ID NO: 397014 - RNA, 22 nt, Human
gauuuacaaagcucucuagugu

SEQ ID NO: 397015 - RNA, 22 nt, Human
caaagcaccacaaaccagguga

SEQ ID NO: 397016 - RNA, 22 nt, Human
ucuauacaaguuucacuuugac

SEQ ID NO: 397017 - RNA, 22 nt, Human
gauuucaaccuaacaguaugac

SEQ ID NO: 397018 - RNA, 22 nt, Human
uggauuagugcugaaaugaugg

SEQ ID NO: 397019 - RNA, 22 nt, Human
uugaauaauauguucaggagga

SEQ ID NO: 397020 - RNA, 18 nt, Human
cuggcuuucuuauccauc

SEQ ID NO: 397021 - RNA, 22 nt, Human
aguccuuaugugguggagagag

SEQ ID NO: 397022 - RNA, 22 nt, Human
caaauuccucagaaucagaaaa

SEQ ID NO: 397023 - RNA, 22 nt, Human
aguacaaugucugacacaguag

SEQ ID NO: 397024 - RNA, 22 nt, Human
aucagaauaauuagauuucaga

SEQ ID NO: 397025 - RNA, 22 nt, Human
aagcagggcuuuaagcgguuuu

SEQ ID NO: 397026 - RNA, 22 nt, Human
uacaggaaguaaguaaugaaau

SEQ ID NO: 397027 - RNA, 22 nt, Human
cagcacagggacaauagcagau

SEQ ID NO: 397028 - RNA, 22 nt, Human
gucacagaguuauuaauugugu

SEQ ID NO: 397029 - RNA, 23 nt, Human
uacagaaggaguagucacuaaga

SEQ ID NO: 397030 - RNA, 22 nt, Human
ugaaaauggccugaagaagcaa

SEQ ID NO: 397031 - RNA, 21 nt, Human
ugaaacaaucagacagagucu

SEQ ID NO: 397032 - RNA, 22 nt, Human
aagauauagauaaaacuaugca

SEQ ID NO: 397033 - RNA, 22 nt, Human
gauuuacagcuauacccaaugg

SEQ ID NO: 397034 - RNA, 22 nt, Human
uguccuuagggauauaaaauau

SEQ ID NO: 397035 - RNA, 22 nt, Human
aauguaaacagcaagagaaggg

SEQ ID NO: 397036 - RNA, 22 nt, Human
uaaaacugaauacauacugagg

SEQ ID NO: 397037 - RNA, 22 nt, Human
ucaaaauuuuauuucucaagga

SEQ ID NO: 397038 - RNA, 22 nt, Human
uggcuuaagauuuaugcuuuua

SEQ ID NO: 397039 - RNA, 22 nt, Human
gaaauauacauugcaggaagag

SEQ ID NO: 397040 - RNA, 22 nt, Human
uuugaagaccuuaucucuaaau

SEQ ID NO: 397041 - RNA, 22 nt, Human
uaucagaaacucuggggcaggg

SEQ ID NO: 397042 - RNA, 22 nt, Human
acagaauugaaaguauaaucug

SEQ ID NO: 397043 - RNA, 22 nt, Human
aacauguugcuuuaauaauauu

SEQ ID NO: 397044 - RNA, 18 nt, Human
augaucuuagcaaauauu

SEQ ID NO: 397045 - RNA, 22 nt, Human
uuacagaaggaacacuacucag

SEQ ID NO: 397046 - RNA, 22 nt, Human
uuaggaaacgcugcuauugacu

SEQ ID NO: 397047 - RNA, 22 nt, Human
uauggcuuuuaacugucguaug

SEQ ID NO: 397048 - RNA, 22 nt, Human
auaaaacuuggguaugaucccu

SEQ ID NO: 397049 - RNA, 22 nt, Human
auucuuaaauuuaggucuguga

SEQ ID NO: 397050 - RNA, 22 nt, Human
ugcuuuaagagauuguuaguac

SEQ ID NO: 397051 - RNA, 22 nt, Human
ugaaagguguccaauauuucuc

SEQ ID NO: 397052 - RNA, 22 nt, Human
uacauacaagauguguuuaaaa

SEQ ID NO: 397053 - RNA, 22 nt, Human
guacaauagucccuguuuggau

SEQ ID NO: 397054 - RNA, 22 nt, Human
auacaaugauaauaguacuuua

SEQ ID NO: 397055 - RNA, 22 nt, Human
aaugugauuagccucuacugga

SEQ ID NO: 397056 - RNA, 22 nt, Human
uuuccaaauaaggucacauucu

SEQ ID NO: 397057 - RNA, 22 nt, Human
uaaguccuaacagacugggggc

SEQ ID NO: 397058 - RNA, 22 nt, Human
aucuauacuacaaauggcuggu

SEQ ID NO: 397059 - RNA, 22 nt, Human
aaacaugaauagauauuaaaca

SEQ ID NO: 397060 - RNA, 21 nt, Human
augugaaauaucaucagagca

SEQ ID NO: 397061 - RNA, 22 nt, Human
uaaagccacuucauucuagucu

SEQ ID NO: 397062 - RNA, 22 nt, Human
ugaagaauaaaugguugagacu

SEQ ID NO: 397063 - RNA, 23 nt, Human
aagucaccaagaggaaggcggag

SEQ ID NO: 397064 - RNA, 22 nt, Human
aaucauaauucaaauaagcuua

SEQ ID NO: 397065 - RNA, 22 nt, Human
ugcagagaaaccaguggaggac

SEQ ID NO: 397066 - RNA, 22 nt, Human
guucuaauuuggggcuccuuag

SEQ ID NO: 397067 - RNA, 22 nt, Human
uuauuauugugguugcauuauc

SEQ ID NO: 397068 - RNA, 22 nt, Human
ccagauuugagcgucuuaaacc

SEQ ID NO: 397069 - RNA, 22 nt, Human
gaauuucaagcagugcaauguu

SEQ ID NO: 397070 - RNA, 22 nt, Human
uuugaaguguuauuucuaucac

SEQ ID NO: 397071 - RNA, 22 nt, Human
uuuaauacuauggggaugaaca

SEQ ID NO: 397072 - RNA, 22 nt, Human
uaguccuugguaaaauucuaug

SEQ ID NO: 397073 - RNA, 19 nt, Human
guuaggcaggguggggagu

SEQ ID NO: 397074 - RNA, 22 nt, Human
ucacagaacaauguuuaguucu

SEQ ID NO: 397075 - RNA, 22 nt, Human
ccauggcuuuugagucucaaga

SEQ ID NO: 397076 - RNA, 22 nt, Human
caaagucagcugccagucccaa

SEQ ID NO: 397077 - RNA, 22 nt, Human
auaggcuuauauaaaaacaucu

SEQ ID NO: 397078 - RNA, 22 nt, Human
gacuaugugaagugugaauagg

SEQ ID NO: 397079 - RNA, 22 nt, Human
ugaauagauuuuuaacauauaa

SEQ ID NO: 397080 - RNA, 22 nt, Human
uucaccgugaaccgauuccuca

SEQ ID NO: 397081 - RNA, 22 nt, Human
acaugaaacuguugcauuagaa

SEQ ID NO: 397082 - RNA, 20 nt, Human
ucuuauacagaaaacauuuu

SEQ ID NO: 397083 - RNA, 22 nt, Human
caaagucauggggaugcagguc

SEQ ID NO: 397084 - RNA, 22 nt, Human
uuccacaauguaugaauaagau

SEQ ID NO: 397085 - RNA, 22 nt, Human
uauuccaacugucauagucaua

SEQ ID NO: 397086 - RNA, 22 nt, Human
auuccaaagguuaaugcccauu

SEQ ID NO: 397087 - RNA, 22 nt, Human
agaucugaccuaaccccaccac

SEQ ID NO: 397088 - RNA, 22 nt, Human
ugguuuaaccugucucuuauua

SEQ ID NO: 397089 - RNA, 22 nt, Human
uagucaccugugagcugcguag

SEQ ID NO: 397090 - RNA, 22 nt, Human
agaagucaaguggucuaugaaa

SEQ ID NO: 397091 - RNA, 22 nt, Human
auacauaauuacuuccgauguu

SEQ ID NO: 397092 - RNA, 22 nt, Human
agaauuccuccucugggacacu

SEQ ID NO: 397093 - RNA, 22 nt, Human
aauuuacaguugcugaugguac

SEQ ID NO: 397094 - RNA, 21 nt, Human
ucagagaacccggcaggcaag

SEQ ID NO: 397095 - RNA, 22 nt, Human
aagaaaucauaucauuucuugg

SEQ ID NO: 397096 - RNA, 22 nt, Human
aguguuuaccccaaucaguuua

SEQ ID NO: 397097 - RNA, 22 nt, Human
cuaugacacaggccauuauaua

SEQ ID NO: 397098 - RNA, 22 nt, Human
uaggauuuaggcuuuaacaucu

SEQ ID NO: 397099 - RNA, 22 nt, Human
uuggagagaggcugcucaggcu

SEQ ID NO: 397100 - RNA, 22 nt, Human
uaagucaucacauugcagagau

SEQ ID NO: 397101 - RNA, 22 nt, Human
uguaagaaucagucuuuaaugu

SEQ ID NO: 397102 - RNA, 20 nt, Human
gaaguccuguuauauccuuu

SEQ ID NO: 397103 - RNA, 22 nt, Human
uacaguaagaugaaauagcaau

SEQ ID NO: 397104 - RNA, 22 nt, Human
caauauauaaugaguacuuucc

SEQ ID NO: 397105 - RNA, 22 nt, Human
uagaaacagauguuuuugaaga

SEQ ID NO: 397106 - RNA, 22 nt, Human
cauagaaaagaguagguaaugu

SEQ ID NO: 397107 - RNA, 22 nt, Human
aguucacauaucuguuuuauuu

SEQ ID NO: 397108 - RNA, 22 nt, Human
aaagcaguauauugguaguugu

SEQ ID NO: 397109 - RNA, 20 nt, Human
guaaaauauggucuuugggu

SEQ ID NO: 397110 - RNA, 22 nt, Human
aggcaacuguuugauaauguug

SEQ ID NO: 397111 - RNA, 18 nt, Human
uacaggaaaaguguuaca

SEQ ID NO: 397112 - RNA, 21 nt, Human
ccaagacucccaucuaguggu

SEQ ID NO: 397113 - RNA, 22 nt, Human
gacauaauccuccucaccuacu

SEQ ID NO: 397114 - RNA, 22 nt, Human
ugugugaauggauuauucuauu

SEQ ID NO: 397115 - RNA, 22 nt, Human
uaugcccagcuuaaaguacaca

SEQ ID NO: 397116 - RNA, 22 nt, Human
gaauuuuucuggaagcaauuau

SEQ ID NO: 397117 - RNA, 22 nt, Human
aaucagaaauucuacaucacaa

SEQ ID NO: 397118 - RNA, 22 nt, Human
aaaugucagaggaacauauuga

SEQ ID NO: 397119 - RNA, 22 nt, Human
uuacagaaguauugagagaucc

SEQ ID NO: 397120 - RNA, 22 nt, Human
aaaugaaaugagugccuggagg

SEQ ID NO: 397121 - RNA, 22 nt, Human
acaagauaaggugucagugugu

SEQ ID NO: 397122 - RNA, 22 nt, Human
aaugguauuugucaagcauagu

SEQ ID NO: 397123 - RNA, 22 nt, Human
cuuaggcagggcuggaagaucu

SEQ ID NO: 397124 - RNA, 22 nt, Human
ugaaguaacuguccaggaucca

SEQ ID NO: 397125 - RNA, 22 nt, Human
acaauuccacauggcaugcagg

SEQ ID NO: 397126 - RNA, 22 nt, Human
aaugugaucgcuuuagaagcuu

SEQ ID NO: 397127 - RNA, 22 nt, Human
cagucaccugaagacuugacca

SEQ ID NO: 397128 - RNA, 22 nt, Human
auugaaaauaaggccagaaaca

SEQ ID NO: 397129 - RNA, 21 nt, Human
uccaaaaaggagcguccuucu

SEQ ID NO: 397130 - RNA, 22 nt, Human
uaugcuguggaaaauacaaaga

SEQ ID NO: 397131 - RNA, 22 nt, Human
aauaaugucuuuggcuugacca

SEQ ID NO: 397132 - RNA, 23 nt, Human
ggccauuucauuugguucaaacu

SEQ ID NO: 397133 - RNA, 22 nt, Human
gcagaauuuucuguuuucuaga

SEQ ID NO: 397134 - RNA, 22 nt, Human
cuuaaacugaaagcuacaagau

SEQ ID NO: 397135 - RNA, 22 nt, Human
aaucccagcuacucaggaaguu

SEQ ID NO: 397136 - RNA, 19 nt, Human
uccauaaugaagauagagg

SEQ ID NO: 397137 - RNA, 22 nt, Human
guuuaauaauguugaauuacua

SEQ ID NO: 397138 - RNA, 22 nt, Human
auuucaggauagccuaguuuug

SEQ ID NO: 397139 - RNA, 22 nt, Human
caacuuuucugugaauuuaagu

SEQ ID NO: 397140 - RNA, 22 nt, Human
gcuggaucccugugggaguggu

SEQ ID NO: 397141 - RNA, 23 nt, Human
aaguacauauauuuagauaguga

SEQ ID NO: 397142 - RNA, 22 nt, Human
uauuaucauuaacuguugaauu

SEQ ID NO: 397143 - RNA, 22 nt, Human
aagaaugagcucaaagaucuua

SEQ ID NO: 397144 - RNA, 22 nt, Human
uuauacaguuuauacuuagaau

SEQ ID NO: 397145 - RNA, 22 nt, Human
ucagaaaagagaaaaucuuaua

SEQ ID NO: 397146 - RNA, 22 nt, Human
auguguaugcaugcacuaagau

SEQ ID NO: 397147 - RNA, 22 nt, Human
aauuucaaacuaauaggaacca

SEQ ID NO: 397148 - RNA, 22 nt, Human
aaguuucaaauauaaaauuaca

SEQ ID NO: 397149 - RNA, 22 nt, Human
auguaaaucaagcagugcuggu

SEQ ID NO: 397150 - RNA, 22 nt, Human
agaaccucaauuauuuuugcac

SEQ ID NO: 397151 - RNA, 22 nt, Human
caaagccauagaguagauaaga

SEQ ID NO: 397152 - RNA, 22 nt, Human
cucuaacaccacagugugguuu

SEQ ID NO: 397153 - RNA, 23 nt, Human
uuaaaggcagauguugaguauua

SEQ ID NO: 397154 - RNA, 22 nt, Human
aucagaaauugcuaccagugga

SEQ ID NO: 397155 - RNA, 21 nt, Human
gauuugcagaaacuagacagg

SEQ ID NO: 397156 - RNA, 22 nt, Human
uuuaaagagaaugugaaggagu

SEQ ID NO: 397157 - RNA, 22 nt, Human
gaugaaaaucuugagaugucga

SEQ ID NO: 397158 - RNA, 22 nt, Human
uucauuaauucauucagugacu

SEQ ID NO: 397159 - RNA, 22 nt, Human
aguuaucagguguuuucaugga

SEQ ID NO: 397160 - RNA, 22 nt, Human
auccaaaccuggacaugagugg

SEQ ID NO: 397161 - RNA, 22 nt, Human
uucacacacagcuuccuauugu

SEQ ID NO: 397162 - RNA, 22 nt, Human
cuggcuuucuauuuggugcuau

SEQ ID NO: 397163 - RNA, 22 nt, Human
uuuauucuugagagugagaaga

SEQ ID NO: 397164 - RNA, 22 nt, Human
aguucacagaauggccagaacu

SEQ ID NO: 397165 - RNA, 22 nt, Human
aacaaacaaacauuuugucauc

SEQ ID NO: 397166 - RNA, 22 nt, Human
cugaauaauuuucuguuguaug

SEQ ID NO: 397167 - RNA, 22 nt, Human
augugaaauagcuggauaugaa

SEQ ID NO: 397168 - RNA, 22 nt, Human
gaagugaagguuacucuagauu

SEQ ID NO: 397169 - RNA, 22 nt, Human
aauaauuuccagccaacuggaa

SEQ ID NO: 397170 - RNA, 19 nt, Human
cauguuaugcuguaguauc

SEQ ID NO: 397171 - RNA, 22 nt, Human
aaagcagguugcaauuacagug

SEQ ID NO: 397172 - RNA, 22 nt, Human
aauacugagaucccacaaagca

SEQ ID NO: 397173 - RNA, 22 nt, Human
auacagaacucucaguuguaua

SEQ ID NO: 397174 - RNA, 21 nt, Human
auagaacaccaggcauauaua

SEQ ID NO: 397175 - RNA, 22 nt, Human
uguacaaugccgagacuaacuc

SEQ ID NO: 397176 - RNA, 22 nt, Human
uccaaaguaauuucacuucugu

SEQ ID NO: 397177 - RNA, 22 nt, Human
ucaguuucuccaucgcuccagu

SEQ ID NO: 397178 - RNA, 22 nt, Human
uggauuuaguucuucacaggcc

SEQ ID NO: 397179 - RNA, 22 nt, Human
aaauccuuuggaggacaugaug

SEQ ID NO: 397180 - RNA, 22 nt, Human
gcaacuuuagaaaaaucuauaa

SEQ ID NO: 397181 - RNA, 22 nt, Human
auuaggcaauucugggcaucuc

SEQ ID NO: 397182 - RNA, 22 nt, Human
auuauccucagaaaacauguga

SEQ ID NO: 397183 - RNA, 22 nt, Human
uuccucuagcuucucacuaaca

SEQ ID NO: 397184 - RNA, 22 nt, Human
uacauagaacauguuuaauguc

SEQ ID NO: 397185 - RNA, 22 nt, Human
aaucuagucuccuuaagucuuu

SEQ ID NO: 397186 - RNA, 22 nt, Human
agaaaucaauaucuauauguug

SEQ ID NO: 397187 - RNA, 22 nt, Human
augguuuaagggagaauauuga

SEQ ID NO: 397188 - RNA, 22 nt, Human
aaugucuucaguguauacaugg

SEQ ID NO: 397189 - RNA, 22 nt, Human
aaauauagcaauuaugccuacu

SEQ ID NO: 397190 - RNA, 22 nt, Human
aaagucauacauggugcuuacu

SEQ ID NO: 397191 - RNA, 22 nt, Human
augcuaaauggccaguaccaaa

SEQ ID NO: 397192 - RNA, 22 nt, Human
agaaccucuggauacaguuuaa

SEQ ID NO: 397193 - RNA, 22 nt, Human
cauuuacacuucuaaccacaag

SEQ ID NO: 397194 - RNA, 22 nt, Human
aaaacuguaucuucuugggacu

SEQ ID NO: 397195 - RNA, 22 nt, Human
uugauggcugugauuuacucag

SEQ ID NO: 397196 - RNA, 22 nt, Human
agcaauuuucccuuagucuuug

SEQ ID NO: 397197 - RNA, 22 nt, Human
aaucagaaucaguugacacagc

SEQ ID NO: 397198 - RNA, 18 nt, Human
gcaggcuuuuccuggguc

SEQ ID NO: 397199 - RNA, 22 nt, Human
uaaaacuuaacuauccagauua

SEQ ID NO: 397200 - RNA, 22 nt, Human
cugcagagcuuucugaaugaag

SEQ ID NO: 397201 - RNA, 20 nt, Human
auucuacaagaauaagcaug

SEQ ID NO: 397202 - RNA, 22 nt, Human
aaacuuugguauguagcaaaac

SEQ ID NO: 397203 - RNA, 22 nt, Human
cagagacauucaguaaauuauc

SEQ ID NO: 397204 - RNA, 22 nt, Human
uuugguccugagcaaaacuaug

SEQ ID NO: 397205 - RNA, 19 nt, Human
guuccaaaggccagaccuu

SEQ ID NO: 397206 - RNA, 22 nt, Human
caaucaguaaccggaucauggu

SEQ ID NO: 397207 - RNA, 22 nt, Human
uauaagaaacaaggcaaauuuu

SEQ ID NO: 397208 - RNA, 22 nt, Human
cauagaaaguauuauggaauuu

SEQ ID NO: 397209 - RNA, 22 nt, Human
cuuaaagaguauuuaauauaau

SEQ ID NO: 397210 - RNA, 22 nt, Human
uucaacccaaguucuccauuuu

SEQ ID NO: 397211 - RNA, 22 nt, Human
gaguccuuuucauagcaguggg

SEQ ID NO: 397212 - RNA, 22 nt, Human
uaauuuuaugacaguguauuuu

SEQ ID NO: 397213 - RNA, 22 nt, Human
augaaacaugcuuuguggauga

SEQ ID NO: 397214 - RNA, 22 nt, Human
ugcaggaagacuucccaagcca

SEQ ID NO: 397215 - RNA, 22 nt, Human
uuucagaaccgcuaaaauaaau

SEQ ID NO: 397216 - RNA, 22 nt, Human
uguaacaauuucuuacuauugu

SEQ ID NO: 397217 - RNA, 22 nt, Human
aguaaacauuuucauauuuucu

SEQ ID NO: 397218 - RNA, 22 nt, Human
uaggaaaacgugauuuucucac

SEQ ID NO: 397219 - RNA, 22 nt, Human
uaaaaugacuuccuccaacauc

SEQ ID NO: 397220 - RNA, 22 nt, Human
gagauuuagcugcuuaacuccu

SEQ ID NO: 397221 - RNA, 22 nt, Human
uaacagaagaaaacauauugga

SEQ ID NO: 397222 - RNA, 22 nt, Human
cauuucaaacaguuacagcugc

SEQ ID NO: 397223 - RNA, 22 nt, Human
agaaaucaauaucuauauguug

SEQ ID NO: 397224 - RNA, 22 nt, Human
aagacagugacagucacaauug

SEQ ID NO: 397225 - RNA, 22 nt, Human
uguggaaagucaaguuccagga

SEQ ID NO: 397226 - RNA, 22 nt, Human
gguuuaauggagauauuucaga

SEQ ID NO: 397227 - RNA, 22 nt, Human
caauuucagucucagagaguuc

SEQ ID NO: 397228 - RNA, 22 nt, Human
cuuauaaaguccaucugaacaa

SEQ ID NO: 397229 - RNA, 22 nt, Human
aaguccuugaagaaacaguucu

SEQ ID NO: 397230 - RNA, 22 nt, Human
uaauuucagugggcucugggcu

SEQ ID NO: 397231 - RNA, 22 nt, Human
uuauuccauucaguucaacaag

SEQ ID NO: 397232 - RNA, 22 nt, Human
acagaaauaacuuuuuauguuu

SEQ ID NO: 397233 - RNA, 22 nt, Human
agaucauaugaaaaauuucaag

SEQ ID NO: 397234 - RNA, 22 nt, Human
cauagaaacugagacaaggauu

SEQ ID NO: 397235 - RNA, 22 nt, Human
auauaauacaaccugcuaagug

SEQ ID NO: 397236 - RNA, 21 nt, Human
agagacugucacugcaguacc

SEQ ID NO: 397237 - RNA, 22 nt, Human
gagucaccacacggugcugacu

SEQ ID NO: 397238 - RNA, 22 nt, Human
caauuuuuaaacuaugaaguug

SEQ ID NO: 397239 - RNA, 17 nt, Human
cuuuuaauuuacuuccc

SEQ ID NO: 397240 - RNA, 21 nt, Human
uaaauaauaaguugcugagau

SEQ ID NO: 397241 - RNA, 21 nt, Human
acuuuaauauacaugaggagg

SEQ ID NO: 397242 - RNA, 22 nt, Human
auauaugcauguguacuuaugu

SEQ ID NO: 397243 - RNA, 22 nt, Human
aaacauguuuucugaauauuuu

SEQ ID NO: 397244 - RNA, 22 nt, Human
cagaucuguuugccagaucagc

SEQ ID NO: 397245 - RNA, 22 nt, Human
ugcaggaauagcuacagagcug

SEQ ID NO: 397246 - RNA, 22 nt, Human
augcuuaacucuguacauaguu

SEQ ID NO: 397247 - RNA, 22 nt, Human
aguacaauuauauuuagauggu

SEQ ID NO: 397248 - RNA, 23 nt, Human
aaucuauacuuaggcugguaaua

SEQ ID NO: 397249 - RNA, 22 nt, Human
uacaguauguucuugaauuugg

SEQ ID NO: 397250 - RNA, 22 nt, Human
ugcuuuaacauaagauaucuuu

SEQ ID NO: 397251 - RNA, 22 nt, Human
caaaggcaggcccccugugcag

SEQ ID NO: 397252 - RNA, 22 nt, Human
ugaaugaacuaaaucauaguuc

SEQ ID NO: 397253 - RNA, 22 nt, Human
ucuuuaauaucugccccagagc

SEQ ID NO: 397254 - RNA, 22 nt, Human
aauuaaaugacaggggaagaug

SEQ ID NO: 397255 - RNA, 22 nt, Human
uuuauaaaauagacugggucua

SEQ ID NO: 397256 - RNA, 22 nt, Human
uucaccacagucucaucuacgc

SEQ ID NO: 397257 - RNA, 22 nt, Human
cuauacagagcauccuuaacuu

SEQ ID NO: 397258 - RNA, 22 nt, Human
auagaauucuuugaaauuuaug

SEQ ID NO: 397259 - RNA, 22 nt, Human
acaacaaaaucacuagucuucc

SEQ ID NO: 397260 - RNA, 22 nt, Human
ugcuggcuacauuauugcuguc

SEQ ID NO: 397261 - RNA, 22 nt, Human
ucuagacacuacuaguaaccgg

SEQ ID NO: 397262 - RNA, 22 nt, Human
uaacaagucauuuuaaauuaug

SEQ ID NO: 397263 - RNA, 22 nt, Human
ucacagaagagauauugacaga

SEQ ID NO: 397264 - RNA, 22 nt, Human
uauguaaaguagauggcaggua

SEQ ID NO: 397265 - RNA, 22 nt, Human
acaacuuuaauggguuucagcu

SEQ ID NO: 397266 - RNA, 19 nt, Human
aucugagauuauaaacaga

SEQ ID NO: 397267 - RNA, 22 nt, Human
uguguaaaaucugauuaauacu

SEQ ID NO: 397268 - RNA, 22 nt, Human
gagucaccuuggccgcuguccc

SEQ ID NO: 397269 - RNA, 22 nt, Human
caucagaaccaguggggacauu

SEQ ID NO: 397270 - RNA, 22 nt, Human
caugcuuauucauucugcuaac

SEQ ID NO: 397271 - RNA, 22 nt, Human
ggcaauuucaugugguuuaaac

SEQ ID NO: 397272 - RNA, 22 nt, Human
auaaacaguagagaaagguggu

SEQ ID NO: 397273 - RNA, 22 nt, Human
uuuaggcaugcaguucuauuua

SEQ ID NO: 397274 - RNA, 22 nt, Human
ucuaaacacgucucuuugaaua

SEQ ID NO: 397275 - RNA, 22 nt, Human
uaucagaaacucuggggcaggg

SEQ ID NO: 397276 - RNA, 22 nt, Human
caaugaaauugagauccagaga

SEQ ID NO: 397277 - RNA, 22 nt, Human
uggcuuaagcgcaacucugucu

SEQ ID NO: 397278 - RNA, 22 nt, Human
auaaagucauuaugaagaucua

SEQ ID NO: 397279 - RNA, 22 nt, Human
uucuuaauaccuauuuucuacc

SEQ ID NO: 397280 - RNA, 22 nt, Human
aaauacugucucugagagagcc

SEQ ID NO: 397281 - RNA, 22 nt, Human
auggcauuugaccgcuuugugg

SEQ ID NO: 397282 - RNA, 22 nt, Human
uaugaaaagguggccaauguag

SEQ ID NO: 397283 - RNA, 22 nt, Human
uuuccaaagguggcaggaacaa

SEQ ID NO: 397284 - RNA, 22 nt, Human
auauccaagaaacaauuaauuc

SEQ ID NO: 397285 - RNA, 22 nt, Human
uuggcuucuucgcacagcagua

SEQ ID NO: 397286 - RNA, 22 nt, Human
guuaggcaauaccucuuacacc

SEQ ID NO: 397287 - RNA, 22 nt, Human
ucagccagcaucagcuaagugc

SEQ ID NO: 397288 - RNA, 22 nt, Human
cccaaaguacaaguaaacaugu

SEQ ID NO: 397289 - RNA, 22 nt, Human
caguccuuauuccuauauuccu

SEQ ID NO: 397290 - RNA, 22 nt, Human
caaagcaccacaaaccagguga

SEQ ID NO: 397291 - RNA, 22 nt, Human
aaucagaaauucuacaucacaa

SEQ ID NO: 397292 - RNA, 22 nt, Human
cauggauugaauauaaauuaga

SEQ ID NO: 397293 - RNA, 22 nt, Human
uuccuuagcagaccugguaucc

SEQ ID NO: 397294 - RNA, 18 nt, Human
ucauagaagugaaucaga

SEQ ID NO: 397295 - RNA, 22 nt, Human
uggcauuucuguuagacucuca

SEQ ID NO: 397296 - RNA, 22 nt, Human
uuggagagaggcugcucaggcu

SEQ ID NO: 397297 - RNA, 22 nt, Human
auccaaaggugacacagaauac

SEQ ID NO: 397298 - RNA, 22 nt, Human
acauaauaggugccugaauauu

SEQ ID NO: 397299 - RNA, 22 nt, Human
guaaacauuuucaucugugccc

SEQ ID NO: 397300 - RNA, 22 nt, Human
ucauaaaguuacccaaauuuua

SEQ ID NO: 397301 - RNA, 22 nt, Human
aucagaaaggugggcaagcaga

SEQ ID NO: 397302 - RNA, 22 nt, Human
auuucaacacuuuuggaauuag

SEQ ID NO: 397303 - RNA, 22 nt, Human
aagguucuaagggaagccaugc

SEQ ID NO: 397304 - RNA, 22 nt, Human
agucuuaauagagaaaaacugu

SEQ ID NO: 397305 - RNA, 22 nt, Human
uuuacagagagagaacuggacu

SEQ ID NO: 397306 - RNA, 22 nt, Human
cauggcuuuguucauauaauuu

SEQ ID NO: 397307 - RNA, 22 nt, Human
uuagaaauauggugcugccgcc

SEQ ID NO: 397308 - RNA, 22 nt, Human
aguaaacauagaauguucuucc

SEQ ID NO: 397309 - RNA, 22 nt, Human
uaucagaaggaagugccuuuaa

SEQ ID NO: 397310 - RNA, 22 nt, Human
uaucuaaauggaauauuccaga

SEQ ID NO: 397311 - RNA, 22 nt, Human
uggcauuuucuccuuugaguuu

SEQ ID NO: 397312 - RNA, 22 nt, Human
uagucaccagcuacaggacagc

SEQ ID NO: 397313 - RNA, 22 nt, Human
caaagccauagaguagauaaga

SEQ ID NO: 397314 - RNA, 21 nt, Human
uuucagaccuaucuuugaagg

SEQ ID NO: 397315 - RNA, 22 nt, Human
auacaaugaaguauagaugaaa

SEQ ID NO: 397316 - RNA, 22 nt, Human
aaagacauuagcuuagauguca

SEQ ID NO: 397317 - RNA, 21 nt, Human
caaagccaggcaacucucucc

SEQ ID NO: 397318 - RNA, 22 nt, Human
cagaucuagagcuuuuccaucu

SEQ ID NO: 397319 - RNA, 22 nt, Human
uucaaacaguguagaauauaug

SEQ ID NO: 397320 - RNA, 22 nt, Human
uaagucauaagucaugauguua

SEQ ID NO: 397321 - RNA, 22 nt, Human
cauggucuacaauuucauuuua

SEQ ID NO: 397322 - RNA, 22 nt, Human
cagcccagagauguuaucuagu

SEQ ID NO: 397323 - RNA, 22 nt, Human
ucuaaacaguuucacucuuaau

SEQ ID NO: 397324 - RNA, 22 nt, Human
agauuuacuggagucuuuggug

SEQ ID NO: 397325 - RNA, 22 nt, Human
caucagaaagaguccuggacuu

SEQ ID NO: 397326 - RNA, 22 nt, Human
uaaguccuaacagacugggggc

SEQ ID NO: 397327 - RNA, 22 nt, Human
uuguuaaaaauagauuuccagg

SEQ ID NO: 397328 - RNA, 22 nt, Human
agauuucacaugcugcucuauu

SEQ ID NO: 397329 - RNA, 22 nt, Human
cagagauuauuauaacuaauua

SEQ ID NO: 397330 - RNA, 22 nt, Human
ucagccaguugccccaguuagu

SEQ ID NO: 397331 - RNA, 22 nt, Human
ucuauaaaugcagauaugugug

SEQ ID NO: 397332 - RNA, 22 nt, Human
uggcuuuacacauccacugccu

SEQ ID NO: 397333 - RNA, 22 nt, Human
uuuacagauguggaaagugagc

SEQ ID NO: 397334 - RNA, 22 nt, Human
auguucaaacuuuuuacacacc

SEQ ID NO: 397335 - RNA, 22 nt, Human
cuauagaaaauuguaucacacg

SEQ ID NO: 397336 - RNA, 22 nt, Human
uacuuaaugccacugaauugua

SEQ ID NO: 397337 - RNA, 22 nt, Human
aaagucauuuuccagaccagua

SEQ ID NO: 397338 - RNA, 22 nt, Human
uuuaggcagcagugaggaugaa

SEQ ID NO: 397339 - RNA, 22 nt, Human
cuaaaauuaucaagauaauucc

SEQ ID NO: 397340 - RNA, 22 nt, Human
gacuaugugaagugugaauagg

SEQ ID NO: 397341 - RNA, 22 nt, Human
uacuagaaccucacaacaaucc

SEQ ID NO: 397342 - RNA, 22 nt, Human
auguuucaaauauauagaguug

SEQ ID NO: 397343 - RNA, 22 nt, Human
aucauaaagugcuaucugauug

SEQ ID NO: 397344 - RNA, 22 nt, Human
gagaagguggaccugaaggagc

SEQ ID NO: 397345 - RNA, 22 nt, Human
ccuggaucagagccagagaagc

SEQ ID NO: 397346 - RNA, 22 nt, Human
uuuagaaugugacuguauuuga

SEQ ID NO: 397347 - RNA, 22 nt, Human
guucuaauauuuuaaaagccaa

SEQ ID NO: 397348 - RNA, 22 nt, Human
cauuucaagcauugacuucuau

SEQ ID NO: 397349 - RNA, 22 nt, Human
uguccuuauaagaaaaggaaau

SEQ ID NO: 397350 - RNA, 22 nt, Human
acagguuuuuguggauauaugu

SEQ ID NO: 397351 - RNA, 22 nt, Human
caugcuuaugauuugcuaagcc

SEQ ID NO: 397352 - RNA, 22 nt, Human
ucuggaucucccucauccuggg

SEQ ID NO: 397353 - RNA, 22 nt, Human
agaauuuccuaugagagauucc

SEQ ID NO: 397354 - RNA, 22 nt, Human
caauuucaaugaggccacaggg

SEQ ID NO: 397355 - RNA, 20 nt, Human
uauuuacaacuuagagccuc

SEQ ID NO: 397356 - RNA, 22 nt, Human
uuuaggcagaagcccugcugau

SEQ ID NO: 397357 - RNA, 22 nt, Human
ugcagagacuugugugcauuug

SEQ ID NO: 397358 - RNA, 22 nt, Human
gauuucaaaaguagauccauca

SEQ ID NO: 397359 - RNA, 22 nt, Human
uucauacucacuccaauaacug

SEQ ID NO: 397360 - RNA, 22 nt, Human
auuccaaagccugaauaaugga

SEQ ID NO: 397361 - RNA, 22 nt, Human
uuccuuagcuccucauggccug

SEQ ID NO: 397362 - RNA, 20 nt, Human
ucuuauacagaaaacauuuu

SEQ ID NO: 397363 - RNA, 22 nt, Human
uggauuuauggagaccgaaagu

SEQ ID NO: 397364 - RNA, 19 nt, Human
aacuggauaauggccacau

SEQ ID NO: 397365 - RNA, 21 nt, Human
uccagaaaagaggucauuagc

SEQ ID NO: 397366 - RNA, 22 nt, Human
aagauauagauggugguauaaa

SEQ ID NO: 397367 - RNA, 22 nt, Human
uuacuacugcuuuacuacuggg

SEQ ID NO: 397368 - RNA, 22 nt, Human
cauuuacauuuaagguuaauau

SEQ ID NO: 397369 - RNA, 22 nt, Human
gaaaauagcagauagaccaaug

SEQ ID NO: 397370 - RNA, 22 nt, Human
gaauuucaaaagccagaacggg

SEQ ID NO: 397371 - RNA, 22 nt, Human
aaauaauguuaggccuuugcuc

SEQ ID NO: 397372 - RNA, 17 nt, Human
ugaaaucagcacccagg

SEQ ID NO: 397373 - RNA, 22 nt, Human
aaauaucauuuauaacuuuuaa

SEQ ID NO: 397374 - RNA, 22 nt, Human
caucagaaugaauguucuggag

SEQ ID NO: 397375 - RNA, 22 nt, Human
aauuucaaacucuugcccucag

SEQ ID NO: 397376 - RNA, 22 nt, Human
gauuuauaguaugugcuuucag

SEQ ID NO: 397377 - RNA, 22 nt, Human
uaagagaacuggauagauagga

SEQ ID NO: 397378 - RNA, 22 nt, Human
aagccaaugagagaggccucag

SEQ ID NO: 397379 - RNA, 22 nt, Human
uuacagaacugucuugaaauuu

SEQ ID NO: 397380 - RNA, 22 nt, Human
uggcauuuggcuuacuuauguu

SEQ ID NO: 397381 - RNA, 22 nt, Human
aauuauauuguggugugaaugu

SEQ ID NO: 397382 - RNA, 22 nt, Human
ucaaacauguuagcagucugug

SEQ ID NO: 397383 - RNA, 22 nt, Human
guauuuaauuccauuaaguuag

SEQ ID NO: 397384 - RNA, 22 nt, Human
uaacagaagaugaaacuucuuu

SEQ ID NO: 397385 - RNA, 21 nt, Human
auccuuagcacuuagaagagu

SEQ ID NO: 397386 - RNA, 22 nt, Human
augcacaagcaagagauaaugg

SEQ ID NO: 397387 - RNA, 22 nt, Human
ccuuuaauuuacaauguuaauu

SEQ ID NO: 397388 - RNA, 22 nt, Human
cacaaagucugcagcugcugua

SEQ ID NO: 397389 - RNA, 22 nt, Human
uuucuagugguuaagauuuaca

SEQ ID NO: 397390 - RNA, 22 nt, Human
aagcauuugugaaauucagaug

SEQ ID NO: 397391 - RNA, 21 nt, Human
agaagucaauugaacugaaau

SEQ ID NO: 397392 - RNA, 22 nt, Human
acuggauuccauugugcaaaga

SEQ ID NO: 397393 - RNA, 21 nt, Human
cucagagaaaugucugggagc

SEQ ID NO: 397394 - RNA, 22 nt, Human
guauagaaacccagaaagauag

SEQ ID NO: 397395 - RNA, 21 nt, Human
caauuucaugggaagauggga

SEQ ID NO: 397396 - RNA, 22 nt, Human
cagaaucagcccuugcuauuaa

SEQ ID NO: 397397 - RNA, 22 nt, Human
uuccauaauaggcuuaagugaa

SEQ ID NO: 397398 - RNA, 22 nt, Human
aaacugugaagcaaguacaagg

SEQ ID NO: 397399 - RNA, 22 nt, Human
acagaauuuacacaucucuaaa

SEQ ID NO: 397400 - RNA, 22 nt, Human
gauucuuacuucuaagcaagcu

SEQ ID NO: 397401 - RNA, 22 nt, Human
uuaaagucccugccuuaauucc

SEQ ID NO: 397402 - RNA, 22 nt, Human
ugcuuuaaccaucuuguuugga

SEQ ID NO: 397403 - RNA, 22 nt, Human
uuuauucuauaggcauuaagca

SEQ ID NO: 397404 - RNA, 22 nt, Human
caaucaguuucuguuguauaau

SEQ ID NO: 397405 - RNA, 22 nt, Human
uucagaaaaaacuucaauaagu

SEQ ID NO: 397406 - RNA, 22 nt, Human
uaauuauagccgcuauuuugcu

SEQ ID NO: 397407 - RNA, 22 nt, Human
gcuggauccacaaauaacuuug

SEQ ID NO: 397408 - RNA, 22 nt, Human
auaacaugagccagauugaaag

SEQ ID NO: 397409 - RNA, 22 nt, Human
ucucuuaacugguucagcaauu

SEQ ID NO: 397410 - RNA, 20 nt, Human
guaaugaauguaaacaguaa

SEQ ID NO: 397411 - RNA, 22 nt, Human
agaauuucuggaagauugcaag

SEQ ID NO: 397412 - RNA, 22 nt, Human
auuguuaauguugcacuaaggu

SEQ ID NO: 397413 - RNA, 22 nt, Human
ucaaacaggacuacauucucau

SEQ ID NO: 397414 - RNA, 20 nt, Human
cuguaucagguuacaaagua

SEQ ID NO: 397415 - RNA, 22 nt, Human
ugauauuuaagcaaaaauaugg

SEQ ID NO: 397416 - RNA, 22 nt, Human
gugaacuauuggguaucauaaa

SEQ ID NO: 397417 - RNA, 22 nt, Human
uaauuacagguccaaaacaauc

SEQ ID NO: 397418 - RNA, 22 nt, Human
auaugaaaagaagucaccauug

SEQ ID NO: 397419 - RNA, 22 nt, Human
aauguuaauguguuugcuuaug

SEQ ID NO: 397420 - RNA, 22 nt, Human
ucuggauccuaugcacuggacu

SEQ ID NO: 397421 - RNA, 22 nt, Human
uaaagcacgucuauuuaaugau

SEQ ID NO: 397422 - RNA, 22 nt, Human
ugaaacaaauuuggaaaaucua

SEQ ID NO: 397423 - RNA, 22 nt, Human
uuuaggcauugggugcucaagu

SEQ ID NO: 397424 - RNA, 22 nt, Human
ucacacauucuagguauguuga

SEQ ID NO: 397425 - RNA, 22 nt, Human
aaaacagacagccaguguagag

SEQ ID NO: 397426 - RNA, 19 nt, Human
gcaggaaaugagugauugc

SEQ ID NO: 397427 - RNA, 22 nt, Human
uacauacaagauguguuuaaaa

SEQ ID NO: 397428 - RNA, 22 nt, Human
uaucagaacacagccacagcca

SEQ ID NO: 397429 - RNA, 22 nt, Human
aucuauacucagaguuaauauc

SEQ ID NO: 397430 - RNA, 23 nt, Human
ggauuuaguggaugagcugagug

SEQ ID NO: 397431 - RNA, 22 nt, Human
auaucagaaauaguaagcagag

SEQ ID NO: 397432 - RNA, 22 nt, Human
ucagaaauacaaaacacuuacu

SEQ ID NO: 397433 - RNA, 19 nt, Human
uggcauuuggaggcaaccu

SEQ ID NO: 397434 - RNA, 22 nt, Human
agucaccaacaugguucccagg

SEQ ID NO: 397435 - RNA, 22 nt, Human
cuuccaaauguaaauaaguuuc

SEQ ID NO: 397436 - RNA, 22 nt, Human
caguccuuaaggaaacauuugu

SEQ ID NO: 397437 - RNA, 22 nt, Human
uggcuucaaaaucuaguggucu

SEQ ID NO: 397438 - RNA, 22 nt, Human
gcuggaucaaguccuucaccca

SEQ ID NO: 397439 - RNA, 22 nt, Human
uaugcuguggaaaauacaaaga

SEQ ID NO: 397440 - RNA, 22 nt, Human
cucuaacacuguaaugcuuucu

SEQ ID NO: 397441 - RNA, 22 nt, Human
ugaaauagucuaaaaaaccaga

SEQ ID NO: 397442 - RNA, 22 nt, Human
augguuuauugcuuuaaugaaa

SEQ ID NO: 397443 - RNA, 22 nt, Human
guuccaaacaagucauaaagua

SEQ ID NO: 397444 - RNA, 22 nt, Human
aacaugcuuugauaaauaaaag

SEQ ID NO: 397445 - RNA, 22 nt, Human
acaacuuucuggguuaucugau

SEQ ID NO: 397446 - RNA, 22 nt, Human
uuucacacaacgugaauauacu

SEQ ID NO: 397447 - RNA, 22 nt, Human
agaauucauaggaaguuuccua

SEQ ID NO: 397448 - RNA, 22 nt, Human
uccuuaauauggaagaguucuc

SEQ ID NO: 397449 - RNA, 22 nt, Human
cauaacaguggcuucagcaagu

SEQ ID NO: 397450 - RNA, 22 nt, Human
auuucuuacauaacaaauuguu

SEQ ID NO: 397451 - RNA, 22 nt, Human
uucagaaaaagaccauugcaau

SEQ ID NO: 397452 - RNA, 22 nt, Human
auuaggcacuagaaugucaauu

SEQ ID NO: 397453 - RNA, 22 nt, Human
uagaaacagaaaacuguaauag

SEQ ID NO: 397454 - RNA, 22 nt, Human
ucugauaacucuggccccaggc

SEQ ID NO: 397455 - RNA, 22 nt, Human
auacuguaauaccuaaaugaac

SEQ ID NO: 397456 - RNA, 22 nt, Human
ugugugaaucuauugaauauau

SEQ ID NO: 397457 - RNA, 22 nt, Human
augguuuacugaucuuuuuggu

SEQ ID NO: 397458 - RNA, 21 nt, Human
uuuaaagaauaggaagggagg

SEQ ID NO: 397459 - RNA, 17 nt, Human
cuguuaauucauuuccc

SEQ ID NO: 397460 - RNA, 22 nt, Human
gaacuuuaccauuuagguaacu

SEQ ID NO: 397461 - RNA, 23 nt, Human
acaacuuuacagauacauuuugu

SEQ ID NO: 397462 - RNA, 22 nt, Human
caucagaacgugagcuccuugu

SEQ ID NO: 397463 - RNA, 22 nt, Human
acaaaauuaccuaguuauuuuc

SEQ ID NO: 397464 - RNA, 22 nt, Human
cauuuacacacagaggugugcu

SEQ ID NO: 397465 - RNA, 22 nt, Human
aauaauuuuagcucagaguugu

SEQ ID NO: 397466 - RNA, 22 nt, Human
ugaucugagagcagaucaccau

SEQ ID NO: 397467 - RNA, 20 nt, Human
agaaaucagaccacacacua

SEQ ID NO: 397468 - RNA, 22 nt, Human
auacagaaaaguggauagccag

SEQ ID NO: 397469 - RNA, 22 nt, Human
caucagucuagauucuaguacc

SEQ ID NO: 397470 - RNA, 23 nt, Human
uacagaaggaguagucacuaaga

SEQ ID NO: 397471 - RNA, 22 nt, Human
ccuggauccaugaaaaggcuac

SEQ ID NO: 397472 - RNA, 22 nt, Human
uucugugacuccucagagauuu

SEQ ID NO: 397473 - RNA, 22 nt, Human
auauacugaggagacuuuauau

SEQ ID NO: 397474 - RNA, 22 nt, Human
cucuuaaugaccuuaauucaag

SEQ ID NO: 397475 - RNA, 22 nt, Human
aaaauugaggcucauguuaaau

SEQ ID NO: 397476 - RNA, 22 nt, Human
uaacacaaaagaauaugugugu

SEQ ID NO: 397477 - RNA, 22 nt, Human
agagacaaugccaaugcacacg

SEQ ID NO: 397478 - RNA, 22 nt, Human
gaauuucaaagagguuaagagg

SEQ ID NO: 397479 - RNA, 22 nt, Human
ugaaagguguccaauauuucuc

SEQ ID NO: 397480 - RNA, 22 nt, Human
aagccauuuguuguccuucagg

SEQ ID NO: 397481 - RNA, 22 nt, Human
ucaccagucuuucuuaccauug

SEQ ID NO: 397482 - RNA, 22 nt, Human
aacaaacaaacauuuugucauc

SEQ ID NO: 397483 - RNA, 22 nt, Human
caucagaauuacuuggggagcu

SEQ ID NO: 397484 - RNA, 22 nt, Human
auuuaucucuggaaacuaagca

SEQ ID NO: 397485 - RNA, 22 nt, Human
acaaaauuuuuagacaaggcuu

SEQ ID NO: 397486 - RNA, 22 nt, Human
aauaauuacccaucuuuuugua

SEQ ID NO: 397487 - RNA, 22 nt, Human
uacacauguuuggcaaguaugu

SEQ ID NO: 397488 - RNA, 19 nt, Human
uacuaaacaugcauauugg

SEQ ID NO: 397489 - RNA, 22 nt, Human
auggccuuagugaugauuaaua

SEQ ID NO: 397490 - RNA, 22 nt, Human
aggcuucuucuuccuauuuagu

SEQ ID NO: 397491 - RNA, 22 nt, Human
uaacagaaaggggacagaaaua

SEQ ID NO: 397492 - RNA, 22 nt, Human
ccagaucuaaguccaaaguacu

SEQ ID NO: 397493 - RNA, 20 nt, Human
uacagaaacaggacuuuugg

SEQ ID NO: 397494 - RNA, 22 nt, Human
auacaaugauaauaguacuuua

SEQ ID NO: 397495 - RNA, 22 nt, Human
caaguccucgcuucuagcugug

SEQ ID NO: 397496 - RNA, 22 nt, Human
aacuuugaggucacugaauucc

SEQ ID NO: 397497 - RNA, 22 nt, Human
cauuucaaugccuucaacauag

SEQ ID NO: 397498 - RNA, 21 nt, Human
augugaaauaucaucagagca

SEQ ID NO: 397499 - RNA, 22 nt, Human
ucagccuacacuccaacagcau

SEQ ID NO: 397500 - RNA, 22 nt, Human
gauuuauaaagguugcacugga

SEQ ID NO: 397501 - RNA, 22 nt, Human
auaauaaaccaggaugggucug

SEQ ID NO: 397502 - RNA, 22 nt, Human
uucauuugccaucaguguaaug

SEQ ID NO: 397503 - RNA, 22 nt, Human
ucagccaggccaggcauucaca

SEQ ID NO: 397504 - RNA, 22 nt, Human
agaaucugguagaaccaaggau

SEQ ID NO: 397505 - RNA, 23 nt, Human
uuaaacuucagugcagaacacuc

SEQ ID NO: 397506 - RNA, 22 nt, Human
ucagaaaugaucguuauucauu

SEQ ID NO: 397507 - RNA, 22 nt, Human
aauuucaaguggcaucuuugau

SEQ ID NO: 397508 - RNA, 22 nt, Human
uuccugggacuggagcagccca

SEQ ID NO: 397509 - RNA, 18 nt, Human
agaugaaagcaaaugaca

SEQ ID NO: 397510 - RNA, 22 nt, Human
guaaugaaugaaagaaacuggg

SEQ ID NO: 397511 - RNA, 22 nt, Human
uugaagaaauuauuuuauauag

SEQ ID NO: 397512 - RNA, 19 nt, Human
guuaggcaggguggggagu

SEQ ID NO: 397513 - RNA, 22 nt, Human
ugugaaagauacuaggcagagg

SEQ ID NO: 397514 - RNA, 23 nt, Human
uaagaacagacaagcauuuacau

SEQ ID NO: 397515 - RNA, 22 nt, Human
acuucacagaaauuuuaugagg

SEQ ID NO: 397516 - RNA, 22 nt, Human
caaugaaagcaacugccuauaa

SEQ ID NO: 397517 - RNA, 22 nt, Human
augugcuucauucuacaugaca

SEQ ID NO: 397518 - RNA, 22 nt, Human
aaaucaguucacguucugaggu

SEQ ID NO: 397519 - RNA, 22 nt, Human
caggccagcuuccugacauccu

SEQ ID NO: 397520 - RNA, 23 nt, Human
cuuucauugugguuucacagagc

SEQ ID NO: 397521 - RNA, 22 nt, Human
auggauuugcuuauacacaugu

SEQ ID NO: 397522 - RNA, 22 nt, Human
guaaauuauuucaagaucaucu

SEQ ID NO: 397523 - RNA, 22 nt, Human
uauuuaucgagugucuacuaug

SEQ ID NO: 397524 - RNA, 23 nt, Human
uguaacaauuucauauacaugca

SEQ ID NO: 397525 - RNA, 22 nt, Human
cuaaagaagcuagcaaucuaua

SEQ ID NO: 397526 - RNA, 22 nt, Human
gagauuuagagagacuuaaaca

SEQ ID NO: 397527 - RNA, 22 nt, Human
auuccaaacgccucgcggacuu

SEQ ID NO: 397528 - RNA, 22 nt, Human
uuccuuagccugccuuccaggg

SEQ ID NO: 397529 - RNA, 22 nt, Human
agaagucaaguggucuaugaaa

SEQ ID NO: 397530 - RNA, 22 nt, Human
cauaauuacugauaugcugauu

SEQ ID NO: 397531 - RNA, 22 nt, Human
aagucaccccacacucuuggga

SEQ ID NO: 397532 - RNA, 22 nt, Human
auaucagacagaaagcauugac

SEQ ID NO: 397533 - RNA, 22 nt, Human
ucacauaaauuauacaauuuca

SEQ ID NO: 397534 - RNA, 22 nt, Human
aaagaaucagaagucucaaaca

SEQ ID NO: 397535 - RNA, 22 nt, Human
ccaaaauuaagccucuuauguu

SEQ ID NO: 397536 - RNA, 22 nt, Human
aucacaaaggucucagagcaca

SEQ ID NO: 397537 - RNA, 22 nt, Human
uaauagaauaguggaaacauug

SEQ ID NO: 397538 - RNA, 22 nt, Human
augguuuuagaaucaggaaaaa

SEQ ID NO: 397539 - RNA, 22 nt, Human
auauaaagaaguggaaaaugag

SEQ ID NO: 397540 - RNA, 22 nt, Human
auuaugcugguuuacacauuuu

SEQ ID NO: 397541 - RNA, 22 nt, Human
aaugaaaauuggacccuagaac

SEQ ID NO: 397542 - RNA, 22 nt, Human
cauggcuuuuuagcauauucaa

SEQ ID NO: 397543 - RNA, 22 nt, Human
ucaauaaaauuguuuuccuauc

SEQ ID NO: 397544 - RNA, 22 nt, Human
acaggauuagcaaguaaucagg

SEQ ID NO: 397545 - RNA, 21 nt, Human
gauuuauaagccuuaagccua

SEQ ID NO: 397546 - RNA, 22 nt, Human
agcauuuauuucuuagaaauug

SEQ ID NO: 397547 - RNA, 22 nt, Human
acaaaauuaugaagaggccuug

SEQ ID NO: 397548 - RNA, 22 nt, Human
guuauaaaggugauaaugguca

SEQ ID NO: 397549 - RNA, 22 nt, Human
uuugaagugcaaugaggauucu

SEQ ID NO: 397550 - RNA, 22 nt, Human
aaaugccuguguaaauucuagc

SEQ ID NO: 397551 - RNA, 22 nt, Human
aaggacagggaugguugauugu

SEQ ID NO: 397552 - RNA, 22 nt, Human
gcauaauauacaugcuugaucc

SEQ ID NO: 397553 - RNA, 22 nt, Human
aggauuuauuggugggaaguua

SEQ ID NO: 397554 - RNA, 22 nt, Human
guauuugcaaaucuaaaagaga

SEQ ID NO: 397555 - RNA, 22 nt, Human
agccauuuuccugaaauauaac

SEQ ID NO: 397556 - RNA, 22 nt, Human
aauguucaaacagaucacuuag

SEQ ID NO: 397557 - RNA, 22 nt, Human
cuuuuaaugggagcaguauuug

SEQ ID NO: 397558 - RNA, 22 nt, Human
caguccuuucugaaauccuaua

SEQ ID NO: 397559 - RNA, 22 nt, Human
auucuacaacccaauaauaauu

SEQ ID NO: 397560 - RNA, 22 nt, Human
caucagaaaccuugaggaaacu

SEQ ID NO: 397561 - RNA, 22 nt, Human
uuaguacugauagggucaauca

SEQ ID NO: 397562 - RNA, 22 nt, Human
uuuccaaacccagcgagcuaca

SEQ ID NO: 397563 - RNA, 22 nt, Human
auacagaagaacuauagccacu

SEQ ID NO: 397564 - RNA, 22 nt, Human
ucuauacugaugggauacuauu

SEQ ID NO: 397565 - RNA, 22 nt, Human
cuggcuuucauuucaagcacgu

SEQ ID NO: 397566 - RNA, 22 nt, Human
uuuccaaaguugccauaagcuu

SEQ ID NO: 397567 - RNA, 22 nt, Human
augcuuaacuuccuagucuaua

SEQ ID NO: 397568 - RNA, 23 nt, Human
acuuuauccuauaucuuuguucu

SEQ ID NO: 397569 - RNA, 22 nt, Human
uucacacacagcuuccuauugu

SEQ ID NO: 397570 - RNA, 22 nt, Human
aagugauuuguacaaaaugucg

SEQ ID NO: 397571 - RNA, 22 nt, Human
auuacacuuguucaucaucacc

SEQ ID NO: 397572 - RNA, 22 nt, Human
aaagaaucuauauaucaccacc

SEQ ID NO: 397573 - RNA, 22 nt, Human
uccaauauggauaaaaggggcc

SEQ ID NO: 397574 - RNA, 23 nt, Human
cagaaaucugaaaucuagaaaug

SEQ ID NO: 397575 - RNA, 22 nt, Human
uagaugcuacaauuuuguacuc

SEQ ID NO: 397576 - RNA, 22 nt, Human
ucccugggcuucuccagacuug

SEQ ID NO: 397577 - RNA, 22 nt, Human
ugugaaaagcguguguucuagg

SEQ ID NO: 397578 - RNA, 22 nt, Human
aacauguaaccagcauucaucu

SEQ ID NO: 397579 - RNA, 22 nt, Human
aaacuuuggauugugauugugc

SEQ ID NO: 397580 - RNA, 22 nt, Human
uuaaaaucuaaagcaguugucu

SEQ ID NO: 397581 - RNA, 22 nt, Human
aaauagcagccuuuaguuaaca

SEQ ID NO: 397582 - RNA, 22 nt, Human
cuacagaaguuucccuugcuua

SEQ ID NO: 397583 - RNA, 23 nt, Human
caauuucauaugauucuaccuaa

SEQ ID NO: 397584 - RNA, 22 nt, Human
ucagccagugccuugaucuugc

SEQ ID NO: 397585 - RNA, 22 nt, Human
acuuuaucaggaaucacacagc

SEQ ID NO: 397586 - RNA, 22 nt, Human
aaagccauuacaaaauuucaua

SEQ ID NO: 397587 - RNA, 22 nt, Human
uguacaaucugaugauguaugg

SEQ ID NO: 397588 - RNA, 22 nt, Human
gcuauacagcaggagaauggaa

SEQ ID NO: 397589 - RNA, 22 nt, Human
auauacaaagggcaaccucgcu

SEQ ID NO: 397590 - RNA, 22 nt, Human
cuuaaacugaaagcuacaagau

SEQ ID NO: 397591 - RNA, 22 nt, Human
uggagaauuuugucaccagaca

SEQ ID NO: 397592 - RNA, 22 nt, Human
ucaauaauggcaggauaaauuu

SEQ ID NO: 397593 - RNA, 22 nt, Human
uuacagaaucuacucgugguga

SEQ ID NO: 397594 - RNA, 22 nt, Human
ugauaauauuuugaaucauaag

SEQ ID NO: 397595 - RNA, 22 nt, Human
uuagaaaaaacgucuucuagug

SEQ ID NO: 397596 - RNA, 22 nt, Human
aagacuuucaaaccuauguuug

SEQ ID NO: 397597 - RNA, 22 nt, Human
aaucaaaaccuacagagguaau

SEQ ID NO: 397598 - RNA, 22 nt, Human
uucagaaagguuaaucuggauu

SEQ ID NO: 397599 - RNA, 22 nt, Human
uaaagacaaacccacuaggguu

SEQ ID NO: 397600 - RNA, 19 nt, Human
uccauaaugaagauagagg

SEQ ID NO: 397601 - RNA, 22 nt, Human
uacacauguauuuauguguaca

SEQ ID NO: 397602 - RNA, 22 nt, Human
uuauuuauggcccucaccugau

SEQ ID NO: 397603 - RNA, 22 nt, Human
aaaaucugcuuccuuuuacaga

SEQ ID NO: 397604 - RNA, 22 nt, Human
uuaggaaacgcugcuauugacu

SEQ ID NO: 397605 - RNA, 22 nt, Human
uuuaggcauugaauuagaauag

SEQ ID NO: 397606 - RNA, 22 nt, Human
uaagacuucauuaguaauaugg

SEQ ID NO: 397607 - RNA, 22 nt, Human
uuccuuagggaaagggauaagg

SEQ ID NO: 397608 - RNA, 22 nt, Human
auucuuaaauuuaggucuguga

SEQ ID NO: 397609 - RNA, 22 nt, Human
aguauuuagcauagugguuagu

SEQ ID NO: 397610 - RNA, 22 nt, Human
uacagagauuuauugcuaaggc

SEQ ID NO: 397611 - RNA, 22 nt, Human
uuacagaaggaacacuacucag

SEQ ID NO: 397612 - RNA, 22 nt, Human
cucuacucuuaacacagcuagg

SEQ ID NO: 397613 - RNA, 22 nt, Human
auaaaugccucagaaucauccc

SEQ ID NO: 397614 - RNA, 22 nt, Human
auucauuagccacuaacuagca

SEQ ID NO: 397615 - RNA, 22 nt, Human
uguacaauguguuuguuggcuu

SEQ ID NO: 397616 - RNA, 22 nt, Human
uguauuaacauuaauaaaaugg

SEQ ID NO: 397617 - RNA, 22 nt, Human
uuucaacauauaccauaaugcc

SEQ ID NO: 397618 - RNA, 22 nt, Human
uguacaauggcuauaauacccu

SEQ ID NO: 397619 - RNA, 18 nt, Human
uacaggaaaaguguuaca

SEQ ID NO: 397620 - RNA, 22 nt, Human
aagacuuucaaguaugcaugca

SEQ ID NO: 397621 - RNA, 22 nt, Human
aaucagaaauugagggucuggu

SEQ ID NO: 397622 - RNA, 22 nt, Human
auuucaacguuagauguaauag

SEQ ID NO: 397623 - RNA, 19 nt, Human
aaucagaaauaucgaggcc

SEQ ID NO: 397624 - RNA, 22 nt, Human
uaguacaguuuaaauauuaaua

SEQ ID NO: 397625 - RNA, 22 nt, Human
uguauaaauuuaaauuccugcu

SEQ ID NO: 397626 - RNA, 22 nt, Human
aaucagaaaggcuaaggaagca

SEQ ID NO: 397627 - RNA, 22 nt, Human
uuaacacuugaacucuacaugu

SEQ ID NO: 397628 - RNA, 22 nt, Human
uuagaaaucugcugccaugcaa

SEQ ID NO: 397629 - RNA, 22 nt, Human
uccaaaguguugggauuauagg

SEQ ID NO: 397630 - RNA, 23 nt, Human
ucuguacacaucagcaucuccca

SEQ ID NO: 397631 - RNA, 22 nt, Human
uuuuaugugcuggacuggcagu

SEQ ID NO: 397632 - RNA, 20 nt, Human
gaaguccuuucacucuuccc

SEQ ID NO: 397633 - RNA, 22 nt, Human
gaauuuuucuggaagcaauuau

SEQ ID NO: 397634 - RNA, 22 nt, Human
augaaauauuucagagcagagu

SEQ ID NO: 397635 - RNA, 22 nt, Human
auagaaauggcagcuggugcua

SEQ ID NO: 397636 - RNA, 21 nt, Human
uuuuauugaugaauggccacu

SEQ ID NO: 397637 - RNA, 21 nt, Human
ugaaacaaucagacagagucu

SEQ ID NO: 397638 - RNA, 22 nt, Human
uggcuuaauauuucauauuuaa

SEQ ID NO: 397639 - RNA, 22 nt, Human
gaauuucaggacaacuggaagg

SEQ ID NO: 397640 - RNA, 20 nt, Human
agaaaaaguguggaaauuuc

SEQ ID NO: 397641 - RNA, 22 nt, Human
uaugaaaauuuagcugaagcau

SEQ ID NO: 397642 - RNA, 22 nt, Human
ggauucuaacugaacagaauau

SEQ ID NO: 397643 - RNA, 21 nt, Human
cauuuacaugacagauugguu

SEQ ID NO: 397644 - RNA, 22 nt, Human
uagaacuacaagcauuaaaagu

SEQ ID NO: 397645 - RNA, 18 nt, Human
ugaaacaagaauggugca

SEQ ID NO: 397646 - RNA, 22 nt, Human
cuacagaagccguggucaggaa

SEQ ID NO: 397647 - RNA, 22 nt, Human
auuauaaaccuuugaggguggg

SEQ ID NO: 397648 - RNA, 23 nt, Human
aguucacugagguugaccacugg

SEQ ID NO: 397649 - RNA, 22 nt, Human
uggcuauugagugaucucuaga

SEQ ID NO: 397650 - RNA, 22 nt, Human
cacaauacuauuuuuaggucuu

SEQ ID NO: 397651 - RNA, 22 nt, Human
uauggaaaaauguaucuuguca

SEQ ID NO: 397652 - RNA, 22 nt, Human
cuuccaaacccaggguaugggc

SEQ ID NO: 397653 - RNA, 22 nt, Human
aaagacauggaacuagagaugg

SEQ ID NO: 397654 - RNA, 22 nt, Human
ugucaccaugccagcuucugcc

SEQ ID NO: 397655 - RNA, 22 nt, Human
ucacaucauuaagacuucuccu

SEQ ID NO: 397656 - RNA, 19 nt, Human
gaaagucauagagcuuguc

SEQ ID NO: 397657 - RNA, 22 nt, Human
caggccaggguugagaagagaa

SEQ ID NO: 397658 - RNA, 22 nt, Human
agaucuauuagcaaacugccau

SEQ ID NO: 397659 - RNA, 22 nt, Human
auauaggcuaacaacuauugag

SEQ ID NO: 397660 - RNA, 22 nt, Human
caauuucagguggauagguuuu

SEQ ID NO: 397661 - RNA, 22 nt, Human
aaucagaaagaucuugaugaga

SEQ ID NO: 397662 - RNA, 22 nt, Human
acagaauugaaaguauaaucug

SEQ ID NO: 397663 - RNA, 22 nt, Human
ucaaaucagcaagcagcuuccc

SEQ ID NO: 397664 - RNA, 22 nt, Human
uacagaauuagauuauuagaga

SEQ ID NO: 397665 - RNA, 22 nt, Human
acaugaaaaauguuugcaguuu

SEQ ID NO: 397666 - RNA, 22 nt, Human
caguccagcccccugcuaaaag

SEQ ID NO: 397667 - RNA, 22 nt, Human
auacaaugagugagugaauggg

SEQ ID NO: 397668 - RNA, 22 nt, Human
uucaacucuucaagaucacauc

SEQ ID NO: 397669 - RNA, 22 nt, Human
cacccagugaaggagcaagagg

SEQ ID NO: 397670 - RNA, 22 nt, Human
aucagcuuuucucaucagaaau

SEQ ID NO: 397671 - RNA, 22 nt, Human
agguauuauuagcaucucuauu

SEQ ID NO: 397672 - RNA, 22 nt, Human
auguauccuuauacacauuuau

SEQ ID NO: 397673 - RNA, 22 nt, Human
aaugccaacuuggauauacauu

SEQ ID NO: 397674 - RNA, 18 nt, Human
aaguccuuccuuugcuuu

SEQ ID NO: 397675 - RNA, 22 nt, Human
agauucuacucuagauccaugg

SEQ ID NO: 397676 - RNA, 22 nt, Human
uaaaguuuguagcaauugauau

SEQ ID NO: 397677 - RNA, 22 nt, Human
uauggcuuuuaacugucguaug

SEQ ID NO: 397678 - RNA, 22 nt, Human
auguacaaaauguuuugaaaug

SEQ ID NO: 397679 - RNA, 22 nt, Human
aggauuuagcaugaaaugugaa

SEQ ID NO: 397680 - RNA, 22 nt, Human
uaauauauuucugcuaagcuca

SEQ ID NO: 397681 - RNA, 22 nt, Human
cuucuuaaaguugucacagcug

SEQ ID NO: 397682 - RNA, 22 nt, Human
aaguuucaugauguaauuauug

SEQ ID NO: 397683 - RNA, 22 nt, Human
aaacaaacauagguuugaaagu

SEQ ID NO: 397684 - RNA, 22 nt, Human
uuucaacuugaagaauugauac

SEQ ID NO: 397685 - RNA, 22 nt, Human
ugaaguaacuguccaggaucca

SEQ ID NO: 397686 - RNA, 22 nt, Human
auacuuaacuguggagucauug

SEQ ID NO: 397687 - RNA, 17 nt, Human
uccauacaauucucucu

SEQ ID NO: 397688 - RNA, 22 nt, Human
auguuacacauaggcauaaaug

SEQ ID NO: 397689 - RNA, 22 nt, Human
gaaugaaaaccuuggcucaaau

SEQ ID NO: 397690 - RNA, 22 nt, Human
acaaaauuguguuaaacuuuau

SEQ ID NO: 397691 - RNA, 22 nt, Human
aaauugcagaugcuaaaugacu

SEQ ID NO: 397692 - RNA, 22 nt, Human
uacugaaaguggucaacagugg

SEQ ID NO: 397693 - RNA, 22 nt, Human
uuccaaacugccaauucagaag

SEQ ID NO: 397694 - RNA, 22 nt, Human
acacaaacugcuagaaaauugg

SEQ ID NO: 397695 - RNA, 20 nt, Human
gauuucaaagcagaguggcc

SEQ ID NO: 397696 - RNA, 19 nt, Human
uuccaaaaucaggauuuga

SEQ ID NO: 397697 - RNA, 17 nt, Human
uaaguccuaguuauuuu

SEQ ID NO: 397698 - RNA, 22 nt, Human
ugugaaagagucuuauaguuuc

SEQ ID NO: 397699 - RNA, 20 nt, Human
aaguuacauuguauuguacc

SEQ ID NO: 397700 - RNA, 22 nt, Human
gucuaacaagcauuaggaaccc

SEQ ID NO: 397701 - RNA, 22 nt, Human
ucaaguuucucucagauuaugg

SEQ ID NO: 397702 - RNA, 22 nt, Human
uccaaaaaacguuugaauaguu

SEQ ID NO: 397703 - RNA, 22 nt, Human
uuauaacaucaaucagaguuaa

SEQ ID NO: 397704 - RNA, 22 nt, Human
ugucaccaccggaagaaacugc

SEQ ID NO: 397705 - RNA, 21 nt, Human
gauaaaaugggccuugguccu

SEQ ID NO: 397706 - RNA, 22 nt, Human
ugcuuaauguacgugaguguac

SEQ ID NO: 397707 - RNA, 22 nt, Human
uuagaaaugauuucaccucuuu

SEQ ID NO: 397708 - RNA, 22 nt, Human
caaguccuuagaugguucuuug

SEQ ID NO: 397709 - RNA, 22 nt, Human
acagaguucccacuccagaagc

SEQ ID NO: 397710 - RNA, 22 nt, Human
caggccagguggcaggcaaaac

SEQ ID NO: 397711 - RNA, 22 nt, Human
cuuccaaagcacuuuauggacc

SEQ ID NO: 397712 - RNA, 22 nt, Human
ucuuuaauauaaaggaaugaau

SEQ ID NO: 397713 - RNA, 22 nt, Human
uaaguccuggcugguuugaagc

SEQ ID NO: 397714 - RNA, 22 nt, Human
cagucaccuagacagaacuuac

SEQ ID NO: 397715 - RNA, 22 nt, Human
aguaaaauuaauggaucagaag

SEQ ID NO: 397716 - RNA, 22 nt, Human
cagucaccauagaauaaaacau

SEQ ID NO: 397717 - RNA, 22 nt, Human
ucaguaaaugaaugaauauaug

SEQ ID NO: 397718 - RNA, 22 nt, Human
acaacuuuucuaucauguggaa

SEQ ID NO: 397719 - RNA, 22 nt, Human
aggcaacuguuugauaauguug

SEQ ID NO: 397720 - RNA, 19 nt, Human
acagaaauuaguuauuuuc

SEQ ID NO: 397721 - RNA, 22 nt, Human
aguaugaacggaaggccuggga

SEQ ID NO: 397722 - RNA, 22 nt, Human
uuagaaaugcacccaagaccua

SEQ ID NO: 397723 - RNA, 22 nt, Human
aaaggcaugauuaauucugugu

SEQ ID NO: 397724 - RNA, 22 nt, Human
auggcuuuucacagaggguucu

SEQ ID NO: 397725 - RNA, 19 nt, Human
uggauuuauauucuuuauc

SEQ ID NO: 397726 - RNA, 22 nt, Human
ugugaauaaugccgcaauaaac

SEQ ID NO: 397727 - RNA, 22 nt, Human
aaugccuuuccacuggguauca

SEQ ID NO: 397728 - RNA, 22 nt, Human
aucagaaauugcuaccagugga

SEQ ID NO: 397729 - RNA, 22 nt, Human
caucagaagauggcucuggaaa

SEQ ID NO: 397730 - RNA, 22 nt, Human
uuucauaaggguuucuagacuu

SEQ ID NO: 397731 - RNA, 22 nt, Human
acaauuccacauggcaugcagg

SEQ ID NO: 397732 - RNA, 22 nt, Human
acacagauuuuacauguuaugc

SEQ ID NO: 397733 - RNA, 22 nt, Human
uguguacacagauaguaauggc

SEQ ID NO: 397734 - RNA, 22 nt, Human
auguauaaugcuaauuagcuag

SEQ ID NO: 397735 - RNA, 22 nt, Human
uguaaauaaugcauguaaauca

SEQ ID NO: 397736 - RNA, 22 nt, Human
aaaaggcauggagguugauagu

SEQ ID NO: 397737 - RNA, 22 nt, Human
auuucacaaaccauccugauuu

SEQ ID NO: 397738 - RNA, 22 nt, Human
uagauuuaagacccugaauuug

SEQ ID NO: 397739 - RNA, 22 nt, Human
acauaauaccuaggacaguuug

SEQ ID NO: 397740 - RNA, 22 nt, Human
auaaagcaucuagucugucacu

SEQ ID NO: 397741 - RNA, 22 nt, Human
ugcagagaaaguguagacaggc

SEQ ID NO: 397742 - RNA, 22 nt, Human
aauuccaggaugcaggaggugc

SEQ ID NO: 397743 - RNA, 22 nt, Human
caacuuuucugugaauuuaagu

SEQ ID NO: 397744 - RNA, 22 nt, Human
ugaaauaggaaacagauguuuc

SEQ ID NO: 397745 - RNA, 22 nt, Human
uuccuuaggggacagggggaua

SEQ ID NO: 397746 - RNA, 22 nt, Human
acaugcuuuucccacaauuaua

SEQ ID NO: 397747 - RNA, 22 nt, Human
uaaagccacgcuggaaaucagg

SEQ ID NO: 397748 - RNA, 22 nt, Human
uagaauaugauuaauuuucuua

SEQ ID NO: 397749 - RNA, 22 nt, Human
aguucacagaauggccagaacu

SEQ ID NO: 397750 - RNA, 19 nt, Human
aacuguaauuaauacccua

SEQ ID NO: 397751 - RNA, 22 nt, Human
uaagucaucacauugcagagau

SEQ ID NO: 397752 - RNA, 22 nt, Human
uguuuauaccuugguauaacca

SEQ ID NO: 397753 - RNA, 22 nt, Human
auacagaaguuuuccacuuauu

SEQ ID NO: 397754 - RNA, 22 nt, Human
aaagcagguugcaauuacagug

SEQ ID NO: 397755 - RNA, 22 nt, Human
aaguccuuggagaauagaaagg

SEQ ID NO: 397756 - RNA, 22 nt, Human
uacagagauacucuagaucaaa

SEQ ID NO: 397757 - RNA, 22 nt, Human
uaaagccaauauaccuagcaua

SEQ ID NO: 397758 - RNA, 22 nt, Human
gugaauaaccuacuccaggccu

SEQ ID NO: 397759 - RNA, 20 nt, Human
uucuauacauaucacugaaa

SEQ ID NO: 397760 - RNA, 22 nt, Human
caguaaauacauaucagagaag

SEQ ID NO: 397761 - RNA, 23 nt, Human
aaauaggaguaucuggaucauga

SEQ ID NO: 397762 - RNA, 22 nt, Human
uuaaggauguugugauuuauua

SEQ ID NO: 397763 - RNA, 22 nt, Human
acuauacaagauuagggauuug

SEQ ID NO: 397764 - RNA, 22 nt, Human
uguuccaagcugcuggauaagc

SEQ ID NO: 397765 - RNA, 22 nt, Human
cauagcuuagggguuaaacuca

SEQ ID NO: 397766 - RNA, 20 nt, Human
uuacagaaaugauguuauuu

SEQ ID NO: 397767 - RNA, 22 nt, Human
ucaauaaaucccucugacccug

SEQ ID NO: 397768 - RNA, 22 nt, Human
aaaaugcuauuucauggaggag

SEQ ID NO: 397769 - RNA, 22 nt, Human
uaauaaacugcuacgcuuaguu

SEQ ID NO: 397770 - RNA, 22 nt, Human
uacaguaagaugaaauagcaau

SEQ ID NO: 397771 - RNA, 22 nt, Human
guacagaaaugugaugacgcaa

SEQ ID NO: 397772 - RNA, 22 nt, Human
guuaggcaugaguguguauuaa

SEQ ID NO: 397773 - RNA, 22 nt, Human
aacuggauuaacuggcucaaau

SEQ ID NO: 397774 - RNA, 22 nt, Human
ugcaggaaaaccaacacgccuu

SEQ ID NO: 397775 - RNA, 22 nt, Human
aaugguuugauggacaaaauga

SEQ ID NO: 397776 - RNA, 22 nt, Human
uaaucuaccacuauugcaauau

SEQ ID NO: 397777 - RNA, 22 nt, Human
acaugcuucauauuauaaccaa

SEQ ID NO: 397778 - RNA, 22 nt, Human
auccaaacauguaccacacuaa

SEQ ID NO: 397779 - RNA, 22 nt, Human
ugagaaaagguugagaugauaa

SEQ ID NO: 397780 - RNA, 22 nt, Human
ccuggaucuuuguuguaaauau

SEQ ID NO: 397781 - RNA, 22 nt, Human
uaguccuuuaauaguuaaugug

SEQ ID NO: 397782 - RNA, 22 nt, Human
uaauuccaccuuuuuccaacuu

SEQ ID NO: 397783 - RNA, 22 nt, Human
caucagaauguuagagaaggga

SEQ ID NO: 397784 - RNA, 22 nt, Human
cucuaauccuuugucccugggu

SEQ ID NO: 397785 - RNA, 22 nt, Human
uuuaggcagcacgggcagcccu

SEQ ID NO: 397786 - RNA, 22 nt, Human
auagcuuuacagaagaguuuag

SEQ ID NO: 397787 - RNA, 20 nt, Human
uuccaacucacaucucuaca

SEQ ID NO: 397788 - RNA, 22 nt, Human
gucaaacaaauuaacauaucca

SEQ ID NO: 397789 - RNA, 22 nt, Human
aggauuuaaauccuuaaccacu

SEQ ID NO: 397790 - RNA, 22 nt, Human
ccuggaucuccucuauucauau

SEQ ID NO: 397791 - RNA, 22 nt, Human
aaacaggcuuccauuagagcaa

SEQ ID NO: 397792 - RNA, 22 nt, Human
uagucaccuuuggcaccugcaa

SEQ ID NO: 397793 - RNA, 22 nt, Human
uaucagaaggcacauggagucu

SEQ ID NO: 397794 - RNA, 22 nt, Human
caauuucagugcuguggagagg

SEQ ID NO: 397795 - RNA, 22 nt, Human
aaucaugugggauagucugcuc

SEQ ID NO: 397796 - RNA, 22 nt, Human
aauaauaagauacuaagggagu

SEQ ID NO: 397797 - RNA, 22 nt, Human
agaaaagaggcuuucuaagcau

SEQ ID NO: 397798 - RNA, 22 nt, Human
uaagaaucggucgcaacagagg

SEQ ID NO: 397799 - RNA, 22 nt, Human
uuuaggcagucauugaacaagu

SEQ ID NO: 397800 - RNA, 22 nt, Human
uggauuaguuaagaaauguuag

SEQ ID NO: 397801 - RNA, 19 nt, Human
cagaaauagcgaaguguaa

SEQ ID NO: 397802 - RNA, 22 nt, Human
uuacagaacugcccuaguuggc

SEQ ID NO: 397803 - RNA, 22 nt, Human
caagaucagggugccagaaugg

SEQ ID NO: 397804 - RNA, 22 nt, Human
acauuccaaaaacuagcagaua

SEQ ID NO: 397805 - RNA, 22 nt, Human
aagcauuuuguuuuaagaauga

SEQ ID NO: 397806 - RNA, 22 nt, Human
uuauaugaguaucauaucacuu

SEQ ID NO: 397807 - RNA, 22 nt, Human
aaguccuucuuuauaugagagu

SEQ ID NO: 397808 - RNA, 22 nt, Human
cauuucaauuauuugcucuucu

SEQ ID NO: 397809 - RNA, 22 nt, Human
aacacuuugggcauggccuucc

SEQ ID NO: 397810 - RNA, 22 nt, Human
cuugccuuugucuucaaaggcu

SEQ ID NO: 397811 - RNA, 21 nt, Human
uucauaaaccauucucaugca

SEQ ID NO: 397812 - RNA, 22 nt, Human
gauuucaaccuaacaguaugac

SEQ ID NO: 397813 - RNA, 22 nt, Human
caucagaaccagcugggugagg

SEQ ID NO: 397814 - RNA, 22 nt, Human
cguccuuacagagggucacagc

SEQ ID NO: 397815 - RNA, 22 nt, Human
auauaacauacauacagaaaag

SEQ ID NO: 397816 - RNA, 22 nt, Human
uucacauaaugauacaaagcuu

SEQ ID NO: 397817 - RNA, 22 nt, Human
acagaauugauggaaaucucag

SEQ ID NO: 397818 - RNA, 22 nt, Human
aaugguuuucuagaacaugaaa

SEQ ID NO: 397819 - RNA, 22 nt, Human
aagcccagcugaaagcauuuuu

SEQ ID NO: 397820 - RNA, 22 nt, Human
uaauauguguuacugacuuuuu

SEQ ID NO: 397821 - RNA, 18 nt, Human
auagaaaccuuuaaucag

SEQ ID NO: 397822 - RNA, 22 nt, Human
aaauuauaggugccaccuugga

SEQ ID NO: 397823 - RNA, 22 nt, Human
gcagaauuuucuguuuucuaga

SEQ ID NO: 397824 - RNA, 22 nt, Human
gauaucauaucagacaaccucu

SEQ ID NO: 397825 - RNA, 22 nt, Human
ggcuuaaugguucuuuuucuca

SEQ ID NO: 397826 - RNA, 22 nt, Human
aucuaucccaguuuaacucauu

SEQ ID NO: 397827 - RNA, 22 nt, Human
aacagugaguugaugacugaau

SEQ ID NO: 397828 - RNA, 17 nt, Human
uaucagaauguguuuac

SEQ ID NO: 397829 - RNA, 22 nt, Human
ucuauacaugugcacacacauc

SEQ ID NO: 397830 - RNA, 22 nt, Human
ugcuuuaagagauuguuaguac

SEQ ID NO: 397831 - RNA, 22 nt, Human
ucaguaaaguucuuucuugcug

SEQ ID NO: 397832 - RNA, 17 nt, Human
uaaauacacaaggguau

SEQ ID NO: 397833 - RNA, 22 nt, Human
agauaucaccaguuuuacauac

SEQ ID NO: 397834 - RNA, 22 nt, Human
uuccuuaguugacugucuuagu

SEQ ID NO: 397835 - RNA, 22 nt, Human
cuuaauuacccaaugugguagg

SEQ ID NO: 397836 - RNA, 22 nt, Human
agacaacaucacuaaagcugag

SEQ ID NO: 397837 - RNA, 22 nt, Human
auuccaaacagugcugcagacu

SEQ ID NO: 397838 - RNA, 22 nt, Human
agaauuucaaauggaaguuuua

SEQ ID NO: 397839 - RNA, 22 nt, Human
aauugagugcagccagcccagu

SEQ ID NO: 397840 - RNA, 22 nt, Human
ccacuucaucagugcuccauuu

SEQ ID NO: 397841 - RNA, 22 nt, Human
aaauuucaguuaccuuuacguu

SEQ ID NO: 397842 - RNA, 22 nt, Human
uuggaucaaauuucaugcuguc

SEQ ID NO: 397843 - RNA, 22 nt, Human
ugcuuaauaggaguugaacauu

SEQ ID NO: 397844 - RNA, 22 nt, Human
uucccaauauucugcuuuuaug

SEQ ID NO: 397845 - RNA, 22 nt, Human
caggccagggagaauaugaagc

SEQ ID NO: 397846 - RNA, 22 nt, Human
uggaauaaagugcuuugaucag

SEQ ID NO: 397847 - RNA, 22 nt, Human
aaagcaaugcuuguggaaugua

SEQ ID NO: 397848 - RNA, 22 nt, Human
cauauaauguuugaagaugugg

SEQ ID NO: 397849 - RNA, 22 nt, Human
cauuuauauaaaauguccagaa

SEQ ID NO: 397850 - RNA, 22 nt, Human
gcuuuaaugcuucguggggcca

SEQ ID NO: 397851 - RNA, 22 nt, Human
cugaaagaauaagauguuuaca

SEQ ID NO: 397852 - RNA, 22 nt, Human
aacagaauaguugauguacagu

SEQ ID NO: 397853 - RNA, 22 nt, Human
ccaaacaaauccccauucuuag

SEQ ID NO: 397854 - RNA, 23 nt, Human
ucuaauacaugaaaccuagaugu

SEQ ID NO: 397855 - RNA, 22 nt, Human
caaauacuggguaaguuaauuu

SEQ ID NO: 397856 - RNA, 22 nt, Human
aaaucucaguguucuaagcauu

SEQ ID NO: 397857 - RNA, 22 nt, Human
auccuuagguggugcaucaggg

SEQ ID NO: 397858 - RNA, 22 nt, Human
ucagagaagcugccaggcgagc

SEQ ID NO: 397859 - RNA, 22 nt, Human
aguuucaguucugucauuuaua

SEQ ID NO: 397860 - RNA, 22 nt, Human
uaacagaaauaguaggugaggg

SEQ ID NO: 397861 - RNA, 22 nt, Human
ucaguaaaugguugcuguuauu

SEQ ID NO: 397862 - RNA, 22 nt, Human
uaaagacaugguguaggugaac

SEQ ID NO: 397863 - RNA, 22 nt, Human
aggcuucugugagcucauacaa

SEQ ID NO: 397864 - RNA, 22 nt, Human
auaaagcaaauaggacuauugc

SEQ ID NO: 397865 - RNA, 22 nt, Human
ugcuuauugcuuucaagacugu

SEQ ID NO: 397866 - RNA, 22 nt, Human
aguguuuauauuauggaaauau

SEQ ID NO: 397867 - RNA, 22 nt, Human
uuaaagauucugaggcugauua

SEQ ID NO: 397868 - RNA, 22 nt, Human
aaggcauaggacaaaucaguga

SEQ ID NO: 397869 - RNA, 22 nt, Human
aaguccuuuauccuaaaagguc

SEQ ID NO: 397870 - RNA, 22 nt, Human
auauacaguuuuacaggguuuc

SEQ ID NO: 397871 - RNA, 22 nt, Human
cuuaggcauccaggguucuucc

SEQ ID NO: 397872 - RNA, 22 nt, Human
aauaauuagugggacagagaac

SEQ ID NO: 397873 - RNA, 22 nt, Human
aaucaguguggugacuugucug

SEQ ID NO: 397874 - RNA, 22 nt, Human
acuuuagaccaucuuccacagu

SEQ ID NO: 397875 - RNA, 22 nt, Human
agcacaauagagcaguuaaaaa

SEQ ID NO: 397876 - RNA, 22 nt, Human
aaaauacuguggaguguugaaa

SEQ ID NO: 397877 - RNA, 22 nt, Human
aagcccagaugggagcauuuca

SEQ ID NO: 397878 - RNA, 22 nt, Human
cuggauuugccuauggugcuuu

SEQ ID NO: 397879 - RNA, 22 nt, Human
uuaaagaauagugccccuauug

SEQ ID NO: 397880 - RNA, 22 nt, Human
gugaauaagaccuaaggaugaa

SEQ ID NO: 397881 - RNA, 20 nt, Human
agaaucugacccagagagac

SEQ ID NO: 397882 - RNA, 22 nt, Human
gaauuucauuuguuuccuacca

SEQ ID NO: 397883 - RNA, 22 nt, Human
augaauaaguaaacuccuuugg

SEQ ID NO: 397884 - RNA, 22 nt, Human
acaugcuuccaaauuauguugg

SEQ ID NO: 397885 - RNA, 22 nt, Human
ugcuuauuuauagucaauagag

SEQ ID NO: 397886 - RNA, 23 nt, Human
uacuuaggguuuagaucugacug

SEQ ID NO: 397887 - RNA, 22 nt, Human
aaagcuaugaggcaugcauuuc

SEQ ID NO: 397888 - RNA, 22 nt, Human
guauacagauacuuagacgugc

SEQ ID NO: 397889 - RNA, 22 nt, Human
acuuuuaaaugaguuucaguug

SEQ ID NO: 397890 - RNA, 22 nt, Human
cuaugacacaggccauuauaua

SEQ ID NO: 397891 - RNA, 22 nt, Human
augugcuuguaauguuaaaugu

SEQ ID NO: 397892 - RNA, 22 nt, Human
acagaauuaaugaaaauuacaa

SEQ ID NO: 397893 - RNA, 22 nt, Human
ucuuuaauucagcaugaugcgg

SEQ ID NO: 397894 - RNA, 23 nt, Human
uaucagugugaugaggcugcugc

SEQ ID NO: 397895 - RNA, 22 nt, Human
ucagaauuuuuguuacccuuga

SEQ ID NO: 397896 - RNA, 22 nt, Human
auuccaaaaggauguuagaaug

SEQ ID NO: 397897 - RNA, 22 nt, Human
uguggaaaauuggaacguuccu

SEQ ID NO: 397898 - RNA, 22 nt, Human
auucauaaguaaaugauuaccu

SEQ ID NO: 397899 - RNA, 22 nt, Human
caaguccuccaugugacuaggu

SEQ ID NO: 397900 - RNA, 22 nt, Human
uucagagaagcaaaggcagauu

SEQ ID NO: 397901 - RNA, 22 nt, Human
gucauaaagcuuguugcauuua

SEQ ID NO: 397902 - RNA, 22 nt, Human
guuaggcaaauaacuguggagc

SEQ ID NO: 397903 - RNA, 22 nt, Human
aauugcaauuuucuuaaggucu

SEQ ID NO: 397904 - RNA, 19 nt, Human
uccuucagucagaucuggg

SEQ ID NO: 397905 - RNA, 22 nt, Human
auuucauacuaaggcucaaaaa

SEQ ID NO: 397906 - RNA, 22 nt, Human
guuaauauuuaccugucaagaa

SEQ ID NO: 397907 - RNA, 18 nt, Human
auauguuaauuagguagg

SEQ ID NO: 397908 - RNA, 22 nt, Human
uugaagaaagucauauauaaug

SEQ ID NO: 397909 - RNA, 22 nt, Human
uaggaagaugaguaucaacuug

SEQ ID NO: 397910 - RNA, 20 nt, Human
uacuggauuagggcucaccc

SEQ ID NO: 397911 - RNA, 22 nt, Human
agauaaugaaugccaugacauu

SEQ ID NO: 397912 - RNA, 22 nt, Human
uguauacaauucacacuuccca

SEQ ID NO: 397913 - RNA, 22 nt, Human
gcuuuuauugucuuuacgacga

SEQ ID NO: 397914 - RNA, 22 nt, Human
accagcugcugauugcuaaaug

SEQ ID NO: 397915 - RNA, 22 nt, Human
aguccuuaugugguggagagag

SEQ ID NO: 397916 - RNA, 22 nt, Human
uggauuuauuagguuggugaaa

SEQ ID NO: 397917 - RNA, 22 nt, Human
cacaauuuggugcuaaagaaag

SEQ ID NO: 397918 - RNA, 22 nt, Human
cugaauaauuuucuguuguaug

SEQ ID NO: 397919 - RNA, 23 nt, Human
uuaaaggcagauguugaguauua

SEQ ID NO: 397920 - RNA, 22 nt, Human
aaagucaugcaguugaacuuuu

SEQ ID NO: 397921 - RNA, 22 nt, Human
ucaguuucuccaucgcuccagu

SEQ ID NO: 397922 - RNA, 22 nt, Human
gcauguuauguaucugcccagc

SEQ ID NO: 397923 - RNA, 22 nt, Human
ucagccaggccaccuucagcuu

SEQ ID NO: 397924 - RNA, 22 nt, Human
gcaggcuccaaggccugggaga

SEQ ID NO: 397925 - RNA, 23 nt, Human
uaaagucacauauuagagugagc

SEQ ID NO: 397926 - RNA, 22 nt, Human
uaaucugaagaaacaggacuug

SEQ ID NO: 397927 - RNA, 22 nt, Human
uacuaaacccucgauggaucuu

SEQ ID NO: 397928 - RNA, 23 nt, Human
aagucaccaagaggaaggcggag

SEQ ID NO: 397929 - RNA, 22 nt, Human
aaaacugaaauacgauccaaug

SEQ ID NO: 397930 - RNA, 22 nt, Human
gaguccuuuugugccacaggga

SEQ ID NO: 397931 - RNA, 22 nt, Human
gcuucacaggcaaguuaagccu

SEQ ID NO: 397932 - RNA, 22 nt, Human
gaagaauccaugcuaauuuacc

SEQ ID NO: 397933 - RNA, 22 nt, Human
cacacuuugugcuaaucuauuu

SEQ ID NO: 397934 - RNA, 22 nt, Human
cauaagaauauuccauccuuug

SEQ ID NO: 397935 - RNA, 22 nt, Human
aagcucauuaauuagaagcuaa

SEQ ID NO: 397936 - RNA, 22 nt, Human
augaaaauguacauguguauaa

SEQ ID NO: 397937 - RNA, 20 nt, Human
aguacaauguaugauucaga

SEQ ID NO: 397938 - RNA, 22 nt, Human
uauuccaaaauaguuaagcacu

SEQ ID NO: 397939 - RNA, 22 nt, Human
cuggcuuucccuggacaacagc

SEQ ID NO: 397940 - RNA, 22 nt, Human
aauaacagagaaggguggcuuc

SEQ ID NO: 397941 - RNA, 22 nt, Human
gaaagccaucuggcugcuggga

SEQ ID NO: 397942 - RNA, 22 nt, Human
aauuuacaguugcugaugguac

SEQ ID NO: 397943 - RNA, 22 nt, Human
uuuauucugugcuacaugaaga

SEQ ID NO: 397944 - RNA, 19 nt, Human
augcuuuauguuauuucuu

SEQ ID NO: 397945 - RNA, 15 nt, Human
aaucagaaguguggc

SEQ ID NO: 397946 - RNA, 22 nt, Human
uaggauuuaggcuuuaacaucu

SEQ ID NO: 397947 - RNA, 22 nt, Human
ccaauacacuuuauagaagaaa

SEQ ID NO: 397948 - RNA, 22 nt, Human
uccauuuagcuggcaaacaaug

SEQ ID NO: 397949 - RNA, 22 nt, Human
acaucugaccauuacaagacau

SEQ ID NO: 397950 - RNA, 22 nt, Human
cuuaauuuuuguaguagaugga

SEQ ID NO: 397951 - RNA, 23 nt, Human
agaucugauguuaccaagaauug

SEQ ID NO: 397952 - RNA, 22 nt, Human
auacacagcgaugagaggaggc

SEQ ID NO: 397953 - RNA, 22 nt, Human
cagaucuguaguaaaagaucuc

SEQ ID NO: 397954 - RNA, 22 nt, Human
aauauuaucaaaagcuuuuuca

SEQ ID NO: 397955 - RNA, 22 nt, Human
gucaaacagccuccuguucuaa

SEQ ID NO: 397956 - RNA, 22 nt, Human
guuuauaaggcccaauauuucu

SEQ ID NO: 397957 - RNA, 23 nt, Human
uagaauucaaucuguuccacauc

SEQ ID NO: 397958 - RNA, 22 nt, Human
augaauaaacaggugccucuuc

SEQ ID NO: 397959 - RNA, 22 nt, Human
gaaagccauagcccagcuuuac

SEQ ID NO: 397960 - RNA, 19 nt, Human
auucauuuuugccuucuaa

SEQ ID NO: 397961 - RNA, 22 nt, Human
uuagaaaugucacagaucugau

SEQ ID NO: 397962 - RNA, 22 nt, Human
uuggagagauuaucagaccagc

SEQ ID NO: 397963 - RNA, 22 nt, Human
uauacagucuuuugcuauauuc

SEQ ID NO: 397964 - RNA, 22 nt, Human
aaguuucauuguucauguaaca

SEQ ID NO: 397965 - RNA, 22 nt, Human
acuucacacagcaaauuuaucu

SEQ ID NO: 397966 - RNA, 22 nt, Human
uucuauacaaagauuucucaca

SEQ ID NO: 397967 - RNA, 22 nt, Human
ucuauaaauuaugcagucucag

SEQ ID NO: 397968 - RNA, 18 nt, Human
aauuuccauaugaauugc

SEQ ID NO: 397969 - RNA, 22 nt, Human
aaaagccaugcauaccuaagag

SEQ ID NO: 397970 - RNA, 22 nt, Human
acauaauaaaaauaacagcuca

SEQ ID NO: 397971 - RNA, 22 nt, Human
augcuuaaugaggguauauaug

SEQ ID NO: 397972 - RNA, 22 nt, Human
caaaacugucuagagagagaag

SEQ ID NO: 397973 - RNA, 18 nt, Human
uacagauuauagauacau

SEQ ID NO: 397974 - RNA, 22 nt, Human
acuggaucuaauugguuauagu

SEQ ID NO: 397975 - RNA, 22 nt, Human
acagauuuuugguaaauaauuu

SEQ ID NO: 397976 - RNA, 22 nt, Human
uaauuauaacaguuacaucuua

SEQ ID NO: 397977 - RNA, 22 nt, Human
uaaucuacuguuuauaugaaau

SEQ ID NO: 397978 - RNA, 22 nt, Human
ugugaaagcaagucuaguucuc

SEQ ID NO: 397979 - RNA, 22 nt, Human
caguccuuggcuucauccgagu

SEQ ID NO: 397980 - RNA, 22 nt, Human
auguuaaauaaucccuuaaagc

SEQ ID NO: 397981 - RNA, 19 nt, Human
agcaaauacaucaaaauug

SEQ ID NO: 397982 - RNA, 21 nt, Human
auggcuuuuuuaaagcuugug

SEQ ID NO: 397983 - RNA, 22 nt, Human
aaugggauaauuguucauggga

SEQ ID NO: 397984 - RNA, 22 nt, Human
gauuucaaggaguuuucacagu

SEQ ID NO: 397985 - RNA, 22 nt, Human
aaaugcauggcuguuuuaaagc

SEQ ID NO: 397986 - RNA, 22 nt, Human
auguucaaacaaguuaaugcca

SEQ ID NO: 397987 - RNA, 22 nt, Human
aaauacuguugaaugaaguaag

SEQ ID NO: 397988 - RNA, 22 nt, Human
aauagaaaggaggggcucuugu

SEQ ID NO: 397989 - RNA, 22 nt, Human
uuauagaacagccuccucuaga

SEQ ID NO: 397990 - RNA, 22 nt, Human
aaaguccuagcgauccacagaa

SEQ ID NO: 397991 - RNA, 22 nt, Human
ucacagaaauaagauaguuauu

SEQ ID NO: 397992 - RNA, 22 nt, Human
acuggaugaggggaaagagaca

SEQ ID NO: 397993 - RNA, 22 nt, Human
aggauuuaccuccagcuaggcu

SEQ ID NO: 397994 - RNA, 22 nt, Human
aaacugugcuucccaaaugccc

SEQ ID NO: 397995 - RNA, 22 nt, Human
uguacaaucuuggucccuuuau

SEQ ID NO: 397996 - RNA, 22 nt, Human
acuauacaguauguacgugcac

SEQ ID NO: 397997 - RNA, 22 nt, Human
uaaauaugcauguauccuuauc

SEQ ID NO: 397998 - RNA, 22 nt, Human
aauuccagaggaggacaguccu

SEQ ID NO: 397999 - RNA, 22 nt, Human
cugaauaauauuccauuaugag

SEQ ID NO: 398000 - RNA, 22 nt, Human
gucaacuugcaagaugcugggc

SEQ ID NO: 398001 - RNA, 22 nt, Human
augcuuaaccuugguguacaau

SEQ ID NO: 398002 - RNA, 22 nt, Human
ugaagaauaaaugguugagacu

SEQ ID NO: 398003 - RNA, 22 nt, Human
aaagcagucacuccagugugau

SEQ ID NO: 398004 - RNA, 22 nt, Human
uaguccuuuaucaaacauuuau

SEQ ID NO: 398005 - RNA, 22 nt, Human
gcagaauugauggagaacuuaa

SEQ ID NO: 398006 - RNA, 22 nt, Human
gcacaauaauucuuguuuugcu

SEQ ID NO: 398007 - RNA, 22 nt, Human
uauggcuuuuuauucaucuuac

SEQ ID NO: 398008 - RNA, 22 nt, Human
agaucaguuagauagcuugaug

SEQ ID NO: 398009 - RNA, 22 nt, Human
augguuuuguccucuuugguuc

SEQ ID NO: 398010 - RNA, 22 nt, Human
aaauuucaguuggaaugagcuc

SEQ ID NO: 398011 - RNA, 22 nt, Human
uugguacaaaaguaacuguggu

SEQ ID NO: 398012 - RNA, 22 nt, Human
uuccauaauaaccugagagaaa

SEQ ID NO: 398013 - RNA, 22 nt, Human
ggcauuuaucuaauauaguuua

SEQ ID NO: 398014 - RNA, 22 nt, Human
uuacagauggaucuagcaaaau

SEQ ID NO: 398015 - RNA, 22 nt, Human
cuuauauuuuaggaacagacaa

SEQ ID NO: 398016 - RNA, 22 nt, Human
uggcauuugcucccuuguguuc

SEQ ID NO: 398017 - RNA, 22 nt, Human
caauuucagaccuuuccuugga

SEQ ID NO: 398018 - RNA, 22 nt, Human
acuauacagaagaggauaggaa

SEQ ID NO: 398019 - RNA, 22 nt, Human
ccaguuuaagacuuaucucaau

SEQ ID NO: 398020 - RNA, 21 nt, Human
ucuauucauuacaguuauuug

SEQ ID NO: 398021 - RNA, 22 nt, Human
acagaugauuuuuaugaaaaca

SEQ ID NO: 398022 - RNA, 22 nt, Human
acugcagagguggggugcagag

SEQ ID NO: 398023 - RNA, 22 nt, Human
aauaauuuccagccaacuggaa

SEQ ID NO: 398024 - RNA, 22 nt, Human
uccauacauugaaauaccauuc

SEQ ID NO: 398025 - RNA, 22 nt, Human
guuaggcaguuuucuucauucu

SEQ ID NO: 398026 - RNA, 22 nt, Human
uucacagaauugucuugacugg

SEQ ID NO: 398027 - RNA, 22 nt, Human
guuaggcagcccaagaugucag

SEQ ID NO: 398028 - RNA, 22 nt, Human
uaagaaucaguagauauagauu

SEQ ID NO: 398029 - RNA, 22 nt, Human
uccagaauauuugggaaagaug

SEQ ID NO: 398030 - RNA, 22 nt, Human
aacauuggauauuuauuaaaag

SEQ ID NO: 398031 - RNA, 22 nt, Human
acagaacugggggcacagauag

SEQ ID NO: 398032 - RNA, 22 nt, Human
ucaauacauacaauguauagug

SEQ ID NO: 398033 - RNA, 22 nt, Human
aaaugucagaagcuuuacuucu

SEQ ID NO: 398034 - RNA, 22 nt, Human
uguguaaauggcaucucucagc

SEQ ID NO: 398035 - RNA, 22 nt, Human
caucagaagaaagacaaaugau

SEQ ID NO: 398036 - RNA, 22 nt, Human
caagaauccuguucuugaagau

SEQ ID NO: 398037 - RNA, 22 nt, Human
caccagacagguguaugcauau

SEQ ID NO: 398038 - RNA, 22 nt, Human
uuggaucacucugaagccuuac

SEQ ID NO: 398039 - RNA, 22 nt, Human
aguccagugaacuguaaauagg

SEQ ID NO: 398040 - RNA, 22 nt, Human
uuuuugcugauaagcagaauuc

SEQ ID NO: 398041 - RNA, 22 nt, Human
aggauuuauuccagaaaugcaa

SEQ ID NO: 398042 - RNA, 22 nt, Human
guaggaaaguaaaugaaauaca

SEQ ID NO: 398043 - RNA, 22 nt, Human
uauacagaaagaauucaagucu

SEQ ID NO: 398044 - RNA, 22 nt, Human
guagaaauagugguugacagga

SEQ ID NO: 398045 - RNA, 22 nt, Human
aagcauuuugccacuugaaguu

SEQ ID NO: 398046 - RNA, 22 nt, Human
guaugaaaauuguaaaguucuu

SEQ ID NO: 398047 - RNA, 22 nt, Human
ucaaaauuucagcacuagcccu

SEQ ID NO: 398048 - RNA, 22 nt, Human
aacuuuguguguuuaauauggc

SEQ ID NO: 398049 - RNA, 22 nt, Human
uuuaggcauacuuuugggagaa

SEQ ID NO: 398050 - RNA, 22 nt, Human
ucugaagaacugaguaaacaug

SEQ ID NO: 398051 - RNA, 22 nt, Human
caguccuuucaauggugaccuu

SEQ ID NO: 398052 - RNA, 23 nt, Human
aaguacauauauuuagauaguga

SEQ ID NO: 398053 - RNA, 21 nt, Human
caaguccuuugccaaagugcu

SEQ ID NO: 398054 - RNA, 22 nt, Human
caguaaauuugagggaucuaau

SEQ ID NO: 398055 - RNA, 22 nt, Human
auagcuuucuuaaauauauaaa

SEQ ID NO: 398056 - RNA, 22 nt, Human
aaucauaauucaaauaagcuua

SEQ ID NO: 398057 - RNA, 22 nt, Human
uaauuucacaguucaacgcaca

SEQ ID NO: 398058 - RNA, 22 nt, Human
aauuaaauugguuuagagagga

SEQ ID NO: 398059 - RNA, 22 nt, Human
caaacuggcuaugggaaucuug

SEQ ID NO: 398060 - RNA, 22 nt, Human
caucagaaggaaggacgauuau

SEQ ID NO: 398061 - RNA, 22 nt, Human
uaucauaaguuaauuaaacagu

SEQ ID NO: 398062 - RNA, 22 nt, Human
aauuauccuuaaugcaguaagc

SEQ ID NO: 398063 - RNA, 22 nt, Human
uauggcuuuucauuccuaugug

SEQ ID NO: 398064 - RNA, 22 nt, Human
aagacagugaucucugagagau

SEQ ID NO: 398065 - RNA, 22 nt, Human
cuacagaaaccuuuuucauaca

SEQ ID NO: 398066 - RNA, 22 nt, Human
augcuuaagcucaguuauauau

SEQ ID NO: 398067 - RNA, 22 nt, Human
uagaaacagcauauauuagccc

SEQ ID NO: 398068 - RNA, 22 nt, Human
cagaaauaaacuucucacaucg

SEQ ID NO: 398069 - RNA, 22 nt, Human
aaagccaugaauguuauagagg

SEQ ID NO: 398070 - RNA, 22 nt, Human
gacaguccuugcccaguaucua

SEQ ID NO: 398071 - RNA, 22 nt, Human
gagcccagcuugcacauggagc

SEQ ID NO: 398072 - RNA, 22 nt, Human
uaugaagaaaccuauccucuag

SEQ ID NO: 398073 - RNA, 22 nt, Human
aaaaguguucaggaagaauaau

SEQ ID NO: 398074 - RNA, 22 nt, Human
auggcauuccaagucuucuuuu

SEQ ID NO: 398075 - RNA, 22 nt, Human
uagucaccuguugugugaugcc

SEQ ID NO: 398076 - RNA, 22 nt, Human
aucuagaacuuaaagucaguca

SEQ ID NO: 398077 - RNA, 22 nt, Human
aaguuucaaauauaaaauuaca

SEQ ID NO: 398078 - RNA, 22 nt, Human
uauggcuuuaaacaacuuaggu

SEQ ID NO: 398079 - RNA, 22 nt, Human
ugaauaaucuuggguauuaaua

SEQ ID NO: 398080 - RNA, 19 nt, Human
uuccuuagaggaggcggug

SEQ ID NO: 398081 - RNA, 22 nt, Human
uaaagccacuucauucuagucu

SEQ ID NO: 398082 - RNA, 22 nt, Human
caauuucaucuugugcuucaau

SEQ ID NO: 398083 - RNA, 22 nt, Human
uaucagaagacuuacaguaucg

SEQ ID NO: 398084 - RNA, 22 nt, Human
aguccuuaugagaugcugccuu

SEQ ID NO: 398085 - RNA, 22 nt, Human
aguccuuagaacagugccuggg

SEQ ID NO: 398086 - RNA, 21 nt, Human
auagaacaccaggcauauaua

SEQ ID NO: 398087 - RNA, 22 nt, Human
aaagaaggaugggagaaauccu

SEQ ID NO: 398088 - RNA, 22 nt, Human
uggcuuuacaucaaauugagua

SEQ ID NO: 398089 - RNA, 22 nt, Human
ucauaaaguuaucaccaaaucc

SEQ ID NO: 398090 - RNA, 22 nt, Human
aaagucauacauggugcuuacu

SEQ ID NO: 398091 - RNA, 22 nt, Human
augcuuuaaaugucuuuugcuu

SEQ ID NO: 398092 - RNA, 22 nt, Human
ucagaauugucuggggaauguu

SEQ ID NO: 398093 - RNA, 22 nt, Human
uccaaauacauuuacuguauuu

SEQ ID NO: 398094 - RNA, 22 nt, Human
ugaaagguuaaaaguaguauug

SEQ ID NO: 398095 - RNA, 22 nt, Human
auaugcuugggacugauacagu

SEQ ID NO: 398096 - RNA, 22 nt, Human
aaauagcauaaaauaggaagcu

SEQ ID NO: 398097 - RNA, 22 nt, Human
uuucauugaacuaaagaaucug

SEQ ID NO: 398098 - RNA, 22 nt, Human
aggcagaccaugaaucaugacc

SEQ ID NO: 398099 - RNA, 22 nt, Human
aauacauguuuucuacuauucu

SEQ ID NO: 398100 - RNA, 22 nt, Human
acaaaguccugguguauggcca

SEQ ID NO: 398101 - RNA, 22 nt, Human
uacuucauuccuuuguaaaaug

SEQ ID NO: 398102 - RNA, 22 nt, Human
aaguccuucccaagcauguacc

SEQ ID NO: 398103 - RNA, 22 nt, Human
cauacuuugggauaagagugga

SEQ ID NO: 398104 - RNA, 22 nt, Human
uaucagaaagauauuacugggg

SEQ ID NO: 398105 - RNA, 22 nt, Human
caguuucagaaucaaaacauca

SEQ ID NO: 398106 - RNA, 22 nt, Human
aacuggauuuaggaacagagaa

SEQ ID NO: 398107 - RNA, 22 nt, Human
guuccaaagucucugagcugag

SEQ ID NO: 398108 - RNA, 22 nt, Human
agaauaucguagcauauuaucu

SEQ ID NO: 398109 - RNA, 21 nt, Human
auucagaguaauucaucuuua

SEQ ID NO: 398110 - RNA, 22 nt, Human
aucacaaaggguuuucucugag

SEQ ID NO: 398111 - RNA, 22 nt, Human
acugguuuuccagguuacuucu

SEQ ID NO: 398112 - RNA, 22 nt, Human
caaguccuuuucuuggcucagg

SEQ ID NO: 398113 - RNA, 20 nt, Human
uacagacaugacaauaaugg

SEQ ID NO: 398114 - RNA, 19 nt, Human
cuauacagccucugaggaa

SEQ ID NO: 398115 - RNA, 21 nt, Human
aaauacagaugcaaaucuguu

SEQ ID NO: 398116 - RNA, 22 nt, Human
uuuuccaaaguaccaugucccu

SEQ ID NO: 398117 - RNA, 22 nt, Human
aaguccuuauguggaggggcua

SEQ ID NO: 398118 - RNA, 22 nt, Human
uuuaggcaaauuucagaugugc

SEQ ID NO: 398119 - RNA, 22 nt, Human
ucuggaucuccagcacuuauca

SEQ ID NO: 398120 - RNA, 22 nt, Human
cuggacucugcagagaaaagua

SEQ ID NO: 398121 - RNA, 22 nt, Human
gauuuagagcaggaaugcaugg

SEQ ID NO: 398122 - RNA, 22 nt, Human
ucauaaaaugcuccugauauug

SEQ ID NO: 398123 - RNA, 22 nt, Human
acagaauucuaguauguggcuu

SEQ ID NO: 398124 - RNA, 22 nt, Human
ucaaaaguuucacauagagaua

SEQ ID NO: 398125 - RNA, 23 nt, Human
uuccagaggaagaagucaugacu

SEQ ID NO: 398126 - RNA, 22 nt, Human
acacaagauuguguauugaauu

SEQ ID NO: 398127 - RNA, 22 nt, Human
gcugcaggcauuuuccugggca

SEQ ID NO: 398128 - RNA, 22 nt, Human
gcuggauccugauucgucuuug

SEQ ID NO: 398129 - RNA, 22 nt, Human
uuccuuagauccuucaaucacg

SEQ ID NO: 398130 - RNA, 22 nt, Human
acagaauuugcuugggcaaugg

SEQ ID NO: 398131 - RNA, 22 nt, Human
aauguaaacagcaagagaaggg

SEQ ID NO: 398132 - RNA, 22 nt, Human
uaaagucauaagaguggauccg

SEQ ID NO: 398133 - RNA, 22 nt, Human
acaugcuuugcacuuacaucau

SEQ ID NO: 398134 - RNA, 22 nt, Human
uccuuguugcugcagucaccug

SEQ ID NO: 398135 - RNA, 22 nt, Human
auaauucaugggccuuucaccu

SEQ ID NO: 398136 - RNA, 22 nt, Human
auacugaauuagguaaagcaua

SEQ ID NO: 398137 - RNA, 22 nt, Human
caguccuuagauuuuacugcca

SEQ ID NO: 398138 - RNA, 22 nt, Human
aagaaacaaccacugcucuccu

SEQ ID NO: 398139 - RNA, 22 nt, Human
uauuaaagagagaaucaucauc

SEQ ID NO: 398140 - RNA, 22 nt, Human
auucauaacggcaaaugucacc

SEQ ID NO: 398141 - RNA, 22 nt, Human
uagucaccugugagcugcguag

SEQ ID NO: 398142 - RNA, 22 nt, Human
uguguaaauuuauuuacauaaa

SEQ ID NO: 398143 - RNA, 22 nt, Human
augugaaagagguguucagugg

SEQ ID NO: 398144 - RNA, 22 nt, Human
ucacaucaacauuauagcauga

SEQ ID NO: 398145 - RNA, 22 nt, Human
uccaaaguaauuucacuucugu

SEQ ID NO: 398146 - RNA, 22 nt, Human
aaacuuuguucgucugaugugg

SEQ ID NO: 398147 - RNA, 22 nt, Human
augaaacacacacgcgcauacu

SEQ ID NO: 398148 - RNA, 22 nt, Human
ugccauuuugagauguuaauga

SEQ ID NO: 398149 - RNA, 22 nt, Human
gaauuucacaaggugaggauaa

SEQ ID NO: 398150 - RNA, 22 nt, Human
ccuggaucgaugccgagggaaa

SEQ ID NO: 398151 - RNA, 22 nt, Human
uauaagaaauugccaaccuguu

SEQ ID NO: 398152 - RNA, 22 nt, Human
caaguccuaggucugauugaac

SEQ ID NO: 398153 - RNA, 22 nt, Human
gauuuucauuugcacucuagaa

SEQ ID NO: 398154 - RNA, 22 nt, Human
gaauacaaacuuaaggcuuuac

SEQ ID NO: 398155 - RNA, 23 nt, Human
uaauacugcuucagaggcuuaga

SEQ ID NO: 398156 - RNA, 22 nt, Human
guaaacaacacaaaucauuuga

SEQ ID NO: 398157 - RNA, 23 nt, Human
uuacagaaaguaugcuuuuguuu

SEQ ID NO: 398158 - RNA, 22 nt, Human
aauuccagcuaggaaaagcuuc

SEQ ID NO: 398159 - RNA, 22 nt, Human
auucuaacacaugcucuaagaa

SEQ ID NO: 398160 - RNA, 22 nt, Human
ccuauacaggcuucuuuacaug

SEQ ID NO: 398161 - RNA, 22 nt, Human
ucuauacaaguuucacuuugac

SEQ ID NO: 398162 - RNA, 22 nt, Human
uuuccaaauaaggucacacuca

SEQ ID NO: 398163 - RNA, 22 nt, Human
caucagaauagcucuguggaua

SEQ ID NO: 398164 - RNA, 22 nt, Human
ucagaauuuugguuugguuggu

SEQ ID NO: 398165 - RNA, 22 nt, Human
aagauauagauaaaacuaugca

SEQ ID NO: 398166 - RNA, 22 nt, Human
uauauacuuucuuccuggguag

SEQ ID NO: 398167 - RNA, 22 nt, Human
agucaccagguuuuagagaccu

SEQ ID NO: 398168 - RNA, 22 nt, Human
uacagaaguaaauaccaaaagc

SEQ ID NO: 398169 - RNA, 22 nt, Human
uuuauuauucucuggagaaugu

SEQ ID NO: 398170 - RNA, 22 nt, Human
auuacagaaugcaguuccuuau

SEQ ID NO: 398171 - RNA, 22 nt, Human
uuugaacaggaguaucuauagu

SEQ ID NO: 398172 - RNA, 22 nt, Human
cauuuaguuauacuaaaacauu

SEQ ID NO: 398173 - RNA, 22 nt, Human
uuccaaaccucaaauaauuaau

SEQ ID NO: 398174 - RNA, 22 nt, Human
ccauuucacucuuccugaagga

SEQ ID NO: 398175 - RNA, 22 nt, Human
gaaugaaagauuugcauucuau

SEQ ID NO: 398176 - RNA, 22 nt, Human
agauuggaucaagcagcaguug

SEQ ID NO: 398177 - RNA, 22 nt, Human
ucagaauuugauuccugggaua

SEQ ID NO: 398178 - RNA, 22 nt, Human
ccagaauucagaaagggcauaa

SEQ ID NO: 398179 - RNA, 22 nt, Human
uacagaaaaacuggcauugaag

SEQ ID NO: 398180 - RNA, 22 nt, Human
auaggcuuauauaaaaacaucu

SEQ ID NO: 398181 - RNA, 20 nt, Human
uguuccaagcuaaugaauga

SEQ ID NO: 398182 - RNA, 22 nt, Human
gcaacuuuagggccagcaagua

SEQ ID NO: 398183 - RNA, 22 nt, Human
gugaauaaaacaccugccaaga

SEQ ID NO: 398184 - RNA, 22 nt, Human
aagucacaagcauauaugcauu

SEQ ID NO: 398185 - RNA, 20 nt, Human
uauaacaguguugggugugu

SEQ ID NO: 398186 - RNA, 22 nt, Human
auuuccagacuuuuuccaggaa

SEQ ID NO: 398187 - RNA, 22 nt, Human
ugcuuaauauugugauguaaua

SEQ ID NO: 398188 - RNA, 23 nt, Human
cagaaauaaacugguuuguagau

SEQ ID NO: 398189 - RNA, 22 nt, Human
auggcuuucagauuucuauguu

SEQ ID NO: 398190 - RNA, 22 nt, Human
aacacuuucuauuauuaugguu

SEQ ID NO: 398191 - RNA, 19 nt, Human
aaaauugcguauuuugagg

SEQ ID NO: 398192 - RNA, 22 nt, Human
uaacagaaauuuuaguuagggg

SEQ ID NO: 398193 - RNA, 22 nt, Human
uuccacaauguaugaauaagau

SEQ ID NO: 398194 - RNA, 22 nt, Human
ccuggaucccgauggcugugag

SEQ ID NO: 398195 - RNA, 22 nt, Human
aucuauacuacaaauggcuggu

SEQ ID NO: 398196 - RNA, 22 nt, Human
auuauucaaucauauuaaaagu

SEQ ID NO: 398197 - RNA, 22 nt, Human
cacaagaaauaagcugccuuuc

SEQ ID NO: 398198 - RNA, 22 nt, Human
aaugcuuaauucaauacugugu

SEQ ID NO: 398199 - RNA, 22 nt, Human
uuuggacaaguuacugguuucc

SEQ ID NO: 398200 - RNA, 22 nt, Human
caguccuuagucuggauggcuu

SEQ ID NO: 398201 - RNA, 22 nt, Human
aaugggauaggucuucaggaau

SEQ ID NO: 398202 - RNA, 22 nt, Human
uuccuuaguguuagauucugug

SEQ ID NO: 398203 - RNA, 22 nt, Human
augcuuuagugucaaguuuggg

SEQ ID NO: 398204 - RNA, 22 nt, Human
uaaaacugaauacauacugagg

SEQ ID NO: 398205 - RNA, 22 nt, Human
agcaucuggcagaaagucagaa

SEQ ID NO: 398206 - RNA, 22 nt, Human
acuauacauaaaacauuugggu

SEQ ID NO: 398207 - RNA, 22 nt, Human
ucauaaaguucuaagaauugua

SEQ ID NO: 398208 - RNA, 22 nt, Human
auuaggcagugccauuguacgg

SEQ ID NO: 398209 - RNA, 22 nt, Human
cagaagucacccucagaauaac

SEQ ID NO: 398210 - RNA, 22 nt, Human
guuaaagaagaauaguuccuuu

SEQ ID NO: 398211 - RNA, 22 nt, Human
gaaugaauucagcacauggaau

SEQ ID NO: 398212 - RNA, 22 nt, Human
uuauacuuuauacuacaucauu

SEQ ID NO: 398213 - RNA, 22 nt, Human
gugaauaaucacccuucuggau

SEQ ID NO: 398214 - RNA, 22 nt, Human
uaaguaaauuuauaaugugauu

SEQ ID NO: 398215 - RNA, 22 nt, Human
uggcuuaagauuuaugcuuuua

SEQ ID NO: 398216 - RNA, 22 nt, Human
caacauuugaguaaagaaaugg

SEQ ID NO: 398217 - RNA, 22 nt, Human
agucaccauuuucaccugccuc

SEQ ID NO: 398218 - RNA, 22 nt, Human
uaucaaaguuguccugugaagu

SEQ ID NO: 398219 - RNA, 22 nt, Human
augguuuugaagggaggucaaa

SEQ ID NO: 398220 - RNA, 22 nt, Human
cuuaggcaguuuaggaaagaga

SEQ ID NO: 398221 - RNA, 22 nt, Human
aaacauguaauucugcuuaaga

SEQ ID NO: 398222 - RNA, 22 nt, Human
ugaagaaucccagggaauuugg

SEQ ID NO: 398223 - RNA, 22 nt, Human
auuccaaaggcuggccuggagg

SEQ ID NO: 398224 - RNA, 22 nt, Human
auuuacugagguaaauaaacug

SEQ ID NO: 398225 - RNA, 22 nt, Human
gaagaaucugaggacagucauu

SEQ ID NO: 398226 - RNA, 22 nt, Human
uuuaaugauagcuguuucacau

SEQ ID NO: 398227 - RNA, 22 nt, Human
uaaagucaucuuuacaucuuug

SEQ ID NO: 398228 - RNA, 22 nt, Human
uugaauaauauguucaggagga

SEQ ID NO: 398229 - RNA, 22 nt, Human
cuucuuaacuguauauacuaug

SEQ ID NO: 398230 - RNA, 22 nt, Human
ucauaaagcucuuccaaaugua

SEQ ID NO: 398231 - RNA, 22 nt, Human
aacaugaaaagcccagagaggu

SEQ ID NO: 398232 - RNA, 22 nt, Human
aaagucauuuguauauacccuu

SEQ ID NO: 398233 - RNA, 22 nt, Human
ugucauaacuuagugacaaauc

SEQ ID NO: 398234 - RNA, 23 nt, Human
aagaaugcuucugaagagcugcc

SEQ ID NO: 398235 - RNA, 22 nt, Human
uuacagaaguuucagcguuuua

SEQ ID NO: 398236 - RNA, 22 nt, Human
uaauuguagcuuuguaaucagc

SEQ ID NO: 398237 - RNA, 22 nt, Human
uuauaagaguauauaguguacu

SEQ ID NO: 398238 - RNA, 22 nt, Human
uuaaugauaccuauguuaauuu

SEQ ID NO: 398239 - RNA, 22 nt, Human
ucacaccaguuuccuuucaauu

SEQ ID NO: 398240 - RNA, 18 nt, Human
uauaaacacacuuagguu

SEQ ID NO: 398241 - RNA, 22 nt, Human
aguucacugcuuaagccuuuga

SEQ ID NO: 398242 - RNA, 22 nt, Human
cuaauuauguuguuauaaucaa

SEQ ID NO: 398243 - RNA, 22 nt, Human
caauuucacugacacccuggaa

SEQ ID NO: 398244 - RNA, 22 nt, Human
uauccaaaguuucucagaaacu

SEQ ID NO: 398245 - RNA, 22 nt, Human
guccaaauuuuucacauguaga

SEQ ID NO: 398246 - RNA, 22 nt, Human
auuacaagaugcauccauauuu

SEQ ID NO: 398247 - RNA, 22 nt, Human
aagucauugguagcuugauagg

SEQ ID NO: 398248 - RNA, 19 nt, Human
ucucuacacuacauuucua

SEQ ID NO: 398249 - RNA, 22 nt, Human
ugcaggaacagaacucacuccc

SEQ ID NO: 398250 - RNA, 22 nt, Human
aaauggaucuguggaauacauu

SEQ ID NO: 398251 - RNA, 22 nt, Human
ucauagaaugaguuaaugaacu

SEQ ID NO: 398252 - RNA, 21 nt, Human
ugaucauuuguguaaaggaga

SEQ ID NO: 398253 - RNA, 22 nt, Human
auuaggcagacaacguagccgg

SEQ ID NO: 398254 - RNA, 22 nt, Human
uuauuauugugguugcauuauc

SEQ ID NO: 398255 - RNA, 22 nt, Human
caauuucaugccauguauugcu

SEQ ID NO: 398256 - RNA, 22 nt, Human
uguauguugggucaaaguacau

SEQ ID NO: 398257 - RNA, 22 nt, Human
uuauuauuccccaagucauuau

SEQ ID NO: 398258 - RNA, 22 nt, Human
aaagccauaagccuaauacuaa

SEQ ID NO: 398259 - RNA, 22 nt, Human
aguguuuaaacugaagugauga

SEQ ID NO: 398260 - RNA, 22 nt, Human
auauuaaauggauuuugggagc

SEQ ID NO: 398261 - RNA, 23 nt, Human
uuuaacuuuccaauaauucauug

SEQ ID NO: 398262 - RNA, 22 nt, Human
aucagaaaaacauaauguuauu

SEQ ID NO: 398263 - RNA, 22 nt, Human
uuaggaaauuccaccuguauuc

SEQ ID NO: 398264 - RNA, 22 nt, Human
cuauuacauuucuggacauuca

SEQ ID NO: 398265 - RNA, 22 nt, Human
auggcuuucucuaaugugguau

SEQ ID NO: 398266 - RNA, 22 nt, Human
uuaauaaacaggugcagcugaa

SEQ ID NO: 398267 - RNA, 22 nt, Human
ucagccaguuugauucuauuug

SEQ ID NO: 398268 - RNA, 22 nt, Human
agaaaucaugucuuauuucuau

SEQ ID NO: 398269 - RNA, 22 nt, Human
uucaacuuuaugcauauguauu

SEQ ID NO: 398270 - RNA, 22 nt, Human
uucaacacaggaacaugauaua

SEQ ID NO: 398271 - RNA, 22 nt, Human
acaugcuuugauguauuuugca

SEQ ID NO: 398272 - RNA, 22 nt, Human
uuucaacuagccccuaaguccu

SEQ ID NO: 398273 - RNA, 22 nt, Human
auacagaauuugcccuuuucau

SEQ ID NO: 398274 - RNA, 22 nt, Human
uaauuucaaauuucuuagcgug

SEQ ID NO: 398275 - RNA, 22 nt, Human
aauuucaaugcacucaugguug

SEQ ID NO: 398276 - RNA, 22 nt, Human
caacagucugguuuauauaaua

SEQ ID NO: 398277 - RNA, 22 nt, Human
ugcaggaagcaaccagguccaa

SEQ ID NO: 398278 - RNA, 22 nt, Human
ugcuuuaaaauggacuguuuug

SEQ ID NO: 398279 - RNA, 20 nt, Human
uacaauacacaugcauauga

SEQ ID NO: 398280 - RNA, 22 nt, Human
gaugggauuuuuuauguguuca

SEQ ID NO: 398281 - RNA, 22 nt, Human
uuucaacguguaaucuuauuua

SEQ ID NO: 398282 - RNA, 22 nt, Human
auuccaaagguuaaugcccauu

SEQ ID NO: 398283 - RNA, 22 nt, Human
ccauggcuuucuuucauuguaa

SEQ ID NO: 398284 - RNA, 22 nt, Human
guacagaaauggggccccaggu

SEQ ID NO: 398285 - RNA, 22 nt, Human
acaugucuuuuaaagucuaaua

SEQ ID NO: 398286 - RNA, 22 nt, Human
uagaauucaagauucaacaggc

SEQ ID NO: 398287 - RNA, 22 nt, Human
uuugaacaugcugcaugauaau

SEQ ID NO: 398288 - RNA, 22 nt, Human
uuuaauacuauggggaugaaca

SEQ ID NO: 398289 - RNA, 22 nt, Human
auagaauagcauagaaaauuga

SEQ ID NO: 398290 - RNA, 22 nt, Human
gguacaauggaccauaaaagcu

SEQ ID NO: 398291 - RNA, 22 nt, Human
auacagaauacuaauuccugag

SEQ ID NO: 398292 - RNA, 22 nt, Human
auuuccaagaaagcuuuaggau

SEQ ID NO: 398293 - RNA, 22 nt, Human
auuaggcauuauggggauaagg

SEQ ID NO: 398294 - RNA, 22 nt, Human
gccccagcguggcuguguuagg

SEQ ID NO: 398295 - RNA, 22 nt, Human
aguaaacauuucagauuuauuu

SEQ ID NO: 398296 - RNA, 22 nt, Human
auggcuuugaaguaauguaauu

SEQ ID NO: 398297 - RNA, 22 nt, Human
gcuagaucucucauaaauucca

SEQ ID NO: 398298 - RNA, 22 nt, Human
caauauauaaugaguacuuucc

SEQ ID NO: 398299 - RNA, 22 nt, Human
cagaauuuuucgaauguacugu

SEQ ID NO: 398300 - RNA, 22 nt, Human
gugcauuuaggucacaugaugu

SEQ ID NO: 398301 - RNA, 22 nt, Human
uuuacagaaugucaauuucuau

SEQ ID NO: 398302 - RNA, 22 nt, Human
ccagucacucugugagagcuac

SEQ ID NO: 398303 - RNA, 22 nt, Human
auacuagacuguucuguuauca

SEQ ID NO: 398304 - RNA, 22 nt, Human
aaugaacagauacacauaggca

SEQ ID NO: 398305 - RNA, 22 nt, Human
cugcagagaccuaggucagguu

SEQ ID NO: 398306 - RNA, 22 nt, Human
uguaaauaauuccuaggcuuuu

SEQ ID NO: 398307 - RNA, 22 nt, Human
uggcuuuaggagcuauauaccu

SEQ ID NO: 398308 - RNA, 22 nt, Human
uaaugcuuaauuuucacaagcc

SEQ ID NO: 398309 - RNA, 22 nt, Human
uagcagaaacuguuacagaagg

SEQ ID NO: 398310 - RNA, 23 nt, Human
ugguucuaggccuauaauuauau

SEQ ID NO: 398311 - RNA, 22 nt, Human
caaguccuaaauguauuuguug

SEQ ID NO: 398312 - RNA, 22 nt, Human
uguagaaagaauauguuucaua

SEQ ID NO: 398313 - RNA, 22 nt, Human
gcucuaauugaaaaauacugca

SEQ ID NO: 398314 - RNA, 22 nt, Human
cuagaaauacaggcacgugcca

SEQ ID NO: 398315 - RNA, 22 nt, Human
aauggcuucugaagcacacuuu

SEQ ID NO: 398316 - RNA, 22 nt, Human
aauacuaguuauuaaagcuuuu

SEQ ID NO: 398317 - RNA, 22 nt, Human
augcugaauugaugcgagggag

SEQ ID NO: 398318 - RNA, 22 nt, Human
acuuugaaggggaacauuuuaa

SEQ ID NO: 398319 - RNA, 22 nt, Human
uggcauuugggcuggcuuuucu

SEQ ID NO: 398320 - RNA, 22 nt, Human
uuuaacuuaaucugcuugauga

SEQ ID NO: 398321 - RNA, 22 nt, Human
guagaaauguaaccaggagaua

SEQ ID NO: 398322 - RNA, 23 nt, Human
uggaauaauaagguacauuaaca

SEQ ID NO: 398323 - RNA, 17 nt, Human
caauuucauagguuuug

SEQ ID NO: 398324 - RNA, 22 nt, Human
aaauuucaagcaaaguagcuau

SEQ ID NO: 398325 - RNA, 22 nt, Human
uauccaaaggaacaaucacagc

SEQ ID NO: 398326 - RNA, 22 nt, Human
aaauggauggaaagcaauuuuu

SEQ ID NO: 398327 - RNA, 22 nt, Human
aaaguucaugguguuauagaaa

SEQ ID NO: 398328 - RNA, 22 nt, Human
augugaaauagcuggauaugaa

SEQ ID NO: 398329 - RNA, 22 nt, Human
uagcaucuggagaaacaagucc

SEQ ID NO: 398330 - RNA, 22 nt, Human
uaaacauguugacaucuuaccu

SEQ ID NO: 398331 - RNA, 22 nt, Human
aagccagauuucacucuuaauu

SEQ ID NO: 398332 - RNA, 22 nt, Human
uccuuaauucugugcaauaugu

SEQ ID NO: 398333 - RNA, 22 nt, Human
caauuucaauacaaaauacauu

SEQ ID NO: 398334 - RNA, 22 nt, Human
caguucacacugugcuaucugc

SEQ ID NO: 398335 - RNA, 22 nt, Human
uguccuuauauuguggaagggg

SEQ ID NO: 398336 - RNA, 22 nt, Human
uaaacauggauucugaucacag

SEQ ID NO: 398337 - RNA, 22 nt, Human
gcuauacacauuucuugguagu

SEQ ID NO: 398338 - RNA, 22 nt, Human
gugauuuagauguugaaaguga

SEQ ID NO: 398339 - RNA, 22 nt, Human
ugcugagaucugccaguagaug

SEQ ID NO: 398340 - RNA, 22 nt, Human
aucaguuaguuacugcuaagau

SEQ ID NO: 398341 - RNA, 22 nt, Human
aaaaagguugauccagauuagg

SEQ ID NO: 398342 - RNA, 22 nt, Human
cagauuucuauuucaaauacau

SEQ ID NO: 398343 - RNA, 22 nt, Human
aggauuuaccgucauuuagucu

SEQ ID NO: 398344 - RNA, 22 nt, Human
aaacugauaaaauaaguacauu

SEQ ID NO: 398345 - RNA, 22 nt, Human
ucuggaucccaccgccacacac

SEQ ID NO: 398346 - RNA, 22 nt, Human
gaaguccuccuaucuugcucuu

SEQ ID NO: 398347 - RNA, 22 nt, Human
aaaucagucccucuuggaauuu

SEQ ID NO: 398348 - RNA, 22 nt, Human
gccuuaauuuaugucuaacaua

SEQ ID NO: 398349 - RNA, 21 nt, Human
auggauuuaaacaggccacaa

SEQ ID NO: 398350 - RNA, 22 nt, Human
ucacagcaaaugcugcuucuca

SEQ ID NO: 398351 - RNA, 22 nt, Human
ggaucugauuaauaagguggac

SEQ ID NO: 398352 - RNA, 22 nt, Human
ugaaauagacacagugcuauac

SEQ ID NO: 398353 - RNA, 22 nt, Human
agaaaucauugaauuauuugcu

SEQ ID NO: 398354 - RNA, 22 nt, Human
ucuuuaaugugauuguaauuau

SEQ ID NO: 398355 - RNA, 22 nt, Human
cauuucaauacuaucugagaau

SEQ ID NO: 398356 - RNA, 22 nt, Human
ucuggaucaccacuucugccuc

SEQ ID NO: 398357 - RNA, 22 nt, Human
augaaacaguguguauagcaaa

SEQ ID NO: 398358 - RNA, 22 nt, Human
ucaguaaaugagcaaaaauuuc

SEQ ID NO: 398359 - RNA, 22 nt, Human
uauauaacuacuauuuugcuca

SEQ ID NO: 398360 - RNA, 22 nt, Human
aguguuuaccccaaucaguuua

SEQ ID NO: 398361 - RNA, 22 nt, Human
aauaaugucuuuggcuugacca

SEQ ID NO: 398362 - RNA, 22 nt, Human
uaauuuuuccacguacacuggg

SEQ ID NO: 398363 - RNA, 22 nt, Human
ucagaauuagagcucuucuuga

SEQ ID NO: 398364 - RNA, 22 nt, Human
ucaauucaauugaacaguuacu

SEQ ID NO: 398365 - RNA, 22 nt, Human
agaucugaccuaaccccaccac

SEQ ID NO: 398366 - RNA, 22 nt, Human
uuccucuagcuucucacuaaca

SEQ ID NO: 398367 - RNA, 22 nt, Human
uuacagaagagaaagaauucag

SEQ ID NO: 398368 - RNA, 22 nt, Human
cagauauuaggagcucaauaau

SEQ ID NO: 398369 - RNA, 22 nt, Human
uucuuagaugauuaaugauggg

SEQ ID NO: 398370 - RNA, 22 nt, Human
uaucagaacacauguuuugcag

SEQ ID NO: 398371 - RNA, 22 nt, Human
uuuacagaauguugaauuuggg

SEQ ID NO: 398372 - RNA, 22 nt, Human
aaagccaucaguaaaaugauuu

SEQ ID NO: 398373 - RNA, 22 nt, Human
aguaaaauuucugcugaggaga

SEQ ID NO: 398374 - RNA, 22 nt, Human
ucaauaaauagcuuggcucagc

SEQ ID NO: 398375 - RNA, 22 nt, Human
auauuauucuaguaacagugau

SEQ ID NO: 398376 - RNA, 22 nt, Human
uagaugcuguagaaauacuuau

SEQ ID NO: 398377 - RNA, 22 nt, Human
aagaauucacugguagagucaa

SEQ ID NO: 398378 - RNA, 22 nt, Human
uuuaggcaauagauggcagugu

SEQ ID NO: 398379 - RNA, 22 nt, Human
acaacuuuagucuggagggaaa

SEQ ID NO: 398380 - RNA, 22 nt, Human
uaaguccuagcuuugguaggaa

SEQ ID NO: 398381 - RNA, 22 nt, Human
aaagaaggggucuacauccaau

SEQ ID NO: 398382 - RNA, 22 nt, Human
uacacagaggcugaugucuuag

SEQ ID NO: 398383 - RNA, 22 nt, Human
caugcuuuucaaucuaucuuaa

SEQ ID NO: 398384 - RNA, 22 nt, Human
uuauaacaacaguuuacuuuaa

SEQ ID NO: 398385 - RNA, 20 nt, Human
auaaaauaacugccacaaga

SEQ ID NO: 398386 - RNA, 22 nt, Human
gaugaaaaaagacgagcauaua

SEQ ID NO: 398387 - RNA, 22 nt, Human
aagaaugagcucaaagaucuua

SEQ ID NO: 398388 - RNA, 22 nt, Human
auggguuucccucugaaauuau

SEQ ID NO: 398389 - RNA, 22 nt, Human
augaaauaucuugaagaaauuc

SEQ ID NO: 398390 - RNA, 22 nt, Human
acaauauuguacccagaaguuu

SEQ ID NO: 398391 - RNA, 22 nt, Human
gacauaauccuccucaccuacu

SEQ ID NO: 398392 - RNA, 22 nt, Human
ggcauuuagagggcuuuucuga

SEQ ID NO: 398393 - RNA, 22 nt, Human
auuauagaggguuacaguuaau

SEQ ID NO: 398394 - RNA, 22 nt, Human
augaacaagagagggaagauuc

SEQ ID NO: 398395 - RNA, 22 nt, Human
augaacaaguauuugcaugagc

SEQ ID NO: 398396 - RNA, 22 nt, Human
gaucagaaucuucauuuucagu

SEQ ID NO: 398397 - RNA, 22 nt, Human
acagaauuaucaggaaauguua

SEQ ID NO: 398398 - RNA, 22 nt, Human
auagucacugccuuccauuugu

SEQ ID NO: 398399 - RNA, 22 nt, Human
uacuauaccauguaagauauga

SEQ ID NO: 398400 - RNA, 22 nt, Human
gcuauacaaguguagaauagag

SEQ ID NO: 398401 - RNA, 22 nt, Human
uaagaaucgauguuuauuuaga

SEQ ID NO: 398402 - RNA, 22 nt, Human
uuccuuagugacuucuagcuac

SEQ ID NO: 398403 - RNA, 22 nt, Human
uuacagaaagguugugggauag

SEQ ID NO: 398404 - RNA, 22 nt, Human
aaaugaaaugagugccuggagg

SEQ ID NO: 398405 - RNA, 22 nt, Human
uuacagaaaguuucccaugccg

SEQ ID NO: 398406 - RNA, 22 nt, Human
uuuccauauuuaaucaaaauaa

SEQ ID NO: 398407 - RNA, 22 nt, Human
auuaggcauucaugcagcuccu

SEQ ID NO: 398408 - RNA, 20 nt, Human
aaaaacaguaaugcugaaga

SEQ ID NO: 398409 - RNA, 22 nt, Human
auuaggcauauaugcuuuuaau

SEQ ID NO: 398410 - RNA, 22 nt, Human
auggaucacagugccgugggug

SEQ ID NO: 398411 - RNA, 22 nt, Human
aaauccuuuucuauacagcaua

SEQ ID NO: 398412 - RNA, 22 nt, Human
uucuaacaaguggcuuguuagu

SEQ ID NO: 398413 - RNA, 22 nt, Human
ucagaaauagucuuuaaaauga

SEQ ID NO: 398414 - RNA, 22 nt, Human
ugcagagagauauggcaagagg

SEQ ID NO: 398415 - RNA, 22 nt, Human
aguauaauuagauaucaaaagu

SEQ ID NO: 398416 - RNA, 22 nt, Human
cugugcagcuggcuuccuggaa

SEQ ID NO: 398417 - RNA, 22 nt, Human
uauaaaauucucaguuuggggu

SEQ ID NO: 398418 - RNA, 21 nt, Human
aaauggauagggcaauggaag

SEQ ID NO: 398419 - RNA, 22 nt, Human
aaugguauuugucaagcauagu

SEQ ID NO: 398420 - RNA, 22 nt, Human
cuuacagagaagaaaauguagu

SEQ ID NO: 398421 - RNA, 22 nt, Human
gaugaaaaucuugagaugucga

SEQ ID NO: 398422 - RNA, 22 nt, Human
aguucacagccauguucaugug

SEQ ID NO: 398423 - RNA, 22 nt, Human
ucuuuaauuguggaagagcagc

SEQ ID NO: 398424 - RNA, 22 nt, Human
gaguccuuuucucuguccacug

SEQ ID NO: 398425 - RNA, 21 nt, Human
auacagaagguggcaaaguac

SEQ ID NO: 398426 - RNA, 22 nt, Human
cuauaauuaugcucaaaaugua

SEQ ID NO: 398427 - RNA, 22 nt, Human
guuccaaaguuagaguguauug

SEQ ID NO: 398428 - RNA, 22 nt, Human
agcauuuagucuuuauugcagc

SEQ ID NO: 398429 - RNA, 22 nt, Human
acaacaaagacacuugaaauga

SEQ ID NO: 398430 - RNA, 22 nt, Human
agaagucaauaguuguuugaug

SEQ ID NO: 398431 - RNA, 22 nt, Human
ucuaaagccuuccauauaacgc

SEQ ID NO: 398432 - RNA, 22 nt, Human
auaaagcauacuuuguaugacu

SEQ ID NO: 398433 - RNA, 22 nt, Human
caaauacuaaacauaagauuuu

SEQ ID NO: 398434 - RNA, 22 nt, Human
auagaauuauggaaagcaucuu

SEQ ID NO: 398435 - RNA, 22 nt, Human
aaaugcuuagagguguucaaau

SEQ ID NO: 398436 - RNA, 22 nt, Human
agucauuuugccagucuucagg

SEQ ID NO: 398437 - RNA, 22 nt, Human
ucuuaauucugugucuucacua

SEQ ID NO: 398438 - RNA, 22 nt, Human
cacauacuuguguguacauaug

SEQ ID NO: 398439 - RNA, 22 nt, Human
guuccaaagcaaaggaggugag

SEQ ID NO: 398440 - RNA, 22 nt, Human
auuaggcagggcaugguggcuc

SEQ ID NO: 398441 - RNA, 22 nt, Human
ccuucaaucagcagucuagcuu

SEQ ID NO: 398442 - RNA, 22 nt, Human
uagaacauaagucauucauuug

SEQ ID NO: 398443 - RNA, 20 nt, Human
caauuucaucauuuccugug

SEQ ID NO: 398444 - RNA, 22 nt, Human
auaaaaucagaguuggauugga

SEQ ID NO: 398445 - RNA, 22 nt, Human
aaguccuuuaauaucacauagu

SEQ ID NO: 398446 - RNA, 21 nt, Human
ccaagacucccaucuaguggu

SEQ ID NO: 398447 - RNA, 22 nt, Human
gcagaauuuggggguaaccuuu

SEQ ID NO: 398448 - RNA, 22 nt, Human
gauggcuucacuuacauggcug

SEQ ID NO: 398449 - RNA, 22 nt, Human
uucacagaauggcaaguuaugg

SEQ ID NO: 398450 - RNA, 22 nt, Human
augugcuuuauuaaguaaaaau

SEQ ID NO: 398451 - RNA, 22 nt, Human
uacagauauagagauuuauaga

SEQ ID NO: 398452 - RNA, 22 nt, Human
caauuucauuaauagauauaga

SEQ ID NO: 398453 - RNA, 22 nt, Human
gauuucaagcccccagagauuc

SEQ ID NO: 398454 - RNA, 22 nt, Human
uguagaaauuaguaagaucaac

SEQ ID NO: 398455 - RNA, 22 nt, Human
uaggcagaauuguugaaugaag

SEQ ID NO: 398456 - RNA, 22 nt, Human
aaaucaguuggaacacaagcag

SEQ ID NO: 398457 - RNA, 22 nt, Human
ucaaacagaggaacaauuguuu

SEQ ID NO: 398458 - RNA, 22 nt, Human
uuauccaaacuggugaaucauu

SEQ ID NO: 398459 - RNA, 23 nt, Human
aucaaaggauguagagaagaagc

SEQ ID NO: 398460 - RNA, 22 nt, Human
aucagaaaauacccaguguuua

SEQ ID NO: 398461 - RNA, 22 nt, Human
uucaagacugcgacuaaugccc

SEQ ID NO: 398462 - RNA, 22 nt, Human
aaaagccaagguccucuucaga

SEQ ID NO: 398463 - RNA, 22 nt, Human
ggauucagugucuguuaauagu

SEQ ID NO: 398464 - RNA, 22 nt, Human
auauacugauagcugcacuucu

SEQ ID NO: 398465 - RNA, 22 nt, Human
ggcauuuauuugucucauucuu

SEQ ID NO: 398466 - RNA, 21 nt, Human
uuuaguucaaguacagaacca

SEQ ID NO: 398467 - RNA, 22 nt, Human
aaugucuucaguguauacaugg

SEQ ID NO: 398468 - RNA, 22 nt, Human
gugcauuugacgaauacucacu

SEQ ID NO: 398469 - RNA, 22 nt, Human
cuaacuuuagcuuagauuauca

SEQ ID NO: 398470 - RNA, 22 nt, Human
aucagaaauugcccagcuguuu

SEQ ID NO: 398471 - RNA, 22 nt, Human
uuuucauuuuuguagaugcaag

SEQ ID NO: 398472 - RNA, 23 nt, Human
uguaacaauucccagccuuugcc

SEQ ID NO: 398473 - RNA, 22 nt, Human
ccauggcucuagagauugaaaa

SEQ ID NO: 398474 - RNA, 22 nt, Human
acaacuuugacccuuguucuua

SEQ ID NO: 398475 - RNA, 22 nt, Human
uauaaaacagaaagcacuaccu

SEQ ID NO: 398476 - RNA, 22 nt, Human
agcauauaaauggacauauuug

SEQ ID NO: 398477 - RNA, 22 nt, Human
aauaacuggcacauaucacaua

SEQ ID NO: 398478 - RNA, 22 nt, Human
aaagucauuggaauauuaauga

SEQ ID NO: 398479 - RNA, 22 nt, Human
cagcacagggacaauagcagau

SEQ ID NO: 398480 - RNA, 22 nt, Human
aaucagaacgcucgaucuucgg

SEQ ID NO: 398481 - RNA, 22 nt, Human
aaauucuucagguaauuuugau

SEQ ID NO: 398482 - RNA, 22 nt, Human
ucccaaagcuacucuucugacu

SEQ ID NO: 398483 - RNA, 23 nt, Human
ucuauacauacugcagccucugg

SEQ ID NO: 398484 - RNA, 22 nt, Human
gguaugaauucacuacuuccaa

SEQ ID NO: 398485 - RNA, 22 nt, Human
augugaaauauuaagccgagga

SEQ ID NO: 398486 - RNA, 22 nt, Human
augguuuaaagaguaugacuuu

SEQ ID NO: 398487 - RNA, 22 nt, Human
ucaagacaucacugugcauuuu

SEQ ID NO: 398488 - RNA, 22 nt, Human
caucauaaaauugagauaacug

SEQ ID NO: 398489 - RNA, 22 nt, Human
aaaacuuucagggauacagaaa

SEQ ID NO: 398490 - RNA, 22 nt, Human
aagcauuuauagauaagaauuu

SEQ ID NO: 398491 - RNA, 22 nt, Human
gcguuaauaacauuaauaaugc

SEQ ID NO: 398492 - RNA, 22 nt, Human
caauuucacuaaugaugugggg

SEQ ID NO: 398493 - RNA, 22 nt, Human
aaacagacugcacugccaguca

SEQ ID NO: 398494 - RNA, 22 nt, Human
uagaaaucagcaggcauaugua

SEQ ID NO: 398495 - RNA, 22 nt, Human
uuucaaguguccugauuaaugg

SEQ ID NO: 398496 - RNA, 22 nt, Human
cuuccaaaauuuauauguugaa

SEQ ID NO: 398497 - RNA, 18 nt, Human
aaaaagugcucaggccua

SEQ ID NO: 398498 - RNA, 22 nt, Human
agccagucggggccaugcuggg

SEQ ID NO: 398499 - RNA, 22 nt, Human
gaguccuugacacauaguaggu

SEQ ID NO: 398500 - RNA, 22 nt, Human
caaagucauggggaugcagguc

SEQ ID NO: 398501 - RNA, 22 nt, Human
aagaaaucauaucauuucuugg

SEQ ID NO: 398502 - RNA, 20 nt, Human
caccagucaugagucaauac

SEQ ID NO: 398503 - RNA, 22 nt, Human
caguccuugcucugggaugaug

SEQ ID NO: 398504 - RNA, 22 nt, Human
caaagaagagauuuacagagcu

SEQ ID NO: 398505 - RNA, 22 nt, Human
aggcuucugcugauauuucauu

SEQ ID NO: 398506 - RNA, 22 nt, Human
auguaaaucaagcagugcuggu

SEQ ID NO: 398507 - RNA, 22 nt, Human
uaaaauugcggugaauauuucc

SEQ ID NO: 398508 - RNA, 22 nt, Human
cuagaaauucugauucaguagg

SEQ ID NO: 398509 - RNA, 22 nt, Human
guagaaauauuuaucucugaga

SEQ ID NO: 398510 - RNA, 22 nt, Human
uguucagcccucuauuaaucag

SEQ ID NO: 398511 - RNA, 22 nt, Human
ugcuuauucuuuccacaauuca

SEQ ID NO: 398512 - RNA, 22 nt, Human
aaagccaucuguauuaagugaa

SEQ ID NO: 398513 - RNA, 22 nt, Human
ucuuaauugagaacaguguagg

SEQ ID NO: 398514 - RNA, 19 nt, Human
uuucagacucaucuccagc

SEQ ID NO: 398515 - RNA, 22 nt, Human
uacaugaaguugucuaaacugg

SEQ ID NO: 398516 - RNA, 22 nt, Human
gcuuaauucuggcucaguuucc

SEQ ID NO: 398517 - RNA, 22 nt, Human
cagauuuaagagauaaacagug

SEQ ID NO: 398518 - RNA, 22 nt, Human
uauccaaacauauagucucucu

SEQ ID NO: 398519 - RNA, 22 nt, Human
aauauuucugcagaaugguuuu

SEQ ID NO: 398520 - RNA, 22 nt, Human
augguuuuucaaguauucagaa

SEQ ID NO: 398521 - RNA, 22 nt, Human
uuaaaacagcgugaaucuggca

SEQ ID NO: 398522 - RNA, 22 nt, Human
uuuccaaauaaggucacauucu

SEQ ID NO: 398523 - RNA, 22 nt, Human
ugaauaauccacagucauucau

SEQ ID NO: 398524 - RNA, 22 nt, Human
ugaaauagaaaaacaggcuucu

SEQ ID NO: 398525 - RNA, 22 nt, Human
cauagaaacuugcagcaagcac

SEQ ID NO: 398526 - RNA, 22 nt, Human
aauuuauauguaauuaggcaca

SEQ ID NO: 398527 - RNA, 22 nt, Human
augcaaaauuaccauucuguuc

SEQ ID NO: 398528 - RNA, 22 nt, Human
ucauuucucccggccaaaaacu

SEQ ID NO: 398529 - RNA, 22 nt, Human
ugcuuuaagacacuaaguuuga

SEQ ID NO: 398530 - RNA, 22 nt, Human
caaugucaugauuuuccauuag

SEQ ID NO: 398531 - RNA, 22 nt, Human
ugucaccaguuccaggaaauaa

SEQ ID NO: 398532 - RNA, 22 nt, Human
aucagcaucuuuaacaauuacc

SEQ ID NO: 398533 - RNA, 22 nt, Human
auuucaacauucucaguuguag

SEQ ID NO: 398534 - RNA, 22 nt, Human
uuauccaacaugacuuaugucc

SEQ ID NO: 398535 - RNA, 22 nt, Human
aaguccauucuuccagccagcu

SEQ ID NO: 398536 - RNA, 22 nt, Human
aaagccagguugugugcaggaa

SEQ ID NO: 398537 - RNA, 22 nt, Human
gugaauaacuuucuauguuaau

SEQ ID NO: 398538 - RNA, 22 nt, Human
ccagcugucagugugaaaauaa

SEQ ID NO: 398539 - RNA, 22 nt, Human
uacaagaaauuucugcauauau

SEQ ID NO: 398540 - RNA, 22 nt, Human
uuacagaaaauguguuuuaacu

SEQ ID NO: 398541 - RNA, 19 nt, Human
uauuucaaagugccgucua

SEQ ID NO: 398542 - RNA, 22 nt, Human
ucagaauucugaccuuggguca

SEQ ID NO: 398543 - RNA, 22 nt, Human
agagugaaguuuuugaaaguga

SEQ ID NO: 398544 - RNA, 22 nt, Human
auuuccaauuucauccaugucc

SEQ ID NO: 398545 - RNA, 22 nt, Human
uaaucauggccucaaauuuuau

SEQ ID NO: 398546 - RNA, 22 nt, Human
auuccaaacucuuucccugucg

SEQ ID NO: 398547 - RNA, 22 nt, Human
aauuucaaagcucacuggcaua

SEQ ID NO: 398548 - RNA, 22 nt, Human
auuauauaggacuugcccuucc

SEQ ID NO: 398549 - RNA, 22 nt, Human
uuuauccaccuuacccuguucc

SEQ ID NO: 398550 - RNA, 22 nt, Human
aaugucuugagaagagaaaucu

SEQ ID NO: 398551 - RNA, 22 nt, Human
uucaacuuuggagauuuaauaa

SEQ ID NO: 398552 - RNA, 22 nt, Human
gaguguucccacaccccaguug

SEQ ID NO: 398553 - RNA, 21 nt, Human
agucccauccgguaagcaagc

SEQ ID NO: 398554 - RNA, 23 nt, Human
uucaaaacuggaaaaucagaugc

SEQ ID NO: 398555 - RNA, 22 nt, Human
uuuauccagaaucaggauuuuu

SEQ ID NO: 398556 - RNA, 22 nt, Human
ugcuggaggauuaaacaaguca

SEQ ID NO: 398557 - RNA, 22 nt, Human
uuaacacuccuaacuacagucu

SEQ ID NO: 398558 - RNA, 22 nt, Human
auaugaaaguaagcaugugugu

SEQ ID NO: 398559 - RNA, 20 nt, Human
uauuccaaggguagagaaaa

SEQ ID NO: 398560 - RNA, 22 nt, Human
uuacaaaguguuaugauaaaca

SEQ ID NO: 398561 - RNA, 22 nt, Human
uaucaagugacuaucacagaac

SEQ ID NO: 398562 - RNA, 22 nt, Human
uguucacaaggugaugcuuuga

SEQ ID NO: 398563 - RNA, 22 nt, Human
cuggauuuuagaaggcuuccua

SEQ ID NO: 398564 - RNA, 22 nt, Human
augguuuuccucugcugcuuaa

SEQ ID NO: 398565 - RNA, 22 nt, Human
uacaaaaaauugauacugacga

SEQ ID NO: 398566 - RNA, 22 nt, Human
uggcuuuacugucauucuuaug

SEQ ID NO: 398567 - RNA, 22 nt, Human
uaccaaaagcuuguuucauaca

SEQ ID NO: 398568 - RNA, 22 nt, Human
uuucagacagauucuucucagu

SEQ ID NO: 398569 - RNA, 22 nt, Human
gaucagaaugggacauauccug

SEQ ID NO: 398570 - RNA, 22 nt, Human
gcaaaauuaaacuuagcaucau

SEQ ID NO: 398571 - RNA, 23 nt, Human
aguacaauaaguauaauucuuuc

SEQ ID NO: 398572 - RNA, 22 nt, Human
uaaagaucuuaggaagauuuuc

SEQ ID NO: 398573 - RNA, 22 nt, Human
acagaaugggauuugaauauuu

SEQ ID NO: 398574 - RNA, 22 nt, Human
acacaauacagggcucaaaaua

SEQ ID NO: 398575 - RNA, 22 nt, Human
gaacuuuaaaacaaaguacagu

SEQ ID NO: 398576 - RNA, 22 nt, Human
caaaauuguugaugcugcuuug

SEQ ID NO: 398577 - RNA, 22 nt, Human
ucaacuuugaaaccauagugaa

SEQ ID NO: 398578 - RNA, 22 nt, Human
aaucagaaagaggucauguugc

SEQ ID NO: 398579 - RNA, 22 nt, Human
uguccuuaucuccaaacaauca

SEQ ID NO: 398580 - RNA, 22 nt, Human
cuauacaguaaccacagugauu

SEQ ID NO: 398581 - RNA, 22 nt, Human
agacugaauaacaagcaaauaa

SEQ ID NO: 398582 - RNA, 22 nt, Human
aucagaaaucuaggauucagaa

SEQ ID NO: 398583 - RNA, 22 nt, Human
augguuuacaauguuuucaguu

SEQ ID NO: 398584 - RNA, 22 nt, Human
uucacagaguuauuuuuaugcu

SEQ ID NO: 398585 - RNA, 22 nt, Human
ucauagaagcaccagaagauau

SEQ ID NO: 398586 - RNA, 22 nt, Human
agaacaucuaaauaucugagac

SEQ ID NO: 398587 - RNA, 22 nt, Human
uugauacuauuaagcacugggc

SEQ ID NO: 398588 - RNA, 22 nt, Human
cagaauuuagcacaauguaugg

SEQ ID NO: 398589 - RNA, 22 nt, Human
augugaaaccugugaguagagu

SEQ ID NO: 398590 - RNA, 22 nt, Human
ugaauaaucauguccauagugu

SEQ ID NO: 398591 - RNA, 22 nt, Human
uucagaaaggauaauuggaagg

SEQ ID NO: 398592 - RNA, 22 nt, Human
uuucuaguaaucaauauaaagu

SEQ ID NO: 398593 - RNA, 22 nt, Human
ucagagaaauaauugcugaguu

SEQ ID NO: 398594 - RNA, 22 nt, Human
uuacagaauguucuuccaacag

SEQ ID NO: 398595 - RNA, 22 nt, Human
uauaacaggaaguauucaaaca

SEQ ID NO: 398596 - RNA, 22 nt, Human
gugauuuaguguuaaguauguu

SEQ ID NO: 398597 - RNA, 22 nt, Human
gaaauagacacuuucuaugaau

SEQ ID NO: 398598 - RNA, 22 nt, Human
gccagucugcucccacaaguuc

SEQ ID NO: 398599 - RNA, 22 nt, Human
uuugaaguggaaaaggauuuaa

SEQ ID NO: 398600 - RNA, 22 nt, Human
acauaauagcauuucuaauuug

SEQ ID NO: 398601 - RNA, 22 nt, Human
caacuuugugugaccuagauag

SEQ ID NO: 398602 - RNA, 22 nt, Human
ucuuuaaucauaaccaagaugg

SEQ ID NO: 398603 - RNA, 22 nt, Human
caaagauuuuagaauuugcaau

SEQ ID NO: 398604 - RNA, 22 nt, Human
acagguuugucugauguaauga

SEQ ID NO: 398605 - RNA, 22 nt, Human
caauuucacuaauaauauuuac

SEQ ID NO: 398606 - RNA, 21 nt, Human
gaguccuuccaauguccucag

SEQ ID NO: 398607 - RNA, 22 nt, Human
auaaagauuuuuaggcauuucu

SEQ ID NO: 398608 - RNA, 22 nt, Human
agcacauaccagaaccacaggu

SEQ ID NO: 398609 - RNA, 22 nt, Human
aaauauaguaaaugcauaguuc

SEQ ID NO: 398610 - RNA, 22 nt, Human
aaagucauggaaaaucuuggaa

SEQ ID NO: 398611 - RNA, 22 nt, Human
uuccaaaguuaguuauuagaaa

SEQ ID NO: 398612 - RNA, 22 nt, Human
auaaaauuugcuacuguuaaau

SEQ ID NO: 398613 - RNA, 22 nt, Human
uacuuguagcagguggcauuua

SEQ ID NO: 398614 - RNA, 22 nt, Human
uuccuuagggucagccagaucu

SEQ ID NO: 398615 - RNA, 22 nt, Human
uuuaggcacagaguugagggac

SEQ ID NO: 398616 - RNA, 22 nt, Human
uuuccaaaaguuuguucugugc

SEQ ID NO: 398617 - RNA, 22 nt, Human
cuucuuaaucccuuauauauuu

SEQ ID NO: 398618 - RNA, 22 nt, Human
ugaaacuaggccaaucaaauua

SEQ ID NO: 398619 - RNA, 22 nt, Human
aggauuuacuagcaaggauucu

SEQ ID NO: 398620 - RNA, 22 nt, Human
aauuccaaguagcaucccauca

SEQ ID NO: 398621 - RNA, 22 nt, Human
aggauuuacaaugauucuaggu

SEQ ID NO: 398622 - RNA, 22 nt, Human
uuugaagacauauuguuacaua

SEQ ID NO: 398623 - RNA, 22 nt, Human
uaugucaaaguuaagaaauagg

SEQ ID NO: 398624 - RNA, 22 nt, Human
aaaguccuguuugaaggaccug

SEQ ID NO: 398625 - RNA, 22 nt, Human
uauacuuuccugcaacuuugau

SEQ ID NO: 398626 - RNA, 22 nt, Human
aaacaaacaauuaguugugugg

SEQ ID NO: 398627 - RNA, 22 nt, Human
caaauucaaugaacauguuuaa

SEQ ID NO: 398628 - RNA, 22 nt, Human
aucaagaacuuauuuuggaaau

SEQ ID NO: 398629 - RNA, 22 nt, Human
augaaacagugaauuagucaag

SEQ ID NO: 398630 - RNA, 22 nt, Human
aaguucuaauuuugcauucagg

SEQ ID NO: 398631 - RNA, 22 nt, Human
ucaacuuuaguguagcuauuua

SEQ ID NO: 398632 - RNA, 22 nt, Human
auaaagcaagcauaccauuaag

SEQ ID NO: 398633 - RNA, 22 nt, Human
uuucagacaggacuucauaugu

SEQ ID NO: 398634 - RNA, 22 nt, Human
uagcaucuguucuuucauuaaa

SEQ ID NO: 398635 - RNA, 22 nt, Human
uucugaaaauugggucauacuu

SEQ ID NO: 398636 - RNA, 22 nt, Human
auccaaagauggaaagaacuuu

SEQ ID NO: 398637 - RNA, 22 nt, Human
gagacaggauuuaaccaaagcu

SEQ ID NO: 398638 - RNA, 22 nt, Human
agaucugaaucucauccgagga

SEQ ID NO: 398639 - RNA, 22 nt, Human
aaagccuuugucucaggcucug

SEQ ID NO: 398640 - RNA, 22 nt, Human
ugaaugaauccuaacaaagaca

SEQ ID NO: 398641 - RNA, 22 nt, Human
caguccuugcucaaagucuaca

SEQ ID NO: 398642 - RNA, 22 nt, Human
auccuuaguuaagaacaggagu

SEQ ID NO: 398643 - RNA, 22 nt, Human
aauuaauggaaaguaaggaagg

SEQ ID NO: 398644 - RNA, 22 nt, Human
auggcuuuuuagacuuugguac

SEQ ID NO: 398645 - RNA, 22 nt, Human
augcaaaauaaggcagaaacau

SEQ ID NO: 398646 - RNA, 22 nt, Human
aguguuuagcaugaaguucauu

SEQ ID NO: 398647 - RNA, 22 nt, Human
gaugaaaaauugcugugucaua

SEQ ID NO: 398648 - RNA, 22 nt, Human
auacaugugggucuaaacauau

SEQ ID NO: 398649 - RNA, 22 nt, Human
auuccaaagcacaucagaacua

SEQ ID NO: 398650 - RNA, 22 nt, Human
gaguucuaaaggcagaacauaa

SEQ ID NO: 398651 - RNA, 22 nt, Human
uucuucaaaauccagcaugauu

SEQ ID NO: 398652 - RNA, 22 nt, Human
aucuaaaguguuucaugaaaga

SEQ ID NO: 398653 - RNA, 22 nt, Human
acauucacuauguccaaacucu

SEQ ID NO: 398654 - RNA, 22 nt, Human
agaucacagcccccagaugcca

SEQ ID NO: 398655 - RNA, 23 nt, Human
uuccuuaacuguuaagauugucu

SEQ ID NO: 398656 - RNA, 22 nt, Human
gaaguccugguccucucauuca

SEQ ID NO: 398657 - RNA, 22 nt, Human
ccguagcacaugcuccuggggc

SEQ ID NO: 398658 - RNA, 22 nt, Human
uucaauucuaaacuaauauucu

SEQ ID NO: 398659 - RNA, 22 nt, Human
agaaaugcucaggucaacuuaa

SEQ ID NO: 398660 - RNA, 22 nt, Human
auaaagucuaccguauuaaaga

SEQ ID NO: 398661 - RNA, 22 nt, Human
uugaauaaaugagcagugaauu

SEQ ID NO: 398662 - RNA, 22 nt, Human
aucagaauaauuagauuucaga

SEQ ID NO: 398663 - RNA, 22 nt, Human
gauuucaauccagcuuucuucu

SEQ ID NO: 398664 - RNA, 20 nt, Human
aucaaaggcugauucagucc

SEQ ID NO: 398665 - RNA, 22 nt, Human
auggcauuugaaucugucuuuu

SEQ ID NO: 398666 - RNA, 22 nt, Human
uucacagagagaacucaaacca

SEQ ID NO: 398667 - RNA, 22 nt, Human
aaauagauugcugaggcauuac

SEQ ID NO: 398668 - RNA, 22 nt, Human
gcagaauuggauaguugugaua

SEQ ID NO: 398669 - RNA, 22 nt, Human
ggcauuuaguuuucauauucug

SEQ ID NO: 398670 - RNA, 22 nt, Human
uucauuaauucauucagugacu

SEQ ID NO: 398671 - RNA, 22 nt, Human
uauaaaauggcaucagcuccaa

SEQ ID NO: 398672 - RNA, 20 nt, Human
aauaaacuacugagagaugu

SEQ ID NO: 398673 - RNA, 22 nt, Human
aacauguaucgcuuuuuaauau

SEQ ID NO: 398674 - RNA, 16 nt, Human
uuuccaaagggcagcu

SEQ ID NO: 398675 - RNA, 22 nt, Human
ugagauuuguuuuauaaaauag

SEQ ID NO: 398676 - RNA, 22 nt, Human
acuuugaaacuaaaauucauua

SEQ ID NO: 398677 - RNA, 22 nt, Human
ggauuugaauuguugaaaugau

SEQ ID NO: 398678 - RNA, 22 nt, Human
uuuaggcagcuacauacuaacu

SEQ ID NO: 398679 - RNA, 22 nt, Human
uacaagaaugucuuaaaagcuc

SEQ ID NO: 398680 - RNA, 22 nt, Human
agagauucauguuuacuguagg

SEQ ID NO: 398681 - RNA, 22 nt, Human
aaguccuuaggaagcagucguu

SEQ ID NO: 398682 - RNA, 20 nt, Human
acaauacagguugugucuga

SEQ ID NO: 398683 - RNA, 23 nt, Human
gagauuuagcagacaaagcucuu

SEQ ID NO: 398684 - RNA, 22 nt, Human
uugauccaguugaaagugauga

SEQ ID NO: 398685 - RNA, 22 nt, Human
cuuaauuacuguccaauaugca

SEQ ID NO: 398686 - RNA, 22 nt, Human
aaauccuuuggaggacaugaug

SEQ ID NO: 398687 - RNA, 22 nt, Human
uauauuaaaugaccaguuuuaa

SEQ ID NO: 398688 - RNA, 22 nt, Human
agaagugagugugacucagcag

SEQ ID NO: 398689 - RNA, 22 nt, Human
ucuggaucgccggcgccugggc

SEQ ID NO: 398690 - RNA, 22 nt, Human
gauuuacagcuauacccaaugg

SEQ ID NO: 398691 - RNA, 22 nt, Human
augaaaauugacagcggaagua

SEQ ID NO: 398692 - RNA, 22 nt, Human
aguacaauuuaaugaagauagc

SEQ ID NO: 398693 - RNA, 22 nt, Human
uggauuuaguucuucacaggcc

SEQ ID NO: 398694 - RNA, 22 nt, Human
aagaaaucagaaaagcauucgu

SEQ ID NO: 398695 - RNA, 22 nt, Human
aucuaaacagguguucuuuaga

SEQ ID NO: 398696 - RNA, 22 nt, Human
ucuaaacagccucuuaccaacu

SEQ ID NO: 398697 - RNA, 20 nt, Human
caucagaaauccugacccac

SEQ ID NO: 398698 - RNA, 22 nt, Human
cuuuaacaaaugacucuugucu

SEQ ID NO: 398699 - RNA, 22 nt, Human
ucaguaaacagguuuaaguccu

SEQ ID NO: 398700 - RNA, 22 nt, Human
uccuggauaucaaacaaacauu

SEQ ID NO: 398701 - RNA, 22 nt, Human
aauguucauugauuaaaugaau

SEQ ID NO: 398702 - RNA, 22 nt, Human
uuugaagauaaauauggagaaa

SEQ ID NO: 398703 - RNA, 22 nt, Human
gaaauauacaugaagucggcug

SEQ ID NO: 398704 - RNA, 22 nt, Human
uuaacacuaucugucauaauua

SEQ ID NO: 398705 - RNA, 22 nt, Human
auauacaggugguauguguaaa

SEQ ID NO: 398706 - RNA, 22 nt, Human
uuuccaaagcugaguugagcaa

SEQ ID NO: 398707 - RNA, 22 nt, Human
auugaaaauaaggccagaaaca

SEQ ID NO: 398708 - RNA, 22 nt, Human
agaauaauacugaaaugcugaa

SEQ ID NO: 398709 - RNA, 22 nt, Human
auacagaacaagccucaccucc

SEQ ID NO: 398710 - RNA, 21 nt, Human
accaaaaccuauacuuucugu

SEQ ID NO: 398711 - RNA, 22 nt, Human
cauuucaaggaccacccuggga

SEQ ID NO: 398712 - RNA, 22 nt, Human
ucagaacauugacauucuuauu

SEQ ID NO: 398713 - RNA, 22 nt, Human
gaaguucaaaagacagauuuga

SEQ ID NO: 398714 - RNA, 22 nt, Human
guacagaaaguacccauagaag

SEQ ID NO: 398715 - RNA, 22 nt, Human
uuuacagaugaggaaacugaga

SEQ ID NO: 398716 - RNA, 22 nt, Human
ccaugcacaccagcaggcagac

SEQ ID NO: 398717 - RNA, 22 nt, Human
uuugaagauuaugccagaguga

SEQ ID NO: 398718 - RNA, 16 nt, Human
ccuggauccccugugg

SEQ ID NO: 398719 - RNA, 22 nt, Human
uuggaucagaugauaucuuugu

SEQ ID NO: 398720 - RNA, 22 nt, Human
gagauuuaauuggauuaacuua

SEQ ID NO: 398721 - RNA, 22 nt, Human
aaaugcuuauuagugucacaaa

SEQ ID NO: 398722 - RNA, 18 nt, Human
uaaauauauuucccccuu

SEQ ID NO: 398723 - RNA, 22 nt, Human
auacaucaugcuccauauauuu

SEQ ID NO: 398724 - RNA, 22 nt, Human
uucaauacaaagaaaggaauuu

SEQ ID NO: 398725 - RNA, 22 nt, Human
agauauaauaauuuacaagugu

SEQ ID NO: 398726 - RNA, 22 nt, Human
uuauuaaugaguacaaguuauu

SEQ ID NO: 398727 - RNA, 22 nt, Human
cuggcuuuaacccuacaaaccu

SEQ ID NO: 398728 - RNA, 22 nt, Human
cuuaggcaagcagagcccaucc

SEQ ID NO: 398729 - RNA, 22 nt, Human
aauuucaaacuaauaggaacca

SEQ ID NO: 398730 - RNA, 22 nt, Human
ugcuauacauguacauauuagu

SEQ ID NO: 398731 - RNA, 22 nt, Human
ucagccaguuuguuuauuccgg

SEQ ID NO: 398732 - RNA, 22 nt, Human
caagaaucuugcagcuuagacu

SEQ ID NO: 398733 - RNA, 22 nt, Human
uuuacagagaauguacauaaag

SEQ ID NO: 398734 - RNA, 23 nt, Human
gaaucaguggcuaacaaggaaac

SEQ ID NO: 398735 - RNA, 20 nt, Human
uuuaggcauuacucuuuugu

SEQ ID NO: 398736 - RNA, 22 nt, Human
uuacagaaaggaaggacugacu

SEQ ID NO: 398737 - RNA, 22 nt, Human
aaaguguacuaugucaugaaca

SEQ ID NO: 398738 - RNA, 22 nt, Human
cuuucaacuacauacaggcgau

SEQ ID NO: 398739 - RNA, 22 nt, Human
acaguccuuguguggaacauua

SEQ ID NO: 398740 - RNA, 21 nt, Human
caagccagaccaauagcagcc

SEQ ID NO: 398741 - RNA, 22 nt, Human
ugguuuaaccugucucuuauua

SEQ ID NO: 398742 - RNA, 22 nt, Human
gauagaaagagugguucuuuuu

SEQ ID NO: 398743 - RNA, 22 nt, Human
gugcuucaaguucuuaauguuu

SEQ ID NO: 398744 - RNA, 22 nt, Human
guaaacaucagccacucuauuu

SEQ ID NO: 398745 - RNA, 22 nt, Human
uguauacauuuaacuagauaga

SEQ ID NO: 398746 - RNA, 22 nt, Human
gaauuacaugacccugaguaga

SEQ ID NO: 398747 - RNA, 18 nt, Human
caagaaucucuaaagaag

SEQ ID NO: 398748 - RNA, 22 nt, Human
uauggcuugucuuuauaccagg

SEQ ID NO: 398749 - RNA, 21 nt, Human
ucagagaacccggcaggcaag

SEQ ID NO: 398750 - RNA, 22 nt, Human
aaaaccugauugaauucuauuu

SEQ ID NO: 398751 - RNA, 22 nt, Human
cagaaaucauugugaugacagg

SEQ ID NO: 398752 - RNA, 22 nt, Human
gaugauaacagcauuucaacug

SEQ ID NO: 398753 - RNA, 22 nt, Human
aaauauagcaauuaugccuacu

SEQ ID NO: 398754 - RNA, 22 nt, Human
uuuaauauucugcauucuccuu

SEQ ID NO: 398755 - RNA, 22 nt, Human
ucuauacacacaaagaaugcuu

SEQ ID NO: 398756 - RNA, 22 nt, Human
uggcuuuauaaauccacugguu

SEQ ID NO: 398757 - RNA, 22 nt, Human
ucaguucaguauacacuauucu

SEQ ID NO: 398758 - RNA, 22 nt, Human
uaaagccauacugaaagccacu

SEQ ID NO: 398759 - RNA, 22 nt, Human
aggaucugugagugcugcagac

SEQ ID NO: 398760 - RNA, 22 nt, Human
gaagugaagguuacucuagauu

SEQ ID NO: 398761 - RNA, 22 nt, Human
aaaaccuucagguuuggaguuu

SEQ ID NO: 398762 - RNA, 22 nt, Human
gaguccuuuguuccuugccaca

SEQ ID NO: 398763 - RNA, 22 nt, Human
acuuuuaaggggccuugauuua

SEQ ID NO: 398764 - RNA, 22 nt, Human
ugcagggcccucauuccugucc

SEQ ID NO: 398765 - RNA, 22 nt, Human
ugcagagaagaggacaguucua

SEQ ID NO: 398766 - RNA, 22 nt, Human
gucacagaguuauuaauugugu

SEQ ID NO: 398767 - RNA, 22 nt, Human
ucaguuuccucaucuacaaaag

SEQ ID NO: 398768 - RNA, 22 nt, Human
cuuugaagauggcaaauuuaga

SEQ ID NO: 398769 - RNA, 23 nt, Human
augcaagaguuucucaaacugga

SEQ ID NO: 398770 - RNA, 22 nt, Human
gugaauaauuuuuuaguauaag

SEQ ID NO: 398771 - RNA, 22 nt, Human
aauacugucuuucacagauauu

SEQ ID NO: 398772 - RNA, 22 nt, Human
acaacuuuguagcaauuccacg

SEQ ID NO: 398773 - RNA, 22 nt, Human
auacagaagccuguauuucugg

SEQ ID NO: 398774 - RNA, 22 nt, Human
uaucagaaugcagccaugugca

SEQ ID NO: 398775 - RNA, 22 nt, Human
uagaauaaguugaugauauaug

SEQ ID NO: 398776 - RNA, 22 nt, Human
uuaauucuaguuuaacacuuag

SEQ ID NO: 398777 - RNA, 22 nt, Human
uaagaaucugcauuuuaacaag

SEQ ID NO: 398778 - RNA, 22 nt, Human
gaucugaaucaauagaauaacu

SEQ ID NO: 398779 - RNA, 22 nt, Human
uucuuaaucuguguggguucga

SEQ ID NO: 398780 - RNA, 22 nt, Human
cugaauaauguucucuuguaug

SEQ ID NO: 398781 - RNA, 22 nt, Human
auaaaaguucaagagaguacag

SEQ ID NO: 398782 - RNA, 22 nt, Human
uguucacaucgauggauuuugc

SEQ ID NO: 398783 - RNA, 22 nt, Human
uuacauaacgguaugaaaaaug

SEQ ID NO: 398784 - RNA, 22 nt, Human
ucauauaaguuuaaaacuaucu

SEQ ID NO: 398785 - RNA, 19 nt, Human
gaaguccucuaguaaauuu

SEQ ID NO: 398786 - RNA, 22 nt, Human
caauuucauggauaaaagaugu

SEQ ID NO: 398787 - RNA, 22 nt, Human
ucagaaaagagaaaaucuuaua

SEQ ID NO: 398788 - RNA, 22 nt, Human
uaaugcuuuuccuucaaauaag

SEQ ID NO: 398789 - RNA, 23 nt, Human
augaaugaauaaggcaggaaagc

SEQ ID NO: 398790 - RNA, 18 nt, Human
gaaagccaugcagcagug

SEQ ID NO: 398791 - RNA, 22 nt, Human
uguccuuacaaggucccuuucg

SEQ ID NO: 398792 - RNA, 22 nt, Human
uuuccaaaggaguaccacgcau

SEQ ID NO: 398793 - RNA, 19 nt, Human
ugcuuaauuccuaguaggu

SEQ ID NO: 398794 - RNA, 22 nt, Human
aguucacauaucuguuuuauuu

SEQ ID NO: 398795 - RNA, 22 nt, Human
uaauuucaaguuuagggcucua

SEQ ID NO: 398796 - RNA, 22 nt, Human
uaguccuuacuuacuagaauaa

SEQ ID NO: 398797 - RNA, 22 nt, Human
uacagacaguuuuucagauauu

SEQ ID NO: 398798 - RNA, 21 nt, Human
cuacagaaucgagcauucugg

SEQ ID NO: 398799 - RNA, 22 nt, Human
aaauugcaaaaguacuuuuagg

SEQ ID NO: 398800 - RNA, 22 nt, Human
ucaccgucgggggucgcugucu

SEQ ID NO: 398801 - RNA, 22 nt, Human
acuuugaaucucagauaaccaa

SEQ ID NO: 398802 - RNA, 22 nt, Human
cuggaagagcauuugcauaggg

SEQ ID NO: 398803 - RNA, 22 nt, Human
ggccuuuaagcaauugaaaaga

SEQ ID NO: 398804 - RNA, 22 nt, Human
uauggaaauaauuagacaagug

SEQ ID NO: 398805 - RNA, 22 nt, Human
aaauacuguagauaauagaguu

SEQ ID NO: 398806 - RNA, 22 nt, Human
uaguccuugguaaaauucuaug

SEQ ID NO: 398807 - RNA, 22 nt, Human
acuauaaccuguuagaauagau

SEQ ID NO: 398808 - RNA, 22 nt, Human
caguaaaugcagauauagauac

SEQ ID NO: 398809 - RNA, 22 nt, Human
uuuauuaugauggacaccuucg

SEQ ID NO: 398810 - RNA, 22 nt, Human
uacaggaaguaaguaaugaaau

SEQ ID NO: 398811 - RNA, 22 nt, Human
cuggaucaugggaaagggauca

SEQ ID NO: 398812 - RNA, 22 nt, Human
caaacauucaaguacaagucuu

SEQ ID NO: 398813 - RNA, 22 nt, Human
ggcauuaagaauaucauuaaaa

SEQ ID NO: 398814 - RNA, 22 nt, Human
uuuauuauguacaggcacuaua

SEQ ID NO: 398815 - RNA, 22 nt, Human
cagaaaaggaagagcuauguaa

SEQ ID NO: 398816 - RNA, 22 nt, Human
guacagaaggauuucuaguagu

SEQ ID NO: 398817 - RNA, 19 nt, Human
agauuuaccucauauaguu

SEQ ID NO: 398818 - RNA, 22 nt, Human
caauuuuuguacuuauaguacu

SEQ ID NO: 398819 - RNA, 22 nt, Human
aaaugcuuguaaauuuuccaug

SEQ ID NO: 398820 - RNA, 22 nt, Human
gauggcuuugugcaccaugauu

SEQ ID NO: 398821 - RNA, 22 nt, Human
guucuaauaggagaaaagacag

SEQ ID NO: 398822 - RNA, 22 nt, Human
cacaauuuccaagucauguuau

SEQ ID NO: 398823 - RNA, 22 nt, Human
aaucagaacuccuaccacagag

SEQ ID NO: 398824 - RNA, 22 nt, Human
auuauucaacacuugagaaauu

SEQ ID NO: 398825 - RNA, 22 nt, Human
uauuuauaccaggugaucggag

SEQ ID NO: 398826 - RNA, 22 nt, Human
uaaauacagucauuugagccau

SEQ ID NO: 398827 - RNA, 22 nt, Human
aaguccuuguauacagaaucaa

SEQ ID NO: 398828 - RNA, 22 nt, Human
uaugcccagcuuaaaguacaca

SEQ ID NO: 398829 - RNA, 22 nt, Human
caaguccaucagauaagcaaga

SEQ ID NO: 398830 - RNA, 22 nt, Human
cuuaaccagaaaaugcacuugu

SEQ ID NO: 398831 - RNA, 22 nt, Human
uuugaaguguuauuucuaucac

SEQ ID NO: 398832 - RNA, 22 nt, Human
aagaaugauuacaaagcaacga

SEQ ID NO: 398833 - RNA, 22 nt, Human
ugauuuaugcauuauacuguug

SEQ ID NO: 398834 - RNA, 22 nt, Human
auggcuuuguuccaauaaaacu

SEQ ID NO: 398835 - RNA, 22 nt, Human
uucaaagcugcagacuccuggg

SEQ ID NO: 398836 - RNA, 22 nt, Human
aguuauccgaaggcacugagau

SEQ ID NO: 398837 - RNA, 22 nt, Human
uucaccgugaaccgauuccuca

SEQ ID NO: 398838 - RNA, 22 nt, Human
uaguccuuuccggcugcuauaa

SEQ ID NO: 398839 - RNA, 22 nt, Human
uuuucuuaggugcuccaaguag

SEQ ID NO: 398840 - RNA, 22 nt, Human
aauaauauuugaagcuucaaag

SEQ ID NO: 398841 - RNA, 22 nt, Human
ugaaaagacugcaagagagcau

SEQ ID NO: 398842 - RNA, 22 nt, Human
uacaauacuuaaccuauuuugc

SEQ ID NO: 398843 - RNA, 22 nt, Human
gcauggcugguguccugaggga

SEQ ID NO: 398844 - RNA, 22 nt, Human
uugaauaauuaauuacacucag

SEQ ID NO: 398845 - RNA, 22 nt, Human
aucagaaauagucauguuacuu

SEQ ID NO: 398846 - RNA, 22 nt, Human
ucauaaaaguacucauguucau

SEQ ID NO: 398847 - RNA, 22 nt, Human
gaguccuucuggcuggcaggau

SEQ ID NO: 398848 - RNA, 22 nt, Human
cuuuacauaaggauaaaccugg

SEQ ID NO: 398849 - RNA, 20 nt, Human
acuggaucuggcuggagcug

SEQ ID NO: 398850 - RNA, 22 nt, Human
auacauaauuacuuccgauguu

SEQ ID NO: 398851 - RNA, 22 nt, Human
cuuaaagaugucaaggcuguuu

SEQ ID NO: 398852 - RNA, 22 nt, Human
cauggcuucuaagugauaacgu

SEQ ID NO: 398853 - RNA, 22 nt, Human
uuacaagauuaauuauuggagu

SEQ ID NO: 398854 - RNA, 22 nt, Human
uagaaacaucagcuaaccaaaa

SEQ ID NO: 398855 - RNA, 22 nt, Human
auuaaauguuggacguauacau

SEQ ID NO: 398856 - RNA, 22 nt, Human
gccuaauaacuagcuguguaac

SEQ ID NO: 398857 - RNA, 22 nt, Human
aucauaaaauugcaccauuucu

SEQ ID NO: 398858 - RNA, 22 nt, Human
auagacauagccguaauuuauu

SEQ ID NO: 398859 - RNA, 22 nt, Human
agucaccaggguuugcuggguu

SEQ ID NO: 398860 - RNA, 22 nt, Human
gcaaacaaggacauacauccug

SEQ ID NO: 398861 - RNA, 22 nt, Human
agaaaaacuaagaguggguggu

SEQ ID NO: 398862 - RNA, 22 nt, Human
ccuucaaucuuaagucagccca

SEQ ID NO: 398863 - RNA, 21 nt, Human
acaugucuggucauuuuuagc

SEQ ID NO: 398864 - RNA, 22 nt, Human
acuauacauugaauguuaaggu

SEQ ID NO: 398865 - RNA, 22 nt, Human
caaaagucuguccuuuaacuuc

SEQ ID NO: 398866 - RNA, 22 nt, Human
augacaaaagaagacaugaggu

SEQ ID NO: 398867 - RNA, 22 nt, Human
cugauacauaguagcaugucau

SEQ ID NO: 398868 - RNA, 22 nt, Human
acuuauuagcugugugaccuug

SEQ ID NO: 398869 - RNA, 22 nt, Human
agaaagcaucuccauuguaggu

SEQ ID NO: 398870 - RNA, 22 nt, Human
ucauaauacaaagaguucugca

SEQ ID NO: 398871 - RNA, 22 nt, Human
ucagaauucuacaauagaucag

SEQ ID NO: 398872 - RNA, 22 nt, Human
aaugcaaagcaagcagagauuu

SEQ ID NO: 398873 - RNA, 22 nt, Human
ucaauacuuaagcuuaauucua

SEQ ID NO: 398874 - RNA, 22 nt, Human
ugcuuaaacacauacauacaua

SEQ ID NO: 398875 - RNA, 22 nt, Human
acagcauugagagcuaaauuua

SEQ ID NO: 398876 - RNA, 22 nt, Human
aaagucaucauuucuuuucaaa

SEQ ID NO: 398877 - RNA, 22 nt, Human
uauacaauggcugaaucaucca

SEQ ID NO: 398878 - RNA, 22 nt, Human
uagauauaucugucauacuggu

SEQ ID NO: 398879 - RNA, 22 nt, Human
aaaucaguuaagaugaggccau

SEQ ID NO: 398880 - RNA, 22 nt, Human
aggauuuauuauaugcccucau

SEQ ID NO: 398881 - RNA, 22 nt, Human
caauuuuuuccaugcucuuaca

SEQ ID NO: 398882 - RNA, 22 nt, Human
gauuucaaagguucugcaugcc

SEQ ID NO: 398883 - RNA, 20 nt, Human
guaaaauauggucuuugggu

SEQ ID NO: 398884 - RNA, 22 nt, Human
gaauaaucaugaaauucaguga

SEQ ID NO: 398885 - RNA, 22 nt, Human
acuagaaacuaauggauuauua

SEQ ID NO: 398886 - RNA, 22 nt, Human
ugcuuaauagugcacugguuuc

SEQ ID NO: 398887 - RNA, 22 nt, Human
uguccuuaaggagcuuaauguc

SEQ ID NO: 398888 - RNA, 22 nt, Human
aaucagaauuuauugaaucuuu

SEQ ID NO: 398889 - RNA, 22 nt, Human
uaaagacacugguuuuaaucau

SEQ ID NO: 398890 - RNA, 22 nt, Human
uuaaaauuauggcccauuugga

SEQ ID NO: 398891 - RNA, 20 nt, Human
uauggcuuggcaaagcuuca

SEQ ID NO: 398892 - RNA, 22 nt, Human
cucauacauaugccauuccugc

SEQ ID NO: 398893 - RNA, 22 nt, Human
uaaguccuauuccaggucucuc

SEQ ID NO: 398894 - RNA, 22 nt, Human
gcaacuuucaagcaccaugggg

SEQ ID NO: 398895 - RNA, 22 nt, Human
uuugaagacagaucaauauaag

SEQ ID NO: 398896 - RNA, 21 nt, Human
aaagaaucauggguaauuuca

SEQ ID NO: 398897 - RNA, 22 nt, Human
uaaacagaaugcguaagaagug

SEQ ID NO: 398898 - RNA, 22 nt, Human
uuuauacauggagaauuuuugc

SEQ ID NO: 398899 - RNA, 21 nt, Human
uaucagaagagaaagaaugau

SEQ ID NO: 398900 - RNA, 22 nt, Human
aauauaaugcuguuuuaugcca

SEQ ID NO: 398901 - RNA, 22 nt, Human
auggcuuugcucaaguuuagcc

SEQ ID NO: 398902 - RNA, 21 nt, Human
caaucaguuggcauuugagca

SEQ ID NO: 398903 - RNA, 22 nt, Human
augguuuaagggagaauauuga

SEQ ID NO: 398904 - RNA, 22 nt, Human
ugugugaaggaauauauacuca

SEQ ID NO: 398905 - RNA, 22 nt, Human
agaauaaucacugaaguucaaa

SEQ ID NO: 398906 - RNA, 22 nt, Human
ccuggaucuaaggaagcuggga

SEQ ID NO: 398907 - RNA, 22 nt, Human
agguacaaaagaguauaugaga

SEQ ID NO: 398908 - RNA, 22 nt, Human
uuucaacuuguuugcuuccaua

SEQ ID NO: 398909 - RNA, 22 nt, Human
uauuaaagggaaguuaugcaug

SEQ ID NO: 398910 - RNA, 22 nt, Human
gaauuucaacaguccucaaaug

SEQ ID NO: 398911 - RNA, 22 nt, Human
aguuaucagguguuuucaugga

SEQ ID NO: 398912 - RNA, 22 nt, Human
cuuaggcagggcuggaagaucu

SEQ ID NO: 398913 - RNA, 17 nt, Human
uaaagccagucaaguca

SEQ ID NO: 398914 - RNA, 22 nt, Human
guuaggcagugugguauagcag

SEQ ID NO: 398915 - RNA, 21 nt, Human
gauuugcagaaacuagacagg

SEQ ID NO: 398916 - RNA, 22 nt, Human
agcucacaguguccuuccucaa

SEQ ID NO: 398917 - RNA, 22 nt, Human
gguacaaugguucauuuuaugu

SEQ ID NO: 398918 - RNA, 22 nt, Human
guuuaaucagaggaauuauaga

SEQ ID NO: 398919 - RNA, 22 nt, Human
uuuaggcagaacauggacuuug

SEQ ID NO: 398920 - RNA, 22 nt, Human
uggauuagguacuaugaauaua

SEQ ID NO: 398921 - RNA, 22 nt, Human
uuucaguuagcugagacccagg

SEQ ID NO: 398922 - RNA, 22 nt, Human
gugaauaauauuguuuauaaaa

SEQ ID NO: 398923 - RNA, 21 nt, Human
uucaaagacuugaugcugacc

SEQ ID NO: 398924 - RNA, 22 nt, Human
acaugcuuguuuuucacaaccu

SEQ ID NO: 398925 - RNA, 22 nt, Human
gauaaaauauguggccuuuagu

SEQ ID NO: 398926 - RNA, 22 nt, Human
ugcagagaaaccaguggaggac

SEQ ID NO: 398927 - RNA, 22 nt, Human
gcaacuuuagaaaaaucuauaa

SEQ ID NO: 398928 - RNA, 22 nt, Human
cauuuacaauguacagguugug

SEQ ID NO: 398929 - RNA, 22 nt, Human
agucaccaucuguggcagccug

SEQ ID NO: 398930 - RNA, 22 nt, Human
cuggcuuucuauuuggugcuau

SEQ ID NO: 398931 - RNA, 22 nt, Human
cauuucaaaagaauugccagaa

SEQ ID NO: 398932 - RNA, 22 nt, Human
aaucagaaaauucaguggaauu

SEQ ID NO: 398933 - RNA, 22 nt, Human
uuagacaagggcuccuuaaaag

SEQ ID NO: 398934 - RNA, 22 nt, Human
cauggcuuuguucuguuagaug

SEQ ID NO: 398935 - RNA, 22 nt, Human
caauauauaggaacaacuuagg

SEQ ID NO: 398936 - RNA, 22 nt, Human
ccagauuugagcgucuuaaacc

SEQ ID NO: 398937 - RNA, 22 nt, Human
cuuaauuuaaaauaguucaggc

SEQ ID NO: 398938 - RNA, 22 nt, Human
auacagaagaccccuccgucau

SEQ ID NO: 398939 - RNA, 22 nt, Human
gcuuuaaugaagucacgcaaag

SEQ ID NO: 398940 - RNA, 22 nt, Human
gaaaaaggauaaauacaguguu

SEQ ID NO: 398941 - RNA, 22 nt, Human
gccuuaauuuuuuauaaucucu

SEQ ID NO: 398942 - RNA, 22 nt, Human
ggcaccagccaccuauuucuag

SEQ ID NO: 398943 - RNA, 22 nt, Human
gcuggaucccugugggaguggu

SEQ ID NO: 398944 - RNA, 20 nt, Human
uggccuuuaaauaguauucc

SEQ ID NO: 398945 - RNA, 22 nt, Human
auuucacaucuaucucagauuu

SEQ ID NO: 398946 - RNA, 22 nt, Human
auuccaaagacagaagcagcug

SEQ ID NO: 398947 - RNA, 22 nt, Human
caaguccucugguuucaaauag

SEQ ID NO: 398948 - RNA, 22 nt, Human
uucauagaucucaauuuugagg

SEQ ID NO: 398949 - RNA, 22 nt, Human
ucaguuucacagucugugcaga

SEQ ID NO: 398950 - RNA, 22 nt, Human
cuuuacagaauaagaauacugg

SEQ ID NO: 398951 - RNA, 22 nt, Human
caguccuucauuccuccuuuga

SEQ ID NO: 398952 - RNA, 22 nt, Human
auuaaagaaacccagcauguga

SEQ ID NO: 398953 - RNA, 22 nt, Human
cagucaccaccagguggcagua

SEQ ID NO: 398954 - RNA, 22 nt, Human
uucacagauuucccugcacaug

SEQ ID NO: 398955 - RNA, 22 nt, Human
acagaauuuaaagcucuagacu

SEQ ID NO: 398956 - RNA, 22 nt, Human
aauucacaaaaguuagauccau

SEQ ID NO: 398957 - RNA, 22 nt, Human
uuuauccaguguuggaauuuuu

SEQ ID NO: 398958 - RNA, 22 nt, Human
aaaucucaauuugaauuguagc

SEQ ID NO: 398959 - RNA, 22 nt, Human
uugaauaauguguauguuguua

SEQ ID NO: 398960 - RNA, 22 nt, Human
aaguguuaaagacuugaacacu

SEQ ID NO: 398961 - RNA, 22 nt, Human
ugucaccaaguugaugaaugca

SEQ ID NO: 398962 - RNA, 22 nt, Human
uaugaaauuuaaacacagauca

SEQ ID NO: 398963 - RNA, 22 nt, Human
gaguccuugucauaauucagug

SEQ ID NO: 398964 - RNA, 22 nt, Human
uuugaagucaaagauugauucc

SEQ ID NO: 398965 - RNA, 18 nt, Human
caauuucauccuuaagcc

SEQ ID NO: 398966 - RNA, 22 nt, Human
uucauacuaaaguguaagaugu

SEQ ID NO: 398967 - RNA, 22 nt, Human
caguccuuggcaaguucucagu

SEQ ID NO: 398968 - RNA, 22 nt, Human
gaguccuuccagcaggcauuua

SEQ ID NO: 398969 - RNA, 22 nt, Human
acuauacaccaaaauauuaagg

SEQ ID NO: 398970 - RNA, 22 nt, Human
aaaacaguuuaggcaucacagu

SEQ ID NO: 398971 - RNA, 22 nt, Human
agcauaaaggcacuagaaagag

SEQ ID NO: 398972 - RNA, 22 nt, Human
uuuuaagaugcuaguauuucag

SEQ ID NO: 398973 - RNA, 22 nt, Human
guagaaaugguguguuucuucu

SEQ ID NO: 398974 - RNA, 22 nt, Human
gucaacuuuaagaugaucuuuu

SEQ ID NO: 398975 - RNA, 22 nt, Human
auaacagauacucucugugagg

SEQ ID NO: 398976 - RNA, 22 nt, Human
auaaaacuuggguaugaucccu

SEQ ID NO: 398977 - RNA, 22 nt, Human
aauaagauccugaagauauguu

SEQ ID NO: 398978 - RNA, 22 nt, Human
cagauacuguaaaauuucagua

SEQ ID NO: 398979 - RNA, 22 nt, Human
ugaaacaagauccacagacuug

SEQ ID NO: 398980 - RNA, 22 nt, Human
uuaauucugccuuucauguaac

SEQ ID NO: 398981 - RNA, 22 nt, Human
ucauaaaaauagacucuaaagu

SEQ ID NO: 398982 - RNA, 22 nt, Human
caaagucagcugccagucccaa

SEQ ID NO: 398983 - RNA, 23 nt, Human
uauuacaauuggucuuauuaaga

SEQ ID NO: 398984 - RNA, 22 nt, Human
augcuuaauacacuguuaaagg

SEQ ID NO: 398985 - RNA, 22 nt, Human
aaaucaguuguuauauuaaaga

SEQ ID NO: 398986 - RNA, 22 nt, Human
uguuuaauaauucuaugauagu

SEQ ID NO: 398987 - RNA, 22 nt, Human
uagcagaagaacaacaugaucu

SEQ ID NO: 398988 - RNA, 22 nt, Human
ugucaccagcugcuccucagga

SEQ ID NO: 398989 - RNA, 22 nt, Human
uuacagaaugugccauuugguc

SEQ ID NO: 398990 - RNA, 22 nt, Human
auucucaaaacauaacuucacu

SEQ ID NO: 398991 - RNA, 22 nt, Human
uuacagaagugaaggccuuuaa

SEQ ID NO: 398992 - RNA, 22 nt, Human
uuuaaugaauaauucaaaucug

SEQ ID NO: 398993 - RNA, 22 nt, Human
ugaagaauaagauagauggagc

SEQ ID NO: 398994 - RNA, 22 nt, Human
ucaaaauuagugaccaaaggca

SEQ ID NO: 398995 - RNA, 22 nt, Human
gaauuucagagguaacaucauc

SEQ ID NO: 398996 - RNA, 22 nt, Human
ccuggaucuuucugacugacaa

SEQ ID NO: 398997 - RNA, 22 nt, Human
gaaacaacuacuauugauuucu

SEQ ID NO: 398998 - RNA, 19 nt, Human
uacauacuuauucuaaaag

SEQ ID NO: 398999 - RNA, 22 nt, Human
acuuugaaagccuuggccccgg

SEQ ID NO: 399000 - RNA, 22 nt, Human
aauacugagaucccacaaagca

SEQ ID NO: 399001 - RNA, 22 nt, Human
aaugugauuagccucuacugga

SEQ ID NO: 399002 - RNA, 23 nt, Human
aaaugacauaugguuucugaagg

SEQ ID NO: 399003 - RNA, 22 nt, Human
guucuaauuuggggcuccuuag

SEQ ID NO: 399004 - RNA, 22 nt, Human
gcacaauaacagccaagguuau

SEQ ID NO: 399005 - RNA, 22 nt, Human
acuagaaauuacucagaauaaa

SEQ ID NO: 399006 - RNA, 22 nt, Human
uucagaaagguaaauggauuuc

SEQ ID NO: 399007 - RNA, 19 nt, Human
ugcugaaguugucagucug

SEQ ID NO: 399008 - RNA, 22 nt, Human
cuucuuaaauuggauugcuauu

SEQ ID NO: 399009 - RNA, 22 nt, Human
cuuaggcagacugcugaugcag

SEQ ID NO: 399010 - RNA, 22 nt, Human
uuuuuugucuugaagaaauggu

SEQ ID NO: 399011 - RNA, 22 nt, Human
guuauaaaaugcacaguuguuu

SEQ ID NO: 399012 - RNA, 22 nt, Human
uuuauucuugagagugagaaga

SEQ ID NO: 399013 - RNA, 22 nt, Human
gaauauauuggugaaaauaguu

SEQ ID NO: 399014 - RNA, 22 nt, Human
uguacaaugcugagguuugggg

SEQ ID NO: 399015 - RNA, 22 nt, Human
acagcauucaauaaauaauaac

SEQ ID NO: 399016 - RNA, 22 nt, Human
uagaaacagauguuuuugaaga

SEQ ID NO: 399017 - RNA, 22 nt, Human
aauaacagauuuucaagcugug

SEQ ID NO: 399018 - RNA, 22 nt, Human
agagaugaacauaaaacaagga

SEQ ID NO: 399019 - RNA, 22 nt, Human
auggcuuaagaaugcuuuugug

SEQ ID NO: 399020 - RNA, 22 nt, Human
uggcauuucaguauuuucauaa

SEQ ID NO: 399021 - RNA, 22 nt, Human
cagaaaauaaaguuucuacgca

SEQ ID NO: 399022 - RNA, 22 nt, Human
aaagcaauggaugagaaucugu

SEQ ID NO: 399023 - RNA, 22 nt, Human
aguccuuacaccuggaaccuau

SEQ ID NO: 399024 - RNA, 22 nt, Human
uucuuaaucccacaaaucuuca

SEQ ID NO: 399025 - RNA, 22 nt, Human
cuauuauuuccucaucuauaaa

SEQ ID NO: 399026 - RNA, 22 nt, Human
ucuuuaauguacuuucuuucac

SEQ ID NO: 399027 - RNA, 22 nt, Human
agauuuacugagaacugauuac

SEQ ID NO: 399028 - RNA, 22 nt, Human
acaucagauuaugcuuugcuua

SEQ ID NO: 399029 - RNA, 22 nt, Human
aaauuccagaaacucaguauau

SEQ ID NO: 399030 - RNA, 22 nt, Human
ccaaagcaagucacaugaucaa

SEQ ID NO: 399031 - RNA, 22 nt, Human
gaaguccucaaugcauugucuu

SEQ ID NO: 399032 - RNA, 22 nt, Human
caagucauuacugaaaugucac

SEQ ID NO: 399033 - RNA, 22 nt, Human
uaucugagaaagaagcaccaga

SEQ ID NO: 399034 - RNA, 22 nt, Human
uauauguaagcuauguaagagu

SEQ ID NO: 399035 - RNA, 22 nt, Human
ugcuuuaaauaugaauuagcau

SEQ ID NO: 399036 - RNA, 22 nt, Human
uuaauauguugaaauuuauuag

SEQ ID NO: 399037 - RNA, 22 nt, Human
agccauucauugugcucucaga

SEQ ID NO: 399038 - RNA, 22 nt, Human
aauauaugagggagcuauuuga

SEQ ID NO: 399039 - RNA, 22 nt, Human
uaugaaagaaucucagagcaca

SEQ ID NO: 399040 - RNA, 22 nt, Human
aacauguaaauaucauuguacu

SEQ ID NO: 399041 - RNA, 23 nt, Human
ucaucaaacagcugcucaagaaa

SEQ ID NO: 399042 - RNA, 22 nt, Human
ucauaaagcauuucagcuuuug

SEQ ID NO: 399043 - RNA, 22 nt, Human
cauuucaauacaguuuguaaau

SEQ ID NO: 399044 - RNA, 22 nt, Human
ccagaauuuggaucaugauuuu

SEQ ID NO: 399045 - RNA, 22 nt, Human
ugaauaauuccuuuuugucaag

SEQ ID NO: 399046 - RNA, 22 nt, Human
guuucacagaugguguucauau

SEQ ID NO: 399047 - RNA, 22 nt, Human
aaugccuucaaguaucugagga

SEQ ID NO: 399048 - RNA, 22 nt, Human
uacacaugaucauuuaguagca

SEQ ID NO: 399049 - RNA, 22 nt, Human
uugguccacugugaaauuggga

SEQ ID NO: 399050 - RNA, 22 nt, Human
uaauacuuuugccuuguauuca

SEQ ID NO: 399051 - RNA, 22 nt, Human
cguauacaugaagacauugcug

SEQ ID NO: 399052 - RNA, 20 nt, Human
uuccuuaggcauuggaagaa

SEQ ID NO: 399053 - RNA, 22 nt, Human
cuuugaauuccaguacaauaac

SEQ ID NO: 399054 - RNA, 22 nt, Human
auuuaguuuaggaaaaguaggu

SEQ ID NO: 399055 - RNA, 22 nt, Human
caacuuuaugauugguuuguca

SEQ ID NO: 399056 - RNA, 22 nt, Human
uucagaaacagagugagugagu

SEQ ID NO: 399057 - RNA, 22 nt, Human
aaaguccagagggcacacugaa

SEQ ID NO: 399058 - RNA, 22 nt, Human
acagcauugcuccaucucaaga

SEQ ID NO: 399059 - RNA, 22 nt, Human
cagaauaaaagucccaaggcau

SEQ ID NO: 399060 - RNA, 22 nt, Human
uguacaauagcuauuaucucca

SEQ ID NO: 399061 - RNA, 22 nt, Human
uuuccaaaggaggaaccaguuu

SEQ ID NO: 399062 - RNA, 22 nt, Human
acaaagaucuugcuuuccuacu

SEQ ID NO: 399063 - RNA, 20 nt, Human
uacagaaugcaauaaaaugg

SEQ ID NO: 399064 - RNA, 22 nt, Human
ccuggaucagucacuguugcug

SEQ ID NO: 399065 - RNA, 22 nt, Human
guccuuaguuacuuuucauguc

SEQ ID NO: 399066 - RNA, 22 nt, Human
agagaauuggagcagugacagg

SEQ ID NO: 399067 - RNA, 22 nt, Human
uggcauuucuggccauuugugu

SEQ ID NO: 399068 - RNA, 22 nt, Human
uuacagaaaagggcuuuaagag

SEQ ID NO: 399069 - RNA, 22 nt, Human
caauacaauuaccaguuaauca

SEQ ID NO: 399070 - RNA, 22 nt, Human
uuucauaauacuguacaugaaa

SEQ ID NO: 399071 - RNA, 22 nt, Human
acauaaguuauggauaaaaugu

SEQ ID NO: 399072 - RNA, 18 nt, Human
auuguuaauagaguacuu

SEQ ID NO: 399073 - RNA, 22 nt, Human
gaucagaauuuacuuauaauug

SEQ ID NO: 399074 - RNA, 22 nt, Human
ucagaauaugcuaaugacauuu

SEQ ID NO: 399075 - RNA, 21 nt, Human
aaaguguucagaccaguucug

SEQ ID NO: 399076 - RNA, 22 nt, Human
aaguccaugaucaagauguggc

SEQ ID NO: 399077 - RNA, 22 nt, Human
acauucacgcucucaaagcuga

SEQ ID NO: 399078 - RNA, 22 nt, Human
aaaggcauuuuaauucuaaaga

SEQ ID NO: 399079 - RNA, 22 nt, Human
gaaagaggaaggagauguauua

SEQ ID NO: 399080 - RNA, 21 nt, Human
aggauuuacuauuaacugugu

SEQ ID NO: 399081 - RNA, 22 nt, Human
auuuagcaaaaaaugaugaagc

SEQ ID NO: 399082 - RNA, 22 nt, Human
gauaaugaugacaaugacaacc

SEQ ID NO: 399083 - RNA, 17 nt, Human
ugcuuaauuuugacugg

SEQ ID NO: 399084 - RNA, 20 nt, Human
ucuaauuaaaauugucuagu

SEQ ID NO: 399085 - RNA, 22 nt, Human
aaugucuuuaaagugcaauaga

SEQ ID NO: 399086 - RNA, 22 nt, Human
agaugaaaagauaagcagcaau

SEQ ID NO: 399087 - RNA, 23 nt, Human
guaaaauacgcagugcaguguga

SEQ ID NO: 399088 - RNA, 22 nt, Human
caacuuucuguuaaauguuagu

SEQ ID NO: 399089 - RNA, 22 nt, Human
aaagucaucagaaccuuccaga

SEQ ID NO: 399090 - RNA, 22 nt, Human
gauuuacagaucuaagggucac

SEQ ID NO: 399091 - RNA, 22 nt, Human
uauacagaacugcacgugcacg

SEQ ID NO: 399092 - RNA, 22 nt, Human
auccauuugaaagaacagucca

SEQ ID NO: 399093 - RNA, 18 nt, Human
cuggcuuucuuauccauc

SEQ ID NO: 399094 - RNA, 22 nt, Human
aagcauuugguucugaagacuc

SEQ ID NO: 399095 - RNA, 22 nt, Human
gaucugaagagcaaugaaauau

SEQ ID NO: 399096 - RNA, 22 nt, Human
ugucaccacuggcugaaacacc

SEQ ID NO: 399097 - RNA, 22 nt, Human
uauacaaugaguacauucuggg

SEQ ID NO: 399098 - RNA, 22 nt, Human
auauuuaaacaggguaccaaua

SEQ ID NO: 399099 - RNA, 21 nt, Human
agaauucuuaaguauucuaau

SEQ ID NO: 399100 - RNA, 22 nt, Human
acuggaucagaaucugauuuuu

SEQ ID NO: 399101 - RNA, 22 nt, Human
uuacagaaaagggguuguccuu

SEQ ID NO: 399102 - RNA, 22 nt, Human
uuuacagaugaggauacugagg

SEQ ID NO: 399103 - RNA, 22 nt, Human
aaaaauugcugagaacggaauu

SEQ ID NO: 399104 - RNA, 22 nt, Human
gaauuucagaucagagaccauu

SEQ ID NO: 399105 - RNA, 19 nt, Human
caguccuuuccgcuuucuc

SEQ ID NO: 399106 - RNA, 22 nt, Human
uugguacagaugagguauucuc

SEQ ID NO: 399107 - RNA, 22 nt, Human
gaagaaucaagcaguaauuugu

SEQ ID NO: 399108 - RNA, 19 nt, Human
cauguuaugcuguaguauc

SEQ ID NO: 399109 - RNA, 21 nt, Human
uguccuuaaugcaauguccuu

SEQ ID NO: 399110 - RNA, 22 nt, Human
cucuaacaccacagugugguuu

SEQ ID NO: 399111 - RNA, 22 nt, Human
ucaaaauucuagggagaauggu

SEQ ID NO: 399112 - RNA, 22 nt, Human
auggcuuaugaauaacaguagg

SEQ ID NO: 399113 - RNA, 22 nt, Human
uuccuuagugccucuuccgcug

SEQ ID NO: 399114 - RNA, 22 nt, Human
aaguuacacauuuucauuguaa

SEQ ID NO: 399115 - RNA, 22 nt, Human
uucaauucaauucuaaauauau

SEQ ID NO: 399116 - RNA, 22 nt, Human
caugguuuugagccuauuaugc

SEQ ID NO: 399117 - RNA, 22 nt, Human
ucugaagauuaccagcuaaaug

SEQ ID NO: 399118 - RNA, 22 nt, Human
ggagaaugauauauagcucagu

SEQ ID NO: 399119 - RNA, 22 nt, Human
aucuaaaaggagcucuuuaucu

SEQ ID NO: 399120 - RNA, 22 nt, Human
uucagaaaugaauauugguauu

SEQ ID NO: 399121 - RNA, 23 nt, Human
agaauuccaguuucuuaugucac

SEQ ID NO: 399122 - RNA, 22 nt, Human
gucauuucuguuucuucagugc

SEQ ID NO: 399123 - RNA, 23 nt, Human
ccaaagucgaagucuaguccaga

SEQ ID NO: 399124 - RNA, 21 nt, Human
cuacagaagcucuccuaucca

SEQ ID NO: 399125 - RNA, 22 nt, Human
uuccuuagaguuuccagaaagc

SEQ ID NO: 399126 - RNA, 22 nt, Human
uuccuuagacagagguggucau

SEQ ID NO: 399127 - RNA, 21 nt, Human
uucaauacuauuucaauaguc

SEQ ID NO: 399128 - RNA, 22 nt, Human
uguucacaagaugucuguggcu

SEQ ID NO: 399129 - RNA, 22 nt, Human
ugcaacuuguuuggagagaaag

SEQ ID NO: 399130 - RNA, 22 nt, Human
aaagccauugaacuguacuuua

SEQ ID NO: 399131 - RNA, 22 nt, Human
ccauggcuuuugagucucaaga

SEQ ID NO: 399132 - RNA, 22 nt, Human
caagaaucagaccugucagggu

SEQ ID NO: 399133 - RNA, 22 nt, Human
gcacaauaauuuuuuuaagagg

SEQ ID NO: 399134 - RNA, 22 nt, Human
aaaauccugcugacucgagaug

SEQ ID NO: 399135 - RNA, 22 nt, Human
ugguuuaauuuccauuuccuug

SEQ ID NO: 399136 - RNA, 22 nt, Human
ugcuuaauacguauuugcugga

SEQ ID NO: 399137 - RNA, 22 nt, Human
aauguuuuaaaagagauugaga

SEQ ID NO: 399138 - RNA, 22 nt, Human
agucauaaagccagugggaggc

SEQ ID NO: 399139 - RNA, 22 nt, Human
gauaauaagcacagcaggaugu

SEQ ID NO: 399140 - RNA, 23 nt, Human
cauaaaauauuaguaugguagca

SEQ ID NO: 399141 - RNA, 22 nt, Human
cuuuacauccuguuucccguuu

SEQ ID NO: 399142 - RNA, 22 nt, Human
ggaucugagagcaagcaggacc

SEQ ID NO: 399143 - RNA, 22 nt, Human
uuuauccauaucauuaaaaucu

SEQ ID NO: 399144 - RNA, 22 nt, Human
ugcaggaaaacaccuaucaccc

SEQ ID NO: 399145 - RNA, 22 nt, Human
cuuaaagaaauugaggagagga

SEQ ID NO: 399146 - RNA, 22 nt, Human
aaagaaucacauccuucagcaa

SEQ ID NO: 399147 - RNA, 20 nt, Human
aacacacugguggcaucagg

SEQ ID NO: 399148 - RNA, 22 nt, Human
cagaauguagaucaucaucaag

SEQ ID NO: 399149 - RNA, 22 nt, Human
acaagccaauuacugugccagg

SEQ ID NO: 399150 - RNA, 22 nt, Human
uuauagugggcccaacauggcg

SEQ ID NO: 399151 - RNA, 22 nt, Human
agccaacuaggagauuaaggua

SEQ ID NO: 399152 - RNA, 22 nt, Human
augugaaaaauuucuuauuaca

SEQ ID NO: 399153 - RNA, 22 nt, Human
aaaguccuuuuugccaugcaag

SEQ ID NO: 399154 - RNA, 22 nt, Human
gugaauaaagggaguuuucaaa

SEQ ID NO: 399155 - RNA, 22 nt, Human
agaucugaggguccaagggagg

SEQ ID NO: 399156 - RNA, 22 nt, Human
cagaauaaagguacaauugagu

SEQ ID NO: 399157 - RNA, 22 nt, Human
auuuaguguauucuaauaugug

SEQ ID NO: 399158 - RNA, 22 nt, Human
aaauugaaugauuaagugguga

SEQ ID NO: 399159 - RNA, 22 nt, Human
aauuccaggcagaaaugugagu

SEQ ID NO: 399160 - RNA, 22 nt, Human
cuguuaauugugaauuuuacau

SEQ ID NO: 399161 - RNA, 22 nt, Human
uuauauuaguuagacuugcugu

SEQ ID NO: 399162 - RNA, 22 nt, Human
uucaaguuuugccuccccaucc

SEQ ID NO: 399163 - RNA, 22 nt, Human
aaaucauguuggcacaauaaaa

SEQ ID NO: 399164 - RNA, 22 nt, Human
uaagaaucuauuaggaauaugu

SEQ ID NO: 399165 - RNA, 22 nt, Human
uaaauaucaccuggaauuguua

SEQ ID NO: 399166 - RNA, 22 nt, Human
uggguuuaaacucaacucuaaa

SEQ ID NO: 399167 - RNA, 22 nt, Human
uacauauacugagugauuugcu

SEQ ID NO: 399168 - RNA, 16 nt, Human
gcaacuuugggguuga

SEQ ID NO: 399169 - RNA, 22 nt, Human
caauuucaagauucuguucuuu

SEQ ID NO: 399170 - RNA, 22 nt, Human
aauuccaaauguuuucaaucca

SEQ ID NO: 399171 - RNA, 22 nt, Human
aguguucauuuauucauucacu

SEQ ID NO: 399172 - RNA, 22 nt, Human
cagucaccugaagacuugacca

SEQ ID NO: 399173 - RNA, 22 nt, Human
aguguuagauucuuacucaguu

SEQ ID NO: 399174 - RNA, 22 nt, Human
ucuauaaagggccagauaguag

SEQ ID NO: 399175 - RNA, 22 nt, Human
uuaauuaugcaaaaggccccau

SEQ ID NO: 399176 - RNA, 22 nt, Human
ccaaaauuauuacauuuguagg

SEQ ID NO: 399177 - RNA, 22 nt, Human
agaauuccuccucugggacacu

SEQ ID NO: 399178 - RNA, 22 nt, Human
auuaaagacagcagauggaugg

SEQ ID NO: 399179 - RNA, 22 nt, Human
aauuuacaggugcacucgccau

SEQ ID NO: 399180 - RNA, 22 nt, Human
uuccuuagcugucccuggaaau

SEQ ID NO: 399181 - RNA, 21 nt, Human
auacagaaggcagacucucuc

SEQ ID NO: 399182 - RNA, 22 nt, Human
uacuuugaagacaauaucugga

SEQ ID NO: 399183 - RNA, 22 nt, Human
auuauaaauauuuucuaggggu

SEQ ID NO: 399184 - RNA, 22 nt, Human
auuaggcauucugaaugagguc

SEQ ID NO: 399185 - RNA, 22 nt, Human
auuauccagcaccaaugucaga

SEQ ID NO: 399186 - RNA, 22 nt, Human
ugcacaaacuugugucccaggg

SEQ ID NO: 399187 - RNA, 22 nt, Human
uuugaauaaucacugggcauua

SEQ ID NO: 399188 - RNA, 23 nt, Human
uuccacaaugaaaauaaagcagg

SEQ ID NO: 399189 - RNA, 22 nt, Human
auuuagaagcuaauuuuucaga

SEQ ID NO: 399190 - RNA, 22 nt, Human
uaaaugauuuauguaugugaaa

SEQ ID NO: 399191 - RNA, 22 nt, Human
gcagagacuaguagugcagacu

SEQ ID NO: 399192 - RNA, 22 nt, Human
aaagcaguauauugguaguugu

SEQ ID NO: 399193 - RNA, 22 nt, Human
cuggcuuucuguuauaaagaca

SEQ ID NO: 399194 - RNA, 22 nt, Human
ucucuuaauuuuggaauagugu

SEQ ID NO: 399195 - RNA, 22 nt, Human
cuuugaauugccguuucaucug

SEQ ID NO: 399196 - RNA, 22 nt, Human
uugauuaaucccaugugaguag

SEQ ID NO: 399197 - RNA, 22 nt, Human
ugauuauauucuaacuucauaa

SEQ ID NO: 399198 - RNA, 22 nt, Human
agauuuccuaugguaauuauag

SEQ ID NO: 399199 - RNA, 22 nt, Human
gcaggaaagguugagacuuugc

SEQ ID NO: 399200 - RNA, 22 nt, Human
ugcagucuccaccuccugggug

SEQ ID NO: 399201 - RNA, 22 nt, Human
auaacaugaccugugcuucaca

SEQ ID NO: 399202 - RNA, 22 nt, Human
gcuggaucauauggugguucua

SEQ ID NO: 399203 - RNA, 22 nt, Human
ucagccagaggcuucuugguuu

SEQ ID NO: 399204 - RNA, 22 nt, Human
auuccaaacuuaccccagagga

SEQ ID NO: 399205 - RNA, 22 nt, Human
aagcagggcuuuaagcgguuuu

SEQ ID NO: 399206 - RNA, 22 nt, Human
gucaaacauagggacuuugugg

SEQ ID NO: 399207 - RNA, 22 nt, Human
gauaaaauucuuauuuuacccg

SEQ ID NO: 399208 - RNA, 22 nt, Human
augaacaauaaaauagaucaca

SEQ ID NO: 399209 - RNA, 22 nt, Human
cauguauaguuggaacuacauc

SEQ ID NO: 399210 - RNA, 22 nt, Human
uagauauaagguccuuagaaca

SEQ ID NO: 399211 - RNA, 22 nt, Human
aguccuuagaacacuguaucug

SEQ ID NO: 399212 - RNA, 22 nt, Human
ugucaccacauuugucaauauc

SEQ ID NO: 399213 - RNA, 22 nt, Human
aaucagucucauuuagcaggga

SEQ ID NO: 399214 - RNA, 22 nt, Human
uacugaaauacuaagaaguuaa

SEQ ID NO: 399215 - RNA, 22 nt, Human
auuucaacagaguuugaaggca

SEQ ID NO: 399216 - RNA, 22 nt, Human
aaugugaucgcuuuagaagcuu

SEQ ID NO: 399217 - RNA, 22 nt, Human
uacugugacagaguacuuaaac

SEQ ID NO: 399218 - RNA, 22 nt, Human
uugguacaaugugcuagguagg

SEQ ID NO: 399219 - RNA, 22 nt, Human
ucacagaagaugcuggauguug

SEQ ID NO: 399220 - RNA, 22 nt, Human
aaaugucagaggaacauauuga

SEQ ID NO: 399221 - RNA, 22 nt, Human
aaaucucacuguagucaaagug

SEQ ID NO: 399222 - RNA, 22 nt, Human
uaucagaaaucaacacacagug

SEQ ID NO: 399223 - RNA, 23 nt, Human
uauggcuuacagugcuuuaggua

SEQ ID NO: 399224 - RNA, 22 nt, Human
uauacagauggaaagauacaca

SEQ ID NO: 399225 - RNA, 22 nt, Human
uauggaaagggaguuuaauuug

SEQ ID NO: 399226 - RNA, 22 nt, Human
cuggaucaugcauugcuugucc

SEQ ID NO: 399227 - RNA, 22 nt, Human
ugcaggaacauagguuccuugg

SEQ ID NO: 399228 - RNA, 18 nt, Human
aagucaccccugcucccu

SEQ ID NO: 399229 - RNA, 22 nt, Human
uucauuuguugacagagacaug

SEQ ID NO: 399230 - RNA, 22 nt, Human
uuacagaaguauugagagaucc

SEQ ID NO: 399231 - RNA, 22 nt, Human
caucagaaucugagucucugcc

SEQ ID NO: 399232 - RNA, 22 nt, Human
aguacaacauuagaguaucuua

SEQ ID NO: 399233 - RNA, 22 nt, Human
uuuaaagaaauuccucaucuuu

SEQ ID NO: 399234 - RNA, 22 nt, Human
aguaaaauuguauuggaaaaca

SEQ ID NO: 399235 - RNA, 22 nt, Human
uuaacagagugccuggcaugua

SEQ ID NO: 399236 - RNA, 22 nt, Human
ccauaauauuaaaugcuuuugu

SEQ ID NO: 399237 - RNA, 22 nt, Human
uacauagaacauguuuaauguc

SEQ ID NO: 399238 - RNA, 22 nt, Human
aaguccuuuccaguccugugau

SEQ ID NO: 399239 - RNA, 22 nt, Human
gauggcuucagucuccuugggu

SEQ ID NO: 399240 - RNA, 22 nt, Human
cugaauaauacagacuagcuuc

SEQ ID NO: 399241 - RNA, 22 nt, Human
ucaaaaguggccuguaaaaucu

SEQ ID NO: 399242 - RNA, 22 nt, Human
ugauuuaaaagaaacauugucu

SEQ ID NO: 399243 - RNA, 22 nt, Human
ucaguuucuucaucucccuaac

SEQ ID NO: 399244 - RNA, 22 nt, Human
cuagaaauguagauucuuagug

SEQ ID NO: 399245 - RNA, 22 nt, Human
aaaguccugacugcaggggaug

SEQ ID NO: 399246 - RNA, 22 nt, Human
uguauacaggcauaagagauac

SEQ ID NO: 399247 - RNA, 22 nt, Human
ugcaggaaugagguucucaguu

SEQ ID NO: 399248 - RNA, 22 nt, Human
auuuccaggagaaaggauuuua

SEQ ID NO: 399249 - RNA, 23 nt, Human
augguuuaugucacacuuuugau

SEQ ID NO: 399250 - RNA, 22 nt, Human
cauagaaaucaggugagaaucu

SEQ ID NO: 399251 - RNA, 20 nt, Human
ucauaaagaggaaauaaaua

SEQ ID NO: 399252 - RNA, 22 nt, Human
aaucagcuaaauaaacuaguca

SEQ ID NO: 399253 - RNA, 22 nt, Human
uucagaaacaucaguggaugga

SEQ ID NO: 399254 - RNA, 18 nt, Human
augaucuuagcaaauauu

SEQ ID NO: 399255 - RNA, 22 nt, Human
gauagucaccucccuuaacuuu

SEQ ID NO: 399256 - RNA, 22 nt, Human
agauuucagaugcucggcaguu

SEQ ID NO: 399257 - RNA, 22 nt, Human
aaaucaguuagugguaggauug

SEQ ID NO: 399258 - RNA, 22 nt, Human
uaaagccaacacuuuacugcuc

SEQ ID NO: 399259 - RNA, 22 nt, Human
uaaagcaguguugggucggacg

SEQ ID NO: 399260 - RNA, 20 nt, Human
aaucagaaagugugagcucu

SEQ ID NO: 399261 - RNA, 22 nt, Human
uucacagagaguaugcagagaa

SEQ ID NO: 399262 - RNA, 18 nt, Human
uaagucauuuugccagca

SEQ ID NO: 399263 - RNA, 22 nt, Human
guuccaaauuuggaucuuuagg

SEQ ID NO: 399264 - RNA, 22 nt, Human
auaaaaguaggaccaacuuaca

SEQ ID NO: 399265 - RNA, 22 nt, Human
cuacagaauucaacaaaugguu

SEQ ID NO: 399266 - RNA, 21 nt, Human
auuauuauaaagaccacaggg

SEQ ID NO: 399267 - RNA, 22 nt, Human
aauaaaaugaacugguagaguu

SEQ ID NO: 399268 - RNA, 22 nt, Human
cacccaguugacuacaaagggg

SEQ ID NO: 399269 - RNA, 18 nt, Human
aacaguuuccagauucuc

SEQ ID NO: 399270 - RNA, 23 nt, Human
aauaucaaggugauguucccaga

SEQ ID NO: 399271 - RNA, 22 nt, Human
aagucauagucgggaaagacau

SEQ ID NO: 399272 - RNA, 22 nt, Human
ugcagguaggccugacuuccag

SEQ ID NO: 399273 - RNA, 22 nt, Human
gaaagccagagagaaagggcuc

SEQ ID NO: 399274 - RNA, 22 nt, Human
uuagaaauacaagugagguuga

SEQ ID NO: 399275 - RNA, 22 nt, Human
agauaaaaugguucaaaggcua

SEQ ID NO: 399276 - RNA, 22 nt, Human
ucaaauaccagcaauuucaugu

SEQ ID NO: 399277 - RNA, 22 nt, Human
auccaaaccuggacaugagugg

SEQ ID NO: 399278 - RNA, 22 nt, Human
ugagacaaccuaauuaaacacc

SEQ ID NO: 399279 - RNA, 22 nt, Human
ccagauaaggcuuuuuaaaagc

SEQ ID NO: 399280 - RNA, 22 nt, Human
auacaaguugugauaauguaaa

SEQ ID NO: 399281 - RNA, 22 nt, Human
cauagaaaagaguagguaaugu

SEQ ID NO: 399282 - RNA, 22 nt, Human
ugaaauaauaucuggaucaauc

SEQ ID NO: 399283 - RNA, 22 nt, Human
cuagaaaucucuguuuacauca

SEQ ID NO: 399284 - RNA, 22 nt, Human
aauaaaauggucaguuuucuca

SEQ ID NO: 399285 - RNA, 22 nt, Human
aaagucaugaugaaccaccgua

SEQ ID NO: 399286 - RNA, 22 nt, Human
uuucaagaacaacauucauuca

SEQ ID NO: 399287 - RNA, 22 nt, Human
uuaauucagucaaagaaaccau

SEQ ID NO: 399288 - RNA, 22 nt, Human
uuuaggcacagggaguugguuu

SEQ ID NO: 399289 - RNA, 23 nt, Human
auauggcuguuguguguuaacau

SEQ ID NO: 399290 - RNA, 22 nt, Human
aagcaauagcaacaacuuuaca

SEQ ID NO: 399291 - RNA, 22 nt, Human
aacaugucuggguauucacaag

SEQ ID NO: 399292 - RNA, 22 nt, Human
uuuaggcaagggcaagauuauc

SEQ ID NO: 399293 - RNA, 22 nt, Human
uaaguccuagaugauucacaga

SEQ ID NO: 399294 - RNA, 22 nt, Human
acaugucuguaauuauuuuagg

SEQ ID NO: 399295 - RNA, 22 nt, Human
uaaaaugcacagcaguugaaag

SEQ ID NO: 399296 - RNA, 22 nt, Human
ugucaccaugcgaggcuaauuu

SEQ ID NO: 399297 - RNA, 22 nt, Human
acuuuaauuaaugaacuguggc

SEQ ID NO: 399298 - RNA, 22 nt, Human
aauuuacacuucauuuggaggg

SEQ ID NO: 399299 - RNA, 22 nt, Human
aacagacaacuccuguggcuca

SEQ ID NO: 399300 - RNA, 22 nt, Human
guuaggcauuugccuuaauuuu

SEQ ID NO: 399301 - RNA, 22 nt, Human
uaauuuaugaugcaaagaaaag

SEQ ID NO: 399302 - RNA, 23 nt, Human
aaaguguagccagguuaagaacc

SEQ ID NO: 399303 - RNA, 22 nt, Human
auucuucacaaauauauagaag

SEQ ID NO: 399304 - RNA, 22 nt, Human
aucaaaaccuugacuuuuaaug

SEQ ID NO: 399305 - RNA, 22 nt, Human
aaguccuuucucauggaggaau

SEQ ID NO: 399306 - RNA, 22 nt, Human
auuauccucagaaaacauguga

SEQ ID NO: 399307 - RNA, 22 nt, Human
aguccuuacucgggggcccaga

SEQ ID NO: 399308 - RNA, 22 nt, Human
aucuaacacuguaaacugucuu

SEQ ID NO: 399309 - RNA, 22 nt, Human
ucagagaaaugaaguagggauu

SEQ ID NO: 399310 - RNA, 22 nt, Human
ucaguguauggagugcuggauu

SEQ ID NO: 399311 - RNA, 22 nt, Human
auugauggcggccucuccauau

SEQ ID NO: 399312 - RNA, 22 nt, Human
uuuuauauggcacauugguugg

SEQ ID NO: 399313 - RNA, 22 nt, Human
uuuaggaaugugguuuuugagc

SEQ ID NO: 399314 - RNA, 22 nt, Human
auguuucauuuagauaucaggc

SEQ ID NO: 399315 - RNA, 22 nt, Human
auuaggcaauucugggcaucuc

SEQ ID NO: 399316 - RNA, 22 nt, Human
gcuucacacuaaaaauguuaaa

SEQ ID NO: 399317 - RNA, 22 nt, Human
gauucaauguugcagauggaau

SEQ ID NO: 399318 - RNA, 22 nt, Human
guuaaagaguuuggcuuucuuc

SEQ ID NO: 399319 - RNA, 22 nt, Human
uaauuucaauagcuugcauaau

SEQ ID NO: 399320 - RNA, 22 nt, Human
gaguccuuaauacacuggugga

SEQ ID NO: 399321 - RNA, 22 nt, Human
gauagaaagaauauagauucca

SEQ ID NO: 399322 - RNA, 22 nt, Human
aauuucaagucuugaagaagua

SEQ ID NO: 399323 - RNA, 22 nt, Human
uucucuuagcuguaaagucaau

SEQ ID NO: 399324 - RNA, 22 nt, Human
uuuaggcacaacuacucagcua

SEQ ID NO: 399325 - RNA, 22 nt, Human
uuuaucuguuguacauuuaugc

SEQ ID NO: 399326 - RNA, 22 nt, Human
cagucaccuugaggacucagac

SEQ ID NO: 399327 - RNA, 22 nt, Human
caagaaucaacauuauuuagug

SEQ ID NO: 399328 - RNA, 22 nt, Human
caguaucugucaguaaucaggu

SEQ ID NO: 399329 - RNA, 22 nt, Human
uauuacaauuuacauugcacuu

SEQ ID NO: 399330 - RNA, 22 nt, Human
auggcauuauagcaaugguuug

SEQ ID NO: 399331 - RNA, 22 nt, Human
aucuauacccaucaugauuuaa

SEQ ID NO: 399332 - RNA, 22 nt, Human
uucuuuuacauuaagauuucag

SEQ ID NO: 399333 - RNA, 23 nt, Human
aggauuuaaaggcaaugcauuuu

SEQ ID NO: 399334 - RNA, 22 nt, Human
cuacagaaggagaaauggguaa

SEQ ID NO: 399335 - RNA, 22 nt, Human
uguacaauguggccaguguuaa

SEQ ID NO: 399336 - RNA, 21 nt, Human
cauuucaaagagcuggaaauc

SEQ ID NO: 399337 - RNA, 22 nt, Human
ugaagaaucagauuggccugcg

SEQ ID NO: 399338 - RNA, 22 nt, Human
caguccuugcuaugacccugag

SEQ ID NO: 399339 - RNA, 22 nt, Human
auacagaauucacuacaguuuc

SEQ ID NO: 399340 - RNA, 22 nt, Human
cagaaacauguauaaaguugua

SEQ ID NO: 399341 - RNA, 22 nt, Human
uaaaauguuugcaagagaccag

SEQ ID NO: 399342 - RNA, 22 nt, Human
ugaaaauggccugaagaagcaa

SEQ ID NO: 399343 - RNA, 22 nt, Human
aaaacaguuuuugcuaacugcu

SEQ ID NO: 399344 - RNA, 22 nt, Human
uugaauaauaugcuucguucuc

SEQ ID NO: 399345 - RNA, 21 nt, Human
uccaaaaaggagcguccuucu

SEQ ID NO: 399346 - RNA, 22 nt, Human
acaagauaaggugucagugugu

SEQ ID NO: 399347 - RNA, 22 nt, Human
ccauggcucuuaccuuguuaua

SEQ ID NO: 399348 - RNA, 22 nt, Human
cuacagaaucuaccucaagcca

SEQ ID NO: 399349 - RNA, 22 nt, Human
ucagaauucagagggagugggg

SEQ ID NO: 399350 - RNA, 22 nt, Human
uauuccaacugucauagucaua

SEQ ID NO: 399351 - RNA, 22 nt, Human
ucuaaacacuaagucuugaugc

SEQ ID NO: 399352 - RNA, 22 nt, Human
aguacaaugucugacacaguag

SEQ ID NO: 399353 - RNA, 22 nt, Human
auggcuuuccugggacaugggc

SEQ ID NO: 399354 - RNA, 22 nt, Human
aaagucauguaaugauaugauu

SEQ ID NO: 399355 - RNA, 22 nt, Human
aaaauugagagucuugugcaag

SEQ ID NO: 399356 - RNA, 22 nt, Human
aaucaagucaaccaucaugugc

SEQ ID NO: 399357 - RNA, 21 nt, Human
uuacagaauccaugggaaguc

SEQ ID NO: 399358 - RNA, 22 nt, Human
aaugaacauauaaagagaucuu

SEQ ID NO: 399359 - RNA, 22 nt, Human
uuugaagaccuuaucucuaaau

SEQ ID NO: 399360 - RNA, 22 nt, Human
uggauuuaccacagggccacag

SEQ ID NO: 399361 - RNA, 22 nt, Human
caguccuuccuugccccuuggg

SEQ ID NO: 399362 - RNA, 22 nt, Human
cuacagaauggagggucagaga

SEQ ID NO: 399363 - RNA, 22 nt, Human
ugugugaauggauuauucuauu

SEQ ID NO: 399364 - RNA, 22 nt, Human
gcagagaacccagcagauuggc

SEQ ID NO: 399365 - RNA, 22 nt, Human
aaaucaguucucccuuucuuca

SEQ ID NO: 399366 - RNA, 22 nt, Human
aaagucauugcuguuaucaaug

SEQ ID NO: 399367 - RNA, 22 nt, Human
uccagaauacucugaaaucauu

SEQ ID NO: 399368 - RNA, 22 nt, Human
cauuuacagugagaguuuuuac

SEQ ID NO: 399369 - RNA, 21 nt, Human
uguguaaaguugaaauccugu

SEQ ID NO: 399370 - RNA, 22 nt, Human
uauggaaacuaauucauuuuuc

SEQ ID NO: 399371 - RNA, 22 nt, Human
cauacuuucuuuuucacgcaua

SEQ ID NO: 399372 - RNA, 22 nt, Human
gauuuccauuuucaacuccugc

SEQ ID NO: 399373 - RNA, 22 nt, Human
caaguccaggucaauuuaaagc

SEQ ID NO: 399374 - RNA, 22 nt, Human
aaaucaguaaauguucauuaac

SEQ ID NO: 399375 - RNA, 22 nt, Human
aauaaccuuacuuauuacaugg

SEQ ID NO: 399376 - RNA, 22 nt, Human
aucuaacagcaacaccagaaua

SEQ ID NO: 399377 - RNA, 22 nt, Human
uaaaaguauacuuucaaaggag

SEQ ID NO: 399378 - RNA, 22 nt, Human
augccaaagcccaaguucauca

SEQ ID NO: 399379 - RNA, 19 nt, Human
aggauuuauuaugugcuca

SEQ ID NO: 399380 - RNA, 22 nt, Human
aucugacuucacgcccaugcca

SEQ ID NO: 399381 - RNA, 22 nt, Human
uaaacauggcuguuucaguuau

SEQ ID NO: 399382 - RNA, 22 nt, Human
uguaacaaaauaccuuggauug

SEQ ID NO: 399383 - RNA, 22 nt, Human
ucaaaauuaaaccaacguccag

SEQ ID NO: 399384 - RNA, 22 nt, Human
aagaaaucugauauuuguuuca

SEQ ID NO: 399385 - RNA, 22 nt, Human
uaauuucagugcaagcucacgg

SEQ ID NO: 399386 - RNA, 22 nt, Human
uucaauaggaugcaugauauaa

SEQ ID NO: 399387 - RNA, 22 nt, Human
gguacaaugucuuacagaccca

SEQ ID NO: 399388 - RNA, 22 nt, Human
uggcuuuaaaucuguauucaua

SEQ ID NO: 399389 - RNA, 22 nt, Human
ccagaucuaguguuguaaagcu

SEQ ID NO: 399390 - RNA, 22 nt, Human
aagucacccacaggcagcagaa

SEQ ID NO: 399391 - RNA, 22 nt, Human
gauuuacagguuagguccugua

SEQ ID NO: 399392 - RNA, 22 nt, Human
aauucucagguaaaaguuaagu

SEQ ID NO: 399393 - RNA, 22 nt, Human
uauuaucauuaacuguugaauu

SEQ ID NO: 399394 - RNA, 22 nt, Human
uaggcaacaugucgaauacugu

SEQ ID NO: 399395 - RNA, 23 nt, Human
auagaagauuauugcaacagucc

SEQ ID NO: 399396 - RNA, 22 nt, Human
uucauacuguguuuccaaguuu

SEQ ID NO: 399397 - RNA, 22 nt, Human
cacauuuagagguuagcauggu

SEQ ID NO: 399398 - RNA, 22 nt, Human
cauuuacauaacaguaacgcug

SEQ ID NO: 399399 - RNA, 22 nt, Human
guaaacauuacugugcuguaua

SEQ ID NO: 399400 - RNA, 22 nt, Human
cuccuuagugccucugcacgag

SEQ ID NO: 399401 - RNA, 20 nt, Human
ugcaggaauuugcauuccuu

SEQ ID NO: 399402 - RNA, 22 nt, Human
aucagaaaguucaucauguuug

SEQ ID NO: 399403 - RNA, 22 nt, Human
auagacauuuugcauucaagca

SEQ ID NO: 399404 - RNA, 22 nt, Human
uuuaauauuucuuuccugaagc

SEQ ID NO: 399405 - RNA, 22 nt, Human
aaucccagcuacucaggaaguu

SEQ ID NO: 399406 - RNA, 22 nt, Human
uaauuucacugauaugaaguca

SEQ ID NO: 399407 - RNA, 22 nt, Human
uuuccaaaaugaaucuaaugca

SEQ ID NO: 399408 - RNA, 22 nt, Human
augguauugcaacaacugucau

SEQ ID NO: 399409 - RNA, 22 nt, Human
aaucaguguguaaaguggcugc

SEQ ID NO: 399410 - RNA, 22 nt, Human
uuaauuacuaagcacaaugcaa

SEQ ID NO: 399411 - RNA, 22 nt, Human
gauaaaauaacuauggaauacu

SEQ ID NO: 399412 - RNA, 22 nt, Human
uuagaaaucaccucugaagauc

SEQ ID NO: 399413 - RNA, 22 nt, Human
ugucauaaucaguuuugcaugu

SEQ ID NO: 399414 - RNA, 22 nt, Human
aguuacagugaccauuuauuua

SEQ ID NO: 399415 - RNA, 22 nt, Human
aaugaaacuguauauagacugu

SEQ ID NO: 399416 - RNA, 22 nt, Human
uaaagucagauaucuggguuga

SEQ ID NO: 399417 - RNA, 22 nt, Human
auucaagauuaauucuauguca

SEQ ID NO: 399418 - RNA, 22 nt, Human
acaaagucacaauaauuaaccu

SEQ ID NO: 399419 - RNA, 20 nt, Human
uguaacaaucuggauguugc

SEQ ID NO: 399420 - RNA, 22 nt, Human
ggauuuccucuugacucuaaag

SEQ ID NO: 399421 - RNA, 22 nt, Human
agaaacauccugcuuuccauuu

SEQ ID NO: 399422 - RNA, 22 nt, Human
aagcauuuuagauaaagcauca

SEQ ID NO: 399423 - RNA, 21 nt, Human
agaauaaugguaucauuugcu

SEQ ID NO: 399424 - RNA, 21 nt, Human
auuuccaaauaaggucacauu

SEQ ID NO: 399425 - RNA, 22 nt, Human
uuuaggcaaacucauugucaga

SEQ ID NO: 399426 - RNA, 22 nt, Human
uagaauucauguuacuguuagc

SEQ ID NO: 399427 - RNA, 22 nt, Human
cugaaaggguuacauaguaagu

SEQ ID NO: 399428 - RNA, 22 nt, Human
caaagccaggcuuucuaaugua

SEQ ID NO: 399429 - RNA, 22 nt, Human
cuagaaaugcucaagagaaagu

SEQ ID NO: 399430 - RNA, 22 nt, Human
acaaugaacacacaaggaauuc

SEQ ID NO: 399431 - RNA, 22 nt, Human
gaagugaagagauuagaaauca

SEQ ID NO: 399432 - RNA, 22 nt, Human
auguuaaaugguuuauuauuaa

SEQ ID NO: 399433 - RNA, 22 nt, Human
agcauuuaagcuucugcaaagc

SEQ ID NO: 399434 - RNA, 22 nt, Human
gagucaccacugugauagucga

SEQ ID NO: 399435 - RNA, 22 nt, Human
uggcauuuagaaaacaacaugu

SEQ ID NO: 399436 - RNA, 22 nt, Human
ggauuuacaaguuuaacucuca

SEQ ID NO: 399437 - RNA, 22 nt, Human
uuaugaaggaucagguacuugg

SEQ ID NO: 399438 - RNA, 22 nt, Human
aaguaaauaucuguuuauagca

SEQ ID NO: 399439 - RNA, 22 nt, Human
agaaccucaauuauuuuugcac

SEQ ID NO: 399440 - RNA, 22 nt, Human
acagaaguuggaauuagauacu

SEQ ID NO: 399441 - RNA, 22 nt, Human
auguguaugcaugcacuaagau

SEQ ID NO: 399442 - RNA, 22 nt, Human
aucauaaaccacuuuguaaucu

SEQ ID NO: 399443 - RNA, 22 nt, Human
ggcauuuacauaaucuuauuua

SEQ ID NO: 399444 - RNA, 22 nt, Human
acaaaaagggagaugagguaga

SEQ ID NO: 399445 - RNA, 22 nt, Human
caaauuccucagaaucagaaaa

SEQ ID NO: 399446 - RNA, 22 nt, Human
aaagucaucuaggagcagauuu

SEQ ID NO: 399447 - RNA, 22 nt, Human
cugaaagguauaaauaagacuu

SEQ ID NO: 399448 - RNA, 22 nt, Human
cugaauaauuuuauaguugcug

SEQ ID NO: 399449 - RNA, 22 nt, Human
aaaacauguccauacagaaacu

SEQ ID NO: 399450 - RNA, 22 nt, Human
auuauaaagaacaugugugugg

SEQ ID NO: 399451 - RNA, 22 nt, Human
gauuuacaaagcucucuagugu

SEQ ID NO: 399452 - RNA, 22 nt, Human
caaauucaaauuucaucagugu

SEQ ID NO: 399453 - RNA, 22 nt, Human
ucauacacaagagcauguaaca

SEQ ID NO: 399454 - RNA, 18 nt, Human
caauuucaauggucugaa

SEQ ID NO: 399455 - RNA, 22 nt, Human
caaaauugaugaauguaugauu

SEQ ID NO: 399456 - RNA, 22 nt, Human
agaauuccucuaggaucugccc

SEQ ID NO: 399457 - RNA, 22 nt, Human
aaagucauuguaauauaugcua

SEQ ID NO: 399458 - RNA, 22 nt, Human
uggauuuaauggaugaggggca

SEQ ID NO: 399459 - RNA, 22 nt, Human
auagaauuugcacuaaaucugc

SEQ ID NO: 399460 - RNA, 22 nt, Human
uggcauuuuguucaguauaugg

SEQ ID NO: 399461 - RNA, 22 nt, Human
uuacagaagaguaacuuggcaa

SEQ ID NO: 399462 - RNA, 22 nt, Human
cauggcuuguaauaaauuuaua

SEQ ID NO: 399463 - RNA, 22 nt, Human
aaugcuuauaccuaaugaucuu

SEQ ID NO: 399464 - RNA, 22 nt, Human
uucauaaucaccaaaaacugga

SEQ ID NO: 399465 - RNA, 22 nt, Human
auagaaauguauuuuggacuag

SEQ ID NO: 399466 - RNA, 22 nt, Human
guagaaauuccauuuacuuuga

SEQ ID NO: 399467 - RNA, 22 nt, Human
acaugaaacuguugcauuagaa

SEQ ID NO: 399468 - RNA, 22 nt, Human
aguaaacacugucuuuauauau

SEQ ID NO: 399469 - RNA, 22 nt, Human
ucaguuucuaaaucuuaccaau

SEQ ID NO: 399470 - RNA, 22 nt, Human
gcagaauucuacagaugauaaa

SEQ ID NO: 399471 - RNA, 20 nt, Human
aggauuuacuacuaccugcu

SEQ ID NO: 399472 - RNA, 22 nt, Human
cuggcuuuggucaugugaucau

SEQ ID NO: 399473 - RNA, 18 nt, Human
gcacuucacccagcuagu

SEQ ID NO: 399474 - RNA, 22 nt, Human
ugugaauaccuugaauucauca

SEQ ID NO: 399475 - RNA, 22 nt, Human
aaacggauauaacagcaaacgc

SEQ ID NO: 399476 - RNA, 22 nt, Human
uuaggaaaggguuuucuaacag

SEQ ID NO: 399477 - RNA, 22 nt, Human
acauguauugacauuauauucu

SEQ ID NO: 399478 - RNA, 22 nt, Human
guuuacauguacucauuauacu

SEQ ID NO: 399479 - RNA, 22 nt, Human
auggcuuucagauggugaaaga

SEQ ID NO: 399480 - RNA, 22 nt, Human
aaucagaacuucucaggguggg

SEQ ID NO: 399481 - RNA, 22 nt, Human
aaucagaaccuugggucauaac

SEQ ID NO: 399482 - RNA, 22 nt, Human
cuuauacacccucuucccaggc

SEQ ID NO: 399483 - RNA, 22 nt, Human
uagucaccucuuuaaauguccu

SEQ ID NO: 399484 - RNA, 22 nt, Human
caaguccucaaagggcucugcu

SEQ ID NO: 399485 - RNA, 22 nt, Human
uaauccaaaacugaaucugugg

SEQ ID NO: 399486 - RNA, 21 nt, Human
ugaaagaaggugcagucugaa

SEQ ID NO: 399487 - RNA, 22 nt, Human
aaucuuuaaggacucagucucu

SEQ ID NO: 399488 - RNA, 22 nt, Human
aaucuagucuccuuaagucuuu

SEQ ID NO: 399489 - RNA, 22 nt, Human
aggauuuaggagcuggcuaacg

SEQ ID NO: 399490 - RNA, 22 nt, Human
gcuuuaaugcaauuucaccuca

SEQ ID NO: 399491 - RNA, 22 nt, Human
cagaaagcuuaggcaaguugga

SEQ ID NO: 399492 - RNA, 22 nt, Human
aucagaaacucuuagagcaggg

SEQ ID NO: 399493 - RNA, 22 nt, Human
aagucacccuagggccuggacu

SEQ ID NO: 399494 - RNA, 20 nt, Human
aacaguaccauuuaucucag

SEQ ID NO: 399495 - RNA, 22 nt, Human
aggaaaaaagucugugauuaua

SEQ ID NO: 399496 - RNA, 22 nt, Human
agccaacuaauuaaacaacuuu

SEQ ID NO: 399497 - RNA, 22 nt, Human
uuugaauagcauaggauuacau

SEQ ID NO: 399498 - RNA, 22 nt, Human
gguacaauucugggguaugcuc

SEQ ID NO: 399499 - RNA, 22 nt, Human
auucacuggcagacagaacuca

SEQ ID NO: 399500 - RNA, 22 nt, Human
uaagagaauguuguggcuaggu

SEQ ID NO: 399501 - RNA, 22 nt, Human
uaaagucaucuuuaaacaugcc

SEQ ID NO: 399502 - RNA, 22 nt, Human
caagauuugccaguggccaacu

SEQ ID NO: 399503 - RNA, 22 nt, Human
gaugaucaucuguaaaguuaga

SEQ ID NO: 399504 - RNA, 22 nt, Human
uaugaacauguucauugacuua

SEQ ID NO: 399505 - RNA, 22 nt, Human
auagaauucguguuuguaauuc

SEQ ID NO: 399506 - RNA, 22 nt, Human
uuguccaaaguaacacaucuag

SEQ ID NO: 399507 - RNA, 20 nt, Human
auacuuguuuucaggcuuuu

SEQ ID NO: 399508 - RNA, 22 nt, Human
auuuagccucauuuuugacaua

SEQ ID NO: 399509 - RNA, 22 nt, Human
uauacagauuaacagauuuaaa

SEQ ID NO: 399510 - RNA, 22 nt, Human
aaauucaauuaacuuucaugcu

SEQ ID NO: 399511 - RNA, 22 nt, Human
uaaguccuucaccuaauccuca

SEQ ID NO: 399512 - RNA, 22 nt, Human
uuccaaagugcuggaauuacau

SEQ ID NO: 399513 - RNA, 22 nt, Human
uuuuauguuccucuuuaugcga

SEQ ID NO: 399514 - RNA, 22 nt, Human
cugaauaaagcccucgcgcgcu

SEQ ID NO: 399515 - RNA, 22 nt, Human
uauuucaacguaugaaaagcug

SEQ ID NO: 399516 - RNA, 22 nt, Human
gauagaaagguguugaaaucca

SEQ ID NO: 399517 - RNA, 22 nt, Human
gcaaacaagcugccugaagauu

SEQ ID NO: 399518 - RNA, 22 nt, Human
uuaauuacaaaacacauagguu

SEQ ID NO: 399519 - RNA, 22 nt, Human
caucagaacaaaucgguuaaga

SEQ ID NO: 399520 - RNA, 22 nt, Human
acaaagucaaauugcagccgcc

SEQ ID NO: 399521 - RNA, 22 nt, Human
ccagaucuucuuuucagugucu

SEQ ID NO: 399522 - RNA, 22 nt, Human
aacauguugcuuuaauaauauu

SEQ ID NO: 399523 - RNA, 22 nt, Human
uuauccaagcagaagcugcaca

SEQ ID NO: 399524 - RNA, 22 nt, Human
gggauuuaguaggauaguauac

SEQ ID NO: 399525 - RNA, 22 nt, Human
gaauuucauugcucugcugugu

SEQ ID NO: 399526 - RNA, 22 nt, Human
gagucaccuugggucagcgaua

SEQ ID NO: 399527 - RNA, 22 nt, Human
uuuaaagagaaugugaaggagu

SEQ ID NO: 399528 - RNA, 22 nt, Human
uaaagacaauaggaaaguuguu

SEQ ID NO: 399529 - RNA, 22 nt, Human
auucucaauggcuacuuucaua

SEQ ID NO: 399530 - RNA, 22 nt, Human
uaguaucuauuaguaacaagag

SEQ ID NO: 399531 - RNA, 22 nt, Human
auucaacggguagaagggucuu

SEQ ID NO: 399532 - RNA, 22 nt, Human
cagauuucagcucauauauuau

SEQ ID NO: 399533 - RNA, 22 nt, Human
ugaaacaaugugaaguugcuga

SEQ ID NO: 399534 - RNA, 22 nt, Human
uauguuaagugggauaaucaaa

SEQ ID NO: 399535 - RNA, 22 nt, Human
augguuuaguuagggcuuuuca

SEQ ID NO: 399536 - RNA, 22 nt, Human
uguaaauaguuagcuugccucu

SEQ ID NO: 399537 - RNA, 22 nt, Human
uacaugaaccuuuaugugugau

SEQ ID NO: 399538 - RNA, 22 nt, Human
cagauaaaggcuuacuaguagu

SEQ ID NO: 399539 - RNA, 22 nt, Human
uucaaacauucaaauaaaccgg

SEQ ID NO: 399540 - RNA, 22 nt, Human
uguccuuagggauauaaaauau

SEQ ID NO: 399541 - RNA, 22 nt, Human
uauaauuaguaaauggcagauu

SEQ ID NO: 399542 - RNA, 22 nt, Human
aaucagugguucccagcccagg

SEQ ID NO: 399543 - RNA, 22 nt, Human
caugguuuauuagagcuuauuu

SEQ ID NO: 399544 - RNA, 22 nt, Human
aaauacugggcucaaaaggguu

SEQ ID NO: 399545 - RNA, 22 nt, Human
gcagggcagaccuccagccuau

SEQ ID NO: 399546 - RNA, 22 nt, Human
ggcauuuagauugaauuucugu

SEQ ID NO: 399547 - RNA, 22 nt, Human
cuuaggcaaccaggucaaugcu

SEQ ID NO: 399548 - RNA, 22 nt, Human
gcaaaauuuacacuccuucuuc

SEQ ID NO: 399549 - RNA, 22 nt, Human
ucagcauaucuugagcuucaug

SEQ ID NO: 399550 - RNA, 22 nt, Human
aauguuaauuuacugucuucau

SEQ ID NO: 399551 - RNA, 22 nt, Human
ucagaauugcagggagggcagg

SEQ ID NO: 399552 - RNA, 22 nt, Human
gauuucaaguaucuugggcgag

SEQ ID NO: 399553 - RNA, 22 nt, Human
uuggaucauggaaugucugcuu

SEQ ID NO: 399554 - RNA, 22 nt, Human
uaucagaaaugccuuaaauugg

SEQ ID NO: 399555 - RNA, 22 nt, Human
auggauuuggaugagauuacuu

SEQ ID NO: 399556 - RNA, 22 nt, Human
uuuauaaacaguaccacggugc

SEQ ID NO: 399557 - RNA, 22 nt, Human
cuagaaauauuuuacagucaag

SEQ ID NO: 399558 - RNA, 22 nt, Human
uaccaaaaccaagccauuaucu

SEQ ID NO: 399559 - RNA, 22 nt, Human
uucagaaaucgaguuucauguc

SEQ ID NO: 399560 - RNA, 22 nt, Human
ugcaggaacuugguuuuacuca

SEQ ID NO: 399561 - RNA, 22 nt, Human
uguucuagcaacacaguuuugg

SEQ ID NO: 399562 - RNA, 22 nt, Human
ugaauaauuaugggaguccuaa

SEQ ID NO: 399563 - RNA, 22 nt, Human
aggauuuaucaggaacucucuu

SEQ ID NO: 399564 - RNA, 22 nt, Human
uauuucaagaacuucuauccau

SEQ ID NO: 399565 - RNA, 22 nt, Human
cauaagaagguaacauccuuaa

SEQ ID NO: 399566 - RNA, 22 nt, Human
cauucauucuguaaguaacuau

SEQ ID NO: 399567 - RNA, 22 nt, Human
gaauuucagggucugguaggaa

SEQ ID NO: 399568 - RNA, 22 nt, Human
gaguccuuggcaucaucaguac

SEQ ID NO: 399569 - RNA, 22 nt, Human
uaguccuugcugggcacagagu

SEQ ID NO: 399570 - RNA, 18 nt, Human
aguccuuacgaggcuaua

SEQ ID NO: 399571 - RNA, 22 nt, Human
augaauaaaacauuuuaaucag

SEQ ID NO: 399572 - RNA, 22 nt, Human
agucaaaugaguaaauauauaa

SEQ ID NO: 399573 - RNA, 22 nt, Human
aaaguccuguuaacuguuaaca

SEQ ID NO: 399574 - RNA, 20 nt, Human
auaggaaagggaggggcuuu

SEQ ID NO: 399575 - RNA, 22 nt, Human
caucagaaggccagaggguagc

SEQ ID NO: 399576 - RNA, 23 nt, Human
ggccauuucauuugguucaaacu

SEQ ID NO: 399577 - RNA, 22 nt, Human
uaauuuacuugcaaauaacaau

SEQ ID NO: 399578 - RNA, 22 nt, Human
acacacucaauugcauaagcac

SEQ ID NO: 399579 - RNA, 22 nt, Human
aaagcauuucaugucuagaaag

SEQ ID NO: 399580 - RNA, 22 nt, Human
uucagaaacccauugggucucu

SEQ ID NO: 399581 - RNA, 22 nt, Human
uaagaaacccaggaauuucuua

SEQ ID NO: 399582 - RNA, 22 nt, Human
auucuuaauugccaugcuguau

SEQ ID NO: 399583 - RNA, 22 nt, Human
uaauuucaccguugcuagaaau

SEQ ID NO: 399584 - RNA, 22 nt, Human
aauucuaaauguaauuuagaau

SEQ ID NO: 399585 - RNA, 22 nt, Human
gauuucaaggauguuagaggug

SEQ ID NO: 399586 - RNA, 22 nt, Human
guacagaaggagcuuuggauuc

SEQ ID NO: 399587 - RNA, 22 nt, Human
gguacaauccacuguggguuag

SEQ ID NO: 399588 - RNA, 22 nt, Human
acagccaggaggaacucaguga

SEQ ID NO: 399589 - RNA, 19 nt, Human
acaagucacuuacuuagua

SEQ ID NO: 399590 - RNA, 18 nt, Human
auacaagaucaaguguuc

SEQ ID NO: 399591 - RNA, 22 nt, Human
ugugaauacagcaugugcuucu

SEQ ID NO: 399592 - RNA, 22 nt, Human
cauaaaauggcuuguucuuuaa

SEQ ID NO: 399593 - RNA, 22 nt, Human
ucaaaauuuuauuucucaagga

SEQ ID NO: 399594 - RNA, 23 nt, Human
cauuucaacgaauuuuccuucug

SEQ ID NO: 399595 - RNA, 22 nt, Human
aacauaauguggccaaagucac

SEQ ID NO: 399596 - RNA, 22 nt, Human
uggcuuuagguugcauguuucu

SEQ ID NO: 399597 - RNA, 21 nt, Human
ucauuuauugagaaaugacug

SEQ ID NO: 399598 - RNA, 22 nt, Human
uuucaucucucuaaaagacagu

SEQ ID NO: 399599 - RNA, 22 nt, Human
auggcuuaugguaaauauuucu

SEQ ID NO: 399600 - RNA, 22 nt, Human
uauaaagcugacucaugaaacu

SEQ ID NO: 399601 - RNA, 23 nt, Human
ucagagaacucgggcagaugacc

SEQ ID NO: 399602 - RNA, 22 nt, Human
gugugaaaguuccuaagacuau

SEQ ID NO: 399603 - RNA, 22 nt, Human
augaaaauacugugguugauag

SEQ ID NO: 399604 - RNA, 22 nt, Human
ucagaaaauaacuguuaguuug

SEQ ID NO: 399605 - RNA, 22 nt, Human
auuucauagauuguaaaucccu

SEQ ID NO: 399606 - RNA, 22 nt, Human
caaugaaaauuuaaguugcagc

SEQ ID NO: 399607 - RNA, 22 nt, Human
aggauuuauuacaagccauggu

SEQ ID NO: 399608 - RNA, 22 nt, Human
ggcauuuaauccaucugauuga

SEQ ID NO: 399609 - RNA, 19 nt, Human
acuguaaggcauuuuuuuc

SEQ ID NO: 399610 - RNA, 22 nt, Human
ccagcuauugcuguguaacagu

SEQ ID NO: 399611 - RNA, 22 nt, Human
uaugcugugcuagauacaauau

SEQ ID NO: 399612 - RNA, 22 nt, Human
uuaagcaacacacauuaauuau

SEQ ID NO: 399613 - RNA, 22 nt, Human
uguccuuagaagaagugaaaga

SEQ ID NO: 399614 - RNA, 22 nt, Human
gcagggcaaacccagguguuca

SEQ ID NO: 399615 - RNA, 22 nt, Human
aguucucauugcaugagacaga

SEQ ID NO: 399616 - RNA, 22 nt, Human
uuuauccaaggguuuuaacugu

SEQ ID NO: 399617 - RNA, 22 nt, Human
aaacaggcaucacucagcaaag

SEQ ID NO: 399618 - RNA, 22 nt, Human
aggauuuagauuuggaggaacu

SEQ ID NO: 399619 - RNA, 22 nt, Human
auuucaggauagccuaguuuug

SEQ ID NO: 399620 - RNA, 22 nt, Human
ugugaauagugccgcaauaaac

SEQ ID NO: 399621 - RNA, 22 nt, Human
ucaaguuuaauugagauguuua

SEQ ID NO: 399622 - RNA, 22 nt, Human
uucaaacacagacagcagcaug

SEQ ID NO: 399623 - RNA, 22 nt, Human
ugagacaaaauugacagacaaa

SEQ ID NO: 399624 - RNA, 22 nt, Human
guuuaauaauguugaauuacua

SEQ ID NO: 399625 - RNA, 22 nt, Human
gaauuucaagcagugcaauguu

SEQ ID NO: 399626 - RNA, 22 nt, Human
uuugaauaucacaaacuuucaa

SEQ ID NO: 399627 - RNA, 22 nt, Human
aauuucaauuacuuuugcacca

SEQ ID NO: 399628 - RNA, 22 nt, Human
auuaaacugagcaaauuaacau

SEQ ID NO: 399629 - RNA, 22 nt, Human
aaagaaucguguguaguuugaa

SEQ ID NO: 399630 - RNA, 17 nt, Human
aaucagauuucugagga

SEQ ID NO: 399631 - RNA, 22 nt, Human
auauauaaccuggauaaggcuu

SEQ ID NO: 399632 - RNA, 22 nt, Human
uguacaaugccagggaacacca

SEQ ID NO: 399633 - RNA, 21 nt, Human
gcuauacagaauggccagagg

SEQ ID NO: 399634 - RNA, 22 nt, Human
uaaagacaauuucgagcuguag

SEQ ID NO: 399635 - RNA, 22 nt, Human
auaucaaagcuaguggaaauuu

SEQ ID NO: 399636 - RNA, 22 nt, Human
augaaaauucuaugcaggccag

SEQ ID NO: 399637 - RNA, 22 nt, Human
acuaaacugaagcaugaaaagg

SEQ ID NO: 399638 - RNA, 22 nt, Human
ugcauaauacguuuccuauaac

SEQ ID NO: 399639 - RNA, 22 nt, Human
auacagaacucucaguuguaua

SEQ ID NO: 399640 - RNA, 22 nt, Human
uguacaaugccgagacuaacuc

SEQ ID NO: 399641 - RNA, 22 nt, Human
uuccuuaggcuguuugcagugc

SEQ ID NO: 399642 - RNA, 22 nt, Human
cuggauuuaggacuaguccaag

SEQ ID NO: 399643 - RNA, 21 nt, Human
aacugguucaauucaacuaga

SEQ ID NO: 399644 - RNA, 22 nt, Human
cuaucaaacagccauuaauaua

SEQ ID NO: 399645 - RNA, 22 nt, Human
ugguuuuagaugccuuuacugc

SEQ ID NO: 399646 - RNA, 22 nt, Human
aauacaagauuuauaguuguuu

SEQ ID NO: 399647 - RNA, 22 nt, Human
guuauaaauaccuaauaggauu

SEQ ID NO: 399648 - RNA, 22 nt, Human
caguaaauuaucucaucucugu

SEQ ID NO: 399649 - RNA, 22 nt, Human
auaaacucaugccaagaaauga

SEQ ID NO: 399650 - RNA, 22 nt, Human
aaacuuuguagagaaugcuggc

SEQ ID NO: 399651 - RNA, 22 nt, Human
aaaguccuugcaguuuccucuu

SEQ ID NO: 399652 - RNA, 22 nt, Human
uggcaauuuuaggugguuuagu

SEQ ID NO: 399653 - RNA, 22 nt, Human
caguccuugauccaauaguggg

SEQ ID NO: 399654 - RNA, 22 nt, Human
acaugcuuuaacuuauuuugau

SEQ ID NO: 399655 - RNA, 22 nt, Human
uaaguccuaauggcagaagucu

SEQ ID NO: 399656 - RNA, 22 nt, Human
cauuuacagcagacugaugaaa

SEQ ID NO: 399657 - RNA, 22 nt, Human
guacagaauuaugccaugaggg

SEQ ID NO: 399658 - RNA, 22 nt, Human
aaagucauccaaauuuuuaugu

SEQ ID NO: 399659 - RNA, 22 nt, Human
uguaagaaucagucuuuaaugu

SEQ ID NO: 399660 - RNA, 22 nt, Human
aagauauacuauuaaguaccau

SEQ ID NO: 399661 - RNA, 22 nt, Human
aaucagaauuuguccccugagu

SEQ ID NO: 399662 - RNA, 22 nt, Human
auacaaauuuauagaugcauuu

SEQ ID NO: 399663 - RNA, 22 nt, Human
uuuaggcaagaacucacugaga

SEQ ID NO: 399664 - RNA, 22 nt, Human
guacaauagucccuguuuggau

SEQ ID NO: 399665 - RNA, 22 nt, Human
ucccaguuuuucuccacuaagg

SEQ ID NO: 399666 - RNA, 20 nt, Human
gaguccuuaugggcugaggu

SEQ ID NO: 399667 - RNA, 22 nt, Human
uagcauaacagguaagagugag

SEQ ID NO: 399668 - RNA, 22 nt, Human
uguuuauaccugcaaccuguca

SEQ ID NO: 399669 - RNA, 21 nt, Human
gagauuuagaaggaucaauuu

SEQ ID NO: 399670 - RNA, 22 nt, Human
ugaauagauuuuuaacauauaa

SEQ ID NO: 399671 - RNA, 22 nt, Human
guacauaaaggaggcucuuugc

SEQ ID NO: 399672 - RNA, 22 nt, Human
aguagaauagauggauacuauu

SEQ ID NO: 399673 - RNA, 22 nt, Human
gaagaauccuguccucuuuagg

SEQ ID NO: 399674 - RNA, 22 nt, Human
uuuauccagcagcuauucaaaa

SEQ ID NO: 399675 - RNA, 22 nt, Human
augcuuuaaacuauaaauccac

SEQ ID NO: 399676 - RNA, 22 nt, Human
ucacagaacaauguuuaguucu

SEQ ID NO: 399677 - RNA, 22 nt, Human
ccuauacagccucagcugagau

SEQ ID NO: 399678 - RNA, 22 nt, Human
aaaucagugcucauuugaaagg

SEQ ID NO: 399679 - RNA, 22 nt, Human
ggcgcacaaugugcagguuugu

SEQ ID NO: 399680 - RNA, 22 nt, Human
augaaaacggaccagagcuauu

SEQ ID NO: 399681 - RNA, 22 nt, Human
ccaguacugucuccaauauucc

SEQ ID NO: 399682 - RNA, 22 nt, Human
auguuucaccagcaaauuaccu

SEQ ID NO: 399683 - RNA, 22 nt, Human
uuccuuaguuauuugguccccu

SEQ ID NO: 399684 - RNA, 22 nt, Human
ugaucugaaggacaugggaccc

SEQ ID NO: 399685 - RNA, 21 nt, Human
agccagucuguuuucuagugc

SEQ ID NO: 399686 - RNA, 22 nt, Human
ugcuauacggagcaucuucagg

SEQ ID NO: 399687 - RNA, 22 nt, Human
cauuaauauuguucuucuuuag

SEQ ID NO: 399688 - RNA, 21 nt, Human
ucauucacaggguauuguaua

SEQ ID NO: 399689 - RNA, 22 nt, Human
uaucaaaggcuaugugauuuuu

SEQ ID NO: 399690 - RNA, 22 nt, Human
gauuuccaggucauuaauaaag

SEQ ID NO: 399691 - RNA, 22 nt, Human
aauacagaggggucacaauuca

SEQ ID NO: 399692 - RNA, 22 nt, Human
uaagaaguacaaaaauuuucug

SEQ ID NO: 399693 - RNA, 22 nt, Human
caggaaacauaugugcuugagg

SEQ ID NO: 399694 - RNA, 22 nt, Human
gaucagaauucuuguguguuuc

SEQ ID NO: 399695 - RNA, 22 nt, Human
guacagaaugcuugguaaggca

SEQ ID NO: 399696 - RNA, 22 nt, Human
cuacagaaacacuggacaugug

SEQ ID NO: 399697 - RNA, 22 nt, Human
gacaauacagaaagggacaugc

SEQ ID NO: 399698 - RNA, 22 nt, Human
uugaucaucuaagaguaauagu

SEQ ID NO: 399699 - RNA, 22 nt, Human
caugcuuuuuucuaguauaaau

SEQ ID NO: 399700 - RNA, 22 nt, Human
acauaauagguaccugaauaau

SEQ ID NO: 399701 - RNA, 20 nt, Human
agaagucagcucagaaguga

SEQ ID NO: 399702 - RNA, 22 nt, Human
auggaucagaaucccgggaggg

SEQ ID NO: 399703 - RNA, 22 nt, Human
cuacagaagaaacuaucacuau

SEQ ID NO: 399704 - RNA, 22 nt, Human
caugauaauuguuaacaaagua

SEQ ID NO: 399705 - RNA, 22 nt, Human
aggaaaaauaaggcagcagggc

SEQ ID NO: 399706 - RNA, 22 nt, Human
ugacuucaagguucagcaccuu

SEQ ID NO: 399707 - RNA, 22 nt, Human
auacagaaaaugaugcagaguu

SEQ ID NO: 399708 - RNA, 22 nt, Human
ucuggaucggguuccucagguc

SEQ ID NO: 399709 - RNA, 22 nt, Human
uuuccaaaggcuaaacucaguu

SEQ ID NO: 399710 - RNA, 20 nt, Human
gaaguccuguuauauccuuu

SEQ ID NO: 399711 - RNA, 21 nt, Human
ucaguaaaccuaaagauugua

SEQ ID NO: 399712 - RNA, 22 nt, Human
cagaauuuaaguggauuauucu

SEQ ID NO: 399713 - RNA, 22 nt, Human
uaacauguuaagaaauuagaua

SEQ ID NO: 399714 - RNA, 21 nt, Human
aauccuuaaugaggaguuggu

SEQ ID NO: 399715 - RNA, 22 nt, Human
uggauuagugcugaaaugaugg

SEQ ID NO: 399716 - RNA, 21 nt, Human
auacagaacauugauccaaga

SEQ ID NO: 399717 - RNA, 22 nt, Human
aguaaacaguaucuuuaguguc

SEQ ID NO: 399718 - RNA, 22 nt, Human
ugaaugaaugaauuaauagagu

SEQ ID NO: 399719 - RNA, 22 nt, Human
uacugaaaagccacaaggacca

SEQ ID NO: 399720 - RNA, 22 nt, Human
auuucaggagcaguuucagugg

SEQ ID NO: 399721 - RNA, 22 nt, Human
uacuaaacaucuggcauuaaau

SEQ ID NO: 399722 - RNA, 22 nt, Human
agucuuaacuaugcaaguacua

SEQ ID NO: 399723 - RNA, 22 nt, Human
caucagaauguuauggggggcu

SEQ ID NO: 399724 - RNA, 22 nt, Human
auccuuagaagggagugaggac

SEQ ID NO: 399725 - RNA, 22 nt, Human
uuauacaguuuauacuuagaau

SEQ ID NO: 399726 - RNA, 22 nt, Human
cauuucaaguaacagauugcuu

SEQ ID NO: 399727 - RNA, 22 nt, Human
cuacagaaaaucagccacaggc

SEQ ID NO: 399728 - RNA, 22 nt, Human
aaacaugaauagauauuaaaca

SEQ ID NO: 399729 - RNA, 22 nt, Human
caguccuucuccauuaaggcuc

SEQ ID NO: 399730 - RNA, 22 nt, Human
uacagaaaucacaucgcuuuga

SEQ ID NO: 399731 - RNA, 22 nt, Human
uuaauaaaguaugaauuggaaa

SEQ ID NO: 399732 - RNA, 22 nt, Human
ucucacuuuguugcccagacuu

SEQ ID NO: 399733 - RNA, 22 nt, Human
auauaauuguucugaaguguuu

SEQ ID NO: 399734 - RNA, 22 nt, Human
aaaaugcugggaaaguuggaau

SEQ ID NO: 399735 - RNA, 22 nt, Human
ucuucaauuuagaauggauuua

SEQ ID NO: 399736 - RNA, 22 nt, Human
uuauauaaagauaacuuuucuu

SEQ ID NO: 399737 - RNA, 22 nt, Human
guuauaaaugacugcaaaaguu

SEQ ID NO: 399738 - RNA, 22 nt, Human
gaaauauacauugcaggaagag

SEQ ID NO: 399739 - RNA, 23 nt, Human
uuaagacuggcugaacuuaguag

SEQ ID NO: 399740 - RNA, 22 nt, Human
auacacauguguaugugcaugc

SEQ ID NO: 399741 - RNA, 18 nt, Human
uacagauuauagauacau

SEQ ID NO: 399742 - RNA, 22 nt, Human
uuauuugcccauguuuagcaga

SEQ ID NO: 399743 - RNA, 22 nt, Human
ucagugugaggucuuccacccg

SEQ ID NO: 399744 - RNA, 22 nt, Human
uguugauuaguguuuagacuua

SEQ ID NO: 399745 - RNA, 22 nt, Human
uacuucauuccuuuguaaaaug

SEQ ID NO: 399746 - RNA, 22 nt, Human
uucagaaacccauugggucucu

SEQ ID NO: 399747 - RNA, 21 nt, Human
uccagaaaagaggucauuagc

SEQ ID NO: 399748 - RNA, 22 nt, Human
uaaggccaaacuauuauaguuc

SEQ ID NO: 399749 - RNA, 22 nt, Human
uuucaaagaguuguaaauuacu

SEQ ID NO: 399750 - RNA, 22 nt, Human
gcuccucuucucccacugaaug

SEQ ID NO: 399751 - RNA, 22 nt, Human
agcaauuuucccuuagucuuug

SEQ ID NO: 399752 - RNA, 22 nt, Human
uuagccaugcccuagaagagga

SEQ ID NO: 399753 - RNA, 22 nt, Human
aacauguaaccagcauucaucu

SEQ ID NO: 399754 - RNA, 23 nt, Human
uuccagaguccacaucugccacc

SEQ ID NO: 399755 - RNA, 22 nt, Human
aggacuuagaacauuauguacu

SEQ ID NO: 399756 - RNA, 22 nt, Human
aaagauuauggcauugaaauac

SEQ ID NO: 399757 - RNA, 22 nt, Human
ucaaaauuuuauuucucaagga

SEQ ID NO: 399758 - RNA, 22 nt, Human
uugaaauaucaaguuauuagug

SEQ ID NO: 399759 - RNA, 22 nt, Human
cauuuguacagaacagcuuuau

SEQ ID NO: 399760 - RNA, 22 nt, Human
aauuaauggaaaguaaggaagg

SEQ ID NO: 399761 - RNA, 22 nt, Human
uaaagacaaacccacuaggguu

SEQ ID NO: 399762 - RNA, 22 nt, Human
augaauaaaacauuuuaaucag

SEQ ID NO: 399763 - RNA, 22 nt, Human
uggauuagguacuaugaauaua

SEQ ID NO: 399764 - RNA, 22 nt, Human
aguccuuaugugguggagagag

SEQ ID NO: 399765 - RNA, 22 nt, Human
gaggaaccaaaucagcuugcac

SEQ ID NO: 399766 - RNA, 22 nt, Human
gaugaaaaauugcugugucaua

SEQ ID NO: 399767 - RNA, 23 nt, Human
augguuuaugucacacuuuugau

SEQ ID NO: 399768 - RNA, 22 nt, Human
aucuuucuccauauacaucuuu

SEQ ID NO: 399769 - RNA, 22 nt, Human
aagcagggcuuuaagcgguuuu

SEQ ID NO: 399770 - RNA, 22 nt, Human
guucuucaggcugugcucuaga

SEQ ID NO: 399771 - RNA, 22 nt, Human
aaugguuuucuagaacaugaaa

SEQ ID NO: 399772 - RNA, 22 nt, Human
cugggaaauggcuucgagcuca

SEQ ID NO: 399773 - RNA, 17 nt, Human
cucacggaggaugaauc

SEQ ID NO: 399774 - RNA, 22 nt, Human
uaguccuugcugggcacagagu

SEQ ID NO: 399775 - RNA, 22 nt, Human
gaaucucaaggcuugugaggau

SEQ ID NO: 399776 - RNA, 22 nt, Human
ugcaacuuguuuggagagaaag

SEQ ID NO: 399777 - RNA, 22 nt, Human
cauuugcagagggugacacucu

SEQ ID NO: 399778 - RNA, 22 nt, Human
acuuuuaaggggccuugauuua

SEQ ID NO: 399779 - RNA, 22 nt, Human
uaucagaacacauguuuugcag

SEQ ID NO: 399780 - RNA, 22 nt, Human
uagauuuuacuucugucauuac

SEQ ID NO: 399781 - RNA, 23 nt, Human
gagauuuagcagacaaagcucuu

SEQ ID NO: 399782 - RNA, 22 nt, Human
aacauguugcuuuaauaauauu

SEQ ID NO: 399783 - RNA, 22 nt, Human
agaccauggccauccuaggaaa

SEQ ID NO: 399784 - RNA, 22 nt, Human
auauacaaagggcaaccucgcu

SEQ ID NO: 399785 - RNA, 22 nt, Human
ggccagagaauaugccuuacgu

SEQ ID NO: 399786 - RNA, 22 nt, Human
cugaaugaggaaaagagugagg

SEQ ID NO: 399787 - RNA, 22 nt, Human
ucaggauguuaauauagcauua

SEQ ID NO: 399788 - RNA, 22 nt, Human
aauguuaauuuacugucuucau

SEQ ID NO: 399789 - RNA, 22 nt, Human
augaguucaauuguuucaguca

SEQ ID NO: 399790 - RNA, 22 nt, Human
uucaggaugcucagaguagucu

SEQ ID NO: 399791 - RNA, 22 nt, Human
uuugaaguguuauuucuaucac

SEQ ID NO: 399792 - RNA, 22 nt, Human
uauguguuugacacccugcaag

SEQ ID NO: 399793 - RNA, 20 nt, Human
cuguggaauuuuaccaugcg

SEQ ID NO: 399794 - RNA, 19 nt, Human
uugaaauuguuugauaugg

SEQ ID NO: 399795 - RNA, 22 nt, Human
caacuuugugugaccuagauag

SEQ ID NO: 399796 - RNA, 19 nt, Human
agcuuccauauucucuagu

SEQ ID NO: 399797 - RNA, 22 nt, Human
uucuuagaugauuaaugauggg

SEQ ID NO: 399798 - RNA, 22 nt, Human
ugaugaaaauaugauucugagg

SEQ ID NO: 399799 - RNA, 22 nt, Human
cuuuacauaaggauaaaccugg

SEQ ID NO: 399800 - RNA, 22 nt, Human
aaauucaauuaacuuucaugcu

SEQ ID NO: 399801 - RNA, 22 nt, Human
uguugaagauaaaguucucauu

SEQ ID NO: 399802 - RNA, 22 nt, Human
aaaaucugcuuccuuuuacaga

SEQ ID NO: 399803 - RNA, 22 nt, Human
augugaggcagcacggagauua

SEQ ID NO: 399804 - RNA, 22 nt, Human
aguccuuacaccuggaaccuau

SEQ ID NO: 399805 - RNA, 22 nt, Human
uaaagucaucuuuaaacaugcc

SEQ ID NO: 399806 - RNA, 22 nt, Human
gaggaaccacucugagaagcca

SEQ ID NO: 399807 - RNA, 22 nt, Human
ucagccagcaucagcuaagugc

SEQ ID NO: 399808 - RNA, 23 nt, Human
uacagaaggaguagucacuaaga

SEQ ID NO: 399809 - RNA, 22 nt, Human
uauaagaaauugccaaccuguu

SEQ ID NO: 399810 - RNA, 22 nt, Human
auguaaaucaagcagugcuggu

SEQ ID NO: 399811 - RNA, 22 nt, Human
augguuuuagaaucaggaaaaa

SEQ ID NO: 399812 - RNA, 22 nt, Human
auaaauaucacuguugucccuc

SEQ ID NO: 399813 - RNA, 22 nt, Human
caggaaugaggucguaaguguc

SEQ ID NO: 399814 - RNA, 22 nt, Human
uaacagaagaugaaacuucuuu

SEQ ID NO: 399815 - RNA, 22 nt, Human
acacauauucauauguacuuac

SEQ ID NO: 399816 - RNA, 19 nt, Human
ugccuggacaaaugugggg

SEQ ID NO: 399817 - RNA, 22 nt, Human
ugcuuuaacauaagauaucuuu

SEQ ID NO: 399818 - RNA, 22 nt, Human
uaagucaucacauugcagagau

SEQ ID NO: 399819 - RNA, 22 nt, Human
gcuuaauucuggcucaguuucc

SEQ ID NO: 399820 - RNA, 22 nt, Human
uucucuuuugugaugugagaug

SEQ ID NO: 399821 - RNA, 22 nt, Human
uacacauguuuggcaaguaugu

SEQ ID NO: 399822 - RNA, 22 nt, Human
uaagaaucgauguuuauuuaga

SEQ ID NO: 399823 - RNA, 22 nt, Human
ggcaauuucaugugguuuaaac

SEQ ID NO: 399824 - RNA, 22 nt, Human
aacuuugaggucacugaauucc

SEQ ID NO: 399825 - RNA, 22 nt, Human
uaaggccauuauggugggcccg

SEQ ID NO: 399826 - RNA, 23 nt, Human
uuucaacuccugccauuauuucu

SEQ ID NO: 399827 - RNA, 22 nt, Human
ggcauuuacauaaucuuauuua

SEQ ID NO: 399828 - RNA, 22 nt, Human
aaauuucaagcaaaguagcuau

SEQ ID NO: 399829 - RNA, 22 nt, Human
cucaagacugaucgcaguggaa

SEQ ID NO: 399830 - RNA, 18 nt, Human
uuugcaaaggaaguaugg

SEQ ID NO: 399831 - RNA, 22 nt, Human
cagucuucuaaccuagcagccu

SEQ ID NO: 399832 - RNA, 22 nt, Human
aaguccuugaagaaacaguucu

SEQ ID NO: 399833 - RNA, 22 nt, Human
cagucucucugaaguauuaaga

SEQ ID NO: 399834 - RNA, 22 nt, Human
gaauuucauuuguuuccuacca

SEQ ID NO: 399835 - RNA, 22 nt, Human
aaagucauuggaauauuaauga

SEQ ID NO: 399836 - RNA, 23 nt, Human
uuacagaaaguaugcuuuuguuu

SEQ ID NO: 399837 - RNA, 20 nt, Human
ccucaguguccuggacuggg

SEQ ID NO: 399838 - RNA, 22 nt, Human
cagaagucacccucagaauaac

SEQ ID NO: 399839 - RNA, 17 nt, Human
uaaguccuaguuauuuu

SEQ ID NO: 399840 - RNA, 22 nt, Human
guuauaaaaugcacaguuguuu

SEQ ID NO: 399841 - RNA, 22 nt, Human
uaauuauucuagucacauagca

SEQ ID NO: 399842 - RNA, 22 nt, Human
caggaugagaggcccagggaag

SEQ ID NO: 399843 - RNA, 22 nt, Human
uacaguaagaugaaauagcaau

SEQ ID NO: 399844 - RNA, 22 nt, Human
uuucaacuuguuugcuuccaua

SEQ ID NO: 399845 - RNA, 22 nt, Human
uuuauaaaauagacugggucua

SEQ ID NO: 399846 - RNA, 22 nt, Human
aaauaauguuaggccuuugcuc

SEQ ID NO: 399847 - RNA, 22 nt, Human
caguucuuaauaccaugugguu

SEQ ID NO: 399848 - RNA, 22 nt, Human
agaaguuguagguuugcauauu

SEQ ID NO: 399849 - RNA, 22 nt, Human
ucaaguuuaauugagauguuua

SEQ ID NO: 399850 - RNA, 22 nt, Human
uuauggcauauuccucauugua

SEQ ID NO: 399851 - RNA, 22 nt, Human
gcucacugccauucucuagaug

SEQ ID NO: 399852 - RNA, 22 nt, Human
cuaauacacccuauugcuuguu

SEQ ID NO: 399853 - RNA, 22 nt, Human
cacccaguugacuacaaagggg

SEQ ID NO: 399854 - RNA, 23 nt, Human
guaaaauacgcagugcaguguga

SEQ ID NO: 399855 - RNA, 22 nt, Human
aagcauuugugaaauucagaug

SEQ ID NO: 399856 - RNA, 22 nt, Human
uuugaaagagcugauacaugaa

SEQ ID NO: 399857 - RNA, 22 nt, Human
ucagguggcuuggagggggacg

SEQ ID NO: 399858 - RNA, 22 nt, Human
agucucugcugguugugccuau

SEQ ID NO: 399859 - RNA, 20 nt, Human
auacuuguuuucaggcuuuu

SEQ ID NO: 399860 - RNA, 22 nt, Human
caauuucaagauucuguucuuu

SEQ ID NO: 399861 - RNA, 22 nt, Human
auugaaagaguuuucugcugca

SEQ ID NO: 399862 - RNA, 22 nt, Human
aucaggaucugcaucauaagaa

SEQ ID NO: 399863 - RNA, 22 nt, Human
cuacuucuaaguacauggugau

SEQ ID NO: 399864 - RNA, 22 nt, Human
auuugcaaagucguaucuguga

SEQ ID NO: 399865 - RNA, 22 nt, Human
aauuccaggcagaaaugugagu

SEQ ID NO: 399866 - RNA, 22 nt, Human
acacaaguucuaaagauugcgc

SEQ ID NO: 399867 - RNA, 22 nt, Human
ucagaauaugcuaaugacauuu

SEQ ID NO: 399868 - RNA, 22 nt, Human
gaguccuuggcaucaucaguac

SEQ ID NO: 399869 - RNA, 22 nt, Human
uggauuaguuaagaaauguuag

SEQ ID NO: 399870 - RNA, 22 nt, Human
ugaauaauccacagucauucau

SEQ ID NO: 399871 - RNA, 22 nt, Human
aauuucaaacucuugcccucag

SEQ ID NO: 399872 - RNA, 22 nt, Human
acagauuuuugguaaauaauuu

SEQ ID NO: 399873 - RNA, 20 nt, Human
gaguuccccauuucuccugg

SEQ ID NO: 399874 - RNA, 21 nt, Human
auacagaagguggcaaaguac

SEQ ID NO: 399875 - RNA, 22 nt, Human
uugcaaaggggaauaaagcaau

SEQ ID NO: 399876 - RNA, 22 nt, Human
uuccuuagcagaccugguaucc

SEQ ID NO: 399877 - RNA, 18 nt, Human
ucauuuguuuugcaugaa

SEQ ID NO: 399878 - RNA, 18 nt, Human
auuguuaauagaguacuu

SEQ ID NO: 399879 - RNA, 22 nt, Human
ucuauaaauuaugcagucucag

SEQ ID NO: 399880 - RNA, 22 nt, Human
uguacaaucugaugauguaugg

SEQ ID NO: 399881 - RNA, 22 nt, Human
ucuuuaaugugauuguaauuau

SEQ ID NO: 399882 - RNA, 17 nt, Human
ugcuuaauuuugacugg

SEQ ID NO: 399883 - RNA, 22 nt, Human
ucugauaacucuggccccaggc

SEQ ID NO: 399884 - RNA, 22 nt, Human
augcuuuaaacuauaaauccac

SEQ ID NO: 399885 - RNA, 22 nt, Human
uagcauaacagguaagagugag

SEQ ID NO: 399886 - RNA, 22 nt, Human
uggcauuuuguucaguauaugg

SEQ ID NO: 399887 - RNA, 22 nt, Human
cagcccagagauguuaucuagu

SEQ ID NO: 399888 - RNA, 22 nt, Human
ugauuauauucuaacuucauaa

SEQ ID NO: 399889 - RNA, 22 nt, Human
gacaauacagaaagggacaugc

SEQ ID NO: 399890 - RNA, 22 nt, Human
acuuugaaagccuuggccccgg

SEQ ID NO: 399891 - RNA, 22 nt, Human
uacaguauguucuugaauuugg

SEQ ID NO: 399892 - RNA, 22 nt, Human
uucuucaacaaggacacuguua

SEQ ID NO: 399893 - RNA, 22 nt, Human
cucuucuugccugaugaggcag

SEQ ID NO: 399894 - RNA, 22 nt, Human
ugcagguaggccugacuuccag

SEQ ID NO: 399895 - RNA, 22 nt, Human
agccauuuuccugaaauauaac

SEQ ID NO: 399896 - RNA, 22 nt, Human
uugaaagucacaauggcauuaa

SEQ ID NO: 399897 - RNA, 22 nt, Human
aucaaaaccuugacuuuuaaug

SEQ ID NO: 399898 - RNA, 22 nt, Human
acugguuuuccagguuacuucu

SEQ ID NO: 399899 - RNA, 22 nt, Human
uguucuagcaacacaguuuugg

SEQ ID NO: 399900 - RNA, 22 nt, Human
aagacagugaucucugagagau

SEQ ID NO: 399901 - RNA, 22 nt, Human
augguauugcaacaacugucau

SEQ ID NO: 399902 - RNA, 22 nt, Human
agauaucaccaguuuuacauac

SEQ ID NO: 399903 - RNA, 23 nt, Human
auguuauuauuagcagucuugcc

SEQ ID NO: 399904 - RNA, 22 nt, Human
ugauugaagaggugaggaaguu

SEQ ID NO: 399905 - RNA, 22 nt, Human
aauaauaagauacuaagggagu

SEQ ID NO: 399906 - RNA, 22 nt, Human
ugugaaagcaagucuaguucuc

SEQ ID NO: 399907 - RNA, 22 nt, Human
cauggcuucuaagugauaacgu

SEQ ID NO: 399908 - RNA, 22 nt, Human
uaaagacaauaggaaaguuguu

SEQ ID NO: 399909 - RNA, 22 nt, Human
agccaacuaauuaaacaacuuu

SEQ ID NO: 399910 - RNA, 22 nt, Human
uuuguuuacucauucauugaug

SEQ ID NO: 399911 - RNA, 18 nt, Human
aauuuccauaugaauugc

SEQ ID NO: 399912 - RNA, 22 nt, Human
uuaaagauucugaggcugauua

SEQ ID NO: 399913 - RNA, 22 nt, Human
cucuaacaccacagugugguuu

SEQ ID NO: 399914 - RNA, 22 nt, Human
acaacauucuuaaauacacuga

SEQ ID NO: 399915 - RNA, 19 nt, Human
aucugccuguuaucacaua

SEQ ID NO: 399916 - RNA, 22 nt, Human
auagacauuuugcauucaagca

SEQ ID NO: 399917 - RNA, 22 nt, Human
uauuccaaaauaguuaagcacu

SEQ ID NO: 399918 - RNA, 22 nt, Human
uucauuuguugacagagacaug

SEQ ID NO: 399919 - RNA, 22 nt, Human
uccuucuuugacaaguggcaga

SEQ ID NO: 399920 - RNA, 22 nt, Human
uaaaugauuuauguaugugaaa

SEQ ID NO: 399921 - RNA, 22 nt, Human
ccauaauauuaaaugcuuuugu

SEQ ID NO: 399922 - RNA, 22 nt, Human
gcagaauuuggggguaaccuuu

SEQ ID NO: 399923 - RNA, 22 nt, Human
aucauaaaccacuuuguaaucu

SEQ ID NO: 399924 - RNA, 20 nt, Human
ccagaagagaugaucaucca

SEQ ID NO: 399925 - RNA, 22 nt, Human
accauguguuuuacacauggua

SEQ ID NO: 399926 - RNA, 22 nt, Human
acagcauugcuccaucucaaga

SEQ ID NO: 399927 - RNA, 23 nt, Human
uuaagacuggcugaacuuaguag

SEQ ID NO: 399928 - RNA, 22 nt, Human
acaagcaugggcuuugacauca

SEQ ID NO: 399929 - RNA, 22 nt, Human
ugaaagcagcaccaauaccauu

SEQ ID NO: 399930 - RNA, 22 nt, Human
gauucuuacuucuaagcaagcu

SEQ ID NO: 399931 - RNA, 23 nt, Human
uggacgccgacuuuggaggcgcu

SEQ ID NO: 399932 - RNA, 19 nt, Human
gcaggaaaugagugauugc

SEQ ID NO: 399933 - RNA, 22 nt, Human
uaugaaauuuaaacacagauca

SEQ ID NO: 399934 - RNA, 22 nt, Human
gaugaaaaaagacgagcauaua

SEQ ID NO: 399935 - RNA, 22 nt, Human
acacuaaugagaaaggaauuaa

SEQ ID NO: 399936 - RNA, 22 nt, Human
acaaaauuaugaagaggccuug

SEQ ID NO: 399937 - RNA, 22 nt, Human
caguccuuauuccuauauuccu

SEQ ID NO: 399938 - RNA, 20 nt, Human
ugcaggaauuugcauuccuu

SEQ ID NO: 399939 - RNA, 22 nt, Human
guucuugccagcauccucaggu

SEQ ID NO: 399940 - RNA, 22 nt, Human
auuuuacuacuccaauuaauga

SEQ ID NO: 399941 - RNA, 22 nt, Human
uguguacacagauaguaauggc

SEQ ID NO: 399942 - RNA, 22 nt, Human
cagugcugggcagaggagagcg

SEQ ID NO: 399943 - RNA, 21 nt, Human
aauccuuaaugaggaguuggu

SEQ ID NO: 399944 - RNA, 20 nt, Human
aguacaauguaugauucaga

SEQ ID NO: 399945 - RNA, 22 nt, Human
uugugaguagugccgcaauaaa

SEQ ID NO: 399946 - RNA, 22 nt, Human
auuuaguguauucuaauaugug

SEQ ID NO: 399947 - RNA, 22 nt, Human
gagcccagcuugcacauggagc

SEQ ID NO: 399948 - RNA, 22 nt, Human
caggauggucuucauuuggcuc

SEQ ID NO: 399949 - RNA, 22 nt, Human
aucagaaaauacccaguguuua

SEQ ID NO: 399950 - RNA, 19 nt, Human
aaaaacuuaguccagaaag

SEQ ID NO: 399951 - RNA, 22 nt, Human
acacauauauacauauuugugc

SEQ ID NO: 399952 - RNA, 22 nt, Human
uuagacaagggcuccuuaaaag

SEQ ID NO: 399953 - RNA, 22 nt, Human
cauuuguaguaucuguuuauau

SEQ ID NO: 399954 - RNA, 22 nt, Human
cuucuucaauagcaagcgcaua

SEQ ID NO: 399955 - RNA, 22 nt, Human
aauugcuaaagauuauguuuuc

SEQ ID NO: 399956 - RNA, 22 nt, Human
cagaaaucauugugaugacagg

SEQ ID NO: 399957 - RNA, 21 nt, Human
auggcuuuuuuaaagcuugug

SEQ ID NO: 399958 - RNA, 22 nt, Human
uucaaacauucaaauaaaccgg

SEQ ID NO: 399959 - RNA, 18 nt, Human
cucaccauucugcccaau

SEQ ID NO: 399960 - RNA, 22 nt, Human
uucuucaaaacaacacuggccu

SEQ ID NO: 399961 - RNA, 22 nt, Human
cagugauguuucugcaucagag

SEQ ID NO: 399962 - RNA, 22 nt, Human
uaggcaacaugucgaauacugu

SEQ ID NO: 399963 - RNA, 22 nt, Human
auugaaagauaggcuacugugg

SEQ ID NO: 399964 - RNA, 22 nt, Human
auggauuuggaugagauuacuu

SEQ ID NO: 399965 - RNA, 22 nt, Human
cuuuaacaaaugacucuugucu

SEQ ID NO: 399966 - RNA, 22 nt, Human
caaagccaggcuuucuaaugua

SEQ ID NO: 399967 - RNA, 22 nt, Human
guucuucaaagugacaacuaaa

SEQ ID NO: 399968 - RNA, 22 nt, Human
cuugaaguugcaaaacauuaau

SEQ ID NO: 399969 - RNA, 22 nt, Human
augaaacagugaauuagucaag

SEQ ID NO: 399970 - RNA, 22 nt, Human
gaaggccacuuuguguugagaa

SEQ ID NO: 399971 - RNA, 22 nt, Human
cauuuccacuucugaaaacugg

SEQ ID NO: 399972 - RNA, 22 nt, Human
uuacagaacugcccuaguuggc

SEQ ID NO: 399973 - RNA, 22 nt, Human
aaagcuaugaggcaugcauuuc

SEQ ID NO: 399974 - RNA, 22 nt, Human
cuucuuaaaguugucacagcug

SEQ ID NO: 399975 - RNA, 22 nt, Human
caauuucacuaaugaugugggg

SEQ ID NO: 399976 - RNA, 22 nt, Human
uuuccaaagguggcaggaacaa

SEQ ID NO: 399977 - RNA, 22 nt, Human
uugagaagaauguguugaguuu

SEQ ID NO: 399978 - RNA, 22 nt, Human
uaguccuuuaucaaacauuuau

SEQ ID NO: 399979 - RNA, 22 nt, Human
aaaucucaguguucuaagcauu

SEQ ID NO: 399980 - RNA, 22 nt, Human
acuucacacagcaaauuuaucu

SEQ ID NO: 399981 - RNA, 18 nt, Human
acucaggaaaugaugaca

SEQ ID NO: 399982 - RNA, 22 nt, Human
auauuuaaacaggguaccaaua

SEQ ID NO: 399983 - RNA, 22 nt, Human
caaggccaagguuuugugaacu

SEQ ID NO: 399984 - RNA, 22 nt, Human
uuugaagucaaagauugauucc

SEQ ID NO: 399985 - RNA, 22 nt, Human
uugggcucaggaguuugagacc

SEQ ID NO: 399986 - RNA, 22 nt, Human
caaggccacugcucagguuucc

SEQ ID NO: 399987 - RNA, 22 nt, Human
uuuaacuuaaucugcuugauga

SEQ ID NO: 399988 - RNA, 23 nt, Human
uucuuucaagaaguucacagugc

SEQ ID NO: 399989 - RNA, 22 nt, Human
gauggcagguaguggucucauc

SEQ ID NO: 399990 - RNA, 22 nt, Human
gaggaaccaaucugugauauuc

SEQ ID NO: 399991 - RNA, 22 nt, Human
ugcagagaagaggacaguucua

SEQ ID NO: 399992 - RNA, 22 nt, Human
ucuccuccuuuuuucaacauag

SEQ ID NO: 399993 - RNA, 20 nt, Human
aaacauucauguacaaguga

SEQ ID NO: 399994 - RNA, 22 nt, Human
aauaaccuuacuuauuacaugg

SEQ ID NO: 399995 - RNA, 23 nt, Human
gaaucaguggcuaacaaggaaac

SEQ ID NO: 399996 - RNA, 19 nt, Human
caagugaagccugggaugg

SEQ ID NO: 399997 - RNA, 22 nt, Human
ugucauaaucaguuuugcaugu

SEQ ID NO: 399998 - RNA, 22 nt, Human
uaagaaucggucgcaacagagg

SEQ ID NO: 399999 - RNA, 22 nt, Human
gaagugaagguuacucuagauu

SEQ ID NO: 400000 - RNA, 22 nt, Human
uucauagaucucaauuuugagg

SEQ ID NO: 400001 - RNA, 22 nt, Human
aaaggccacuugaaggauuuuu

SEQ ID NO: 400002 - RNA, 22 nt, Human
gaguccuuaauacacuggugga

SEQ ID NO: 400003 - RNA, 19 nt, Human
cuucuucuuggcagccaag

SEQ ID NO: 400004 - RNA, 22 nt, Human
ucucucuucaacccuuaacuag

SEQ ID NO: 400005 - RNA, 22 nt, Human
uaccauuucauucuuuccucau

SEQ ID NO: 400006 - RNA, 21 nt, Human
cucaaagaccaaaaguguaga

SEQ ID NO: 400007 - RNA, 22 nt, Human
uccauuuuguagguaugcuaca

SEQ ID NO: 400008 - RNA, 20 nt, Human
ucauuguguugccaauuccc

SEQ ID NO: 400009 - RNA, 22 nt, Human
uaauauauuucugcuaagcuca

SEQ ID NO: 400010 - RNA, 22 nt, Human
aagccagauuucacucuuaauu

SEQ ID NO: 400011 - RNA, 22 nt, Human
caaaucuauauguugauauucu

SEQ ID NO: 400012 - RNA, 22 nt, Human
uaucaucuuguugucaugcagc

SEQ ID NO: 400013 - RNA, 22 nt, Human
acaugcuuguuuuucacaaccu

SEQ ID NO: 400014 - RNA, 22 nt, Human
aauugcaauuuucuuaaggucu

SEQ ID NO: 400015 - RNA, 22 nt, Human
aggcagaccaugaaucaugacc

SEQ ID NO: 400016 - RNA, 22 nt, Human
aaacuuuguagagaaugcuggc

SEQ ID NO: 400017 - RNA, 22 nt, Human
auguuacacauaggcauaaaug

SEQ ID NO: 400018 - RNA, 22 nt, Human
cagaguucaaagccugcuggga

SEQ ID NO: 400019 - RNA, 19 nt, Human
uggagacugagagugagca

SEQ ID NO: 400020 - RNA, 22 nt, Human
uuuaggcaugcaguucuauuua

SEQ ID NO: 400021 - RNA, 22 nt, Human
caugauaauuguuaacaaagua

SEQ ID NO: 400022 - RNA, 22 nt, Human
auuauagaggguuacaguuaau

SEQ ID NO: 400023 - RNA, 22 nt, Human
gaucagaauucuuguguguuuc

SEQ ID NO: 400024 - RNA, 22 nt, Human
ccuucuucuguguggcccaaga

SEQ ID NO: 400025 - RNA, 22 nt, Human
aaucuuuaaggacucagucucu

SEQ ID NO: 400026 - RNA, 22 nt, Human
caggguggcacaucacagcauu

SEQ ID NO: 400027 - RNA, 22 nt, Human
auucuuaauugccaugcuguau

SEQ ID NO: 400028 - RNA, 22 nt, Human
ucuaaacacgucucuuugaaua

SEQ ID NO: 400029 - RNA, 22 nt, Human
aaugggauaauuguucauggga

SEQ ID NO: 400030 - RNA, 22 nt, Human
uugaauaauauguucaggagga

SEQ ID NO: 400031 - RNA, 22 nt, Human
aauacauguuuucuacuauucu

SEQ ID NO: 400032 - RNA, 22 nt, Human
acaacuuucuggguuaucugau

SEQ ID NO: 400033 - RNA, 22 nt, Human
aucagaaaaacauaauguuauu

SEQ ID NO: 400034 - RNA, 22 nt, Human
gaaauuauugcuagagacugca

SEQ ID NO: 400035 - RNA, 22 nt, Human
acacacucaauugcauaagcac

SEQ ID NO: 400036 - RNA, 22 nt, Human
uuguaaauaguaguaagaugcc

SEQ ID NO: 400037 - RNA, 23 nt, Human
aguacaauaaguauaauucuuuc

SEQ ID NO: 400038 - RNA, 22 nt, Human
acuauaaccuguuagaauagau

SEQ ID NO: 400039 - RNA, 22 nt, Human
auagcuuucuuaaauauauaaa

SEQ ID NO: 400040 - RNA, 22 nt, Human
gcaucuaaacuugcaucauugu

SEQ ID NO: 400041 - RNA, 22 nt, Human
ugaagaauaagauagauggagc

SEQ ID NO: 400042 - RNA, 22 nt, Human
uaauuucagugcaagcucacgg

SEQ ID NO: 400043 - RNA, 22 nt, Human
cuucuucauaggcaguccuguu

SEQ ID NO: 400044 - RNA, 22 nt, Human
acaugcauacacguacauaccu

SEQ ID NO: 400045 - RNA, 22 nt, Human
uugaauaauguguauguuguua

SEQ ID NO: 400046 - RNA, 22 nt, Human
uuuccauauuuaaucaaaauaa

SEQ ID NO: 400047 - RNA, 22 nt, Human
uuuacagaugaggaaacugaga

SEQ ID NO: 400048 - RNA, 22 nt, Human
gccauuuucugucuuguuuauu

SEQ ID NO: 400049 - RNA, 22 nt, Human
uaucagaaagauauuacugggg

SEQ ID NO: 400050 - RNA, 22 nt, Human
gaaauauacauugcaggaagag

SEQ ID NO: 400051 - RNA, 22 nt, Human
uucaacccaaguucuccauuuu

SEQ ID NO: 400052 - RNA, 22 nt, Human
aucuccaggcauuucaagagac

SEQ ID NO: 400053 - RNA, 22 nt, Human
agaucugaggguccaagggagg

SEQ ID NO: 400054 - RNA, 22 nt, Human
acucaggaaaugaagacugguu

SEQ ID NO: 400055 - RNA, 22 nt, Human
accuugaugccuuuccaagaug

SEQ ID NO: 400056 - RNA, 22 nt, Human
aguguuuauauuauggaaauau

SEQ ID NO: 400057 - RNA, 22 nt, Human
aggcacagagaaugcccuccau

SEQ ID NO: 400058 - RNA, 22 nt, Human
uucagugucaauuuuuaaauau

SEQ ID NO: 400059 - RNA, 22 nt, Human
aggaaacuccccuacaucucaa

SEQ ID NO: 400060 - RNA, 22 nt, Human
ucuggaucucccucauccuggg

SEQ ID NO: 400061 - RNA, 22 nt, Human
ucauaaaguuacccaaauuuua

SEQ ID NO: 400062 - RNA, 22 nt, Human
gaaagccauagcccagcuuuac

SEQ ID NO: 400063 - RNA, 22 nt, Human
uguccuuauaagaaaaggaaau

SEQ ID NO: 400064 - RNA, 22 nt, Human
agucauuuugccagucuucagg

SEQ ID NO: 400065 - RNA, 22 nt, Human
uggaguucucaggugagggcuu

SEQ ID NO: 400066 - RNA, 22 nt, Human
gaucauuuugaugcccuuuuag

SEQ ID NO: 400067 - RNA, 22 nt, Human
ugcuggcuacauuauugcuguc

SEQ ID NO: 400068 - RNA, 21 nt, Human
cuacagaagcucuccuaucca

SEQ ID NO: 400069 - RNA, 20 nt, Human
aucuucuuggccagcuugcu

SEQ ID NO: 400070 - RNA, 22 nt, Human
cuuaacauccugcauuuuucuu

SEQ ID NO: 400071 - RNA, 20 nt, Human
uucacagaggacucagguca

SEQ ID NO: 400072 - RNA, 22 nt, Human
aguuugaaaguauugacagaag

SEQ ID NO: 400073 - RNA, 22 nt, Human
guaucacuuuugagagugagaa

SEQ ID NO: 400074 - RNA, 22 nt, Human
agaaaagaggcuuucuaagcau

SEQ ID NO: 400075 - RNA, 22 nt, Human
gagggucccugcucagggccag

SEQ ID NO: 400076 - RNA, 22 nt, Human
uuagcaucugcuguaagcuuau

SEQ ID NO: 400077 - RNA, 22 nt, Human
uagaacauaagucauucauuug

SEQ ID NO: 400078 - RNA, 22 nt, Human
gucacuguauccagguuccagc

SEQ ID NO: 400079 - RNA, 22 nt, Human
uuaugaaggaucagguacuugg

SEQ ID NO: 400080 - RNA, 21 nt, Human
cuugaaagguagagucuacag

SEQ ID NO: 400081 - RNA, 21 nt, Human
uguccuuaaugcaauguccuu

SEQ ID NO: 400082 - RNA, 22 nt, Human
aaagccaucaguaaaaugauuu

SEQ ID NO: 400083 - RNA, 22 nt, Human
ucuucauuuuauagcaucugug

SEQ ID NO: 400084 - RNA, 22 nt, Human
uuuguuaaauauuuauugagug

SEQ ID NO: 400085 - RNA, 22 nt, Human
aggccagaugucgggcuagaag

SEQ ID NO: 400086 - RNA, 18 nt, Human
uacaggaaaaguguuaca

SEQ ID NO: 400087 - RNA, 22 nt, Human
uugcagcuucgagucuaucugu

SEQ ID NO: 400088 - RNA, 22 nt, Human
gcaacuuucaagcaccaugggg

SEQ ID NO: 400089 - RNA, 22 nt, Human
gaaggccauuuuuagguagaau

SEQ ID NO: 400090 - RNA, 22 nt, Human
auggcauuugaaucugucuuuu

SEQ ID NO: 400091 - RNA, 22 nt, Human
ugagauuuguuuuauaaaauag

SEQ ID NO: 400092 - RNA, 22 nt, Human
agaccaugggcucugaagagca

SEQ ID NO: 400093 - RNA, 21 nt, Human
auacauucuauuaagcauuua

SEQ ID NO: 400094 - RNA, 22 nt, Human
aaccauuugccauuaucuuaag

SEQ ID NO: 400095 - RNA, 22 nt, Human
guuaggcaauaccucuuacacc

SEQ ID NO: 400096 - RNA, 22 nt, Human
ugugaauacagcaugugcuucu

SEQ ID NO: 400097 - RNA, 22 nt, Human
gauugaaacauaggcagucgag

SEQ ID NO: 400098 - RNA, 22 nt, Human
uuucuucucgacaccuuauccc

SEQ ID NO: 400099 - RNA, 22 nt, Human
ucaaaauuucagcacuagcccu

SEQ ID NO: 400100 - RNA, 22 nt, Human
cacaaaugugcagaaaugugag

SEQ ID NO: 400101 - RNA, 22 nt, Human
aaucagaacgcucgaucuucgg

SEQ ID NO: 400102 - RNA, 22 nt, Human
auuauuauuguugauguuaggg

SEQ ID NO: 400103 - RNA, 22 nt, Human
agagauucauguuuacuguagg

SEQ ID NO: 400104 - RNA, 22 nt, Human
agaccaagaaaggaugaggauc

SEQ ID NO: 400105 - RNA, 22 nt, Human
gaauuucaaagagguuaagagg

SEQ ID NO: 400106 - RNA, 22 nt, Human
augaaaauucuaugcaggccag

SEQ ID NO: 400107 - RNA, 22 nt, Human
ucauuuaauaauuuuugaguag

SEQ ID NO: 400108 - RNA, 22 nt, Human
guuauaaaugacugcaaaaguu

SEQ ID NO: 400109 - RNA, 22 nt, Human
auuucaggauagccuaguuuug

SEQ ID NO: 400110 - RNA, 22 nt, Human
acuuauuagcugugugaccuug

SEQ ID NO: 400111 - RNA, 22 nt, Human
acaugucuguaauuauuuuagg

SEQ ID NO: 400112 - RNA, 22 nt, Human
cugccuccugccgugcagcuuc

SEQ ID NO: 400113 - RNA, 21 nt, Human
ucucugguuggaguugugcca

SEQ ID NO: 400114 - RNA, 22 nt, Human
agcauuuaagcuucugcaaagc

SEQ ID NO: 400115 - RNA, 22 nt, Human
ucaguguauggagugcuggauu

SEQ ID NO: 400116 - RNA, 22 nt, Human
ugaauaauuaugggaguccuaa

SEQ ID NO: 400117 - RNA, 22 nt, Human
uuugcaaauaccaugaaacuug

SEQ ID NO: 400118 - RNA, 22 nt, Human
uugaaaguccuucuugaguuac

SEQ ID NO: 400119 - RNA, 21 nt, Human
augugaaauaucaucagagca

SEQ ID NO: 400120 - RNA, 20 nt, Human
ucuuauacagaaaacauuuu

SEQ ID NO: 400121 - RNA, 22 nt, Human
augcuuaaccuugguguacaau

SEQ ID NO: 400122 - RNA, 22 nt, Human
uuauacauguguuuugagauga

SEQ ID NO: 400123 - RNA, 22 nt, Human
uaaagacaauuucgagcuguag

SEQ ID NO: 400124 - RNA, 22 nt, Human
cuguauuucccacauucucuau

SEQ ID NO: 400125 - RNA, 22 nt, Human
ucucaggaagugauauugagac

SEQ ID NO: 400126 - RNA, 22 nt, Human
aauguuuuaaaagagauugaga

SEQ ID NO: 400127 - RNA, 22 nt, Human
uuugaaagggacaaagucacug

SEQ ID NO: 400128 - RNA, 22 nt, Human
aaguguuaaagacuugaacacu

SEQ ID NO: 400129 - RNA, 22 nt, Human
uucaucaauguguuuaauaaug

SEQ ID NO: 400130 - RNA, 22 nt, Human
caaggccaguucaccaagggca

SEQ ID NO: 400131 - RNA, 22 nt, Human
ccuucaaucuuaagucagccca

SEQ ID NO: 400132 - RNA, 22 nt, Human
aacaucuacuaagugccaggca

SEQ ID NO: 400133 - RNA, 23 nt, Human
cuuucauugugguuucacagagc

SEQ ID NO: 400134 - RNA, 22 nt, Human
cagcacagggacaauagcagau

SEQ ID NO: 400135 - RNA, 22 nt, Human
aguccuuagaacacuguaucug

SEQ ID NO: 400136 - RNA, 22 nt, Human
gcucacugcaaccucugcuucc

SEQ ID NO: 400137 - RNA, 22 nt, Human
ucacagaagagauauugacaga

SEQ ID NO: 400138 - RNA, 22 nt, Human
cuggauuuaggacuaguccaag

SEQ ID NO: 400139 - RNA, 22 nt, Human
ugagagggcccagagcacacca

SEQ ID NO: 400140 - RNA, 22 nt, Human
aauauuaucaaaagcuuuuuca

SEQ ID NO: 400141 - RNA, 22 nt, Human
cagagggcucuuggcugccugc

SEQ ID NO: 400142 - RNA, 22 nt, Human
auccaugaucaauuuauuacua

SEQ ID NO: 400143 - RNA, 22 nt, Human
aauacaagauuuauaguuguuu

SEQ ID NO: 400144 - RNA, 22 nt, Human
ucaaguuucucucagauuaugg

SEQ ID NO: 400145 - RNA, 22 nt, Human
uauguuaagugggauaaucaaa

SEQ ID NO: 400146 - RNA, 20 nt, Human
gaguccuuaugggcugaggu

SEQ ID NO: 400147 - RNA, 22 nt, Human
gaguccuucuggcuggcaggau

SEQ ID NO: 400148 - RNA, 22 nt, Human
aaaugucagaggaacauauuga

SEQ ID NO: 400149 - RNA, 22 nt, Human
gaucagaauuuacuuauaauug

SEQ ID NO: 400150 - RNA, 22 nt, Human
ccuucauugcaucuuuaagaga

SEQ ID NO: 400151 - RNA, 22 nt, Human
uucaauucuaaacuaauauucu

SEQ ID NO: 400152 - RNA, 22 nt, Human
ucacaucucccuggaggacaca

SEQ ID NO: 400153 - RNA, 22 nt, Human
uacugugacagaguacuuaaac

SEQ ID NO: 400154 - RNA, 21 nt, Human
ucuauucauuacaguuauuug

SEQ ID NO: 400155 - RNA, 22 nt, Human
cacaagaaauaagcugccuuuc

SEQ ID NO: 400156 - RNA, 22 nt, Human
cuggaucaugcauugcuugucc

SEQ ID NO: 400157 - RNA, 22 nt, Human
aaaauccugcugacucgagaug

SEQ ID NO: 400158 - RNA, 22 nt, Human
ucaaaauuagugaccaaaggca

SEQ ID NO: 400159 - RNA, 22 nt, Human
uaucaaaggcuaugugauuuuu

SEQ ID NO: 400160 - RNA, 22 nt, Human
uugauccaguugaaagugauga

SEQ ID NO: 400161 - RNA, 22 nt, Human
uuuggacaaguuacugguuucc

SEQ ID NO: 400162 - RNA, 22 nt, Human
caggccagggagaauaugaagc

SEQ ID NO: 400163 - RNA, 22 nt, Human
caagaugugccuaaucagaccu

SEQ ID NO: 400164 - RNA, 22 nt, Human
acaaauguggacauggauaaug

SEQ ID NO: 400165 - RNA, 22 nt, Human
auguauuucuauguagugaaga

SEQ ID NO: 400166 - RNA, 22 nt, Human
uuuuccagauuggacuuagucc

SEQ ID NO: 400167 - RNA, 22 nt, Human
uugguuuacuaggauucaaauu

SEQ ID NO: 400168 - RNA, 20 nt, Human
agcauuugaaauaugacuau

SEQ ID NO: 400169 - RNA, 22 nt, Human
cuucuucacacuggucugaagc

SEQ ID NO: 400170 - RNA, 22 nt, Human
aaccauuugcaguuacugagac

SEQ ID NO: 400171 - RNA, 20 nt, Human
ucaggaugugcugagugaag

SEQ ID NO: 400172 - RNA, 22 nt, Human
uuugaaaggugucgagaugugu

SEQ ID NO: 400173 - RNA, 22 nt, Human
gaaggccaagaggcuccaagau

SEQ ID NO: 400174 - RNA, 22 nt, Human
augacaaaagaagacaugaggu

SEQ ID NO: 400175 - RNA, 22 nt, Human
auaaaauuugcuacuguuaaau

SEQ ID NO: 400176 - RNA, 22 nt, Human
cauaagaagguaacauccuuaa

SEQ ID NO: 400177 - RNA, 22 nt, Human
uuuacaaccucauauucugaug

SEQ ID NO: 400178 - RNA, 22 nt, Human
uuccaaaccucaaauaauuaau

SEQ ID NO: 400179 - RNA, 22 nt, Human
gaaagccaucuggcugcuggga

SEQ ID NO: 400180 - RNA, 22 nt, Human
ugaaugaacuaaaucauaguuc

SEQ ID NO: 400181 - RNA, 22 nt, Human
gaggcugaggguuagagaguca

SEQ ID NO: 400182 - RNA, 21 nt, Human
gaguccuuccaauguccucag

SEQ ID NO: 400183 - RNA, 22 nt, Human
auacuuucugaccaauuaauug

SEQ ID NO: 400184 - RNA, 22 nt, Human
uacugaaaagccacaaggacca

SEQ ID NO: 400185 - RNA, 22 nt, Human
uuuaggcagcuacauacuaacu

SEQ ID NO: 400186 - RNA, 22 nt, Human
uauuuccauguuagaacuaagu

SEQ ID NO: 400187 - RNA, 22 nt, Human
aucauucuauuguugagcugcc

SEQ ID NO: 400188 - RNA, 22 nt, Human
uugauagguuuuauguauaguu

SEQ ID NO: 400189 - RNA, 22 nt, Human
aguccaugguucugacucaucu

SEQ ID NO: 400190 - RNA, 22 nt, Human
cuggacucugcagagaaaagua

SEQ ID NO: 400191 - RNA, 23 nt, Human
ucucaagaggaagcagggcucau

SEQ ID NO: 400192 - RNA, 22 nt, Human
aaaugcauggcuguuuuaaagc

SEQ ID NO: 400193 - RNA, 22 nt, Human
aacuggauuaacuggcucaaau

SEQ ID NO: 400194 - RNA, 22 nt, Human
gaauaaucaugaaauucaguga

SEQ ID NO: 400195 - RNA, 22 nt, Human
aauuccaggaugcaggaggugc

SEQ ID NO: 400196 - RNA, 22 nt, Human
ucugaaaugcaaauuugacuga

SEQ ID NO: 400197 - RNA, 22 nt, Human
aaguguauauaugacuuauaaa

SEQ ID NO: 400198 - RNA, 22 nt, Human
auauuauucuaguaacagugau

SEQ ID NO: 400199 - RNA, 22 nt, Human
acuggaugaggggaaagagaca

SEQ ID NO: 400200 - RNA, 22 nt, Human
ugugugaauggauuauucuauu

SEQ ID NO: 400201 - RNA, 22 nt, Human
agacucaagacugcagaagacg

SEQ ID NO: 400202 - RNA, 22 nt, Human
uaaacauuuguuauucuuguuu

SEQ ID NO: 400203 - RNA, 22 nt, Human
guuuaauaauguugaauuacua

SEQ ID NO: 400204 - RNA, 22 nt, Human
cacaauguauauguauaucaaa

SEQ ID NO: 400205 - RNA, 22 nt, Human
aaagccaugaauguuauagagg

SEQ ID NO: 400206 - RNA, 20 nt, Human
uauuccaaggguagagaaaa

SEQ ID NO: 400207 - RNA, 23 nt, Human
ucuauacauacugcagccucugg

SEQ ID NO: 400208 - RNA, 22 nt, Human
ugaaugaguuuggcugcuguuc

SEQ ID NO: 400209 - RNA, 22 nt, Human
auggcuuaugguaaauauuucu

SEQ ID NO: 400210 - RNA, 22 nt, Human
ucugggaaguccucugucaugc

SEQ ID NO: 400211 - RNA, 22 nt, Human
caguccuuucugaaauccuaua

SEQ ID NO: 400212 - RNA, 22 nt, Human
augguuuaguuagggcuuuuca

SEQ ID NO: 400213 - RNA, 21 nt, Human
ucucugugucuuuaagcugga

SEQ ID NO: 400214 - RNA, 22 nt, Human
ugaaggcccuaucuccauauac

SEQ ID NO: 400215 - RNA, 22 nt, Human
auguucaaacaaguuaaugcca

SEQ ID NO: 400216 - RNA, 22 nt, Human
gaugaucaucuguaaaguuaga

SEQ ID NO: 400217 - RNA, 22 nt, Human
gaaagaggaaggagauguauua

SEQ ID NO: 400218 - RNA, 22 nt, Human
aagaacuuccuaauauauuuuc

SEQ ID NO: 400219 - RNA, 22 nt, Human
uuucauaauacuguacaugaaa

SEQ ID NO: 400220 - RNA, 22 nt, Human
ccuggaucuaaggaagcuggga

SEQ ID NO: 400221 - RNA, 22 nt, Human
cucaggaugaaagucaugguga

SEQ ID NO: 400222 - RNA, 22 nt, Human
auuucagauucagaaauguagg

SEQ ID NO: 400223 - RNA, 22 nt, Human
cauucauuuaugaaauaucuau

SEQ ID NO: 400224 - RNA, 22 nt, Human
aucccaugagaccacguuggcu

SEQ ID NO: 400225 - RNA, 22 nt, Human
guagaaaugguguguuucuucu

SEQ ID NO: 400226 - RNA, 22 nt, Human
cuggcuuuaacccuacaaaccu

SEQ ID NO: 400227 - RNA, 22 nt, Human
gcauguuauguaucugcccagc

SEQ ID NO: 400228 - RNA, 22 nt, Human
cauuuaguuauacuaaaacauu

SEQ ID NO: 400229 - RNA, 21 nt, Human
agccagucuguuuucuagugc

SEQ ID NO: 400230 - RNA, 22 nt, Human
caaauuccucagaaucagaaaa

SEQ ID NO: 400231 - RNA, 22 nt, Human
cuagaaauacaggcacgugcca

SEQ ID NO: 400232 - RNA, 22 nt, Human
aguuaucagguguuuucaugga

SEQ ID NO: 400233 - RNA, 22 nt, Human
aagucacccacaggcagcagaa

SEQ ID NO: 400234 - RNA, 22 nt, Human
ccuggaucuccucuauucauau

SEQ ID NO: 400235 - RNA, 22 nt, Human
auaaaaguucaagagaguacag

SEQ ID NO: 400236 - RNA, 22 nt, Human
gugcuucaaguucuuaauguuu

SEQ ID NO: 400237 - RNA, 22 nt, Human
gaggcugauucggggaacagca

SEQ ID NO: 400238 - RNA, 22 nt, Human
agagugucugguagcugcucug

SEQ ID NO: 400239 - RNA, 18 nt, Human
auacaagaucaaguguuc

SEQ ID NO: 400240 - RNA, 22 nt, Human
aaaugucagaagcuuuacuucu

SEQ ID NO: 400241 - RNA, 22 nt, Human
uauguaaaguagauggcaggua

SEQ ID NO: 400242 - RNA, 22 nt, Human
cuugccuuugucuucaaaggcu

SEQ ID NO: 400243 - RNA, 22 nt, Human
caguccuuagauuuuacugcca

SEQ ID NO: 400244 - RNA, 22 nt, Human
cagauacuguaaaauuucagua

SEQ ID NO: 400245 - RNA, 22 nt, Human
guucuucaucauuaacacucug

SEQ ID NO: 400246 - RNA, 22 nt, Human
uucuucaaccaucuacauaaac

SEQ ID NO: 400247 - RNA, 22 nt, Human
agucuuaacuaugcaaguacua

SEQ ID NO: 400248 - RNA, 22 nt, Human
caauuucacugacacccuggaa

SEQ ID NO: 400249 - RNA, 22 nt, Human
gcugucccgcugacuuccagcu

SEQ ID NO: 400250 - RNA, 22 nt, Human
aaugcuuauaccuaaugaucuu

SEQ ID NO: 400251 - RNA, 22 nt, Human
ugagaaaagguugagaugauaa

SEQ ID NO: 400252 - RNA, 22 nt, Human
agucacuguucugucaugucaa

SEQ ID NO: 400253 - RNA, 22 nt, Human
aaaacagacagccaguguagag

SEQ ID NO: 400254 - RNA, 17 nt, Human
uuucuccuuccaucuca

SEQ ID NO: 400255 - RNA, 23 nt, Human
auagaagauuauugcaacagucc

SEQ ID NO: 400256 - RNA, 19 nt, Human
uggcaucuguaaaauggug

SEQ ID NO: 400257 - RNA, 22 nt, Human
agacaaauggaguaugagcaac

SEQ ID NO: 400258 - RNA, 19 nt, Human
agcauuuggaauucuacac

SEQ ID NO: 400259 - RNA, 22 nt, Human
aucuuucuauuucuaaaaacua

SEQ ID NO: 400260 - RNA, 17 nt, Human
cccaugagcccacuccc

SEQ ID NO: 400261 - RNA, 22 nt, Human
auccuuagguggugcaucaggg

SEQ ID NO: 400262 - RNA, 22 nt, Human
gaaucucaguggaagcaggaag

SEQ ID NO: 400263 - RNA, 22 nt, Human
ucucugguuauuaacuaacucc

SEQ ID NO: 400264 - RNA, 21 nt, Human
uaaauaauaaguugcugagau

SEQ ID NO: 400265 - RNA, 22 nt, Human
aaguucuaauuuugcauucagg

SEQ ID NO: 400266 - RNA, 22 nt, Human
uuuucagugggcaaugauguga

SEQ ID NO: 400267 - RNA, 22 nt, Human
aggcuucuucuuccuauuuagu

SEQ ID NO: 400268 - RNA, 22 nt, Human
cuggguaaguuccuaaggcuca

SEQ ID NO: 400269 - RNA, 22 nt, Human
aguuauccgaaggcacugagau

SEQ ID NO: 400270 - RNA, 22 nt, Human
ucaauucaacacaugcacauug

SEQ ID NO: 400271 - RNA, 22 nt, Human
caguccuugcuaugacccugag

SEQ ID NO: 400272 - RNA, 22 nt, Human
uuaaagaauagugccccuauug

SEQ ID NO: 400273 - RNA, 22 nt, Human
auuuaaauuuucugauggagag

SEQ ID NO: 400274 - RNA, 22 nt, Human
gaaguccuccuaucuugcucuu

SEQ ID NO: 400275 - RNA, 22 nt, Human
aaugaaacuguauauagacugu

SEQ ID NO: 400276 - RNA, 21 nt, Human
cucaggauggcggccuggugg

SEQ ID NO: 400277 - RNA, 22 nt, Human
ucucaggaucuaauacauggua

SEQ ID NO: 400278 - RNA, 22 nt, Human
auacagaaaaugaugcagaguu

SEQ ID NO: 400279 - RNA, 22 nt, Human
aagugggaauagaaaugaaggu

SEQ ID NO: 400280 - RNA, 22 nt, Human
gauggcuuugugcaccaugauu

SEQ ID NO: 400281 - RNA, 22 nt, Human
gccccagcguggcuguguuagg

SEQ ID NO: 400282 - RNA, 22 nt, Human
auaaagcaucuagucugucacu

SEQ ID NO: 400283 - RNA, 22 nt, Human
gaaugaauucagcacauggaau

SEQ ID NO: 400284 - RNA, 22 nt, Human
uuucuucacaggguauugggug

SEQ ID NO: 400285 - RNA, 22 nt, Human
uuggaucauggaaugucugcuu

SEQ ID NO: 400286 - RNA, 22 nt, Human
agaauuccuccucugggacacu

SEQ ID NO: 400287 - RNA, 22 nt, Human
ccaggauggggagcagauagaa

SEQ ID NO: 400288 - RNA, 22 nt, Human
ugucaccaaguugaugaaugca

SEQ ID NO: 400289 - RNA, 22 nt, Human
auaucagacagaaagcauugac

SEQ ID NO: 400290 - RNA, 22 nt, Human
uuugaaagaaaccagugaguga

SEQ ID NO: 400291 - RNA, 22 nt, Human
aaauguuuugcucccauguggu

SEQ ID NO: 400292 - RNA, 22 nt, Human
acagguuugucugauguaauga

SEQ ID NO: 400293 - RNA, 22 nt, Human
uuagccauauagaaaaagagcu

SEQ ID NO: 400294 - RNA, 22 nt, Human
auacugaauuagguaaagcaua

SEQ ID NO: 400295 - RNA, 22 nt, Human
cucaggauuaaggaaucuaaau

SEQ ID NO: 400296 - RNA, 22 nt, Human
caaggccauauugccuguaugu

SEQ ID NO: 400297 - RNA, 22 nt, Human
auuugcuucugugaaaucaagu

SEQ ID NO: 400298 - RNA, 22 nt, Human
aaaucauguuggcacaauaaaa

SEQ ID NO: 400299 - RNA, 22 nt, Human
uaagagaacuggauagauagga

SEQ ID NO: 400300 - RNA, 22 nt, Human
cucuuaaugaccuuaauucaag

SEQ ID NO: 400301 - RNA, 22 nt, Human
auucacuggcagacagaacuca

SEQ ID NO: 400302 - RNA, 22 nt, Human
ucuucaauuagauuuaccaauu

SEQ ID NO: 400303 - RNA, 22 nt, Human
cagagccauuauggagacuugc

SEQ ID NO: 400304 - RNA, 22 nt, Human
uuuauccaccuuacccuguucc

SEQ ID NO: 400305 - RNA, 22 nt, Human
ccuucaaucagcagucuagcuu

SEQ ID NO: 400306 - RNA, 22 nt, Human
guucuaauauuuuaaaagccaa

SEQ ID NO: 400307 - RNA, 22 nt, Human
auggcuuucagauggugaaaga

SEQ ID NO: 400308 - RNA, 21 nt, Human
cucaggaucuuauauauuagu

SEQ ID NO: 400309 - RNA, 22 nt, Human
caaagauuuuagaauuugcaau

SEQ ID NO: 400310 - RNA, 22 nt, Human
ugugaauaccuugaauucauca

SEQ ID NO: 400311 - RNA, 22 nt, Human
aauaauuacccaucuuuuugua

SEQ ID NO: 400312 - RNA, 22 nt, Human
auaaaaucagaguuggauugga

SEQ ID NO: 400313 - RNA, 22 nt, Human
aaguguagauuauggagugucu

SEQ ID NO: 400314 - RNA, 22 nt, Human
ucaucucaaaacccaaggggca

SEQ ID NO: 400315 - RNA, 23 nt, Human
uggagcugacagucagagggagg

SEQ ID NO: 400316 - RNA, 22 nt, Human
uccauucauucauugaugaaca

SEQ ID NO: 400317 - RNA, 22 nt, Human
uagauauaucugucauacuggu

SEQ ID NO: 400318 - RNA, 22 nt, Human
uugaaaguuuauggagucugca

SEQ ID NO: 400319 - RNA, 22 nt, Human
gcagaauucuacagaugauaaa

SEQ ID NO: 400320 - RNA, 22 nt, Human
gaauuuuucuggaagcaauuau

SEQ ID NO: 400321 - RNA, 22 nt, Human
aggccagcaagaaagagagucu

SEQ ID NO: 400322 - RNA, 17 nt, Human
uccauacaauucucucu

SEQ ID NO: 400323 - RNA, 22 nt, Human
aaagucauuguaauauaugcua

SEQ ID NO: 400324 - RNA, 22 nt, Human
aaacaugaauagauauuaaaca

SEQ ID NO: 400325 - RNA, 22 nt, Human
uuugcagugucagcuucugugu

SEQ ID NO: 400326 - RNA, 22 nt, Human
aagaaugagcucaaagaucuua

SEQ ID NO: 400327 - RNA, 22 nt, Human
auacaaagacaaaucucaaucu

SEQ ID NO: 400328 - RNA, 22 nt, Human
aaggcaguuaauuuggcuagaa

SEQ ID NO: 400329 - RNA, 17 nt, Human
aaggccauuuccaccca

SEQ ID NO: 400330 - RNA, 22 nt, Human
auacagaacaagccucaccucc

SEQ ID NO: 400331 - RNA, 22 nt, Human
caaguccuuagaugguucuuug

SEQ ID NO: 400332 - RNA, 22 nt, Human
gugaauaaccuacuccaggccu

SEQ ID NO: 400333 - RNA, 22 nt, Human
aagcccagaugggagcauuuca

SEQ ID NO: 400334 - RNA, 22 nt, Human
aagcccagcugaaagcauuuuu

SEQ ID NO: 400335 - RNA, 22 nt, Human
ucucaggagccacagcgggagu

SEQ ID NO: 400336 - RNA, 22 nt, Human
cugugcagcuggcuuccuggaa

SEQ ID NO: 400337 - RNA, 22 nt, Human
uuucauuuugguuaugccauaa

SEQ ID NO: 400338 - RNA, 22 nt, Human
aguaaacauuuucauauuuucu

SEQ ID NO: 400339 - RNA, 21 nt, Human
cgcagagcgaacuugcggcgc

SEQ ID NO: 400340 - RNA, 22 nt, Human
auuauaaaccuuugaggguggg

SEQ ID NO: 400341 - RNA, 22 nt, Human
uuuaggcacagggaguugguuu

SEQ ID NO: 400342 - RNA, 22 nt, Human
auuuccauagagcgucucacag

SEQ ID NO: 400343 - RNA, 22 nt, Human
guccaugacugugacucacaug

SEQ ID NO: 400344 - RNA, 22 nt, Human
uaauauguguuacugacuuuuu

SEQ ID NO: 400345 - RNA, 18 nt, Human
auauguuaauuagguagg

SEQ ID NO: 400346 - RNA, 16 nt, Human
ccuggauccccugugg

SEQ ID NO: 400347 - RNA, 18 nt, Human
uuccaugauuccuuucac

SEQ ID NO: 400348 - RNA, 22 nt, Human
acaggauuagcaaguaaucagg

SEQ ID NO: 400349 - RNA, 22 nt, Human
gucaaacauagggacuuugugg

SEQ ID NO: 400350 - RNA, 22 nt, Human
agauggaguuaguaccagaguc

SEQ ID NO: 400351 - RNA, 22 nt, Human
ucaaauaccagcaauuucaugu

SEQ ID NO: 400352 - RNA, 22 nt, Human
uuccauaauaaccugagagaaa

SEQ ID NO: 400353 - RNA, 22 nt, Human
ucauuuguugaacuuuagugcg

SEQ ID NO: 400354 - RNA, 22 nt, Human
guacagaaggagcuuuggauuc

SEQ ID NO: 400355 - RNA, 22 nt, Human
auguuaaaugguuuauuauuaa

SEQ ID NO: 400356 - RNA, 22 nt, Human
uucacagacuuuccauagauug

SEQ ID NO: 400357 - RNA, 22 nt, Human
acuggaucuaauugguuauagu

SEQ ID NO: 400358 - RNA, 22 nt, Human
uuaagcaacacacauuaauuau

SEQ ID NO: 400359 - RNA, 22 nt, Human
ucauucuuuaccaaguugucac

SEQ ID NO: 400360 - RNA, 17 nt, Human
gccucugcuugugucau

SEQ ID NO: 400361 - RNA, 22 nt, Human
acaugcuucauauuauaaccaa

SEQ ID NO: 400362 - RNA, 22 nt, Human
uagucaccucuuuaaauguccu

SEQ ID NO: 400363 - RNA, 22 nt, Human
agaucacagcccccagaugcca

SEQ ID NO: 400364 - RNA, 22 nt, Human
caauuucauggauaaaagaugu

SEQ ID NO: 400365 - RNA, 22 nt, Human
uggcuucaaaaucuaguggucu

SEQ ID NO: 400366 - RNA, 22 nt, Human
aucugccucuucuucauugcga

SEQ ID NO: 400367 - RNA, 22 nt, Human
uuucaguguaucuuccaaaagc

SEQ ID NO: 400368 - RNA, 22 nt, Human
ugaaaauggccugaagaagcaa

SEQ ID NO: 400369 - RNA, 22 nt, Human
auucuucaccauggauaauuug

SEQ ID NO: 400370 - RNA, 22 nt, Human
uuagaaagaacuuuagauauca

SEQ ID NO: 400371 - RNA, 22 nt, Human
uucaauacaaagaaaggaauuu

SEQ ID NO: 400372 - RNA, 22 nt, Human
cuucugcaauaaguuuuggucc

SEQ ID NO: 400373 - RNA, 22 nt, Human
uccauuuucuaaguaucacuua

SEQ ID NO: 400374 - RNA, 23 nt, Human
aguucacugagguugaccacugg

SEQ ID NO: 400375 - RNA, 22 nt, Human
auguucuuguucaaaugucagu

SEQ ID NO: 400376 - RNA, 22 nt, Human
uucucuuuucaccaguugcuaa

SEQ ID NO: 400377 - RNA, 22 nt, Human
uugaaaguagcagcugcauaug

SEQ ID NO: 400378 - RNA, 22 nt, Human
auagaauucguguuuguaauuc

SEQ ID NO: 400379 - RNA, 22 nt, Human
gucaggaucucccaguacauau

SEQ ID NO: 400380 - RNA, 22 nt, Human
uucugggacaucuggacaguuu

SEQ ID NO: 400381 - RNA, 22 nt, Human
ggacuucuaagugccagacacu

SEQ ID NO: 400382 - RNA, 22 nt, Human
acaaaaagggagaugagguaga

SEQ ID NO: 400383 - RNA, 22 nt, Human
ucauacaucuguccuggagcuc

SEQ ID NO: 400384 - RNA, 22 nt, Human
auccaugauuaguaggauaaag

SEQ ID NO: 400385 - RNA, 22 nt, Human
caguccuuccuugccccuuggg

SEQ ID NO: 400386 - RNA, 22 nt, Human
uugaauaauaugcuucguucuc

SEQ ID NO: 400387 - RNA, 22 nt, Human
aaaacaguuuuugcuaacugcu

SEQ ID NO: 400388 - RNA, 22 nt, Human
caggauggugugagugugagga

SEQ ID NO: 400389 - RNA, 22 nt, Human
cucacugugaccucagcagaca

SEQ ID NO: 400390 - RNA, 22 nt, Human
auacagaacucucaguuguaua

SEQ ID NO: 400391 - RNA, 22 nt, Human
auuuacugagguaaauaaacug

SEQ ID NO: 400392 - RNA, 22 nt, Human
aucuuucaguuucauaccaauu

SEQ ID NO: 400393 - RNA, 22 nt, Human
caguccuucauuccuccuuuga

SEQ ID NO: 400394 - RNA, 22 nt, Human
aaagaaucuauauaucaccacc

SEQ ID NO: 400395 - RNA, 22 nt, Human
ugaauaauuccuuuuugucaag

SEQ ID NO: 400396 - RNA, 23 nt, Human
ccaaagucgaagucuaguccaga

SEQ ID NO: 400397 - RNA, 22 nt, Human
uguacaaugcugagguuugggg

SEQ ID NO: 400398 - RNA, 21 nt, Human
ggcagccucuguggaagggga

SEQ ID NO: 400399 - RNA, 23 nt, Human
ucagagaacucgggcagaugacc

SEQ ID NO: 400400 - RNA, 22 nt, Human
uugcugaaaacaguggguauug

SEQ ID NO: 400401 - RNA, 22 nt, Human
ugcugagaucugccaguagaug

SEQ ID NO: 400402 - RNA, 22 nt, Human
auaucaaagcuaguggaaauuu

SEQ ID NO: 400403 - RNA, 22 nt, Human
agaggccggccgagcccauggg

SEQ ID NO: 400404 - RNA, 22 nt, Human
cucucuguuaugcuuucaugaa

SEQ ID NO: 400405 - RNA, 22 nt, Human
aguucacugcuuaagccuuuga

SEQ ID NO: 400406 - RNA, 22 nt, Human
auuucaacguuagauguaauag

SEQ ID NO: 400407 - RNA, 22 nt, Human
ccacagagacaggguccuugcu

SEQ ID NO: 400408 - RNA, 22 nt, Human
gaucagaaucuucauuuucagu

SEQ ID NO: 400409 - RNA, 22 nt, Human
ugaaggccagcucuuuaucagc

SEQ ID NO: 400410 - RNA, 22 nt, Human
gucuaacaagcauuaggaaccc

SEQ ID NO: 400411 - RNA, 22 nt, Human
gaguccuuuucucuguccacug

SEQ ID NO: 400412 - RNA, 22 nt, Human
cuagcaucagaugagaagcugu

SEQ ID NO: 400413 - RNA, 22 nt, Human
uucuucagucccacuagccaca

SEQ ID NO: 400414 - RNA, 22 nt, Human
aauuucaagucuugaagaagua

SEQ ID NO: 400415 - RNA, 23 nt, Human
uaaagucacauauuagagugagc

SEQ ID NO: 400416 - RNA, 22 nt, Human
uucaacuuuaugcauauguauu

SEQ ID NO: 400417 - RNA, 22 nt, Human
acagauguacacucauauauaa

SEQ ID NO: 400418 - RNA, 22 nt, Human
caacagucugguuuauauaaua

SEQ ID NO: 400419 - RNA, 22 nt, Human
uuuaggcacaacuacucagcua

SEQ ID NO: 400420 - RNA, 18 nt, Human
aguccuuacgaggcuaua

SEQ ID NO: 400421 - RNA, 22 nt, Human
uugguacaaaaguaacuguggu

SEQ ID NO: 400422 - RNA, 22 nt, Human
gcuuuaaugaagucacgcaaag

SEQ ID NO: 400423 - RNA, 21 nt, Human
ugaaugaggaggauggcauuu

SEQ ID NO: 400424 - RNA, 22 nt, Human
gcaugucaugucauguaggaau

SEQ ID NO: 400425 - RNA, 22 nt, Human
uuacagaaucuacucgugguga

SEQ ID NO: 400426 - RNA, 22 nt, Human
guuaucaugcuucaucaucacu

SEQ ID NO: 400427 - RNA, 22 nt, Human
auuuccaguccuaaugaucugg

SEQ ID NO: 400428 - RNA, 20 nt, Human
agaaaucagaccacacacua

SEQ ID NO: 400429 - RNA, 22 nt, Human
acaugcuuuucccacaauuaua

SEQ ID NO: 400430 - RNA, 22 nt, Human
cugcuucuccaaaguaggacuu

SEQ ID NO: 400431 - RNA, 20 nt, Human
uacuggauuagggcucaccc

SEQ ID NO: 400432 - RNA, 20 nt, Human
uguaacaaucuggauguugc

SEQ ID NO: 400433 - RNA, 22 nt, Human
agucaccauuuucaccugccuc

SEQ ID NO: 400434 - RNA, 22 nt, Human
agucucugccagcuuguccucu

SEQ ID NO: 400435 - RNA, 20 nt, Human
auaaaauaacugccacaaga

SEQ ID NO: 400436 - RNA, 22 nt, Human
ucuauaaaugcagauaugugug

SEQ ID NO: 400437 - RNA, 17 nt, Human
ugaaggccaugaccacg

SEQ ID NO: 400438 - RNA, 22 nt, Human
uagauuuaagacccugaauuug

SEQ ID NO: 400439 - RNA, 18 nt, Human
aaaaagugcucaggccua

SEQ ID NO: 400440 - RNA, 22 nt, Human
augaaaauacugugguugauag

SEQ ID NO: 400441 - RNA, 22 nt, Human
aaagacuuggcuuaugauuugc

SEQ ID NO: 400442 - RNA, 22 nt, Human
ccaggaugacccccacuuuccu

SEQ ID NO: 400443 - RNA, 22 nt, Human
acugccauuggucaaaugagug

SEQ ID NO: 400444 - RNA, 22 nt, Human
gcagagcuucuguccuucagga

SEQ ID NO: 400445 - RNA, 22 nt, Human
cucaucugauaaaucacucuua

SEQ ID NO: 400446 - RNA, 22 nt, Human
uuucaacguguaaucuuauuua

SEQ ID NO: 400447 - RNA, 22 nt, Human
ucaguaaacagguuuaaguccu

SEQ ID NO: 400448 - RNA, 22 nt, Human
aaauugcaaaaguacuuuuagg

SEQ ID NO: 400449 - RNA, 22 nt, Human
cagaguggcacucugcuggaug

SEQ ID NO: 400450 - RNA, 22 nt, Human
auuugcuuaucuccacaguugu

SEQ ID NO: 400451 - RNA, 23 nt, Human
uccuuccuuugagaggcuccauc

SEQ ID NO: 400452 - RNA, 22 nt, Human
uauacagauggaaagauacaca

SEQ ID NO: 400453 - RNA, 22 nt, Human
caggaugagguagaggcagaua

SEQ ID NO: 400454 - RNA, 22 nt, Human
aaggcauaggacaaaucaguga

SEQ ID NO: 400455 - RNA, 22 nt, Human
cagucucuaaaucaaucugaau

SEQ ID NO: 400456 - RNA, 22 nt, Human
cauuucaagcauugacuucuau

SEQ ID NO: 400457 - RNA, 22 nt, Human
aaauauaauuucugccucaaua

SEQ ID NO: 400458 - RNA, 22 nt, Human
cucuggcuucuaccuugcaguu

SEQ ID NO: 400459 - RNA, 22 nt, Human
aagucauagucgggaaagacau

SEQ ID NO: 400460 - RNA, 22 nt, Human
gcaaacaaggacauacauccug

SEQ ID NO: 400461 - RNA, 22 nt, Human
gugucccaggccucuggaauua

SEQ ID NO: 400462 - RNA, 22 nt, Human
uaacaauaguguuugcuaguca

SEQ ID NO: 400463 - RNA, 19 nt, Human
agggaguuuauauuugcac

SEQ ID NO: 400464 - RNA, 22 nt, Human
uuucagacaggacuucauaugu

SEQ ID NO: 400465 - RNA, 22 nt, Human
auauaaagaaguggaaaaugag

SEQ ID NO: 400466 - RNA, 22 nt, Human
aaugaacauauaaagagaucuu

SEQ ID NO: 400467 - RNA, 22 nt, Human
uccaugagggacacuggaugcu

SEQ ID NO: 400468 - RNA, 22 nt, Human
auaaagauuuuuaggcauuucu

SEQ ID NO: 400469 - RNA, 22 nt, Human
guccucugaaguugugcaaugc

SEQ ID NO: 400470 - RNA, 22 nt, Human
gaucauuugcaggaaacauuaa

SEQ ID NO: 400471 - RNA, 20 nt, Human
ucacuaguaaccaucugcuu

SEQ ID NO: 400472 - RNA, 22 nt, Human
uaaguccuauuccaggucucuc

SEQ ID NO: 400473 - RNA, 22 nt, Human
cuacagaaacacuggacaugug

SEQ ID NO: 400474 - RNA, 20 nt, Human
cuguaucagguuacaaagua

SEQ ID NO: 400475 - RNA, 22 nt, Human
aauuuccagaccccauccacag

SEQ ID NO: 400476 - RNA, 22 nt, Human
aguauaauuagauaucaaaagu

SEQ ID NO: 400477 - RNA, 22 nt, Human
uuuccaaaaguuuguucugugc

SEQ ID NO: 400478 - RNA, 22 nt, Human
ucaaauaaugccauucaucauc

SEQ ID NO: 400479 - RNA, 22 nt, Human
aaaaugcugggaaaguuggaau

SEQ ID NO: 400480 - RNA, 23 nt, Human
uuccuuaacuguuaagauugucu

SEQ ID NO: 400481 - RNA, 22 nt, Human
ccagaggaaaaauaucucccua

SEQ ID NO: 400482 - RNA, 22 nt, Human
uuagccauugucagcacauggc

SEQ ID NO: 400483 - RNA, 22 nt, Human
gucccauaaguagugcaacuug

SEQ ID NO: 400484 - RNA, 22 nt, Human
uggaaagucucuuuugacugua

SEQ ID NO: 400485 - RNA, 22 nt, Human
uucaagacugcgacuaaugccc

SEQ ID NO: 400486 - RNA, 22 nt, Human
ugggagcccaagggagcugccg

SEQ ID NO: 400487 - RNA, 22 nt, Human
acuuuaucaggaaucacacagc

SEQ ID NO: 400488 - RNA, 17 nt, Human
uaucagaauguguuuac

SEQ ID NO: 400489 - RNA, 22 nt, Human
uguucacaagaugucuguggcu

SEQ ID NO: 400490 - RNA, 22 nt, Human
gcuuuaaugcuucguggggcca

SEQ ID NO: 400491 - RNA, 22 nt, Human
uucuucaauuuuccauauacug

SEQ ID NO: 400492 - RNA, 22 nt, Human
gguacaauucugggguaugcuc

SEQ ID NO: 400493 - RNA, 22 nt, Human
uagcuaucuguguccagaucca

SEQ ID NO: 400494 - RNA, 22 nt, Human
uugaaagugccaaguccuagug

SEQ ID NO: 400495 - RNA, 22 nt, Human
uuaguacugauagggucaauca

SEQ ID NO: 400496 - RNA, 22 nt, Human
cuggcuuucuguuauaaagaca

SEQ ID NO: 400497 - RNA, 21 nt, Human
caaucaguuggcauuugagca

SEQ ID NO: 400498 - RNA, 22 nt, Human
uuagccaugugggaaaaacagc

SEQ ID NO: 400499 - RNA, 22 nt, Human
caacauuugaguaaagaaaugg

SEQ ID NO: 400500 - RNA, 22 nt, Human
uuugguccugagcaaaacuaug

SEQ ID NO: 400501 - RNA, 22 nt, Human
uuauuauuccccaagucauuau

SEQ ID NO: 400502 - RNA, 22 nt, Human
ucaguuucuccaucgcuccagu

SEQ ID NO: 400503 - RNA, 22 nt, Human
ucuggaucgccggcgccugggc

SEQ ID NO: 400504 - RNA, 22 nt, Human
ucagagaaaugaaguagggauu

SEQ ID NO: 400505 - RNA, 22 nt, Human
uggcuuaauauuucauauuuaa

SEQ ID NO: 400506 - RNA, 23 nt, Human
uccaugagaugugggcuucuagu

SEQ ID NO: 400507 - RNA, 22 nt, Human
guucucucugcuuccaagaugg

SEQ ID NO: 400508 - RNA, 22 nt, Human
uucaggauaguggugaguggca

SEQ ID NO: 400509 - RNA, 23 nt, Human
aagaaugcuucugaagagcugcc

SEQ ID NO: 400510 - RNA, 19 nt, Human
uauuucaaagugccgucua

SEQ ID NO: 400511 - RNA, 22 nt, Human
cagaaaauaaaguuucuacgca

SEQ ID NO: 400512 - RNA, 22 nt, Human
uuuuauauggcacauugguugg

SEQ ID NO: 400513 - RNA, 22 nt, Human
guccaugauucuguguaguaga

SEQ ID NO: 400514 - RNA, 22 nt, Human
aagaauucacugguagagucaa

SEQ ID NO: 400515 - RNA, 22 nt, Human
uuuuuuaguuaggucagaaugu

SEQ ID NO: 400516 - RNA, 22 nt, Human
ucaguaaaguucuuucuugcug

SEQ ID NO: 400517 - RNA, 22 nt, Human
aucacuguguauguauaugcag

SEQ ID NO: 400518 - RNA, 22 nt, Human
caaguccuuuucuuggcucagg

SEQ ID NO: 400519 - RNA, 22 nt, Human
ugguaaauauguccauucucuu

SEQ ID NO: 400520 - RNA, 16 nt, Human
auuuccagauuaugca

SEQ ID NO: 400521 - RNA, 22 nt, Human
gaaguccugguccucucauuca

SEQ ID NO: 400522 - RNA, 22 nt, Human
aucagaaaggugggcaagcaga

SEQ ID NO: 400523 - RNA, 22 nt, Human
cuuaaaaucuggcaguuagcua

SEQ ID NO: 400524 - RNA, 22 nt, Human
aaaggccagguuggcugguauu

SEQ ID NO: 400525 - RNA, 22 nt, Human
ccaggcugcagucaaggggcau

SEQ ID NO: 400526 - RNA, 22 nt, Human
auuauccucagaaaacauguga

SEQ ID NO: 400527 - RNA, 22 nt, Human
aaauggaucuguggaauacauu

SEQ ID NO: 400528 - RNA, 22 nt, Human
ucucaggaagauuagggcuaag

SEQ ID NO: 400529 - RNA, 22 nt, Human
acauaauaggugccugaauauu

SEQ ID NO: 400530 - RNA, 22 nt, Human
uugaaaggguuaaagugguaaa

SEQ ID NO: 400531 - RNA, 22 nt, Human
uaaguccuagaugauucacaga

SEQ ID NO: 400532 - RNA, 22 nt, Human
aaaauacuguggaguguugaaa

SEQ ID NO: 400533 - RNA, 22 nt, Human
uuaagauagaacccaguagucu

SEQ ID NO: 400534 - RNA, 22 nt, Human
uuggaaagcaagcuggacauac

SEQ ID NO: 400535 - RNA, 22 nt, Human
gcaaauauucaagacuuuucca

SEQ ID NO: 400536 - RNA, 22 nt, Human
auucauuugcuauuguguaugg

SEQ ID NO: 400537 - RNA, 22 nt, Human
uuuaaauuuguguuuagagggu

SEQ ID NO: 400538 - RNA, 22 nt, Human
aguuauuacucuuuaacauauu

SEQ ID NO: 400539 - RNA, 22 nt, Human
auuugcuuuaagguauaaaagg

SEQ ID NO: 400540 - RNA, 22 nt, Human
uugagaagaaauaguuugcaau

SEQ ID NO: 400541 - RNA, 22 nt, Human
ugcaggaacauagguuccuugg

SEQ ID NO: 400542 - RNA, 22 nt, Human
agauuucagaugcucggcaguu

SEQ ID NO: 400543 - RNA, 22 nt, Human
aacauucugguucuaaaaaccu

SEQ ID NO: 400544 - RNA, 22 nt, Human
gcuccucuauuccccacauuuu

SEQ ID NO: 400545 - RNA, 22 nt, Human
ugcuuaauauugugauguaaua

SEQ ID NO: 400546 - RNA, 22 nt, Human
cuuugaauuccaguacaauaac

SEQ ID NO: 400547 - RNA, 22 nt, Human
gcucucuugguggcuguccugg

SEQ ID NO: 400548 - RNA, 22 nt, Human
aacauguaucgcuuuuuaauau

SEQ ID NO: 400549 - RNA, 22 nt, Human
guacagaaugcuugguaaggca

SEQ ID NO: 400550 - RNA, 22 nt, Human
aucuaaacagguguucuuuaga

SEQ ID NO: 400551 - RNA, 21 nt, Human
cauuuacaugacagauugguu

SEQ ID NO: 400552 - RNA, 22 nt, Human
ucugguaaccuuuaucccuccu

SEQ ID NO: 400553 - RNA, 22 nt, Human
uauacagucuuuugcuauauuc

SEQ ID NO: 400554 - RNA, 22 nt, Human
uucauacucacuccaauaacug

SEQ ID NO: 400555 - RNA, 23 nt, Human
uauggcuuacagugcuuuaggua

SEQ ID NO: 400556 - RNA, 22 nt, Human
aaaauugaggcucauguuaaau

SEQ ID NO: 400557 - RNA, 22 nt, Human
uaucaauacauguuaucagugu

SEQ ID NO: 400558 - RNA, 22 nt, Human
aaaugccuguguaaauucuagc

SEQ ID NO: 400559 - RNA, 19 nt, Human
ucugccucuggucaggcuc

SEQ ID NO: 400560 - RNA, 22 nt, Human
auuaggcaauucugggcaucuc

SEQ ID NO: 400561 - RNA, 22 nt, Human
ucagccaguugccccaguuagu

SEQ ID NO: 400562 - RNA, 22 nt, Human
uaaucuacuguuuauaugaaau

SEQ ID NO: 400563 - RNA, 23 nt, Human
uugauuucaaaugcagagaacac

SEQ ID NO: 400564 - RNA, 22 nt, Human
ucacuguugaccuggaaguggg

SEQ ID NO: 400565 - RNA, 22 nt, Human
gagagucuaggaaccucauaua

SEQ ID NO: 400566 - RNA, 22 nt, Human
auucucaauggcuacuuucaua

SEQ ID NO: 400567 - RNA, 22 nt, Human
agucccuguacuuuccacugcc

SEQ ID NO: 400568 - RNA, 22 nt, Human
uuugaaaggguuaugagacuga

SEQ ID NO: 400569 - RNA, 22 nt, Human
uucauucuuugaaucugaggua

SEQ ID NO: 400570 - RNA, 19 nt, Human
cagaaauagcgaaguguaa

SEQ ID NO: 400571 - RNA, 22 nt, Human
cagauggaacacagaaaggaga

SEQ ID NO: 400572 - RNA, 22 nt, Human
uagcaucuguucuuucauuaaa

SEQ ID NO: 400573 - RNA, 22 nt, Human
caaggccagggaauuuuucugg

SEQ ID NO: 400574 - RNA, 22 nt, Human
ccauuucacucuuccugaagga

SEQ ID NO: 400575 - RNA, 17 nt, Human
ucaggauguagcaguag

SEQ ID NO: 400576 - RNA, 22 nt, Human
ucucagucuuugcaaggaugcu

SEQ ID NO: 400577 - RNA, 22 nt, Human
guacauaaaggaggcucuuugc

SEQ ID NO: 400578 - RNA, 22 nt, Human
aagacauugucauuuuauaauu

SEQ ID NO: 400579 - RNA, 22 nt, Human
uuuauucuauaggcauuaagca

SEQ ID NO: 400580 - RNA, 22 nt, Human
caaugugguggcagaugucagu

SEQ ID NO: 400581 - RNA, 22 nt, Human
auacaaugagugagugaauggg

SEQ ID NO: 400582 - RNA, 15 nt, Human
uucaggauaugacuc

SEQ ID NO: 400583 - RNA, 22 nt, Human
uuaacacuccuaacuacagucu

SEQ ID NO: 400584 - RNA, 22 nt, Human
auacacagcgaugagaggaggc

SEQ ID NO: 400585 - RNA, 22 nt, Human
uuucaaagaccauuaacuauca

SEQ ID NO: 400586 - RNA, 20 nt, Human
ucauaaagaggaaauaaaua

SEQ ID NO: 400587 - RNA, 22 nt, Human
augaggcaucugcagucacuag

SEQ ID NO: 400588 - RNA, 22 nt, Human
aggcuucugugagcucauacaa

SEQ ID NO: 400589 - RNA, 22 nt, Human
uaauuucagugggcucugggcu

SEQ ID NO: 400590 - RNA, 22 nt, Human
uuuccaaaaugaaucuaaugca

SEQ ID NO: 400591 - RNA, 23 nt, Human
uuugaaguugacugccuuccaga

SEQ ID NO: 400592 - RNA, 22 nt, Human
augguuuuucaaguauucagaa

SEQ ID NO: 400593 - RNA, 22 nt, Human
auucuaacacaugcucuaagaa

SEQ ID NO: 400594 - RNA, 22 nt, Human
uucacagacauugcagacugaa

SEQ ID NO: 400595 - RNA, 22 nt, Human
ggccagaggugguacauagcuu

SEQ ID NO: 400596 - RNA, 22 nt, Human
auuuuacuuugugaauauugac

SEQ ID NO: 400597 - RNA, 17 nt, Human
uaaauacacaaggguau

SEQ ID NO: 400598 - RNA, 22 nt, Human
gauucaauguugcagauggaau

SEQ ID NO: 400599 - RNA, 22 nt, Human
gaaggccacggaauggagcugg

SEQ ID NO: 400600 - RNA, 22 nt, Human
cauagagugauguaagguaugu

SEQ ID NO: 400601 - RNA, 22 nt, Human
ucugcaucauuuuucagagccg

SEQ ID NO: 400602 - RNA, 22 nt, Human
gaauacauuggaaaucagaaua

SEQ ID NO: 400603 - RNA, 22 nt, Human
aaucagaauuuauugaaucuuu

SEQ ID NO: 400604 - RNA, 22 nt, Human
uguacauacauagauauacaca

SEQ ID NO: 400605 - RNA, 22 nt, Human
aucuauacuacaaauggcuggu

SEQ ID NO: 400606 - RNA, 22 nt, Human
ucagagaguuacacaaauuguu

SEQ ID NO: 400607 - RNA, 22 nt, Human
uacaauacuuaaccuauuuugc

SEQ ID NO: 400608 - RNA, 22 nt, Human
cggagccugcuuguugcagcug

SEQ ID NO: 400609 - RNA, 22 nt, Human
cuucagagugcagaagauuggg

SEQ ID NO: 400610 - RNA, 22 nt, Human
ugaaggccagggauuugcagcc

SEQ ID NO: 400611 - RNA, 22 nt, Human
ucaagacaucacugugcauuuu

SEQ ID NO: 400612 - RNA, 22 nt, Human
cauucuuacacaauauuuuaau

SEQ ID NO: 400613 - RNA, 22 nt, Human
caauuuuuaaacuaugaaguug

SEQ ID NO: 400614 - RNA, 22 nt, Human
caaagcaccacaaaccagguga

SEQ ID NO: 400615 - RNA, 22 nt, Human
aaauagcagccuuuaguuaaca

SEQ ID NO: 400616 - RNA, 19 nt, Human
aucugccuuagugcugcug

SEQ ID NO: 400617 - RNA, 22 nt, Human
caguuucuuggaugccaauuuc

SEQ ID NO: 400618 - RNA, 19 nt, Human
uucacaauuaugaaauuag

SEQ ID NO: 400619 - RNA, 22 nt, Human
cucccaggggaacuaucaagua

SEQ ID NO: 400620 - RNA, 22 nt, Human
uagaugcuguagaaauacuuau

SEQ ID NO: 400621 - RNA, 22 nt, Human
aaagcaguauauugguaguugu

SEQ ID NO: 400622 - RNA, 22 nt, Human
aucauuucccuuuagaucacaa

SEQ ID NO: 400623 - RNA, 22 nt, Human
aaguccuuguauacagaaucaa

SEQ ID NO: 400624 - RNA, 22 nt, Human
aggcacaggaaugucauccagu

SEQ ID NO: 400625 - RNA, 22 nt, Human
agagugaaguuuuugaaaguga

SEQ ID NO: 400626 - RNA, 22 nt, Human
auucuucaucagagaugcacua

SEQ ID NO: 400627 - RNA, 22 nt, Human
acagaauugauggaaaucucag

SEQ ID NO: 400628 - RNA, 22 nt, Human
uacaagaaauuucugcauauau

SEQ ID NO: 400629 - RNA, 22 nt, Human
uccaaaaaacguuugaauaguu

SEQ ID NO: 400630 - RNA, 22 nt, Human
uacauagaacauguuuaauguc

SEQ ID NO: 400631 - RNA, 22 nt, Human
auauacugauagcugcacuucu

SEQ ID NO: 400632 - RNA, 22 nt, Human
cauuuguuuagaagucuuuaua

SEQ ID NO: 400633 - RNA, 22 nt, Human
cucaggauccaucuccugcccu

SEQ ID NO: 400634 - RNA, 22 nt, Human
uucacagaguuauuuuuaugcu

SEQ ID NO: 400635 - RNA, 22 nt, Human
ccuggaucgaugccgagggaaa

SEQ ID NO: 400636 - RNA, 22 nt, Human
cuauagaaaauuguaucacacg

SEQ ID NO: 400637 - RNA, 19 nt, Human
uucaggauugacccuacug

SEQ ID NO: 400638 - RNA, 22 nt, Human
uuuguuuagaugguaaaucagu

SEQ ID NO: 400639 - RNA, 22 nt, Human
aguucacauaucuguuuuauuu

SEQ ID NO: 400640 - RNA, 22 nt, Human
guuuuauaggcuguugcuauau

SEQ ID NO: 400641 - RNA, 22 nt, Human
auaaacucaugccaagaaauga

SEQ ID NO: 400642 - RNA, 22 nt, Human
ucagauggguuuugaaggaugu

SEQ ID NO: 400643 - RNA, 22 nt, Human
cacaugaguccugccagguaug

SEQ ID NO: 400644 - RNA, 22 nt, Human
agauuuccuaugguaauuauag

SEQ ID NO: 400645 - RNA, 22 nt, Human
uaauuauagccgcuauuuugcu

SEQ ID NO: 400646 - RNA, 22 nt, Human
aacauuggauauuuauuaaaag

SEQ ID NO: 400647 - RNA, 22 nt, Human
acauuccaaaaacuagcagaua

SEQ ID NO: 400648 - RNA, 18 nt, Human
agaugaaagcaaaugaca

SEQ ID NO: 400649 - RNA, 22 nt, Human
uguucauuuggcccuuuuguau

SEQ ID NO: 400650 - RNA, 22 nt, Human
aucuuucagggccauuuguauu

SEQ ID NO: 400651 - RNA, 22 nt, Human
uuauuucauugauuucuaagac

SEQ ID NO: 400652 - RNA, 22 nt, Human
ucuccucuauuucuguauguau

SEQ ID NO: 400653 - RNA, 17 nt, Human
caauuucauagguuuug

SEQ ID NO: 400654 - RNA, 22 nt, Human
aaaacaguuuaggcaucacagu

SEQ ID NO: 400655 - RNA, 22 nt, Human
uccauuuagcuggcaaacaaug

SEQ ID NO: 400656 - RNA, 22 nt, Human
agauuucacaugcugcucuauu

SEQ ID NO: 400657 - RNA, 22 nt, Human
gcuggaucauauggugguucua

SEQ ID NO: 400658 - RNA, 22 nt, Human
uagucaccuuuggcaccugcaa

SEQ ID NO: 400659 - RNA, 22 nt, Human
aggcaguuuaggcagcgauuua

SEQ ID NO: 400660 - RNA, 22 nt, Human
ucaaaucagcaagcagcuuccc

SEQ ID NO: 400661 - RNA, 19 nt, Human
ugagaggcuuaaggcagcu

SEQ ID NO: 400662 - RNA, 22 nt, Human
aaagucaugaugaaccaccgua

SEQ ID NO: 400663 - RNA, 22 nt, Human
uucauuugccaucaguguaaug

SEQ ID NO: 400664 - RNA, 22 nt, Human
cacauacuuguguguacauaug

SEQ ID NO: 400665 - RNA, 22 nt, Human
acauaauagcauuucuaauuug

SEQ ID NO: 400666 - RNA, 22 nt, Human
uuaauucugccuuucauguaac

SEQ ID NO: 400667 - RNA, 22 nt, Human
uacaagaaugucuuaaaagcuc

SEQ ID NO: 400668 - RNA, 22 nt, Human
agaacaucuaaauaucugagac

SEQ ID NO: 400669 - RNA, 22 nt, Human
gcucaggaucccaggggugugc

SEQ ID NO: 400670 - RNA, 22 nt, Human
aaagaaucacauccuucagcaa

SEQ ID NO: 400671 - RNA, 22 nt, Human
ucacaauuuggauacagcuaug

SEQ ID NO: 400672 - RNA, 22 nt, Human
aauauuucugcagaaugguuuu

SEQ ID NO: 400673 - RNA, 22 nt, Human
ucauuuguucucauucucuacu

SEQ ID NO: 400674 - RNA, 22 nt, Human
uauuuccaaaagccuauuauga

SEQ ID NO: 400675 - RNA, 21 nt, Human
uuugaaagugggugauucuuu

SEQ ID NO: 400676 - RNA, 22 nt, Human
cagaccucaguccucaguagga

SEQ ID NO: 400677 - RNA, 23 nt, Human
auauggcuguuguguguuaacau

SEQ ID NO: 400678 - RNA, 22 nt, Human
uucaugugaauauauuugucuu

SEQ ID NO: 400679 - RNA, 22 nt, Human
uuuauucuugagagugagaaga

SEQ ID NO: 400680 - RNA, 22 nt, Human
uuguaaaugaccuuuucuaauu

SEQ ID NO: 400681 - RNA, 22 nt, Human
uuccugggacuggagcagccca

SEQ ID NO: 400682 - RNA, 22 nt, Human
aaagucauggaaaaucuuggaa

SEQ ID NO: 400683 - RNA, 18 nt, Human
auagaaaccuuuaaucag

SEQ ID NO: 400684 - RNA, 22 nt, Human
caacuuuaugauugguuuguca

SEQ ID NO: 400685 - RNA, 22 nt, Human
ucugggaacucugucauuuccc

SEQ ID NO: 400686 - RNA, 17 nt, Human
aaucuguuuacagucag

SEQ ID NO: 400687 - RNA, 22 nt, Human
cacagcauaaugaaauauacuu

SEQ ID NO: 400688 - RNA, 22 nt, Human
aauuuccagaucagaugacuca

SEQ ID NO: 400689 - RNA, 22 nt, Human
gagagaaaugugcaguuugggc

SEQ ID NO: 400690 - RNA, 22 nt, Human
cucaggauguacuacagaaggc

SEQ ID NO: 400691 - RNA, 22 nt, Human
ugaauaaucauguccauagugu

SEQ ID NO: 400692 - RNA, 22 nt, Human
caggauggagggagggcuguua

SEQ ID NO: 400693 - RNA, 22 nt, Human
caaaggcaggcccccugugcag

SEQ ID NO: 400694 - RNA, 22 nt, Human
ucagagaagcugccaggcgagc

SEQ ID NO: 400695 - RNA, 20 nt, Human
augugagggguugaaguggg

SEQ ID NO: 400696 - RNA, 22 nt, Human
uagcuuuccuuguugccugugc

SEQ ID NO: 400697 - RNA, 22 nt, Human
agaauuucaaauggaaguuuua

SEQ ID NO: 400698 - RNA, 22 nt, Human
aauuucaaagcucacuggcaua

SEQ ID NO: 400699 - RNA, 20 nt, Human
uuucaguuaucuugaccuuc

SEQ ID NO: 400700 - RNA, 19 nt, Human
aacuguaauuaauacccua

SEQ ID NO: 400701 - RNA, 22 nt, Human
cagaucuguuugccagaucagc

SEQ ID NO: 400702 - RNA, 22 nt, Human
aaacugauaaaauaaguacauu

SEQ ID NO: 400703 - RNA, 22 nt, Human
ccucaggggucacugugaggag

SEQ ID NO: 400704 - RNA, 22 nt, Human
aacauguaaauaucauuguacu

SEQ ID NO: 400705 - RNA, 22 nt, Human
aggcacaggccucagcacccag

SEQ ID NO: 400706 - RNA, 22 nt, Human
caguuuuugccauuaagaguaa

SEQ ID NO: 400707 - RNA, 22 nt, Human
uauuaaagagagaaucaucauc

SEQ ID NO: 400708 - RNA, 22 nt, Human
auucuucacaccuguuccuguu

SEQ ID NO: 400709 - RNA, 22 nt, Human
uaaagccauacugaaagccacu

SEQ ID NO: 400710 - RNA, 22 nt, Human
auguucuuucagccagugcauc

SEQ ID NO: 400711 - RNA, 22 nt, Human
aaacuuuguucgucugaugugg

SEQ ID NO: 400712 - RNA, 22 nt, Human
agucuuaauagagaaaaacugu

SEQ ID NO: 400713 - RNA, 22 nt, Human
aucagaaaucuaggauucagaa

SEQ ID NO: 400714 - RNA, 22 nt, Human
aucaggaugacaacugcugggu

SEQ ID NO: 400715 - RNA, 22 nt, Human
aguaccaugcuuccugacuggu

SEQ ID NO: 400716 - RNA, 22 nt, Human
aacauuucagcaaauaagaaca

SEQ ID NO: 400717 - RNA, 22 nt, Human
aaaguccagagggcacacugaa

SEQ ID NO: 400718 - RNA, 22 nt, Human
ugcagggcccucauuccugucc

SEQ ID NO: 400719 - RNA, 22 nt, Human
uucaggaugacaccauguccag

SEQ ID NO: 400720 - RNA, 22 nt, Human
cucuaauccuuugucccugggu

SEQ ID NO: 400721 - RNA, 22 nt, Human
acucaggaaaugagaggcucuc

SEQ ID NO: 400722 - RNA, 22 nt, Human
uucauucugcaguucucagcuc

SEQ ID NO: 400723 - RNA, 23 nt, Human
aaauaggaguaucuggaucauga

SEQ ID NO: 400724 - RNA, 22 nt, Human
caaggccaguccauuuuggaag

SEQ ID NO: 400725 - RNA, 22 nt, Human
cucagaauuuagggcucugagg

SEQ ID NO: 400726 - RNA, 22 nt, Human
uucaggauucuuucagacuggg

SEQ ID NO: 400727 - RNA, 22 nt, Human
uuaauuaugcaaaaggccccau

SEQ ID NO: 400728 - RNA, 22 nt, Human
uaauuuacuugcaaauaacaau

SEQ ID NO: 400729 - RNA, 22 nt, Human
gaugagcauuguuucauguguu

SEQ ID NO: 400730 - RNA, 22 nt, Human
aauacugucuuucacagauauu

SEQ ID NO: 400731 - RNA, 22 nt, Human
uuuaggcagcacgggcagcccu

SEQ ID NO: 400732 - RNA, 22 nt, Human
uaauuuuuccacguacacuggg

SEQ ID NO: 400733 - RNA, 22 nt, Human
uuuuucaagacaaccugcaugu

SEQ ID NO: 400734 - RNA, 22 nt, Human
auacagaaaaguggauagccag

SEQ ID NO: 400735 - RNA, 19 nt, Human
aucugagauuauaaacaga

SEQ ID NO: 400736 - RNA, 22 nt, Human
uuucccaguucccugcucuaua

SEQ ID NO: 400737 - RNA, 22 nt, Human
uagaaacagaaaacuguaauag

SEQ ID NO: 400738 - RNA, 22 nt, Human
cagaaauaaacuucucacaucg

SEQ ID NO: 400739 - RNA, 22 nt, Human
uuccagcaggcagacaggagau

SEQ ID NO: 400740 - RNA, 22 nt, Human
caaauguauucucacuucaggg

SEQ ID NO: 400741 - RNA, 22 nt, Human
aaucauucuuauuucacagcaa

SEQ ID NO: 400742 - RNA, 22 nt, Human
acaaaugugucuaauugugccu

SEQ ID NO: 400743 - RNA, 22 nt, Human
caaguccucaaagggcucugcu

SEQ ID NO: 400744 - RNA, 22 nt, Human
uacacaugaucauuuaguagca

SEQ ID NO: 400745 - RNA, 22 nt, Human
ucacagaacaauguuuaguucu

SEQ ID NO: 400746 - RNA, 23 nt, Human
ucuccuccuagauacagucaugg

SEQ ID NO: 400747 - RNA, 22 nt, Human
caggccaggguugagaagagaa

SEQ ID NO: 400748 - RNA, 19 nt, Human
acuguaaggcauuuuuuuc

SEQ ID NO: 400749 - RNA, 22 nt, Human
gucuucaacaauaacuaccacu

SEQ ID NO: 400750 - RNA, 18 nt, Human
gaugggagcaagagaaga

SEQ ID NO: 400751 - RNA, 22 nt, Human
guuuuauaggugaaauauuacu

SEQ ID NO: 400752 - RNA, 22 nt, Human
cugaaagaauaagauguuuaca

SEQ ID NO: 400753 - RNA, 20 nt, Human
acuggaucuggcuggagcug

SEQ ID NO: 400754 - RNA, 22 nt, Human
uauuuucuguggaggaccagau

SEQ ID NO: 400755 - RNA, 22 nt, Human
cuuguccccagcagguugguuu

SEQ ID NO: 400756 - RNA, 22 nt, Human
gaaaggccauuucugaggguuu

SEQ ID NO: 400757 - RNA, 22 nt, Human
gaaggccacaaaaaaugucaua

SEQ ID NO: 400758 - RNA, 22 nt, Human
cucuucuuauggccguggcuga

SEQ ID NO: 400759 - RNA, 22 nt, Human
aaaaaucuaugacugcuucucc

SEQ ID NO: 400760 - RNA, 22 nt, Human
ucagaaauacaaaacacuuacu

SEQ ID NO: 400761 - RNA, 22 nt, Human
aagauggagcacgagcagaagc

SEQ ID NO: 400762 - RNA, 22 nt, Human
uucuuacagaguuuacagagcc

SEQ ID NO: 400763 - RNA, 22 nt, Human
uuuuaucuaccuaugcucauuu

SEQ ID NO: 400764 - RNA, 22 nt, Human
gccagucugcucccacaaguuc

SEQ ID NO: 400765 - RNA, 22 nt, Human
ccagaggaggggggucuuucug

SEQ ID NO: 400766 - RNA, 22 nt, Human
aguccuuagaacagugccuggg

SEQ ID NO: 400767 - RNA, 22 nt, Human
ucugggaaugaauaagaccugu

SEQ ID NO: 400768 - RNA, 22 nt, Human
auuucaaggcuauuaauauaaa

SEQ ID NO: 400769 - RNA, 22 nt, Human
augcacaagcaagagauaaugg

SEQ ID NO: 400770 - RNA, 22 nt, Human
uggaguucauccaugacagcuu

SEQ ID NO: 400771 - RNA, 22 nt, Human
ggcuuggaaauugcaggacaca

SEQ ID NO: 400772 - RNA, 22 nt, Human
caccagacagguguaugcauau

SEQ ID NO: 400773 - RNA, 21 nt, Human
auggauuuaaacaggccacaa

SEQ ID NO: 400774 - RNA, 22 nt, Human
gagagguccauuccccugucag

SEQ ID NO: 400775 - RNA, 22 nt, Human
uucauucuugggaucagagagu

SEQ ID NO: 400776 - RNA, 22 nt, Human
caguucacacugugcuaucugc

SEQ ID NO: 400777 - RNA, 22 nt, Human
aaagucaucagaaccuuccaga

SEQ ID NO: 400778 - RNA, 22 nt, Human
caguuucuauggcugggcucug

SEQ ID NO: 400779 - RNA, 22 nt, Human
uuucaaaccuacuuguauguuu

SEQ ID NO: 400780 - RNA, 22 nt, Human
acaguccuuguguggaacauua

SEQ ID NO: 400781 - RNA, 22 nt, Human
auaaagcaaauaggacuauugc

SEQ ID NO: 400782 - RNA, 22 nt, Human
aucuauacccaucaugauuuaa

SEQ ID NO: 400783 - RNA, 22 nt, Human
ugcauggacucaucagacaaga

SEQ ID NO: 400784 - RNA, 22 nt, Human
ucugggaaccagugcggcuggg

SEQ ID NO: 400785 - RNA, 22 nt, Human
uuuaucuguuguacauuuaugc

SEQ ID NO: 400786 - RNA, 22 nt, Human
aaagucauguaaugauaugauu

SEQ ID NO: 400787 - RNA, 22 nt, Human
gucauuucuguuucuucagugc

SEQ ID NO: 400788 - RNA, 22 nt, Human
auucauuagccacuaacuagca

SEQ ID NO: 400789 - RNA, 22 nt, Human
uauuacaauuuacauugcacuu

SEQ ID NO: 400790 - RNA, 22 nt, Human
ugucaccaugccagcuucugcc

SEQ ID NO: 400791 - RNA, 22 nt, Human
aaaacuaaauacgcuuugccuc

SEQ ID NO: 400792 - RNA, 22 nt, Human
uaguacaguuuaaauauuaaua

SEQ ID NO: 400793 - RNA, 22 nt, Human
augguuuauugcuuuaaugaaa

SEQ ID NO: 400794 - RNA, 22 nt, Human
auuuguagugaagugaaaauaa

SEQ ID NO: 400795 - RNA, 22 nt, Human
aauacuaguuauuaaagcuuuu

SEQ ID NO: 400796 - RNA, 23 nt, Human
ucaucaaacagcugcucaagaaa

SEQ ID NO: 400797 - RNA, 22 nt, Human
uguccauggauagagcugcucg

SEQ ID NO: 400798 - RNA, 22 nt, Human
augaaauauuucagagcagagu

SEQ ID NO: 400799 - RNA, 22 nt, Human
gaugauaacagcauuucaacug

SEQ ID NO: 400800 - RNA, 22 nt, Human
aaugaacagauacacauaggca

SEQ ID NO: 400801 - RNA, 22 nt, Human
caaggccaguuucuccuaguca

SEQ ID NO: 400802 - RNA, 22 nt, Human
uucucacuauguauguagauug

SEQ ID NO: 400803 - RNA, 22 nt, Human
cagaucuagagcuuuuccaucu

SEQ ID NO: 400804 - RNA, 22 nt, Human
auugaaaauaaggccagaaaca

SEQ ID NO: 400805 - RNA, 22 nt, Human
ccuggaucagagccagagaagc

SEQ ID NO: 400806 - RNA, 22 nt, Human
acuggauuccauugugcaaaga

SEQ ID NO: 400807 - RNA, 22 nt, Human
uuauagugggcccaacauggcg

SEQ ID NO: 400808 - RNA, 22 nt, Human
guugaaaguagaugcuauuugg

SEQ ID NO: 400809 - RNA, 22 nt, Human
gcuauacaaguguagaauagag

SEQ ID NO: 400810 - RNA, 22 nt, Human
caucagaaucugagucucugcc

SEQ ID NO: 400811 - RNA, 22 nt, Human
uaauuacagguccaaaacaauc

SEQ ID NO: 400812 - RNA, 22 nt, Human
auuauauaggacuugcccuucc

SEQ ID NO: 400813 - RNA, 22 nt, Human
acuaaacugaagcaugaaaagg

SEQ ID NO: 400814 - RNA, 22 nt, Human
ugguaauuaauuugauagguuc

SEQ ID NO: 400815 - RNA, 22 nt, Human
acugcagagguggggugcagag

SEQ ID NO: 400816 - RNA, 22 nt, Human
guucuucaucuuaaccaucugu

SEQ ID NO: 400817 - RNA, 22 nt, Human
guugaaagcuuuucauuuaguu

SEQ ID NO: 400818 - RNA, 22 nt, Human
ucucucuugucaccccaucugc

SEQ ID NO: 400819 - RNA, 22 nt, Human
caaguccuccaugugacuaggu

SEQ ID NO: 400820 - RNA, 22 nt, Human
cauuuguaucauauguaucuua

SEQ ID NO: 400821 - RNA, 22 nt, Human
gaucugaagagcaaugaaauau

SEQ ID NO: 400822 - RNA, 22 nt, Human
aaagcauuucaugucuagaaag

SEQ ID NO: 400823 - RNA, 22 nt, Human
uuuaaauucugucugccgcuua

SEQ ID NO: 400824 - RNA, 22 nt, Human
uagaaacagauguuuuugaaga

SEQ ID NO: 400825 - RNA, 22 nt, Human
uucuuaaaacuuauggacaggu

SEQ ID NO: 400826 - RNA, 22 nt, Human
ugcuuaauaggaguugaacauu

SEQ ID NO: 400827 - RNA, 22 nt, Human
acauuuuuauucaucaaagcag

SEQ ID NO: 400828 - RNA, 22 nt, Human
auacaacagaaaaugauuauuc

SEQ ID NO: 400829 - RNA, 22 nt, Human
ucaacuuugaaaccauagugaa

SEQ ID NO: 400830 - RNA, 19 nt, Human
aggauuuauuaugugcuca

SEQ ID NO: 400831 - RNA, 22 nt, Human
acagcauugagagcuaaauuua

SEQ ID NO: 400832 - RNA, 22 nt, Human
uauggcuuuuuauucaucuuac

SEQ ID NO: 400833 - RNA, 22 nt, Human
ucaaaauucuagggagaauggu

SEQ ID NO: 400834 - RNA, 22 nt, Human
cugaaaggguuacauaguaagu

SEQ ID NO: 400835 - RNA, 23 nt, Human
uucauuugucuacuucacuuguu

SEQ ID NO: 400836 - RNA, 22 nt, Human
uauuaaagggaaguuaugcaug

SEQ ID NO: 400837 - RNA, 22 nt, Human
cauuucaaguaacagauugcuu

SEQ ID NO: 400838 - RNA, 22 nt, Human
gaguccuugucauaauucagug

SEQ ID NO: 400839 - RNA, 19 nt, Human
aauacaguguuauagaauu

SEQ ID NO: 400840 - RNA, 22 nt, Human
ucugggaagcugguccuguucu

SEQ ID NO: 400841 - RNA, 22 nt, Human
auguuucaccagcaaauuaccu

SEQ ID NO: 400842 - RNA, 22 nt, Human
acacaaauuguaggauaauugc

SEQ ID NO: 400843 - RNA, 22 nt, Human
acuauacauugaauguuaaggu

SEQ ID NO: 400844 - RNA, 22 nt, Human
auggcuuucagauuucuauguu

SEQ ID NO: 400845 - RNA, 20 nt, Human
uuuaggcauuacucuuuugu

SEQ ID NO: 400846 - RNA, 22 nt, Human
guuuaaucagaggaauuauaga

SEQ ID NO: 400847 - RNA, 22 nt, Human
cugcuuccauaaauaaugugcu

SEQ ID NO: 400848 - RNA, 22 nt, Human
aaauaucauuuauaacuuuuaa

SEQ ID NO: 400849 - RNA, 22 nt, Human
cucucagacugaagggccugug

SEQ ID NO: 400850 - RNA, 22 nt, Human
cugaauaauacagacuagcuuc

SEQ ID NO: 400851 - RNA, 22 nt, Human
auauuaaauggauuuugggagc

SEQ ID NO: 400852 - RNA, 22 nt, Human
cagaauuuuucgaauguacugu

SEQ ID NO: 400853 - RNA, 22 nt, Human
uccaugagacagauacuguaag

SEQ ID NO: 400854 - RNA, 22 nt, Human
aaucaugugggauagucugcuc

SEQ ID NO: 400855 - RNA, 22 nt, Human
cagucucagaggugggaguggg

SEQ ID NO: 400856 - RNA, 22 nt, Human
uucuuugaguuaguacagucca

SEQ ID NO: 400857 - RNA, 22 nt, Human
uguccuuaucuccaaacaauca

SEQ ID NO: 400858 - RNA, 20 nt, Human
aaaaacaguaaugcugaaga

SEQ ID NO: 400859 - RNA, 22 nt, Human
augcuuuuccaggagaaauaua

SEQ ID NO: 400860 - RNA, 22 nt, Human
cugaaagguauaaauaagacuu

SEQ ID NO: 400861 - RNA, 22 nt, Human
agucauaugacccuucacaaac

SEQ ID NO: 400862 - RNA, 22 nt, Human
cuugaaagcacuuaguaaauua

SEQ ID NO: 400863 - RNA, 22 nt, Human
aaaucucaauuugaauuguagc

SEQ ID NO: 400864 - RNA, 22 nt, Human
aucaggaucacugggagucuug

SEQ ID NO: 400865 - RNA, 22 nt, Human
acagaugauuuuuaugaaaaca

SEQ ID NO: 400866 - RNA, 22 nt, Human
gugaauaaaacaccugccaaga

SEQ ID NO: 400867 - RNA, 22 nt, Human
aaugccaacuuggauauacauu

SEQ ID NO: 400868 - RNA, 22 nt, Human
gaauuucagagguaacaucauc

SEQ ID NO: 400869 - RNA, 22 nt, Human
uguaacaaaauaccuuggauug

SEQ ID NO: 400870 - RNA, 17 nt, Human
ugaaaucagcacccagg

SEQ ID NO: 400871 - RNA, 22 nt, Human
uucccaugccuggccccuaucc

SEQ ID NO: 400872 - RNA, 22 nt, Human
ugcuuaaacacauacauacaua

SEQ ID NO: 400873 - RNA, 22 nt, Human
caauacaauuaccaguuaauca

SEQ ID NO: 400874 - RNA, 22 nt, Human
uuaaaauuauggcccauuugga

SEQ ID NO: 400875 - RNA, 22 nt, Human
gccuaauaacuagcuguguaac

SEQ ID NO: 400876 - RNA, 22 nt, Human
uaguccuugguaaaauucuaug

SEQ ID NO: 400877 - RNA, 22 nt, Human
caaauacuggguaaguuaauuu

SEQ ID NO: 400878 - RNA, 22 nt, Human
augugaaaaauuucuuauuaca

SEQ ID NO: 400879 - RNA, 22 nt, Human
uuacagaaggaacacuacucag

SEQ ID NO: 400880 - RNA, 22 nt, Human
caugcuuaugauuugcuaagcc

SEQ ID NO: 400881 - RNA, 22 nt, Human
uucuauacaaagauuucucaca

SEQ ID NO: 400882 - RNA, 22 nt, Human
cuuaggcaguuuaggaaagaga

SEQ ID NO: 400883 - RNA, 22 nt, Human
aaaucaguuguuauauuaaaga

SEQ ID NO: 400884 - RNA, 20 nt, Human
aaguuacauuguauuguacc

SEQ ID NO: 400885 - RNA, 18 nt, Human
gcacuucacccagcuagu

SEQ ID NO: 400886 - RNA, 22 nt, Human
aaaguccugacugcaggggaug

SEQ ID NO: 400887 - RNA, 22 nt, Human
aaaggccauuacuugcuuuuag

SEQ ID NO: 400888 - RNA, 22 nt, Human
uugguccacugugaaauuggga

SEQ ID NO: 400889 - RNA, 22 nt, Human
gaggaacccagcugggguugcc

SEQ ID NO: 400890 - RNA, 22 nt, Human
uaauacuuuugccuuguauuca

SEQ ID NO: 400891 - RNA, 22 nt, Human
guucuucacauuucauugagga

SEQ ID NO: 400892 - RNA, 23 nt, Human
auuucuaggggauuuucuggugc

SEQ ID NO: 400893 - RNA, 17 nt, Human
ugauaguucauuuuaag

SEQ ID NO: 400894 - RNA, 22 nt, Human
aucuauacucagaguuaauauc

SEQ ID NO: 400895 - RNA, 22 nt, Human
uuccuuaggcuguuugcagugc

SEQ ID NO: 400896 - RNA, 22 nt, Human
aaauuagucgguuuaggaauuu

SEQ ID NO: 400897 - RNA, 22 nt, Human
acaugaaacuguugcauuagaa

SEQ ID NO: 400898 - RNA, 22 nt, Human
ucauagaaugaguuaaugaacu

SEQ ID NO: 400899 - RNA, 22 nt, Human
acuuucugcaguguuggaaaug

SEQ ID NO: 400900 - RNA, 22 nt, Human
uuaguuuucccaucuuuauggu

SEQ ID NO: 400901 - RNA, 22 nt, Human
agauuggaucaagcagcaguug

SEQ ID NO: 400902 - RNA, 22 nt, Human
cuaucaaacagccauuaauaua

SEQ ID NO: 400903 - RNA, 22 nt, Human
uuagaaauacaagugagguuga

SEQ ID NO: 400904 - RNA, 22 nt, Human
uaaagucauaagaguggauccg

SEQ ID NO: 400905 - RNA, 22 nt, Human
acagaauuugcuugggcaaugg

SEQ ID NO: 400906 - RNA, 22 nt, Human
aguggaccagaagacugaagcu

SEQ ID NO: 400907 - RNA, 22 nt, Human
uuucagaaagcugaacauauga

SEQ ID NO: 400908 - RNA, 22 nt, Human
uuuacagaugaggauacugagg

SEQ ID NO: 400909 - RNA, 22 nt, Human
uggcauuucuguuagacucuca

SEQ ID NO: 400910 - RNA, 22 nt, Human
ucagaaaugaucguuauucauu

SEQ ID NO: 400911 - RNA, 22 nt, Human
uuucaguuuuugcucgauguau

SEQ ID NO: 400912 - RNA, 22 nt, Human
cucugcaugccuugcucagaca

SEQ ID NO: 400913 - RNA, 22 nt, Human
guauacagauacuuagacgugc

SEQ ID NO: 400914 - RNA, 22 nt, Human
auucucuuuguauaacaucuug

SEQ ID NO: 400915 - RNA, 22 nt, Human
ucucaggaauagaguggcagca

SEQ ID NO: 400916 - RNA, 22 nt, Human
acuucacagaaauuuuaugagg

SEQ ID NO: 400917 - RNA, 18 nt, Human
gucacuguguuucugagc

SEQ ID NO: 400918 - RNA, 22 nt, Human
aauggccagcaacaggagugaa

SEQ ID NO: 400919 - RNA, 22 nt, Human
gucacagaguuauuaauugugu

SEQ ID NO: 400920 - RNA, 22 nt, Human
aaacauuugcaacucgguuugg

SEQ ID NO: 400921 - RNA, 22 nt, Human
augauguugauaaauuacuuua

SEQ ID NO: 400922 - RNA, 22 nt, Human
cuguaugaggaucagacuggac

SEQ ID NO: 400923 - RNA, 22 nt, Human
uuacagaauguucuuccaacag

SEQ ID NO: 400924 - RNA, 19 nt, Human
ugaguucugugguucucaa

SEQ ID NO: 400925 - RNA, 22 nt, Human
uuugacaaaggaaaaaugcaca

SEQ ID NO: 400926 - RNA, 22 nt, Human
aagcuggaacaucuugaggaag

SEQ ID NO: 400927 - RNA, 22 nt, Human
aaggcaguacuuuauguccaua

SEQ ID NO: 400928 - RNA, 22 nt, Human
ggcuuggaccagucacaguggu

SEQ ID NO: 400929 - RNA, 22 nt, Human
aguguuagauucuuacucaguu

SEQ ID NO: 400930 - RNA, 22 nt, Human
ugaagaauaaaugguugagacu

SEQ ID NO: 400931 - RNA, 22 nt, Human
uuguuuuaucuuucuacagacu

SEQ ID NO: 400932 - RNA, 22 nt, Human
aaaacuuucagggauacagaaa

SEQ ID NO: 400933 - RNA, 22 nt, Human
uaaugucaaggugauagauuug

SEQ ID NO: 400934 - RNA, 22 nt, Human
uccaaaguaauuucacuucugu

SEQ ID NO: 400935 - RNA, 22 nt, Human
cauuuccagcuccugcaucaug

SEQ ID NO: 400936 - RNA, 22 nt, Human
ucauauaaguuuaaaacuaucu

SEQ ID NO: 400937 - RNA, 22 nt, Human
ugcuggaggauuaaacaaguca

SEQ ID NO: 400938 - RNA, 22 nt, Human
uuccuuagcugucccuggaaau

SEQ ID NO: 400939 - RNA, 22 nt, Human
uuugaacaggaguaucuauagu

SEQ ID NO: 400940 - RNA, 22 nt, Human
uuaaauuuuagaaacagacucu

SEQ ID NO: 400941 - RNA, 22 nt, Human
aauagaaaggaggggcucuugu

SEQ ID NO: 400942 - RNA, 22 nt, Human
uggagcugggguuugaaucugg

SEQ ID NO: 400943 - RNA, 22 nt, Human
uguggaaaauuggaacguuccu

SEQ ID NO: 400944 - RNA, 22 nt, Human
cauagcuuagggguuaaacuca

SEQ ID NO: 400945 - RNA, 22 nt, Human
uaucuaaaggauuuaauuuagu

SEQ ID NO: 400946 - RNA, 22 nt, Human
acagaaugggauuugaauauuu

SEQ ID NO: 400947 - RNA, 22 nt, Human
cccaugagaccugguuuaaggc

SEQ ID NO: 400948 - RNA, 22 nt, Human
ucaaaauuaaaccaacguccag

SEQ ID NO: 400949 - RNA, 22 nt, Human
uguuuaauaauucuaugauagu

SEQ ID NO: 400950 - RNA, 22 nt, Human
cuuaaccagaaaaugcacuugu

SEQ ID NO: 400951 - RNA, 22 nt, Human
uaucagaaugcagccaugugca

SEQ ID NO: 400952 - RNA, 22 nt, Human
ucagagaguuagugucuuagcu

SEQ ID NO: 400953 - RNA, 22 nt, Human
uuauuaaugaguacaaguuauu

SEQ ID NO: 400954 - RNA, 22 nt, Human
aagucacaagcauauaugcauu

SEQ ID NO: 400955 - RNA, 22 nt, Human
uuucauaaggguuucuagacuu

SEQ ID NO: 400956 - RNA, 22 nt, Human
ggcuuaaugguucuuuuucuca

SEQ ID NO: 400957 - RNA, 22 nt, Human
aagccauuuguuguccuucagg

SEQ ID NO: 400958 - RNA, 22 nt, Human
uuuaaauuauaguuaaugucug

SEQ ID NO: 400959 - RNA, 22 nt, Human
aaguugagaugucauaggagac

SEQ ID NO: 400960 - RNA, 22 nt, Human
uccaugagagguaacuuuacaa

SEQ ID NO: 400961 - RNA, 22 nt, Human
gugcauuugugcaugcacaugu

SEQ ID NO: 400962 - RNA, 22 nt, Human
uucacagaauggcaaguuaugg

SEQ ID NO: 400963 - RNA, 22 nt, Human
ggauguugauugaauggccauu

SEQ ID NO: 400964 - RNA, 22 nt, Human
gaguccuuuucauagcaguggg

SEQ ID NO: 400965 - RNA, 22 nt, Human
uugaacauuggcaauuucauau

SEQ ID NO: 400966 - RNA, 21 nt, Human
gcaaauguucaggaaaaaaga

SEQ ID NO: 400967 - RNA, 22 nt, Human
cacauuuaauccuuuauaagua

SEQ ID NO: 400968 - RNA, 22 nt, Human
auauacaguuuuacaggguuuc

SEQ ID NO: 400969 - RNA, 22 nt, Human
caaaauugaugaauguaugauu

SEQ ID NO: 400970 - RNA, 22 nt, Human
aaaagccaagguccucuucaga

SEQ ID NO: 400971 - RNA, 22 nt, Human
ugaaaagacugcaagagagcau

SEQ ID NO: 400972 - RNA, 22 nt, Human
uuuacagaauguugaauuuggg

SEQ ID NO: 400973 - RNA, 22 nt, Human
caauuuuuguacuuauaguacu

SEQ ID NO: 400974 - RNA, 22 nt, Human
aaguccuuuaauaucacauagu

SEQ ID NO: 400975 - RNA, 22 nt, Human
ucacaguaucacacaaggauua

SEQ ID NO: 400976 - RNA, 22 nt, Human
uauaaaauucucaguuuggggu

SEQ ID NO: 400977 - RNA, 22 nt, Human
auacaaauuuauagaugcauuu

SEQ ID NO: 400978 - RNA, 22 nt, Human
auuaggcauucugaaugagguc

SEQ ID NO: 400979 - RNA, 22 nt, Human
auaucaaacgaaguuauuuuaa

SEQ ID NO: 400980 - RNA, 22 nt, Human
cugaauaauauuccauuaugag

SEQ ID NO: 400981 - RNA, 22 nt, Human
ucauggauggccgggaggugau

SEQ ID NO: 400982 - RNA, 22 nt, Human
auguuauaguuauaaaaugagg

SEQ ID NO: 400983 - RNA, 21 nt, Human
uucugggaaaugagcuggggc

SEQ ID NO: 400984 - RNA, 22 nt, Human
aucacaaaggucucagagcaca

SEQ ID NO: 400985 - RNA, 22 nt, Human
acagaguucccacuccagaagc

SEQ ID NO: 400986 - RNA, 22 nt, Human
guaaauuauuucaagaucaucu

SEQ ID NO: 400987 - RNA, 22 nt, Human
ucacagaaauaagauaguuauu

SEQ ID NO: 400988 - RNA, 22 nt, Human
aguguuuaccccaaucaguuua

SEQ ID NO: 400989 - RNA, 22 nt, Human
cucagugugaaugcucaguaaa

SEQ ID NO: 400990 - RNA, 22 nt, Human
guggaaugaauagauuugcauu

SEQ ID NO: 400991 - RNA, 22 nt, Human
ucccaguuuuucuccacuaagg

SEQ ID NO: 400992 - RNA, 22 nt, Human
auaaagucuaccguauuaaaga

SEQ ID NO: 400993 - RNA, 22 nt, Human
acauuuuuuagagucccacauu

SEQ ID NO: 400994 - RNA, 22 nt, Human
agccuuguuggucugaguuugg

SEQ ID NO: 400995 - RNA, 22 nt, Human
cuaugacacaggccauuauaua

SEQ ID NO: 400996 - RNA, 22 nt, Human
uuaaauauuuucagcaggguca

SEQ ID NO: 400997 - RNA, 22 nt, Human
cagaccagaaggaagccgacaa

SEQ ID NO: 400998 - RNA, 22 nt, Human
ggcacagagcccagcuuccuag

SEQ ID NO: 400999 - RNA, 22 nt, Human
uagaaauaaaucugcagcuggg

SEQ ID NO: 401000 - RNA, 22 nt, Human
uuuccaaacccagcgagcuaca

SEQ ID NO: 401001 - RNA, 22 nt, Human
aucaggauagugguuaccuggg

SEQ ID NO: 401002 - RNA, 21 nt, Human
agaauaaugguaucauuugcu

SEQ ID NO: 401003 - RNA, 22 nt, Human
cuuugcaaacgauuaccacaug

SEQ ID NO: 401004 - RNA, 22 nt, Human
uucaccacagucucaucuacgc

SEQ ID NO: 401005 - RNA, 22 nt, Human
acuuuaauuaaugaacuguggc

SEQ ID NO: 401006 - RNA, 22 nt, Human
agaggccaugcuagaggccugg

SEQ ID NO: 401007 - RNA, 22 nt, Human
ugcauaauacguuuccuauaac

SEQ ID NO: 401008 - RNA, 22 nt, Human
aucagaauaauuagauuucaga

SEQ ID NO: 401009 - RNA, 22 nt, Human
aaaucucacuguagucaaagug

SEQ ID NO: 401010 - RNA, 22 nt, Human
gauuuucauuugcacucuagaa

SEQ ID NO: 401011 - RNA, 22 nt, Human
auguagagcaguguuguccaau

SEQ ID NO: 401012 - RNA, 22 nt, Human
uguuuuaaagccauugccuuuc

SEQ ID NO: 401013 - RNA, 22 nt, Human
agagacaaugccaaugcacacg

SEQ ID NO: 401014 - RNA, 22 nt, Human
uaucugagaaagaagcaccaga

SEQ ID NO: 401015 - RNA, 22 nt, Human
uggauuuauggagaccgaaagu

SEQ ID NO: 401016 - RNA, 22 nt, Human
uuguccaaaguaacacaucuag

SEQ ID NO: 401017 - RNA, 22 nt, Human
uguccucagauaugucuacucu

SEQ ID NO: 401018 - RNA, 22 nt, Human
uauggaaacuaauucauuuuuc

SEQ ID NO: 401019 - RNA, 22 nt, Human
uauucaaaguaccuucauugcc

SEQ ID NO: 401020 - RNA, 19 nt, Human
cucucacucgccacauccu

SEQ ID NO: 401021 - RNA, 22 nt, Human
uguaacaauuucuuacuauugu

SEQ ID NO: 401022 - RNA, 20 nt, Human
auuuggcaugaaguauugau

SEQ ID NO: 401023 - RNA, 22 nt, Human
gauuuacaaagcucucuagugu

SEQ ID NO: 401024 - RNA, 22 nt, Human
auucuucacauggauaggaucu

SEQ ID NO: 401025 - RNA, 22 nt, Human
uucuuucucaacaugaauguuu

SEQ ID NO: 401026 - RNA, 22 nt, Human
aagcauuuugccacuugaaguu

SEQ ID NO: 401027 - RNA, 22 nt, Human
gagacaggauuuaaccaaagcu

SEQ ID NO: 401028 - RNA, 22 nt, Human
auuaggcauuauggggauaagg

SEQ ID NO: 401029 - RNA, 22 nt, Human
uguacaauagcuauuaucucca

SEQ ID NO: 401030 - RNA, 22 nt, Human
agguauuauuagcaucucuauu

SEQ ID NO: 401031 - RNA, 22 nt, Human
aauggcuucugaagcacacuuu

SEQ ID NO: 401032 - RNA, 22 nt, Human
uucauucuugucuuuguauagu

SEQ ID NO: 401033 - RNA, 22 nt, Human
uaucagaaacucuggggcaggg

SEQ ID NO: 401034 - RNA, 22 nt, Human
ucacacauucuagguauguuga

SEQ ID NO: 401035 - RNA, 19 nt, Human
ugcuuaauuccuaguaggu

SEQ ID NO: 401036 - RNA, 22 nt, Human
agcauaaaggcacuagaaagag

SEQ ID NO: 401037 - RNA, 22 nt, Human
uugaauaguuuuggauagcaua

SEQ ID NO: 401038 - RNA, 21 nt, Human
uuugaaagcuacaucuauagc

SEQ ID NO: 401039 - RNA, 22 nt, Human
acauaauagguaccugaauaau

SEQ ID NO: 401040 - RNA, 22 nt, Human
auaaaacuuggguaugaucccu

SEQ ID NO: 401041 - RNA, 22 nt, Human
agauauaauaauuuacaagugu

SEQ ID NO: 401042 - RNA, 22 nt, Human
auuuaaaugcuuaagaggguuu

SEQ ID NO: 401043 - RNA, 22 nt, Human
gucacuguuuccuauuauauuu

SEQ ID NO: 401044 - RNA, 22 nt, Human
uuugaaagucaaccuuccaguu

SEQ ID NO: 401045 - RNA, 22 nt, Human
ucagaaaauaacuguuaguuug

SEQ ID NO: 401046 - RNA, 22 nt, Human
uugaaagaagaagcugcgaugu

SEQ ID NO: 401047 - RNA, 22 nt, Human
cucuuaguaaugccaugaagca

SEQ ID NO: 401048 - RNA, 22 nt, Human
ccuauacagccucagcugagau

SEQ ID NO: 401049 - RNA, 22 nt, Human
uuauccaagcagaagcugcaca

SEQ ID NO: 401050 - RNA, 22 nt, Human
uaucuaaauggaauauuccaga

SEQ ID NO: 401051 - RNA, 22 nt, Human
auacuagacuguucuguuauca

SEQ ID NO: 401052 - RNA, 22 nt, Human
caaaagucuguccuuuaacuuc

SEQ ID NO: 401053 - RNA, 21 nt, Human
auuucagagcacacaaguaaa

SEQ ID NO: 401054 - RNA, 22 nt, Human
cagaauggcuuuuauggcucag

SEQ ID NO: 401055 - RNA, 22 nt, Human
uauuuccaccuauuauuuucug

SEQ ID NO: 401056 - RNA, 22 nt, Human
uucaaacaguguagaauauaug

SEQ ID NO: 401057 - RNA, 18 nt, Human
aaguccuuccuuugcuuu

SEQ ID NO: 401058 - RNA, 22 nt, Human
cuuaggcagacugcugaugcag

SEQ ID NO: 401059 - RNA, 22 nt, Human
acaaaauuuuuagacaaggcuu

SEQ ID NO: 401060 - RNA, 22 nt, Human
uguggaaaagaauaagggagau

SEQ ID NO: 401061 - RNA, 22 nt, Human
ggauuuccucuugacucuaaag

SEQ ID NO: 401062 - RNA, 22 nt, Human
guuaauauuuaccugucaagaa

SEQ ID NO: 401063 - RNA, 22 nt, Human
auuaaauuagcaaacugugaaa

SEQ ID NO: 401064 - RNA, 22 nt, Human
cuuugcaaacugucacacuuuc

SEQ ID NO: 401065 - RNA, 22 nt, Human
ucacaaauagcuauauuaagga

SEQ ID NO: 401066 - RNA, 22 nt, Human
uuagccauuaaauuacaaggug

SEQ ID NO: 401067 - RNA, 22 nt, Human
gaucagaaugggacauauccug

SEQ ID NO: 401068 - RNA, 22 nt, Human
gaauuucagggucugguaggaa

SEQ ID NO: 401069 - RNA, 22 nt, Human
uucagaaaucgaguuucauguc

SEQ ID NO: 401070 - RNA, 22 nt, Human
auuauucaacacuugagaaauu

SEQ ID NO: 401071 - RNA, 22 nt, Human
auccauuugaaagaacagucca

SEQ ID NO: 401072 - RNA, 22 nt, Human
uacacacagaggccaugggauu

SEQ ID NO: 401073 - RNA, 22 nt, Human
caacuuuucugugaauuuaagu

SEQ ID NO: 401074 - RNA, 22 nt, Human
caaugaaauugagauccagaga

SEQ ID NO: 401075 - RNA, 21 nt, Human
uucaauacuauuucaauaguc

SEQ ID NO: 401076 - RNA, 22 nt, Human
auggagacgcaagggaccuagg

SEQ ID NO: 401077 - RNA, 22 nt, Human
uuuuuugucuugaagaaauggu

SEQ ID NO: 401078 - RNA, 21 nt, Human
caaagccaggcaacucucucc

SEQ ID NO: 401079 - RNA, 22 nt, Human
uuugaaagaauuuauguacuuu

SEQ ID NO: 401080 - RNA, 22 nt, Human
aacauacauauuucagugucca

SEQ ID NO: 401081 - RNA, 22 nt, Human
cauuuguuggucagauuguagu

SEQ ID NO: 401082 - RNA, 22 nt, Human
acuucuucuucagcugggggau

SEQ ID NO: 401083 - RNA, 22 nt, Human
cagaaacauguauaaaguugua

SEQ ID NO: 401084 - RNA, 22 nt, Human
uuucacacaacgugaauauacu

SEQ ID NO: 401085 - RNA, 22 nt, Human
aguucuucauaaccuuacugug

SEQ ID NO: 401086 - RNA, 22 nt, Human
uucuucuucuggcugcaccugg

SEQ ID NO: 401087 - RNA, 22 nt, Human
uaacacaaaagaauaugugugu

SEQ ID NO: 401088 - RNA, 22 nt, Human
guugaaagagcauggacuugaa

SEQ ID NO: 401089 - RNA, 22 nt, Human
uuugaaaguucuucugacacua

SEQ ID NO: 401090 - RNA, 22 nt, Human
gauuucaagcccccagagauuc

SEQ ID NO: 401091 - RNA, 22 nt, Human
auuccaaacuuaccccagagga

SEQ ID NO: 401092 - RNA, 22 nt, Human
aacauauaaacucuuaaguuca

SEQ ID NO: 401093 - RNA, 22 nt, Human
ucagucucuggggcuucuguuu

SEQ ID NO: 401094 - RNA, 22 nt, Human
uguauaaauuuaaauuccugcu

SEQ ID NO: 401095 - RNA, 22 nt, Human
ucaauucaauugaacaguuacu

SEQ ID NO: 401096 - RNA, 22 nt, Human
aauacugagaucccacaaagca

SEQ ID NO: 401097 - RNA, 22 nt, Human
uaugaagaaaccuauccucuag

SEQ ID NO: 401098 - RNA, 22 nt, Human
uucauacuguguuuccaaguuu

SEQ ID NO: 401099 - RNA, 22 nt, Human
gaaggccacaagagaaguuaag

SEQ ID NO: 401100 - RNA, 22 nt, Human
gucauauacacugcauguaauc

SEQ ID NO: 401101 - RNA, 22 nt, Human
acacaagauuguguauugaauu

SEQ ID NO: 401102 - RNA, 22 nt, Human
gcagagcuccccaagacaccaa

SEQ ID NO: 401103 - RNA, 22 nt, Human
gcuggauccugauucgucuuug

SEQ ID NO: 401104 - RNA, 22 nt, Human
agucucugggcaugguugugac

SEQ ID NO: 401105 - RNA, 22 nt, Human
ucucucagaggaagaggcagug

SEQ ID NO: 401106 - RNA, 23 nt, Human
agaauuccaguuucuuaugucac

SEQ ID NO: 401107 - RNA, 22 nt, Human
acauaauaccuaggacaguuug

SEQ ID NO: 401108 - RNA, 22 nt, Human
aggcuggagggcaauggcaaga

SEQ ID NO: 401109 - RNA, 22 nt, Human
auggguuucccucugaaauuau

SEQ ID NO: 401110 - RNA, 22 nt, Human
uuuccagagcaugucugcucag

SEQ ID NO: 401111 - RNA, 22 nt, Human
ugcuggaauaauuucauguuaa

SEQ ID NO: 401112 - RNA, 22 nt, Human
uucuucuuuccuauaauuaauu

SEQ ID NO: 401113 - RNA, 22 nt, Human
acauuucuaguuguucaucucc

SEQ ID NO: 401114 - RNA, 22 nt, Human
agcauccaacaggagggaaggg

SEQ ID NO: 401115 - RNA, 22 nt, Human
cccaugagguggagguugcagu

SEQ ID NO: 401116 - RNA, 20 nt, Human
ucacaucuggcagcugauga

SEQ ID NO: 401117 - RNA, 22 nt, Human
cuuaaagaaauugaggagagga

SEQ ID NO: 401118 - RNA, 22 nt, Human
cagucaccauagaauaaaacau

SEQ ID NO: 401119 - RNA, 22 nt, Human
aauaaugucuuuggcuugacca

SEQ ID NO: 401120 - RNA, 22 nt, Human
cauuucaaaagaauugccagaa

SEQ ID NO: 401121 - RNA, 22 nt, Human
ucuucuucccaucccucaaaug

SEQ ID NO: 401122 - RNA, 22 nt, Human
gaugggauuuuuuauguguuca

SEQ ID NO: 401123 - RNA, 22 nt, Human
uuggaauucaaguuguagcuua

SEQ ID NO: 401124 - RNA, 22 nt, Human
aaugguuugauggacaaaauga

SEQ ID NO: 401125 - RNA, 22 nt, Human
acaauuccacauggcaugcagg

SEQ ID NO: 401126 - RNA, 22 nt, Human
gugugaaaguuccuaagacuau

SEQ ID NO: 401127 - RNA, 22 nt, Human
uggauuuauuagguuggugaaa

SEQ ID NO: 401128 - RNA, 22 nt, Human
uucagaaagguaaauggauuuc

SEQ ID NO: 401129 - RNA, 22 nt, Human
gucauucuuaacaacucaguag

SEQ ID NO: 401130 - RNA, 22 nt, Human
ugaaacaagauccacagacuug

SEQ ID NO: 401131 - RNA, 23 nt, Human
auguauuuaaauuucagugauga

SEQ ID NO: 401132 - RNA, 21 nt, Human
accaaaaccuauacuuucugu

SEQ ID NO: 401133 - RNA, 23 nt, Human
ggagugcaauggcgccaucucgg

SEQ ID NO: 401134 - RNA, 22 nt, Human
acuauacaagauuagggauuug

SEQ ID NO: 401135 - RNA, 22 nt, Human
augcuuaagcucaguuauauau

SEQ ID NO: 401136 - RNA, 22 nt, Human
caguaaauacauaucagagaag

SEQ ID NO: 401137 - RNA, 22 nt, Human
agacccagaaagcagcugcauu

SEQ ID NO: 401138 - RNA, 22 nt, Human
caauuucagaccuuuccuugga

SEQ ID NO: 401139 - RNA, 22 nt, Human
ucagaauuagagcucuucuuga

SEQ ID NO: 401140 - RNA, 22 nt, Human
uacugccuggagcauuggugcu

SEQ ID NO: 401141 - RNA, 23 nt, Human
ugaguucucaucuuggcuucuau

SEQ ID NO: 401142 - RNA, 22 nt, Human
cauacuuucuuuuucacgcaua

SEQ ID NO: 401143 - RNA, 20 nt, Human
uacagacaugacaauaaugg

SEQ ID NO: 401144 - RNA, 22 nt, Human
cucauacauaugccauuccugc

SEQ ID NO: 401145 - RNA, 22 nt, Human
accgaaggaaacuggaaccguu

SEQ ID NO: 401146 - RNA, 22 nt, Human
guaugaaaauuguaaaguucuu

SEQ ID NO: 401147 - RNA, 22 nt, Human
uauggaaaaauguaucuuguca

SEQ ID NO: 401148 - RNA, 22 nt, Human
aauauaauuuuauuccuagagu

SEQ ID NO: 401149 - RNA, 22 nt, Human
aaauguuucuacuugugagcau

SEQ ID NO: 401150 - RNA, 22 nt, Human
uauuuguugaguuguuaugucu

SEQ ID NO: 401151 - RNA, 23 nt, Human
aagucaccaagaggaaggcggag

SEQ ID NO: 401152 - RNA, 22 nt, Human
aaauacuagaauucagaguuga

SEQ ID NO: 401153 - RNA, 22 nt, Human
ugcaggaaaaccaacacgccuu

SEQ ID NO: 401154 - RNA, 22 nt, Human
cagagcucuauguucauggagg

SEQ ID NO: 401155 - RNA, 22 nt, Human
aagguucuaagggaagccaugc

SEQ ID NO: 401156 - RNA, 22 nt, Human
ggugaguugggguucacagguc

SEQ ID NO: 401157 - RNA, 22 nt, Human
cagauuucagcucauauauuau

SEQ ID NO: 401158 - RNA, 22 nt, Human
gucuccugagccuugacugcaa

SEQ ID NO: 401159 - RNA, 22 nt, Human
auacauacauguaugcacauac

SEQ ID NO: 401160 - RNA, 22 nt, Human
caucagaaggccagaggguagc

SEQ ID NO: 401161 - RNA, 22 nt, Human
uauuaucauuaacuguugaauu

SEQ ID NO: 401162 - RNA, 22 nt, Human
cugguacaaaaugcugauauca

SEQ ID NO: 401163 - RNA, 22 nt, Human
guagaaauuccauuuacuuuga

SEQ ID NO: 401164 - RNA, 22 nt, Human
aaacagacugcacugccaguca

SEQ ID NO: 401165 - RNA, 22 nt, Human
gcucaggaaaacagucuaguaa

SEQ ID NO: 401166 - RNA, 22 nt, Human
aauaacagauuuucaagcugug

SEQ ID NO: 401167 - RNA, 22 nt, Human
uuacaguuuaguccaagccaga

SEQ ID NO: 401168 - RNA, 22 nt, Human
auuacaguaacagcuacaaugc

SEQ ID NO: 401169 - RNA, 20 nt, Human
accaauguuagcuuaguacu

SEQ ID NO: 401170 - RNA, 21 nt, Human
uuuaaagaauaggaagggagg

SEQ ID NO: 401171 - RNA, 22 nt, Human
uugcugaauugaauccuuuggu

SEQ ID NO: 401172 - RNA, 21 nt, Human
aaaguguucagaccaguucug

SEQ ID NO: 401173 - RNA, 22 nt, Human
cuaacuuuagcuuagauuauca

SEQ ID NO: 401174 - RNA, 22 nt, Human
guaguucugcagugucaccuga

SEQ ID NO: 401175 - RNA, 22 nt, Human
uuucaguucaguuuauuauauc

SEQ ID NO: 401176 - RNA, 23 nt, Human
acacauuuuucccguucugaggu

SEQ ID NO: 401177 - RNA, 22 nt, Human
ccaugagcuuccuauauagggu

SEQ ID NO: 401178 - RNA, 22 nt, Human
gcuagaucucucauaaauucca

SEQ ID NO: 401179 - RNA, 22 nt, Human
aaagccuuugucucaggcucug

SEQ ID NO: 401180 - RNA, 22 nt, Human
ucagucucaucaacucuauucc

SEQ ID NO: 401181 - RNA, 22 nt, Human
uaugcuguggaaaauacaaaga

SEQ ID NO: 401182 - RNA, 22 nt, Human
uucuaugccauguucagcuacu

SEQ ID NO: 401183 - RNA, 22 nt, Human
aaagucauuuuccagaccagua

SEQ ID NO: 401184 - RNA, 22 nt, Human
uugauuaaacaggcauauucaa

SEQ ID NO: 401185 - RNA, 22 nt, Human
uaaggccaggcuguggucggca

SEQ ID NO: 401186 - RNA, 22 nt, Human
ucuucagauaaagggagaguau

SEQ ID NO: 401187 - RNA, 22 nt, Human
ugauuuuuagcuauucugaaga

SEQ ID NO: 401188 - RNA, 22 nt, Human
aguuugaaauguuggcaauauu

SEQ ID NO: 401189 - RNA, 22 nt, Human
cuggcuugcagcucaucauaaa

SEQ ID NO: 401190 - RNA, 22 nt, Human
aguaaacauagaauguucuucc

SEQ ID NO: 401191 - RNA, 22 nt, Human
aaucuuucccuauuaaaugugg

SEQ ID NO: 401192 - RNA, 22 nt, Human
uauggaaauaauuagacaagug

SEQ ID NO: 401193 - RNA, 22 nt, Human
cucuaacacuguaaugcuuucu

SEQ ID NO: 401194 - RNA, 22 nt, Human
gagccaaggguugccauggaga

SEQ ID NO: 401195 - RNA, 22 nt, Human
ucugggaacugagcuccccuag

SEQ ID NO: 401196 - RNA, 22 nt, Human
uccuuaauucugugcaauaugu

SEQ ID NO: 401197 - RNA, 21 nt, Human
cucuugugucagagccagagg

SEQ ID NO: 401198 - RNA, 22 nt, Human
ucucgacagccuggcacagugg

SEQ ID NO: 401199 - RNA, 22 nt, Human
ucaguucugcuagaaaaacagu

SEQ ID NO: 401200 - RNA, 22 nt, Human
gucaggauuuacaaacuucagu

SEQ ID NO: 401201 - RNA, 20 nt, Human
uacagaaugcaauaaaaugg

SEQ ID NO: 401202 - RNA, 22 nt, Human
acaugcuuugcacuuacaucau

SEQ ID NO: 401203 - RNA, 22 nt, Human
gcagagacuaguagugcagacu

SEQ ID NO: 401204 - RNA, 22 nt, Human
aguauugugacucaaguauucu

SEQ ID NO: 401205 - RNA, 22 nt, Human
augaacaauaaaauagaucaca

SEQ ID NO: 401206 - RNA, 22 nt, Human
ucauaaaguucuaagaauugua

SEQ ID NO: 401207 - RNA, 22 nt, Human
aguguuuagcaugaaguucauu

SEQ ID NO: 401208 - RNA, 22 nt, Human
aaagcagucacuccagugugau

SEQ ID NO: 401209 - RNA, 22 nt, Human
cguccuuacagagggucacagc

SEQ ID NO: 401210 - RNA, 22 nt, Human
aaaacuguaucuucuugggacu

SEQ ID NO: 401211 - RNA, 22 nt, Human
aauaucaguauauuguaucagu

SEQ ID NO: 401212 - RNA, 22 nt, Human
uuaggaaacgcugcuauugacu

SEQ ID NO: 401213 - RNA, 22 nt, Human
uggugguuaugcgcuuuguggg

SEQ ID NO: 401214 - RNA, 22 nt, Human
uucuuaauaccuauuuucuacc

SEQ ID NO: 401215 - RNA, 20 nt, Human
uggcaucucucaauuguagg

SEQ ID NO: 401216 - RNA, 22 nt, Human
uaauuguagcuuuguaaucagc

SEQ ID NO: 401217 - RNA, 22 nt, Human
caagauggagaagcagcaaggg

SEQ ID NO: 401218 - RNA, 22 nt, Human
acagaauucuaguauguggcuu

SEQ ID NO: 401219 - RNA, 22 nt, Human
uuauuccauucaguucaacaag

SEQ ID NO: 401220 - RNA, 20 nt, Human
agaagucagcucagaaguga

SEQ ID NO: 401221 - RNA, 22 nt, Human
ucaacuuuaguguagcuauuua

SEQ ID NO: 401222 - RNA, 22 nt, Human
auacuguuuugugacuuaucuu

SEQ ID NO: 401223 - RNA, 22 nt, Human
uagauauaagguccuuagaaca

SEQ ID NO: 401224 - RNA, 22 nt, Human
ucccugggcuucuccagacuug

SEQ ID NO: 401225 - RNA, 23 nt, Human
ucuugaaaagccuacagcaguuc

SEQ ID NO: 401226 - RNA, 22 nt, Human
caaaugauaccuauuacuaggc

SEQ ID NO: 401227 - RNA, 22 nt, Human
ucugaaagaagggcagucuuuu

SEQ ID NO: 401228 - RNA, 22 nt, Human
uauugaugcuuggauugggcca

SEQ ID NO: 401229 - RNA, 22 nt, Human
acuuugaaucucagauaaccaa

SEQ ID NO: 401230 - RNA, 22 nt, Human
uauauacuuucuuccuggguag

SEQ ID NO: 401231 - RNA, 22 nt, Human
aaauuaguacauugcaaagucc

SEQ ID NO: 401232 - RNA, 22 nt, Human
uuauaagaguauauaguguacu

SEQ ID NO: 401233 - RNA, 22 nt, Human
uguccuuaaggagcuuaauguc

SEQ ID NO: 401234 - RNA, 22 nt, Human
uuugaagacauauuguuacaua

SEQ ID NO: 401235 - RNA, 22 nt, Human
auaaaaguaggaccaacuuaca

SEQ ID NO: 401236 - RNA, 22 nt, Human
uucuucuuucccccugugguac

SEQ ID NO: 401237 - RNA, 22 nt, Human
cuuauaaaguccaucugaacaa

SEQ ID NO: 401238 - RNA, 22 nt, Human
cagagccacuuggagaugagaa

SEQ ID NO: 401239 - RNA, 22 nt, Human
auguggaggaaaugaguguaca

SEQ ID NO: 401240 - RNA, 21 nt, Human
aggauuuacuauuaacugugu

SEQ ID NO: 401241 - RNA, 22 nt, Human
acaagauaaggugucagugugu

SEQ ID NO: 401242 - RNA, 22 nt, Human
aagucacccuagggccuggacu

SEQ ID NO: 401243 - RNA, 22 nt, Human
uaaaaugaucucucauguucuu

SEQ ID NO: 401244 - RNA, 22 nt, Human
ugaaagguuaaaaguaguauug

SEQ ID NO: 401245 - RNA, 22 nt, Human
uggcuuaagcgcaacucugucu

SEQ ID NO: 401246 - RNA, 22 nt, Human
auugaaaguccuaucuaaggga

SEQ ID NO: 401247 - RNA, 20 nt, Human
uugagcuuuuaguacagaca

SEQ ID NO: 401248 - RNA, 22 nt, Human
acagaauuuaaagcucuagacu

SEQ ID NO: 401249 - RNA, 22 nt, Human
auuuagcaaaaaaugaugaagc

SEQ ID NO: 401250 - RNA, 22 nt, Human
gaauuucaaaagccagaacggg

SEQ ID NO: 401251 - RNA, 22 nt, Human
cuucuuaaucccuuauauauuu

SEQ ID NO: 401252 - RNA, 22 nt, Human
gcaacuuuagaaaaaucuauaa

SEQ ID NO: 401253 - RNA, 22 nt, Human
ucacaucaacauuauagcauga

SEQ ID NO: 401254 - RNA, 22 nt, Human
acaucugaccauuacaagacau

SEQ ID NO: 401255 - RNA, 22 nt, Human
auuaguaaaacauuguauaugu

SEQ ID NO: 401256 - RNA, 21 nt, Human
aaauacagaugcaaaucuguu

SEQ ID NO: 401257 - RNA, 22 nt, Human
ucuucagacccuuagcugugau

SEQ ID NO: 401258 - RNA, 23 nt, Human
aaggccagaauuucaauggugcc

SEQ ID NO: 401259 - RNA, 22 nt, Human
uuacagaaguauugagagaucc

SEQ ID NO: 401260 - RNA, 22 nt, Human
cauucucaauaguagaugagua

SEQ ID NO: 401261 - RNA, 18 nt, Human
agucuucugauccauuuu

SEQ ID NO: 401262 - RNA, 19 nt, Human
ucauuguugguuugucggg

SEQ ID NO: 401263 - RNA, 19 nt, Human
aaaauugcguauuuugagg

SEQ ID NO: 401264 - RNA, 22 nt, Human
uuaacaugucuugacuucaucu

SEQ ID NO: 401265 - RNA, 22 nt, Human
cugcagagaccuaggucagguu

SEQ ID NO: 401266 - RNA, 22 nt, Human
ccaggcugggcuacaaguugag

SEQ ID NO: 401267 - RNA, 22 nt, Human
cugaggaagacagcagcugugu

SEQ ID NO: 401268 - RNA, 21 nt, Human
ucauucacaggguauuguaua

SEQ ID NO: 401269 - RNA, 22 nt, Human
uuucuaggucuuccauacugcc

SEQ ID NO: 401270 - RNA, 22 nt, Human
gcuucacacuaaaaauguuaaa

SEQ ID NO: 401271 - RNA, 22 nt, Human
caaauucaaugaacauguuuaa

SEQ ID NO: 401272 - RNA, 22 nt, Human
ccaguacugucuccaauauucc

SEQ ID NO: 401273 - RNA, 22 nt, Human
gauuuauaguaugugcuuucag

SEQ ID NO: 401274 - RNA, 22 nt, Human
cuguggaaauaaacaaugcuaa

SEQ ID NO: 401275 - RNA, 22 nt, Human
aaagucauccaaauuuuuaugu

SEQ ID NO: 401276 - RNA, 22 nt, Human
cuaaaauuaucaagauaauucc

SEQ ID NO: 401277 - RNA, 22 nt, Human
agaagucauuuauguuagauga

SEQ ID NO: 401278 - RNA, 22 nt, Human
auuauucaaucauauuaaaagu

SEQ ID NO: 401279 - RNA, 22 nt, Human
uuugaagugcaaugaggauucu

SEQ ID NO: 401280 - RNA, 22 nt, Human
gauaaaauauguggccuuuagu

SEQ ID NO: 401281 - RNA, 22 nt, Human
aucuagaacuuaaagucaguca

SEQ ID NO: 401282 - RNA, 22 nt, Human
uuugaauagcauaggauuacau

SEQ ID NO: 401283 - RNA, 22 nt, Human
uuuauuaugauggacaccuucg

SEQ ID NO: 401284 - RNA, 22 nt, Human
gucuucuuguguugccugucuu

SEQ ID NO: 401285 - RNA, 22 nt, Human
aaggcagucugguuucaaagca

SEQ ID NO: 401286 - RNA, 22 nt, Human
uacagaaaaacuggcauugaag

SEQ ID NO: 401287 - RNA, 20 nt, Human
acaauacagguugugucuga

SEQ ID NO: 401288 - RNA, 22 nt, Human
augaaaacggaccagagcuauu

SEQ ID NO: 401289 - RNA, 22 nt, Human
gcuucacaggcaaguuaagccu

SEQ ID NO: 401290 - RNA, 22 nt, Human
aaucagaaauucuacaucacaa

SEQ ID NO: 401291 - RNA, 22 nt, Human
aucauucuagcuguuguguuga

SEQ ID NO: 401292 - RNA, 22 nt, Human
ucacauucucagcaucuauaca

SEQ ID NO: 401293 - RNA, 22 nt, Human
aggauuuacaaugauucuaggu

SEQ ID NO: 401294 - RNA, 22 nt, Human
ucuuaauugagaacaguguagg

SEQ ID NO: 401295 - RNA, 22 nt, Human
gagauuuagagagacuuaaaca

SEQ ID NO: 401296 - RNA, 22 nt, Human
ucugaaggugcuagagaaagcu

SEQ ID NO: 401297 - RNA, 22 nt, Human
uuauucuuuaaacauauauguu

SEQ ID NO: 401298 - RNA, 22 nt, Human
agcauuuauuucuuagaaauug

SEQ ID NO: 401299 - RNA, 22 nt, Human
agauuuacugagaacugauuac

SEQ ID NO: 401300 - RNA, 22 nt, Human
uuacuacugcuuuacuacuggg

SEQ ID NO: 401301 - RNA, 22 nt, Human
uaaauacagucauuugagccau

SEQ ID NO: 401302 - RNA, 22 nt, Human
cagcuucugucugauuagcaag

SEQ ID NO: 401303 - RNA, 22 nt, Human
aguggcagagccaaguagagcc

SEQ ID NO: 401304 - RNA, 22 nt, Human
gauaaaauucuuauuuuacccg

SEQ ID NO: 401305 - RNA, 22 nt, Human
aauguauuccucaugcaagagu

SEQ ID NO: 401306 - RNA, 22 nt, Human
caguccuugcucaaagucuaca

SEQ ID NO: 401307 - RNA, 22 nt, Human
aacagacaacuccuguggcuca

SEQ ID NO: 401308 - RNA, 22 nt, Human
ugaguucucacccauucuucuu

SEQ ID NO: 401309 - RNA, 22 nt, Human
gcagaagucagaccaucugaau

SEQ ID NO: 401310 - RNA, 22 nt, Human
uuaauauguugaaauuuauuag

SEQ ID NO: 401311 - RNA, 22 nt, Human
ucuacugugguccuuguaacca

SEQ ID NO: 401312 - RNA, 22 nt, Human
uucuucuucauuucugacgaug

SEQ ID NO: 401313 - RNA, 22 nt, Human
acagucauuagauacaaugucu

SEQ ID NO: 401314 - RNA, 22 nt, Human
uuucacauuagauaugucauuu

SEQ ID NO: 401315 - RNA, 22 nt, Human
uaguccuuuccggcugcuauaa

SEQ ID NO: 401316 - RNA, 22 nt, Human
uccuuguugcugcagucaccug

SEQ ID NO: 401317 - RNA, 22 nt, Human
ccagaucuucuuuucagugucu

SEQ ID NO: 401318 - RNA, 23 nt, Human
uuccacaaugaaaauaaagcagg

SEQ ID NO: 401319 - RNA, 22 nt, Human
cuuuccaagaaugcagauaccu

SEQ ID NO: 401320 - RNA, 22 nt, Human
uacaaaaaauugauacugacga

SEQ ID NO: 401321 - RNA, 22 nt, Human
ccaaacaaauccccauucuuag

SEQ ID NO: 401322 - RNA, 22 nt, Human
aucugacuucacgcccaugcca

SEQ ID NO: 401323 - RNA, 21 nt, Human
gcuauacagaauggccagagg

SEQ ID NO: 401324 - RNA, 20 nt, Human
gaaguccuguuauauccuuu

SEQ ID NO: 401325 - RNA, 22 nt, Human
uucaggauccccuugaugggcu

SEQ ID NO: 401326 - RNA, 22 nt, Human
cucccagagaccaagcugagaa

SEQ ID NO: 401327 - RNA, 22 nt, Human
caaagucauggggaugcagguc

SEQ ID NO: 401328 - RNA, 23 nt, Human
caguggagacucaugcuuccuua

SEQ ID NO: 401329 - RNA, 20 nt, Human
ugugaaagcaguagaaugac

SEQ ID NO: 401330 - RNA, 22 nt, Human
uauaucauggagauuaacauuc

SEQ ID NO: 401331 - RNA, 22 nt, Human
uucuucaugcuguugcugcuug

SEQ ID NO: 401332 - RNA, 22 nt, Human
ccacuucaucagugcuccauuu

SEQ ID NO: 401333 - RNA, 22 nt, Human
aaucccagcuacucaggaaguu

SEQ ID NO: 401334 - RNA, 22 nt, Human
aauaacuggcacauaucacaua

SEQ ID NO: 401335 - RNA, 22 nt, Human
uucuuaaucuguguggguucga

SEQ ID NO: 401336 - RNA, 23 nt, Human
aucaaaggauguagagaagaagc

SEQ ID NO: 401337 - RNA, 21 nt, Human
uuugaaagcccuauguuuuca

SEQ ID NO: 401338 - RNA, 22 nt, Human
uauaacaggaaguauucaaaca

SEQ ID NO: 401339 - RNA, 22 nt, Human
gaucuucuagcagaaguaauuu

SEQ ID NO: 401340 - RNA, 22 nt, Human
caucagaaaccuugaggaaacu

SEQ ID NO: 401341 - RNA, 22 nt, Human
caucagaagauggcucuggaaa

SEQ ID NO: 401342 - RNA, 22 nt, Human
aucacaaaggguuuucucugag

SEQ ID NO: 401343 - RNA, 22 nt, Human
auuauaaagaacaugugugugg

SEQ ID NO: 401344 - RNA, 22 nt, Human
uauggcuuuucauuccuaugug

SEQ ID NO: 401345 - RNA, 22 nt, Human
uuauuauagauuaugcaagauu

SEQ ID NO: 401346 - RNA, 22 nt, Human
acauaccauacauggugagaug

SEQ ID NO: 401347 - RNA, 22 nt, Human
gaauacaugauacaugaacugc

SEQ ID NO: 401348 - RNA, 19 nt, Human
guuaggcaggguggggagu

SEQ ID NO: 401349 - RNA, 22 nt, Human
aaugaaauguagcuuauccaua

SEQ ID NO: 401350 - RNA, 22 nt, Human
ucauuugugugagugauuugac

SEQ ID NO: 401351 - RNA, 22 nt, Human
cauuuacacacagaggugugcu

SEQ ID NO: 401352 - RNA, 22 nt, Human
cagaaagcuuaggcaaguugga

SEQ ID NO: 401353 - RNA, 21 nt, Human
uaaggccaagucuauuucugu

SEQ ID NO: 401354 - RNA, 22 nt, Human
aagccaaugagagaggccucag

SEQ ID NO: 401355 - RNA, 22 nt, Human
ggaucugagagcaagcaggacc

SEQ ID NO: 401356 - RNA, 22 nt, Human
caggauggagaguuguugguug

SEQ ID NO: 401357 - RNA, 22 nt, Human
aaagccagguugugugcaggaa

SEQ ID NO: 401358 - RNA, 22 nt, Human
caagauggguguugugaugguu

SEQ ID NO: 401359 - RNA, 15 nt, Human
aaucagaaguguggc

SEQ ID NO: 401360 - RNA, 22 nt, Human
uucacagucacccuucuccaug

SEQ ID NO: 401361 - RNA, 22 nt, Human
uuccuuagaguuuccagaaagc

SEQ ID NO: 401362 - RNA, 22 nt, Human
aaacauguuuucugaauauuuu

SEQ ID NO: 401363 - RNA, 22 nt, Human
guucuucaggccauccucccag

SEQ ID NO: 401364 - RNA, 22 nt, Human
auggcuuaagaaugcuuuugug

SEQ ID NO: 401365 - RNA, 22 nt, Human
uguucacaucgauggauuuugc

SEQ ID NO: 401366 - RNA, 22 nt, Human
aucaggauuacacggggaugcu

SEQ ID NO: 401367 - RNA, 22 nt, Human
aguuauaaucugcuacugauau

SEQ ID NO: 401368 - RNA, 21 nt, Human
ccaagacucccaucuaguggu

SEQ ID NO: 401369 - RNA, 22 nt, Human
ccucaugguacuuacuguagcu

SEQ ID NO: 401370 - RNA, 22 nt, Human
uguaaauaauuccuaggcuuuu

SEQ ID NO: 401371 - RNA, 22 nt, Human
uggaaugacagagagucugaau

SEQ ID NO: 401372 - RNA, 22 nt, Human
auuccaaaaggauguuagaaug

SEQ ID NO: 401373 - RNA, 22 nt, Human
cauaaaauggcuuguucuuuaa

SEQ ID NO: 401374 - RNA, 20 nt, Human
ugaaggccagcagcauaggg

SEQ ID NO: 401375 - RNA, 22 nt, Human
augugcuucauucuacaugaca

SEQ ID NO: 401376 - RNA, 22 nt, Human
uuuuuauaacucuuuugugaca

SEQ ID NO: 401377 - RNA, 22 nt, Human
uccaugagaacccuuggagaua

SEQ ID NO: 401378 - RNA, 22 nt, Human
aauuucaaacuaauaggaacca

SEQ ID NO: 401379 - RNA, 22 nt, Human
augcuuaacuuccuagucuaua

SEQ ID NO: 401380 - RNA, 22 nt, Human
guugacagcuggugagcugcua

SEQ ID NO: 401381 - RNA, 22 nt, Human
uucaugugauaaaugugugacu

SEQ ID NO: 401382 - RNA, 22 nt, Human
ucaggaauccagacagggcaca

SEQ ID NO: 401383 - RNA, 22 nt, Human
uaaagccaauauaccuagcaua

SEQ ID NO: 401384 - RNA, 22 nt, Human
aucaggauguuuggcugucaua

SEQ ID NO: 401385 - RNA, 22 nt, Human
caguccagcccccugcuaaaag

SEQ ID NO: 401386 - RNA, 23 nt, Human
cccauuuucauguuaacuccugg

SEQ ID NO: 401387 - RNA, 22 nt, Human
uugacacaguuuucucauuaag

SEQ ID NO: 401388 - RNA, 22 nt, Human
cagaugaggcaaccucauugcu

SEQ ID NO: 401389 - RNA, 22 nt, Human
caguaaauuaucucaucucugu

SEQ ID NO: 401390 - RNA, 22 nt, Human
caguccuuggcaaguucucagu

SEQ ID NO: 401391 - RNA, 21 nt, Human
uucuucaguuuaauauaaaau

SEQ ID NO: 401392 - RNA, 22 nt, Human
uucuuuuccuacacagcgauuu

SEQ ID NO: 401393 - RNA, 22 nt, Human
auacagaagaccccuccgucau

SEQ ID NO: 401394 - RNA, 22 nt, Human
agaauaucguagcauauuaucu

SEQ ID NO: 401395 - RNA, 22 nt, Human
aaucauaauuguauacauucau

SEQ ID NO: 401396 - RNA, 18 nt, Human
ugcuuggagcauuuacca

SEQ ID NO: 401397 - RNA, 22 nt, Human
uaagaaucuauuaggaauaugu

SEQ ID NO: 401398 - RNA, 22 nt, Human
gaccauuuguugaaaagauuau

SEQ ID NO: 401399 - RNA, 20 nt, Human
uauggcuuggcaaagcuuca

SEQ ID NO: 401400 - RNA, 22 nt, Human
uuucaaaauuuugcagugguaa

SEQ ID NO: 401401 - RNA, 23 nt, Human
ucucuuucaagagcuuaaugugc

SEQ ID NO: 401402 - RNA, 22 nt, Human
uuucaaaguugggaauuguaau

SEQ ID NO: 401403 - RNA, 22 nt, Human
aguacaaugucugacacaguag

SEQ ID NO: 401404 - RNA, 22 nt, Human
guuaggcaaauaacuguggagc

SEQ ID NO: 401405 - RNA, 22 nt, Human
auuucacaaaccauccugauuu

SEQ ID NO: 401406 - RNA, 22 nt, Human
ucuacuguagugaugcugcagu

SEQ ID NO: 401407 - RNA, 22 nt, Human
uaaauaucaccuggaauuguua

SEQ ID NO: 401408 - RNA, 22 nt, Human
gauuuacagguuagguccugua

SEQ ID NO: 401409 - RNA, 22 nt, Human
aacaaacaaacauuuugucauc

SEQ ID NO: 401410 - RNA, 22 nt, Human
caaggccacguucugcaugcgg

SEQ ID NO: 401411 - RNA, 22 nt, Human
aucugccuggcuccaggugagc

SEQ ID NO: 401412 - RNA, 22 nt, Human
uguuuauaccugcaaccuguca

SEQ ID NO: 401413 - RNA, 22 nt, Human
uucagagaagcaaaggcagauu

SEQ ID NO: 401414 - RNA, 18 nt, Human
caauuucauccuuaagcc

SEQ ID NO: 401415 - RNA, 22 nt, Human
uguuuauaccuugguauaacca

SEQ ID NO: 401416 - RNA, 22 nt, Human
ggaggccagggacccagucagc

SEQ ID NO: 401417 - RNA, 17 nt, Human
uuugaaaggaugucagu

SEQ ID NO: 401418 - RNA, 22 nt, Human
aaauuauaggugccaccuugga

SEQ ID NO: 401419 - RNA, 20 nt, Human
uuucacagucccuguuuccu

SEQ ID NO: 401420 - RNA, 18 nt, Human
guaggucaguaccaagca

SEQ ID NO: 401421 - RNA, 22 nt, Human
aguacaauuauauuuagauggu

SEQ ID NO: 401422 - RNA, 22 nt, Human
uuccuuagggaaagggauaagg

SEQ ID NO: 401423 - RNA, 22 nt, Human
ugaaugaaugaauuaauagagu

SEQ ID NO: 401424 - RNA, 22 nt, Human
gaccaaggaagaggggagccag

SEQ ID NO: 401425 - RNA, 22 nt, Human
ugcagagaaaguguagacaggc

SEQ ID NO: 401426 - RNA, 20 nt, Human
aucaaaggcugauucagucc

SEQ ID NO: 401427 - RNA, 22 nt, Human
ucauuguuucugcuuuucauga

SEQ ID NO: 401428 - RNA, 22 nt, Human
ucucucuuuuuaaucauguaau

SEQ ID NO: 401429 - RNA, 22 nt, Human
uuacauaacgguaugaaaaaug

SEQ ID NO: 401430 - RNA, 22 nt, Human
acaacaaagacacuugaaauga

SEQ ID NO: 401431 - RNA, 22 nt, Human
gaauuucauugcucugcugugu

SEQ ID NO: 401432 - RNA, 20 nt, Human
uacagaaacaggacuuuugg

SEQ ID NO: 401433 - RNA, 22 nt, Human
cucuccucugaaguggugaccc

SEQ ID NO: 401434 - RNA, 18 nt, Human
ccagguggugacagagau

SEQ ID NO: 401435 - RNA, 22 nt, Human
aaagccagagcaagcugucaca

SEQ ID NO: 401436 - RNA, 22 nt, Human
aaaucagugcucauuugaaagg

SEQ ID NO: 401437 - RNA, 22 nt, Human
uguaggccuauguccagcaauu

SEQ ID NO: 401438 - RNA, 22 nt, Human
acauacauauguuuaaaugcau

SEQ ID NO: 401439 - RNA, 22 nt, Human
cucacuguccaacaggcuuuac

SEQ ID NO: 401440 - RNA, 22 nt, Human
gauuuuauauggcauacugugg

SEQ ID NO: 401441 - RNA, 22 nt, Human
auucuucacauaagugcuguac

SEQ ID NO: 401442 - RNA, 22 nt, Human
gccuuaauuuaugucuaacaua

SEQ ID NO: 401443 - RNA, 22 nt, Human
caguaaaugcagauauagauac

SEQ ID NO: 401444 - RNA, 22 nt, Human
gccugcagauauauaggauggu

SEQ ID NO: 401445 - RNA, 22 nt, Human
uuagaaaugcacccaagaccua

SEQ ID NO: 401446 - RNA, 22 nt, Human
auugaaagauuuugggcucaug

SEQ ID NO: 401447 - RNA, 22 nt, Human
ccucagggaaugggaggcuggg

SEQ ID NO: 401448 - RNA, 22 nt, Human
ccaggcugccgaggaaagaaag

SEQ ID NO: 401449 - RNA, 22 nt, Human
uuuuaucugcuucauuaguuga

SEQ ID NO: 401450 - RNA, 21 nt, Human
uuucuucacuuugccccaugu

SEQ ID NO: 401451 - RNA, 22 nt, Human
aggggcucaaagugugcaggga

SEQ ID NO: 401452 - RNA, 22 nt, Human
augguuuaaagaguaugacuuu

SEQ ID NO: 401453 - RNA, 22 nt, Human
aaucagaacuccuaccacagag

SEQ ID NO: 401454 - RNA, 22 nt, Human
uuuaauauucugcauucuccuu

SEQ ID NO: 401455 - RNA, 22 nt, Human
gaauuacaugacccugaguaga

SEQ ID NO: 401456 - RNA, 22 nt, Human
ucacaucauuaagacuucuccu

SEQ ID NO: 401457 - RNA, 22 nt, Human
uauuuauaccaggugaucggag

SEQ ID NO: 401458 - RNA, 22 nt, Human
uucaggauccccaccgcguuua

SEQ ID NO: 401459 - RNA, 22 nt, Human
uuccuuagacagagguggucau

SEQ ID NO: 401460 - RNA, 22 nt, Human
ccuggaucuuucugacugacaa

SEQ ID NO: 401461 - RNA, 22 nt, Human
uauuugcaacauaaaacucuga

SEQ ID NO: 401462 - RNA, 22 nt, Human
uuuccaagagcuuauuucugaa

SEQ ID NO: 401463 - RNA, 22 nt, Human
aacaugucuggguauucacaag

SEQ ID NO: 401464 - RNA, 22 nt, Human
gcuguucucuguaacaugcauu

SEQ ID NO: 401465 - RNA, 22 nt, Human
aacaguaaagacagaauuuauc

SEQ ID NO: 401466 - RNA, 22 nt, Human
caugguuuauuagagcuuauuu

SEQ ID NO: 401467 - RNA, 22 nt, Human
aaagucauuuguauauacccuu

SEQ ID NO: 401468 - RNA, 22 nt, Human
gcagggcaaacccagguguuca

SEQ ID NO: 401469 - RNA, 22 nt, Human
acucaggaauggggcugggacu

SEQ ID NO: 401470 - RNA, 22 nt, Human
uucaccgugaaccgauuccuca

SEQ ID NO: 401471 - RNA, 22 nt, Human
cagagccaggucuaggagucuc

SEQ ID NO: 401472 - RNA, 22 nt, Human
acaagccaauuacugugccagg

SEQ ID NO: 401473 - RNA, 22 nt, Human
uucucuuagcuguaaagucaau

SEQ ID NO: 401474 - RNA, 22 nt, Human
uuccuuaguguuagauucugug

SEQ ID NO: 401475 - RNA, 22 nt, Human
gaaaggcaguacagcugagccu

SEQ ID NO: 401476 - RNA, 22 nt, Human
ucucaggaaauaggauuugagu

SEQ ID NO: 401477 - RNA, 22 nt, Human
ggaucugauuaauaagguggac

SEQ ID NO: 401478 - RNA, 20 nt, Human
uacaauacacaugcauauga

SEQ ID NO: 401479 - RNA, 23 nt, Human
aaaugacauaugguuucugaagg

SEQ ID NO: 401480 - RNA, 22 nt, Human
aaauacuguagauaauagaguu

SEQ ID NO: 401481 - RNA, 22 nt, Human
uaaggccagcaugaaugcagca

SEQ ID NO: 401482 - RNA, 22 nt, Human
uaucauaaguuaauuaaacagu

SEQ ID NO: 401483 - RNA, 22 nt, Human
aauguaaacagcaagagaaggg

SEQ ID NO: 401484 - RNA, 22 nt, Human
uuugaaaggaauuaggaugaca

SEQ ID NO: 401485 - RNA, 22 nt, Human
uuaaggauguugugauuuauua

SEQ ID NO: 401486 - RNA, 22 nt, Human
auccaugaagguacuucucagg

SEQ ID NO: 401487 - RNA, 22 nt, Human
ucaaucacguguuccauguucu

SEQ ID NO: 401488 - RNA, 22 nt, Human
augcugaauugaugcgagggag

SEQ ID NO: 401489 - RNA, 23 nt, Human
uuuaacuuuccaauaauucauug

SEQ ID NO: 401490 - RNA, 22 nt, Human
uagaauaugauuaauuuucuua

SEQ ID NO: 401491 - RNA, 22 nt, Human
auauacaggugguauguguaaa

SEQ ID NO: 401492 - RNA, 22 nt, Human
cugcaucacagcaggaggcaca

SEQ ID NO: 401493 - RNA, 22 nt, Human
aaacaggcaucacucagcaaag

SEQ ID NO: 401494 - RNA, 22 nt, Human
aucauucugauggucaaugcua

SEQ ID NO: 401495 - RNA, 22 nt, Human
gcacaauaauuuuuuuaagagg

SEQ ID NO: 401496 - RNA, 23 nt, Human
aaguacauauauuuagauaguga

SEQ ID NO: 401497 - RNA, 21 nt, Human
auucagaguaauucaucuuua

SEQ ID NO: 401498 - RNA, 22 nt, Human
ucaccgccuugcccggccgggc

SEQ ID NO: 401499 - RNA, 22 nt, Human
ucuucagagugaaagucuguga

SEQ ID NO: 401500 - RNA, 22 nt, Human
guugaaaguggagaaccugguu

SEQ ID NO: 401501 - RNA, 22 nt, Human
cuuugaagauggcaaauuuaga

SEQ ID NO: 401502 - RNA, 22 nt, Human
acaaaauuguguuaaacuuuau

SEQ ID NO: 401503 - RNA, 22 nt, Human
agugauggugagugagaagcuc

SEQ ID NO: 401504 - RNA, 18 nt, Human
caugucugcgccacaagg

SEQ ID NO: 401505 - RNA, 21 nt, Human
gacaaagugaagcaggcagga

SEQ ID NO: 401506 - RNA, 21 nt, Human
cauuucaaagagcuggaaauc

SEQ ID NO: 401507 - RNA, 22 nt, Human
cuagaaauucugauucaguagg

SEQ ID NO: 401508 - RNA, 22 nt, Human
uccuggauaucaaacaaacauu

SEQ ID NO: 401509 - RNA, 22 nt, Human
caaguccucugguuucaaauag

SEQ ID NO: 401510 - RNA, 22 nt, Human
gaaauauacaugaagucggcug

SEQ ID NO: 401511 - RNA, 22 nt, Human
gaauuucaggacaacuggaagg

SEQ ID NO: 401512 - RNA, 22 nt, Human
ccaggcugagcaugauuggagc

SEQ ID NO: 401513 - RNA, 22 nt, Human
auagucacugccuuccauuugu

SEQ ID NO: 401514 - RNA, 22 nt, Human
agauucuacucuagauccaugg

SEQ ID NO: 401515 - RNA, 20 nt, Human
uuucugugagaaacacuguu

SEQ ID NO: 401516 - RNA, 22 nt, Human
auccuuagaagggagugaggac

SEQ ID NO: 401517 - RNA, 22 nt, Human
ucaggaugguguggaggaaaua

SEQ ID NO: 401518 - RNA, 22 nt, Human
aaauagcauaaaauaggaagcu

SEQ ID NO: 401519 - RNA, 21 nt, Human
gauaaaaugggccuugguccu

SEQ ID NO: 401520 - RNA, 22 nt, Human
ugaaagguagcuggccucauag

SEQ ID NO: 401521 - RNA, 22 nt, Human
aaagcaaugcuuguggaaugua

SEQ ID NO: 401522 - RNA, 22 nt, Human
ucaggauggcuucugcaucaaa

SEQ ID NO: 401523 - RNA, 22 nt, Human
gguuauauaauucagugcuuuc

SEQ ID NO: 401524 - RNA, 22 nt, Human
ggcuuggaaaugguaaugagcu

SEQ ID NO: 401525 - RNA, 22 nt, Human
cuucuucaaccugaaaguuuca

SEQ ID NO: 401526 - RNA, 22 nt, Human
ugaaauagucuaaaaaaccaga

SEQ ID NO: 401527 - RNA, 22 nt, Human
guuuuauaauugcuucauaaga

SEQ ID NO: 401528 - RNA, 22 nt, Human
gauagaaagagugguucuuuuu

SEQ ID NO: 401529 - RNA, 21 nt, Human
ucuugaaaauuguagcaguuu

SEQ ID NO: 401530 - RNA, 23 nt, Human
uuuauccaacucuguaaucucuc

SEQ ID NO: 401531 - RNA, 22 nt, Human
ucagaacauugacauucuuauu

SEQ ID NO: 401532 - RNA, 22 nt, Human
gauuuagagcaggaaugcaugg

SEQ ID NO: 401533 - RNA, 22 nt, Human
ggcauuuaauccaucugauuga

SEQ ID NO: 401534 - RNA, 22 nt, Human
ugcuuaauacguauuugcugga

SEQ ID NO: 401535 - RNA, 22 nt, Human
acagagagaaacaaucagcagc

SEQ ID NO: 401536 - RNA, 22 nt, Human
uaugaaacauucauacaaauaa

SEQ ID NO: 401537 - RNA, 20 nt, Human
aacacacugguggcaucagg

SEQ ID NO: 401538 - RNA, 22 nt, Human
auaaaugccucagaaucauccc

SEQ ID NO: 401539 - RNA, 22 nt, Human
ugaaaggugacauuucuuggau

SEQ ID NO: 401540 - RNA, 22 nt, Human
acaguacauaauccugagucug

SEQ ID NO: 401541 - RNA, 20 nt, Human
acaggggcagcacaauaaug

SEQ ID NO: 401542 - RNA, 22 nt, Human
cucaggauucucgacacucaca

SEQ ID NO: 401543 - RNA, 22 nt, Human
uaaggccaauuaacaaccaggg

SEQ ID NO: 401544 - RNA, 23 nt, Human
ugguucuaggccuauaauuauau

SEQ ID NO: 401545 - RNA, 22 nt, Human
uucugugacuccucagagauuu

SEQ ID NO: 401546 - RNA, 22 nt, Human
uuuuaugugcuggacuggcagu

SEQ ID NO: 401547 - RNA, 22 nt, Human
aauacauauggaauuccauguu

SEQ ID NO: 401548 - RNA, 22 nt, Human
uauuccaacugucauagucaua

SEQ ID NO: 401549 - RNA, 22 nt, Human
ucugaagauuaccagcuaaaug

SEQ ID NO: 401550 - RNA, 22 nt, Human
gauaucauaucagacaaccucu

SEQ ID NO: 401551 - RNA, 22 nt, Human
ugaugaauaaacuugagaguca

SEQ ID NO: 401552 - RNA, 22 nt, Human
gauaauaagcacagcaggaugu

SEQ ID NO: 401553 - RNA, 20 nt, Human
ggggcugcaugcagagaaga

SEQ ID NO: 401554 - RNA, 19 nt, Human
uucauucuuucuacuuacc

SEQ ID NO: 401555 - RNA, 22 nt, Human
guuaaagaguuuggcuuucuuc

SEQ ID NO: 401556 - RNA, 22 nt, Human
ugcuuuaaaauggacuguuuug

SEQ ID NO: 401557 - RNA, 21 nt, Human
uucuccccagcgaauccucgg

SEQ ID NO: 401558 - RNA, 22 nt, Human
aaaggaagauugagcuuuucca

SEQ ID NO: 401559 - RNA, 22 nt, Human
aguacaacauuagaguaucuua

SEQ ID NO: 401560 - RNA, 22 nt, Human
aaggcaguuugggccaccaucu

SEQ ID NO: 401561 - RNA, 22 nt, Human
uauacuuuccugcaacuuugau

SEQ ID NO: 401562 - RNA, 22 nt, Human
ucacaaaugaggaaaucgagca

SEQ ID NO: 401563 - RNA, 22 nt, Human
uaguccuuuaauaguuaaugug

SEQ ID NO: 401564 - RNA, 23 nt, Human
ucuguacacaucagcaucuccca

SEQ ID NO: 401565 - RNA, 22 nt, Human
uuucaguuuccagcuuugucau

SEQ ID NO: 401566 - RNA, 22 nt, Human
acuuuugguucuguaacuguga

SEQ ID NO: 401567 - RNA, 22 nt, Human
uacagagauuuauugcuaaggc

SEQ ID NO: 401568 - RNA, 22 nt, Human
agccagucggggccaugcuggg

SEQ ID NO: 401569 - RNA, 22 nt, Human
acuauacauaaaacauuugggu

SEQ ID NO: 401570 - RNA, 22 nt, Human
aaucaaaaccuacagagguaau

SEQ ID NO: 401571 - RNA, 22 nt, Human
acaaaugucuccucuuuuguua

SEQ ID NO: 401572 - RNA, 22 nt, Human
uucuuuuacauuaagauuucag

SEQ ID NO: 401573 - RNA, 22 nt, Human
acuagaaacuaauggauuauua

SEQ ID NO: 401574 - RNA, 22 nt, Human
acucaggaaaaauguagugaua

SEQ ID NO: 401575 - RNA, 22 nt, Human
caucaucaaaacaaauggaguc

SEQ ID NO: 401576 - RNA, 22 nt, Human
augugucuuugagacucugcua

SEQ ID NO: 401577 - RNA, 22 nt, Human
augguuuuccucugcugcuuaa

SEQ ID NO: 401578 - RNA, 22 nt, Human
aucaagaacuuauuuuggaaau

SEQ ID NO: 401579 - RNA, 22 nt, Human
ucaggauaaaauguaauggcaa

SEQ ID NO: 401580 - RNA, 22 nt, Human
aaugucuucaguguauacaugg

SEQ ID NO: 401581 - RNA, 22 nt, Human
gaaaauagcagauagaccaaug

SEQ ID NO: 401582 - RNA, 22 nt, Human
aauaauuuccagccaacuggaa

SEQ ID NO: 401583 - RNA, 22 nt, Human
uuauucuucuucucuugccagg

SEQ ID NO: 401584 - RNA, 22 nt, Human
cucuucuuggcccccaugaggg

SEQ ID NO: 401585 - RNA, 22 nt, Human
augguuuuguccucuuugguuc

SEQ ID NO: 401586 - RNA, 22 nt, Human
uuuaggcaagggcaagauuauc

SEQ ID NO: 401587 - RNA, 22 nt, Human
gaucauuuacuuguucuggacu

SEQ ID NO: 401588 - RNA, 22 nt, Human
aucacaaaggcugcuucaugau

SEQ ID NO: 401589 - RNA, 22 nt, Human
aaagucaugcaguugaacuuuu

SEQ ID NO: 401590 - RNA, 22 nt, Human
acuauacaguauguacgugcac

SEQ ID NO: 401591 - RNA, 22 nt, Human
acacauuucuaaauuuuuaccg

SEQ ID NO: 401592 - RNA, 22 nt, Human
augaaacaguguguauagcaaa

SEQ ID NO: 401593 - RNA, 22 nt, Human
caaagaagagauuuacagagcu

SEQ ID NO: 401594 - RNA, 22 nt, Human
uuccaugaaggagacugagaag

SEQ ID NO: 401595 - RNA, 22 nt, Human
uuuaaugauagcuguuucacau

SEQ ID NO: 401596 - RNA, 18 nt, Human
ucuuccaacacugacacc

SEQ ID NO: 401597 - RNA, 22 nt, Human
caauuucaucuugugcuucaau

SEQ ID NO: 401598 - RNA, 16 nt, Human
uuuccaaagggcagcu

SEQ ID NO: 401599 - RNA, 22 nt, Human
gacuucuauuaauaccucuacu

SEQ ID NO: 401600 - RNA, 22 nt, Human
auacagauguugaauguuauau

SEQ ID NO: 401601 - RNA, 22 nt, Human
cuccuuagugccucugcacgag

SEQ ID NO: 401602 - RNA, 22 nt, Human
guggaauguccuugaucauaag

SEQ ID NO: 401603 - RNA, 22 nt, Human
aauggccagcugggagaguuga

SEQ ID NO: 401604 - RNA, 22 nt, Human
gguacaauggaccauaaaagcu

SEQ ID NO: 401605 - RNA, 22 nt, Human
acagucuugcuguauggucagg

SEQ ID NO: 401606 - RNA, 22 nt, Human
uucaggauaugugauaucugaa

SEQ ID NO: 401607 - RNA, 23 nt, Human
acuuuauccuauaucuuuguucu

SEQ ID NO: 401608 - RNA, 22 nt, Human
uucuuaaucccacaaaucuuca

SEQ ID NO: 401609 - RNA, 22 nt, Human
uaucagaaggaagugccuuuaa

SEQ ID NO: 401610 - RNA, 22 nt, Human
ugaaggccucugguacaugcca

SEQ ID NO: 401611 - RNA, 22 nt, Human
uaaaauguuugcaagagaccag

SEQ ID NO: 401612 - RNA, 22 nt, Human
caaugaaagcaacugccuauaa

SEQ ID NO: 401613 - RNA, 22 nt, Human
uccauuuuucaugacuccucaa

SEQ ID NO: 401614 - RNA, 22 nt, Human
cuuaggcaaccaggucaaugcu

SEQ ID NO: 401615 - RNA, 22 nt, Human
guucuucagcauuagaagucau

SEQ ID NO: 401616 - RNA, 22 nt, Human
aaugagacacgugaagcagaug

SEQ ID NO: 401617 - RNA, 22 nt, Human
uguauguugggucaaaguacau

SEQ ID NO: 401618 - RNA, 22 nt, Human
guaaacauuacugugcuguaua

SEQ ID NO: 401619 - RNA, 17 nt, Human
uaaagccagucaaguca

SEQ ID NO: 401620 - RNA, 22 nt, Human
gauuucaaccuaacaguaugac

SEQ ID NO: 401621 - RNA, 22 nt, Human
agaucaguuagauagcuugaug

SEQ ID NO: 401622 - RNA, 22 nt, Human
uugaaguuguaguucagugaag

SEQ ID NO: 401623 - RNA, 22 nt, Human
aagugagugguaaggagcaugg

SEQ ID NO: 401624 - RNA, 22 nt, Human
aauauaaugcuguuuuaugcca

SEQ ID NO: 401625 - RNA, 17 nt, Human
ucauuuguugugacuag

SEQ ID NO: 401626 - RNA, 22 nt, Human
ggaccuggcaauuugcaucucu

SEQ ID NO: 401627 - RNA, 22 nt, Human
uuucaugagauuccuccacauc

SEQ ID NO: 401628 - RNA, 22 nt, Human
accagcugcugauugcuaaaug

SEQ ID NO: 401629 - RNA, 22 nt, Human
uauuugaaaguguacaaaaacu

SEQ ID NO: 401630 - RNA, 22 nt, Human
uggcaauuuuaggugguuuagu

SEQ ID NO: 401631 - RNA, 22 nt, Human
cuagaaauauuuuacagucaag

SEQ ID NO: 401632 - RNA, 22 nt, Human
augcagcuucaggauuaugaug

SEQ ID NO: 401633 - RNA, 22 nt, Human
uuuaggcauugggugcucaagu

SEQ ID NO: 401634 - RNA, 22 nt, Human
uuggaucacucugaagccuuac

SEQ ID NO: 401635 - RNA, 22 nt, Human
guaggaaaguaaaugaaauaca

SEQ ID NO: 401636 - RNA, 22 nt, Human
uauuuccaggccccacucuaga

SEQ ID NO: 401637 - RNA, 22 nt, Human
ucaaaaguuucacauagagaua

SEQ ID NO: 401638 - RNA, 22 nt, Human
agcauauaaauggacauauuug

SEQ ID NO: 401639 - RNA, 22 nt, Human
agucuucucauuucacaugcuu

SEQ ID NO: 401640 - RNA, 22 nt, Human
caucagaagaaagacaaaugau

SEQ ID NO: 401641 - RNA, 20 nt, Human
uguuaaaggacacuugcuuu

SEQ ID NO: 401642 - RNA, 19 nt, Human
ucucugcuucucuuggcau

SEQ ID NO: 401643 - RNA, 20 nt, Human
gucaggauuaguaaacucug

SEQ ID NO: 401644 - RNA, 22 nt, Human
cauaauaucuccgauuacuugc

SEQ ID NO: 401645 - RNA, 22 nt, Human
aaugauuuccccuacacagaag

SEQ ID NO: 401646 - RNA, 22 nt, Human
aucaggauucaguaucuccagc

SEQ ID NO: 401647 - RNA, 22 nt, Human
uugaagaaauuauuuuauauag

SEQ ID NO: 401648 - RNA, 22 nt, Human
ugucaccagcugcuccucagga

SEQ ID NO: 401649 - RNA, 22 nt, Human
uaaguccuagcuuugguaggaa

SEQ ID NO: 401650 - RNA, 20 nt, Human
cuucuucaguaguuuguucu

SEQ ID NO: 401651 - RNA, 22 nt, Human
uaaguccuaauggcagaagucu

SEQ ID NO: 401652 - RNA, 22 nt, Human
uuagaaaugauuucaccucuuu

SEQ ID NO: 401653 - RNA, 22 nt, Human
caauuucaugccauguauugcu

SEQ ID NO: 401654 - RNA, 22 nt, Human
gaggggcagagguagagaacaa

SEQ ID NO: 401655 - RNA, 22 nt, Human
ugugaaggagaugaagggagug

SEQ ID NO: 401656 - RNA, 22 nt, Human
ucagagaguuggaaagaauuaa

SEQ ID NO: 401657 - RNA, 22 nt, Human
auuuggcaacauuaauugaauc

SEQ ID NO: 401658 - RNA, 22 nt, Human
uuuuuauaugaaggauagugcg

SEQ ID NO: 401659 - RNA, 23 nt, Human
cagaaauaaacugguuuguagau

SEQ ID NO: 401660 - RNA, 22 nt, Human
ugaaauaauaucuggaucaauc

SEQ ID NO: 401661 - RNA, 22 nt, Human
uggagacugugcuaagggaguu

SEQ ID NO: 401662 - RNA, 23 nt, Human
uuucaaauuacucugcagaugac

SEQ ID NO: 401663 - RNA, 22 nt, Human
cucaggaugucggugacuauug

SEQ ID NO: 401664 - RNA, 22 nt, Human
uucagcaaauggacuguucagg

SEQ ID NO: 401665 - RNA, 22 nt, Human
caugugguucaaguacuccaca

SEQ ID NO: 401666 - RNA, 22 nt, Human
aaauuccagaaacucaguauau

SEQ ID NO: 401667 - RNA, 22 nt, Human
uuauucuuuucuccagaauccc

SEQ ID NO: 401668 - RNA, 22 nt, Human
cuggauuugccuauggugcuuu

SEQ ID NO: 401669 - RNA, 23 nt, Human
uauuacaauuggucuuauuaaga

SEQ ID NO: 401670 - RNA, 22 nt, Human
cuucuuaacuguauauacuaug

SEQ ID NO: 401671 - RNA, 22 nt, Human
auguacaaaauguuuugaaaug

SEQ ID NO: 401672 - RNA, 22 nt, Human
guugaaagaugucuugguuccc

SEQ ID NO: 401673 - RNA, 22 nt, Human
augguuuacaauguuuucaguu

SEQ ID NO: 401674 - RNA, 22 nt, Human
guucuaauaggagaaaagacag

SEQ ID NO: 401675 - RNA, 22 nt, Human
caagagagaugcagcucacuca

SEQ ID NO: 401676 - RNA, 22 nt, Human
uuacagaagaguaacuuggcaa

SEQ ID NO: 401677 - RNA, 22 nt, Human
auaugaaaguaagcaugugugu

SEQ ID NO: 401678 - RNA, 22 nt, Human
ucuuuaauaucugccccagagc

SEQ ID NO: 401679 - RNA, 22 nt, Human
cuagccugggauuugaacuuau

SEQ ID NO: 401680 - RNA, 22 nt, Human
uucauugucucuguuugccuuc

SEQ ID NO: 401681 - RNA, 22 nt, Human
uucagaaguagcuaagcaguca

SEQ ID NO: 401682 - RNA, 22 nt, Human
aguucucauugcaugagacaga

SEQ ID NO: 401683 - RNA, 22 nt, Human
ugcuuaauagugcacugguuuc

SEQ ID NO: 401684 - RNA, 22 nt, Human
uauuucaacguaugaaaagcug

SEQ ID NO: 401685 - RNA, 22 nt, Human
aaugucugcucuacucaggagg

SEQ ID NO: 401686 - RNA, 22 nt, Human
ugaguaauaaacugucuugcuc

SEQ ID NO: 401687 - RNA, 22 nt, Human
uuagaaauauggugcugccgcc

SEQ ID NO: 401688 - RNA, 22 nt, Human
uuggagagaggcugcucaggcu

SEQ ID NO: 401689 - RNA, 22 nt, Human
uauacagaacugcacgugcacg

SEQ ID NO: 401690 - RNA, 22 nt, Human
gauggcuucagucuccuugggu

SEQ ID NO: 401691 - RNA, 22 nt, Human
cuacagaauucaacaaaugguu

SEQ ID NO: 401692 - RNA, 22 nt, Human
caugcuuauucauucugcuaac

SEQ ID NO: 401693 - RNA, 22 nt, Human
uugaagaaagucauauauaaug

SEQ ID NO: 401694 - RNA, 22 nt, Human
acauuuaaauaccuauguuucu

SEQ ID NO: 401695 - RNA, 22 nt, Human
uucauugugaacacauucugcc

SEQ ID NO: 401696 - RNA, 22 nt, Human
aaugcuuaauucaauacugugu

SEQ ID NO: 401697 - RNA, 22 nt, Human
ucuucuccagugcuucugcaca

SEQ ID NO: 401698 - RNA, 22 nt, Human
ugcuuucaaaggcuuucuagau

SEQ ID NO: 401699 - RNA, 22 nt, Human
uguguuauugccacugaagacc

SEQ ID NO: 401700 - RNA, 22 nt, Human
auucaagauuaauucuauguca

SEQ ID NO: 401701 - RNA, 18 nt, Human
uaagucauuuugccagca

SEQ ID NO: 401702 - RNA, 22 nt, Human
uguagaaauuaguaagaucaac

SEQ ID NO: 401703 - RNA, 22 nt, Human
aucagcuuuucucaucagaaau

SEQ ID NO: 401704 - RNA, 22 nt, Human
ucuauacaaguuucacuuugac

SEQ ID NO: 401705 - RNA, 22 nt, Human
aaguccauucuuccagccagcu

SEQ ID NO: 401706 - RNA, 19 nt, Human
uuugaaagaguuuuauugg

SEQ ID NO: 401707 - RNA, 22 nt, Human
gagggagugccagagggccagc

SEQ ID NO: 401708 - RNA, 22 nt, Human
uugcacuaggaaaaggcagcca

SEQ ID NO: 401709 - RNA, 22 nt, Human
uaaagacacugguuuuaaucau

SEQ ID NO: 401710 - RNA, 22 nt, Human
uccaugucuucaugugucuaac

SEQ ID NO: 401711 - RNA, 21 nt, Human
uaucagaagagaaagaaugau

SEQ ID NO: 401712 - RNA, 22 nt, Human
cuuauacacccucuucccaggc

SEQ ID NO: 401713 - RNA, 22 nt, Human
acagaaauaacuuuuuauguuu

SEQ ID NO: 401714 - RNA, 22 nt, Human
uuauacuuuauacuacaucauu

SEQ ID NO: 401715 - RNA, 22 nt, Human
acaacuuuagucuggagggaaa

SEQ ID NO: 401716 - RNA, 22 nt, Human
guaaaauagaauaacguggcua

SEQ ID NO: 401717 - RNA, 22 nt, Human
aaggaaccauuugugugcaugg

SEQ ID NO: 401718 - RNA, 22 nt, Human
ugacuucaagguucagcaccuu

SEQ ID NO: 401719 - RNA, 22 nt, Human
uuugaaagacagaauauuuuug

SEQ ID NO: 401720 - RNA, 22 nt, Human
aucauuacuccuguaaaauugu

SEQ ID NO: 401721 - RNA, 22 nt, Human
uggcuuuaggagcuauauaccu

SEQ ID NO: 401722 - RNA, 22 nt, Human
cuuuuccacugagccucacaaa

SEQ ID NO: 401723 - RNA, 22 nt, Human
aaugucugccagaacugaucau

SEQ ID NO: 401724 - RNA, 22 nt, Human
uaauaucuacuucauagaguuu

SEQ ID NO: 401725 - RNA, 22 nt, Human
aaaggaagaugccaggacucug

SEQ ID NO: 401726 - RNA, 22 nt, Human
uuuccaaaggaguaccacgcau

SEQ ID NO: 401727 - RNA, 20 nt, Human
ucucagcauaagaacccuuc

SEQ ID NO: 401728 - RNA, 22 nt, Human
uuggaucaaauuucaugcuguc

SEQ ID NO: 401729 - RNA, 22 nt, Human
aguaaaauuaauggaucagaag

SEQ ID NO: 401730 - RNA, 22 nt, Human
aaaugaaaugagugccuggagg

SEQ ID NO: 401731 - RNA, 22 nt, Human
acuuugcagggcuugauaucca

SEQ ID NO: 401732 - RNA, 22 nt, Human
caaaauuguugaugcugcuuug

SEQ ID NO: 401733 - RNA, 22 nt, Human
caaggccaugagcagcgagugu

SEQ ID NO: 401734 - RNA, 22 nt, Human
caaguccuaggucugauugaac

SEQ ID NO: 401735 - RNA, 18 nt, Human
gcaggcuuuuccuggguc

SEQ ID NO: 401736 - RNA, 22 nt, Human
agaucauaugaaaaauuucaag

SEQ ID NO: 401737 - RNA, 20 nt, Human
caucaucacaugagccaauu

SEQ ID NO: 401738 - RNA, 22 nt, Human
gaauacaaacuuaaggcuuuac

SEQ ID NO: 401739 - RNA, 22 nt, Human
uucaggaucaaguugccaguag

SEQ ID NO: 401740 - RNA, 22 nt, Human
ucccaaagcuacucuucugacu

SEQ ID NO: 401741 - RNA, 22 nt, Human
acaaagucacaauaauuaaccu

SEQ ID NO: 401742 - RNA, 22 nt, Human
uugguacagaugagguauucuc

SEQ ID NO: 401743 - RNA, 22 nt, Human
auggcuuuguuccaauaaaacu

SEQ ID NO: 401744 - RNA, 22 nt, Human
aauuauauuguggugugaaugu

SEQ ID NO: 401745 - RNA, 22 nt, Human
uaauuccaccuuuuuccaacuu

SEQ ID NO: 401746 - RNA, 22 nt, Human
aaauauaguaaaugcauaguuc

SEQ ID NO: 401747 - RNA, 22 nt, Human
uacaggaaguaaguaaugaaau

SEQ ID NO: 401748 - RNA, 22 nt, Human
aaagcaauggaugagaaucugu

SEQ ID NO: 401749 - RNA, 19 nt, Human
guuccaaaggccagaccuu

SEQ ID NO: 401750 - RNA, 22 nt, Human
gucagagagggcacgugcacac

SEQ ID NO: 401751 - RNA, 22 nt, Human
uucaaauacauucuuugccacu

SEQ ID NO: 401752 - RNA, 22 nt, Human
uuucagacagauucuucucagu

SEQ ID NO: 401753 - RNA, 22 nt, Human
ucuuuaaucauaaccaagaugg

SEQ ID NO: 401754 - RNA, 22 nt, Human
acauguauugacauuauauucu

SEQ ID NO: 401755 - RNA, 22 nt, Human
guaaacauuuucaucugugccc

SEQ ID NO: 401756 - RNA, 22 nt, Human
auacaugugggucuaaacauau

SEQ ID NO: 401757 - RNA, 22 nt, Human
cuggaagagcauuugcauaggg

SEQ ID NO: 401758 - RNA, 19 nt, Human
uuccaaaaucaggauuuga

SEQ ID NO: 401759 - RNA, 22 nt, Human
caaucaguaaccggaucauggu

SEQ ID NO: 401760 - RNA, 22 nt, Human
uacaacauuguguugcuucaua

SEQ ID NO: 401761 - RNA, 22 nt, Human
uucacacacagcuuccuauugu

SEQ ID NO: 401762 - RNA, 22 nt, Human
ugauuuccuaggucuggagaag

SEQ ID NO: 401763 - RNA, 22 nt, Human
uuauuacacugaaagaauugcg

SEQ ID NO: 401764 - RNA, 22 nt, Human
auccaaaccuggacaugagugg

SEQ ID NO: 401765 - RNA, 22 nt, Human
ggccuuuaagcaauugaaaaga

SEQ ID NO: 401766 - RNA, 22 nt, Human
aucuaaaguguuucaugaaaga

SEQ ID NO: 401767 - RNA, 22 nt, Human
uucaggauucugugucugacaa

SEQ ID NO: 401768 - RNA, 22 nt, Human
ucacaugaguauuauuuuccaa

SEQ ID NO: 401769 - RNA, 22 nt, Human
ugacaguuaagguauacauuca

SEQ ID NO: 401770 - RNA, 22 nt, Human
agucaccaucuguggcagccug

SEQ ID NO: 401771 - RNA, 22 nt, Human
gcaggaaagguugagacuuugc

SEQ ID NO: 401772 - RNA, 22 nt, Human
aguccagugaacuguaaauagg

SEQ ID NO: 401773 - RNA, 22 nt, Human
uauaucaccaaaaacaguucug

SEQ ID NO: 401774 - RNA, 22 nt, Human
ucauucuugaucacuaguuagu

SEQ ID NO: 401775 - RNA, 22 nt, Human
uaaugucagcauaguuuauuuu

SEQ ID NO: 401776 - RNA, 22 nt, Human
uucccucuccuacucaggaaag

SEQ ID NO: 401777 - RNA, 21 nt, Human
agaauucuuaaguauucuaau

SEQ ID NO: 401778 - RNA, 23 nt, Human
uacuuaggguuuagaucugacug

SEQ ID NO: 401779 - RNA, 22 nt, Human
ucuauacaugugcacacacauc

SEQ ID NO: 401780 - RNA, 20 nt, Human
uauuuacaacuuagagccuc

SEQ ID NO: 401781 - RNA, 22 nt, Human
gauuucaaaaguagauccauca

SEQ ID NO: 401782 - RNA, 22 nt, Human
ugugaauaaugccgcaauaaac

SEQ ID NO: 401783 - RNA, 22 nt, Human
ucuuuuggguucuuaugauuua

SEQ ID NO: 401784 - RNA, 20 nt, Human
cucaggauugucuagccccu

SEQ ID NO: 401785 - RNA, 22 nt, Human
ugucaccacuggcugaaacacc

SEQ ID NO: 401786 - RNA, 22 nt, Human
aaguccuuggagaauagaaagg

SEQ ID NO: 401787 - RNA, 22 nt, Human
agcauuuagucuuuauugcagc

SEQ ID NO: 401788 - RNA, 22 nt, Human
agccuauuccaggaugagcuca

SEQ ID NO: 401789 - RNA, 22 nt, Human
ccacuguuuuucaguuaacuuu

SEQ ID NO: 401790 - RNA, 22 nt, Human
auuucauacuaaggcucaaaaa

SEQ ID NO: 401791 - RNA, 22 nt, Human
ucuucagauggccaguuguccc

SEQ ID NO: 401792 - RNA, 22 nt, Human
auaugaaaagaagucaccauug

SEQ ID NO: 401793 - RNA, 22 nt, Human
uuacagaaaguuucccaugccg

SEQ ID NO: 401794 - RNA, 22 nt, Human
ucacaguaaaagcauggaagag

SEQ ID NO: 401795 - RNA, 22 nt, Human
auggaucacagugccgugggug

SEQ ID NO: 401796 - RNA, 19 nt, Human
uggcauuuggaggcaaccu

SEQ ID NO: 401797 - RNA, 22 nt, Human
auuucauugaaguuaauucuuc

SEQ ID NO: 401798 - RNA, 22 nt, Human
aaugccuuuccacuggguauca

SEQ ID NO: 401799 - RNA, 22 nt, Human
uuuucuuaggugcuccaaguag

SEQ ID NO: 401800 - RNA, 22 nt, Human
aaaguccuguuaacuguuaaca

SEQ ID NO: 401801 - RNA, 22 nt, Human
auugauggcggccucuccauau

SEQ ID NO: 401802 - RNA, 22 nt, Human
ucauuuaauagcuuuugucuuu

SEQ ID NO: 401803 - RNA, 22 nt, Human
uagaauaaguugaugauauaug

SEQ ID NO: 401804 - RNA, 22 nt, Human
auacaaugaaguauagaugaaa

SEQ ID NO: 401805 - RNA, 22 nt, Human
uuauccuggauuauauauguga

SEQ ID NO: 401806 - RNA, 22 nt, Human
aggcaguuguugcugagcagcu

SEQ ID NO: 401807 - RNA, 22 nt, Human
uagcaucuggagaaacaagucc

SEQ ID NO: 401808 - RNA, 22 nt, Human
aagauaaacucuugauuucuga

SEQ ID NO: 401809 - RNA, 22 nt, Human
gggacuucauagcuaggcacuu

SEQ ID NO: 401810 - RNA, 22 nt, Human
aaugcauauguaggcaagcagu

SEQ ID NO: 401811 - RNA, 22 nt, Human
uuuagaaguucacacauuuaaa

SEQ ID NO: 401812 - RNA, 20 nt, Human
auucuacaagaauaagcaug

SEQ ID NO: 401813 - RNA, 19 nt, Human
ucucuacacuacauuucua

SEQ ID NO: 401814 - RNA, 22 nt, Human
ucuuagaaauuccccaguggcu

SEQ ID NO: 401815 - RNA, 22 nt, Human
cuuugcaauagaggcacacaug

SEQ ID NO: 401816 - RNA, 22 nt, Human
guuuacauguacucauuauacu

SEQ ID NO: 401817 - RNA, 22 nt, Human
ccucacugaagaggugacauuu

SEQ ID NO: 401818 - RNA, 22 nt, Human
cagaauuuagcacaauguaugg

SEQ ID NO: 401819 - RNA, 22 nt, Human
ucagagaaauaauugcugaguu

SEQ ID NO: 401820 - RNA, 22 nt, Human
uaucaagugacuaucacagaac

SEQ ID NO: 401821 - RNA, 22 nt, Human
ucuucuuccucauuuauacaua

SEQ ID NO: 401822 - RNA, 22 nt, Human
gaaauagacacuuucuaugaau

SEQ ID NO: 401823 - RNA, 22 nt, Human
guaaacaacacaaaucauuuga

SEQ ID NO: 401824 - RNA, 22 nt, Human
aaaucaguucacguucugaggu

SEQ ID NO: 401825 - RNA, 22 nt, Human
gaccauuuuuacagagcauuca

SEQ ID NO: 401826 - RNA, 22 nt, Human
ugaucugagagcagaucaccau

SEQ ID NO: 401827 - RNA, 22 nt, Human
caucagaauagcucuguggaua

SEQ ID NO: 401828 - RNA, 22 nt, Human
gcauguguuauuuuauguauga

SEQ ID NO: 401829 - RNA, 22 nt, Human
cugucccuucauuauucacuac

SEQ ID NO: 401830 - RNA, 22 nt, Human
augugaaaccugugaguagagu

SEQ ID NO: 401831 - RNA, 22 nt, Human
uggcuuuacugucauucuuaug

SEQ ID NO: 401832 - RNA, 21 nt, Human
gagauuuagaaggaucaauuu

SEQ ID NO: 401833 - RNA, 22 nt, Human
auggauuugcuuauacacaugu

SEQ ID NO: 401834 - RNA, 22 nt, Human
caaguccaucagauaagcaaga

SEQ ID NO: 401835 - RNA, 21 nt, Human
gauuuauaagccuuaagccua

SEQ ID NO: 401836 - RNA, 21 nt, Human
ucacagacuggucagugaggc

SEQ ID NO: 401837 - RNA, 22 nt, Human
uucaaagcugcagacuccuggg

SEQ ID NO: 401838 - RNA, 22 nt, Human
uugaauaauuaauuacacucag

SEQ ID NO: 401839 - RNA, 22 nt, Human
uuauccaacaugacuuaugucc

SEQ ID NO: 401840 - RNA, 22 nt, Human
gcaggggcuaaggacacagaga

SEQ ID NO: 401841 - RNA, 22 nt, Human
uaauccaaaacugaaucugugg

SEQ ID NO: 401842 - RNA, 22 nt, Human
caguggagagacuuuuacucuu

SEQ ID NO: 401843 - RNA, 22 nt, Human
aauaauauuugaagcuucaaag

SEQ ID NO: 401844 - RNA, 22 nt, Human
gccucugcccuccugggacugc

SEQ ID NO: 401845 - RNA, 22 nt, Human
uaugaaagaaucucagagcaca

SEQ ID NO: 401846 - RNA, 22 nt, Human
agaaaugcucaggucaacuuaa

SEQ ID NO: 401847 - RNA, 22 nt, Human
ucauagaagcaccagaagauau

SEQ ID NO: 401848 - RNA, 22 nt, Human
ccucaggauacaggagccacag

SEQ ID NO: 401849 - RNA, 22 nt, Human
uguuugaacugaauaacauagu

SEQ ID NO: 401850 - RNA, 23 nt, Human
aggauguaggauguauggcagag

SEQ ID NO: 401851 - RNA, 22 nt, Human
uuugaaaggaaguuaauacuuu

SEQ ID NO: 401852 - RNA, 22 nt, Human
cugccaucugagccaaaagugc

SEQ ID NO: 401853 - RNA, 23 nt, Human
uguugaaguaacuguuacauaga

SEQ ID NO: 401854 - RNA, 22 nt, Human
ucuucagacuccaaauguuuua

SEQ ID NO: 401855 - RNA, 20 nt, Human
uuccaacucacaucucuaca

SEQ ID NO: 401856 - RNA, 22 nt, Human
ccagauuugagcgucuuaaacc

SEQ ID NO: 401857 - RNA, 22 nt, Human
uuccaaaguuaguuauuagaaa

SEQ ID NO: 401858 - RNA, 22 nt, Human
aucacauuguuagcauagacug

SEQ ID NO: 401859 - RNA, 22 nt, Human
ugccauuuugagauguuaauga

SEQ ID NO: 401860 - RNA, 22 nt, Human
ggauuugaauuguugaaaugau

SEQ ID NO: 401861 - RNA, 22 nt, Human
uuugaaauuaagauauugucca

SEQ ID NO: 401862 - RNA, 22 nt, Human
uuccuuaguuauuugguccccu

SEQ ID NO: 401863 - RNA, 22 nt, Human
ucauuuguggaagugauugugg

SEQ ID NO: 401864 - RNA, 22 nt, Human
aaaucagucccucuuggaauuu

SEQ ID NO: 401865 - RNA, 20 nt, Human
uugauaggcagcuugucagg

SEQ ID NO: 401866 - RNA, 22 nt, Human
cuuacagagaagaaaauguagu

SEQ ID NO: 401867 - RNA, 22 nt, Human
gugggagcuuuggcaucaggcu

SEQ ID NO: 401868 - RNA, 22 nt, Human
aauucucagguaaaaguuaagu

SEQ ID NO: 401869 - RNA, 22 nt, Human
cuagaaauguagauucuuagug

SEQ ID NO: 401870 - RNA, 22 nt, Human
auaugcuugggacugauacagu

SEQ ID NO: 401871 - RNA, 22 nt, Human
uuuccuaguucuaagaaaugua

SEQ ID NO: 401872 - RNA, 22 nt, Human
uuaaaacagcgugaaucuggca

SEQ ID NO: 401873 - RNA, 22 nt, Human
uaagaaucugcauuuuaacaag

SEQ ID NO: 401874 - RNA, 22 nt, Human
uuacaaaguguuaugauaaaca

SEQ ID NO: 401875 - RNA, 22 nt, Human
cuaaagaagcuagcaaucuaua

SEQ ID NO: 401876 - RNA, 22 nt, Human
ugcaggaauagcuacagagcug

SEQ ID NO: 401877 - RNA, 22 nt, Human
aagucauugguagcuugauagg

SEQ ID NO: 401878 - RNA, 22 nt, Human
ucagaauuugauuccugggaua

SEQ ID NO: 401879 - RNA, 22 nt, Human
ugagauguaagguaugcuuacu

SEQ ID NO: 401880 - RNA, 22 nt, Human
guccaaauuuuucacauguaga

SEQ ID NO: 401881 - RNA, 22 nt, Human
agcagcauuaugauauaucuua

SEQ ID NO: 401882 - RNA, 22 nt, Human
ccucugcucugguccaugugcu

SEQ ID NO: 401883 - RNA, 22 nt, Human
uuucauugcagagucugugugc

SEQ ID NO: 401884 - RNA, 22 nt, Human
agauggagaccuuggaugaacu

SEQ ID NO: 401885 - RNA, 22 nt, Human
uuucuucagccuucacaaccug

SEQ ID NO: 401886 - RNA, 22 nt, Human
auauauaaccuggauaaggcuu

SEQ ID NO: 401887 - RNA, 22 nt, Human
gagugucugaauuagagcacaa

SEQ ID NO: 401888 - RNA, 22 nt, Human
uucccaauauucugcuuuuaug

SEQ ID NO: 401889 - RNA, 22 nt, Human
uuucacaaaugucuuuaacuug

SEQ ID NO: 401890 - RNA, 22 nt, Human
cucaggauuuacuaauuucaag

SEQ ID NO: 401891 - RNA, 22 nt, Human
gaccauuugcuaguaaauugca

SEQ ID NO: 401892 - RNA, 22 nt, Human
uuaggaaauuccaccuguauuc

SEQ ID NO: 401893 - RNA, 22 nt, Human
cagauuuaagagauaaacagug

SEQ ID NO: 401894 - RNA, 22 nt, Human
uuuaggcagaagcccugcugau

SEQ ID NO: 401895 - RNA, 22 nt, Human
uuaauaaacaggugcagcugaa

SEQ ID NO: 401896 - RNA, 22 nt, Human
aaaggccacacugcucuuucuc

SEQ ID NO: 401897 - RNA, 22 nt, Human
gucuauauauugcuugaauaau

SEQ ID NO: 401898 - RNA, 22 nt, Human
gcagggcagaccuccagccuau

SEQ ID NO: 401899 - RNA, 22 nt, Human
ucuauaaagggccagauaguag

SEQ ID NO: 401900 - RNA, 22 nt, Human
cuuaaauuggaugaguuaaguu

SEQ ID NO: 401901 - RNA, 22 nt, Human
cuauacagagcauccuuaacuu

SEQ ID NO: 401902 - RNA, 22 nt, Human
ugucaccaguuccaggaaauaa

SEQ ID NO: 401903 - RNA, 22 nt, Human
caguccuuaaggaaacauuugu

SEQ ID NO: 401904 - RNA, 22 nt, Human
uggguuuaaacucaacucuaaa

SEQ ID NO: 401905 - RNA, 22 nt, Human
cagaauaaagguacaauugagu

SEQ ID NO: 401906 - RNA, 22 nt, Human
agaauucauaggaaguuuccua

SEQ ID NO: 401907 - RNA, 22 nt, Human
uugaaaggugaacaugaugcac

SEQ ID NO: 401908 - RNA, 22 nt, Human
uacugaaaguggucaacagugg

SEQ ID NO: 401909 - RNA, 22 nt, Human
gauuucaaggaguuuucacagu

SEQ ID NO: 401910 - RNA, 22 nt, Human
aaaaagguugauccagauuagg

SEQ ID NO: 401911 - RNA, 22 nt, Human
cuuugaauugccguuucaucug

SEQ ID NO: 401912 - RNA, 22 nt, Human
gcucaggacccaggugugaccu

SEQ ID NO: 401913 - RNA, 22 nt, Human
ucacaguuauagucuguagaau

SEQ ID NO: 401914 - RNA, 22 nt, Human
aggcucagaggugagcaucugc

SEQ ID NO: 401915 - RNA, 22 nt, Human
caaauucaaauuucaucagugu

SEQ ID NO: 401916 - RNA, 22 nt, Human
ugcuuuaagacacuaaguuuga

SEQ ID NO: 401917 - RNA, 22 nt, Human
uugcugaagugaagguauguuu

SEQ ID NO: 401918 - RNA, 22 nt, Human
auucaaguggcugcuauguuaa

SEQ ID NO: 401919 - RNA, 22 nt, Human
uuucuucauucaccuucacccc

SEQ ID NO: 401920 - RNA, 22 nt, Human
auagaauuauggaaagcaucuu

SEQ ID NO: 401921 - RNA, 22 nt, Human
aaaagccaugcauaccuaagag

SEQ ID NO: 401922 - RNA, 22 nt, Human
aauuaaauugguuuagagagga

SEQ ID NO: 401923 - RNA, 22 nt, Human
ucucuguaguugggcagcugcu

SEQ ID NO: 401924 - RNA, 22 nt, Human
auguucuguuuuguaauucaua

SEQ ID NO: 401925 - RNA, 22 nt, Human
cauuuacaauguacagguugug

SEQ ID NO: 401926 - RNA, 21 nt, Human
acagcaagccuucacaugagu

SEQ ID NO: 401927 - RNA, 22 nt, Human
ugugauauuugaguauugucaa

SEQ ID NO: 401928 - RNA, 22 nt, Human
gucaacuugcaagaugcugggc

SEQ ID NO: 401929 - RNA, 22 nt, Human
caguaaauuugagggaucuaau

SEQ ID NO: 401930 - RNA, 22 nt, Human
guagccauuggcaaugaagccu

SEQ ID NO: 401931 - RNA, 19 nt, Human
caaggccaccauuucuccg

SEQ ID NO: 401932 - RNA, 22 nt, Human
gccaugcuugguaugcugugag

SEQ ID NO: 401933 - RNA, 23 nt, Human
ucagagagcuguugagagcugcc

SEQ ID NO: 401934 - RNA, 22 nt, Human
uccauuuuagaagaaaauccac

SEQ ID NO: 401935 - RNA, 22 nt, Human
uuugaaaguguuuacuugggaa

SEQ ID NO: 401936 - RNA, 18 nt, Human
gaaagccaugcagcagug

SEQ ID NO: 401937 - RNA, 22 nt, Human
auaacaugagccagauugaaag

SEQ ID NO: 401938 - RNA, 22 nt, Human
acaaaguccugguguauggcca

SEQ ID NO: 401939 - RNA, 22 nt, Human
cuggaggcacccuuagagaggc

SEQ ID NO: 401940 - RNA, 22 nt, Human
ggcagaagauaggacagggaau

SEQ ID NO: 401941 - RNA, 22 nt, Human
uggcuuuacaucaaauugagua

SEQ ID NO: 401942 - RNA, 22 nt, Human
uaagaaacccaggaauuucuua

SEQ ID NO: 401943 - RNA, 22 nt, Human
uucaugugaucacagauuguaa

SEQ ID NO: 401944 - RNA, 22 nt, Human
cugcauuagucaugcuuugcag

SEQ ID NO: 401945 - RNA, 22 nt, Human
acuuugaaggggaacauuuuaa

SEQ ID NO: 401946 - RNA, 22 nt, Human
gggcacagaagucuaagacauc

SEQ ID NO: 401947 - RNA, 22 nt, Human
uccaaaguguugggauuauagg

SEQ ID NO: 401948 - RNA, 22 nt, Human
gaaaggccagcucacagaugag

SEQ ID NO: 401949 - RNA, 22 nt, Human
gcucuaauugaaaaauacugca

SEQ ID NO: 401950 - RNA, 22 nt, Human
uuuugcuugagugcacaaaaug

SEQ ID NO: 401951 - RNA, 22 nt, Human
uuugaagauaaauauggagaaa

SEQ ID NO: 401952 - RNA, 22 nt, Human
cuuccaaacccaggguaugggc

SEQ ID NO: 401953 - RNA, 22 nt, Human
cucuucuuuaguccagaccauc

SEQ ID NO: 401954 - RNA, 22 nt, Human
guagaaauguaaccaggagaua

SEQ ID NO: 401955 - RNA, 22 nt, Human
caagaugggcaccccagcaccu

SEQ ID NO: 401956 - RNA, 23 nt, Human
ucucaggacacacaugucuauca

SEQ ID NO: 401957 - RNA, 22 nt, Human
uuccuuagauccuucaaucacg

SEQ ID NO: 401958 - RNA, 20 nt, Human
agaaucugacccagagagac

SEQ ID NO: 401959 - RNA, 17 nt, Human
caaggccagcaucuuca

SEQ ID NO: 401960 - RNA, 21 nt, Human
ggauggauagggaagagauuu

SEQ ID NO: 401961 - RNA, 22 nt, Human
uuuccauguuggugaaaugagg

SEQ ID NO: 401962 - RNA, 22 nt, Human
ucagaaaagagaaaaucuuaua

SEQ ID NO: 401963 - RNA, 22 nt, Human
gaguccuuccagcaggcauuua

SEQ ID NO: 401964 - RNA, 22 nt, Human
auacagaauuugcccuuuucau

SEQ ID NO: 401965 - RNA, 16 nt, Human
cuuccucuucacuggc

SEQ ID NO: 401966 - RNA, 22 nt, Human
aauauaugugguauugaccagc

SEQ ID NO: 401967 - RNA, 22 nt, Human
cuauuauuuccucaucuauaaa

SEQ ID NO: 401968 - RNA, 22 nt, Human
ugucucugauaaguaguucagu

SEQ ID NO: 401969 - RNA, 22 nt, Human
aguacauauaguaauuuagcca

SEQ ID NO: 401970 - RNA, 22 nt, Human
guacagaaauggggccccaggu

SEQ ID NO: 401971 - RNA, 22 nt, Human
ucugggaacagccuggcugugu

SEQ ID NO: 401972 - RNA, 22 nt, Human
augugaaauagcuggauaugaa

SEQ ID NO: 401973 - RNA, 19 nt, Human
acaagucacuuacuuagua

SEQ ID NO: 401974 - RNA, 22 nt, Human
uuggaucagaugauaucuuugu

SEQ ID NO: 401975 - RNA, 22 nt, Human
agguccagcuguugcagccucc

SEQ ID NO: 401976 - RNA, 22 nt, Human
cagucaccuagacagaacuuac

SEQ ID NO: 401977 - RNA, 22 nt, Human
uuugaaaggagcuuuauccaga

SEQ ID NO: 401978 - RNA, 22 nt, Human
augaaacacacacgcgcauacu

SEQ ID NO: 401979 - RNA, 22 nt, Human
auggaucagaaucccgggaggg

SEQ ID NO: 401980 - RNA, 22 nt, Human
aauucuaaauguaauuuagaau

SEQ ID NO: 401981 - RNA, 22 nt, Human
ucaguuucuucaucucccuaac

SEQ ID NO: 401982 - RNA, 22 nt, Human
uuaaagucccugccuuaauucc

SEQ ID NO: 401983 - RNA, 22 nt, Human
acauuuaaccaaacuguuuaau

SEQ ID NO: 401984 - RNA, 22 nt, Human
aaucagucucauuuagcaggga

SEQ ID NO: 401985 - RNA, 22 nt, Human
uugaaaggaauacagaggccua

SEQ ID NO: 401986 - RNA, 22 nt, Human
guugaaagaucauguggcugcc

SEQ ID NO: 401987 - RNA, 22 nt, Human
ucauuucaaugauacuacuaag

SEQ ID NO: 401988 - RNA, 19 nt, Human
ugugaaagcuaguguucuu

SEQ ID NO: 401989 - RNA, 22 nt, Human
caaucaguuucuguuguauaau

SEQ ID NO: 401990 - RNA, 22 nt, Human
uccaaauacauuuacuguauuu

SEQ ID NO: 401991 - RNA, 22 nt, Human
aaggccagccugagagcuaaca

SEQ ID NO: 401992 - RNA, 22 nt, Human
caugucuguguacacaugcaca

SEQ ID NO: 401993 - RNA, 22 nt, Human
gucaggauuggggucaugaguc

SEQ ID NO: 401994 - RNA, 22 nt, Human
uggcuuuacacauccacugccu

SEQ ID NO: 401995 - RNA, 22 nt, Human
cuauacaguaaccacagugauu

SEQ ID NO: 401996 - RNA, 22 nt, Human
uuuaggcacagaguugagggac

SEQ ID NO: 401997 - RNA, 22 nt, Human
cuauuucaaggcccagauauga

SEQ ID NO: 401998 - RNA, 22 nt, Human
auugaaagagaauguagcucuu

SEQ ID NO: 401999 - RNA, 22 nt, Human
ccagaccacccuggccaugcac

SEQ ID NO: 402000 - RNA, 22 nt, Human
gacuaugugaagugugaauagg

SEQ ID NO: 402001 - RNA, 22 nt, Human
ucagccaggccaggcauucaca

SEQ ID NO: 402002 - RNA, 22 nt, Human
ucagagaggcaauacuguuuaa

SEQ ID NO: 402003 - RNA, 22 nt, Human
caauuucagugcuguggagagg

SEQ ID NO: 402004 - RNA, 22 nt, Human
auuaaaauuccaagguaugcca

SEQ ID NO: 402005 - RNA, 22 nt, Human
uauaaaauggcaucagcuccaa

SEQ ID NO: 402006 - RNA, 22 nt, Human
aaucagaaagaggucauguugc

SEQ ID NO: 402007 - RNA, 22 nt, Human
ccagaauuuggaucaugauuuu

SEQ ID NO: 402008 - RNA, 22 nt, Human
ggagcugugcagugacuacaga

SEQ ID NO: 402009 - RNA, 22 nt, Human
aauuuacaggugcacucgccau

SEQ ID NO: 402010 - RNA, 22 nt, Human
uaaauuaugucacaugacucug

SEQ ID NO: 402011 - RNA, 22 nt, Human
ccccaggacacauggaccaagu

SEQ ID NO: 402012 - RNA, 22 nt, Human
aauuucaaguggcaucuuugau

SEQ ID NO: 402013 - RNA, 22 nt, Human
auaucaguaucuauguauuugu

SEQ ID NO: 402014 - RNA, 22 nt, Human
uguacaaugccgagacuaacuc

SEQ ID NO: 402015 - RNA, 22 nt, Human
auacauauaugguacuuccugg

SEQ ID NO: 402016 - RNA, 22 nt, Human
uuauagaacagccuccucuaga

SEQ ID NO: 402017 - RNA, 22 nt, Human
gcauguguugguuuaugcaugu

SEQ ID NO: 402018 - RNA, 22 nt, Human
uuauaugaguaucauaucacuu

SEQ ID NO: 402019 - RNA, 22 nt, Human
aucuaucccaguuuaacucauu

SEQ ID NO: 402020 - RNA, 22 nt, Human
aaaugcuuguaaauuuuccaug

SEQ ID NO: 402021 - RNA, 22 nt, Human
agaugaaaagauaagcagcaau

SEQ ID NO: 402022 - RNA, 22 nt, Human
auuccaaagacagaagcagcug

SEQ ID NO: 402023 - RNA, 22 nt, Human
cauuucaauuauuugcucuucu

SEQ ID NO: 402024 - RNA, 22 nt, Human
auucaaguucuucugucuuugc

SEQ ID NO: 402025 - RNA, 22 nt, Human
gaguguucccacaccccaguug

SEQ ID NO: 402026 - RNA, 22 nt, Human
uugacacagaucaauauucaac

SEQ ID NO: 402027 - RNA, 23 nt, Human
ccacagagcugccaauuccugug

SEQ ID NO: 402028 - RNA, 22 nt, Human
agacucaagcagauaggaauua

SEQ ID NO: 402029 - RNA, 22 nt, Human
auucauaacggcaaaugucacc

SEQ ID NO: 402030 - RNA, 22 nt, Human
uauauuaaaugaccaguuuuaa

SEQ ID NO: 402031 - RNA, 17 nt, Human
guccuacccauggucua

SEQ ID NO: 402032 - RNA, 22 nt, Human
caaauacuaaacauaagauuuu

SEQ ID NO: 402033 - RNA, 22 nt, Human
ugcaggaagacuucccaagcca

SEQ ID NO: 402034 - RNA, 22 nt, Human
uuagccauuaauguccugugca

SEQ ID NO: 402035 - RNA, 22 nt, Human
ucacaccaguuuccuuucaauu

SEQ ID NO: 402036 - RNA, 22 nt, Human
gugaauaauauuguuuauaaaa

SEQ ID NO: 402037 - RNA, 22 nt, Human
ugguaauuuacgcauuucugua

SEQ ID NO: 402038 - RNA, 22 nt, Human
gaaguacaguuuuaucuagcca

SEQ ID NO: 402039 - RNA, 23 nt, Human
uaagaacagacaagcauuuacau

SEQ ID NO: 402040 - RNA, 22 nt, Human
aaauuauuaugccccucuauaa

SEQ ID NO: 402041 - RNA, 22 nt, Human
agggaguuagaaauccaggaua

SEQ ID NO: 402042 - RNA, 22 nt, Human
cccuguacagucucuguggcac

SEQ ID NO: 402043 - RNA, 22 nt, Human
uguuuuaagagcgcacuuuaua

SEQ ID NO: 402044 - RNA, 22 nt, Human
uacaugaaguugucuaaacugg

SEQ ID NO: 402045 - RNA, 22 nt, Human
cucacugacgaggaagcugaga

SEQ ID NO: 402046 - RNA, 22 nt, Human
cucaggaugcaggucacaggac

SEQ ID NO: 402047 - RNA, 20 nt, Human
cagagccaagagcagcaucu

SEQ ID NO: 402048 - RNA, 22 nt, Human
caggaugguggcaugaucagaa

SEQ ID NO: 402049 - RNA, 20 nt, Human
ugaaggccauuuguuccaga

SEQ ID NO: 402050 - RNA, 22 nt, Human
uucagaaaggauaauuggaagg

SEQ ID NO: 402051 - RNA, 22 nt, Human
uucaauaggaugcaugauauaa

SEQ ID NO: 402052 - RNA, 22 nt, Human
uaauuucaaguuuagggcucua

SEQ ID NO: 402053 - RNA, 22 nt, Human
acagucuugagcaucagccaga

SEQ ID NO: 402054 - RNA, 22 nt, Human
ugaaauagaaaaacaggcuucu

SEQ ID NO: 402055 - RNA, 22 nt, Human
uacauauacugagugauuugcu

SEQ ID NO: 402056 - RNA, 22 nt, Human
augaggcaaucaugguccaguu

SEQ ID NO: 402057 - RNA, 22 nt, Human
uugaauaggacucagcagugau

SEQ ID NO: 402058 - RNA, 22 nt, Human
ugcagagacuugugugcauuug

SEQ ID NO: 402059 - RNA, 22 nt, Human
uacagagauacucuagaucaaa

SEQ ID NO: 402060 - RNA, 22 nt, Human
ggcugaaggaugaaagcugcag

SEQ ID NO: 402061 - RNA, 22 nt, Human
uugaaagacuucuccugugaaa

SEQ ID NO: 402062 - RNA, 22 nt, Human
ugugaaagauacuaggcagagg

SEQ ID NO: 402063 - RNA, 23 nt, Human
acagaaaucauuuguaagguacc

SEQ ID NO: 402064 - RNA, 22 nt, Human
caauuucagucucagagaguuc

SEQ ID NO: 402065 - RNA, 22 nt, Human
uaaacauguugacaucuuaccu

SEQ ID NO: 402066 - RNA, 18 nt, Human
caauuucaauggucugaa

SEQ ID NO: 402067 - RNA, 22 nt, Human
cugcuucugggaugauggagua

SEQ ID NO: 402068 - RNA, 22 nt, Human
ugccuggaaggcccaugggaag

SEQ ID NO: 402069 - RNA, 22 nt, Human
uaacaagucauuuuaaauuaug

SEQ ID NO: 402070 - RNA, 22 nt, Human
uugcugaaaucuaugacauccu

SEQ ID NO: 402071 - RNA, 22 nt, Human
aauucacaaaaguuagauccau

SEQ ID NO: 402072 - RNA, 22 nt, Human
agaggccaggcugcagagggau

SEQ ID NO: 402073 - RNA, 20 nt, Human
cucuccucacccgugucagg

SEQ ID NO: 402074 - RNA, 22 nt, Human
cagaaucagcccuugcuauuaa

SEQ ID NO: 402075 - RNA, 22 nt, Human
uaauuucaccguugcuagaaau

SEQ ID NO: 402076 - RNA, 20 nt, Human
ucuaauuaaaauugucuagu

SEQ ID NO: 402077 - RNA, 22 nt, Human
cucagagaggcaguggaaguca

SEQ ID NO: 402078 - RNA, 22 nt, Human
auaucacaguaguuguuuaguu

SEQ ID NO: 402079 - RNA, 22 nt, Human
augcaaaauuaccauucuguuc

SEQ ID NO: 402080 - RNA, 22 nt, Human
uauaaagcugacucaugaaacu

SEQ ID NO: 402081 - RNA, 22 nt, Human
cugaauaauguucucuuguaug

SEQ ID NO: 402082 - RNA, 22 nt, Human
uugcagcugcaguaaauguuca

SEQ ID NO: 402083 - RNA, 22 nt, Human
gucaaacaaauuaacauaucca

SEQ ID NO: 402084 - RNA, 22 nt, Human
auacacauauguguguauaugu

SEQ ID NO: 402085 - RNA, 22 nt, Human
gugcauuugacgaauacucacu

SEQ ID NO: 402086 - RNA, 22 nt, Human
cucuucuugcuagacugagugc

SEQ ID NO: 402087 - RNA, 22 nt, Human
aaucagaaccuugggucauaac

SEQ ID NO: 402088 - RNA, 22 nt, Human
ucuuaauucugugucuucacua

SEQ ID NO: 402089 - RNA, 22 nt, Human
aucagaaauugcccagcuguuu

SEQ ID NO: 402090 - RNA, 22 nt, Human
uuuuuggguccaggcuguaucu

SEQ ID NO: 402091 - RNA, 22 nt, Human
uuucacuagaacguucuuguuu

SEQ ID NO: 402092 - RNA, 22 nt, Human
aaaagucugcucucauuucaga

SEQ ID NO: 402093 - RNA, 22 nt, Human
caguccuuggcuucauccgagu

SEQ ID NO: 402094 - RNA, 22 nt, Human
auguuucaaauauauagaguug

SEQ ID NO: 402095 - RNA, 22 nt, Human
augccaaagcccaaguucauca

SEQ ID NO: 402096 - RNA, 22 nt, Human
uucaauucaauucuaaauauau

SEQ ID NO: 402097 - RNA, 22 nt, Human
agucucugcaugccugcugugc

SEQ ID NO: 402098 - RNA, 22 nt, Human
cauggcuuuguucuguuagaug

SEQ ID NO: 402099 - RNA, 22 nt, Human
aggauuuauuauaugcccucau

SEQ ID NO: 402100 - RNA, 22 nt, Human
ccugucacgaugacugcacucu

SEQ ID NO: 402101 - RNA, 19 nt, Human
uacuaaacaugcauauugg

SEQ ID NO: 402102 - RNA, 22 nt, Human
augcuuaaugaggguauauaug

SEQ ID NO: 402103 - RNA, 22 nt, Human
acacaaacugcuagaaaauugg

SEQ ID NO: 402104 - RNA, 22 nt, Human
gauuuccauuuucaacuccugc

SEQ ID NO: 402105 - RNA, 22 nt, Human
ucuggcuuucauuuguuuaaag

SEQ ID NO: 402106 - RNA, 22 nt, Human
uacuaaacccucgauggaucuu

SEQ ID NO: 402107 - RNA, 22 nt, Human
gcuauacacauuucuugguagu

SEQ ID NO: 402108 - RNA, 23 nt, Human
ggccauuucauuugguucaaacu

SEQ ID NO: 402109 - RNA, 22 nt, Human
ugugugucagagucuccauggu

SEQ ID NO: 402110 - RNA, 21 nt, Human
cuacagaaucgagcauucugg

SEQ ID NO: 402111 - RNA, 22 nt, Human
auuucuuacauaacaaauuguu

SEQ ID NO: 402112 - RNA, 22 nt, Human
gaacuuuaccauuuagguaacu

SEQ ID NO: 402113 - RNA, 22 nt, Human
cuguggaaaauuuguauguaau

SEQ ID NO: 402114 - RNA, 22 nt, Human
auuaucuauguagaaugauuuu

SEQ ID NO: 402115 - RNA, 22 nt, Human
ucucacuuuguugcccagacuu

SEQ ID NO: 402116 - RNA, 22 nt, Human
aggcaacuguuugauaauguug

SEQ ID NO: 402117 - RNA, 22 nt, Human
uaaacagaaugcguaagaagug

SEQ ID NO: 402118 - RNA, 22 nt, Human
cugucauuuaagacauucugga

SEQ ID NO: 402119 - RNA, 22 nt, Human
augcagcugugggcaagaaaug

SEQ ID NO: 402120 - RNA, 22 nt, Human
auucuucaucacuaccuuguga

SEQ ID NO: 402121 - RNA, 22 nt, Human
uuuaaugaauaauucaaaucug

SEQ ID NO: 402122 - RNA, 22 nt, Human
gauuucaaagguucugcaugcc

SEQ ID NO: 402123 - RNA, 22 nt, Human
aaagccauugaacuguacuuua

SEQ ID NO: 402124 - RNA, 22 nt, Human
ucagauggcacacagagccugc

SEQ ID NO: 402125 - RNA, 23 nt, Human
acaacuuuacagauacauuuugu

SEQ ID NO: 402126 - RNA, 22 nt, Human
aacauucuauuuugcuaaaaca

SEQ ID NO: 402127 - RNA, 22 nt, Human
cuucuuaaauuggauugcuauu

SEQ ID NO: 402128 - RNA, 22 nt, Human
gagauuuaauuggauuaacuua

SEQ ID NO: 402129 - RNA, 22 nt, Human
cacucaggcugugucaggagga

SEQ ID NO: 402130 - RNA, 21 nt, Human
uuacagaauccaugggaaguc

SEQ ID NO: 402131 - RNA, 22 nt, Human
uguacaaucuuggucccuuuau

SEQ ID NO: 402132 - RNA, 22 nt, Human
ucacagcaaaugcugcuucuca

SEQ ID NO: 402133 - RNA, 20 nt, Human
ucagaugggagugagccauc

SEQ ID NO: 402134 - RNA, 22 nt, Human
uuucuuauacuauauugucauc

SEQ ID NO: 402135 - RNA, 22 nt, Human
aaucaagucaaccaucaugugc

SEQ ID NO: 402136 - RNA, 22 nt, Human
auacagaauacuaauuccugag

SEQ ID NO: 402137 - RNA, 22 nt, Human
ccauggcuuucuuucauuguaa

SEQ ID NO: 402138 - RNA, 22 nt, Human
uaaaauagcaugugcagugaaa

SEQ ID NO: 402139 - RNA, 19 nt, Human
uggauuuauauucuuuauc

SEQ ID NO: 402140 - RNA, 22 nt, Human
auagacauagccguaauuuauu

SEQ ID NO: 402141 - RNA, 22 nt, Human
gggagcugaauggcaauggaga

SEQ ID NO: 402142 - RNA, 19 nt, Human
ugcauaaauuauauacuuu

SEQ ID NO: 402143 - RNA, 20 nt, Human
uauaacaguguugggugugu

SEQ ID NO: 402144 - RNA, 23 nt, Human
uugaaagguagcuggcagcuaga

SEQ ID NO: 402145 - RNA, 22 nt, Human
acaguggagaaggcaugaggcu

SEQ ID NO: 402146 - RNA, 22 nt, Human
aaggaaccuggaguagagggag

SEQ ID NO: 402147 - RNA, 22 nt, Human
acucaggaaauugagauaaugg

SEQ ID NO: 402148 - RNA, 22 nt, Human
ucuuuaauguacuuucuuucac

SEQ ID NO: 402149 - RNA, 22 nt, Human
aggauuuauuggugggaaguua

SEQ ID NO: 402150 - RNA, 22 nt, Human
aagaaacaaccacugcucuccu

SEQ ID NO: 402151 - RNA, 22 nt, Human
uucuugcaggucacucacugag

SEQ ID NO: 402152 - RNA, 22 nt, Human
uuugaauaucacaaacuuucaa

SEQ ID NO: 402153 - RNA, 22 nt, Human
auucauaaguaaaugauuaccu

SEQ ID NO: 402154 - RNA, 22 nt, Human
gaagugaagagauuagaaauca

SEQ ID NO: 402155 - RNA, 22 nt, Human
ucagaauucuacaauagaucag

SEQ ID NO: 402156 - RNA, 22 nt, Human
uuuccuaggagauugaucacau

SEQ ID NO: 402157 - RNA, 22 nt, Human
aaagccaucuguauuaagugaa

SEQ ID NO: 402158 - RNA, 22 nt, Human
auacagaagaacuauagccacu

SEQ ID NO: 402159 - RNA, 21 nt, Human
uuagaaagcucacuacaguua

SEQ ID NO: 402160 - RNA, 23 nt, Human
uuaaacuucagugcagaacacuc

SEQ ID NO: 402161 - RNA, 21 nt, Human
uaauaauuccacuacagagua

SEQ ID NO: 402162 - RNA, 22 nt, Human
aaggacagggaugguugauugu

SEQ ID NO: 402163 - RNA, 22 nt, Human
gaauuucagaucagagaccauu

SEQ ID NO: 402164 - RNA, 22 nt, Human
agaaucugguagaaccaaggau

SEQ ID NO: 402165 - RNA, 22 nt, Human
ucucacuggguauaaaugagua

SEQ ID NO: 402166 - RNA, 22 nt, Human
caggccagcuuccugacauccu

SEQ ID NO: 402167 - RNA, 22 nt, Human
aauguuaauguguuugcuuaug

SEQ ID NO: 402168 - RNA, 22 nt, Human
gauuucaaguaucuugggcgag

SEQ ID NO: 402169 - RNA, 22 nt, Human
uccagaauauuugggaaagaug

SEQ ID NO: 402170 - RNA, 22 nt, Human
ggguacuuaauauuuacggggu

SEQ ID NO: 402171 - RNA, 22 nt, Human
uucauacuaaaguguaagaugu

SEQ ID NO: 402172 - RNA, 22 nt, Human
cuacagaauggagggucagaga

SEQ ID NO: 402173 - RNA, 22 nt, Human
uauuuguauguguguacauaua

SEQ ID NO: 402174 - RNA, 20 nt, Human
guaaugaauguaaacaguaa

SEQ ID NO: 402175 - RNA, 22 nt, Human
aucaggaucaugcuggguggga

SEQ ID NO: 402176 - RNA, 22 nt, Human
ucauuuauaaggaugcaauuaa

SEQ ID NO: 402177 - RNA, 22 nt, Human
aucugcuugaaugagcaacagg

SEQ ID NO: 402178 - RNA, 22 nt, Human
auuccaaagcacaucagaacua

SEQ ID NO: 402179 - RNA, 22 nt, Human
gucuucuguaagaugagguccc

SEQ ID NO: 402180 - RNA, 22 nt, Human
caucagaauguuagagaaggga

SEQ ID NO: 402181 - RNA, 22 nt, Human
guagaaauauuuaucucugaga

SEQ ID NO: 402182 - RNA, 22 nt, Human
uacacacaugcauuugccuuau

SEQ ID NO: 402183 - RNA, 22 nt, Human
guucuucagaggggaaagaacc

SEQ ID NO: 402184 - RNA, 22 nt, Human
uagucaccugugagcugcguag

SEQ ID NO: 402185 - RNA, 22 nt, Human
uuucagaaccgcuaaaauaaau

SEQ ID NO: 402186 - RNA, 22 nt, Human
ccacagcugaccgcaggugagc

SEQ ID NO: 402187 - RNA, 22 nt, Human
auaucagaaauaguaagcagag

SEQ ID NO: 402188 - RNA, 22 nt, Human
uccaugaguuugaggaaaagag

SEQ ID NO: 402189 - RNA, 22 nt, Human
guuccaaaguuagaguguauug

SEQ ID NO: 402190 - RNA, 22 nt, Human
auuccaaacagugcugcagacu

SEQ ID NO: 402191 - RNA, 22 nt, Human
aguaaaauuucugcugaggaga

SEQ ID NO: 402192 - RNA, 22 nt, Human
ggucagagggugggcugccugu

SEQ ID NO: 402193 - RNA, 20 nt, Human
uuugucuguuaaguguuucu

SEQ ID NO: 402194 - RNA, 22 nt, Human
uuuaaauuuagaagaaacacug

SEQ ID NO: 402195 - RNA, 22 nt, Human
uucagaaacagagugagugagu

SEQ ID NO: 402196 - RNA, 20 nt, Human
agcuucuucugucuaauuuu

SEQ ID NO: 402197 - RNA, 22 nt, Human
cauguauaguuggaacuacauc

SEQ ID NO: 402198 - RNA, 22 nt, Human
auuccaaacgccucgcggacuu

SEQ ID NO: 402199 - RNA, 22 nt, Human
agucuccuuggccucaaugccu

SEQ ID NO: 402200 - RNA, 22 nt, Human
uucagaaaaagaccauugcaau

SEQ ID NO: 402201 - RNA, 22 nt, Human
aacuuuguguguuuaauauggc

SEQ ID NO: 402202 - RNA, 22 nt, Human
uucuucaaugugcccuguuuuc

SEQ ID NO: 402203 - RNA, 22 nt, Human
aaauggauggaaagcaauuuuu

SEQ ID NO: 402204 - RNA, 17 nt, Human
cauuuguugaucaguug

SEQ ID NO: 402205 - RNA, 22 nt, Human
uguauacaauucacacuuccca

SEQ ID NO: 402206 - RNA, 22 nt, Human
cagagacauucaguaaauuauc

SEQ ID NO: 402207 - RNA, 22 nt, Human
ccaaaauuauuacauuuguagg

SEQ ID NO: 402208 - RNA, 22 nt, Human
uacagaaguaaauaccaaaagc

SEQ ID NO: 402209 - RNA, 22 nt, Human
ugauuuaugcauuauacuguug

SEQ ID NO: 402210 - RNA, 22 nt, Human
aaggagaaaugguagaugugca

SEQ ID NO: 402211 - RNA, 22 nt, Human
cauuuacagugagaguuuuuac

SEQ ID NO: 402212 - RNA, 22 nt, Human
aaaucaguucucccuuucuuca

SEQ ID NO: 402213 - RNA, 22 nt, Human
aggauuuauuacaagccauggu

SEQ ID NO: 402214 - RNA, 22 nt, Human
agauuuacuggagucuuuggug

SEQ ID NO: 402215 - RNA, 22 nt, Human
gggauuuaguaggauaguauac

SEQ ID NO: 402216 - RNA, 22 nt, Human
uaaugcuuaauuuucacaagcc

SEQ ID NO: 402217 - RNA, 23 nt, Human
uugcacauuggagcuggucuucu

SEQ ID NO: 402218 - RNA, 22 nt, Human
ucuauacacacaaagaaugcuu

SEQ ID NO: 402219 - RNA, 22 nt, Human
uuccaugacaccgagggaaguc

SEQ ID NO: 402220 - RNA, 22 nt, Human
ugcuucuggaaacaguggcugu

SEQ ID NO: 402221 - RNA, 21 nt, Human
aaauggauagggcaauggaag

SEQ ID NO: 402222 - RNA, 22 nt, Human
uuuuccagagcugucucuugca

SEQ ID NO: 402223 - RNA, 22 nt, Human
uugcaucuagggcaacccagag

SEQ ID NO: 402224 - RNA, 22 nt, Human
cacaauuuggugcuaaagaaag

SEQ ID NO: 402225 - RNA, 22 nt, Human
augaaacaugcuuuguggauga

SEQ ID NO: 402226 - RNA, 22 nt, Human
agggacuuguguccuauguaug

SEQ ID NO: 402227 - RNA, 22 nt, Human
uuauuucauguaaaauuuaugu

SEQ ID NO: 402228 - RNA, 22 nt, Human
gaguccuuuguuccuugccaca

SEQ ID NO: 402229 - RNA, 22 nt, Human
ugaaacaaauuuggaaaaucua

SEQ ID NO: 402230 - RNA, 21 nt, Human
caauuucaugggaagauggga

SEQ ID NO: 402231 - RNA, 22 nt, Human
uuauuauugugguugcauuauc

SEQ ID NO: 402232 - RNA, 22 nt, Human
cuguggaaggccuguccugaaa

SEQ ID NO: 402233 - RNA, 22 nt, Human
aaucauaauucaaauaagcuua

SEQ ID NO: 402234 - RNA, 22 nt, Human
cacucaggguacaauggagggc

SEQ ID NO: 402235 - RNA, 22 nt, Human
auuauccagcaccaaugucaga

SEQ ID NO: 402236 - RNA, 22 nt, Human
aaaguguacuaugucaugaaca

SEQ ID NO: 402237 - RNA, 22 nt, Human
ggauucuaacugaacagaauau

SEQ ID NO: 402238 - RNA, 22 nt, Human
uucacagauuucccugcacaug

SEQ ID NO: 402239 - RNA, 23 nt, Human
aucauucuccaaucuggagcagg

SEQ ID NO: 402240 - RNA, 22 nt, Human
cauucauuagaauagauaugua

SEQ ID NO: 402241 - RNA, 23 nt, Human
uuaaaggcagauguugaguauua

SEQ ID NO: 402242 - RNA, 22 nt, Human
aaggccagcuuguagggcuggu

SEQ ID NO: 402243 - RNA, 22 nt, Human
uuugaacaugcugcaugauaau

SEQ ID NO: 402244 - RNA, 22 nt, Human
uaguaucuauuaguaacaagag

SEQ ID NO: 402245 - RNA, 22 nt, Human
ucagggugaaccaggcaggaau

SEQ ID NO: 402246 - RNA, 22 nt, Human
gauaaugaugacaaugacaacc

SEQ ID NO: 402247 - RNA, 22 nt, Human
uugcaucuaccauaucaaagau

SEQ ID NO: 402248 - RNA, 22 nt, Human
uucaggauggaguaccuuuuau

SEQ ID NO: 402249 - RNA, 22 nt, Human
uuuccaaaguugccauaagcuu

SEQ ID NO: 402250 - RNA, 22 nt, Human
uaggauuuaggcuuuaacaucu

SEQ ID NO: 402251 - RNA, 23 nt, Human
uuugaaaguaucaacucgccuga

SEQ ID NO: 402252 - RNA, 22 nt, Human
uauaauuaguaaauggcagauu

SEQ ID NO: 402253 - RNA, 22 nt, Human
agcucacaguguccuuccucaa

SEQ ID NO: 402254 - RNA, 22 nt, Human
ccuccucugggaagauucagag

SEQ ID NO: 402255 - RNA, 22 nt, Human
cacugagcugauagaauuccag

SEQ ID NO: 402256 - RNA, 22 nt, Human
cacaaaugguuguagacauuaa

SEQ ID NO: 402257 - RNA, 23 nt, Human
aggauuuaaaggcaaugcauuuu

SEQ ID NO: 402258 - RNA, 22 nt, Human
uuguuauaaagacuaaauaugu

SEQ ID NO: 402259 - RNA, 22 nt, Human
cuugaaagcacuccuuugacug

SEQ ID NO: 402260 - RNA, 22 nt, Human
cacaauacuauuuuuaggucuu

SEQ ID NO: 402261 - RNA, 22 nt, Human
cuguauuuguccucuauuuauu

SEQ ID NO: 402262 - RNA, 22 nt, Human
gcaaaauuuacacuccuucuuc

SEQ ID NO: 402263 - RNA, 22 nt, Human
caacuuucuguuaaauguuagu

SEQ ID NO: 402264 - RNA, 22 nt, Human
ugcauaaagugccauaguauua

SEQ ID NO: 402265 - RNA, 22 nt, Human
uauuucagcccuacuacuuggc

SEQ ID NO: 402266 - RNA, 22 nt, Human
uacuuugaagacaauaucugga

SEQ ID NO: 402267 - RNA, 22 nt, Human
uauccaaacauauagucucucu

SEQ ID NO: 402268 - RNA, 22 nt, Human
ucacagacacagggagaagcau

SEQ ID NO: 402269 - RNA, 22 nt, Human
guuauaaaggugauaaugguca

SEQ ID NO: 402270 - RNA, 22 nt, Human
cauuucaauacaguuuguaaau

SEQ ID NO: 402271 - RNA, 22 nt, Human
caaaugauagagccgauuauca

SEQ ID NO: 402272 - RNA, 22 nt, Human
aauugagugcagccagcccagu

SEQ ID NO: 402273 - RNA, 22 nt, Human
uccauacauugaaauaccauuc

SEQ ID NO: 402274 - RNA, 22 nt, Human
uucauugugauucuuggcuagc

SEQ ID NO: 402275 - RNA, 22 nt, Human
agagaugaacauaaaacaagga

SEQ ID NO: 402276 - RNA, 22 nt, Human
agaucuauuagcaaacugccau

SEQ ID NO: 402277 - RNA, 22 nt, Human
uucaaguuuugccuccccaucc

SEQ ID NO: 402278 - RNA, 22 nt, Human
uuuguuuagaaagagauuggug

SEQ ID NO: 402279 - RNA, 22 nt, Human
aucagaaauagucauguuacuu

SEQ ID NO: 402280 - RNA, 22 nt, Human
uguacaauggcuauaauacccu

SEQ ID NO: 402281 - RNA, 22 nt, Human
gaucugaaucaauagaauaacu

SEQ ID NO: 402282 - RNA, 22 nt, Human
uucagaaagguuaaucuggauu

SEQ ID NO: 402283 - RNA, 21 nt, Human
auacacauacacauaaaugug

SEQ ID NO: 402284 - RNA, 22 nt, Human
aauauccacacugugucccugc

SEQ ID NO: 402285 - RNA, 20 nt, Human
uauuuguauuugggaaaguu

SEQ ID NO: 402286 - RNA, 22 nt, Human
auuuaucucuggaaacuaagca

SEQ ID NO: 402287 - RNA, 22 nt, Human
uucuucaguuugguaaauguaa

SEQ ID NO: 402288 - RNA, 22 nt, Human
aaauauagcaauuaugccuacu

SEQ ID NO: 402289 - RNA, 22 nt, Human
gggagucugggcuagacuccuu

SEQ ID NO: 402290 - RNA, 22 nt, Human
uguacaauguguuuguuggcuu

SEQ ID NO: 402291 - RNA, 18 nt, Human
ccucagggagagagacgc

SEQ ID NO: 402292 - RNA, 22 nt, Human
ugcuuaauguacgugaguguac

SEQ ID NO: 402293 - RNA, 22 nt, Human
acaugaaaaauguuugcaguuu

SEQ ID NO: 402294 - RNA, 22 nt, Human
aggaucugugagugcugcagac

SEQ ID NO: 402295 - RNA, 22 nt, Human
cagaaaaggaagagcuauguaa

SEQ ID NO: 402296 - RNA, 22 nt, Human
uacacauguauuuauguguaca

SEQ ID NO: 402297 - RNA, 22 nt, Human
augcuuuaaaugucuuuugcuu

SEQ ID NO: 402298 - RNA, 22 nt, Human
cagucaccuugaggacucagac

SEQ ID NO: 402299 - RNA, 22 nt, Human
ucucacuuuccagacuuuucaa

SEQ ID NO: 402300 - RNA, 20 nt, Human
caccagucaugagucaauac

SEQ ID NO: 402301 - RNA, 22 nt, Human
ugcauggaggaagaugaaugca

SEQ ID NO: 402302 - RNA, 22 nt, Human
caggauggccccggggcugugc

SEQ ID NO: 402303 - RNA, 22 nt, Human
uuacagaagagaaagaauucag

SEQ ID NO: 402304 - RNA, 22 nt, Human
uauggcuuuaaacaacuuaggu

SEQ ID NO: 402305 - RNA, 22 nt, Human
agccauucauugugcucucaga

SEQ ID NO: 402306 - RNA, 22 nt, Human
cugcagagcaaguaacauccuc

SEQ ID NO: 402307 - RNA, 22 nt, Human
aaaucaguaaauguucauuaac

SEQ ID NO: 402308 - RNA, 22 nt, Human
gaguucuaaaggcagaacauaa

SEQ ID NO: 402309 - RNA, 22 nt, Human
aauaugcauuaacuguguacau

SEQ ID NO: 402310 - RNA, 22 nt, Human
cauuuguaucugggcugcugug

SEQ ID NO: 402311 - RNA, 22 nt, Human
acaacuuuaauggguuucagcu

SEQ ID NO: 402312 - RNA, 22 nt, Human
uccauuuucaucucauguauaa

SEQ ID NO: 402313 - RNA, 22 nt, Human
ucacugucugaaagaaauggcc

SEQ ID NO: 402314 - RNA, 22 nt, Human
gacauaauccuccucaccuacu

SEQ ID NO: 402315 - RNA, 22 nt, Human
uugugguuaaccgcacauuuuu

SEQ ID NO: 402316 - RNA, 22 nt, Human
aguaaaauuguauuggaaaaca

SEQ ID NO: 402317 - RNA, 22 nt, Human
guucuucagauuccauuucagu

SEQ ID NO: 402318 - RNA, 22 nt, Human
cagaaggcuuuguggaguagac

SEQ ID NO: 402319 - RNA, 20 nt, Human
caucagaaauccugacccac

SEQ ID NO: 402320 - RNA, 22 nt, Human
ucaccagucuuucuuaccauug

SEQ ID NO: 402321 - RNA, 19 nt, Human
guugaaaguaggugagggu

SEQ ID NO: 402322 - RNA, 22 nt, Human
ucauuguuauguuuugcugucu

SEQ ID NO: 402323 - RNA, 22 nt, Human
ugcagagagauauggcaagagg

SEQ ID NO: 402324 - RNA, 22 nt, Human
uaauuauaacaguuacaucuua

SEQ ID NO: 402325 - RNA, 22 nt, Human
acagguuuuuguggauauaugu

SEQ ID NO: 402326 - RNA, 22 nt, Human
cuacagacccaccuuggaagaa

SEQ ID NO: 402327 - RNA, 22 nt, Human
cacaaauggccguguucaaaga

SEQ ID NO: 402328 - RNA, 22 nt, Human
uuuaaaaucagaugggaguugg

SEQ ID NO: 402329 - RNA, 22 nt, Human
uuuagaaugugacuguauuuga

SEQ ID NO: 402330 - RNA, 22 nt, Human
cuggcugggagcgagcugcuca

SEQ ID NO: 402331 - RNA, 22 nt, Human
cacucuccagcacaccccauuu

SEQ ID NO: 402332 - RNA, 22 nt, Human
gauagaaagguguugaaaucca

SEQ ID NO: 402333 - RNA, 22 nt, Human
uagcagaagaacaacaugaucu

SEQ ID NO: 402334 - RNA, 22 nt, Human
uaguccuuacuuacuagaauaa

SEQ ID NO: 402335 - RNA, 22 nt, Human
cugcaucaguggauaugauggu

SEQ ID NO: 402336 - RNA, 22 nt, Human
uuugaagaccuuaucucuaaau

SEQ ID NO: 402337 - RNA, 20 nt, Human
uucaggauucuagaccacac

SEQ ID NO: 402338 - RNA, 22 nt, Human
uuaauuuuaaccuguuuguguc

SEQ ID NO: 402339 - RNA, 22 nt, Human
ucagccucucugaguccagacc

SEQ ID NO: 402340 - RNA, 22 nt, Human
gucaggaucaaauugaaguuau

SEQ ID NO: 402341 - RNA, 21 nt, Human
acagcauguuuguguguuugc

SEQ ID NO: 402342 - RNA, 22 nt, Human
ucaguuucacagucugugcaga

SEQ ID NO: 402343 - RNA, 22 nt, Human
aucugccugagucuagguuuuc

SEQ ID NO: 402344 - RNA, 22 nt, Human
gauuuccaggucauuaauaaag

SEQ ID NO: 402345 - RNA, 22 nt, Human
uugauacauuuuuaggauaaac

SEQ ID NO: 402346 - RNA, 22 nt, Human
aggcacagcacaccuggccccc

SEQ ID NO: 402347 - RNA, 22 nt, Human
agaauuccucuaggaucugccc

SEQ ID NO: 402348 - RNA, 22 nt, Human
uaaagccacgcuggaaaucagg

SEQ ID NO: 402349 - RNA, 22 nt, Human
ugaaauagacacagugcuauac

SEQ ID NO: 402350 - RNA, 22 nt, Human
gcagaauuuucuguuuucuaga

SEQ ID NO: 402351 - RNA, 21 nt, Human
auuuccaaauaaggucacauu

SEQ ID NO: 402352 - RNA, 22 nt, Human
acauguaaaaggaacaugcaug

SEQ ID NO: 402353 - RNA, 22 nt, Human
gcuuuuauugucuuuacgacga

SEQ ID NO: 402354 - RNA, 22 nt, Human
gaguccuugacacauaguaggu

SEQ ID NO: 402355 - RNA, 22 nt, Human
auagaaauguauuuuggacuag

SEQ ID NO: 402356 - RNA, 22 nt, Human
agaaccucaauuauuuuugcac

SEQ ID NO: 402357 - RNA, 19 nt, Human
uuccuuagaggaggcggug

SEQ ID NO: 402358 - RNA, 22 nt, Human
caguucuuuguggggaguucuc

SEQ ID NO: 402359 - RNA, 20 nt, Human
cuucuucauuaacccuacug

SEQ ID NO: 402360 - RNA, 22 nt, Human
ucauaaaaguacucauguucau

SEQ ID NO: 402361 - RNA, 22 nt, Human
ugugaaagagucuuauaguuuc

SEQ ID NO: 402362 - RNA, 22 nt, Human
acagucuacuugagcuuguaua

SEQ ID NO: 402363 - RNA, 22 nt, Human
aaacaaacauagguuugaaagu

SEQ ID NO: 402364 - RNA, 22 nt, Human
cuugaaagcuuugcgucuucua

SEQ ID NO: 402365 - RNA, 22 nt, Human
aucacauugccagugauuaccc

SEQ ID NO: 402366 - RNA, 22 nt, Human
agaucugaccuaaccccaccac

SEQ ID NO: 402367 - RNA, 22 nt, Human
cuccaugaauuugagcuuugug

SEQ ID NO: 402368 - RNA, 22 nt, Human
uucuacaugguugcucagaggg

SEQ ID NO: 402369 - RNA, 22 nt, Human
gaauauauuggugaaaauaguu

SEQ ID NO: 402370 - RNA, 22 nt, Human
caguaucugucaguaaucaggu

SEQ ID NO: 402371 - RNA, 22 nt, Human
ugaaagguuauuuaggucugcu

SEQ ID NO: 402372 - RNA, 22 nt, Human
guacagaaaguacccauagaag

SEQ ID NO: 402373 - RNA, 22 nt, Human
uuuauccaguguuggaauuuuu

SEQ ID NO: 402374 - RNA, 22 nt, Human
gauggcagucaaccaggugagg

SEQ ID NO: 402375 - RNA, 22 nt, Human
uuuccaaagcugaguugagcaa

SEQ ID NO: 402376 - RNA, 22 nt, Human
aagaaaucauaucauuucuugg

SEQ ID NO: 402377 - RNA, 22 nt, Human
caaaugauacuguuuuuagucu

SEQ ID NO: 402378 - RNA, 22 nt, Human
cagucaccaccagguggcagua

SEQ ID NO: 402379 - RNA, 22 nt, Human
gauuuacagcuauacccaaugg

SEQ ID NO: 402380 - RNA, 22 nt, Human
aaucagaaaggcuaaggaagca

SEQ ID NO: 402381 - RNA, 22 nt, Human
ggcauuuagagggcuuuucuga

SEQ ID NO: 402382 - RNA, 22 nt, Human
uuuccagguauuaauacuguau

SEQ ID NO: 402383 - RNA, 22 nt, Human
aaauuauuacaagcuaguuggc

SEQ ID NO: 402384 - RNA, 22 nt, Human
aguggcagagugcacucaggca

SEQ ID NO: 402385 - RNA, 22 nt, Human
gucaggauuaaugggaguaugc

SEQ ID NO: 402386 - RNA, 22 nt, Human
uucuucaaauagcagggaguca

SEQ ID NO: 402387 - RNA, 22 nt, Human
ggagcacuauaauagagauuuu

SEQ ID NO: 402388 - RNA, 22 nt, Human
uuucacaucagagguagauuag

SEQ ID NO: 402389 - RNA, 22 nt, Human
gauuucaaggauguuagaggug

SEQ ID NO: 402390 - RNA, 22 nt, Human
uaacaucuuuagcagcucgaac

SEQ ID NO: 402391 - RNA, 22 nt, Human
uuuucauuguuccucgagcauu

SEQ ID NO: 402392 - RNA, 22 nt, Human
cuuccaaaauuuauauguugaa

SEQ ID NO: 402393 - RNA, 22 nt, Human
cuuuacagaauaagaauacugg

SEQ ID NO: 402394 - RNA, 22 nt, Human
agaauaauacugaaaugcugaa

SEQ ID NO: 402395 - RNA, 22 nt, Human
uuaauucagucaaagaaaccau

SEQ ID NO: 402396 - RNA, 22 nt, Human
cucacugucuguacuagcugau

SEQ ID NO: 402397 - RNA, 22 nt, Human
aguucucagcuuaguaugcugu

SEQ ID NO: 402398 - RNA, 19 nt, Human
uccauaaugaagauagagg

SEQ ID NO: 402399 - RNA, 22 nt, Human
uguauacauuuaacuagauaga

SEQ ID NO: 402400 - RNA, 22 nt, Human
ucuuuuggaaaugaugugcagg

SEQ ID NO: 402401 - RNA, 22 nt, Human
auuacaagaugcauccauauuu

SEQ ID NO: 402402 - RNA, 22 nt, Human
aaaguccuagcgauccacagaa

SEQ ID NO: 402403 - RNA, 22 nt, Human
augaggcauuccacucaaacuc

SEQ ID NO: 402404 - RNA, 22 nt, Human
ggcauuuaguuuucauauucug

SEQ ID NO: 402405 - RNA, 22 nt, Human
uucuucuuuaucucaguauccu

SEQ ID NO: 402406 - RNA, 22 nt, Human
gaaaggugccccauaggcagga

SEQ ID NO: 402407 - RNA, 20 nt, Human
aucaggauucuugcuuuguu

SEQ ID NO: 402408 - RNA, 22 nt, Human
cauuuacacuucuaaccacaag

SEQ ID NO: 402409 - RNA, 23 nt, Human
auucuucauuaucuucuagaaaa

SEQ ID NO: 402410 - RNA, 22 nt, Human
ucagagagugcaaaauauagcu

SEQ ID NO: 402411 - RNA, 22 nt, Human
auugaaagguuuugagcagaua

SEQ ID NO: 402412 - RNA, 22 nt, Human
uuuuuaguagagguggguuuca

SEQ ID NO: 402413 - RNA, 22 nt, Human
auccaaagauggaaagaacuuu

SEQ ID NO: 402414 - RNA, 22 nt, Human
acauucacuauguccaaacucu

SEQ ID NO: 402415 - RNA, 22 nt, Human
uuaacauuguccuuagcagauu

SEQ ID NO: 402416 - RNA, 22 nt, Human
aagugauuuguacaaaaugucg

SEQ ID NO: 402417 - RNA, 22 nt, Human
uuauuuacaacucuucucuucc

SEQ ID NO: 402418 - RNA, 22 nt, Human
uugaauaaaugagcagugaauu

SEQ ID NO: 402419 - RNA, 23 nt, Human
caauuucauaugauucuaccuaa

SEQ ID NO: 402420 - RNA, 22 nt, Human
cucccagagagcaggugggccg

SEQ ID NO: 402421 - RNA, 22 nt, Human
aaagacauuagcuuagauguca

SEQ ID NO: 402422 - RNA, 22 nt, Human
acaaagucaaauugcagccgcc

SEQ ID NO: 402423 - RNA, 22 nt, Human
ugcauguguuugccacagugag

SEQ ID NO: 402424 - RNA, 21 nt, Human
auugaaagucaacaaucaguu

SEQ ID NO: 402425 - RNA, 22 nt, Human
aauuuccaaauuucugucacac

SEQ ID NO: 402426 - RNA, 22 nt, Human
cuuaauuacuguccaauaugca

SEQ ID NO: 402427 - RNA, 22 nt, Human
aacagugaguugaugacugaau

SEQ ID NO: 402428 - RNA, 20 nt, Human
cauuuguuagcuuucuacug

SEQ ID NO: 402429 - RNA, 22 nt, Human
acuuggcaaguaucuauaaagu

SEQ ID NO: 402430 - RNA, 22 nt, Human
uuucacaacugcuuauuugaga

SEQ ID NO: 402431 - RNA, 22 nt, Human
gcaaaauuaaacuuagcaucau

SEQ ID NO: 402432 - RNA, 22 nt, Human
uaaguaaauuuauaaugugauu

SEQ ID NO: 402433 - RNA, 22 nt, Human
acaugauuuuaguaucauaaua

SEQ ID NO: 402434 - RNA, 22 nt, Human
cuacagaaggagaaauggguaa

SEQ ID NO: 402435 - RNA, 22 nt, Human
guacauuucucuuguucuuauu

SEQ ID NO: 402436 - RNA, 22 nt, Human
cgccucagccguggucaucuuc

SEQ ID NO: 402437 - RNA, 22 nt, Human
uauccaaaguuucucagaaacu

SEQ ID NO: 402438 - RNA, 22 nt, Human
uacugcauaacuggcauguggg

SEQ ID NO: 402439 - RNA, 22 nt, Human
uacaaaguagaaauucaguaaa

SEQ ID NO: 402440 - RNA, 21 nt, Human
uucuucaaagaagaaggcaca

SEQ ID NO: 402441 - RNA, 21 nt, Human
ugaaacaaucagacagagucu

SEQ ID NO: 402442 - RNA, 22 nt, Human
auuacacuuguucaucaucacc

SEQ ID NO: 402443 - RNA, 22 nt, Human
auagaauucuuugaaauuuaug

SEQ ID NO: 402444 - RNA, 22 nt, Human
auucucaaaacauaacuucacu

SEQ ID NO: 402445 - RNA, 22 nt, Human
aaauacugggcucaaaaggguu

SEQ ID NO: 402446 - RNA, 22 nt, Human
agaauuucuggaagauugcaag

SEQ ID NO: 402447 - RNA, 22 nt, Human
aaaggugacacucugccagcug

SEQ ID NO: 402448 - RNA, 22 nt, Human
guuaaagaagaauaguuccuuu

SEQ ID NO: 402449 - RNA, 22 nt, Human
agauaaaaugguucaaaggcua

SEQ ID NO: 402450 - RNA, 22 nt, Human
aggaaaaaagucugugauuaua

SEQ ID NO: 402451 - RNA, 22 nt, Human
ggagugucagaaacaguguccu

SEQ ID NO: 402452 - RNA, 22 nt, Human
augaaggcaguuaaacgucauc

SEQ ID NO: 402453 - RNA, 22 nt, Human
ugaaggaaugaguauacuguuu

SEQ ID NO: 402454 - RNA, 22 nt, Human
uaucaaaguuguccugugaagu

SEQ ID NO: 402455 - RNA, 22 nt, Human
caggguggggaaauagcgcccu

SEQ ID NO: 402456 - RNA, 22 nt, Human
ucaccgucgggggucgcugucu

SEQ ID NO: 402457 - RNA, 22 nt, Human
ccuggaucccgauggcugugag

SEQ ID NO: 402458 - RNA, 22 nt, Human
auaguuugugaaacacagcagu

SEQ ID NO: 402459 - RNA, 18 nt, Human
ugaauagggguuugcaga

SEQ ID NO: 402460 - RNA, 22 nt, Human
uucuccaacacaagcaugaugu

SEQ ID NO: 402461 - RNA, 22 nt, Human
uggcauuucuggccauuugugu
